United States Patent 9,976,191 (RICE WHOLE GENOME BREEDING CHIP AND APPLICATION THEREOF) - sequence listing, part 2

SEQ ID NO: 16365 - DNA, 101 bp, rice(Oryza sativa)
  misc_feature (71): n=t or g
atttgctggcttcacttgggttcaggtagctcgcaaatcacatctaagctcacgcaataaactaaaaaaanaaaaagagaagagaagaaaagaaaagttgg

SEQ ID NO: 16366 - DNA, 101 bp, rice(Oryza sativa)
  misc_feature (71): n=t or c
aactgactaaaatacccccaagtaccaaatcaatcaacccaaatttatcaccccgtggtccactcatcccnggccttcttgtcggtgaggcggcgggtggc

SEQ ID NO: 16367 - DNA, 101 bp, rice(Oryza sativa)
  misc_feature (71): n=t or c
cgaggaaacttacattataagatcagatcatatgttttgcatgttatagttccctggtgacaactaagcgntttttttaaaaaatacgaaccgcacaaaaa

SEQ ID NO: 16368 - DNA, 101 bp, rice(Oryza sativa)
  misc_feature (71): n=t or c
ggagtacagcccaattaaatcagccatttatgatgggggtctgtttggtgaggtgggtagtggtactatantctcctaggagcaagtttaatattacctcc

SEQ ID NO: 16369 - DNA, 101 bp, rice(Oryza sativa)
  misc_feature (71): n=t or c
tgatggccaaatcaatacggtacgtattagagttagcttcactgcttattaggaaacgctaatcaagcacngaactaaatcaggttattttaatactctcc

SEQ ID NO: 16370 - DNA, 101 bp, rice(Oryza sativa)
  misc_feature (71): n=a or g
aatgtgaggcccgggcccacatatccatcacacatgcaatgcactactacatattagaatttttcattcgnccgaaatcaatttttgcatgcagaaggatg

SEQ ID NO: 16371 - DNA, 101 bp, rice(Oryza sativa)
  misc_feature (71): n=t or c
gtggaaataatcaaactttagatgtgatgatccacgagttagatcctaatggcaccgaaagggaaagaagngggccggactgcgagtgccgaagccgacca

SEQ ID NO: 16372 - DNA, 101 bp, rice(Oryza sativa)
  misc_feature (71): n=t or g
tgaatcaagcgatcgagagacaaaattaaagcaggtgaatgaaatgaaatgtaagtagggcacatgcagangcagggaacggagtgaccgatcgaatgcta

SEQ ID NO: 16373 - DNA, 101 bp, rice(Oryza sativa)
  misc_feature (71): n=t or g
aattaagaaaaacaattgggaccaagacgcgggtttgatgcaaacgtatatgtacagtacgtacgccttgnattctgtgctgtaaattacgagttattctc

SEQ ID NO: 16374 - DNA, 101 bp, rice(Oryza sativa)
  misc_feature (71): n=a or g
caggcaacttgaggcattttatgtaccgccaatccttcatttcttatcacagtagtaatcttgtagagatntagttgttattgttacggtgctataaagat

SEQ ID NO: 16375 - DNA, 101 bp, rice(Oryza sativa)
  misc_feature (71): n=a or g
agggtgatccaccttcaacagcttcatgatctgagtcaatctaataggataccaatcaaaatgcttttatnattgctagtcgaggaacctcttcattgttt

SEQ ID NO: 16376 - DNA, 101 bp, rice(Oryza sativa)
  misc_feature (71): n=t or g
tgtctttcttttttgtacttgcgtcagttggataggaggccaaggcatgcttatttggaagcttatttaanaaaaatatagatgatgacccaaactatcac

SEQ ID NO: 16377 - DNA, 101 bp, rice(Oryza sativa)
  misc_feature (71): n=a or c
atatgctgatatgcatggaaagtaacgtgcagatgtcaaactggctgcttagttccaaatcgtgacaaatntagtaatcacaaggaaaggatatgtacata

SEQ ID NO: 16378 - DNA, 101 bp, rice(Oryza sativa)
  misc_feature (71): n=a or g
gtagatatattgcaatgagttatgcactacggggttgtttggatggtgaccatactttgccacaactttgncaagctactttgaccaacttagcctagtgt

SEQ ID NO: 16379 - DNA, 101 bp, rice(Oryza sativa)
  misc_feature (71): n=a or c
gttagctcacacagaaggtcagagcttactgttcttgcgcagttgccagaagaagatcacaataggggatnttgtcattagacacagcaggagtaaagaga

SEQ ID NO: 16380 - DNA, 101 bp, rice(Oryza sativa)
  misc_feature (71): n=t or c
tgccttataacgagtagatgacgatatcgatctgcaatatgatacggattggggagggtatggaggccganagcagggataacatttcccctcctgccaaa

SEQ ID NO: 16381 - DNA, 101 bp, rice(Oryza sativa)
  misc_feature (71): n=t or c
aaaattccaagaaataattaaggacaagaaattacaggtcaagtaggcagtacataccgtaaggagcaacngaaattcagagcagtatcgttttaggcaag

SEQ ID NO: 16382 - DNA, 101 bp, rice(Oryza sativa)
  misc_feature (71): n=t or c
ctcgattctcatttcccctcctcttatacacatcgaagaacgctcacctagctaacagcaagtacaatagnaggctataagccagctataaacatatttta

SEQ ID NO: 16383 - DNA, 101 bp, rice(Oryza sativa)
  misc_feature (71): n=t or g
ttggtgactttgggctggtgaggcaagtccccattgacaaaacttcttgcccaatgaccatatttgggtcntcaagatatatagaccctcaatattgtagc

SEQ ID NO: 16384 - DNA, 101 bp, rice(Oryza sativa)
  misc_feature (71): n=a or g
gggctaggaaggtcaattgagatggatagggaaggcggattgaggataagcaccggagatggtggttacgnacatgaaggtgtgaaagatacaatgcacgg

SEQ ID NO: 16385 - DNA, 101 bp, rice(Oryza sativa)
  misc_feature (71): n=t or g
ccattagatgttttttgaggaaacacttcacagttaaagcaacagcgctaaaacgtgtgcacttatttttnacaacatcggtagatgcatatggattagct

SEQ ID NO: 16386 - DNA, 101 bp, rice(Oryza sativa)
  misc_feature (71): n=t or c
tgctgggaattatatggaagtaacttccccatctggccacatggccatgcggcctgttttttcccaccccntcgtggggaggtcaggtagcaatgaggtgg

SEQ ID NO: 16387 - DNA, 101 bp, rice(Oryza sativa)
  misc_feature (71): n=t or c
tgcgtgtgatgcgtgtggcgcctccatctgaattggcttcagtgttcccctttgcaataaaagctttccanaaaatgtggatcacattaacattttctgct

SEQ ID NO: 16388 - DNA, 101 bp, rice(Oryza sativa)
  misc_feature (71): n=t or c
aatggacaatgccatctagaagagcctggagtagaggaaaaaaatcccagaaccaaaaaaaaagaaggggntgtctatataggaatcgaatgatttctgaa

SEQ ID NO: 16389 - DNA, 101 bp, rice(Oryza sativa)
  misc_feature (71): n=t or c
tcactgacatactggtcccacgtcggtttttattcgttatttttctttgccatgtcagcgccacatcattnaaaaccgttattaatacttctttgggacct

SEQ ID NO: 16390 - DNA, 101 bp, rice(Oryza sativa)
  misc_feature (71): n=a or g
acattattagatgtacaattgtacattgttagtatctttctcgtcaccggttaagtgcctgttgaaatgcntaccttagtaatctagtggtactgtatcaa

SEQ ID NO: 16391 - DNA, 101 bp, rice(Oryza sativa)
  misc_feature (71): n=t or c
cggtctgttttcgctctgttttcgttttcgacaatatttgattctgttttttatccggggtttccaattcngaaaaaatatgaaaacaaaaacgataaagg

SEQ ID NO: 16392 - DNA, 101 bp, rice(Oryza sativa)
  misc_feature (71): n=t or c
acaatctgttgggccattctgacaatccttgagctttggcaaatatagtaccgaagtatatttttgcaacngtaacccttaacccaacatatatgtattac

SEQ ID NO: 16393 - DNA, 101 bp, rice(Oryza sativa)
  misc_feature (71): n=t or c
aatggattgctagtagtatcgtactagattttgattttccatctccaaaatgaatttctaaatttcctgtngttatcacgtagtactccgtaagtagaatc

SEQ ID NO: 16394 - DNA, 101 bp, rice(Oryza sativa)
  misc_feature (71): n=a or c
atgtaagcacagaagtgcacttatgcttgatttaattcccacatggatcaacatattcacccaatacgagnaaacaaataaaggctaacaaataccactcc

SEQ ID NO: 16395 - DNA, 101 bp, rice(Oryza sativa)
  misc_feature (71): n=a or g
aaatacatgacacatggatcaagctgtcagtgaacatgcctctcatcagaataacttttaggatatggagncatgcaaaagtcttagatgctgcaacatta

SEQ ID NO: 16396 - DNA, 101 bp, rice(Oryza sativa)
  misc_feature (71): n=t or c
tgcatacttcgacctcggatttctacgtcttccaaagatgacctgttcagtgttgttagataattaatttngtctcgtctttctataccttgattagactc

SEQ ID NO: 16397 - DNA, 101 bp, rice(Oryza sativa)
  misc_feature (71): n=a or g
gacagcatgacacgtctggtatgttcagttggtggatgacttgtctatgatattgcaatccagtaagcccntgctacataaaagtataaaaataagcaacc

SEQ ID NO: 16398 - DNA, 101 bp, rice(Oryza sativa)
  misc_feature (71): n=a or c
aaatcgtatgagattagtctgcacttgaactcagcagtttgcctgaagagggcgatttttctttgtttganttgattggcaagctatatttggatgaaatt

SEQ ID NO: 16399 - DNA, 101 bp, rice(Oryza sativa)
  misc_feature (71): n=a or g
ccaaggttcagatcattgcttttgtacatacacggatcatcaggatattgtggaatcgattaattgggatnatgtagctctttcagccccaactactttac

SEQ ID NO: 16400 - DNA, 101 bp, rice(Oryza sativa)
  misc_feature (71): n=t or c
tcgaacttgtactcggcgtccatgggcttggtgttcttgacggacatcgcccagttgcggttgtggacgancagcttcagggtgaggttgtaggcgatcga

SEQ ID NO: 16401 - DNA, 101 bp, rice(Oryza sativa)
  misc_feature (71): n=a or g
ataaaataaaaccaaagagtcacgtgctcaaaggaaaatgaagcacatatggatagaagattaaaccaagnccatgtgcaactaaaccagtattgagtatt

SEQ ID NO: 16402 - DNA, 101 bp, rice(Oryza sativa)
  misc_feature (71): n=t or c
tgaaagattcaatttctaaataaaaaaaccacggaaaaaggtcggcaaaaaaaaagtttcagcgcctcctnggctcccggcggcggaaaaaagaagcgaga

SEQ ID NO: 16403 - DNA, 101 bp, rice(Oryza sativa)
  misc_feature (71): n=a or g
ttgtccccctgttgctacttgtggtaccttagaagaatatagataatctgcttgggccttgaactaccggnctatactcaggaaatgggccggccacctac

SEQ ID NO: 16404 - DNA, 101 bp, rice(Oryza sativa)
  misc_feature (71): n=a or g
tccttgaagaaggagaccctctggctaccagattcggacgaaatgctgcaaggcctgctcaacaagaccancaatattttctcgactgcaaaagataattt

SEQ ID NO: 16405 - DNA, 101 bp, rice(Oryza sativa)
  misc_feature (71): n=t or c
ttgggttactgccgaacgtactggatgaagagaagaaattcgtggccttctggcgccactgaggcgattcngccagcggcatcgccgccttcacaggacaa

SEQ ID NO: 16406 - DNA, 101 bp, rice(Oryza sativa)
  misc_feature (71): n=a or g
cttcccctgccactccatatgccactcatatgatacggagggtttttaacaaaatgccacctaatacattncgaaggataaaatactacttaataggttat

SEQ ID NO: 16407 - DNA, 101 bp, rice(Oryza sativa)
  misc_feature (71): n=a or g
cacgcaccaaggagaggagacgaccatggttttgaggtgaaaaccacgagtggttgcatatgctggagtgntcggtggcactgtgctcgatctgccccctg

SEQ ID NO: 16408 - DNA, 101 bp, rice(Oryza sativa)
  misc_feature (71): n=a or g
gtgaggtgctattgctgcatgcccttttgtgcttgattgcctaaatttctcggtgaggtaaggtgctactnctgaatgtcttttgtgcttgattgaggaag

SEQ ID NO: 16409 - DNA, 101 bp, rice(Oryza sativa)
  misc_feature (71): n=a or g
aaatcatgaaggagaggatgtataagattttatcatctagtatcgtggttgacttcacacatctgctcccngtcgtgccgttcaatgccttcaatccacct

SEQ ID NO: 16410 - DNA, 101 bp, rice(Oryza sativa)
  misc_feature (71): n=t or c
tagcagtatgatcatatatagtgtcgtactatggtaataggaataatatataggggcaattaattgctccnatccaacaggcaccttactgtccggtacca

SEQ ID NO: 16411 - DNA, 101 bp, rice(Oryza sativa)
  misc_feature (71): n=t or c
gatcgcgaggggaccatcgccgcgatcgttcgcgtattagacacccccttgttgagctaaagatgagactnttttttttttaaaaaaaagatgaactgaag

SEQ ID NO: 16412 - DNA, 101 bp, rice(Oryza sativa)
  misc_feature (71): n=t or c
cagtgatagagtgagctagctaatttgcaccaaccatgagttaaccaatgaacggttcaaattaaaccacnattttgctctttgttgctatatgttgatta

SEQ ID NO: 16413 - DNA, 101 bp, rice(Oryza sativa)
  misc_feature (71): n=t or g
acacaacgactgtatttgtttttgttgcctgggtgagtttgagaggagaggagagtaaaaaacgaggtganctattagcatataattaattgagtataaac

SEQ ID NO: 16414 - DNA, 101 bp, rice(Oryza sativa)
  misc_feature (71): n=a or g
atcgaattcgtgtcgctgtgaaaggcaagagcataggttggtgttgaatttatttggcataatgtcgttgnttcgagttcgaatcggtgaagaatctcgag

SEQ ID NO: 16415 - DNA, 101 bp, rice(Oryza sativa)
  misc_feature (71): n=t or g
tcgtcctcacaacccatctagtcccccttcccttccctactgtctttagcacccttgtcgatggtgaggangcccttctattttattttaggaatatttta

SEQ ID NO: 16416 - DNA, 101 bp, rice(Oryza sativa)
  misc_feature (71): n=a or g
agcaagctcacgagccgagccaaactattctttcgttaaggttaagacagggagctcaaacgaacgagccnagccaaactattctttcgttatctacccgc

SEQ ID NO: 16417 - DNA, 101 bp, rice(Oryza sativa)
  misc_feature (71): n=a or g
atcgatcatggatttgtttgcaatgctcaaccttctcaagataaccgtgaaagcatgctgaagaagcttgngaagggatcaaccgtagcttgcaccaagtt

SEQ ID NO: 16418 - DNA, 101 bp, rice(Oryza sativa)
  misc_feature (71): n=a or g
gtctggaactcttggagcacattaccgataagtgaaacagccaacaaaatgctgcagaaaacaagcaaacntatgagatggacttgcactaatttcctttc

SEQ ID NO: 16419 - DNA, 101 bp, rice(Oryza sativa)
  misc_feature (71): n=t or c
gatggaggccaccgttaatggcacacggatgaggacggactaacgacgatgatgatccaattaaaatatcncgtgtggatctcggggtggggcctccgacc

SEQ ID NO: 16420 - DNA, 101 bp, rice(Oryza sativa)
  misc_feature (71): n=a or g
aaataaattagtactagtttaatggtgcactgatcgcatgctgcttagcacgcaaaacgaagtttgttttnttgtatgattaattaagtattaattatttt

SEQ ID NO: 16421 - DNA, 101 bp, rice(Oryza sativa)
  misc_feature (71): n=a or g
gattgttaacaatggaaaagaattgcacttttgtcaccattattattaggagaggacacacgagaaagagncagggatcgctcccattaccatctactact

SEQ ID NO: 16422 - DNA, 101 bp, rice(Oryza sativa)
  misc_feature (71): n=t or c
aaagaatctagctctgtagctttagctcactagcttttacagtggatagctgctgttctttgtagatcccntttgtatctcatctgttccatcccctttgc

SEQ ID NO: 16423 - DNA, 101 bp, rice(Oryza sativa)
  misc_feature (71): n=a or g
atatacagggtgggccctttgagatggaatgacggcgaacaaatcccttaacaaccgcgcgtgttggacgncgatcgatcaatcatacgcatgcatgcatt

SEQ ID NO: 16424 - DNA, 101 bp, rice(Oryza sativa)
  misc_feature (71): n=t or g
ggatcccaagttgctccctggcagcctcatcatctgcctacaaggaaaaaaaaacacaaatattagaaaanaatctaatatcaaataattaaaaggggtga

SEQ ID NO: 16425 - DNA, 101 bp, rice(Oryza sativa)
  misc_feature (71): n=t or c
tatatgatagaagttttttcctgaaataattcaaggcacaattgcagtaaaatctccgaagtcagacatgnaggatcttgaataggaagagttttttgggg

SEQ ID NO: 16426 - DNA, 101 bp, rice(Oryza sativa)
  misc_feature (71): n=a or g
attgtgtactccttatcctcggttggtaggtgtcttttttttgtgtgagaaactttttattttgtgtgctnctctgtaataattggctgtagctcgttgag

SEQ ID NO: 16427 - DNA, 101 bp, rice(Oryza sativa)
  misc_feature (71): n=a or g
cactcaagagtcaagacaatagagcactaacttggaaccaagctagcagagatgactcagttgtgcgtacnatatcgatatcggtttggcgatggtcttcc

SEQ ID NO: 16428 - DNA, 101 bp, rice(Oryza sativa)
  misc_feature (71): n=t or c
ggacgagaatcgtgatctacgtgttcccaatacctgtgcatgtctgaatcgtgaactacactgactttgcnaatactgtttgtcagtgtagttgcgtgcat

SEQ ID NO: 16429 - DNA, 101 bp, rice(Oryza sativa)
  misc_feature (71): n=t or c
cttaaccaacctggttagagtgacttgcttgcaacataagcaaaaacgatttctatgtactccctccgttncacaatataaatcattctagcattttccac

SEQ ID NO: 16430 - DNA, 101 bp, rice(Oryza sativa)
  misc_feature (71): n=t or c
ctattttttttggcacgggtgaaaaatctctagcatgcacttctcctgtcgttttcacgccctcacacacngccactgcccttctcctttgtcgcactgtc

SEQ ID NO: 16431 - DNA, 101 bp, rice(Oryza sativa)
  misc_feature (71): n=t or c
ctgatccccttgctgctgctgccatcaaatccttggacatttccagttgcaaatttagactcttcccccgngattcccagcactcccaagtcccatccttc

SEQ ID NO: 16432 - DNA, 101 bp, rice(Oryza sativa)
  misc_feature (71): n=t or c
caaacaagttcttggaccaattcggagggaaaatatcaagaacagttgaactagaatcccccaagggcaangtgtatgtcgtcaaagttagcaagcacatg

SEQ ID NO: 16433 - DNA, 101 bp, rice(Oryza sativa)
  misc_feature (71): n=t or c
ccgaggacagatcgatggtagcagccaacttgaagtcggtacgtatgtaagttcgtcgtcctgtgatcctngacgaagcaagttgaaccaaccattaaata

SEQ ID NO: 16434 - DNA, 101 bp, rice(Oryza sativa)
  misc_feature (71): n=a or g
catagtccgctaccactgccaccaactctcacatcgtccgctaccactgccaactcctatatccttcgctnccgcctccaacgcccacatcctctgtcact

SEQ ID NO: 16435 - DNA, 101 bp, rice(Oryza sativa)
  misc_feature (71): n=a or c
gtctaaatgatcgtaaatttctcttacggttacaaaatcttgatcataagtaaagggcctcattgttacanttatacttatacttataagccaaaatttga

SEQ ID NO: 16436 - DNA, 101 bp, rice(Oryza sativa)
  misc_feature (71): n=t or c
gatttttttttcaatggaaaatctgaacacaaaggagatgactcctgctgcatgtataatgttttttcgangaggaattttacaatccttgagaaagtatc

SEQ ID NO: 16437 - DNA, 101 bp, rice(Oryza sativa)
  misc_feature (71): n=a or g
aattaaatacagtaccaaaactgttgatgttcctgcccaacgcaataaatccaccaaagtaaaaacaaganagacaaggggctctgaaaccaactgtttta

SEQ ID NO: 16438 - DNA, 101 bp, rice(Oryza sativa)
  misc_feature (71): n=t or c
gacccacgcatccaaacaaaccaacccaaggcaggcaccagtatatactatggcagcgtttagttcccttnaaatttctaaaaatttcaccacatcaaatg

SEQ ID NO: 16439 - DNA, 101 bp, rice(Oryza sativa)
  misc_feature (71): n=t or c
ctaactaaaccaatgcaagaaccaacctacaaagccaatacacgctgctcagcggcgcttggaagcagcanacccagattggactgaagaacagaacaatt

SEQ ID NO: 16440 - DNA, 101 bp, rice(Oryza sativa)
  misc_feature (71): n=t or c
ctttggaactttgtgggtcctctctccatctttttgcattgctagcttcttcttcttcttccggcctcctntcacactctctgcccacacacccacggaat

SEQ ID NO: 16441 - DNA, 101 bp, rice(Oryza sativa)
  misc_feature (71): n=t or c
ctgaagcagaagctgccgttgcatcagctccagatccaactatctcatcactactaatagctgcaacagcnacagcagaggcagctgcttcagcctcagct

SEQ ID NO: 16442 - DNA, 101 bp, rice(Oryza sativa)
  misc_feature (71): n=t or c
agggttacgtatacctttgtgattggaagggaggggcatttcggggatatgagtgagttgagtggcatggnatctactctgtccggtcaagggggtttgac

SEQ ID NO: 16443 - DNA, 101 bp, rice(Oryza sativa)
  misc_feature (71): n=t or c
tctagttagatgccctagaatcaagcagctgagaagttggtggttgacatgagaagtgccttgcctccctnctcctcccttgctttgttcgttcggcgtct

SEQ ID NO: 16444 - DNA, 101 bp, rice(Oryza sativa)
  misc_feature (71): n=t or c
gaaccactcgagcacctggttcaccgggtcatcagtcctaccgccagttcgtccggtccaagtgctgaacnagaagaggtttatttatcatgcatgacgga

SEQ ID NO: 16445 - DNA, 101 bp, rice(Oryza sativa)
  misc_feature (71): n=t or c
aataagaagtctatttttatgtcagctcaattgcgagtcaagtttcaatcccacccctcaattacaaaacnggatatatgtcatctctcaacttttaaaac

SEQ ID NO: 16446 - DNA, 101 bp, rice(Oryza sativa)
  misc_feature (71): n=a or g
aaatttctcacagtaatccttgaatggttcagcatgctcaagaagaagaaaggttgagtcattaaaatacnagttcacacataaattcactgcaatgacct

SEQ ID NO: 16447 - DNA, 101 bp, rice(Oryza sativa)
  misc_feature (71): n=a or g
agttcctcctcatgagtcttccaaggcccttctagaagatgaggtctcagattttatcaaggaagaagcanaccccggtgagactctcgacctaccaatca

SEQ ID NO: 16448 - DNA, 101 bp, rice(Oryza sativa)
  misc_feature (71): n=a or g
agactttccccttgttcatgtgaggaatattgtgtttcctgtgttgctacattgacagcattggatgttgnctatgacatcgtgtagttacagctgaagca

SEQ ID NO: 16449 - DNA, 101 bp, rice(Oryza sativa)
  misc_feature (71): n=a or g
cacgtgccaacctaaaagaattcctacattttggacggaggaagtagtaaacttagggctctttgatttgnaggaaaaacataggaattttagaggatttc

SEQ ID NO: 16450 - DNA, 101 bp, rice(Oryza sativa)
  misc_feature (71): n=t or c
ggacaagcaatggatgcgacaatggttgatggttcatcgaatgggtcatcggggccaaggtagtacatctnggttgcaggcccttcgcatagatcctgtga

SEQ ID NO: 16451 - DNA, 101 bp, rice(Oryza sativa)
  misc_feature (71): n=a or g
gctatggactctcgtaacaactagacacaagataacgagttcagtagcatatggatcatatggataacatnaaacttgaaatttgtcaatacaaacaatga

SEQ ID NO: 16452 - DNA, 101 bp, rice(Oryza sativa)
  misc_feature (71): n=t or g
agggaggggtggggttggcgggaatttttttggcgtcgggggtattttcgcaggcgtgggctactatagcncttgcagcgcctgagaagattcgaactgct

SEQ ID NO: 16453 - DNA, 101 bp, rice(Oryza sativa)
  misc_feature (71): n=a or g
ggtgggtagttgcctaaccagtaggccccgttttacagtgaagatcggattgactacttcctcaattttcnttagcatgttttttaaattacttcactcat

SEQ ID NO: 16454 - DNA, 101 bp, rice(Oryza sativa)
  misc_feature (71): n=a or g
atgatattgcaagtatcgcgtggtaccttgcaagcatcaactaacacctcacagtaatcatctaatgcctnttgttattataaactggtaacacaaagtgt

SEQ ID NO: 16455 - DNA, 101 bp, rice(Oryza sativa)
  misc_feature (71): n=t or c
atttctttcagttatctatacatacagctgttagttgttactgtacccttgttaatagagcattagaacgnaattctatggtgtctcactttctatgcagt

SEQ ID NO: 16456 - DNA, 101 bp, rice(Oryza sativa)
  misc_feature (71): n=a or g
agcagaggattcaaattaagggttcattaaaacaaatgattggaaaaaaatcgatgaatagtaagaaaatnatttttactaaaatgccggtgcaaaacaga

SEQ ID NO: 16457 - DNA, 101 bp, rice(Oryza sativa)
  misc_feature (71): n=t or g
gtgctattttttagtattgtatacctctgtcatgcacttgttctactgttttacctgacctataccacttngtatttactacttgacttgacaatctggaa

SEQ ID NO: 16458 - DNA, 101 bp, rice(Oryza sativa)
  misc_feature (71): n=t or c
ccaggcctaattgtgcgcaccatttacccttgttgcccccaatgactcctaaagctgttgactgtacatgngtttcacacttagtggagttgtaggagaac

SEQ ID NO: 16459 - DNA, 101 bp, rice(Oryza sativa)
  misc_feature (71): n=a or g
gaagaccatccctaaagtctagagcgcatcccgaagattgaaattcttcgttcttcggtgctgatggcttnggagaggattccttagccgacacagatgat

SEQ ID NO: 16460 - DNA, 101 bp, rice(Oryza sativa)
  misc_feature (71): n=t or c
tctagtcaaggatggagactaagagacatgtccttgggatgctaagaagttaattggttgacccacgtcangtcacctattctagccaatttcggctgagg

SEQ ID NO: 16461 - DNA, 101 bp, rice(Oryza sativa)
  misc_feature (71): n=t or c
ctgctcgctctcgctttgcttcccctaatcttctcccgggccaggggggaagaggggcggaattcgggcangagctttggagttggagatcacttcggcga

SEQ ID NO: 16462 - DNA, 101 bp, rice(Oryza sativa)
  misc_feature (71): n=t or g
acaaagcatagcaaaaggctcggctcgcaatcatgtgacctcggtttctaagccctccttgttccaatcanctgggccattagtagtctagtacacatcaa

SEQ ID NO: 16463 - DNA, 101 bp, rice(Oryza sativa)
  misc_feature (71): n=t or c
tggcgatctcaccaccaaattaaaatagtgcagattattaaagagggcacttttaggctgcgttcgagcgnaggagaaagagagaaatattgtttcgtttt

SEQ ID NO: 16464 - DNA, 101 bp, rice(Oryza sativa)
  misc_feature (71): n=t or c
ggctgcgatgctggagaaggcgagggcagcgacggcttagcttaccttagcttagcttccatcgatcatgncgccgccttgtatgaatgcacttgactcag

SEQ ID NO: 16465 - DNA, 101 bp, rice(Oryza sativa)
  misc_feature (71): n=t or c
tgatttactagtatacctttagccctacttttctgggcctaatttcatgttgcttatgagttacatgaacnattagcagtgaaatactcattctcctgtct

SEQ ID NO: 16466 - DNA, 101 bp, rice(Oryza sativa)
  misc_feature (71): n=t or c
cttcagcagaattggaagctgggatgctgacctggaaagagtttgagacaatttcactagggaatatttcnttcaaaaaagaatttgagacttatttcctt

SEQ ID NO: 16467 - DNA, 101 bp, rice(Oryza sativa)
  misc_feature (71): n=a or g
acctcacagctgttccttttttgtacacttgagttacagctgaatcactatgaagaccaaagaaaagaganagagaaataataaatggaaagggaattgct

SEQ ID NO: 16468 - DNA, 101 bp, rice(Oryza sativa)
  misc_feature (71): n=a or g
gtggcggccacgctctccacatcggccagcaccagctgcttgtcgaggaggatgaagtaagagcgacgcanctaggctttgcaggtatgtgatgtagatcc

SEQ ID NO: 16469 - DNA, 101 bp, rice(Oryza sativa)
  misc_feature (71): n=t or c
gtgtcgtcgatcgatcggccggtggagttttgtggattccgtgcccaatcttttgtcaaaaacggccactntgcctctacagttacctgcactgccgccgg

SEQ ID NO: 16470 - DNA, 101 bp, rice(Oryza sativa)
  misc_feature (71): n=t or c
aagacaatggctgtgcctctctcagatgagttggacggtggcaaaggcgaagtggtgcgagaaggcgctgnagctcggagaaggcggcctgctcaatcatg

SEQ ID NO: 16471 - DNA, 101 bp, rice(Oryza sativa)
  misc_feature (71): n=t or c
gcattaggcgagagctaagtgctaaccactgctactagaggagtaggagtgaatagtgatagaattaaggntattctcaacccaagacactagacatagtt

SEQ ID NO: 16472 - DNA, 101 bp, rice(Oryza sativa)
  misc_feature (71): n=a or c
tttttctactagtataatactatctcctgcttcggttgctcttgctcgcttagttaaataatactaagganagtattctacttggccgccttcttcttcct

SEQ ID NO: 16473 - DNA, 101 bp, rice(Oryza sativa)
  misc_feature (71): n=t or g
atcaacatggcatcctagtaagcaaatagaataaaaaagtatgtaggacctacatcgaagtcagcatctcntttttctcctcttctcttttttcttttttt

SEQ ID NO: 16474 - DNA, 101 bp, rice(Oryza sativa)
  misc_feature (71): n=t or c
tcctgtcaaatctatcacaattcacaactcatcaggccatgatttgttgctcatcaattaatattgtaacnaacttatcatccaatcattagaatctctgt

SEQ ID NO: 16475 - DNA, 101 bp, rice(Oryza sativa)
  misc_feature (71): n=t or c
caaaatctgttccgcaatggggagtgcttcctgcatattgtatccttactgaatgggacttttgatgaagnagttggtgaacaattagtccttaatgtcct

SEQ ID NO: 16476 - DNA, 101 bp, rice(Oryza sativa)
  misc_feature (71): n=a or g
ggtcgagtgcatatatattatattatatgtccacctgcatcgatatcgtccatggatgattatcgatcaangtgtcgttttattcatcaactttttattta

SEQ ID NO: 16477 - DNA, 101 bp, rice(Oryza sativa)
  misc_feature (71): n=a or g
atcaaatttgctggcaatcagaacagcgagatagcaaaagtcgccggatttgcttagggggtgtttagatngggctaaaactttttagcccaagtcacatc

SEQ ID NO: 16478 - DNA, 101 bp, rice(Oryza sativa)
  misc_feature (71): n=t or g
attatcatagacataaattggtaacaaaacaaacattcaaactctactattgaaacttaaaaaaaactagnactcactccgtttcacaatgtaagtcattc

SEQ ID NO: 16479 - DNA, 101 bp, rice(Oryza sativa)
  misc_feature (71): n=a or g
tttggagaagggtagtagcaggggcatcatatctacaaaaggttaggaggcagagacgtctccacggcatnaactttatgttgctaagacaacgaagaaca

SEQ ID NO: 16480 - DNA, 101 bp, rice(Oryza sativa)
  misc_feature (71): n=a or c
acaggagaaattaaccttcagccatacaatcatgcatcgtcccccttctccaggtcgcgcatctctctctntatatatatatagatacgcgcgcggcccat

SEQ ID NO: 16481 - DNA, 101 bp, rice(Oryza sativa)
  misc_feature (71): n=a or g
taacaagaataaccaccttcgaacttcaaatttttatgtcctagtgtttttttcgaccgaataggaggacngcggttctcccccaacttttgattcgaaca

SEQ ID NO: 16482 - DNA, 101 bp, rice(Oryza sativa)
  misc_feature (71): n=t or g
tttcgttgtgcctgcatgaatggagcacgtctacgatccaaaactcaaacatacttgttccataatttctnatgacaaaaaccaaaaaatttctttgattt

SEQ ID NO: 16483 - DNA, 101 bp, rice(Oryza sativa)
  misc_feature (71): n=t or g
caagccgtgtacaccctcacctgcgtagagagaaaaatactcctatgtcatcagcatttccaataccaaangaaatgtagcctagtggtggccgtgtaaaa

SEQ ID NO: 16484 - DNA, 101 bp, rice(Oryza sativa)
  misc_feature (71): n=t or c
catccagcgtactttaataaagcttaacacgggtataaagtaccaggtatcagagaacatgcacttacatncacagagagcatgtgacaggtgttaagttg

SEQ ID NO: 16485 - DNA, 101 bp, rice(Oryza sativa)
  misc_feature (71): n=a or g
aagaatgccaaccgctatttctctcgagagcatcctttactcattttttcagttaactcattattgctccnttagaagcaaagagtgttgccaccttcatt

SEQ ID NO: 16486 - DNA, 101 bp, rice(Oryza sativa)
  misc_feature (71): n=a or g
ttcgtgaggatcgatgtcgattaccccgatgaatcgatctgaaatagtcatcgctccctgttccttgtccncatctctaggagagatttgtgactgctgga

SEQ ID NO: 16487 - DNA, 101 bp, rice(Oryza sativa)
  misc_feature (71): n=t or c
gaaaaacacactacaatcaggctctagtcgctctactgataacaaaacaattaagttctccataacggcangacacggcaactgatattgatccctaattc

SEQ ID NO: 16488 - DNA, 101 bp, rice(Oryza sativa)
  misc_feature (71): n=t or c
ggaagaacttctgggtgaatcaaatctcccgatgcttacagctgttgcagatcctgcagagtcatgaaatncctatcacctaacacaagattaaaacacag

SEQ ID NO: 16489 - DNA, 101 bp, rice(Oryza sativa)
  misc_feature (71): n=t or c
ttgtatgtgtaactctttattatggaataaaaagggggtggtggggggtgtgcttaattagtactacctcngttttttaatatatgacatcactcactttt

SEQ ID NO: 16490 - DNA, 101 bp, rice(Oryza sativa)
  misc_feature (71): n=a or c
tgctgtaattgaagcaacggaacattgggagtagtgtacagccgggctgcaaattagtcgccaacctgctntctttctcttccctttatccctccagctcc

SEQ ID NO: 16491 - DNA, 101 bp, rice(Oryza sativa)
  misc_feature (71): n=t or c
gaacgttgatgacaattgcaagctcgagtctcgagtgtgtcaaaagcatgtgttagccgatagccgatagncgatggtttggtacagaatcaacgggagga

SEQ ID NO: 16492 - DNA, 101 bp, rice(Oryza sativa)
  misc_feature (71): n=t or c
attctgttgcatgtttttcatggcaggtgtttgatttgtttgatctgaagagaaatggggtaatcgaattnggggagtttgtacggtcgctcagtgtgttc

SEQ ID NO: 16493 - DNA, 101 bp, rice(Oryza sativa)
  misc_feature (71): n=t or c
acatgccactggaaatttctaaaattgaaaccatgccactcttgtcacgttttccgtctcctctctcatgncgtttcttttcctccagtttaatcgtttcc

SEQ ID NO: 16494 - DNA, 101 bp, rice(Oryza sativa)
  misc_feature (71): n=t or c
gtcacagcctcctatcgatcggagtactccgtattcgcccagccgactagtgtcactcatggcttctatcnattgtttacgatttattgttgtttttcaag

SEQ ID NO: 16495 - DNA, 101 bp, rice(Oryza sativa)
  misc_feature (71): n=t or c
ctcgagctgttgctccacctccaggagcactgcgcccgagctccaatttgactttagcgttatatctgggngccaaagcttggtatgccaccacgatcgat

SEQ ID NO: 16496 - DNA, 101 bp, rice(Oryza sativa)
  misc_feature (71): n=t or g
tagcggggcgcgggacacggaaagcaattgcgcgcgaggaccaccacaccacacacccctcttctctctcncgcgcgcgcgcctgaccaagcacgcaagct

SEQ ID NO: 16497 - DNA, 101 bp, rice(Oryza sativa)
  misc_feature (71): n=a or g
actgccataggctcacaaggatacattgatccacagtgcatgaaggatggtgaggtcagcttcaaccgtanctccgacgtgtacagcttcggcattgccct

SEQ ID NO: 16498 - DNA, 101 bp, rice(Oryza sativa)
  misc_feature (71): n=t or c
tgtaacaacatttcacccgtgtgaatagacaccgattgaccggttaacctctctacctctccgggttaatncaaaagttactctgttcctcgtccctgtgt

SEQ ID NO: 16499 - DNA, 101 bp, rice(Oryza sativa)
  misc_feature (71): n=a or c
aatgaatttgagttttcgtgatttcgtcgaactttgtctaaaccacagccttctcgtagggcggcgcgggngaaggcggcgcaagacgagtctggagggac

SEQ ID NO: 16500 - DNA, 101 bp, rice(Oryza sativa)
  misc_feature (71): n=a or g
tatcttacagtaaaagtagcaaatattttaattggacccctccttggccccacccccaaggctccagcccncggtgccgctatcccttccatcgcctgctt

SEQ ID NO: 16501 - DNA, 101 bp, rice(Oryza sativa)
  misc_feature (71): n=t or c
cgtggtctgtctgcataaatagatttttagaccgcatatgaaaatgagcctcgatttttaaaggcacgatnatttatggtccgcctacaacttatataggt

SEQ ID NO: 16502 - DNA, 101 bp, rice(Oryza sativa)
  misc_feature (71): n=t or g
aatttaggttacatttatttctatatggtttgtacctccctacttgttttgatatatgtagtcgggaacancaggtaggtagttaagggcccctgtcagtt

SEQ ID NO: 16503 - DNA, 101 bp, rice(Oryza sativa)
  misc_feature (71): n=a or g
tctccactaaaccacctgcattgccaaatctctcgttacctgaagcggacaggaagagcagcggcaatgcnacggcgaggatgagggcgcggaggcgcccg

SEQ ID NO: 16504 - DNA, 101 bp, rice(Oryza sativa)
  misc_feature (71): n=a or c
tagcttgtttaggtgaaggaaatgaggacttcaaacgtatagatagagagagattgagaggaatcaagtgnggatccgatcagccaagaggtcgggtttat

SEQ ID NO: 16505 - DNA, 101 bp, rice(Oryza sativa)
  misc_feature (71): n=t or c
aatgtggtgctacagtaaacatttgctaatgacggatttgctatactggaaggggaagcccgtgcaccgcngcctatttcccgtcggtgcatcgttgccgt

SEQ ID NO: 16506 - DNA, 101 bp, rice(Oryza sativa)
  misc_feature (71): n=a or g
ctggagaagggattgtctagattcgttggactcgaatatatcttatctaattctagtgttgctatattttnaggtaggatagatctcatccagttttagat

SEQ ID NO: 16507 - DNA, 101 bp, rice(Oryza sativa)
  misc_feature (71): n=t or c
gattgattgtcctccccgacccgatccatccatgtttttaccagccccagtcccactggcccacacaaaanaaattatatttcaccactgctacacactct

SEQ ID NO: 16508 - DNA, 101 bp, rice(Oryza sativa)
  misc_feature (71): n=a or g
actcttcattgctgatctaatgccaataacatcagctcagcggttaacgatatgtgattggccctttgtcnaacggctatcgtttatggatttaactttgt

SEQ ID NO: 16509 - DNA, 101 bp, rice(Oryza sativa)
  misc_feature (71): n=a or c
ggtgaacacaaggagtactgctgctaacaatgctcgtgctaggaattcagctcagaatcagaatcagaacnagaaccagaattaggaccaaggccacgccc

SEQ ID NO: 16510 - DNA, 101 bp, rice(Oryza sativa)
  misc_feature (71): n=a or c
gtgtttgttgaatcggcaatgactgtactgggtcggctgttgtcggagttggtaaaaacatcgcagcaacntgctcctgagtcagtcgattgatattttgc

SEQ ID NO: 16511 - DNA, 101 bp, rice(Oryza sativa)
  misc_feature (71): n=a or g
cgtccctaccatcccacacctaatcttgttctcgtctaccctgccttcttctcagcgctaagaggggaggngcggtggatctagttcgtgggcagcggcaa

SEQ ID NO: 16512 - DNA, 101 bp, rice(Oryza sativa)
  misc_feature (71): n=a or g
tatatcggccggtgggccttttgtctttattcgatatactcttttttaaagacaaaaattatgttatgatngcataattattagttactacctccgtttca

SEQ ID NO: 16513 - DNA, 101 bp, rice(Oryza sativa)
  misc_feature (71): n=t or c
catcttcaaagtttagtatttattaaagtgaattacagtgtgtcttaattccacactcggcagcaatgtgntcaggaggcacttctgataggatttttgat

SEQ ID NO: 16514 - DNA, 101 bp, rice(Oryza sativa)
  misc_feature (71): n=t or g
acacatgcatgcattcagatatattcatatcagatcgatcaactgcgcgcatgcatttttcggtagcaacnagcaattttaccgtccaatatttgaaacct

SEQ ID NO: 16515 - DNA, 101 bp, rice(Oryza sativa)
  misc_feature (71): n=a or g
ctccgtatatatctgtctctatatagcagactaagggtccgtttacaaatcgcttatatacaaagctgccnagaattgagcctcaaatcagcgtttgccgc

SEQ ID NO: 16516 - DNA, 101 bp, rice(Oryza sativa)
  misc_feature (71): n=t or c
ccagaggtaaagaaactcgtaggctcccaagtgtagtatacgggcaaacaaactatttaaccccccccccnttttttttatagttgccagacctttttact

SEQ ID NO: 16517 - DNA, 101 bp, rice(Oryza sativa)
  misc_feature (71): n=a or g
tataaaatttcttagaattttaactgttccctatcaccctatgtgccaagggggcaagaagactaaagggnatgccttggttaggtataaaactgctcgga

SEQ ID NO: 16518 - DNA, 101 bp, rice(Oryza sativa)
  misc_feature (71): n=t or g
gacttgggaagtcggccaaatttggggcccccgtgagaatgccacatgttataggttttgaagtagtagtnacaaaagatatttatcctcttctttcttga

SEQ ID NO: 16519 - DNA, 101 bp, rice(Oryza sativa)
  misc_feature (71): n=a or g
aacgttctaagagatcatcggaactgttatatataatatgcaacgattggagtttgtagctgcttagtttncaaagtgaggcgagtaacatctcttctttt

SEQ ID NO: 16520 - DNA, 101 bp, rice(Oryza sativa)
  misc_feature (71): n=a or g
atactacgcatgattttagtcccggttgataatacaaccgggagtaaagatccaggagatctttagtcccngttctagagtggtgatctttagtcccgttt

SEQ ID NO: 16521 - DNA, 101 bp, rice(Oryza sativa)
  misc_feature (71): n=t or g
atgtagcctttacattttgtacacagttttctcatgaaattaatgcatggactctggaccctatgtacctncagcaaagcagcatgtggatactctctgcc

SEQ ID NO: 16522 - DNA, 101 bp, rice(Oryza sativa)
  misc_feature (71): n=t or c
tttgcatcatatatatcgcattcagaaagtagtgctgcagctaacacatagatatggtgttagcttcatgngtttgtaccatatatagcggatgcagaaag

SEQ ID NO: 16523 - DNA, 101 bp, rice(Oryza sativa)
  misc_feature (71): n=a or g
cgcccattgtagatggtgtggtagtgttgtttcgcaagcggggtgacatgacaaaaaaggttcaaattttngaaataagtttcagaagattttatttttaa

SEQ ID NO: 16524 - DNA, 101 bp, rice(Oryza sativa)
  misc_feature (71): n=a or c
aaactatcccctcaagaggtgctaattgagactatttgggtggggctcactgaaaagcggcttctctctcnatgggaatgtgcattaaaggtcaaatagct

SEQ ID NO: 16525 - DNA, 101 bp, rice(Oryza sativa)
  misc_feature (71): n=t or c
ttcgagaccacgcgatcatcttcatggaaggcgtaaagtcccaaagcggttatttggtggctaaaagaagnatcaaagaaatttgatttcaaaaagggttt

SEQ ID NO: 16526 - DNA, 101 bp, rice(Oryza sativa)
  misc_feature (71): n=a or g
gtcatcatgctctaatcgaccatcacgtcctaacccgcctgcaattgtcacagacctcgccggggtagccnccgcggaggttgcccatcttgaccatggcg

SEQ ID NO: 16527 - DNA, 101 bp, rice(Oryza sativa)
  misc_feature (71): n=t or g
ataccacctataatttttgtgaggggctgaaattagtcccccatccaaataggaccctaaacttgggactngtatgtatctctggagctgcagatatatgt

SEQ ID NO: 16528 - DNA, 101 bp, rice(Oryza sativa)
  misc_feature (71): n=a or g
aaaaaggcgtgaaaaatagaggcactgcaaatctacaagccaagcctcaaaaattgaatcctgattgtganaaaacaaagcaactctcatttctcttttct

SEQ ID NO: 16529 - DNA, 101 bp, rice(Oryza sativa)
  misc_feature (71): n=a or g
tttcactttggacaccctttttaaacatcttcttgattcactttagtcccattatcctgaataccctgccnctttgggtatacaaaggacatcaatgcaac

SEQ ID NO: 16530 - DNA, 101 bp, rice(Oryza sativa)
  misc_feature (71): n=a or g
tggagcggctggatctgtccttctgcaattcgataggcgccctcaagatacctagtgcactccggcggctnaggtccctacgggtgcgctcgtgcaggatg

SEQ ID NO: 16531 - DNA, 101 bp, rice(Oryza sativa)
  misc_feature (71): n=t or c
aatgtaaaattaaagttttcttttgattacacaaaagacacaaatatccctcaacacatgctcaaagcaanaggggcaaatggtaggggtgaaaatgatat

SEQ ID NO: 16532 - DNA, 101 bp, rice(Oryza sativa)
  misc_feature (71): n=a or g
gcagaagttgcatcacatcttctaatgcacaggagacatcacttcttgggctatatatgagccttaatggncccaaaattactgatgggccgtaatgagcc

SEQ ID NO: 16533 - DNA, 101 bp, rice(Oryza sativa)
  misc_feature (71): n=a or g
gctttatgatctactccaaatgcatgagacaaatctgtagtctagcttactggcctgtgaaaaacacaaanccaggccaggtctaaggagcactagtaatg

SEQ ID NO: 16534 - DNA, 101 bp, rice(Oryza sativa)
  misc_feature (71): n=t or g
caacaaaacatccctaccccgagaggcccattgcttaagccgcatcttcatccagcgtagctagcaccttnttgagctgagcaacatcatggtcatccagg

SEQ ID NO: 16535 - DNA, 101 bp, rice(Oryza sativa)
  misc_feature (71): n=t or c
accaacgctactgtagaagttatctttgccgggatggcgaaaatcacactagtcccggtcaaataggaacngggactaaagaacatttttagttggataaa

SEQ ID NO: 16536 - DNA, 101 bp, rice(Oryza sativa)
  misc_feature (71): n=t or c
gccaaagttagaaaatgaaccaaacatgttctaaccacgtttcccttttttcagaccttgttcggttatcntcaagaggaagggattgagcaggattaatt

SEQ ID NO: 16537 - DNA, 101 bp, rice(Oryza sativa)
  misc_feature (71): n=a or c
tctgacgtgcgtggaagggaagacgaatccgacggagatatattgatgggcttgtgttgggctggatcaantttttcttcttctttttaaaatttaaacat

SEQ ID NO: 16538 - DNA, 101 bp, rice(Oryza sativa)
  misc_feature (71): n=t or c
gggtatccacagtatgcacacacgaatccctcctgtacgttccctgctacttgcttcaagccctagcgtgnatggatcgatcgcctgcttgtttagatatt

SEQ ID NO: 16539 - DNA, 101 bp, rice(Oryza sativa)
  misc_feature (71): n=t or g
ctgtataatgggtacgtagatccgccctgtatatatcattggcaaatgaaatctctcaacttcattttagnatgatggcattttgcgaaattcatctcttc

SEQ ID NO: 16540 - DNA, 101 bp, rice(Oryza sativa)
  misc_feature (71): n=a or c
gcaggtaacagatcatcaaattcgatctttcgatggttcagtcttggtgaaatttcatatgggtgtatccnggtatttttctcctattaaatcctttcact

SEQ ID NO: 16541 - DNA, 101 bp, rice(Oryza sativa)
  misc_feature (71): n=t or c
acactgcatagtaagccaagcacctgctaatatgtttgacctcacaacaatctattcgctgctaataatgnacctatttgatatccaagaaacaataacta

SEQ ID NO: 16542 - DNA, 101 bp, rice(Oryza sativa)
  misc_feature (71): n=t or c
gcggccagtcgaaggagttgacggcgttcagcattgccgcatcgacgtggctgtccatgttgaagctgatnggcgtccggtgagaccttctcgaagcacac

SEQ ID NO: 16543 - DNA, 101 bp, rice(Oryza sativa)
  misc_feature (71): n=a or g
ctcagcaaagggcacagtggtctgtgctgtcactctggtgcactccaggtagtggttgcttgagtctagtncacagtacagagcaccagaacacacagatg

SEQ ID NO: 16544 - DNA, 101 bp, rice(Oryza sativa)
  misc_feature (71): n=t or c
atgaatttcctttgaatcaaaggaggccttacttcccggacttgtgtggctgccacagatcgaactgttgntttgctttgtgtaattgtgttggtcccgta

SEQ ID NO: 16545 - DNA, 101 bp, rice(Oryza sativa)
  misc_feature (71): n=t or c
acaagtcgagcataggaaacaaggcaacaagcgtaacattcttttttcttctctgaaagactgaaactaanccatggtcccaaacaagcgtacaatggact

SEQ ID NO: 16546 - DNA, 101 bp, rice(Oryza sativa)
  misc_feature (71): n=t or c
attactgcgcgagcacgggcgaggaagtgggatggtgcggtccgccaaattttcccggatggagcggtacngaatattgaaggaatattcccttttggaat

SEQ ID NO: 16547 - DNA, 101 bp, rice(Oryza sativa)
  misc_feature (71): n=a or g
tgaggttatagcagattatataacagtagtgtcattaattgacagtcatggaaaagaccttttagtgatcncactcagctggagtgctgatggccaacgcg

SEQ ID NO: 16548 - DNA, 101 bp, rice(Oryza sativa)
  misc_feature (71): n=t or g
atacatcgatttgaaaaaaaaacaaataaaatgacaacttaaaacgagagattactttgtttgccctcatntatggtccaactatctttaaggtcaccaat

SEQ ID NO: 16549 - DNA, 101 bp, rice(Oryza sativa)
  misc_feature (71): n=t or c
gatggctggaatgaagtaggtggcggtggaggggatcaccgaacttgatcagcagtgcggccaaaccatanaatgtaatatgcttgactatatgtgcaatt

SEQ ID NO: 16550 - DNA, 101 bp, rice(Oryza sativa)
  misc_feature (71): n=a or g
ggacattggccactaatagattcacacgtgtgtatcatgagtcctaggggtgagtaaccgcatgcaagatntgtacatacatgcatgcatgtgacaacata

SEQ ID NO: 16551 - DNA, 101 bp, rice(Oryza sativa)
  misc_feature (71): n=t or c
gggccgtccatagggatgttcgagctgaacgtttaattagcggtcctaattttttttatgagatttgcttngatctaataaaaaatattttaaggtactat

SEQ ID NO: 16552 - DNA, 101 bp, rice(Oryza sativa)
  misc_feature (71): n=a or c
gctgaagcacaccgctagatcttgcactgggagttccgtaagatccgttgcattcaatctagtacggtagntacatgggacggtaggatccgttttgctag

SEQ ID NO: 16553 - DNA, 101 bp, rice(Oryza sativa)
  misc_feature (71): n=t or g
taaaaagggaaaacttttgaatagaaagtgattgatgggacaacttagtactccatagtgaccagtatttngggacaaaatttaaatcctaaagagacaag

SEQ ID NO: 16554 - DNA, 101 bp, rice(Oryza sativa)
  misc_feature (71): n=t or c
tcaagccgcgatggcaagccgcctcctgctggtcgcattcgatgcactcggagcatttctccattattttngttaaaaaaagttttccattcaagtatttg

SEQ ID NO: 16555 - DNA, 101 bp, rice(Oryza sativa)
  misc_feature (71): n=a or g
tccatgatttgggaaaaaggacagtggcttgatcagatgcattgcagcaacaacaacatatcaaaattcanacttgttattcatcagattattatcgcgga

SEQ ID NO: 16556 - DNA, 101 bp, rice(Oryza sativa)
  misc_feature (71): n=t or c
gcatctaacgggagagagagagggtgagagggaaagagagagagaatattatgtcatgacaggtgggccanatcctttatttaataaaaaacttgctgact

SEQ ID NO: 16557 - DNA, 101 bp, rice(Oryza sativa)
  misc_feature (71): n=a or g
caatcaatcaaatctcgatccatagattgattcatcaatcgcgagcacatgcatgtactccctacgtcctnaaaaaaggcaaacggtggattcccgtgcca

SEQ ID NO: 16558 - DNA, 101 bp, rice(Oryza sativa)
  misc_feature (71): n=t or c
tggaaatcgccctgcgcgtcgagtaggttgccggagagagagaggacgggatctgtttaagcggtgaaganggaaatcacggtgtgaagatttttgggggc

SEQ ID NO: 16559 - DNA, 101 bp, rice(Oryza sativa)
  misc_feature (71): n=t or c
aattggagattagtttggtgagagattgatgataaagtactagatcctactatagttacgcacacacaaangagcgcacagcctcttaagcacgataagga

SEQ ID NO: 16560 - DNA, 101 bp, rice(Oryza sativa)
  misc_feature (71): n=a or g
gcaaattttgccattgaagtctgttgtactgtactgcactccactacatatagataaattttactacaganaatcgcgacttcgtggttttaacttgagga

SEQ ID NO: 16561 - DNA, 101 bp, rice(Oryza sativa)
  misc_feature (71): n=t or c
agcgaagcaaagaaattaaagactggactaagaacagcagaatcatgatatgctaacagattatcacaaantttctggtcaaaagctcacagtattttcag

SEQ ID NO: 16562 - DNA, 101 bp, rice(Oryza sativa)
  misc_feature (71): n=t or c
ccagatggtataggtcgcatatgccctcgaagtcgatccacaggacatcatttgacgagcctccaaacatntctctaccaccgggtgatttgtccatgtac

SEQ ID NO: 16563 - DNA, 101 bp, rice(Oryza sativa)
  misc_feature (71): n=a or g
cctccctcctccaatctcattcgatatggtgaggtttttttttcgagtggaccaatgtggtgaggtcacgncgaagagattaaaacgtcggaatataagcg

SEQ ID NO: 16564 - DNA, 101 bp, rice(Oryza sativa)
  misc_feature (71): n=t or c
tgcaaggcaaagttttggaagaaagctaagggcagtcagttgaaggggaaagaaataataattagaaattntgatggggaggaagtttccactgatgatga

SEQ ID NO: 16565 - DNA, 101 bp, rice(Oryza sativa)
  misc_feature (71): n=t or c
acgaatcttaaagcaaatctaacggttttcaaaattacatgaaagttacacatcggttacagtgtagttanatataagctagaatttaattacactactat

SEQ ID NO: 16566 - DNA, 101 bp, rice(Oryza sativa)
  misc_feature (71): n=a or g
tgtctttacagtttccatcagatatcgctagcatatccatatcttcggtgcctttaggaaccaacacaccnccactcagatactcctcttgggagaaggat

SEQ ID NO: 16567 - DNA, 101 bp, rice(Oryza sativa)
  misc_feature (71): n=t or c
ttcttaaaagttacaactgtagatactgtggctgtgtttgtttgggtgtgttgggaaccaatctcctgtcnacggaaaacggagtggtccattagcacgtg

SEQ ID NO: 16568 - DNA, 101 bp, rice(Oryza sativa)
  misc_feature (71): n=a or c
tcaaatcggcctaatacccataggtacaagacttgatacttgtgtatcgggtatttggtacccaaattggngttgacgttagcatcaaaacaaacaatgtg

SEQ ID NO: 16569 - DNA, 101 bp, rice(Oryza sativa)
  misc_feature (71): n=a or g
ctatctcaaatccaccaagctcaggacacttcagcgctagtgtccctatggctcattggtgtcgatgaccntggcttggcaacggctccaagacaagctag

SEQ ID NO: 16570 - DNA, 101 bp, rice(Oryza sativa)
  misc_feature (71): n=a or g
ctgggactgacattatcattcagctaatgataaatatacatagtaggcaaaacaaggatgacgcataagcnctttcccttttcctttaaccaaagaagcaa

SEQ ID NO: 16571 - DNA, 101 bp, rice(Oryza sativa)
  misc_feature (71): n=a or g
gacaaagcaagggccttctaattgcttcctgtagtagtgctgaaaattcatgttttagagtcgatggatcnatatgccataaaaggatcctaccacaaaaa

SEQ ID NO: 16572 - DNA, 101 bp, rice(Oryza sativa)
  misc_feature (71): n=a or c
agttgtctcctagctagtccagggccaaatcccgggtcctgttgctaacaaggggtctacctgttgtttgntctttggattagagctgaattgaaccagcc

SEQ ID NO: 16573 - DNA, 101 bp, rice(Oryza sativa)
  misc_feature (71): n=a or g
cttcaacaaattttaaaaaaattggcaagatagcttaatatgatatatatatcactttacaagtatgcaanttaaaattcaacttctactacaaattgtaa

SEQ ID NO: 16574 - DNA, 101 bp, rice(Oryza sativa)
  misc_feature (71): n=a or g
ctcgctgtcatttgttacgtcttggacatcctacgatgaaatatcatatttaatggattttaaacgttgcntagtgatgtataattgaatttaagtacaga

SEQ ID NO: 16575 - DNA, 101 bp, rice(Oryza sativa)
  misc_feature (71): n=a or g
agatggtgacaaaaacatgcatggtacaccaacattcatctcccacaactatatacaagaagcaaacatcntgctaataaaaaaaaaacaatcgcaagaat

SEQ ID NO: 16576 - DNA, 101 bp, rice(Oryza sativa)
  misc_feature (71): n=t or g
tccaatcaaaggaacaaatatcaccatcaaaaattgcatgttaccgcataagcaatcttagcggcagggangtaacaaaatcaagaaaattaacaaggaaa

SEQ ID NO: 16577 - DNA, 101 bp, rice(Oryza sativa)
  misc_feature (71): n=t or c
gaagaaacctcgtttttatgaaacaatcacttgtccatgtggttctcgaagtggaggaaacagaaatttantggcttcattagtataatcagaaagtcaca

SEQ ID NO: 16578 - DNA, 101 bp, rice(Oryza sativa)
  misc_feature (71): n=t or c
agaacactcacgacgccaagaacggagtagaagtcgtcggcgacctcatcctccgcgctgccgtactcagnttccgccgcataggcacagctcctaaggtc

SEQ ID NO: 16579 - DNA, 101 bp, rice(Oryza sativa)
  misc_feature (71): n=a or g
gatatactcgaccacaaacaattcactgaattaaggaagtgaaaaaggtgtaccgtccattcgatatgcanttattaatatgtactagaaacaatattgaa

SEQ ID NO: 16580 - DNA, 101 bp, rice(Oryza sativa)
  misc_feature (71): n=t or g
ttttaattagttgagaatgtgaaatatcgtgtactccgtacatcagagtaaattatatcgtaaagaaacanatattttttatatctcctgtggtagctaag

SEQ ID NO: 16581 - DNA, 101 bp, rice(Oryza sativa)
  misc_feature (71): n=a or g
tctctatgaaatcttttgatttaaaaggtccgggggaaacatttttgtaaatgctcgcttcaatacctgcngggctttcgtcccttttttttcacttccta

SEQ ID NO: 16582 - DNA, 101 bp, rice(Oryza sativa)
  misc_feature (71): n=t or c
tacacaaaaccttcaagttcaccttccacacatagatgaatccaatcttgtattgttcaaccgtatagctngtgaaaatagacaagggtaaaaagaggtgg

SEQ ID NO: 16583 - DNA, 101 bp, rice(Oryza sativa)
  misc_feature (71): n=t or c
ctcagatatgatgcttcgtcatgcgtgtcgaaggcaaaggtttagacatgcattgtttagcgtgccaaaangagaacttcaaatgctttatttattaacaa

SEQ ID NO: 16584 - DNA, 101 bp, rice(Oryza sativa)
  misc_feature (71): n=a or g
cgtttgaaacgtatgcacgtcacatacccaaaaagttagaaaacacaacacacgagacttatatacatacntctacatgtaccgaattacatctggtcagc

SEQ ID NO: 16585 - DNA, 101 bp, rice(Oryza sativa)
  misc_feature (71): n=t or c
cttcctcctcctcgctgccatttgtcaacatgcatcgtggcgcacatgtagggcttccaccttggtggcgnggtcgccacctgctcatcattgagaggttc

SEQ ID NO: 16586 - DNA, 101 bp, rice(Oryza sativa)
  misc_feature (71): n=a or g
tctatcaacatttcatgtttttttttctattcatgtggtttatttaatcttttttttgcggggatggtttntttaatcttatgttttaaacaaagaagact

SEQ ID NO: 16587 - DNA, 101 bp, rice(Oryza sativa)
  misc_feature (71): n=a or g
aaccttgactaatgtggagacgtggatccaacatggtgaggcaataccattccccacatccccacactatntaagctcttagaacaggtacaatagcaggc

SEQ ID NO: 16588 - DNA, 101 bp, rice(Oryza sativa)
  misc_feature (71): n=a or g
tgtccatggcagctgactctctgcaatgatttgtgcgaaaactaggagacaagaatggtgtgcctccttcnccatttcgagatgatgaaatattacttgat

SEQ ID NO: 16589 - DNA, 101 bp, rice(Oryza sativa)
  misc_feature (71): n=t or c
cgacgttacctttcttggcgaggtcaattggatagcgcacgattaataaggtgacgttgtgctacaattanagagttgtttgaatcttgttgatcggaaac

SEQ ID NO: 16590 - DNA, 101 bp, rice(Oryza sativa)
  misc_feature (71): n=a or g
tcatcgtaaatatttttaatctaacaaatatcatcttatacgaaggaaagtacactgctggagaatgcatntatactcccggttcacaacccctttaatcc

SEQ ID NO: 16591 - DNA, 101 bp, rice(Oryza sativa)
  misc_feature (71): n=t or c
cgaagaaggctttgcagcagggtggcgaagcgtaggctcatctcgtgcatcggacagagactctgtccttngccatgagtcccgggggggaaccccggctc

SEQ ID NO: 16592 - DNA, 101 bp, rice(Oryza sativa)
  misc_feature (71): n=a or g
ctccacgcagcgctgccggccactccacaagttcacaaccgcattcgcccgccgtccgcttcgccgctccncccaccacccaccgcccactgcctccattt

SEQ ID NO: 16593 - DNA, 101 bp, rice(Oryza sativa)
  misc_feature (71): n=a or g
aaaacaaccgaagccaccaaaaattttgaaagagtcaaaagccatcgaactcgaaagaagatatgaaggcngcgaaggattcagaagaacaaaataaggta

SEQ ID NO: 16594 - DNA, 101 bp, rice(Oryza sativa)
  misc_feature (71): n=a or c
tatacatatgtttcgaagcacttattttgatactttgattatgtgtcatttatggattagaaaatttatgnttaaaatatgactcgtataaagagaaacaa

SEQ ID NO: 16595 - DNA, 101 bp, rice(Oryza sativa)
  misc_feature (71): n=t or g
ttttttttttgcttcctaggactgcaataaatgccattgattgccacctttgccgcaaacaactggacaantggtccttccgatggcgggttcattgattt

SEQ ID NO: 16596 - DNA, 101 bp, rice(Oryza sativa)
  misc_feature (71): n=a or g
ccggaggactacaaggttggatgccagatgatggctctcttactgtgtttagtcgcacttatccttaatancttttaggttagtccaatgagagtactgat

SEQ ID NO: 16597 - DNA, 101 bp, rice(Oryza sativa)
  misc_feature (71): n=t or g
tatcgtttcgcattaagccaatgtaatatgcatcagatcggccatgaagaataaaataaagaaagagttanacttacttgatcggctgtagatatcaatga

SEQ ID NO: 16598 - DNA, 101 bp, rice(Oryza sativa)
  misc_feature (71): n=a or c
tgaatgtaggcatgccacatcagctcctagcaggatgttgatgctttgggatgtacaatagtacattaganaagattaaaagtataaatatacaatacaaa

SEQ ID NO: 16599 - DNA, 101 bp, rice(Oryza sativa)
  misc_feature (71): n=t or c
cagaagataaataatttcgatgaaccatgtaactcttgacaccctgaagaactactatggctaacactaanacttttaagctagattttcaaaactgcaac

SEQ ID NO: 16600 - DNA, 101 bp, rice(Oryza sativa)
  misc_feature (71): n=a or c
gctggcagtggagcctgagtgatcgctcaatctgcccgagagctggctgcgttgttgctggctgctactanaccaataataataattcatgttcctttttg

SEQ ID NO: 16601 - DNA, 101 bp, rice(Oryza sativa)
  misc_feature (71): n=t or c
tagttcatcaaggcattaggcgttagaggatcgaccgttcaaactagtaattatagtagaagaaaacaacnattatatttctttcaaaaaagacaataaaa

SEQ ID NO: 16602 - DNA, 101 bp, rice(Oryza sativa)
  misc_feature (71): n=t or c
cgctcttcttttcttcaggtccgatttttttttgccatgatggaaatcgctcttttttctattaaatggangataaaatcatttaaattttttttatgtag

SEQ ID NO: 16603 - DNA, 101 bp, rice(Oryza sativa)
  misc_feature (71): n=t or c
gcttgcttaatcaacttgtacaatataatgaactacacacaccacatcagtggtaaaatggttaaggtctnaactttagtgtaacccctctcctatctttt

SEQ ID NO: 16604 - DNA, 101 bp, rice(Oryza sativa)
  misc_feature (71): n=t or c
ctcaacttagatatagatggaaacctaactcgtcacctgtcacacaatcatgtattggcataatgtagggnggcggtgctgcagatctacaggatggcgtt

SEQ ID NO: 16605 - DNA, 101 bp, rice(Oryza sativa)
  misc_feature (71): n=t or c
agtttcaatgagaatgaattcaggctaaccttgcccaatcaataattcatcagaattcatatcagactctngcttattgagaaaggaccagtcccacctct

SEQ ID NO: 16606 - DNA, 101 bp, rice(Oryza sativa)
  misc_feature (71): n=t or c
agattataacatttttgacatttggagtatgtcatgattagtgatgtaccccttctccatgatgacatttnaatggttgccagattgagcaatatgggagg

SEQ ID NO: 16607 - DNA, 101 bp, rice(Oryza sativa)
  misc_feature (71): n=t or c
tttagcgtggaactaaacacagcctgtgatctcaagcaaatgtgtgagaccagtacagcacatccccttancacagaattatgagagaaatctacagcaca

SEQ ID NO: 16608 - DNA, 101 bp, rice(Oryza sativa)
  misc_feature (71): n=t or c
aaggcattgtgtcgctgacagtaatgatacctggtgcaccgtccacgctggaggaacgcaaatcgcgcagngatatcggcggccactgcagggagccgtgc

SEQ ID NO: 16609 - DNA, 101 bp, rice(Oryza sativa)
  misc_feature (71): n=t or c
agcggatttcttaagcaaccgctagcgaaaatggacctaaaccttccacccctctttaaaatttcgcaagnggatttcttatataaccgccagcgaaaaga

SEQ ID NO: 16610 - DNA, 101 bp, rice(Oryza sativa)
  misc_feature (71): n=a or g
catggcagcactagcttaattggagctagggcacttaatcaaggttgcatattaaatcttgagcacgaatnaatgtggcaggggcagcgaaggctgactgg

SEQ ID NO: 16611 - DNA, 101 bp, rice(Oryza sativa)
  misc_feature (71): n=a or g
cgtagtcgttgtaaactatctcacagatcaatataactactctttctcgaggttttatttatcactggcgnaacttggcacctgacgcggggctgtatcga

SEQ ID NO: 16612 - DNA, 101 bp, rice(Oryza sativa)
  misc_feature (71): n=t or g
caggtttcaaatcatctcaccttttctttttactcccttcgatcacaaattgaaatacttgaaagttttanatatgaaccaattaaacttacgtaactttt

SEQ ID NO: 16613 - DNA, 101 bp, rice(Oryza sativa)
  misc_feature (71): n=a or g
aaatatgtggttttacaattcaatgtttccgatattattaccagtttctgattgatacctacgtgatatanttcagtttctggtttttcatattctcaata

SEQ ID NO: 16614 - DNA, 101 bp, rice(Oryza sativa)
  misc_feature (71): n=t or c
ggtcgacccaccctgtctaatgggtggatccgcccctagattaacatattgcaatatatcagagttacaangactctcgatcggatgcctttgtcagtcta

SEQ ID NO: 16615 - DNA, 101 bp, rice(Oryza sativa)
  misc_feature (71): n=t or g
aggtgattgagagatggggagaaaattgatgggaatatgggatgtgattgataggaccaatagtactatancatttattctggtaaaaaatatttgaatat

SEQ ID NO: 16616 - DNA, 101 bp, rice(Oryza sativa)
  misc_feature (71): n=t or g
ataccacactataactaatcatgaaaagcaattatatgtaacaagctgcaaagagattttcttgtgcgtgncaggaaaattgatatgtgaaccaccaaaat

SEQ ID NO: 16617 - DNA, 101 bp, rice(Oryza sativa)
  misc_feature (71): n=a or c
aacatgcaagcatagtatttgttagcattcctaaaacctacatataagcatgccgcatcaactcattaagnaaaaaaaagctcaacatgcatgcatatagt

SEQ ID NO: 16618 - DNA, 101 bp, rice(Oryza sativa)
  misc_feature (71): n=a or g
agcatggcagctcgatcattcgcttaggggaaaatatgtagttgcaaagcctatatatagtgaaaatttgnaaactaccgttggaccgaaaaatggacatc

SEQ ID NO: 16619 - DNA, 101 bp, rice(Oryza sativa)
  misc_feature (71): n=t or c
agagagagagagagagagagagagagagagagtcagagagatgcggcgttgcagttgctggcagctattgnggctggtgcttgtgtgctcatggcggatcg

SEQ ID NO: 16620 - DNA, 101 bp, rice(Oryza sativa)
  misc_feature (71): n=t or c
aaatttccaatatatatcttttagaaatttgtttgtgcttctctcgatgaggcaaacaataaacagaagcnaaaaaataataaacagaatcagacttcaca

SEQ ID NO: 16621 - DNA, 101 bp, rice(Oryza sativa)
  misc_feature (71): n=t or c
gagaggacgagtcggcggttggcgaaaggaaggaggagaggtccctgcctccactcccttttaattcttgnctcatccgcgctcgcctcctcgtttcgcac

SEQ ID NO: 16622 - DNA, 101 bp, rice(Oryza sativa)
  misc_feature (71): n=a or c
gaacaggtagggcaagtgtaccgaaatactactaaaacatgaaggtaaaaagaaacatctagggctactanaaacaatagtgaaacattaatataattgga

SEQ ID NO: 16623 - DNA, 101 bp, rice(Oryza sativa)
  misc_feature (71): n=a or c
catgtactgacattaaattaaaaagtggtatgtagtggtactaaatgaaaaaagaagttatgtactactantacttaaaaaaaaggatatactaatactgc

SEQ ID NO: 16624 - DNA, 101 bp, rice(Oryza sativa)
  misc_feature (71): n=t or g
agggaatgtgtacgtttagctcttctttaggttcatctaaggacaaaagataaatgtacgcaatgtggtanagagttgtttagaaagcttaactttaatcc

SEQ ID NO: 16625 - DNA, 101 bp, rice(Oryza sativa)
  misc_feature (71): n=t or g
tgtttatcaagttgtccttaagaacctgcactctcttacaatcttccaactaataaagtagagtgctaatnaatttgcataatttttacagaaagggtgaa

SEQ ID NO: 16626 - DNA, 101 bp, rice(Oryza sativa)
  misc_feature (71): n=a or c
taatatggtgtaacttaccttgcgtatatttgttactatactttacatgggcgttgctcttttactattcncttcatctcattttaagcgtctcaatgtcc

SEQ ID NO: 16627 - DNA, 101 bp, rice(Oryza sativa)
  misc_feature (71): n=t or c
cccaaatctgatgatatcaaattatctattcatgaccaatatttgatagtagactactatcatatactccntccatcctaaaaaagatttaattcttgggt

SEQ ID NO: 16628 - DNA, 101 bp, rice(Oryza sativa)
  misc_feature (71): n=t or g
tctatagtacaagagtgagcagtactatacatatacataaggtactacagatgaccgacctgcatccatcngtgtcgcagcacgatcctaaatgaaaccat

SEQ ID NO: 16629 - DNA, 101 bp, rice(Oryza sativa)
  misc_feature (71): n=a or g
gttcagttatcttaagaactgttcgtatttgatcaatcacacactaaacaaacataaatctttttttctcnaacgcgcggaaggattgcacgtcaatatat

SEQ ID NO: 16630 - DNA, 101 bp, rice(Oryza sativa)
  misc_feature (71): n=a or g
aaatatcttaattcagaattaggaagttgcctgtttcagccaattggcaattcatgaatagaaacctgatntctgcagtctgcacccaagcagaggcgaaa

SEQ ID NO: 16631 - DNA, 101 bp, rice(Oryza sativa)
  misc_feature (71): n=t or g
attaatctgctctcttatgtgtgcttcccaagtttgagaaattgcccaatttgttcaatacctgcaggatnccatatggaatagcaatagacactgacagt

SEQ ID NO: 16632 - DNA, 101 bp, rice(Oryza sativa)
  misc_feature (71): n=a or g
tttgggtaagctagcttcaggattaaggaaaatgtatcctagtttctatgttttctgagccaatatagtcntgttagaatcggactcagatatgttttggt

SEQ ID NO: 16633 - DNA, 101 bp, rice(Oryza sativa)
  misc_feature (71): n=t or c
actgcacaaaacattctctcttgctggaaacaacccctaccctcaacatgaacagccagcaacttcacatngctcggtttattttcctcctccaatccctt

SEQ ID NO: 16634 - DNA, 101 bp, rice(Oryza sativa)
  misc_feature (71): n=t or c
accactcattcaatgagaggcacccaattattttcttggcaacttttctccactaaacaatatagaaatanttatattttaaaatagattatgtgcttttg

SEQ ID NO: 16635 - DNA, 101 bp, rice(Oryza sativa)
  misc_feature (71): n=t or c
tatgcagagttgctgcgataaagaatgacgcatgggtctatgcatgctcacataatgatgggagaagagantgaatactgagtgaaccagtagatcggcag

SEQ ID NO: 16636 - DNA, 101 bp, rice(Oryza sativa)
  misc_feature (71): n=t or c
aaaagtgtgatcaacgtcgcaccgtacagacccaaaaaaactgatattcgcaactcttcactatatatacngtgtacctatgtgcaggcttgcaggagctg

SEQ ID NO: 16637 - DNA, 101 bp, rice(Oryza sativa)
  misc_feature (71): n=a or g
gaatcacacaaataattagaattttcttcctattctagcaactaggggatgtcctcttgcaattttgcgcngagctatataattcacgtagagttaggttg

SEQ ID NO: 16638 - DNA, 101 bp, rice(Oryza sativa)
  misc_feature (71): n=a or g
tgaccagctatctaaatgctactatgttcgttacttgtggttgggagcgaatccctcccgcacgggaaacngagcggtccattagtgcgtgattaattaaa

SEQ ID NO: 16639 - DNA, 101 bp, rice(Oryza sativa)
  misc_feature (71): n=a or c
acaatacagaaagacactagcagccccattaaaacatcaagaatactacgctagtctgtcgttttctgatntttgagacgacatgaggatcttggactatg

SEQ ID NO: 16640 - DNA, 101 bp, rice(Oryza sativa)
  misc_feature (71): n=t or g
gattctgatagaaatgtaagtgtaaaacaaaatattgaaaaagagaggagaaatatatgaatgatcgttanattaggtcataggaaaaacacaagaattga

SEQ ID NO: 16641 - DNA, 101 bp, rice(Oryza sativa)
  misc_feature (71): n=t or g
tgtggctaggttgtacctggtggtccaattcaggactgtagccttgctctgaaatagatgggcatcaaganaaccattttccatgtgttcatacacaagta

SEQ ID NO: 16642 - DNA, 101 bp, rice(Oryza sativa)
  misc_feature (71): n=t or c
taggcggagaggtcaaggtgggaccgtggggtaggtgtacaaatgaagagtacaaaattaagactacaaangaattagaaaattatagaaaaaaagtgtaa

SEQ ID NO: 16643 - DNA, 101 bp, rice(Oryza sativa)
  misc_feature (71): n=a or g
gagaaagcagacaaaaaataatggatagatcatgtatcactacgtacgaaaacggttagtagcttccacantattcccaacataacatgtagagtcctacg

SEQ ID NO: 16644 - DNA, 101 bp, rice(Oryza sativa)
  misc_feature (71): n=a or g
atgcaatgagacatcctagtattatagatgtggacatagcagtatctcatcttatctcatctcatacaaanttgctatattttgagatggaaggagtatat

SEQ ID NO: 16645 - DNA, 101 bp, rice(Oryza sativa)
  misc_feature (71): n=a or g
atggtctcaaagtacataccaccgggagaaaatcaaagaaaactgaaatccgagagctaccgtcatatatnggatgagccatacctatacagggtctgctc

SEQ ID NO: 16646 - DNA, 101 bp, rice(Oryza sativa)
  misc_feature (71): n=t or c
ccccggagtagcccaatggctgccaaatgaacgacatctacaagattatcaagattatcaacaataagaantaattagcaaccttaagtgaggccccaaag

SEQ ID NO: 16647 - DNA, 101 bp, rice(Oryza sativa)
  misc_feature (71): n=a or g
cattctcacgggaaggggtctccactccccactgaccatggaatcgcccccacgacacatacttagtgctncatcagtacattagatctgctaagtcgtgc

SEQ ID NO: 16648 - DNA, 101 bp, rice(Oryza sativa)
  misc_feature (71): n=a or c
taatctgagcttatatccaaatggtaaagaactgtcaagagctttagtggaaagctgaggtctttcttaanaatggagattccatgagcaatttttctaaa

SEQ ID NO: 16649 - DNA, 101 bp, rice(Oryza sativa)
  misc_feature (71): n=a or g
gagaggatgggaggagaggagatgagagaaagagtgatggactgatgagagagattaataaaatgagagantaggtgagagatgagaggaggagtaatgga

SEQ ID NO: 16650 - DNA, 101 bp, rice(Oryza sativa)
  misc_feature (71): n=a or c
ggttaagctcgctggagaagaagaggaggaggagggtgaaccggggtaataatggtggtccggaccggttngagcggtcggcggttgggtcggaccgggag

SEQ ID NO: 16651 - DNA, 101 bp, rice(Oryza sativa)
  misc_feature (71): n=a or g
tttaggaattgctaactagcgctaaaaaaaagcgcgaaattttttaagatttctgtacggtaaaaaaacangcgctaaaaattttaggaattgctaactag

SEQ ID NO: 16652 - DNA, 101 bp, rice(Oryza sativa)
  misc_feature (71): n=t or g
gggactaaactttttttttttttggagattggcactaaactgctacagctcctgccggttgccttgcatgngctcgctagctagctgctgctactgctttg

SEQ ID NO: 16653 - DNA, 101 bp, rice(Oryza sativa)
  misc_feature (71): n=t or c
gttaatgtagcatcaaatctaaaccattaataaaaactgacggtcaaaattatatgtagtagttaacttanagttataagtataactacacctgatctgaa

SEQ ID NO: 16654 - DNA, 101 bp, rice(Oryza sativa)
  misc_feature (71): n=t or c
tcagatcagtatatattgcatgcatgcaagtgtaagtggtgtttctgggggtaagaacctgcgccgccgcngccgccgccgccgctgccgctgccgcggtt

SEQ ID NO: 16655 - DNA, 101 bp, rice(Oryza sativa)
  misc_feature (71): n=t or c
acatgatagtttcaaaatttaggacaacattaaagagcaaaaacaattagaaattcccaaccatgaaaatnaactttttaaaaccaatttttcaacaaaat

SEQ ID NO: 16656 - DNA, 101 bp, rice(Oryza sativa)
  misc_feature (71): n=t or c
cccctccctctgcggcagagaataagagaaaaggaaaagagagaagattgctgactagcatggtttacccnatatttttttctcgcttacatgtgggtccc

SEQ ID NO: 16657 - DNA, 101 bp, rice(Oryza sativa)
  misc_feature (71): n=a or g
atcaacggagctgatgggctggcccatctagcccagtcctttctcttggacttcgcttgatggatcctcanctcagtggcatggtggttgggcccaattgt

SEQ ID NO: 16658 - DNA, 101 bp, rice(Oryza sativa)
  misc_feature (71): n=t or c
cctagccacctacaagctaagctgtttgttcatcactgactcaatcacttggtaagagcaaccacagtgtntggttcggccattgtattgattgaagtcga

SEQ ID NO: 16659 - DNA, 101 bp, rice(Oryza sativa)
  misc_feature (71): n=a or c
agctaccaaataattgtggattgatcaacaagcatttgcatcttgaaggaaattattggcgcacccaaagnacaattcatagcatacgatgctgcttgctg

SEQ ID NO: 16660 - DNA, 101 bp, rice(Oryza sativa)
  misc_feature (71): n=a or c
ggaggattttttttaaaaaaaaatgttatggaaggaggaattgttacttaattgcatgtatatgtgcgtgncttacattataaaacattgaaaaagatagt

SEQ ID NO: 16661 - DNA, 101 bp, rice(Oryza sativa)
  misc_feature (71): n=t or c
gcccagggctcttcactgcgttgccctgcgctttaactttcacaatatgccatctaattcacactactttnaagatatgccacctaattcgtgctattttc

SEQ ID NO: 16662 - DNA, 101 bp, rice(Oryza sativa)
  misc_feature (71): n=a or g
atccagatttactatattgtatattgtatagtatcttacttaatcgtaggttggtttatttaaaacgaagnaaatatattttaagataaataaagtagtac

SEQ ID NO: 16663 - DNA, 101 bp, rice(Oryza sativa)
  misc_feature (71): n=a or g
cagtggccccctttgatagggaagttcatattgtggatgccgaagggcaagaaagagcaagacccacgccnaaacctgctccgcatggcaaggtgatgcag

SEQ ID NO: 16664 - DNA, 101 bp, rice(Oryza sativa)
  misc_feature (71): n=a or c
tttttctaagctatctattggctttatactatatatatactatacagtccattctataagcaattatctangattcggtttatcatccaaaagaaaacgta

SEQ ID NO: 16665 - DNA, 101 bp, rice(Oryza sativa)
  misc_feature (71): n=t or c
ggttagcagtttccttttttttatatatatatttggagacatgtcgcaaatcagagtaaaaaaacagattngctaaaaatatgtcgccagtttttgtcaaa

SEQ ID NO: 16666 - DNA, 101 bp, rice(Oryza sativa)
  misc_feature (71): n=a or g
attagttttagtagagtgctactgaaaatacactatgttacaccaagatgcattgttttaacattgtactnctatactccatttcagtagtagaaaaaata

SEQ ID NO: 16667 - DNA, 101 bp, rice(Oryza sativa)
  misc_feature (71): n=t or c
cctagcggacaactttagatgcaattattgcagcaacgtgcagataaattcgacgattgtacgaagtgagnataactcaactgattaaattcattatgatg

SEQ ID NO: 16668 - DNA, 101 bp, rice(Oryza sativa)
  misc_feature (71): n=a or g
gagagacgagacctactacatgtccgtgctgatcgaggtgtcgtgcgcttgcaccccggatcacctcgtcnccgtcaggcgcgcctacctcgccctcttcg

SEQ ID NO: 16669 - DNA, 101 bp, rice(Oryza sativa)
  misc_feature (71): n=a or g
catgtgattctggcgcatttaactcaataaaagaaaggaagaagttcaaattacccgcttaaactattgcnatggtccaaataattcgttaaactagaaaa

SEQ ID NO: 16670 - DNA, 101 bp, rice(Oryza sativa)
  misc_feature (71): n=t or c
aatttaatcaaagaatcactgagtagccgcagtttttagataaatgaatacacagatcttgtaaccagagnatattgaaaatatagattttttaagattaa

SEQ ID NO: 16671 - DNA, 101 bp, rice(Oryza sativa)
  misc_feature (71): n=a or g
agaggagggcagtgagccagcattgacctttttttttatatataattagcagcagggagcttccagagacnaggaagacggttggggtaggggcactgtaa

SEQ ID NO: 16672 - DNA, 101 bp, rice(Oryza sativa)
  misc_feature (71): n=t or c
aataattcaccacaccaaatatctctttcagattttgtcttttcagccacagtcttattttactgtataantatttataaccacttcttttgaatacccat

SEQ ID NO: 16673 - DNA, 101 bp, rice(Oryza sativa)
  misc_feature (71): n=t or c
aactaaacggggccttaccatatccttaagaacatctccgaaatattaggttaacatatcttaagattaangaagtcaccatgggtctatgtctactactg

SEQ ID NO: 16674 - DNA, 101 bp, rice(Oryza sativa)
  misc_feature (71): n=a or c
agaaaaaaaattgaaagttcaattaatttctgcaccttaatcaaacaacggaaatgattggaaaaggaaanaaaatgaatgggcatataatggagagtctc

SEQ ID NO: 16675 - DNA, 101 bp, rice(Oryza sativa)
  misc_feature (71): n=a or g
cttaagagatattttggctggttcggctcagtgtcggatatttaaataaagtgatatggatattattatcnatgtcggtctgttaaggaaccggtatatat

SEQ ID NO: 16676 - DNA, 101 bp, rice(Oryza sativa)
  misc_feature (71): n=t or c
atagcaaggataataacagtagagctcacttcctactactcccttcgtattcgtattttaatatatgacgncgttgatttttcgactaacgtttgaccact

SEQ ID NO: 16677 - DNA, 101 bp, rice(Oryza sativa)
  misc_feature (71): n=t or c
caagtttcctaaagataaaaggaaaattacaaaatcttgtcgagttaatatatagaattaaactgctatgncgtggtcttcacgattcctctttgaactcg

SEQ ID NO: 16678 - DNA, 101 bp, rice(Oryza sativa)
  misc_feature (71): n=a or g
tatcatagaacaaaataaaagttttgccatggattaaaagaaccatagaccaaaagaagcacattttactncacctggagcttcttgctcctggtatttct

SEQ ID NO: 16679 - DNA, 101 bp, rice(Oryza sativa)
  misc_feature (71): n=t or c
taaacatacatgctgaggcagcagcccgagaatataagcagaaagtaagcagtttttttaagaattgaaanttgatagttttaaatgatactaatgaagta

SEQ ID NO: 16680 - DNA, 101 bp, rice(Oryza sativa)
  misc_feature (71): n=a or g
aatattattaaatgaatacatgcaagcatggagtggagagagaaaagagagagagagtagcaatagatatncagtagcaagtcactggcaaaggtggcatg

SEQ ID NO: 16681 - DNA, 101 bp, rice(Oryza sativa)
  misc_feature (71): n=t or c
accattcatttgctgacaattggcttcggccttgcttatgtttatatttaccaatcaaaatatgaattttnaattttaaatttaaagttgattttaaggtt

SEQ ID NO: 16682 - DNA, 101 bp, rice(Oryza sativa)
  misc_feature (71): n=a or g
cggcaggaggatgcagctcacaattttgcaagcaatatacacatgttatgcttaactcatttatcaaaaanaaaattgaaacattttaagaagccaaatac

SEQ ID NO: 16683 - DNA, 101 bp, rice(Oryza sativa)
  misc_feature (71): n=a or g
aacctgctcttaaaagtaggggtacactgctcattcagattaaaaagtagaggtaaaactgcaaatcctanaaagtagtaggagtaaaacagcaattggct

SEQ ID NO: 16684 - DNA, 101 bp, rice(Oryza sativa)
  misc_feature (71): n=a or c
ccgccgccgcttcgccatcgatctatcagtagatagagaagagagaaggtcagctcgatcgttgctagctncgaccgcgagcggggatcggatgcgtgggg

SEQ ID NO: 16685 - DNA, 101 bp, rice(Oryza sativa)
  misc_feature (71): n=t or c
gtggctaggatggtagggggtgtctgcgaagtgtagaagagacgtgcgaaccacgcaggtggcgtagatgnggcggcgccggttgtcgtcgcggcggatgg

SEQ ID NO: 16686 - DNA, 101 bp, rice(Oryza sativa)
  misc_feature (71): n=t or c
catagatctgtcagtaccataaggttgaacttttataactgagtagctgacataaacaaattaaactaaanaggtacctgtaaaatgtcaaaggctgcccc

SEQ ID NO: 16687 - DNA, 101 bp, rice(Oryza sativa)
  misc_feature (71): n=a or g
ttgcggcagtgagctcaccattagaatccaccatctttcttggagggagaatcgaggagcaagaagagcgnggagcagcgctaaccttggagcttgtcttt

SEQ ID NO: 16688 - DNA, 101 bp, rice(Oryza sativa)
  misc_feature (71): n=a or g
tttttagagaagggtttttttttacctgtcttctacatccagttagatatatgtaggttttttaaatcaanaatttagcctatcggaaacttagccctcaa

SEQ ID NO: 16689 - DNA, 101 bp, rice(Oryza sativa)
  misc_feature (71): n=a or g
ctttcgttgtacataaatttgtctgatccgtattggctgccgctgaagtgcattgttcagtactccctcanactcataatatggcaatctagaattagatg

SEQ ID NO: 16690 - DNA, 101 bp, rice(Oryza sativa)
  misc_feature (71): n=t or c
ggaaaagtgtcatagcaagtaaactaatgtaggtgcggagatatgatcgttgttgattagagtctggtaanctgcattaattattttggtaattactgata

SEQ ID NO: 16691 - DNA, 101 bp, rice(Oryza sativa)
  misc_feature (71): n=t or c
tcgattcccagatggtggaatcgcaattgctcccatttcagtttgttttcacgctactcctttagtttgtnttcatgttactcctttaataccagataaaa

SEQ ID NO: 16692 - DNA, 101 bp, rice(Oryza sativa)
  misc_feature (71): n=t or c
caacgaatctcttttgtttttcctcgcaaaaataattgaaaaaacggagcaagattttggcagatatgtcnaacgggtttcttcaaggttcaagtactggc

SEQ ID NO: 16693 - DNA, 101 bp, rice(Oryza sativa)
  misc_feature (71): n=a or c
agtaagtttcacgaatttaaggatccaacggtttacatcgtttggagctgaaatcaaatgctctatgtttntccggtgatgtggcttcctaattttgcgag

SEQ ID NO: 16694 - DNA, 101 bp, rice(Oryza sativa)
  misc_feature (71): n=a or c
gtaagaagatcctttaacagaggcatagggaaaacaaagaaatttacacatcacttcatttccaagaggtntgacctctttttagtttcctttgaaatcca

SEQ ID NO: 16695 - DNA, 101 bp, rice(Oryza sativa)
  misc_feature (71): n=a or g
acattgagctggtcatagcctcggttcatggtttgattggttcaaccggttgaaccgccagctcaacacanttcatatggtctgagatatgcactattatc

SEQ ID NO: 16696 - DNA, 101 bp, rice(Oryza sativa)
  misc_feature (71): n=t or c
aacaccttggtctccaagtaagactcagagacatcggacccaatacggtacaatagaaactctatcctctncgagtaggactttgtaaatcacctgacccg

SEQ ID NO: 16697 - DNA, 101 bp, rice(Oryza sativa)
  misc_feature (71): n=t or c
aatgattgctcccaggggcggatccaggaataaaaaaaaattagggagctcaattatgcagtttcttcaanctccagccatatagagacctttagtttatc

SEQ ID NO: 16698 - DNA, 101 bp, rice(Oryza sativa)
  misc_feature (71): n=a or c
taattaacgtatcggtctctacctttgtacttgccgtaacgccgctgccgcgacctcccggatgatgcctntagagtgcagctgcgagcaaatcgactccc

SEQ ID NO: 16699 - DNA, 101 bp, rice(Oryza sativa)
  misc_feature (71): n=t or c
ggcaagccggcagatttgtatacatcgcgtccagacctctacatgtccttaaaacccagcatgtgtcgtanccccgaggccgaatgagacgcagccacagc

SEQ ID NO: 16700 - DNA, 101 bp, rice(Oryza sativa)
  misc_feature (71): n=a or g
accaaaaggtaggcatgaactagctatcgtcggatgcatggttcaaacgtcaagctcaccaaaatcttganaagctagagatggttaaggacgtgaacagt

SEQ ID NO: 16701 - DNA, 101 bp, rice(Oryza sativa)
  misc_feature (71): n=t or g
aaaaatgtggttctataattaatttagagggctaaattgaacaagtgcgtaagttcagacggataattttntattattattattattattgctgctgctgc

SEQ ID NO: 16702 - DNA, 101 bp, rice(Oryza sativa)
  misc_feature (71): n=a or g
cttggctagttgtagaaaagctggtggaacgtgaatgtggccattttgtaccactccagtatttactactnctacatacatcctttcttgtggacatgcag

SEQ ID NO: 16703 - DNA, 101 bp, rice(Oryza sativa)
  misc_feature (71): n=a or g
acacacccatcagaatgcagatttcagaacccctaacacgccatatgtatttcagatagaaaaatacattntacagattacaaagggatatcaatttcctt

SEQ ID NO: 16704 - DNA, 101 bp, rice(Oryza sativa)
  misc_feature (71): n=a or g
agcaccttactttaccactgcgggtgctcttaacttcctgtcacacatacctcggtttttttttctctacnatcacggatcaccggataagaactagtaaa

SEQ ID NO: 16705 - DNA, 101 bp, rice(Oryza sativa)
  misc_feature (71): n=t or c
gtttctatagttatgttgtggagccccgagttgattttctttcttttatgctgtagatttgtgatggatanatcatatgcaagtagcaaccgtgcaagtgt

SEQ ID NO: 16706 - DNA, 101 bp, rice(Oryza sativa)
  misc_feature (71): n=t or c
gtgggcctggccggcccatctgttagccgatatggcaatatccctttccatttctccgatacctccactcnactctgctcctccccaatccaaacccgctc

SEQ ID NO: 16707 - DNA, 101 bp, rice(Oryza sativa)
  misc_feature (71): n=a or g
tgcattttctgtcttaaaatgctttctttttcgctgaaatagtagccactgatgcaatacaaggatcatantggctccctggttctcacttcctagtgggg

SEQ ID NO: 16708 - DNA, 101 bp, rice(Oryza sativa)
  misc_feature (71): n=t or g
tcgtgcggtgaccccaccttgtagctcttatacagcataattggctgcttatgtggcttaagtgctaaaangttggggcacatgttccttgtatgcggcct

SEQ ID NO: 16709 - DNA, 101 bp, rice(Oryza sativa)
  misc_feature (71): n=a or g
gacgatctcttcgccatgatctctcgcgttggtgcaggtgcaggtgaggtgacgaggaggaggagaggcancgaagtggagccccggaggttttgtaattt

SEQ ID NO: 16710 - DNA, 101 bp, rice(Oryza sativa)
  misc_feature (71): n=a or c
cttttctaaggttttgttggtatcaactaaattatttcatcgatttagattagctaaggtgttcatcaccntgaaaatcaattaaagacttgattgtttag

SEQ ID NO: 16711 - DNA, 101 bp, rice(Oryza sativa)
  misc_feature (71): n=t or c
ttcctttgctccaaatattcctttgatctttgaaaattcatatctcttcaaccgtaagtccgattgacttngttcaacttccacattttttctaaaattga

SEQ ID NO: 16712 - DNA, 101 bp, rice(Oryza sativa)
  misc_feature (71): n=a or g
ggccggcgacgagatcgggacaacggcgaggtatgggtcaacaatggcaacggctttccggcgatgagcgncggcaacagaagggtgtacgggcttcggct

SEQ ID NO: 16713 - DNA, 101 bp, rice(Oryza sativa)
  misc_feature (71): n=t or g
ttgggaactaaacaaggccttagttgttcaagccgaggatggatatatatatagagtccacaaaatatatnactttgtttgagtactttgattttcagctc

SEQ ID NO: 16714 - DNA, 101 bp, rice(Oryza sativa)
  misc_feature (71): n=a or g
aatgatggtaaatgctaaaagagggatagggtaacgagctagcaagtagtgtgatagcggttgatgaaacnataaaaactatgaataaacctctcttacga

SEQ ID NO: 16715 - DNA, 101 bp, rice(Oryza sativa)
  misc_feature (71): n=a or g
gaggacgcgtgtttctggaaatttgcttatatgcttgtgtggttagattgacggggacgtagaattctctngggttagaagggtgggttgtatgacatccc

SEQ ID NO: 16716 - DNA, 101 bp, rice(Oryza sativa)
  misc_feature (71): n=t or c
ttgcaccaccacctccaatgctgcctccaggcggaatgatggggcaggcttttgatcctactggttatggngcaatgggaaggatgggtgctgggtttggt

SEQ ID NO: 16717 - DNA, 101 bp, rice(Oryza sativa)
  misc_feature (71): n=a or g
atacttcatccttatcaaaatccttgagacttggttcaacaattctgagcgcttgatccttttcatatagnccccataccttttaatgaacataggttcag

SEQ ID NO: 16718 - DNA, 101 bp, rice(Oryza sativa)
  misc_feature (71): n=t or c
cccacattcatatagatgttaatgaatctggacataacatctgtatgaatgtgggatatatgtctagattnattaatatctatatgaatgtgggcaatgct

SEQ ID NO: 16719 - DNA, 101 bp, rice(Oryza sativa)
  misc_feature (71): n=t or c
ctcgggtgtaaatatcaccaggcatgcctgcttgtatgagacttccccggcttatgtgactgatcagccgnggttcctgaactctgctgttaggggcacaa

SEQ ID NO: 16720 - DNA, 101 bp, rice(Oryza sativa)
  misc_feature (71): n=a or g
ggcggcatgggtggagttagtctggggggctaaggtctctcctcgctgtaaaatgttcatgtacctggcgnctcggggcagctgcttgacctccgacaact

SEQ ID NO: 16721 - DNA, 101 bp, rice(Oryza sativa)
  misc_feature (71): n=t or g
tgtacgatcaactatacacagagagctacagtgtttgtgccatagaactctttggaccgttggatcagacnttgcatgattgggactgggtctactgggag

SEQ ID NO: 16722 - DNA, 101 bp, rice(Oryza sativa)
  misc_feature (71): n=t or c
ctggccaggctcacacttgctgagctttcatgctgcaggccaacagctaatacggaaccctggtttagttnccaacttttctatcacatcaaaacttttct

SEQ ID NO: 16723 - DNA, 101 bp, rice(Oryza sativa)
  misc_feature (71): n=t or c
cacttttactagcggacgacataagcatcggctagtgaaaatcgatttttactggcgtgcgtttaagacgnccgtttgtgaaaatcaattttagaaaaata

SEQ ID NO: 16724 - DNA, 101 bp, rice(Oryza sativa)
  misc_feature (71): n=t or c
tctgaaccattccatatttcatttgcttgcatgcgttttctaaacgtagtattgaacgtgattataattangttgagaagactaggaatatgcccgtgcta

SEQ ID NO: 16725 - DNA, 101 bp, rice(Oryza sativa)
  misc_feature (71): n=a or g
tcttgctactagtctactagaccctacgtacgcacaaaataccaaaattttgaaatttaggatttttattnaagagtaaaatgcatggagggtcacttaac

SEQ ID NO: 16726 - DNA, 101 bp, rice(Oryza sativa)
  misc_feature (71): n=a or g
atcaccgggaattttactaatagcccaagggctggccggggccagccactctagattcactataggaccangggcaataaagaaatttcttcttgtatacc

SEQ ID NO: 16727 - DNA, 101 bp, rice(Oryza sativa)
  misc_feature (71): n=t or g
ctcgtcttcgttacaaaatagtccccatagttcaaaataagaagtcgatcaaaacaaatcggcccaggtgnctcccaaaatagtgtcccaaaataatatgg

SEQ ID NO: 16728 - DNA, 101 bp, rice(Oryza sativa)
  misc_feature (71): n=a or g
aattttctccacttttgttcattattgttcacttcttttttatatatgcggtgtacatttcgtgcgtaccncacggtatacgtggtctaccattgaaccgt

SEQ ID NO: 16729 - DNA, 101 bp, rice(Oryza sativa)
  misc_feature (71): n=a or g
gtgacgggcattaacttagtgaccgattgagatgagggtgcacacaactgaagacaaagtgtgtagaaaanactggcttggcctaggagaggcgggacgtt

SEQ ID NO: 16730 - DNA, 101 bp, rice(Oryza sativa)
  misc_feature (71): n=a or g
gaaattgttggtagaaactaattaatcaagcacgcaatatgcacaatgataggtccaattcggagcccacntatataacacggctataacactgtacaacg

SEQ ID NO: 16731 - DNA, 101 bp, rice(Oryza sativa)
  misc_feature (71): n=a or g
agagagcaaaaggagaggagatgagacgactacgattggaggggaaataaaatcagacttgggtctgtttngaagagtttctatctaatataagcttcttc

SEQ ID NO: 16732 - DNA, 101 bp, rice(Oryza sativa)
  misc_feature (71): n=t or c
cggtttatgtgtcgcctccctgggccggccggcataagccgtgcgggacgcaacggaaggaataagttcancggaggtccctcaatttaacagcgagattt

SEQ ID NO: 16733 - DNA, 101 bp, rice(Oryza sativa)
  misc_feature (71): n=a or g
aagaaatgaggttttggcccaaagcaaagcgtatacgatccaaaaatgattttacccattgcaatgcacgngtatttttctagtcgattcaggatatttgc

SEQ ID NO: 16734 - DNA, 101 bp, rice(Oryza sativa)
  misc_feature (71): n=a or g
gtatatttgattttatccgcggtagagtttttatcctttgcttttttttctagatacgttatatatagttnaacatatacagtcatactccatgctattac

SEQ ID NO: 16735 - DNA, 101 bp, rice(Oryza sativa)
  misc_feature (71): n=t or c
tgttcaaaaacagtttagtaaaggtgaacctgtcaattttctcattaagaataattatggttatctgaaantaacaaaatagtaaaaaaaaaaaagtgaat

SEQ ID NO: 16736 - DNA, 101 bp, rice(Oryza sativa)
  misc_feature (71): n=t or c
acgagccgaggaaagcttggcaaagaacaggcttggattggctcggtttgattaactaaacgaactaaaanagcagcttggctcggctcgtttcaaagctc

SEQ ID NO: 16737 - DNA, 101 bp, rice(Oryza sativa)
  misc_feature (71): n=t or c
ctatttaaaataacattatgattatagtgatgtattggctaagacaaaagatcaaactaaaccgagacagncacaagtaaatcgatgtgtcacaaaacacg

SEQ ID NO: 16738 - DNA, 101 bp, rice(Oryza sativa)
  misc_feature (71): n=a or g
agcacgccgccgcctcgtcgtcctcgctggcggaagaaagagaggaagagatgaacggagagagagagagnggaagaagaacaatagagaaagagggattg

SEQ ID NO: 16739 - DNA, 101 bp, rice(Oryza sativa)
  misc_feature (71): n=t or c
atgtaattatagtatttctgttggcgtctttttggctaacagtagtagtgaagttcccactccgcgtcggncggccgccatgaggttttccgaagctttga

SEQ ID NO: 16740 - DNA, 101 bp, rice(Oryza sativa)
  misc_feature (71): n=a or g
cctagtgccgtgctgtgctaccactgtaaaccctaaaaaaaaatgccacgctgtaacaaagttgttaccgnttacttgaactgagtaaaagaaaagggaat

SEQ ID NO: 16741 - DNA, 101 bp, rice(Oryza sativa)
  misc_feature (71): n=a or g
ctcgtcggcgtgggatgtcgcggagtggcctagatgggactgcaactattacaactactgcggcccgaacngctactgcgacaacacagcgagggcgcctg

SEQ ID NO: 16742 - DNA, 101 bp, rice(Oryza sativa)
  misc_feature (71): n=a or g
tcaagacctcaagggtcttaacagttgaactaactcggttatgatttggacacttggtgattaactactgntaatagtactacttattgttattggcttgt

SEQ ID NO: 16743 - DNA, 101 bp, rice(Oryza sativa)
  misc_feature (71): n=a or g
ctcctccgccgccatcccttttcctccctctaactccctaattccgccgagcttcttcgccgcaaccaccnttcgtcgtccaagtttcatcgtctgttaga

SEQ ID NO: 16744 - DNA, 101 bp, rice(Oryza sativa)
  misc_feature (71): n=t or g
taataacagcatgagtcagacagacagattcagaggtccaatgtgtgaaaatgaaatctagcaaagcaagnaaaaggggatgtttattgataaaccctgtt

SEQ ID NO: 16745 - DNA, 101 bp, rice(Oryza sativa)
  misc_feature (71): n=t or c
aaatacagattttatattgaagttattacaaaattaatataaattccaaagtataaatccctaggactaancgtatgttagagctataaacgttgtagttt

SEQ ID NO: 16746 - DNA, 101 bp, rice(Oryza sativa)
  misc_feature (71): n=t or c
gctatagtgaagtgggaatcatgcctattcacagcatctaccctcgggcttattccgttagatttgcctcnaattttccattgtcctcacaagacagcagg

SEQ ID NO: 16747 - DNA, 101 bp, rice(Oryza sativa)
  misc_feature (71): n=t or c
ttcttgtaggggcaccggaccttgcctataatagcccgcgctccagaactacgcaacccagcccatccganaagcaaacccatttacacatagcacctcac

SEQ ID NO: 16748 - DNA, 101 bp, rice(Oryza sativa)
  misc_feature (71): n=a or g
ggggtttcatgcggccttccatgatccactagtcgttctcatgctagattagcccctttgtttgacattcntatggattttacaatctgttgggaatgcat

SEQ ID NO: 16749 - DNA, 101 bp, rice(Oryza sativa)
  misc_feature (71): n=t or c
agcaagtacaaaatgactatgagaatgagcctgatctgtgggtgcaggagaggttgtgagagcgcacacanatatataggagcagccggctcgctggcggg

SEQ ID NO: 16750 - DNA, 101 bp, rice(Oryza sativa)
  misc_feature (71): n=a or g
gacccactgtacaaccatgattcatcacgaaacctaagtccgtgatcaaatgagcaaccctttcaaatcgnctatccaggatagcaaccagccgtatatca

SEQ ID NO: 16751 - DNA, 101 bp, rice(Oryza sativa)
  misc_feature (71): n=t or c
ctgctgctgctgttgttgctaatttattaatctcaggtttctgcttgcagcactgctcgatgcactgagcntatacttctagatcgatataaacaaatgaa

SEQ ID NO: 16752 - DNA, 101 bp, rice(Oryza sativa)
  misc_feature (71): n=t or g
tggaagctagcgtgtgagcaggaggagcggccacctacaccagtatcggtgcggatgtcttggagcggcangtgcatggaggcgacgagcggcttgacgcc

SEQ ID NO: 16753 - DNA, 101 bp, rice(Oryza sativa)
  misc_feature (71): n=t or c
agcaggtgcttagccaaacaccgatggaccgatcgaggccataagaagtcataagttgctacggatcaacnttattagcatcgataaaagcaaagaaagaa

SEQ ID NO: 16754 - DNA, 101 bp, rice(Oryza sativa)
  misc_feature (71): n=t or c
acatggctatccccttgcagcctaatccggccgccgctaaataagtccacttatcatctctagcctttatngacttttaattggtatcactaaatcacaat

SEQ ID NO: 16755 - DNA, 101 bp, rice(Oryza sativa)
  misc_feature (71): n=a or g
agctattaatctggatgaccgtgcgtccagattcatagccaaaggtgttacattttgggacggagatagtngtaaatgatatttacataaagccagaatta

SEQ ID NO: 16756 - DNA, 101 bp, rice(Oryza sativa)
  misc_feature (71): n=a or g
atcaataggatgcaaccaaatgtagacgtctcacatgcaacaaagatattttttcgatatacaaggaaacncaactctggaaattagttataagtctacta

SEQ ID NO: 16757 - DNA, 101 bp, rice(Oryza sativa)
  misc_feature (71): n=a or g
tagtgctaaccaacgactatcctttttaccaaaaacaatatagtgtgtatcaactcgttacccttcttagngcatgagcaatgtatatggcataagtaggc

SEQ ID NO: 16758 - DNA, 101 bp, rice(Oryza sativa)
  misc_feature (71): n=t or c
ccttctcatcctgctgctgctgctgctgctgctgggagctcttccctttccatgacgcctttatcggtatnggtgcctccaagctctgcaccttcctacca

SEQ ID NO: 16759 - DNA, 101 bp, rice(Oryza sativa)
  misc_feature (71): n=t or c
tcacatgtttgatttgtttgcgtgctatggaaatcagcatttggtcatggataaagggaccatataatgcnttgtttgaacttagttcatgtatttttggt

SEQ ID NO: 16760 - DNA, 101 bp, rice(Oryza sativa)
  misc_feature (71): n=t or g
gtgccgccagctccgccaagacttggctgcacattagataagaacaaatcaagaaacaattgccattggtngaaaatatttttttttaccaagtcactgga

SEQ ID NO: 16761 - DNA, 101 bp, rice(Oryza sativa)
  misc_feature (71): n=t or c
aaattttaaataggtaccattgatgggacatgtaaaaatactgataagttttaaatagcaaaatttattanaggacactaaaaatttatataatttacttg

SEQ ID NO: 16762 - DNA, 101 bp, rice(Oryza sativa)
  misc_feature (71): n=t or c
tggtcatatctctcatacacattaaaaaaacatctctcacatacacacaacgtattaaatttgtagtccgnttttattctctctcctatgttatctcctcc

SEQ ID NO: 16763 - DNA, 101 bp, rice(Oryza sativa)
  misc_feature (71): n=a or g
atcctatgaggaaggacatcgtacggaactcttggacaaatccttcggtaccaaacaagtactcaggcttntagcgcggcatctaagacaagtgaaaggag

SEQ ID NO: 16764 - DNA, 101 bp, rice(Oryza sativa)
  misc_feature (71): n=a or g
tttattgtcttttgggtaaatttcttcatccaaggtcccattaaattctgcatcccatttggcatttcacnatcaaacacacattttactgtactccaaac

SEQ ID NO: 16765 - DNA, 101 bp, rice(Oryza sativa)
  misc_feature (71): n=a or c
taaaatatatactgtaggtagtaaaaatttaaattaaagttgatggatgcgataagtagcacactaaaatntcttatattatgggataaatagaatgaaaa

SEQ ID NO: 16766 - DNA, 101 bp, rice(Oryza sativa)
  misc_feature (71): n=a or g
actatgtaaataccggaatcgcgacatcaaacgtcgacaaacatatattcacagtcatattttttgttacntcatttagaaattgaattttattttatatg

SEQ ID NO: 16767 - DNA, 101 bp, rice(Oryza sativa)
  misc_feature (71): n=a or c
ttttaatttcaagactctgctctccagtgaaaaggttcctcacacaacatatcagaaaatcaagactaggnacaaaacctgcgtaagaaaatggaatactc

SEQ ID NO: 16768 - DNA, 101 bp, rice(Oryza sativa)
  misc_feature (71): n=t or c
caataaagcaagcaagcacgaactcccaatccgaaacttacctcgatgagctccgggtccggggggcgggnggccatgcctatgccctgcagtccgcctgg

SEQ ID NO: 16769 - DNA, 101 bp, rice(Oryza sativa)
  misc_feature (71): n=t or g
aatgttgcatggtctgcaggttttgcatagccgattagccgatggtggtgtagctcaattcatttgatttnattttattttattgaattttgtgatatgat

SEQ ID NO: 16770 - DNA, 101 bp, rice(Oryza sativa)
  misc_feature (71): n=a or g
tttcttaaagagggcagctagcccacgggataccgtggaaaagtgaagtcacggaacaattttaatgtgtnattaattagcgtacaccatactgtaccaca

SEQ ID NO: 16771 - DNA, 101 bp, rice(Oryza sativa)
  misc_feature (71): n=a or g
gccaactgccaagtgcagaaactcattgttaaaattttcctgcggagaaatctattgaatctaaagctcanatgaattttcctgaaactatccagatttca

SEQ ID NO: 16772 - DNA, 101 bp, rice(Oryza sativa)
  misc_feature (71): n=t or g
tctcgcgggaataattcgaggtgtttccataatcttcgaaaaggtcctgctcgaattggaatggaatttcngaaggatgaactaggatgaggattcgacag

SEQ ID NO: 16773 - DNA, 101 bp, rice(Oryza sativa)
  misc_feature (71): n=a or g
gcattgcatattttctggtcatattagaactcatgcaaatatgtactgcatatgtactatattcataaccnaacttatatcaaaatttggattttagagaa

SEQ ID NO: 16774 - DNA, 101 bp, rice(Oryza sativa)
  misc_feature (71): n=a or g
tatttgataaaaagggcagagagggatggggtttttatgggggtttggcttggggataagccagaatggcntggaggataaggtcgatgacaggcgcgctc

SEQ ID NO: 16775 - DNA, 101 bp, rice(Oryza sativa)
  misc_feature (71): n=a or g
aacataaaagcaacggtagtacattacaagtaacaggtgaataaaatgagcatgtaaattagaaaaaaaantccattttactcgcccaaactaattcaata

SEQ ID NO: 16776 - DNA, 101 bp, rice(Oryza sativa)
  misc_feature (71): n=t or c
tgtacgtatcatgtggtacatgtgttgtcgtcagccttggtttctttaggactccctccgtcctaaattanaagacaccatattttcaaagaaaatcaaac

SEQ ID NO: 16777 - DNA, 101 bp, rice(Oryza sativa)
  misc_feature (71): n=t or g
gtcaatttgtcatataggagtgtttagaaattgagggaatagcttaccttccttccttcctcctcttcttnatctcttcataaaaattcaggtttcacaag

SEQ ID NO: 16778 - DNA, 101 bp, rice(Oryza sativa)
  misc_feature (71): n=t or c
ataaagaatacacattgaatacgttgtttggactcttttccaacagtggtggctctgatggtggtagcggnggctctggtggcggtggccatgacaagagc

SEQ ID NO: 16779 - DNA, 101 bp, rice(Oryza sativa)
  misc_feature (71): n=a or c
cacatggtccatcatctcaccgaccggcaaaacctgcaccccgaagcccatcaaccgtgtaacttaaagtntaagcccaaagacgagcgccccatgccgtg

SEQ ID NO: 16780 - DNA, 101 bp, rice(Oryza sativa)
  misc_feature (71): n=a or g
tggaactttgtgcactagttccaacaaaattagattcttgcaaatatggaaatattgtattgtaggagtanttccaacaaagttcgatgaaatttctcgcc

SEQ ID NO: 16781 - DNA, 101 bp, rice(Oryza sativa)
  misc_feature (71): n=a or g
gaaggtagcccgcgcaaatgtgcgggcgtgtatcatattgtcagctttagagacttatataccatcaactngattattcatactatatttcaaaattatgt

SEQ ID NO: 16782 - DNA, 101 bp, rice(Oryza sativa)
  misc_feature (71): n=a or c
tcaaattcttaaaaacctatatttcgcaatgttaagctctcaaacatagcctcagtgtctctctttgtgtncttgtgtgatgagtgatgggccaggtactg

SEQ ID NO: 16783 - DNA, 101 bp, rice(Oryza sativa)
  misc_feature (71): n=t or c
gggctagaccactagagtgatcgtaaaaaaataactagtgaggcggtgtggatgctccatagttctactcnaaactccactttcaatagttatatttagaa

SEQ ID NO: 16784 - DNA, 101 bp, rice(Oryza sativa)
  misc_feature (71): n=a or g
ctttctctggccagatagtaaagaggaaggttgcagatccacgaagaggaggaggagggcacgcaacaacnacgaagaggtggaggctgcggcgtcgacct

SEQ ID NO: 16785 - DNA, 101 bp, rice(Oryza sativa)
  misc_feature (71): n=a or g
gtgtgttgaaaagcttgcatataatgcacaggatgtatatgcagcagattcaggaagtcatgagaaatatnagaaaaaaatggtaataattgcttggtgtc

SEQ ID NO: 16786 - DNA, 101 bp, rice(Oryza sativa)
  misc_feature (71): n=a or c
tgcacaagaactatactaatccttgagacttcaatcaattcacatcaaccccaagaattcaacaatatgcnttaacaaaagactattcaatggaaaagtat

SEQ ID NO: 16787 - DNA, 101 bp, rice(Oryza sativa)
  misc_feature (71): n=a or g
cctcgaagagaggagacctcatttttgttagccccatcataccctgctaaaccaacggttatattagattngtacctcatggtacctcgtatctcatggta

SEQ ID NO: 16788 - DNA, 101 bp, rice(Oryza sativa)
  misc_feature (71): n=t or c
tctattgtggatagtgcaatcgtgggaagagtgtgacacattttcacctttttttttaagttactccctcngtcccaaaatattactacacacgcaacacc

SEQ ID NO: 16789 - DNA, 101 bp, rice(Oryza sativa)
  misc_feature (71): n=a or g
caagtccttaatcagttgctccaaacaaacctcttcttttcttctttgaatgagcctccagcgctgaagcngtgaaattatcctgtaaacaacctgcaaag

SEQ ID NO: 16790 - DNA, 101 bp, rice(Oryza sativa)
  misc_feature (71): n=t or c
gcaccacctgctgcaggacgttcgcatgggtaatcgattcttcataatatttttattactaatactccctnatttctaaaatgttcgactccgttgacttt

SEQ ID NO: 16791 - DNA, 101 bp, rice(Oryza sativa)
  misc_feature (71): n=a or g
atgtattctccaaattaattagtaaaggtgtctaatgtggttatgaacaataggtgttgaaaaaaagcagnctaaattatagatatttgtcaaaatgtaac

SEQ ID NO: 16792 - DNA, 101 bp, rice(Oryza sativa)
  misc_feature (71): n=a or c
acaatggaggctttgctgaaatttttaataaactccatacatgcgggttttctatgtggtttataacactntggatatgtggtttataacactctgcaatc

SEQ ID NO: 16793 - DNA, 101 bp, rice(Oryza sativa)
  misc_feature (71): n=a or g
taaaaaacaaaccacctccacttgctagtagctcaccgcacaacccattagaaggcactagcactaagctngtcaccgctaagcgtgatcgaccgccgata

SEQ ID NO: 16794 - DNA, 101 bp, rice(Oryza sativa)
  misc_feature (71): n=t or c
ttttgaccaaagtttcacaatgggcaaggtccacaccaaccttttcacttagggtatgtttagttcacgcnaaaattagaagtttgattgaaatttgaaca

SEQ ID NO: 16795 - DNA, 101 bp, rice(Oryza sativa)
  misc_feature (71): n=t or c
tacgtgtattaggatttaggaatacatatcgtacaaacatgatgatgatatgaatactatatagcgtactntttttgtcctataaaaaactaatttattac

SEQ ID NO: 16796 - DNA, 101 bp, rice(Oryza sativa)
  misc_feature (71): n=a or g
agttgtgggtgcaacggagggaaccgcctgagaagatggctaaacatcagtgatcaacgatcgataattcnggaagacacctccttgcaaataaaccgggc

SEQ ID NO: 16797 - DNA, 101 bp, rice(Oryza sativa)
  misc_feature (71): n=a or g
gcgctggccccagaaattcagcacatgaaaagaccctgcgtggttcaagtgcaaacatgacaactctacangccagtagatgatggtccagcgttgtctgt

SEQ ID NO: 16798 - DNA, 101 bp, rice(Oryza sativa)
  misc_feature (71): n=a or c
atttaacttgagacaaggtaatatatggcgtagaaagtatgagatagatgaccaaacagggaaaagaattnatgttgttaccagagatactgtatgtaaga

SEQ ID NO: 16799 - DNA, 101 bp, rice(Oryza sativa)
  misc_feature (71): n=t or c
gtgtttgtatgtgcaatatttttccgttgatccccttttcttatatcgccctatcttgaagtcgtcctatnattcctttacgctattctaaatgcatatta

SEQ ID NO: 16800 - DNA, 101 bp, rice(Oryza sativa)
  misc_feature (71): n=t or c
atggaattgtcataaacatataatgaatccaaaaaattcaaacatgataatagtaagtagaagaagtaagngttttacattttcaccacaataaatagaca

SEQ ID NO: 16801 - DNA, 101 bp, rice(Oryza sativa)
  misc_feature (71): n=a or g
acaactttgtacgggatgacttttcgatttaaggccgtttgaatgttcaaaaatatgttacaaggtctccnatctatttgcataagtgaatatttataatt

SEQ ID NO: 16802 - DNA, 101 bp, rice(Oryza sativa)
  misc_feature (71): n=t or c
ggaggagccattgcgcctgccaccgttggatccaccgcttgtgtgcctcaccgcagttggatctgcttccngcttgcctcacccgagccagatccgccgcc

SEQ ID NO: 16803 - DNA, 101 bp, rice(Oryza sativa)
  misc_feature (71): n=t or c
aaggttgttatgtcctcaatgagttgtagtccaattcatatcccgcaaaaagcgtcgttgtgatgagatgngtcaaatgaacaaatgatatattgtacttt

SEQ ID NO: 16804 - DNA, 101 bp, rice(Oryza sativa)
  misc_feature (71): n=a or c
cataaatttttttagctagcaattctaatggaactacaccacctcatgctaatcatgccaccaccagttcntgattgatcctcgcctcttttgtcccacca

SEQ ID NO: 16805 - DNA, 101 bp, rice(Oryza sativa)
  misc_feature (71): n=a or g
aaaacggatccgatgatccgctaatagatgtgttggtttacaactcttatcaacaaagatagagcagtccngagatcacctggaccatcccctacaatcgc

SEQ ID NO: 16806 - DNA, 101 bp, rice(Oryza sativa)
  misc_feature (71): n=a or g
aatagccctacagtgagtcaagtgttagttgacccggaagttccggaaccacagatggtcggaacctctgnacctctccaggccaggaagttccgggtcca

SEQ ID NO: 16807 - DNA, 101 bp, rice(Oryza sativa)
  misc_feature (71): n=a or g
cttagtggtgtattagtcccaagttgcttaggagtgggctaggatgcttggagaccccccaaaacaaaacngcaagaagacttggagccgagtaagactag

SEQ ID NO: 16808 - DNA, 101 bp, rice(Oryza sativa)
  misc_feature (71): n=a or g
cgatgatagcggcatagaagaactcgtgcaagaccaaggcgcattggaaaaattggtaaaggaatttctanagtgttttaagagtacaaaatataaaggaa

SEQ ID NO: 16809 - DNA, 101 bp, rice(Oryza sativa)
  misc_feature (71): n=a or g
tgattacattgtcttacaacatagtatcttggtagactgaaaatctattactatgtattattttcctacantcttgtcatgacagtgaaccaagtatctgt

SEQ ID NO: 16810 - DNA, 101 bp, rice(Oryza sativa)
  misc_feature (71): n=t or c
atctgcccttgatgatccccagatgatagctagctcgcatcgatcgatcggtattagggcagtatcaaccnatattgtctacaagtagtgtctatggtaac

SEQ ID NO: 16811 - DNA, 101 bp, rice(Oryza sativa)
  misc_feature (71): n=t or c
gagttattttttgttatgacttataaaaaacgaatttaaactagcatgttgtgacatgatatatctcatgntaatctatcttgtaaattctttacaatttt

SEQ ID NO: 16812 - DNA, 101 bp, rice(Oryza sativa)
  misc_feature (71): n=t or c
acgctgactcgtgggtcccacatgatgacttagcaaggtggactaggtcaacatgccacgtcagcgaaaancaccctcaaaaccaccgagggagtaatttt

SEQ ID NO: 16813 - DNA, 101 bp, rice(Oryza sativa)
  misc_feature (71): n=a or g
ggcgcaccaaccaatggagcaatggaacaggatcaggcggcgccaccttgtagctggtgtagatgtcggcngcgcggacccagaactccgcggagcggctc

SEQ ID NO: 16814 - DNA, 101 bp, rice(Oryza sativa)
  misc_feature (71): n=a or g
gaagaagttcaagaataggtaatggcaaaaaaaaattttggaggtgtgccaaagctccatgtaggcctctntttatgttagcaaaagcaaagctagcacaa

SEQ ID NO: 16815 - DNA, 101 bp, rice(Oryza sativa)
  misc_feature (71): n=t or c
aataatcgtgctggagcttgagcttattatacatactgctccccttcgagccacatgctacgcatgaaggntgattttaaaagagagatttttggcatgta

SEQ ID NO: 16816 - DNA, 101 bp, rice(Oryza sativa)
  misc_feature (71): n=t or c
cgactccgcgaacgccgaatacgccgccgcttacatttgcaacggaggaaggaggagagaggaccacgacngacggcttgactgactccgcgtccgccgcg

SEQ ID NO: 16817 - DNA, 101 bp, rice(Oryza sativa)
  misc_feature (71): n=a or g
agcgtgagcggaagactaatagagcgacggggtctctagagctctgataccatgtggaaaaatctaatttnttgtattctaatgttttctgatatattata

SEQ ID NO: 16818 - DNA, 101 bp, rice(Oryza sativa)
  misc_feature (71): n=t or c
ttatggcacaaaagaaaaggataaacagtgttttttttttgagatggacagtgtttttttcgtaagtactngattgggtccaatggcatattttcttcttg

SEQ ID NO: 16819 - DNA, 101 bp, rice(Oryza sativa)
  misc_feature (71): n=a or g
cgtggcagcggtggatctgggtggtgcggttgtaccagcagctggcgacggcgatgtcgatgacaggagtngtggcggcggcagcagcgctagtttttttt

SEQ ID NO: 16820 - DNA, 101 bp, rice(Oryza sativa)
  misc_feature (71): n=c or g
ctgtttggtgttacatcttcgtagctgtcaattgtgacaacctttgcgtttttctgtgagtatagcagcanaagtgagcaatagcatatcaaaattatgct

SEQ ID NO: 16821 - DNA, 101 bp, rice(Oryza sativa)
  misc_feature (71): n=a or t
atcacctagtagtgtatattgctggaatgatggcctacatatttcggccggagcttcagacatgagttaangccaatggtagtacagatttcaacagcaag

SEQ ID NO: 16822 - DNA, 101 bp, rice(Oryza sativa)
  misc_feature (71): n=c or g
ttttgattgtgaccagatggagtaatcactagcaaccaactccatgcatgatgaatgttaactctgaaganctaaatgaaactagagggtcgggtagctac

SEQ ID NO: 16823 - DNA, 101 bp, rice(Oryza sativa)
  misc_feature (71): n=a or t
agtccgatccaaaaataaaaaaaaagtccgactctaccgattccaggtccggtcaaaaaaaaatagcgaanttttttttaaaaaaagtccgactcctaccg

SEQ ID NO: 16824 - DNA, 101 bp, rice(Oryza sativa)
  misc_feature (71): n=c or g
ggtgacaaactacctaagttgggaagaaatatatatgaagtaggatgagaattaaatttccatattcaagnctatggagttttggacccacaaacctaatg

SEQ ID NO: 16825 - DNA, 101 bp, rice(Oryza sativa)
  misc_feature (71): n=a or t
ttcctccttggttgttactgttgttcccccttgacatataaatctgaataagtgaaacatccacttttttnaaaaaaataaatgcatatttattatttaac

SEQ ID NO: 16826 - DNA, 101 bp, rice(Oryza sativa)
  misc_feature (71): n=c or g
atatttaaaagaaaagctagatggtcatactttcttagatgtaagccaattacttcaaaaggctttaactnaagagagccgagttaaagaggccaaaatct

SEQ ID NO: 16827 - DNA, 101 bp, rice(Oryza sativa)
  misc_feature (71): n=a or t
ttagggggtgtttgggctttagtccctctggactttttttttttgagagaagtccttctctccctaggacntttttttttggagtttagtctctctctccc

SEQ ID NO: 16828 - DNA, 101 bp, rice(Oryza sativa)
  misc_feature (71): n=a or t
ggtgaatgcacattgccatgttggctctcacaaattttaattggatgtacaaaacccaccaaatatgccantacaattgtatctttctttactaaattttg

SEQ ID NO: 16829 - DNA, 101 bp, rice(Oryza sativa)
  misc_feature (71): n=a or t
ccggagtgtcgagttcatgttcatctccagctaatactttggataagtgttcagatctagctttttttttnaaaaaaaagaaaaaggtccatatcaaagta

SEQ ID NO: 16830 - DNA, 101 bp, rice(Oryza sativa)
  misc_feature (71): n=a or t
ggaaaaaaaaaaggcccctatggtctttgtacacagaggagagaagtgcaaagtaacaatggggatttccngaaaaaaaataacaattttcctatatattt

SEQ ID NO: 16831 - DNA, 101 bp, rice(Oryza sativa)
  misc_feature (71): n=c or g
cggcaccggatccactactctccatgcgccgagtcaccatcctcatgctaaggcaggtcgccactgggganaggcctcaccaccaccctcccggctggccg

SEQ ID NO: 16832 - DNA, 101 bp, rice(Oryza sativa)
  misc_feature (71): n=c or g
agtaaaaatctggtaaatttacatcgagacatgcatgaggccgttgaattaccgaaacaaattaactacgnactaccagtacgtcgcacatgtgcctgacg

SEQ ID NO: 16833 - DNA, 101 bp, rice(Oryza sativa)
  misc_feature (71): n=c or g
tgatgtccttgccgttgttgacgatggtggcgttcacggcgttgtagttgcggtccagcgtgtcgaggtcngagcgcgggacgacggtcttggtgttgatg

SEQ ID NO: 16834 - DNA, 101 bp, rice(Oryza sativa)
  misc_feature (71): n=c or g
ttagtatcccgttttcttactgtttagtgagagaatcatggaagatggatcggaaaacctcaagtgaccancaatctggtatctcctagcatggaaaccat

SEQ ID NO: 16835 - DNA, 101 bp, rice(Oryza sativa)
  misc_feature (71): n=c or g
tatcaggtgtttgggtcgattcttggagtgaagctcatccgagcagctctccctaaagtaggcaaaggagntccgttaagcgttggagttcaccatggagc

SEQ ID NO: 16836 - DNA, 101 bp, rice(Oryza sativa)
  misc_feature (71): n=a or t
ctcccttcccccattaagcatggaggaaccactgacatgccactgcacaatcttttaggatttgatattcntttgacttagtattatgcacccatagaagt

SEQ ID NO: 16837 - DNA, 101 bp, rice(Oryza sativa)
  misc_feature (71): n=c or g
ctagaattaacacatacagagattatagatgccacttcttactatataaccgataactttagctaggttcnataaataaaagaaaaaggtggctcaatgca

SEQ ID NO: 16838 - DNA, 101 bp, rice(Oryza sativa)
  misc_feature (71): n=c or g
aataagttaaagacactatggagcccacatgtcaatgaagcatgtcttccttccctatcctctctctcctntctcctttctccggttctccccacaacgag

SEQ ID NO: 16839 - DNA, 101 bp, rice(Oryza sativa)
  misc_feature (71): n=c or g
ttcaagaaatagtcttaaagactgtactaagtggtacggagggagtatgtaacggtcaggtataagttcanaaaaacatgtataccacgaccaacatgaaa

SEQ ID NO: 16840 - DNA, 101 bp, rice(Oryza sativa)
  misc_feature (71): n=c or g
acggagggagctagtactactaaaacaagtacagtattctgtactaattcctcattcttatacagatgacnttgtttaaacacgtacgtacatgtggtatg

SEQ ID NO: 16841 - DNA, 101 bp, rice(Oryza sativa)
  misc_feature (71): n=a or t
gtttaagccagactctcggaattcaagaccaattcctgtaccagcagacttcgttagattacgaagtagtncaggggcattcttctcaataacgtcaactg

SEQ ID NO: 16842 - DNA, 101 bp, rice(Oryza sativa)
  misc_feature (71): n=a or t
gaatatgtttctcaccatggagatgctcagctccaggtaaaatatgcgaatcggttcgacgttccgtttgntcgagggattagatgatcaactgatctctc

SEQ ID NO: 16843 - DNA, 101 bp, rice(Oryza sativa)
  misc_feature (71): n=a or t
tggtcggagcaggaagcattggtcggtcgcgcggacgatcgagctcgatctacgtactccgagattcagcntctcgcgccgccgcggtctcgtcaccctag

SEQ ID NO: 16844 - DNA, 101 bp, rice(Oryza sativa)
  misc_feature (71): n=c or g
ccctcagggccgggcctgattgagaatatgaaacaggagcgcatattctggagctttacagtatctacacnatcataatgcctagattttattttggataa

SEQ ID NO: 16845 - DNA, 101 bp, rice(Oryza sativa)
  misc_feature (71): n=a or t
gcttgaaacaaaacaaacccctagctaccacaacatccacaatgattgaaacccagaaaggcaaaaaaaanaataataattcaaaccatttatccttattt

SEQ ID NO: 16846 - DNA, 101 bp, rice(Oryza sativa)
  misc_feature (71): n=a or t
tggttgacttaagattgaggatggtatggtatgatgagcctctttggtgatctgatcattttcctttttcntgtcaggtttgacacctttggattgcatac

SEQ ID NO: 16847 - DNA, 101 bp, rice(Oryza sativa)
  misc_feature (71): n=c or g
ctttttgcatctgaaaatcaatgatacatgatttggtagtatttatacctctcatccatagctgcatgtanataactgagtactgtctattgttattgact

SEQ ID NO: 16848 - DNA, 101 bp, rice(Oryza sativa)
  misc_feature (71): n=a or t
ctgacttatctgggccggcaatgttatattgggctgcctctggaataattcttgatggcccttttgataanttatagaattcatttttcagttccgttatt

SEQ ID NO: 16849 - DNA, 101 bp, rice(Oryza sativa)
  misc_feature (71): n=a or t
caacccaacccattactccgcttggaatggattcgtgttcgttttacctccgcagattgcggcgaccggcncagcgactccatccgaccacccctcctgcc

SEQ ID NO: 16850 - DNA, 101 bp, rice(Oryza sativa)
  misc_feature (71): n=a or t
tgatctccatcacccttttgcatcggcccgtgcatagagctttggctgacacctgactcatacaaatagcnccatcatgtcctgcttgcctatttgctgag

SEQ ID NO: 16851 - DNA, 101 bp, rice(Oryza sativa)
  misc_feature (71): n=c or g
tgcaagcaaaaacaacatatgagatggagtaaagttctgttcgagcatcagcatattgtatccaatcatcnatggttgagctcacgactactccctccgtc

SEQ ID NO: 16852 - DNA, 101 bp, rice(Oryza sativa)
  misc_feature (71): n=c or g
aaagaagctgacgacgcgccgaattacgtctgccctaaagttgttcgagatcattgataggtgcgctcatncagacaatgctctgaggcgcaaggagggaa

SEQ ID NO: 16853 - DNA, 101 bp, rice(Oryza sativa)
  misc_feature (71): n=a or t
gtagggccccgtgtagctactatgctgattcaacatagctgaccggagtgaaaatgccacgttggatgaanctgggagccatactgccttaggacgaaagt

SEQ ID NO: 16854 - DNA, 101 bp, rice(Oryza sativa)
  misc_feature (71): n=a or g
gagacgattcacccatcgttgccctgctccggctcacttcgcttcgctttgcttatcctctctttgctctnctccatgctggttctctggttccttggtgc

SEQ ID NO: 16855 - DNA, 101 bp, rice(Oryza sativa)
  misc_feature (71): n=t or g
gatgaaattcaaaagaaacttgaaaattgtgctcactatttttaagtggcactatgcttgcatatgagttngtgtgtttgcacttagcatcatggtagtat

SEQ ID NO: 16856 - DNA, 101 bp, rice(Oryza sativa)
  misc_feature (71): n=t or c
tgcaggttgggtttctttccttcctcaatttctttcacaactccactgcattttccaacctgatcgggtgntgccttttcattcttccctcctacctcgtt

SEQ ID NO: 16857 - DNA, 101 bp, rice(Oryza sativa)
  misc_feature (71): n=a or g
tcaatgccggtgacaacccaaactctagcgaagagccaataaatgagggtcccgggttagagtggggatgngaggggtggaaggggaagggagaagaaggg

SEQ ID NO: 16858 - DNA, 101 bp, rice(Oryza sativa)
  misc_feature (71): n=t or g
gcgaagccacgtcatcagcctccctcactcattctcctctatcgccaacgtgcacatgcagatctcaattnaacgtcttccttaccagcagccgtaattgg

SEQ ID NO: 16859 - DNA, 101 bp, rice(Oryza sativa)
  misc_feature (71): n=t or c
ctctttgactgttgtctcaactatagggtacattagcccattgccatagtatcccaaaggaagttttctcnatctcccccgcgcatttatgattatcttta

SEQ ID NO: 16860 - DNA, 101 bp, rice(Oryza sativa)
  misc_feature (71): n=a or g
aattggttcagctaggaggaaaattgcagaatgtcgcccttctgcaagatagggatgacgatatcctttgnaaatggaacgaaaatggtcaatgttcaaca

SEQ ID NO: 16861 - DNA, 101 bp, rice(Oryza sativa)
  misc_feature (71): n=t or g
gctgcaaaatctcctttcaatgtcaaatttgacgaggatgcagttaatctctcagaaatacaggtggaagntactccaccattgacagatgatcgacaacc

SEQ ID NO: 16862 - DNA, 101 bp, rice(Oryza sativa)
  misc_feature (71): n=t or g
taggcaaaaactgatgcaaacatctcagcaacagcagctacatgctcaacagcaactaagaccatcggctnctgggatgctagcacaggtaaggtaatttt

SEQ ID NO: 16863 - DNA, 101 bp, rice(Oryza sativa)
  misc_feature (71): n=t or c
tgttctacctcctcttgctcctcgttcatcttttcttcatcgcctgaagctgcatcaagcaatgtagtaantccataatatacctaaaatagttaaacata

SEQ ID NO: 16864 - DNA, 101 bp, rice(Oryza sativa)
  misc_feature (71): n=t or c
actggaatctcgttgaaccatatggcgaggtaccagccaggagatgcaatgtttttatacttacttccagngtcttcagggagtgtaggcttgaagaagcc

SEQ ID NO: 16865 - DNA, 101 bp, rice(Oryza sativa)
  misc_feature (71): n=a or g
agtaagcgttcgtgcactgttatgttttctgttagcctcgaaccactcggttagcatcgtttttttggctncagggctggatagcaaggactttaggtcag

SEQ ID NO: 16866 - DNA, 101 bp, rice(Oryza sativa)
  misc_feature (71): n=a or g
tcgattggctaaatccatcagcatgtgtgtatacgttcagttttacccaacagtattgtcagtttgtcacntctggactcacgagttgatcatggacacca

SEQ ID NO: 16867 - DNA, 101 bp, rice(Oryza sativa)
  misc_feature (71): n=a or c
accttcgcgtgaccaccatgaagttgcttgtttgaccggaccgatgtcgttggtctgaccgccaatgtccngagcaaacacaaattcaagatctctcaaag

SEQ ID NO: 16868 - DNA, 101 bp, rice(Oryza sativa)
  misc_feature (71): n=t or c
gttgaacactttcactgcaaccaccttttcgtccgtaaatttcccttgatacacagaactataccttcctnttccaattaaatgtgatgttgaaaacccct

SEQ ID NO: 16869 - DNA, 101 bp, rice(Oryza sativa)
  misc_feature (71): n=t or g
gcttcgctactctgctttctgtggaaagcctggtcggaaacggggaaaggataatagtaggattcttacanatgtgtgcacagtgcagagttaatttgttg

SEQ ID NO: 16870 - DNA, 101 bp, rice(Oryza sativa)
  misc_feature (71): n=t or g
taattgcagccatgaaaaactggcatggctcatatgaatccttgttatcgttatgtacatgttagctgatntgaggccacagtaatccttcagccgcattg

SEQ ID NO: 16871 - DNA, 101 bp, rice(Oryza sativa)
  misc_feature (71): n=a or g
taatgtttatcatcagtttgtcattagtcaagtcaatcatcgagcgaacaatctaacaggcagtcaggcantggcaaaattagacggcacggctaataaga

SEQ ID NO: 16872 - DNA, 101 bp, rice(Oryza sativa)
  misc_feature (71): n=t or c
tgttcttgggcaaactaaggataaaaagcaccttgctatcacatatgctagtaaaatttttactagagctnagcttaattatgccacaacggaaaaagagc

SEQ ID NO: 16873 - DNA, 101 bp, rice(Oryza sativa)
  misc_feature (71): n=t or c
tcagcatctcttaaccacattcactgtatcttatttcttggcaggaggacaaactggaaggagctgcctgntcaaaggccaaatttattcttggagttaac

SEQ ID NO: 16874 - DNA, 101 bp, rice(Oryza sativa)
  misc_feature (71): n=a or g
aaatcctacagaactggtatcaggagaaaattgttatgtagttttgcataccattgctaatgagaaaagcntatatgataaaaaaagagtagtatagctat

SEQ ID NO: 16875 - DNA, 101 bp, rice(Oryza sativa)
  misc_feature (71): n=a or g
aggtctggtcaccgtgttgagaaatgcttcaagctacatcctgaattgttggctgagtttagggccaagcntggtgcatctcgccgtgcccctagtacttc

SEQ ID NO: 16876 - DNA, 101 bp, rice(Oryza sativa)
  misc_feature (71): n=t or c
gacaggacaatataattactaggttcctaaaggaatactgtaagtgatacactagttagcttagttacctntttgatgctctcaaccagtttaccatcaaa

SEQ ID NO: 16877 - DNA, 101 bp, rice(Oryza sativa)
  misc_feature (71): n=a or c
tgtggtgtgactttgatgtcacaacggcaccctcctccccggccaaatgatccaatcttgatgattccctnctaagtatagacaaatcatggaaatagaac

SEQ ID NO: 16878 - DNA, 101 bp, rice(Oryza sativa)
  misc_feature (71): n=t or c
ctcgacgcactcccctctccgcgcctcatcaacacgcatatgccactcgctatactaccgagcgccacgcnagccactaccacagctaactcctctggcaa

SEQ ID NO: 16879 - DNA, 101 bp, rice(Oryza sativa)
  misc_feature (71): n=t or c
gcgggggcaatgtggcaggtgagtcacggtgcaagcgtgcgcaagtgactgcaacaaccaaggacggtcanggcgaaagcacctcacgcgtccaccgtcta

SEQ ID NO: 16880 - DNA, 101 bp, rice(Oryza sativa)
  misc_feature (71): n=t or c
gggagactcaccaacaagtgtgctaaatggatctgcagaagatgaatgcacccgactaaggtgttgctgantgctcgactcaagaggttgcagtgatctgt

SEQ ID NO: 16881 - DNA, 101 bp, rice(Oryza sativa)
  misc_feature (71): n=t or c
gtctcggcagatcctatggacgttcatcggatcgacgagccaaacttacaacaacacacccccaccgtcangaaggaaacagcaccagaggacacagcaat

SEQ ID NO: 16882 - DNA, 101 bp, rice(Oryza sativa)
  misc_feature (71): n=t or c
ggtgtgccttgcttcttgttgacaatggccatggccaagtacctagtacccatgccaattggggtttggtngtcaggaccttcccagaatggggcttcacc

SEQ ID NO: 16883 - DNA, 101 bp, rice(Oryza sativa)
  misc_feature (71): n=a or c
tattgttatctcaattttcgaaggagagaggccacaagcaagtgagaacactctcctctgcgagatcgaancttccgggggctcacagcaaagcaaagccc

SEQ ID NO: 16884 - DNA, 101 bp, rice(Oryza sativa)
  misc_feature (71): n=a or g
tatggtaccttaaaattttcctctggctgaggaaatatagagtatggattcaattcctcctcagatggcgntgcagcagtgactactgcagcttttttctc

SEQ ID NO: 16885 - DNA, 101 bp, rice(Oryza sativa)
  misc_feature (71): n=t or c
gccttgtgcgtcatccgcagagagtacacgccttgcctgatcagtacaaacgatgggagtcgtgttcggcntcctcccatgcagttgcggtacccgcgcca

SEQ ID NO: 16886 - DNA, 101 bp, rice(Oryza sativa)
  misc_feature (71): n=a or c
agagtgaaattatgtatgcagttagggcgggcaatatatatataatataattcacctggattgtatggttnttgaggagaggatgatcgaatgcaggctgt

SEQ ID NO: 16887 - DNA, 101 bp, rice(Oryza sativa)
  misc_feature (71): n=a or g
gctgtcatcaacgagacaattataaacagcgatcgagccaacatggtagaatatatcaaggactgcttatngtaccatcaagacaaggaattcattatgtg

SEQ ID NO: 16888 - DNA, 101 bp, rice(Oryza sativa)
  misc_feature (71): n=a or g
gacacataaggtgtgtatacaaaactcccatatataccattcgtgtacatttgacagtaatcctctgggcntgtatggcccaaatactgcagctttgaggt

SEQ ID NO: 16889 - DNA, 101 bp, rice(Oryza sativa)
  misc_feature (71): n=t or c
catggtaacatcaacgaacaatatcagcagaattcgtccagcctgtatgctgcgccgcagcgtaggactgncgtgcaggctgtccaagacagcatgaactt

SEQ ID NO: 16890 - DNA, 101 bp, rice(Oryza sativa)
  misc_feature (71): n=a or g
gaatctttcacagttagatccgtgtcacatttcatgttttgtcctcattctcctctagcttcgaagagatngcggtggaccaaccaattaggattaagatt

SEQ ID NO: 16891 - DNA, 101 bp, rice(Oryza sativa)
  misc_feature (71): n=a or c
aaaagcttgccatcttcttcctgtgcaattttccttgcttcttctgaggcccagctctcttcctttggggnagagagtagctgttcttcttcttcctgtta

SEQ ID NO: 16892 - DNA, 101 bp, rice(Oryza sativa)
  misc_feature (71): n=a or g
tgtcttctctatacggaagaaactaagaccttcatccatgcgaacaacggtagcacctctgccagatggcntgtatcctcgagtatcctattatgaactgt

SEQ ID NO: 16893 - DNA, 101 bp, rice(Oryza sativa)
  misc_feature (71): n=a or g
gctacaaggtgcactgcaaaacatagagactgtaattggtgatatcaatgagtttgtaatccttctggctngatgtgagcgcatgtcccataggccctatg

SEQ ID NO: 16894 - DNA, 101 bp, rice(Oryza sativa)
  misc_feature (71): n=a or g
gtggctggagctgagctgatcagaattcagaattcagagaacgatgaggaataggagaacaatggtggcgnaaacgctctgcggttgcagcggtgagcttg

SEQ ID NO: 16895 - DNA, 101 bp, rice(Oryza sativa)
  misc_feature (71): n=t or c
gccaacacaagaatgcgatatgctgccctcacatcattcgtccttacagcctccaatatatcaatggtaanttgattggtatctttggcaataagaagctt

SEQ ID NO: 16896 - DNA, 101 bp, rice(Oryza sativa)
  misc_feature (71): n=a or g
tcctaaacagcactgtcagaccactgaattaatacttgtggtatagcagaagtacctgatttgcgaactcnggtgtcgaggacagcaacaggaactttctt

SEQ ID NO: 16897 - DNA, 101 bp, rice(Oryza sativa)
  misc_feature (71): n=t or c
gtaatggtcacgtagtggagtagaaagttgtgtttgtgtgggtcggttggagttggactggcacgttgcangcggtcggagagcccccacgatcccgaacc

SEQ ID NO: 16898 - DNA, 101 bp, rice(Oryza sativa)
  misc_feature (71): n=a or g
acaggtagcaaccaaccgaccaagcattttattactgtcctttcttctcacaagacctgggattacaacgnaaaggagtagccacgaaggtacttggaatc

SEQ ID NO: 16899 - DNA, 101 bp, rice(Oryza sativa)
  misc_feature (71): n=a or g
ccgatacatgcgaaggattccgaacccgatttttagtgggggccgtatttggtgtacatatatcgacgcanacccgcgacccgttaagcctatctcatcga

SEQ ID NO: 16900 - DNA, 101 bp, rice(Oryza sativa)
  misc_feature (71): n=a or g
gttccggtggacctgggcaccgacaacaagacctccaatcaattccgcacgtggtggcagccgccggacanctccacgcagctcacggcgggggtcaacgt

SEQ ID NO: 16901 - DNA, 101 bp, rice(Oryza sativa)
  misc_feature (71): n=t or c
tttgtaataataaatcgataaaaaaacccaaggagacgtacagcgagagagacgcttcgtttcgtcgaggnatgcgtcgtctccctcctcctcctcgattc

SEQ ID NO: 16902 - DNA, 101 bp, rice(Oryza sativa)
  misc_feature (71): n=t or g
caatgtgattggaaagggtggcttcggtgaggtctacaaggggcatattggagatagtaatcaattagttncagtgaagaagccaattcatgttagtttgg

SEQ ID NO: 16903 - DNA, 101 bp, rice(Oryza sativa)
  misc_feature (71): n=t or g
ttgggcgtgacccttcattacttgcaacataagactcgagtctcacattttcctgtgcttcactctttctnaattcctttgctttcttctgcaaattgagc

SEQ ID NO: 16904 - DNA, 101 bp, rice(Oryza sativa)
  misc_feature (71): n=t or c
gcacacaacggttgctacatcatcactgtcatcacacccgctctcaacgagcaagcggtcgccgagagcanggcgccagcaagcagcccaagaagccaaca

SEQ ID NO: 16905 - DNA, 101 bp, rice(Oryza sativa)
  misc_feature (71): n=a or g
ccaacagacggtaaaaactgaacaatgacaccaatcaggaaaagagcgagaagacattcagggtctgtttngcacagctccagctccagtttcactctttc

SEQ ID NO: 16906 - DNA, 101 bp, rice(Oryza sativa)
  misc_feature (71): n=t or c
aggcaaaaggtttcttctagtattggatgatgtatggaatgaggatcctgatagatgggatagataccgangtgctctagttgctggtgcaaaaggaagta

SEQ ID NO: 16907 - DNA, 101 bp, rice(Oryza sativa)
  misc_feature (71): n=t or c
tgtagatacaacaaattttgtaaatggcctatggctgctggaagttttccaattttacttccatgtatgtncagtgtttgtaaatttttcaggtcgccaat

SEQ ID NO: 16908 - DNA, 101 bp, rice(Oryza sativa)
  misc_feature (71): n=a or g
gcaaaactagctccatcgtctcttatcctcttcttcatcaactgggatataccactctggtcgcttcttcnagttgctgtaccggtagttcaggaagagct

SEQ ID NO: 16909 - DNA, 101 bp, rice(Oryza sativa)
  misc_feature (71): n=a or g
gagaacctgattctgtcaaagctaagatccttaagttgggtctgtctgaggttgatgagagcaacattatncccatcactctggataaattgacacctgaa

SEQ ID NO: 16910 - DNA, 101 bp, rice(Oryza sativa)
  misc_feature (71): n=a or c
atccctcttcctcctcatccacaatcctgttcttctcatactcctgtaccttatcaactgacacatccaanatcattggcgagtgtccatcgcctatgcta

SEQ ID NO: 16911 - DNA, 101 bp, rice(Oryza sativa)
  misc_feature (71): n=a or g
tcaactctaaatattcttgtgttctgagtgttgctcacaagagctggaaagccagtgatttcatcaacccnattaccattcccctcctgtggtttccaaac

SEQ ID NO: 16912 - DNA, 101 bp, rice(Oryza sativa)
  misc_feature (71): n=t or c
tttacaataggagatctcctctccgatgagataaatgaaaccactgttgcatctacttcggcgtacctatnaacctttatcgcagaccaaccaaactgtac

SEQ ID NO: 16913 - DNA, 101 bp, rice(Oryza sativa)
  misc_feature (71): n=t or g
ccagattggagcttcttttggcctttgtgattctcacttctcagatgttcatgcaataggtaaaaagagangatatgacactatcaccgatcatcaggttt

SEQ ID NO: 16914 - DNA, 101 bp, rice(Oryza sativa)
  misc_feature (71): n=t or c
atgaggggcatactgtgtcaagctcccggatgtgaacaactctgtgattatgttaacagtcttcttctccncatcaacccatgaagcaaacattttctcaa

SEQ ID NO: 16915 - DNA, 101 bp, rice(Oryza sativa)
  misc_feature (71): n=a or g
acaaggctctaccgacaaaagattcctcatatttggtgtctacgtcacagtgtgtctaggaaatggtttcntgtaagttagaccttttacttttatattat

SEQ ID NO: 16916 - DNA, 101 bp, rice(Oryza sativa)
  misc_feature (71): n=a or g
agcggatgagttcatgataaggtttgaggtgttgttgcggttcttggagtcaacatatgtgacattcaagnaaagggcgtacgagagaggtggctgctaga

SEQ ID NO: 16917 - DNA, 101 bp, rice(Oryza sativa)
  misc_feature (71): n=a or g
gccagacaagaggaagttcaatgttaaggaggatgtggggcataatttctctctagatgatgctagagatnaacgaccaatagggggcaagcaagctaagg

SEQ ID NO: 16918 - DNA, 101 bp, rice(Oryza sativa)
  misc_feature (71): n=a or c
gttatagtaatgccagaatgccccccaactggtgaagagtgaagatttgctaaaattttctgttgaacaanagaattagtaccaatccacattctgccctt

SEQ ID NO: 16919 - DNA, 101 bp, rice(Oryza sativa)
  misc_feature (71): n=a or c
ggattccgtatgaatcctgattctttgtttaagctgtccacaggctcttttcctggttggttttgttgtgnaagaagagtggccaattgtgcaagttgctc

SEQ ID NO: 16920 - DNA, 101 bp, rice(Oryza sativa)
  misc_feature (71): n=t or c
attaaggccggcacattaattcatttgttacgtactctgactggatagttgggggttttgtgggtgcaggntgatgtgccgcttatttcatttccatgcaa

SEQ ID NO: 16921 - DNA, 101 bp, rice(Oryza sativa)
  misc_feature (71): n=a or g
ttgacacatgccagcaccgcgacaccatgtttttgcctgttctgatctgccaaatttgtgccacccagccnctttgcatttatttccagctgcactggaac

SEQ ID NO: 16922 - DNA, 101 bp, rice(Oryza sativa)
  misc_feature (71): n=t or c
gtaggatttttcatttttcaataagatgtcttgttcttggatgttgccatggacagcatgcaaggaggggnagcgatggtggtgacagtgaacggcggcaa

SEQ ID NO: 16923 - DNA, 101 bp, rice(Oryza sativa)
  misc_feature (71): n=t or c
caattgatttctaattctagattaacctcctggtatctttcggtgtttgtgtgttggtcggagatcaagangaaactgtcgccggcgtcgagattttcttc

SEQ ID NO: 16924 - DNA, 101 bp, rice(Oryza sativa)
  misc_feature (71): n=t or g
atgatgatcttggcacaaagataatggtaccaaatccaatctggtccttgtaggaggagaagagctcgggnctgtcctccttcgccggcggcgcgacatcc

SEQ ID NO: 16925 - DNA, 101 bp, rice(Oryza sativa)
  misc_feature (71): n=a or g
tacgtgtgaccctttttcatgtatttttcgtatgtgtctatcgttggtggttttgtttcatctaatggtcnttcatctctgtctacttgtaggcgatacat

SEQ ID NO: 16926 - DNA, 101 bp, rice(Oryza sativa)
  misc_feature (71): n=a or g
taccacttgctgaattgtggtacaataccacctatcatactgcgattcagatgacacccttcaaggccctntatggatatacaccaccacaagtcaatgag

SEQ ID NO: 16927 - DNA, 101 bp, rice(Oryza sativa)
  misc_feature (71): n=t or g
gcaggtgactggtacagctgctgaggttgctgtggaaggactccaaaactcgaggtaccaagtaaacctgngggagtcatgccagcagatgctcccagtgg

SEQ ID NO: 16928 - DNA, 101 bp, rice(Oryza sativa)
  misc_feature (71): n=a or g
aaagtccgaaagattccctgaataactttttcaccgggcattccctgaataacttcctcaatggcggatgntacatgttttgttggatgtaacagagtgga

SEQ ID NO: 16929 - DNA, 101 bp, rice(Oryza sativa)
  misc_feature (71): n=a or g
tcgatggatggatctagggcaggcagatcatcaactagcttgatcttctttggcttggtttgttttttggnagctggggctgaagtatctgcagccgatga

SEQ ID NO: 16930 - DNA, 101 bp, rice(Oryza sativa)
  misc_feature (71): n=t or c
agacccttacatatatacctttgtgttgtagttcttccaaaatgaaaatgagttcagggtgatcccttggnaagttttttcatcctatcacatcgaatatt

SEQ ID NO: 16931 - DNA, 101 bp, rice(Oryza sativa)
  misc_feature (71): n=t or c
tttggcagggtattatcgcaagtttgtccgacattttggcatcattagtaagccattaactaagctattgngtaaggggcagccttttatctggacacaac

SEQ ID NO: 16932 - DNA, 101 bp, rice(Oryza sativa)
  misc_feature (71): n=t or g
cagaggcaagcatccacgcactgctgttaggattttgggacagcacatgatggtccgaaagaagagacganggaggggggtagtgatgcagcacgtgtgca

SEQ ID NO: 16933 - DNA, 101 bp, rice(Oryza sativa)
  misc_feature (71): n=t or c
caacgcccaggacaggatggtgtccatctgttcctgacccatcctgtacgtttggtacgtcttgggactcnccatctcgcgctgctgctctcccccacaac

SEQ ID NO: 16934 - DNA, 101 bp, rice(Oryza sativa)
  misc_feature (71): n=a or g
caggaacttaactttcaacatagttttgtctttccatccacatgatgacaggcggcgaacttccctgtttntctttaccatggtgccaaaatcatttgcgt

SEQ ID NO: 16935 - DNA, 101 bp, rice(Oryza sativa)
  misc_feature (71): n=t or c
cctctaactgattcaaacccaggtcggagaagaagagtttgccaaagttgtcgatgagaaaattggacacngagaagaagagtttgcaaaagttgattaca

SEQ ID NO: 16936 - DNA, 101 bp, rice(Oryza sativa)
  misc_feature (71): n=t or c
tgttgcacgagagagagagagagagttgcacggtggatggatagggtttctgagggtattttgggcattangaatattagttacattctcttctctctttt

SEQ ID NO: 16937 - DNA, 101 bp, rice(Oryza sativa)
  misc_feature (71): n=t or g
gctcctaactaatagactgtcgggttgtcatcattgctgggaccaagattcaattctcgctaacacggtgnttattttatccatcccataataccaaacta

SEQ ID NO: 16938 - DNA, 101 bp, rice(Oryza sativa)
  misc_feature (71): n=a or c
taggctcataaggatctggccagatatgttggagcatgcgcttagggatgcaactttgtatacttctcccnttacttccgagctgaagccagtgacctcca

SEQ ID NO: 16939 - DNA, 101 bp, rice(Oryza sativa)
  misc_feature (71): n=a or g
cagctaaaccagaggagagagagagaggaggtgggaactgggaagaaaaaaatggcggctttgctccgccncgccgcggcggcggcggcggccgtggtcct

SEQ ID NO: 16940 - DNA, 101 bp, rice(Oryza sativa)
  misc_feature (71): n=t or c
gccgcctcctgctgctccccgggcaccgggtggtggctcgtcctctgcagcaccatctccatcgtttcgcnaatcttgatttgatcttagcttaactatta

SEQ ID NO: 16941 - DNA, 101 bp, rice(Oryza sativa)
  misc_feature (71): n=a or c
ggcggttcacttgggagcaattggactcgttgtcggagcagctgccgctctgcatactctcctgattccgntgcataatcacgtgcaaattacaacggtag

SEQ ID NO: 16942 - DNA, 101 bp, rice(Oryza sativa)
  misc_feature (71): n=a or c
tgttgtgcgtaggccaaagcgacaggagggttggaaattgaagaagtgggaagtgtggatggataggctcnatcgactagagaatcattgcagaagtatcc

SEQ ID NO: 16943 - DNA, 101 bp, rice(Oryza sativa)
  misc_feature (71): n=t or c
tttactatcatatacatggagaactcgaaggtcgtccaattactcctggtccgtttcaggagctgctatgnttccttctagaatttaaagtttttgaacac

SEQ ID NO: 16944 - DNA, 101 bp, rice(Oryza sativa)
  misc_feature (71): n=t or c
ttgtaggaaacggccgggatggccggtgcagtcaataatattagagaatttggatcaatgtgtaaaatccnttatatcttagtatagaggaagtatgttat

SEQ ID NO: 16945 - DNA, 101 bp, rice(Oryza sativa)
  misc_feature (71): n=a or c
tacgattttgtagttacacttgtacacactacaattttaacatgggggcaatgcagctgttaaggttctcncatgctgttatgcagtctattccaaaggca

SEQ ID NO: 16946 - DNA, 101 bp, rice(Oryza sativa)
  misc_feature (71): n=a or g
tccagtaattagtcatatggaggacatacagctcagcatacggaatgatacctgtgcagcatggaagaagnggggatggggtgcctccctgccctcattga

SEQ ID NO: 16947 - DNA, 101 bp, rice(Oryza sativa)
  misc_feature (71): n=t or c
ggtccgcgtcgacgccgaccaggtccgcctcgtggatgcgcggatctgaggcagatgagcacgacggccanggctcatccacctgcgccgcagccgatgag

SEQ ID NO: 16948 - DNA, 101 bp, rice(Oryza sativa)
  misc_feature (71): n=a or c
aaacaacaccgataagaagattcgatccttggtcaagttccaaataacagcacaaaaagacttactcttcnagcacttaagagggaacagctaggaggaga

SEQ ID NO: 16949 - DNA, 101 bp, rice(Oryza sativa)
  misc_feature (71): n=t or c
tactcctcttaactaatcacaaccattcccttccatctacttatagtcgtaatcaatcttaatcttcctcnaattattcttacctactttcttaatatatg

SEQ ID NO: 16950 - DNA, 101 bp, rice(Oryza sativa)
  misc_feature (71): n=t or c
acggatgcatggcatgagaaaacagatacatatatacatatggattcatgaagcaacgaacttacgagganttccatcgcaatgggggatgaaaggaggac

SEQ ID NO: 16951 - DNA, 101 bp, rice(Oryza sativa)
  misc_feature (71): n=t or g
aactgatatacagtgcaaatgattcatgccctcgcaagccaaaaacgaggtaacatcatgcatggattttnagcagccaccaagccttattttttctagta

SEQ ID NO: 16952 - DNA, 101 bp, rice(Oryza sativa)
  misc_feature (71): n=t or c
tgcttcatttcatggataaagaagagatgaagaaaacggccatactcctcccatcctggaatttgatcttntgttagtttattggagaagttcaccatttt

SEQ ID NO: 16953 - DNA, 101 bp, rice(Oryza sativa)
  misc_feature (71): n=t or c
caacctttcatgaccctcccagcttccaggggcttctcaagctattatttctaatgataagataaggatangtcatggaagagaccaagaaaagtcaaagg

SEQ ID NO: 16954 - DNA, 101 bp, rice(Oryza sativa)
  misc_feature (71): n=t or c
cctcatcccgttttgggcaaggagcagagtccccttttcctctcccttttttccttttcccggcctcaacngctgtctcctgccgcccgtggccaccagcc

SEQ ID NO: 16955 - DNA, 101 bp, rice(Oryza sativa)
  misc_feature (71): n=t or g
acataacttggagatgagtcaattgagtgaacaacaaaaggacgatttgatgagacctttttctatggaanaactgaaagaagttgtttttgaaatggaaa

SEQ ID NO: 16956 - DNA, 101 bp, rice(Oryza sativa)
  misc_feature (71): n=a or c
ctcacctattatcatgaaggtgaagacccaaatcatgctgtggttgaaatgcaaacatccatagaattggntaagcttgggctaaagtgcacagagccatc

SEQ ID NO: 16957 - DNA, 101 bp, rice(Oryza sativa)
  misc_feature (71): n=t or c
acccccaccaccctctcgtcgtctgcatgaaggagagcccatcggtcagccttgacctcgaggcgatcaanagctccgtcgtcgtcgaggccctcggagag

SEQ ID NO: 16958 - DNA, 101 bp, rice(Oryza sativa)
  misc_feature (71): n=t or c
ggaacgcttcttgtttgatccgtggttccttgccctacaaaacctcaagagattcggcgtcgaaagcacgncccggatgataaacattccaagttggattc

SEQ ID NO: 16959 - DNA, 101 bp, rice(Oryza sativa)
  misc_feature (71): n=a or c
acccgccgttcccgaactccatcgcctccctcctccctccccacctatccgtcagcatcaagcaacgcacnacgccggccgcgcaccacaggaattcgacg

SEQ ID NO: 16960 - DNA, 101 bp, rice(Oryza sativa)
  misc_feature (71): n=t or g
ctcgtcagctcggcgaatccttccgtggacatcctggtttcgtcggagcaccaaacggaaataaccttcanagaaggcgacctgtacttgcaaagttgcaa

SEQ ID NO: 16961 - DNA, 101 bp, rice(Oryza sativa)
  misc_feature (71): n=a or c
tagcggaatcctgcagacgcaatcgacaccatccttccccacccagcaacgtaaaaaatgggaaaaaaaanccccttcaattcctaacaaacaacaacctc

SEQ ID NO: 16962 - DNA, 101 bp, rice(Oryza sativa)
  misc_feature (71): n=t or c
cagcctttgcagcgacgacattgcgactcctcatcctccctgcatacgagcacattagagcacatgatacncaatggctcgtttgcaaagaaacaacaata

SEQ ID NO: 16963 - DNA, 101 bp, rice(Oryza sativa)
  misc_feature (71): n=t or c
aaaagagctttgcaggcagaacctttacctgatagtgcatatatcttgtccaaccaaccttcagctagacnagccccactaaccacagcaaccaaggaagg

SEQ ID NO: 16964 - DNA, 101 bp, rice(Oryza sativa)
  misc_feature (71): n=t or c
ccgatttctgattttgtacttctgcagaaaaataagatagcttctaaaaaacctcaaggagcggctccacnggtaaacttccctaattctgtcaattctct

SEQ ID NO: 16965 - DNA, 101 bp, rice(Oryza sativa)
  misc_feature (71): n=a or g
aatatatagcttaatttgctgcaagtgacactggcttccaagcggggagcattgctatctactatatcttntagctaattaatttaattaatttggtttac

SEQ ID NO: 16966 - DNA, 101 bp, rice(Oryza sativa)
  misc_feature (71): n=t or c
tggaggagagttcttgcagattggagtaaaaaaagatcttatgtactagtagtggtggctagtgagtgatntgggtttcgttcggtttgttttgtttcgcc

SEQ ID NO: 16967 - DNA, 101 bp, rice(Oryza sativa)
  misc_feature (71): n=a or g
agaaagttgtcgttgactccgaacataccgtatgaaattgtttgccgccatattacgccgtcgaagcatgnccaaggactggttggccatgacagccgggt

SEQ ID NO: 16968 - DNA, 101 bp, rice(Oryza sativa)
  misc_feature (71): n=t or c
attagacatagccgcattatcatttgtactccagtctgttcctctcagctacgtgagttaaagttggatancatcgatattttattggttgatgatgctgc

SEQ ID NO: 16969 - DNA, 101 bp, rice(Oryza sativa)
  misc_feature (71): n=a or g
cttcaccggtgtgctgggctctcacattatcttcttccacatggacattgccggtgatgccctcaccactntgaggacctggagtattcagaacgttattc

SEQ ID NO: 16970 - DNA, 101 bp, rice(Oryza sativa)
  misc_feature (71): n=t or c
tgatgttgaggtgaaaatgaagttggcacacataatacaagatagccatcagcacttaattagttgagttntaattattataaacttgaaaaatagattta

SEQ ID NO: 16971 - DNA, 101 bp, rice(Oryza sativa)
  misc_feature (71): n=t or c
atatggagctcctgcacccttctatttatagagggagataccttggactataatggccaaatgggccaccnatcccggcccggcgtgagcatgaccaggca

SEQ ID NO: 16972 - DNA, 101 bp, rice(Oryza sativa)
  misc_feature (71): n=t or g
cccactgcaagagtccatcataagtaatgttttgtcctaggtcctccatggcagctatgatctcgacaagntggtggccagtggctaaggatatggtgatt

SEQ ID NO: 16973 - DNA, 101 bp, rice(Oryza sativa)
  misc_feature (71): n=a or g
tcgcgtttgagtgaacacccaatccttgaggttgacataggtttgcttctcatgatcattttccacgtcgnggtctgtatcagggttctcgccttgatctt

SEQ ID NO: 16974 - DNA, 101 bp, rice(Oryza sativa)
  misc_feature (71): n=t or c
caacatcaattctcgtcggatgtagtgtcattgcttttaagtttaccaaagtccgaggaattgatcctganatgttatttgctgctaaattcaagtattga

SEQ ID NO: 16975 - DNA, 101 bp, rice(Oryza sativa)
  misc_feature (71): n=t or g
aacatctaccggggacaactccagcagtgatgtcaattcaccaatcctgtctgacagtgatatattttcangaaaatataggaacatcaatcttcttagct

SEQ ID NO: 16976 - DNA, 101 bp, rice(Oryza sativa)
  misc_feature (71): n=t or c
tgaggccggagaggttgctgagagcagtgggtatctctcctgataacttgttactgtacagaaacaaaaantccaaggatggcaactcggcgagcgacaga

SEQ ID NO: 16977 - DNA, 101 bp, rice(Oryza sativa)
  misc_feature (71): n=t or c
cctaatgtcatcgatccacttgttgccatccaaagcctcagcaacagtcctcttctttctcttggagtggnggtagaggttgggagctattgccttgagtg

SEQ ID NO: 16978 - DNA, 101 bp, rice(Oryza sativa)
  misc_feature (71): n=t or c
aaaatttctcttaataactaaatactggtaaaaattttcccaccaggtaacaaccttataaacggagatcnatttaaaacaatctagaaataacattatac

SEQ ID NO: 16979 - DNA, 101 bp, rice(Oryza sativa)
  misc_feature (71): n=a or g
tgaggatggaaaacctattaaggatcctttggttttgctcgaagctacttcagaccagcacacaatgcaangtagttcatccagcagcaggaacgaaaatg

SEQ ID NO: 16980 - DNA, 101 bp, rice(Oryza sativa)
  misc_feature (71): n=a or c
ccgtattattctgtctaggagcatggtagttgctatcgcttggatctgggggggtttcgttttcttaattngtgaattttagtttgcggtatttcaattat

SEQ ID NO: 16981 - DNA, 101 bp, rice(Oryza sativa)
  misc_feature (71): n=a or g
gatcccccaatcgctcagcaccgctcaccccatcggcaggctagtcagactagtggaggcccgaaaatctngtctgacgctcaaccaaacatctcaaagcc

SEQ ID NO: 16982 - DNA, 101 bp, rice(Oryza sativa)
  misc_feature (71): n=t or c
agttatctatataccatccatgtatgacgtggagagattatataagctatagtcgtgtgaacttattgttnatacctttattctaggagatgaaactctaa

SEQ ID NO: 16983 - DNA, 101 bp, rice(Oryza sativa)
  misc_feature (71): n=a or g
acgatgaacattttgacctccatggtcatcagcagcagctatcacgaagctgtttgctccgaaaatcagcncaaggatcgcccatgcttccaggaagaacg

SEQ ID NO: 16984 - DNA, 101 bp, rice(Oryza sativa)
  misc_feature (71): n=a or g
aaattgtgtcgtaccctggtaaaatcttccaaagaaagcgtgcaatcccttgtgtatccagcttcttccantacatttgttattactcgctgaaaggtatc

SEQ ID NO: 16985 - DNA, 101 bp, rice(Oryza sativa)
  misc_feature (71): n=t or c
aacaaaagttcagtaacaccttattgcattgtcatcaccagcagctcttgcttcactagcatcatcatccncgctgtcactcgaaccagattgtagcccat

SEQ ID NO: 16986 - DNA, 101 bp, rice(Oryza sativa)
  misc_feature (71): n=t or c
ggaacttatgattttttttttgggggccattttcagcatttgcggctactaacattgcatttattcaaggntatcttttttttttaacgaatgggtaagtt

SEQ ID NO: 16987 - DNA, 101 bp, rice(Oryza sativa)
  misc_feature (71): n=t or c
actctatcaggaggcattgatcataaagtgaagctagtattccgctttcttgataaagctgtttccgatcnttctacaaacaaaacatatgactctatgct

SEQ ID NO: 16988 - DNA, 101 bp, rice(Oryza sativa)
  misc_feature (71): n=a or g
catggaccaatatagatagatcgatgtgcattgcactagctatagcttttgctaagctgcagacatcacgncgcactgatgatgtgagatgatatgataca

SEQ ID NO: 16989 - DNA, 101 bp, rice(Oryza sativa)
  misc_feature (71): n=a or g
cgatggtgccgcagttactgtacttgagagcaagcttgattccgttgtggctgcatacgaggtagtcgtgnacgtggacgcgtttattgagcaatctcgag

SEQ ID NO: 16990 - DNA, 101 bp, rice(Oryza sativa)
  misc_feature (71): n=t or c
atgtttgtggataactagttgaaagtatcctatttggtatttggtagtgaagtcacaaagttttactcctntgtttacctaatgaattctagcatatggaa

SEQ ID NO: 16991 - DNA, 101 bp, rice(Oryza sativa)
  misc_feature (71): n=t or c
agcagtgataatggtattccatgaaatccgatcccttgcttccatcagctgaaaaactctacatgctttancaatggcaccacacttggcatacatattaa

SEQ ID NO: 16992 - DNA, 101 bp, rice(Oryza sativa)
  misc_feature (71): n=t or c
tcatgcaagttcaccatcacacctggcccctgttttccaatgttgtgccttactgccacgcgcaagtcgcngcaatatctactggcaagtgcactcctgag

SEQ ID NO: 16993 - DNA, 101 bp, rice(Oryza sativa)
  misc_feature (71): n=t or c
accataattcattgtacattccaagttattgtagtttaacagtacttctggcacaatgttgacacctcctncattttttttacctttttgactttcatgca

SEQ ID NO: 16994 - DNA, 101 bp, rice(Oryza sativa)
  misc_feature (71): n=a or c
tagattctaaagcatctgcagaggttaagtcctgtgcgttcttctccccaggtttaaactgttgctgaaanaataatttagagacaacatactgcccttct

SEQ ID NO: 16995 - DNA, 101 bp, rice(Oryza sativa)
  misc_feature (71): n=t or c
atatacattgtatagatgaaattgggaatacataccttgtactccatgtcagctatacctgatgccagatnccctgcggaacaagataagacaggaccatt

SEQ ID NO: 16996 - DNA, 101 bp, rice(Oryza sativa)
  misc_feature (71): n=t or g
ttcttgtttttcatacatgcatttggttaatgcattgctgacattttctttggactgatcactttcaggcntgcccggtgagtttagtggtgaccagaggc

SEQ ID NO: 16997 - DNA, 101 bp, rice(Oryza sativa)
  misc_feature (71): n=t or c
catggggagaggagtcggcttcccttgttttccttcgccttctcgtcaggtggatgttattgagggggatngggattgggatgcttggaacgggtggatgt

SEQ ID NO: 16998 - DNA, 101 bp, rice(Oryza sativa)
  misc_feature (71): n=a or c
tttgagaactgccgtaacttggggtgctcatggttgccccacctcagcaacctcaccatcgatgattgtcntgatttcactgtgcctcatccttttccccc

SEQ ID NO: 16999 - DNA, 101 bp, rice(Oryza sativa)
  misc_feature (71): n=t or c
gatcccggcgtctcttgcggtgctcaggaacttcgaggtgatacatctccagtggaacaatctatctgggncgatcccggcagcgtggggggagctacggt

SEQ ID NO: 17000 - DNA, 101 bp, rice(Oryza sativa)
  misc_feature (71): n=a or c
agtagtagagcaaatgatggcaacgatgagaacgctagcagccacctccagcccaaacttggcattacagnctgaaaattaaacaaataataagttcctac

SEQ ID NO: 17001 - DNA, 101 bp, rice(Oryza sativa)
  misc_feature (71): n=a or g
gctgttgaaaggggcagaaggaatatagttgagtatgctcaccgtactcgatcattggctaggattttcantatgcaagacaatgatggcaacaccgcaat

SEQ ID NO: 17002 - DNA, 101 bp, rice(Oryza sativa)
  misc_feature (71): n=t or c
ggagccgtcatggttgttgatgaagttgagggtgccaatgaagctttagtggctaggaacacgcgttctgntgcagctggtatgctcttggcccctgacgt

SEQ ID NO: 17003 - DNA, 101 bp, rice(Oryza sativa)
  misc_feature (71): n=t or c
gttttgagttgtaaatgatgacttttacggcgatgaagcgtgtgggatggagtagtaataatctggaggtnaacttggcaaaatcccatcgctgatgtggg

SEQ ID NO: 17004 - DNA, 101 bp, rice(Oryza sativa)
  misc_feature (71): n=t or g
acccggatcccagttgtgcttcactagccgcggcactaggattcgacgacatcgtgtggatttggttgganccaagccttgatgcatctctctgcccatga

SEQ ID NO: 17005 - DNA, 101 bp, rice(Oryza sativa)
  misc_feature (71): n=a or c
tacatgctactagtacacacaagagttctaagtcaaccagctagcaccaatcaatgtctgtcttacaatantggaacaacaaatggggtggcaaatagtag

SEQ ID NO: 17006 - DNA, 101 bp, rice(Oryza sativa)
  misc_feature (71): n=a or g
cggcccagaaggcccgttgcgcaagcaagagttgcccgtaaatggagtatatttgtcaccgttgtaaggcnccgttgcaactttgatcacggaaaataatt

SEQ ID NO: 17007 - DNA, 101 bp, rice(Oryza sativa)
  misc_feature (71): n=a or g
tctgaagaggttggcgcactacgctccacataaacggaaaagtccaaatagtggtgcattgaggagagaancccatatagtagagcccacccctaaccaat

SEQ ID NO: 17008 - DNA, 101 bp, rice(Oryza sativa)
  misc_feature (71): n=t or c
tcgatccaaatggcaagcacatcagggaattgatccatcaagccactcaagtaacattagccacaattcanggtattccacgcaaaatagtatatgcaaaa

SEQ ID NO: 17009 - DNA, 101 bp, rice(Oryza sativa)
  misc_feature (71): n=a or g
gtcgtcagaactggagcaattactatacatgtgtgccaacttggggggtattctgcagttatcatgtactncacgtcttccattcccactacaatgtttag

SEQ ID NO: 17010 - DNA, 101 bp, rice(Oryza sativa)
  misc_feature (71): n=a or g
ggcgagatcgtcctcccctcctcacattatcagagcttgaagctcttcctctctctctgctgtcaactccngccgactccgccatcggtcgatctcctccc

SEQ ID NO: 17011 - DNA, 101 bp, rice(Oryza sativa)
  misc_feature (71): n=t or g
gatagcgtactttttttttctcgatcaggtccaactccaaattagaatgtcttctattatctttagtacanatggccataaggcccgaggcccgacgaccc

SEQ ID NO: 17012 - DNA, 101 bp, rice(Oryza sativa)
  misc_feature (71): n=t or c
gcaactgtggctggaggagagattttcacatctgaagacattgtgggtgtagtcaaaactgcactcttagnatttccatcttttgatccaacaaccgcaga

SEQ ID NO: 17013 - DNA, 101 bp, rice(Oryza sativa)
  misc_feature (71): n=a or g
gaaaatgcattcagaatttcagattcagcgtgtacaagtgctattgttcttaatctgcctcaattataggnaacttgctcgaggtgtaggacggttggctc

SEQ ID NO: 17014 - DNA, 101 bp, rice(Oryza sativa)
  misc_feature (71): n=t or c
cactcacgcttccaagaacagctctgcagggaagttcaggcatgccagtaagaccaatgtaggtgaataanatgaagtagggaacggaaaaagatgattgg

SEQ ID NO: 17015 - DNA, 101 bp, rice(Oryza sativa)
  misc_feature (71): n=t or g
ctggcggctgatttgctgaaaatgagttcatattgctgccgcggcatttgtaggattcgttgtttggttgngttcctcggctgtttctgtttgtgaagctt

SEQ ID NO: 17016 - DNA, 101 bp, rice(Oryza sativa)
  misc_feature (71): n=t or c
aattatccgcacagcaccgtgcatttcacagcataaatggccgtccaatcaacgtgacccgaatgctctgntctggacgctgcagtttttgagcccatttt

SEQ ID NO: 17017 - DNA, 101 bp, rice(Oryza sativa)
  misc_feature (71): n=t or c
ggaatactcaataagtacaagtccaactgcataaatgcctcgtgaaggggttatgagaggttgcagcttangagcaccctgcatataatatatttttggat

SEQ ID NO: 17018 - DNA, 101 bp, rice(Oryza sativa)
  misc_feature (71): n=t or c
ttcacttaaacttcttttcacgaaagctaattttttcactagcgatatagagcgcgagactcccaggtgtngcctcaagctgtcttaccttggtgcgatgc

SEQ ID NO: 17019 - DNA, 101 bp, rice(Oryza sativa)
  misc_feature (71): n=a or c
aacagcgcgggtttgcgtgatgccaagggaaggacattcctctatgtcgcagttgagaaacagagtttagntgttgttaggttcgcttgccggactacgtc

SEQ ID NO: 17020 - DNA, 101 bp, rice(Oryza sativa)
  misc_feature (71): n=t or g
ccaaatagattatcatgtgagtcaagtgaccaaggacaagccactgcagaagcttcaaaaattagtgagcngccaaaggtacctccttgtattggatgacg

SEQ ID NO: 17021 - DNA, 101 bp, rice(Oryza sativa)
  misc_feature (71): n=t or c
atttggtttaagttcttttctgatgattcagcaaatagtcgagaattgccagtcaaggttgacaacaacancaaacattcattttcctggattgcatctac

SEQ ID NO: 17022 - DNA, 101 bp, rice(Oryza sativa)
  misc_feature (71): n=a or c
cattcaaagccgccactgctgttactgcagcagacaagcagttacactaatacagtacaaataaattggtnagttttatttcatgatcccataaaaaaaat

SEQ ID NO: 17023 - DNA, 101 bp, rice(Oryza sativa)
  misc_feature (71): n=a or g
ctattatacaccagtaccttatgcatcaactcctcgaacctactgtaatactcctctatagttccctcttntttcaagttatcaagtttctctaagaattg

SEQ ID NO: 17024 - DNA, 101 bp, rice(Oryza sativa)
  misc_feature (71): n=t or c
ctacacccagattcagacgatgaggaggtactatgagccagccaccatctcctctcctttgaattcactcntaatctgtctatatgatgtgttccacttga

SEQ ID NO: 17025 - DNA, 101 bp, rice(Oryza sativa)
  misc_feature (71): n=a or g
accgatcctcggcttgttcaactgcttcctattggagttctgctcacaaccatttgtagctaaaatcctancaatggtggctgtctccctctcactgcttg

SEQ ID NO: 17026 - DNA, 101 bp, rice(Oryza sativa)
  misc_feature (71): n=t or g
ttgcaatgctgaagagaattaaagaacactataataataaacgagagggtctataagcaccttgcagatantctttgtagcatttagggaggttactgcat

SEQ ID NO: 17027 - DNA, 101 bp, rice(Oryza sativa)
  misc_feature (71): n=a or c
ttgaaagatttcacatagggcttgttaagcatcatgagttctctctccagtgctaagtcgtcttcgttggngagcaccaagcttcttgctgcagcattgct

SEQ ID NO: 17028 - DNA, 101 bp, rice(Oryza sativa)
  misc_feature (71): n=a or g
ccttagttgcctttatgcttatgcagagaaaaaggacaacatgccactccgaatcgggttttgacaaaatnccaccccctacaatacaaaggataaaatgc

SEQ ID NO: 17029 - DNA, 101 bp, rice(Oryza sativa)
  misc_feature (71): n=t or c
attatgtagggttctctcatcggaatgactggacccaagcgtggcataaaattctgttcatctgccctaantgagtatgatatgagaatcaagacaggaga

SEQ ID NO: 17030 - DNA, 101 bp, rice(Oryza sativa)
  misc_feature (71): n=t or c
ggcccagcctcgtggatatactcatagagacagggtatgcgtatgcgtatgcgtgtgttataagcaccaangattgtactgtgtttctcaaaagaaaatca

SEQ ID NO: 17031 - DNA, 101 bp, rice(Oryza sativa)
  misc_feature (71): n=a or g
gttttttgctgctgcatttttgtgctctcactgttagaataaattgggctattcctaataaattctgttgntacacaattagtgttaagcgattaatacca

SEQ ID NO: 17032 - DNA, 101 bp, rice(Oryza sativa)
  misc_feature (71): n=t or c
agagcacgcagcggcgcctacataagcgaggaacccgtgtgttttcctgttcccgtgtgttttcattgctnggcggcgggatcctgacgggcaaagaagag

SEQ ID NO: 17033 - DNA, 101 bp, rice(Oryza sativa)
  misc_feature (71): n=t or c
ggatagttttccatgtcatcactgacaagaagacctatcctgctatgcactcatggtttgctttgaatacnctttctcctgccattgttgaggtgaaaggt

SEQ ID NO: 17034 - DNA, 101 bp, rice(Oryza sativa)
  misc_feature (71): n=t or c
tcttgccttgcctgcctaataatctgactgaactgcgcatcagtggttgccccattctgaaggagaagtanggcgaatatggtcctgaatgggacaacata

SEQ ID NO: 17035 - DNA, 101 bp, rice(Oryza sativa)
  misc_feature (71): n=a or g
agcttgctaaaccgaggcagttttactatcattgtgatccccaagtttccaaataaaacaaaagtggaccnacccgtttcaggttatcagatgttttgatt

SEQ ID NO: 17036 - DNA, 101 bp, rice(Oryza sativa)
  misc_feature (71): n=t or c
tcatatatatttgtgagcaccatctgaaccttagtgggtgttataaaacaagccccaaaaatgacattagntaccaaacacggaagaatgccataaaagat

SEQ ID NO: 17037 - DNA, 101 bp, rice(Oryza sativa)
  misc_feature (71): n=a or c
ctgttcaagctgtgctctgctggccatctatggcaagctcatgatctgtgtcaagtacgaatgtacaatcngcaaataattatcgagctggccctaaaaca

SEQ ID NO: 17038 - DNA, 101 bp, rice(Oryza sativa)
  misc_feature (71): n=t or c
gaaggcgccgtcgcggtaggcgatgtcggagtagggagaccagtagtaggaggaggtggtgatccagtgcnactgcttgtcgtccccgaccctcgcgaacg

SEQ ID NO: 17039 - DNA, 101 bp, rice(Oryza sativa)
  misc_feature (71): n=t or g
tgaagtagcaacatctactctgccaactggtgtatacaatcaggctttgcattggatggctattgcacatnctgaagcctatgactacatacattcgaaaa

SEQ ID NO: 17040 - DNA, 101 bp, rice(Oryza sativa)
  misc_feature (71): n=a or g
agcgaactagatggtagagccatagagatacttggaacactacccaacctcatgctcctgaatctcgatgncagagcatatgttgggaatgaattagcatt

SEQ ID NO: 17041 - DNA, 101 bp, rice(Oryza sativa)
  misc_feature (71): n=a or c
accatggtgttcgatgctggcagctgcgatgggtgtagcttggcgatggcggtggcgtcctcgacgtaggnggcgttcgtgccggtgccgaggatgacggc

SEQ ID NO: 17042 - DNA, 101 bp, rice(Oryza sativa)
  misc_feature (71): n=t or c
caaaacgttgcttagttttctgtagtaattggactatcagtgcaagtatcatgagtgtttgtctgctgccnctaaaaacatcacgtaggattaggtgatga

SEQ ID NO: 17043 - DNA, 101 bp, rice(Oryza sativa)
  misc_feature (71): n=t or c
gcagtagtagttgcaaagcgaagcaacatgcacattgaacgggggtacactgctctccaacttgccgctgncgccagcgagcgcggggcttgccgcctatc

SEQ ID NO: 17044 - DNA, 101 bp, rice(Oryza sativa)
  misc_feature (71): n=t or g
accactttattttattttacaggaggtaaaacaatcctataaactttcagttagtaaagcagcccgatganatcgacggcgatgttacagtgcgtcgccgt

SEQ ID NO: 17045 - DNA, 101 bp, rice(Oryza sativa)
  misc_feature (71): n=a or g
ctactattcctcgtattgtctggcctacacccatttttcctttcacatattgcactgacccatcagggttntaggtatgcccagtgaagtacctacaggaa

SEQ ID NO: 17046 - DNA, 101 bp, rice(Oryza sativa)
  misc_feature (71): n=t or c
gccgcggggtgtttcatgctacgtacaatgtatggtactagaaatttaacgaaaccacgcggtttctgggnctcacatatacgcatatatatgtgcactag

SEQ ID NO: 17047 - DNA, 101 bp, rice(Oryza sativa)
  misc_feature (71): n=t or g
agcggcactgggagtatgacaacgatgacgctaggcgggcagggagtgaacggcagacgtgatgggaaaangaggagaaagagagagggggtgggacccat

SEQ ID NO: 17048 - DNA, 101 bp, rice(Oryza sativa)
  misc_feature (71): n=t or c
gcgtcagatgcttatgcagagaaatgacagtagcaatagcaaatggatgttgtcacggagggcattttcgncttttcacgtgagtgctaaatttgcatggg

SEQ ID NO: 17049 - DNA, 101 bp, rice(Oryza sativa)
  misc_feature (71): n=t or c
aatattaaaaaaatacttatttgttcgtcatcttataggtaagtttggcttttttttttcagtcccaccanaaactgcattatcaaatagtaacctctttt

SEQ ID NO: 17050 - DNA, 101 bp, rice(Oryza sativa)
  misc_feature (71): n=a or c
agagagaaaagctcccagatcaacaagtagagaatgtaatgttatgggaaagagagaaaaatgaggcgctnaccggccggcggcgaggacgccggcgccgc

SEQ ID NO: 17051 - DNA, 101 bp, rice(Oryza sativa)
  misc_feature (71): n=a or g
gagctgggaagctttaggcattcccaagaggccccgggatatgtttgagtaggttaagattttaaaatgcngctgctgagaatctgaagaagctaaaaacc

SEQ ID NO: 17052 - DNA, 101 bp, rice(Oryza sativa)
  misc_feature (71): n=a or c
ttgcgcaatcggcgacgacctaatgcatacttgcgtcggaagaatttactgctgccatcttccgatgatgntgcccgtaatggcaatggtaacagtattgc

SEQ ID NO: 17053 - DNA, 101 bp, rice(Oryza sativa)
  misc_feature (71): n=a or c
attaaattaatgaaaaattaacacatttgaggtctaaaggcatagcaaatcgtacatcatctatcggtagnaaatatggtacacccctcaaatagttaggt

SEQ ID NO: 17054 - DNA, 101 bp, rice(Oryza sativa)
  misc_feature (71): n=a or g
atgttttaccatcgacaagtaatattataatgctactcacagatagaccaagccccaaaacccaaaatttngctggtcaaatggtcagctagttggccttt

SEQ ID NO: 17055 - DNA, 101 bp, rice(Oryza sativa)
  misc_feature (71): n=t or c
aacctcctacttaaagtaggagtagaacttctagttccactaggactcaatacacaatttccatacctttnacaatttcccaaaacctgcagccacaccgg

SEQ ID NO: 17056 - DNA, 101 bp, rice(Oryza sativa)
  misc_feature (71): n=a or c
gttgtttgctcgcttggggacagagtcgatcctcgcttaccagcttgacaagtttgacaccggggagaaantgaacggagtaggaacttattctcttatta

SEQ ID NO: 17057 - DNA, 101 bp, rice(Oryza sativa)
  misc_feature (71): n=t or c
tgtagaggagaaggatgcaattattagatggagtagtacactcttgcaaaagtgatagtgagtgtataggnagctgctggctgcagcatgtactgtagtgt

SEQ ID NO: 17058 - DNA, 101 bp, rice(Oryza sativa)
  misc_feature (71): n=a or g
ctcaacttgtgaaaggataccagaaactgattctacctcggtttccgttaacgtgcgtcttacaaacagtnttgaacgatgtgttttcgtgcgaaagttct

SEQ ID NO: 17059 - DNA, 101 bp, rice(Oryza sativa)
  misc_feature (71): n=t or c
catgatgactttattagcactcttgccgagaaagaaacgaggtagttaaggtcaggagtcagagaacttangttgacaatgcgagttgcttcaccaagtgc

SEQ ID NO: 17060 - DNA, 101 bp, rice(Oryza sativa)
  misc_feature (71): n=a or g
ggaatgcacaatcgacctcccaaaattactcctgagcagttgaaggagctattagaagaattattcgaagnttgaagcagatgaatttcagtggaataaat

SEQ ID NO: 17061 - DNA, 101 bp, rice(Oryza sativa)
  misc_feature (71): n=a or g
agcacacacatgcatcttttactacaaactccagagaaactcagacatccaagaaaccaaggtccaacttntccgttgaacacacatgcatgtgcatattc

SEQ ID NO: 17062 - DNA, 101 bp, rice(Oryza sativa)
  misc_feature (71): n=t or g
ctttatttacgtgagtttcaaacatcaccgtagtattttgttatacgatttggttagcctgggtcgaggtngtgtggctgtatggtcaagttgcaaggatc

SEQ ID NO: 17063 - DNA, 101 bp, rice(Oryza sativa)
  misc_feature (71): n=a or g
cctgcacccccttaccctgtcaaggaggctccaattctcagagaagttcctgtgcatatttcccctgtcanggagacttcattcctgagagaagttcctgc

SEQ ID NO: 17064 - DNA, 101 bp, rice(Oryza sativa)
  misc_feature (71): n=a or c
gccaattagttactcatattcatttttctggcatctacaaccatgacgatgctatcaattcttgtgagganttttgctggaaacactagttcaaagttcaa

SEQ ID NO: 17065 - DNA, 101 bp, rice(Oryza sativa)
  misc_feature (71): n=t or c
tctccagaccaccgaaccagcaagtgctccaccatcttggatcctttccaaatgaagcaacgatccaacanttgcgatggaacaactgatgtaccagcagt

SEQ ID NO: 17066 - DNA, 101 bp, rice(Oryza sativa)
  misc_feature (71): n=t or c
ctgaggtcccccccccccccctaaatttcaagaacagcgacgaacggtggacatggttagaacatcttacnaaacaatcgcaagaaaaggatttttatcga

SEQ ID NO: 17067 - DNA, 101 bp, rice(Oryza sativa)
  misc_feature (71): n=a or g
cattggcccattccgttaatcacctgaagaggacatcacctgaaggggacaatagtagttttaggaacagnttaagacttaagacgttcaaaaacttggaa

SEQ ID NO: 17068 - DNA, 101 bp, rice(Oryza sativa)
  misc_feature (71): n=t or c
tgttgatatcagcatgaacacgcacctgaaaactgtgaaactcacattgaaagggaaaaatcctgttaccnttgatcacctcagtgtgaggggaaacaaca

SEQ ID NO: 17069 - DNA, 101 bp, rice(Oryza sativa)
  misc_feature (71): n=t or g
ttatgctgaaaacatgttgaggctttctcaaagcaattcatcaggaaaaaagaggaggaaaaataatatangaaaccttgagattttcaaggtcactccta

SEQ ID NO: 17070 - DNA, 101 bp, rice(Oryza sativa)
  misc_feature (71): n=t or g
tggcgctgtcaggcggtttctcaacaggaacgacgacgactacgatgattactgaattaattactgtgttnctgatactgttaggaacgatgtcatcagat

SEQ ID NO: 17071 - DNA, 101 bp, rice(Oryza sativa)
  misc_feature (71): n=t or c
agctttctccactgtaagtgttgaacagaccaagaagggtcaggttacaaaaattggagagtgatggaagnggatcaatgctgagcctgctattctgaaga

SEQ ID NO: 17072 - DNA, 101 bp, rice(Oryza sativa)
  misc_feature (71): n=a or g
cactttgttgcaataagaacagagaagggaattattccacaaaactgaccgtgtcgtcaggcacaagaggnctccacaccattcccagcgctgcatggctc

SEQ ID NO: 17073 - DNA, 101 bp, rice(Oryza sativa)
  misc_feature (71): n=t or g
catggcgctttgggcaaaacatgcgaactaggacattgcgttgattctgtcgtacgcttgacgagcctttnctggcctctccgttctttattgtgttcttc

SEQ ID NO: 17074 - DNA, 101 bp, rice(Oryza sativa)
  misc_feature (71): n=t or c
gcgccatcgacgccggcgacgtgcgtgatgacgcaagtgtagctctcagagagctcggcctcctctctcgngcggcgccgagccgccgcgccgatggcgat

SEQ ID NO: 17075 - DNA, 101 bp, rice(Oryza sativa)
  misc_feature (71): n=a or c
aaggaggaggaggaggaggagaaagaaagaaggcctctctctgtggtttgatctagtcgagttttaaatgnattttgattttttggatttgttttggttta

SEQ ID NO: 17076 - DNA, 101 bp, rice(Oryza sativa)
  misc_feature (71): n=a or g
caaccagagaaattaaacaatcaaaagaaaccaagttaccaaccaagcgccggtcccctgaaacctccgcnacggcgagcccgtaggagggatccccgatc

SEQ ID NO: 17077 - DNA, 101 bp, rice(Oryza sativa)
  misc_feature (71): n=a or g
caactcgcttggttttgctctgctttgagaacaagtgggcagaaaaatggtgaagaacattggaagaagangatataataaaaaaattcataaaaacatgt

SEQ ID NO: 17078 - DNA, 101 bp, rice(Oryza sativa)
  misc_feature (71): n=a or g
ttgagatgagggtatccgttctagtgaaagctggtggaaatgaatatagaggatgattgcctatgtctagntgaagaaattgctttgttctgaaataaatt

SEQ ID NO: 17079 - DNA, 101 bp, rice(Oryza sativa)
  misc_feature (71): n=t or c
aggcaccttgcacgttgttgctaagggtatccctgttgtatactctgctgggaatgatggacccattgctnagacagtggagaactcatcaccgtggctgc

SEQ ID NO: 17080 - DNA, 101 bp, rice(Oryza sativa)
  misc_feature (71): n=t or c
gctcggattcgcgtctgttccaaaaatggagatggagatggttttagagcacaagaggccatgacagaggntgccatgcgtaagatgctatctcttactct

SEQ ID NO: 17081 - DNA, 101 bp, rice(Oryza sativa)
  misc_feature (71): n=a or g
aattggcgtatcagtttagctttctgtgtatttgttctaaatttgtgggtgtgtacacagttgcaaacagngttaaagaatcttggaagcccccctggttt

SEQ ID NO: 17082 - DNA, 101 bp, rice(Oryza sativa)
  misc_feature (71): n=t or c
cattctaccgttccgatgatccaagtcggagtctacgtggaactcaccattttgatagctgctattgtttncttgtggacgttggtcggcatcaatgttac

SEQ ID NO: 17083 - DNA, 101 bp, rice(Oryza sativa)
  misc_feature (71): n=a or g
ctggatgaaggcagggatcactgaatgtgatctggttatgacggttagtccacattatgtcaaagaactcncttctggcccagataaaggtgttgaattgg

SEQ ID NO: 17084 - DNA, 101 bp, rice(Oryza sativa)
  misc_feature (71): n=a or g
actatcacatgataagtaagctaatcaactaagctgtgttcttttcaactgagtactacctcgaagcgacnagtaatatgggacggatgtagtattaactg

SEQ ID NO: 17085 - DNA, 101 bp, rice(Oryza sativa)
  misc_feature (71): n=t or g
cttgaggaacaccaaactgtggattcatcccttcatttgtttctaatgcatccttagtacccaggtgtgtnaaggatttgccacattttggtgttgcacaa

SEQ ID NO: 17086 - DNA, 101 bp, rice(Oryza sativa)
  misc_feature (71): n=a or c
tcactgcaactagctgagaacttccctttccaaactttcaaggatcctaatggaagcattttttcacaggngagcacacaagcgaacactacaatggctat

SEQ ID NO: 17087 - DNA, 101 bp, rice(Oryza sativa)
  misc_feature (71): n=t or c
aatgctagatctcctactcaaaaccttggaggacaacaagaagaaaagaatggaggcagaggagaggaatnggatggacatgaaggagctcaaggcggtgt

SEQ ID NO: 17088 - DNA, 101 bp, rice(Oryza sativa)
  misc_feature (71): n=t or c
cagagaccacaagaggggcggcctatcaccgtattgggtttagcaattactccttcctttgtaatatgtgntatttatactatcttttttaaaagaaaata

SEQ ID NO: 17089 - DNA, 101 bp, rice(Oryza sativa)
  misc_feature (71): n=a or g
ctcttaagtatttcagccagcttttcgggtatcatcgtgtttgaaccaaaaacccctgatgtcggtggctncttcgatcttgaaaccatcacattattgtc

SEQ ID NO: 17090 - DNA, 101 bp, rice(Oryza sativa)
  misc_feature (71): n=t or c
aactaccgcaagagtttgtaagcacaaattgagcctgttaagtaaccttgatggactgtggctgcagctanaccaacagtaactacaacaatagcggtaca

SEQ ID NO: 17091 - DNA, 101 bp, rice(Oryza sativa)
  misc_feature (71): n=t or g
ctcagttgattttaaagcaacaggcaaatgactagaagggcttccggaaatatcatcaatcagcttctccncaacttccataatatcttccttagaaccag

SEQ ID NO: 17092 - DNA, 101 bp, rice(Oryza sativa)
  misc_feature (71): n=a or g
atcctcttcctcttcgcatggtaaatcaccatcactccgcttgctactactcgatcgaatgcttcaccacnttaaccaaacaacattacgaatgctttgcc

SEQ ID NO: 17093 - DNA, 101 bp, rice(Oryza sativa)
  misc_feature (71): n=t or c
ccacaatagatgcccgcgcgaatgcgtattaggaaatagttataacccctcaagccgccacgtggcatccnaaaaatactcccgagtcgccatgtgacatt

SEQ ID NO: 17094 - DNA, 101 bp, rice(Oryza sativa)
  misc_feature (71): n=t or c
tataattaggtttacgacttgtgctgtcgtgcttggttgctgctgaaaaattcttgtgtttcattgtagcnagatgtgccaccaagtcatcacgaggagat

SEQ ID NO: 17095 - DNA, 101 bp, rice(Oryza sativa)
  misc_feature (71): n=t or c
acaatgggtttgcaggcaacccgtacctggaaggagggtgccaaggtaaccaactcactgcaattcacttntatttttcaagttcaccttatgtccatctg

SEQ ID NO: 17096 - DNA, 101 bp, rice(Oryza sativa)
  misc_feature (71): n=a or g
atgaagagaaacttttttaattagcatctcccctaaggcataaagctaccgggtaaccagaaatacctatntttctttacttaatgtcactactagaaata

SEQ ID NO: 17097 - DNA, 101 bp, rice(Oryza sativa)
  misc_feature (71): n=a or g
tcaaatgcagctcatactattatattgcaccatggaaaaggatggatgcacatccctagacaagtatcacntagaagaatgtatattgaaactggagtact

SEQ ID NO: 17098 - DNA, 101 bp, rice(Oryza sativa)
  misc_feature (71): n=t or c
aagaccccgtcaggcacgcaatccactgtcatcgaacttagtgacagaggtgtgcagacacctgcaacagntgccaccggccttggcgagaagtgggccaa

SEQ ID NO: 17099 - DNA, 101 bp, rice(Oryza sativa)
  misc_feature (71): n=t or c
aaataatcatttgattggaccactggaaaacacaggataaacacataaataatcgtttggtcggacaacanggaaaatgcaggaatgatcatttgattgga

SEQ ID NO: 17100 - DNA, 101 bp, rice(Oryza sativa)
  misc_feature (71): n=a or g
gtgtaatccatacaggtgtgcgtcgaacttgcgtgttatttaatacattctcaatttttatttcgtttggngtaatgaattagtggttgatcttttttcta

SEQ ID NO: 17101 - DNA, 101 bp, rice(Oryza sativa)
  misc_feature (71): n=t or c
ctgaagtacgaaatcaggtattctccccccaagtatcaaaactagttcaaataatcccctagtggttttanggtgcacacaatgacatggcgatggttttg

SEQ ID NO: 17102 - DNA, 101 bp, rice(Oryza sativa)
  misc_feature (71): n=a or g
tgtcaactcaaaccttattacatggatacatggttagttcctgtctacacttcacatcagttctgttaccntatattcaattgtaggctgtcattttgatg

SEQ ID NO: 17103 - DNA, 101 bp, rice(Oryza sativa)
  misc_feature (71): n=t or g
cttcagcaaatcaattgttagccaaatttgttgaatttttggataaaatagataaggggcaattgcgattntgatcctattttgaaacctaactaccaatt

SEQ ID NO: 17104 - DNA, 101 bp, rice(Oryza sativa)
  misc_feature (71): n=a or g
gctaaggaagctaggtgtggttgttgatgataagagaggtcaccttgggaatttgcttaaagcaatcagcnacctacatgagtgcatccgttctctgacaa

SEQ ID NO: 17105 - DNA, 101 bp, rice(Oryza sativa)
  misc_feature (71): n=t or c
ctcttatctgccaacacgaggttatactcaatttctgtaggacctccgcatgttgcagcatcagagatagncacttcccattaattccacaagaagcaata

SEQ ID NO: 17106 - DNA, 101 bp, rice(Oryza sativa)
  misc_feature (71): n=t or g
atcaaatgttgcaccaataaaggcaagtgtgttgaattacttgttcctgtacatgagctgttgtttgtatnagtgaggttaaggattttggtatcctttca

SEQ ID NO: 17107 - DNA, 101 bp, rice(Oryza sativa)
  misc_feature (71): n=t or c
tgggtggttgggaggagggttttcgattgggtgggcggtttttttttccttctcgtttggttttttgggtntgtttggaattggacgctaccgagtttttg

SEQ ID NO: 17108 - DNA, 101 bp, rice(Oryza sativa)
  misc_feature (71): n=t or c
ttagcatgcccacgaaaatattgaagctatccttcccacgcttaggttcttctccaaggaaattgctatgnatatgacccaactgtccgactcagatacga

SEQ ID NO: 17109 - DNA, 101 bp, rice(Oryza sativa)
  misc_feature (71): n=t or g
gattctgatctgagtgagcttcttaagttgtggatttgtgttggccatccagcacgggaacgtttcccctncataagaaatgatctccagtattttcaacc

SEQ ID NO: 17110 - DNA, 101 bp, rice(Oryza sativa)
  misc_feature (71): n=a or g
tcagcaacatctattgagctatagacgctacaagtatatccttggtggttttctgtaaaacaagttcacgnctgtaaaagcgagcattatttgggaccgca

SEQ ID NO: 17111 - DNA, 101 bp, rice(Oryza sativa)
  misc_feature (71): n=t or c
aaaaggagagatgcgatcctttgcccaaaccctggagccaaagtctcgaataatagaatcacatcatcacntcaaacctcttctattcccatgcctctctc

SEQ ID NO: 17112 - DNA, 101 bp, rice(Oryza sativa)
  misc_feature (71): n=a or g
gtatgcttttgctacacctgtcatagggatgtcatcgatagatccaccttggtatgcaacttgtccaaccnctcccttgttgttcaagctttgatgcaatc

SEQ ID NO: 17113 - DNA, 101 bp, rice(Oryza sativa)
  misc_feature (71): n=a or c
ggacctttcaaacaaccaactgactggtactattccagaatcaatcatgctaatggacaagctccaagttnttaatctctctggaaatatcatgtctggca

SEQ ID NO: 17114 - DNA, 101 bp, rice(Oryza sativa)
  misc_feature (71): n=a or g
atcacatatgcattctgatttccagagtcctttttggtgaagtttgaatgattccaaaaggaaacatcttngactagggaatgtatgattctgtaagaaca

SEQ ID NO: 17115 - DNA, 101 bp, rice(Oryza sativa)
  misc_feature (71): n=a or g
tccatatgtgtttcacaatcttgtgtttcagagtgggtcttatgggctatctgagagcttctagcaactgnatcttttttttaggatcaagagctctccca

SEQ ID NO: 17116 - DNA, 101 bp, rice(Oryza sativa)
  misc_feature (71): n=a or g
tctcaggcgcgtgccacgtggcgggccctcgtacgtccaagcgcgcccgtttcttttttcttcttttttcncagctgtcgtgtttctttttttttcttttc

SEQ ID NO: 17117 - DNA, 101 bp, rice(Oryza sativa)
  misc_feature (71): n=a or g
cagtacataaggttagccagcataatctcgagggtaaccgttgctgagtgaattccaggacacattcttcntccagacccaaacggcaggtaatgaaaatc

SEQ ID NO: 17118 - DNA, 101 bp, rice(Oryza sativa)
  misc_feature (71): n=t or g
gtttgattcttttctttctattggtggtctccatcgtctaatctgatgtgttgttgtttgttgttttgggngtggggggattggggattttcttggtttct

SEQ ID NO: 17119 - DNA, 101 bp, rice(Oryza sativa)
  misc_feature (71): n=t or c
tttccatagcttccgagtatcccttatagcacaagccggttcgatcagaaaacgcttatcaacttgtgcgnggacttgtgccggttcattcgtcgcgacat

SEQ ID NO: 17120 - DNA, 101 bp, rice(Oryza sativa)
  misc_feature (71): n=a or g
gcagtaacaaagaagaatcccaatccatccccacgtgatgctgtatataaattgagtaaaattgcaaagancggtgacaggcacaagttactagagcagaa

SEQ ID NO: 17121 - DNA, 101 bp, rice(Oryza sativa)
  misc_feature (71): n=t or c
acgtcgctgccacggatcgagagctccgcgaccatgatgtagatgtggtcggatcctccgggaaccacgangaggccagtggcggcgcctgtctcggtggg

SEQ ID NO: 17122 - DNA, 101 bp, rice(Oryza sativa)
  misc_feature (71): n=t or c
gatgttgtatcctagttaggaaaaaaacatgcgagactcacatgtagttgagtccatgtgttaatcgggcncacatgtcagggttttcttcttctctcctc

SEQ ID NO: 17123 - DNA, 101 bp, rice(Oryza sativa)
  misc_feature (71): n=t or c
cggtggaacttgccggtggtggtgctctccctggggaagggatcggaccacttgcccttgaagtagatggngttcacgagcaccagggtggtgaggcgatg

SEQ ID NO: 17124 - DNA, 101 bp, rice(Oryza sativa)
  misc_feature (71): n=t or c
aacagcatgtcaaagcactatgaacacccttacacaagataaagaggaaaaagtccttcattttccactangcgcgctttccaaactattaaacggtattt

SEQ ID NO: 17125 - DNA, 101 bp, rice(Oryza sativa)
  misc_feature (71): n=a or g
gcaatcacaaatctctcctagagatacggacaaggaacaaggtgcggcgactactttagatcgattcgtcngggtaatcgatatcgatccccacgagccat

SEQ ID NO: 17126 - DNA, 101 bp, rice(Oryza sativa)
  misc_feature (71): n=a or g
aatctatatgagttccagaaatataatcaggaatctggtggtgaagcatacttcacattgcctagaatacnggtatgtttgaccgttctatactaagatgc

SEQ ID NO: 17127 - DNA, 101 bp, rice(Oryza sativa)
  misc_feature (71): n=a or c
ctgtgctgctcagcctcctccttcaggtcatcctcatcttcgtggggcccatgcgcaagcgcacctcccancctgtcccgtgcttcgccatctgggcatgc

SEQ ID NO: 17128 - DNA, 101 bp, rice(Oryza sativa)
  misc_feature (71): n=t or c
aaagctacgtcgaacagtaaaatgttgagcttgttcaagaaaatcagtaatcaatacctgatgatcatccnagagctcttccggaagaataggctcaacca

SEQ ID NO: 17129 - DNA, 101 bp, rice(Oryza sativa)
  misc_feature (71): n=a or g
tgtgctgctattgcctgtgctgctgtcacctgcgctgctgttgtcttgggtgaagtcacatctgccccctncactgacagacggtgagcatcaggagaaga

SEQ ID NO: 17130 - DNA, 101 bp, rice(Oryza sativa)
  misc_feature (71): n=t or c
ctgccgagaactacgcataggatgctagctactgatcggttgttgtcttgttcgaaacttgtactaccttnattttatattataagtcgttcaactttttt

SEQ ID NO: 17131 - DNA, 101 bp, rice(Oryza sativa)
  misc_feature (71): n=t or c
gattacaaaacagtatcatttagagaaaaaaacagaacaaaagttcaaagggaggacgggcgatcgactangccgcgcgcgtacggcgcacgttctttgcc

SEQ ID NO: 17132 - DNA, 101 bp, rice(Oryza sativa)
  misc_feature (71): n=t or g
agaaatgttgagaaaacaaagcgaaattcttcacaggctttttttgtcactgatcgatccagtagctgtcngtgggcggtggctacggctggtggccagtt

SEQ ID NO: 17133 - DNA, 101 bp, rice(Oryza sativa)
  misc_feature (71): n=t or c
aggatgggtccatcctaacaggagatatgtgagatatcggtacccatggtgatagcatcagcgcgacaggnaggcgtctcctccctaattcctgtcacgcc

SEQ ID NO: 17134 - DNA, 101 bp, rice(Oryza sativa)
  misc_feature (71): n=a or g
tgaaaaaaaaaagtagaagatataggtggtgcctaggcacttcgcttgtaagagagccaagagtgtgaaanggattaggagtaggaggcaaatgcggaatc

SEQ ID NO: 17135 - DNA, 101 bp, rice(Oryza sativa)
  misc_feature (71): n=t or g
tgaaataaacgagcaattaggactaccaataaatccgctaatggaacacataatgaacataaattccatanatctaggagtaatattagcactacagtcac

SEQ ID NO: 17136 - DNA, 101 bp, rice(Oryza sativa)
  misc_feature (71): n=t or c
cattttggtgggcatgtgccaaatggattaacagaatacaacgggatggtgtgacgtacagattggtcctncttttcaatgttggaagctactccctccgg

SEQ ID NO: 17137 - DNA, 101 bp, rice(Oryza sativa)
  misc_feature (71): n=a or c
agcacgttggttttgtcctttaccgaataggtgcatggatcgggtcatacggtgtattcgcagttacagtngtagactcgtaggtatgtgtcgacagagta

SEQ ID NO: 17138 - DNA, 101 bp, rice(Oryza sativa)
  misc_feature (71): n=t or c
tcagtcttcgctctctccaccttctccacatcctcaacaatttccctttgcaccatctcctcaaattcatnaaatcgttcgatccttttgacctgattatc

SEQ ID NO: 17139 - DNA, 101 bp, rice(Oryza sativa)
  misc_feature (71): n=a or g
ctcggcccgtcacaggtgagtgtctttgtgacgggccgcaaacctccgttacagatgagtcgttcacgatnccatgttctgtgcaatttaaactatcagtg

SEQ ID NO: 17140 - DNA, 101 bp, rice(Oryza sativa)
  misc_feature (71): n=a or g
atgccataaaaaagtcactatctcaccaaaccgacacctaaatagtaccggagaaacattgcaaccagcancttagctaacagtatcatcagtcctcgtgc

SEQ ID NO: 17141 - DNA, 101 bp, rice(Oryza sativa)
  misc_feature (71): n=a or g
gtcagatccttcttatggcttactacctccattggatattaatcattcccttgctgatatctgtgattctnaagtggctcatatcctgctaaaggaatgaa

SEQ ID NO: 17142 - DNA, 101 bp, rice(Oryza sativa)
  misc_feature (71): n=a or c
catctggcagtggccctcctgttcatcttgttggatctcaagtaggagtagctaggaagaatctgatgtgncacagctgcctgctctccagatgcagccag

SEQ ID NO: 17143 - DNA, 101 bp, rice(Oryza sativa)
  misc_feature (71): n=t or c
ctgccacagtagcgagcggcgatattacaactactggtcaactaagctgcagctgcttcttcttctgctgntgcttcctttgtacaagctggaggaagaag

SEQ ID NO: 17144 - DNA, 101 bp, rice(Oryza sativa)
  misc_feature (71): n=t or c
taattcctcacaatcctatgagatttttcattcaaacctgtgatggtggtgatgacaagttggagatcagngacaagttcacccacatcgccaagttttct

SEQ ID NO: 17145 - DNA, 101 bp, rice(Oryza sativa)
  misc_feature (71): n=t or g
actttccattttttctgttgacaaagggtatctgaggacaatctggcagcaatctgtgcccaggttttctntgcccctcgctcttagccaccaccaggcac

SEQ ID NO: 17146 - DNA, 101 bp, rice(Oryza sativa)
  misc_feature (71): n=a or g
gagattcaatgaccggagaggccagtggactctccggcgagagaggtgctaccaagagttgggatggagcntgaccgagctgccgtttgacgaggccgtcc

SEQ ID NO: 17147 - DNA, 101 bp, rice(Oryza sativa)
  misc_feature (71): n=a or c
aggaacactcgtcgccctccctgttgacacggagcccaagcgctgctattaccacatcgacatcgccatgngtgagctctgttcttgctttggtttcagaa

SEQ ID NO: 17148 - DNA, 101 bp, rice(Oryza sativa)
  misc_feature (71): n=a or g
aactcgtcgtatagaacagatataaccatagccagttactcttatttaatcttagatggatacgtggcagnaagtagtgggcggtggaaaagtaggaggtg

SEQ ID NO: 17149 - DNA, 101 bp, rice(Oryza sativa)
  misc_feature (71): n=t or c
agtatcacagaaggtttttgatcctgaagagttaggacccctccaaaaatttgcaatcgagacagcgtgcnagcttgagatgtttttccctccagcttact

SEQ ID NO: 17150 - DNA, 101 bp, rice(Oryza sativa)
  misc_feature (71): n=t or c
tataaaggataaaacatgttggaccaggcatagagagcaagagccatcgaatattccagttactgaagtgngagatgtatagaacatggaacaagatcgag

SEQ ID NO: 17151 - DNA, 101 bp, rice(Oryza sativa)
  misc_feature (71): n=t or c
gttcctttactagcactagttcattaccactcacttcttccactaagaaggcaggttgtttgcatcatctncttcatctccatgtatataatttgtaagat

SEQ ID NO: 17152 - DNA, 101 bp, rice(Oryza sativa)
  misc_feature (71): n=a or g
cctggcattgttagagcagagatgtagtgaagtctcaatggacctatccagattggactccaaactgcaanctacatctgatgtctctcagctgagaagat

SEQ ID NO: 17153 - DNA, 101 bp, rice(Oryza sativa)
  misc_feature (71): n=a or g
taagaacattgagctgaacttttgcgttcacctacatatagaaacaattcctctactcagacgaacacagncacaggaaggaaactactccctccgtccct

SEQ ID NO: 17154 - DNA, 101 bp, rice(Oryza sativa)
  misc_feature (71): n=t or c
agaggccgcattctgcaaggcctgcgcaaggtttggctttggtctgtatctttaccacgaagacgagactncgtagggaagtggcgcagcatccacttcat

SEQ ID NO: 17155 - DNA, 101 bp, rice(Oryza sativa)
  misc_feature (71): n=a or g
tggccacatacaccacaaacaaaatacaaggtagctagctatagctgcagaagagaagggaaagcaatcangcatcagcagctagggagagagagaaaaga

SEQ ID NO: 17156 - DNA, 101 bp, rice(Oryza sativa)
  misc_feature (71): n=t or c
agcttttgtgagtgggattgtggggattctgtgcttcagcataattggaacatggagagtgcccatgtttntgggggtgctttctgctttttctttatttt

SEQ ID NO: 17157 - DNA, 101 bp, rice(Oryza sativa)
  misc_feature (71): n=a or g
gagccaatcaaggagggtgatcctatttctgcgcgttgtttaaattcaaatccattgtcttcctgtacgcnttgtttggataagggccacaatgcttctaa

SEQ ID NO: 17158 - DNA, 101 bp, rice(Oryza sativa)
  misc_feature (71): n=a or g
agcttgcttaggcaagctattgctgaccatgcacgactaaaccacgattagacgagctaattagtttggcnacgacaatgcgtacgtacggcgtgcatggt

SEQ ID NO: 17159 - DNA, 101 bp, rice(Oryza sativa)
  misc_feature (71): n=a or g
accataatgtgctagaagtacttatgtgtgtttaaactttaaagctctgagcctctgagcaatcagcctantttgattcttgcactgtttgcttcattgac

SEQ ID NO: 17160 - DNA, 101 bp, rice(Oryza sativa)
  misc_feature (71): n=a or g
gcccaaaatagcagactttggtatggcacgcatatttggtgacaaccaacagaatgccaatactagaaganttgttggaacatagtgcgtaattctttgtg

SEQ ID NO: 17161 - DNA, 101 bp, rice(Oryza sativa)
  misc_feature (71): n=t or c
gcatcaatattttccaatgagcttactggtagattaaagccatgcaaagtgcgcaatgacttcaattttcnaatcccatccggtaatccccccttatgctg

SEQ ID NO: 17162 - DNA, 101 bp, rice(Oryza sativa)
  misc_feature (71): n=t or c
cagcaatatagtaggcatagaagaatacataatgcagcacatgccacaacaaattgatcatactagcatgnactaattaataatacatataaggtgatgat

SEQ ID NO: 17163 - DNA, 101 bp, rice(Oryza sativa)
  misc_feature (71): n=a or c
agactaaaaatgcataaaaggtctctcaaaatagtgaaagcacacagttatcagccaaagagcatgttctntattataagttaattaaacatgtgcccatc

SEQ ID NO: 17164 - DNA, 101 bp, rice(Oryza sativa)
  misc_feature (71): n=t or g
tcccatgtggactgaaggaatgagcctgatacaatgcaagggggtaaaaaaagtacaatgagtagcagtgnattagttatctttttacaccaagtagaaat

SEQ ID NO: 17165 - DNA, 101 bp, rice(Oryza sativa)
  misc_feature (71): n=t or c
actgcggaaccacgatgacatcgaattttttaccgcgtcggcactgttcaatcactgtttgtacactgttntgtactgttcatacgacggttctgcgtaac

SEQ ID NO: 17166 - DNA, 101 bp, rice(Oryza sativa)
  misc_feature (71): n=t or c
gtttccaagtaatttttttatatggttgatggaaaaggacaatgaaggggaattctgtgtatcgtgtagcngctagagttcattatgtgagatgttgatta

SEQ ID NO: 17167 - DNA, 101 bp, rice(Oryza sativa)
  misc_feature (71): n=a or g
atactcctgggcaagaaggttgcccagcttgcccaggagagatctcatggtggcttccgaagcacctaccnccaactccatcgtcgatcttgttttctgta

SEQ ID NO: 17168 - DNA, 101 bp, rice(Oryza sativa)
  misc_feature (71): n=t or g
actacttatatgcatttcaagaaaggagagattccaccacgaggcgtgcaaactattttcgtaactatttntactataaaataaactatcacatttaaaac

SEQ ID NO: 17169 - DNA, 101 bp, rice(Oryza sativa)
  misc_feature (71): n=t or c
ttattttgaatcctgaaattctgctaacttaacttaaagtacaattgacagataggtagatgtaacttacngaaaatgaaactttggagtctctacaagta

SEQ ID NO: 17170 - DNA, 101 bp, rice(Oryza sativa)
  misc_feature (71): n=t or g
taatatggggtcgttctcgttgccttttgggacgattcattcgattgagccggcattcaacctctctgcanggtgagtggcgatcctatacagtcctagcc

SEQ ID NO: 17171 - DNA, 101 bp, rice(Oryza sativa)
  misc_feature (71): n=t or g
ttggatatttttttagaaactcaacacgcgtacaccctagcccttagagtaccttcaaaagattgagatgncacattttgagattgatgaagtcaccgtga

SEQ ID NO: 17172 - DNA, 101 bp, rice(Oryza sativa)
  misc_feature (71): n=t or c
gcagcacgtgttctattcacaaactaacaacaaatgttcagcatattccacatgatcacatcacgcagcangcacatgcccattttgctcatctgtaacca

SEQ ID NO: 17173 - DNA, 101 bp, rice(Oryza sativa)
  misc_feature (71): n=a or c
gatgacatgtataataattatatagcattaatctctggcctcgttttgatgaagccatgtaaatatcaatntgtatttttttcaccctattctatccatat

SEQ ID NO: 17174 - DNA, 101 bp, rice(Oryza sativa)
  misc_feature (71): n=t or c
cccgcggacttcggggcagaccaagatcggattcgacgtctcctccgctgtttcagtggcatcgcaatagnggtgttggtcgtagtggccgtgctcgtctt

SEQ ID NO: 17175 - DNA, 101 bp, rice(Oryza sativa)
  misc_feature (71): n=t or c
tttcatcttgcttttgaggcactagctgatttctcggctgctcgctactgtgaaaattttgaggcaaagancctgtttagatctcaccctaaaatttttca

SEQ ID NO: 17176 - DNA, 101 bp, rice(Oryza sativa)
  misc_feature (71): n=a or g
tctccctatttaggctgccttcgttctgctcggttgggaacccactccctttcacatggaaaacgaaatanttcattaacgcgtgattaattaagtattat

SEQ ID NO: 17177 - DNA, 101 bp, rice(Oryza sativa)
  misc_feature (71): n=t or g
ccatacttctctctgtttgttccttgcttgaacacaaacagccactatctacatagctagaattcttcagnattctcttctgcatagaagatactccctcg

SEQ ID NO: 17178 - DNA, 101 bp, rice(Oryza sativa)
  misc_feature (71): n=a or g
ccatggtcacatcaccttcaccatagctaaatccactcaatagtctacagcagttgactagtggagtcagntttcctgctgcagaattgcaactgtgggtg

SEQ ID NO: 17179 - DNA, 101 bp, rice(Oryza sativa)
  misc_feature (71): n=t or c
aagtgtgaacaatattaaaagatgcaatgtacagagaacaaagatgtcaccttgggatgcttcttccatcnaaggcttctcttgctgcagaagctgtggct

SEQ ID NO: 17180 - DNA, 101 bp, rice(Oryza sativa)
  misc_feature (71): n=t or c
aagaatattgcgaattgtaaatctgccttttgttgagactcttcctcctcttgtgcagcaaagggtactantggggaaattcatttccaattacatcatag

SEQ ID NO: 17181 - DNA, 101 bp, rice(Oryza sativa)
  misc_feature (71): n=t or c
ttttgtggatgacctgccaacccacctttgacatcagattagcatccggaagatggctcgacgacaaccgncaccggagcagcacaaaccatggtggccga

SEQ ID NO: 17182 - DNA, 101 bp, rice(Oryza sativa)
  misc_feature (71): n=a or g
agtgtattactactagtttcttgttatggacagcttgtcctacttttaaatccatctcggctcaaacaganaatattggctttggacataaccttgatttg

SEQ ID NO: 17183 - DNA, 101 bp, rice(Oryza sativa)
  misc_feature (71): n=a or g
cttcttaagggtgtcgatgaacctttccccctgaccaactacttctgttgtgtggcccttgaaatactccnacttgccgatcgcatgatatcgcggctcgc

SEQ ID NO: 17184 - DNA, 101 bp, rice(Oryza sativa)
  misc_feature (71): n=t or c
gtgagtgcaatgaagatggaggatatctccattgcaatggcgcccacgagcagtatgtaagatatgagaanatcaggtctactatatttgaacttactact

SEQ ID NO: 17185 - DNA, 101 bp, rice(Oryza sativa)
  misc_feature (71): n=t or c
ataactattctcttcacttactttatctaatccactaattacaaccctccttcaatcatctatacctattncatctgttccaaaatataaatatttatgtt

SEQ ID NO: 17186 - DNA, 101 bp, rice(Oryza sativa)
  misc_feature (71): n=t or c
gctgctcgctgccgttgcctgcttgactatctcactcgctgttgctgactggttaatttgtacttgctaantcgtgatctcccgcgcgactaggatcacga

SEQ ID NO: 17187 - DNA, 101 bp, rice(Oryza sativa)
  misc_feature (71): n=a or g
catcggctctaggaaaaacaatgccctcttcagcaacctttcaaaagccgatgtctggggtacaagactcnaagatccccaatccaggacaattggtgcga

SEQ ID NO: 17188 - DNA, 101 bp, rice(Oryza sativa)
  misc_feature (71): n=a or g
gttcccatcttcccaaccgaactcagcccaaaagcccaaacatccaaaggccgaagcgggcccaactcccntgcatgtaggccgaagctcccagaagatgc

SEQ ID NO: 17189 - DNA, 101 bp, rice(Oryza sativa)
  misc_feature (71): n=a or g
ggatgcctcaagcaacgtcttgatagcgttgaggagaaactcttgtcacatatgcgctccagcgatccacnggaaggtacttcctggtttttcccttttat

SEQ ID NO: 17190 - DNA, 101 bp, rice(Oryza sativa)
  misc_feature (71): n=t or c
cagaagatgtccataatgttgatttacctcctgttgtgatccctcttggaaactcgttgactttagtaatnaaaagatggaacaatgaaatgacagagaca

SEQ ID NO: 17191 - DNA, 101 bp, rice(Oryza sativa)
  misc_feature (71): n=a or g
ctggccgccgttctcaggagcaaggatggcgaggcagaaacaattgtcaacaacccagaatatgaagaatnggttgcggttgatcagcaggtcctctcgta

SEQ ID NO: 17192 - DNA, 101 bp, rice(Oryza sativa)
  misc_feature (71): n=t or c
ttggttggccggtcatactcagagcaaatcacccctaaactattagagtactccttatatacacttcatcngttctaaaatataagtatttttaaaatagt

SEQ ID NO: 17193 - DNA, 101 bp, rice(Oryza sativa)
  misc_feature (71): n=a or g
atctattgtcttggattctcccccatcttctttcttttcacatgttcttttaggccattcacaatgcaacncgctggcattcgccctgagcggtccacgtt

SEQ ID NO: 17194 - DNA, 101 bp, rice(Oryza sativa)
  misc_feature (71): n=a or g
ttatatgtcaatgtcatggaaattccatcaggactatctgcaaggatgggctgcagctcaagatctggacntagatcatgtccataggggctgcagctaca

SEQ ID NO: 17195 - DNA, 101 bp, rice(Oryza sativa)
  misc_feature (71): n=t or c
tcgcgatacgttctaaccctaaaatcatcgatcaaaaccatcgaacactgagcaagccaaagaacatcaanggcgctgcttccccaaccccaactcagctc

SEQ ID NO: 17196 - DNA, 101 bp, rice(Oryza sativa)
  misc_feature (71): n=t or c
gggatattcatatccatgctcagcctattggacattggtccaaaccaatgcaccatacttattccacgaanagaaggtctgaacctacagaattagtaatg

SEQ ID NO: 17197 - DNA, 101 bp, rice(Oryza sativa)
  misc_feature (71): n=a or g
gataagagaccggcctcctcatcagcttcactgaggggaaattcgccaagaaggcgacttgcctctgacantgttaatgctgttgtgaaaaacatagattt

SEQ ID NO: 17198 - DNA, 101 bp, rice(Oryza sativa)
  misc_feature (71): n=a or c
ctcaagctaccccgtcatcgtgtcattgcttcaccatggcctcctctcccctctccccgtgccatggcggnaatcaaggaggctggggacgcagcggtgat

SEQ ID NO: 17199 - DNA, 101 bp, rice(Oryza sativa)
  misc_feature (71): n=t or c
gtcccgtaacatactctcaaagaggtagatattcctgactacgaggatttgaaacatagtgcatggagtcnaccaggacattcccaacccaataattagaa

SEQ ID NO: 17200 - DNA, 101 bp, rice(Oryza sativa)
  misc_feature (71): n=t or c
tgctcggccataaatccaaaatgtcagtccaaaaatggttggcccatgacaaaagcaaaactgtcccatcnggacttgcgagagggcgctatccctagatt

SEQ ID NO: 17201 - DNA, 101 bp, rice(Oryza sativa)
  misc_feature (71): n=a or g
accagggcgcacaccatggccatgatctggctggtgatctgccacttggcaagctccgaggaagccagctnggccctcttggcttggaaagcaaggtggag

SEQ ID NO: 17202 - DNA, 101 bp, rice(Oryza sativa)
  misc_feature (71): n=t or c
ctggatcaggatgacttccatacaatttcaacacgatcatgttcttttgtatgactgacgaaaattctagnatttcaaatctcagattaaaaaaaaaatcc

SEQ ID NO: 17203 - DNA, 101 bp, rice(Oryza sativa)
  misc_feature (71): n=t or c
agctagctatcccagttgcagacttgcagtagtcctgagctttttttgacgaattccggagcaataatggngaaaagttcccttgcaatggaggatgcagc

SEQ ID NO: 17204 - DNA, 101 bp, rice(Oryza sativa)
  misc_feature (71): n=a or g
aaaatcccctgaaaatctccagcaaaattggggagccatcgatcagtccaagagaggaggatggatggagntgttggtctgcgcggagggaggaggagggc

SEQ ID NO: 17205 - DNA, 101 bp, rice(Oryza sativa)
  misc_feature (71): n=a or g
ttatagatatatagatgcaaatatgcaatcatcttcttcggcgcgtcgtctggtatggctaaacaattatngattatccgatgctgttgtaggtttatgga

SEQ ID NO: 17206 - DNA, 101 bp, rice(Oryza sativa)
  misc_feature (71): n=a or g
aggtgactgaatcgattcgtgtgtatagtggccatttggtttatgttaacctttgattattggaaaaattngaaccataccattataattttgtaaaattt

SEQ ID NO: 17207 - DNA, 101 bp, rice(Oryza sativa)
  misc_feature (71): n=t or c
aatcccttatttacgaacaagcgatgagggagtacacattaacaagttctttgatttgtagggaaaaaaanatacaaatttcagaggattttaattctata

SEQ ID NO: 17208 - DNA, 101 bp, rice(Oryza sativa)
  misc_feature (71): n=a or g
tgctatttcagcagctgctgtgaagtcgaaactccttgcaaagcatgaggaatatcaaatccagcgactanctgcacttgtgattgataaacaggtatttt

SEQ ID NO: 17209 - DNA, 101 bp, rice(Oryza sativa)
  misc_feature (71): n=a or g
atttcaaacgatgtttatgttccaacgtatgttggctgcaatttaatgctccatttacttgtttattgggnaaaaaaaccttattacccccaaaatataag

SEQ ID NO: 17210 - DNA, 101 bp, rice(Oryza sativa)
  misc_feature (71): n=t or c
gtccttgcaagctacataaagacatgccaagagatttcacgaaagaccagtcctctacctcgaatcatctncgatgaggtaaataccgatagcgtacccct

SEQ ID NO: 17211 - DNA, 101 bp, rice(Oryza sativa)
  misc_feature (71): n=a or g
gttgcatacaactcgtagccaggatttcctcggattggactacacccaatcagctggtttactgcatgatncaaactatggagacagcgtcatcattggaa

SEQ ID NO: 17212 - DNA, 101 bp, rice(Oryza sativa)
  misc_feature (71): n=a or g
agccttgcttaagagctacagctaattattacaaggatcgtataaaagcaaactcacacacattcagtatntagctaaagtaataaaaccaaaagtgaaag

SEQ ID NO: 17213 - DNA, 101 bp, rice(Oryza sativa)
  misc_feature (71): n=a or c
tgacgttgcgggtgtttaacgtggaggcttcccttgttcatctgcaagcagtgcttgatgtcgcggagcgnaggcccgtcgtcgatgataatttcaccggc

SEQ ID NO: 17214 - DNA, 101 bp, rice(Oryza sativa)
  misc_feature (71): n=t or c
ccatgttatcaactctactatatgcgttggtatgtaccttgcaaagagcttgctggcacaccgtagtcgcnagagacggagaagattgaggagcccccata

SEQ ID NO: 17215 - DNA, 101 bp, rice(Oryza sativa)
  misc_feature (71): n=t or c
cttcctttggtacacatgagtttttttccttgatttgtatgaaaaatgagctccttgatgtaaaggctctntttgtttaggcttataagccaacttataag

SEQ ID NO: 17216 - DNA, 101 bp, rice(Oryza sativa)
  misc_feature (71): n=a or g
tgaaagaaacagttacaattatcctcaaaccacaaaatttcgtacgagggatttcatagctgcagaggaantacatcctcgtcctctttattcttgctgtc

SEQ ID NO: 17217 - DNA, 101 bp, rice(Oryza sativa)
  misc_feature (71): n=a or g
ggtccgacacgtggcccggcatggcaggagaggccagtgaatttccttttttactgggtgcatagatgcgnggatttaattgtgagaggttttcccgagat

SEQ ID NO: 17218 - DNA, 101 bp, rice(Oryza sativa)
  misc_feature (71): n=a or g
tagggttgagatcgaaaagttggaggagttcccttatttagagggcgatcacaatgataaagaaacaacancggatatcagcagtggagaggttgcgaggt

SEQ ID NO: 17219 - DNA, 101 bp, rice(Oryza sativa)
  misc_feature (71): n=t or c
tccattctgaatccaacgggccacgatgtggttctcggttctctagttcagctcactcatacaccatgttngaagggttttgttttggccgctgcggcttt

SEQ ID NO: 17220 - DNA, 101 bp, rice(Oryza sativa)
  misc_feature (71): n=t or c
acaggtaaagcatctttcccactgccattgcttccctcatcagctttctcacttgaactatcctttgcatncgctgtaatgacatcagaaggttgaggctc

SEQ ID NO: 17221 - DNA, 101 bp, rice(Oryza sativa)
  misc_feature (71): n=t or c
aattctaatcccaccccatttttccattatccaaacacaccttcggtgaatctttaacttcctcgtttccnattaggatgctttttaaagggttaaattgg

SEQ ID NO: 17222 - DNA, 101 bp, rice(Oryza sativa)
  misc_feature (71): n=a or g
atcttaccatgtggacaccgattttgttattcatgcattcaagaatgggcggattctctggtatgtattcngagcactttgttcagctcgattcattcatt

SEQ ID NO: 17223 - DNA, 101 bp, rice(Oryza sativa)
  misc_feature (71): n=t or g
gtgctttttggctgctgcatgaagagctgcttttactagcattttggcacttccctgaacagaacagaacnaggttagcagcagtaacagttatggccata

SEQ ID NO: 17224 - DNA, 101 bp, rice(Oryza sativa)
  misc_feature (71): n=a or g
gctggtttgaaacctcaatatttcgtgaaaaccgaatggtttttgtcagttttatggaaccttgagggcancaagcatgtatttgtacatatacaaatgtt

SEQ ID NO: 17225 - DNA, 101 bp, rice(Oryza sativa)
  misc_feature (71): n=t or c
ctaattcgatcgtgcacatggcgagctccactgctctaggtatcatgtcctttcgagttcgagatagaacnatttggaaatccaagaccaatcaatcatta

SEQ ID NO: 17226 - DNA, 101 bp, rice(Oryza sativa)
  misc_feature (71): n=t or c
tttttgaatttgttttgttttaatttaaagagccatgtttggtctcaataagggaagtgtttgcattatgngatattgtcttcatagaaaatagttgcatc

SEQ ID NO: 17227 - DNA, 101 bp, rice(Oryza sativa)
  misc_feature (71): n=a or g
aatgttactgattgttttgctcacatgctggggcctttagaacatttcagacagttagccctgccaaaacntaaaagctatatcagcacattgtctaaaga

SEQ ID NO: 17228 - DNA, 101 bp, rice(Oryza sativa)
  misc_feature (71): n=a or g
gaagaggcctacagatcccatgttcattggtggattgaccctgaggctgtgggtttctcaatcatttcctnagaatcttattgatgttgccgatgagcacc

SEQ ID NO: 17229 - DNA, 101 bp, rice(Oryza sativa)
  misc_feature (71): n=t or c
ctttgctcggcaatagtcttggaacatctccttcatcactagctgatccccaacaataaaaacagcttaanggatcttgttgagtaaattagtaacaacag

SEQ ID NO: 17230 - DNA, 101 bp, rice(Oryza sativa)
  misc_feature (71): n=a or c
gctgttaagtggtccacaaaaaaaaaagacagttctgcatcttctccagccaaaaaggagtcaaggtagtnatggtcactccaggtgcactggctccatcc

SEQ ID NO: 17231 - DNA, 101 bp, rice(Oryza sativa)
  misc_feature (71): n=a or g
acgcgtcgcacatgcccagcgacacccgattcagccaaacaggcaaaattgtaaccatggcaccatttcgngcaggctgggactcgccaggcccaccactc

SEQ ID NO: 17232 - DNA, 101 bp, rice(Oryza sativa)
  misc_feature (71): n=t or c
caatgtcagtgcagtcgtcgtccttacctggctttgatgctttcgatattccgaagtcactaatcttaggntgtattttcagcgtaaattttggattttca

SEQ ID NO: 17233 - DNA, 101 bp, rice(Oryza sativa)
  misc_feature (71): n=a or g
acagtggtttggcaaaacctcattttatttcgtagtttttacgtaggcagagggccatttcctgtgaagtntaaattgcacggcgtggtttcatctggtag

SEQ ID NO: 17234 - DNA, 101 bp, rice(Oryza sativa)
  misc_feature (71): n=a or g
ttttgaaataacaggaaaaatcgtttttcgtgaggtggatggagtatccgggatccctgaacaaattgctncttcacaaaaaaacaaaaaacaaaaaacgt

SEQ ID NO: 17235 - DNA, 101 bp, rice(Oryza sativa)
  misc_feature (71): n=a or g
ttcgacccggaggcgaaccatgttcatgtgagcagagacgtggtgttcaacgaagaggcgaagtgggactnggcggcagccgtgactggagacgatgaagc

SEQ ID NO: 17236 - DNA, 101 bp, rice(Oryza sativa)
  misc_feature (71): n=a or c
ttacaaagtattccttcaaccaagaaacaatttggtcaggctcaacgtgtgccttcaaaaatttcttggantcaccatcctggatgatgatgagtggtacc

SEQ ID NO: 17237 - DNA, 101 bp, rice(Oryza sativa)
  misc_feature (71): n=t or c
ttttgtgtttctctagtgcacttggccttaaatagaaaacgaggtgtgcactgtgcacgcaatctatgcangccgttgctagtattttcctactcccccgt

SEQ ID NO: 17238 - DNA, 101 bp, rice(Oryza sativa)
  misc_feature (71): n=t or c
aggcctacttagccctggaccaggtctgctttattcagaccagtccaattcatcagttccgaatgacgagncgcacttatgggccattgggcctacggtga

SEQ ID NO: 17239 - DNA, 101 bp, rice(Oryza sativa)
  misc_feature (71): n=t or g
tgacgtggaggtgagagaaagcaccattgagcagagttccatattatcgccagcgctttgtgtgctcctangcagatgagcaactcactgccaatcaagtc

SEQ ID NO: 17240 - DNA, 101 bp, rice(Oryza sativa)
  misc_feature (71): n=a or g
acgaaaaacacgtattaccgcgagtcacatcgtggtttaaccatgcgaaaagttaccgcccgagataaccntgaggttttgtaaacctgctcttactatag

SEQ ID NO: 17241 - DNA, 101 bp, rice(Oryza sativa)
  misc_feature (71): n=a or g
catgtgagcattggactgcgtcgacttgtcatgcatagctccggcaaccttcaggcaaacctcgttaaccntctcgccggccgcgaacctccaattgctcg

SEQ ID NO: 17242 - DNA, 101 bp, rice(Oryza sativa)
  misc_feature (71): n=t or c
aattaacatcggtttaattagacggtgcagtgatgatgcttctacaggaaccacaagtgatttgatttggnggtatacatcttttattcattttgtatata

SEQ ID NO: 17243 - DNA, 101 bp, rice(Oryza sativa)
  misc_feature (71): n=a or g
acgctgcaacgacttggattggatagttactacaaggccgagatagatgagcttctctgcactgtttacancaccgactacaacgataaagatttacacct

SEQ ID NO: 17244 - DNA, 101 bp, rice(Oryza sativa)
  misc_feature (71): n=a or g
cacaacgtacgtatactaagctggaagtcttttgaactccctaaaacaaagtggtgcaccgcttcatcccnagtgcgctagtgcgaatcaagtcatttctg

SEQ ID NO: 17245 - DNA, 101 bp, rice(Oryza sativa)
  misc_feature (71): n=a or g
ttggtcgaatcgatcgcacactagaaacttaggcatcttctcctaggtgcaatcctgtctttcaaaagagncctagatttttcttttaccagtttaaactg

SEQ ID NO: 17246 - DNA, 101 bp, rice(Oryza sativa)
  misc_feature (71): n=a or g
gtccacctacggtaccttaggctagggaccaccattggcaataactttcatttaccaattaacctttccanattttatcatttaaggattttggatctgga

SEQ ID NO: 17247 - DNA, 101 bp, rice(Oryza sativa)
  misc_feature (71): n=t or c
cattattcacacgtacaatgtatatactgaatatagcctctctacgtatccccccgtacgtgcacactagnactgatccaacaaacatgcacacactgatc

SEQ ID NO: 17248 - DNA, 101 bp, rice(Oryza sativa)
  misc_feature (71): n=a or g
gatatttaagttgattgtgtataccagtaaaacaaagtacactcgcttgagtcaactgtcacaaatctgantactctatcaaaagggggataaatagaatt

SEQ ID NO: 17249 - DNA, 101 bp, rice(Oryza sativa)
  misc_feature (71): n=a or g
gatctcgcacttgcagatgttaatcatagaaacccaagaggttatactgttcttcacattgctgcgaggcnaagagagcctaaaatcattgtctccctttt

SEQ ID NO: 17250 - DNA, 101 bp, rice(Oryza sativa)
  misc_feature (71): n=a or g
tgctgctcaccaggaaacacgagattcttcagtgcagaaaaggatgtcgattttaccggttcatttgagtnattttttagctacttcatccgtttcatatt

SEQ ID NO: 17251 - DNA, 101 bp, rice(Oryza sativa)
  misc_feature (71): n=a or g
gggcctcaagaattagattgaaatcactcgcgacaactcatagccccatacgagaagagcacaacgaccgnggctcgtcaagaaaccaaagtttgtccatc

SEQ ID NO: 17252 - DNA, 101 bp, rice(Oryza sativa)
  misc_feature (71): n=t or g
atccctgacagtgtccccatgcatgcataatacgacataaatataattaatgcaccatttgactgtgcatngcgtaaataaattactttgtataattattt

SEQ ID NO: 17253 - DNA, 101 bp, rice(Oryza sativa)
  misc_feature (71): n=a or g
gggcctcagtgacaacgtcgtcaccttcggcgagtggtcacgctatttccaggtggacttcaacccctgcnactacgccttcctcgtcgccaaggacgaat

SEQ ID NO: 17254 - DNA, 101 bp, rice(Oryza sativa)
  misc_feature (71): n=t or c
cgttccaggcagttcagctctcccctctcgtttatccagttcagccagttcaaactgttaaatggtatgtnttttataaaaaaagtttatatatgcaagtt

SEQ ID NO: 17255 - DNA, 101 bp, rice(Oryza sativa)
  misc_feature (71): n=t or c
tcttccagtgacgatctctagtaccaaaacgccgaaactaaatacgtccaacttgactgaataatgaccangcatggcgtattcaggcgccatgtatccac

SEQ ID NO: 17256 - DNA, 101 bp, rice(Oryza sativa)
  misc_feature (71): n=a or g
cgtgcttgactaggtctctccctcaatctgtttctctattgtgctatgcatccgagttggaaacatatccnactccttccatgtcacaacctctccagatc

SEQ ID NO: 17257 - DNA, 101 bp, rice(Oryza sativa)
  misc_feature (71): n=a or c
aatttgatcatcatatttgcaaatagcgccgagaccaaggcaaaaaaaaccttcttccttaaattagctcnttgatcaatgtgtttcttccgcaaaactag

SEQ ID NO: 17258 - DNA, 101 bp, rice(Oryza sativa)
  misc_feature (71): n=a or c
aattcaattactcgaaaatcttatgttcctgaaaattttcagatagagggtactttggtggctcctccaangaggtcagattggagcaaggaaactattag

SEQ ID NO: 17259 - DNA, 101 bp, rice(Oryza sativa)
  misc_feature (71): n=a or g
atcaagggagtatgtgaagagaacggtgtatgggattgcttttgatacaccatcaaaggtcaatgttggtnttcttacaacacgccaatttcatatatttt

SEQ ID NO: 17260 - DNA, 101 bp, rice(Oryza sativa)
  misc_feature (71): n=t or c
cataacagaaaaacgaggtgacccgatgtgaggattgaccacatgagatcgaggaaatcataagaaggtcnacgaaatgcgtgaatatatataaaatcacc

SEQ ID NO: 17261 - DNA, 101 bp, rice(Oryza sativa)
  misc_feature (71): n=a or g
ctcgtggcgccatgcctcttgccaacatgggaggaggagagggagccgtgatgaccgggagaagaaagagnaagaagggttagggtggagaagaaggatgg

SEQ ID NO: 17262 - DNA, 101 bp, rice(Oryza sativa)
  misc_feature (71): n=t or c
taatcttctaaacataataagcctaaagattaccccgatgttaaatattaggggtaacggcctaactggcnatttgtttgacatatttgcgcctgtttttt

SEQ ID NO: 17263 - DNA, 101 bp, rice(Oryza sativa)
  misc_feature (71): n=a or g
attggctgataatgatggttgtgggtgtactgacctctgtaaccgctatttgacactatgaaaccaggggntcatttcatttgcaacacacaactcaagtt

SEQ ID NO: 17264 - DNA, 101 bp, rice(Oryza sativa)
  misc_feature (71): n=a or g
gatttggtggtctttcttgtgaacgctcacattcttccactaggcacactcagattattttgcagtaacanatgatcaaacgggtagtttaggtcatgttc

SEQ ID NO: 17265 - DNA, 101 bp, rice(Oryza sativa)
  misc_feature (71): n=t or g
tgcgcattcatgctgcaaataagtttgctgtttgccaatatgccctgcattggcattgcacgatatcagtnctccattaacagtttaaaatggcaccaggt

SEQ ID NO: 17266 - DNA, 101 bp, rice(Oryza sativa)
  misc_feature (71): n=a or c
gttcgtacgtcgtccatggaactgcatttacgtacccaacacgtgatcgcatccaaatcgcagtactcaanagcagctaatacctagtcaactacaagtca

SEQ ID NO: 17267 - DNA, 101 bp, rice(Oryza sativa)
  misc_feature (71): n=t or c
catgaagtcaggatcaagactgattttgtgttcttgtggaggttgcgaaagtatttgctacttcttgctgngctagctgttagtgtcacatacaatgctgg

SEQ ID NO: 17268 - DNA, 101 bp, rice(Oryza sativa)
  misc_feature (71): n=t or c
ctgcatttctgcatcaataacccctccaaaacttaacaatctactagtagtagcatgcctgtgacatttanatagaagcatacatgacagatgaatgatat

SEQ ID NO: 17269 - DNA, 101 bp, rice(Oryza sativa)
  misc_feature (71): n=t or c
tggctagatgattaaatgccacgtggcgatgtacgagcgattgtgggagttctatgtggcggcttaatagngtttataggatgtttaatggacttttagta

SEQ ID NO: 17270 - DNA, 101 bp, rice(Oryza sativa)
  misc_feature (71): n=t or c
aggcaaaaatgttttgagaataatctagtcgagacaggcagtttaggtcatgcttgattcactttaggatnattataatctgaattattagtagtaagctg

SEQ ID NO: 17271 - DNA, 101 bp, rice(Oryza sativa)
  misc_feature (71): n=a or g
ggaagccggtgatcctccacatcggttgaaactctattgccatttggaagctgaatctcatactgcacccncaaattccggagattctgaaggtgacattg

SEQ ID NO: 17272 - DNA, 101 bp, rice(Oryza sativa)
  misc_feature (71): n=t or c
atactggtaacaatatcatcgtctcagccaaagtatacatattgttcttgctttacatgtaacagtatgantaattgcgaccatattgtacattgatcagt

SEQ ID NO: 17273 - DNA, 101 bp, rice(Oryza sativa)
  misc_feature (71): n=a or g
tggaggggaccggcaacaaggaggaaaaagaggaggtggatgggagccaaggtcctacaaggacggggacngagctctcgccggagattatagccgcagtg

SEQ ID NO: 17274 - DNA, 101 bp, rice(Oryza sativa)
  misc_feature (71): n=t or c
taccattgttgcattcgctgtaaagcgtacgttctgcatttctatgagggttagtatgtctcagcgggttntaaacgcaaagtgcacgttgtttagtacca

SEQ ID NO: 17275 - DNA, 101 bp, rice(Oryza sativa)
  misc_feature (71): n=a or g
agatgtgcacagacacactagcctttagagagcagcacacaaacacacaagcctttgcagagctacacacntgaatagattcagatggaggtagccttatc

SEQ ID NO: 17276 - DNA, 101 bp, rice(Oryza sativa)
  misc_feature (71): n=t or c
atggttgacattacaactaacgaatcggatttgcaagagcttaccactctactatttagggtttagggttntgggtttgtcgccatcagctcactcaaaga

SEQ ID NO: 17277 - DNA, 101 bp, rice(Oryza sativa)
  misc_feature (71): n=a or g
gcatcgtcggtggaaagcgtaggcagagactgatccacaccgctactactcgtcttctctcgtctttgctnctccacgccgccgtcctcgtccctgctccg

SEQ ID NO: 17278 - DNA, 101 bp, rice(Oryza sativa)
  misc_feature (71): n=a or g
tacagtgtccacgagaagatacatgttctttatatgtctcatagcaaaagccataaaatttaagtgtcttntagtaaattttgccaataataatttggctc

SEQ ID NO: 17279 - DNA, 101 bp, rice(Oryza sativa)
  misc_feature (71): n=a or g
gtgcccttctgtatggagctttagttgcatatacacgagatgcatcatgcgtctgtgtcgatcgatcgctngatggtctcgaggtaaacgtaaaccgcggg

SEQ ID NO: 17280 - DNA, 101 bp, rice(Oryza sativa)
  misc_feature (71): n=a or c
aacgccacgatggagaggcgatcaccatcagcaagcttcctgatgacaaacttcatggacgccttgagcanatccaacctcgacccctgcagattgctctt

SEQ ID NO: 17281 - DNA, 101 bp, rice(Oryza sativa)
  misc_feature (71): n=a or g
gatcaatttgcttcttcaaataaaagagtacttcaaaatcatggtgttgttggaggagatggaggaggaanatggccttcagattcttcctcatcagtagg

SEQ ID NO: 17282 - DNA, 101 bp, rice(Oryza sativa)
  misc_feature (71): n=t or c
agcgacaatgtgaacgtggcctcagaacgacgccttgggtctccctgttggagtgtataaaagtgaattgnccgtctttccttatcagcttaggttttagg

SEQ ID NO: 17283 - DNA, 101 bp, rice(Oryza sativa)
  misc_feature (71): n=a or c
tcgactaaacctacagcagttcaacaatcaaactgaccaaaaaaaggctatcggaggcaatacctgatccnattcgcacccttcgtcgtcgtcctcctcct

SEQ ID NO: 17284 - DNA, 101 bp, rice(Oryza sativa)
  misc_feature (71): n=t or c
tcgtatttatcctcttgcttttaacctttgcagctgaactactcatctaatccgatttgacagtgacacantcatttcgctctcatttatcaatccatgtc

SEQ ID NO: 17285 - DNA, 101 bp, rice(Oryza sativa)
  misc_feature (71): n=t or c
atgccgacatggttgccatctatgtccataaactcgttgttttgtgcagtgtcgatctcaacagcaaaaanatggttgctcaagttgccgttgttactgta

SEQ ID NO: 17286 - DNA, 101 bp, rice(Oryza sativa)
  misc_feature (71): n=t or c
agggcaataaaaaagaggttgtaaagtttctgtttggtcacagaattgacaattagccttcccttttctcnagcccctcttgaaaagattgtcctttgtga

SEQ ID NO: 17287 - DNA, 101 bp, rice(Oryza sativa)
  misc_feature (71): n=a or g
taccggtatcttaaatatgatacaatctaattcaaacaatatgaacgtggcaactacttcctccgtgttangttataagatgtttttactttcgtcaaagt

SEQ ID NO: 17288 - DNA, 101 bp, rice(Oryza sativa)
  misc_feature (71): n=t or c
tcaacaccgacagcactaatatctggtagggggtatgtaggaccataaacgatacagagagtcaagggtanattagcactaagcagggagccgccacattc

SEQ ID NO: 17289 - DNA, 101 bp, rice(Oryza sativa)
  misc_feature (71): n=a or g
tgtctgaagaggaagtcaatgacaagaaggaacaatcccctaagtcaatgccaacaattccgcccaccatnccttcccagccaccggatccacctcctcca

SEQ ID NO: 17290 - DNA, 101 bp, rice(Oryza sativa)
  misc_feature (71): n=t or c
tgggcgagggaagtgggggagaggaggcggtgcgaaatgaggcgatgcagaagggcgcccgatattttccnctctcgtctagtgcccgagtcaaaggattt

SEQ ID NO: 17291 - DNA, 101 bp, rice(Oryza sativa)
  misc_feature (71): n=t or c
ttcatagggattggtattttcttccacatgccgatgacacacaatgctctttttattaagagatttgctcnggtctaataccctgcctagctagatccaac

SEQ ID NO: 17292 - DNA, 101 bp, rice(Oryza sativa)
  misc_feature (71): n=t or c
gttaagagatattgaatcatattcgacctatatttgagggtgtcgacgccaaatcagttaaagccacctanaaaaccaccgatgaagtcaaatcgtactgg

SEQ ID NO: 17293 - DNA, 101 bp, rice(Oryza sativa)
  misc_feature (71): n=t or c
tctgaagaatatgctttgcatcagtcactgacatgctgggcgctcgctatagccaaatacatatatactcnctccgtcctataaaaaaaccaatctattac

SEQ ID NO: 17294 - DNA, 101 bp, rice(Oryza sativa)
  misc_feature (71): n=a or g
ctgttgggcctaaggccttctcaaaccagccgtttgttcatttggatcgtcactaatgcaatcttttcacntcagactagctaactttatggttattgttg

SEQ ID NO: 17295 - DNA, 101 bp, rice(Oryza sativa)
  misc_feature (71): n=t or c
ttagctagaaaatgtaatcctggaaaagcaaactatcaagagggagcaagttatcagtgcagtgagttagngtacgatccatctctaagaatatatgagca

SEQ ID NO: 17296 - DNA, 101 bp, rice(Oryza sativa)
  misc_feature (71): n=t or c
atttgccaggagtaataatgtaccacagggtgaagatgtacgggaacaaatggagctagctgtcagtttancagagtttgtctcttctctcttagtcttac

SEQ ID NO: 17297 - DNA, 101 bp, rice(Oryza sativa)
  misc_feature (71): n=t or c
gattctctttttataccacagtgttttcttctcatccattgagaattctttcacatgaccagtggccatgngttccttcacctcctggatctctccgttgt

SEQ ID NO: 17298 - DNA, 101 bp, rice(Oryza sativa)
  misc_feature (71): n=a or g
cgcactgaagtcatccccccgcggccctccttggtcgcttgcaagcatgcaaagaaattacgtgtaaattncgagacgaatcttttaaacctagttgctct

SEQ ID NO: 17299 - DNA, 101 bp, rice(Oryza sativa)
  misc_feature (71): n=a or g
gataattcgaaattgcaattcaaggcaacttactttagttggtggcggccgaggtgcctttagttctacanaaatctgtaatgcacccagatttccagaac

SEQ ID NO: 17300 - DNA, 101 bp, rice(Oryza sativa)
  misc_feature (71): n=a or g
gatttcgaaaacgaaattattttctagggttgaaagtagggtaccttctccttcctctcctggtgccctcncgctgggaggtgaaggaccacgcaggcccc

SEQ ID NO: 17301 - DNA, 101 bp, rice(Oryza sativa)
  misc_feature (71): n=a or g
aaaagaatgcccatggtaaaaaagacaaaaaaaagaggggcctttgcctcgccaattgtttgctctcttcntggtatgatcaagatcctctgtagtcaaag

SEQ ID NO: 17302 - DNA, 101 bp, rice(Oryza sativa)
  misc_feature (71): n=a or g
tataattgttgccgactataaaaccggcacctatccaggtttacaaccgggaatttttagatgttctgtantagtagtgaacaattataatttatatccct

SEQ ID NO: 17303 - DNA, 101 bp, rice(Oryza sativa)
  misc_feature (71): n=t or g
tgttgcccaggtaggtcaattctgtgagaagctaatcattagcatcatagtctcaacggttatccaagatnaaagctgacaggtcaagaattttgcacagc

SEQ ID NO: 17304 - DNA, 101 bp, rice(Oryza sativa)
  misc_feature (71): n=a or g
gggtaccgggcgagtggtcaagtgggctatagagctctcggagtttgaccttcactttgagccatgccacncagtcaagagctaggccctcgccgacttct

SEQ ID NO: 17305 - DNA, 101 bp, rice(Oryza sativa)
  misc_feature (71): n=t or g
gatagtcgccactgacaagtctccatcagtctccatccctgattcactataatgtgtatttctagattccngactccacagagggcttaaaagaagccagt

SEQ ID NO: 17306 - DNA, 101 bp, rice(Oryza sativa)
  misc_feature (71): n=t or c
ttcctgctagttaggccgatgagagattatcgtcacttcatcagcaacaggagacataagtgaaaagtagngtccaatcttcacacaattagatggataat

SEQ ID NO: 17307 - DNA, 101 bp, rice(Oryza sativa)
  misc_feature (71): n=a or g
tcccattctttatttggtcacgggagaaacatacgaggcataaaatctttggacgtgataggttggaactnaatgccacctatatacactgtgaatggcct

SEQ ID NO: 17308 - DNA, 101 bp, rice(Oryza sativa)
  misc_feature (71): n=a or g
tattagattaaccaactgattgtcgatataagtatatactagcgcgaacgtactgaccagcaaaatccacncagaacacggagtaagtaaagcataaagaa

SEQ ID NO: 17309 - DNA, 101 bp, rice(Oryza sativa)
  misc_feature (71): n=t or c
ccctagagtcaaaagcttttgaggtaaggctagaatgaagatggaaaatgatgtatcactacaagaatccngttaatccgtgatgaaaaatatctgtcacg

SEQ ID NO: 17310 - DNA, 101 bp, rice(Oryza sativa)
  misc_feature (71): n=a or g
ggcaaaacaagttcttttcagctgcagatgatgtgatcgttggtcagtagtctggtgtgctagacaagganaaataatgctaagtacaatacaaatagtta

SEQ ID NO: 17311 - DNA, 101 bp, rice(Oryza sativa)
  misc_feature (71): n=t or g
cgcgggcggcaataccgatttgccgtcctccatggtggctacgtcttgatgaagattgatcgatctcgccngatcgaaaatttgacaatgatggttccgat

SEQ ID NO: 17312 - DNA, 101 bp, rice(Oryza sativa)
  misc_feature (71): n=a or g
agcctcctctgacagtcttcttcgttggacaatttccgccttgcaagctgaattctccatgaaggacctcnggcctctccaccacttccttggaatcagtg

SEQ ID NO: 17313 - DNA, 101 bp, rice(Oryza sativa)
  misc_feature (71): n=t or c
gaacctttgttccaggccaaactcttcagcaaatgcttctatgtcggttgcaatttcagagcagccctttngaccgacaatatgtgggggttcagtgccgc

SEQ ID NO: 17314 - DNA, 101 bp, rice(Oryza sativa)
  misc_feature (71): n=t or g
gtcaaagcacctactacagctatgcttgaggcagatcatgtgtttgtcatggcaatgtcttcaatcatctncgatcagtgtggcgtctagtgcttctgacc

SEQ ID NO: 17315 - DNA, 101 bp, rice(Oryza sativa)
  misc_feature (71): n=a or g
gttgcatttttgttagggaattttatgtcttaacagtatggtctcgacatctctctctgttgggttacgcncaggctatgatagtataaatcaaaattttc

SEQ ID NO: 17316 - DNA, 101 bp, rice(Oryza sativa)
  misc_feature (71): n=t or c
tcttgttttgcctcctcatctcctttacgtgggcttttctatcccacttattagaccctgtttagttccgngaaaatttttctcaaaaatatcacattaaa

SEQ ID NO: 17317 - DNA, 101 bp, rice(Oryza sativa)
  misc_feature (71): n=t or c
tacttcttggtaatgctactcataagccttgtaacaccagggtcacttataggcactttgaagtttctganagggggttgcatggaacgacaacggcgtgt

SEQ ID NO: 17318 - DNA, 101 bp, rice(Oryza sativa)
  misc_feature (71): n=t or c
caagttattgatttgtgcgctgtgttattgatttgtgcgatgtatttatgcgatgtgttcttgacttgtgngatgtatttgtgcgttgtgtttggtgcgat

SEQ ID NO: 17319 - DNA, 101 bp, rice(Oryza sativa)
  misc_feature (71): n=t or c
tagggagacagggtggtaagagatacataggtgagtcatgtgtgatgtgtagtaagttaaacgtatcaacngtcacagatgactcatcacggatacagatt

SEQ ID NO: 17320 - DNA, 101 bp, rice(Oryza sativa)
  misc_feature (71): n=t or c
tagataaattggtcggcaaagataatttgtagcctcatgaagtcatgaggcttattaccttctgtgactcnatcaagttcttaagcagcatagtattctcg

SEQ ID NO: 17321 - DNA, 101 bp, rice(Oryza sativa)
  misc_feature (71): n=a or c
ttcccgtccggtccagtgctaggtgacgatgtagtaaatcgccacacccctaaaatgatggcgacagcacngcccagaactctgtacgatgtctgcgcgga

SEQ ID NO: 17322 - DNA, 101 bp, rice(Oryza sativa)
  misc_feature (71): n=a or g
aatgagctcaacattgtcaactttgtggagaagaacttcccagagcagataccacagataattgatgctcnactccaagaagaacgcaagagatttcaagc

SEQ ID NO: 17323 - DNA, 101 bp, rice(Oryza sativa)
  misc_feature (71): n=t or c
ttcagtggatttagcacacatgatttatggaacggttaatttcgaccaccgagggactttctttgcttaantgacaagaagaaatatttttctaaattaaa

SEQ ID NO: 17324 - DNA, 101 bp, rice(Oryza sativa)
  misc_feature (71): n=t or c
tgagttaaatgagagggtaacaatcaacgctcatcgctcatctatttctttgtagtacaacgcaggcgctnacaagtcacgtccactcatccctgtaaaca

SEQ ID NO: 17325 - DNA, 101 bp, rice(Oryza sativa)
  misc_feature (71): n=a or g
gctctcagatggaatgccggaagaatgtttcttctcggtgcccgagctgcaggattctgttgatggtgatnccggtgtcggtgtggatatccgcatcacca

SEQ ID NO: 17326 - DNA, 101 bp, rice(Oryza sativa)
  misc_feature (71): n=a or g
tattattatcacccacacaactgaaatttcctgcttgctattaaatcttttaccaaatcaatgtcaggtcnttgtccaacctgttcacatgactaatgatt

SEQ ID NO: 17327 - DNA, 101 bp, rice(Oryza sativa)
  misc_feature (71): n=t or c
catctcatcctgaagcgctccaagtgccacttcggcgaacagcagatcaactacctcggccatgtggtgtncgcaaacagggtggccatggatgtgcagaa

SEQ ID NO: 17328 - DNA, 101 bp, rice(Oryza sativa)
  misc_feature (71): n=t or g
aaatgccacggatcaattcgtctgtcttcctcacgatggctgccgttttcagctgctctccaccctgattnccatagaccttccttccaggtgagaggtgg

SEQ ID NO: 17329 - DNA, 101 bp, rice(Oryza sativa)
  misc_feature (71): n=a or g
tttggtggagtttgaagagctctgtcgccgtcttcactcctcgcagtcagacgggagtggactactggagngagagagagggtgagcgaggggatcttcac

SEQ ID NO: 17330 - DNA, 101 bp, rice(Oryza sativa)
  misc_feature (71): n=a or g
taattagtactataagagagttttgcggatgtgacgttgttgatacttcacagacataggtggtgctcacngtaataattgtctatgatggctgaaaagtc

SEQ ID NO: 17331 - DNA, 101 bp, rice(Oryza sativa)
  misc_feature (71): n=a or g
tagtgaaaggtacaggttgggacagactttctgtccattgattgatattttttttgaacgactcaccgccntcgccaccagctgtgaacgctgtcaccggt

SEQ ID NO: 17332 - DNA, 101 bp, rice(Oryza sativa)
  misc_feature (71): n=a or g
cccgcgctcccaaagttttcttgcttctttagcctgcagcagaaaatatcagctatgccaaaacaaaagcnctcgaatacataactaaacaaagtgcagtg

SEQ ID NO: 17333 - DNA, 101 bp, rice(Oryza sativa)
  misc_feature (71): n=a or g
agatactcctgataggccagatctgacaaaggaaggaataacatctgagatagatcctttaaagaagtctncagcattgagtctttctagtttcttacaaa

SEQ ID NO: 17334 - DNA, 101 bp, rice(Oryza sativa)
  misc_feature (71): n=a or g
ttagttcacatgcatttttctacactgtaccgtagcattccagtgccgttttatgtgcacgttactatggnttagaaggacctgtatcttcacgaaattct

SEQ ID NO: 17335 - DNA, 101 bp, rice(Oryza sativa)
  misc_feature (71): n=t or c
ggaagtggagaatcttaggaggataatcctcgcagatactgaggggcagccatggaggaggaggtggaatngcctctccccacggagaagctcgccgtgga

SEQ ID NO: 17336 - DNA, 101 bp, rice(Oryza sativa)
  misc_feature (71): n=t or c
gacttgctttctattgaagtgaactgaacattaggataagcattatacaaatgcttcattctggaccaggncatgaccaatatttttcatttcagtagcaa

SEQ ID NO: 17337 - DNA, 101 bp, rice(Oryza sativa)
  misc_feature (71): n=a or g
atctagtataggtagaggtaactcttacataagagttagtacctattatctctctcctccacatatgcacnccacgagccaaagaagactgtcaccggttc

SEQ ID NO: 17338 - DNA, 101 bp, rice(Oryza sativa)
  misc_feature (71): n=t or c
ctatactatctcatggaagaaaggaacgaaacaccaacccttttctttaaaaatacacaacttgcagagcngctcctttcaatctttttagacgtcatgta

SEQ ID NO: 17339 - DNA, 101 bp, rice(Oryza sativa)
  misc_feature (71): n=a or g
actttatgatgacttattatgtaatttatacttgatatgattttcatgtaactgctattgttgttaccagnttctactgaggatcctacaagagatcgatc

SEQ ID NO: 17340 - DNA, 101 bp, rice(Oryza sativa)
  misc_feature (71): n=a or g
aataatgcattttaggataaaattagagtaatagagatgcacagatggagcgagtatgagataatgccccnccatattgtaatgtacaaaccacttgctta

SEQ ID NO: 17341 - DNA, 101 bp, rice(Oryza sativa)
  misc_feature (71): n=t or g
agagcatatcgggctgccgccgcaccaccttcgcattccaatgtcattggccacatgagagagagagaganagagagagatgcagagagctacaaatcgaa

SEQ ID NO: 17342 - DNA, 101 bp, rice(Oryza sativa)
  misc_feature (71): n=t or c
gtggctactatacgcgacgcgcatcactacacgttatcgccagaggatacagttgctgtttctatcaaggntggtaagttcattctgcatgtcctgtaaat

SEQ ID NO: 17343 - DNA, 101 bp, rice(Oryza sativa)
  misc_feature (71): n=t or c
attagtacgacccatatttttctaaagggactgtctgtatatctattgaaaaatcccacctcctatctttnaaattttggaccgtcgaatacgctttaaga

SEQ ID NO: 17344 - DNA, 101 bp, rice(Oryza sativa)
  misc_feature (71): n=t or c
atttggaggattttgtatggttttcttgtattgatcgcatattaattaaatattcgaatagtcgtgctcanggatattgagcgccgggacttgtactactc

SEQ ID NO: 17345 - DNA, 101 bp, rice(Oryza sativa)
  misc_feature (71): n=t or g
tgcggtgacgtggcagtgacagttgagttagttggtgggtttacctgatgagcacgatgtagaggttccgntcggtggtgacctcctcctcctcgtcggag

SEQ ID NO: 17346 - DNA, 101 bp, rice(Oryza sativa)
  misc_feature (71): n=a or g
ggcagatgtggaaagatgaaacatggcttcaactcgtagacccattgttacccaccgattctcatacaatngagataatgagatgtattaacattgctttg

SEQ ID NO: 17347 - DNA, 101 bp, rice(Oryza sativa)
  misc_feature (71): n=t or c
aggccttgtcagttctagttttccatctaaaacagaaacatccagtggaagcggtcattttcagcaccaanagtttggaagctttaagtgatttttatcca

SEQ ID NO: 17348 - DNA, 101 bp, rice(Oryza sativa)
  misc_feature (71): n=t or g
tgcagcaacaggagagaaccacgggcacgacacgacacgacaaacaactaatcaagggtaagtaaacaatngagtgtggcaacaggagagaaccacgcgta

SEQ ID NO: 17349 - DNA, 101 bp, rice(Oryza sativa)
  misc_feature (71): n=a or g
atatggtaccattttctccgagtcaatgttgagaaatgtgccattgcgctagagtttgttgaatctgaaanacaacttgcagacatttttacaaaacaact

SEQ ID NO: 17350 - DNA, 101 bp, rice(Oryza sativa)
  misc_feature (71): n=a or g
cttcatgcagagctattacatctgttcagctagagaactagcaaggatggttggcataagaaaagctccantcctccaccatttttcagagactgtatcag

SEQ ID NO: 17351 - DNA, 101 bp, rice(Oryza sativa)
  misc_feature (71): n=a or g
tggtctcattaagaaagagggcagaatatgggttggggctaattcggggttgcagaccaaattgattacancctttcattcttctccagtagggggacatt

SEQ ID NO: 17352 - DNA, 101 bp, rice(Oryza sativa)
  misc_feature (71): n=t or c
cctgccgccatttttcatagagaacataaaacttcaccacaacatctgcaggtttgatggcgtctaacttngggtaagggaattcaagatctcttggggaa

SEQ ID NO: 17353 - DNA, 101 bp, rice(Oryza sativa)
  misc_feature (71): n=t or c
gtccctccatacttcctcaaatactccgtttcaatttacctatcacgttcaagatttgttttaagtcaaanattttgatctttaacttcaatttctacaaa

SEQ ID NO: 17354 - DNA, 101 bp, rice(Oryza sativa)
  misc_feature (71): n=t or c
gttatgttaccacaataattaattgggcaaaaaccaaagtataagatgctatagggccttctcattctacnaccctcagtctttcacacatagaagtcaca

SEQ ID NO: 17355 - DNA, 101 bp, rice(Oryza sativa)
  misc_feature (71): n=t or c
tatagggacatgaggagagctcatgaagttgtccttcactgagcatgaccttatatccaatcggtgaatgnatacagcttctccctgatatatgtttatgt

SEQ ID NO: 17356 - DNA, 101 bp, rice(Oryza sativa)
  misc_feature (71): n=t or g
tattaatagaccctataaaactgccacaccatttttgaaaatgaacctttttagctagtgtgaataacacnggcatgccatttatgagaaccctaatgaaa

SEQ ID NO: 17357 - DNA, 101 bp, rice(Oryza sativa)
  misc_feature (71): n=a or c
tctaacagcaggtgtccccttaccttgagctgtgcagagtgagctgtccatgaagaaagcaggaaaggccntgagttcactcactcactcactcattcact

SEQ ID NO: 17358 - DNA, 101 bp, rice(Oryza sativa)
  misc_feature (71): n=a or g
atcattgagatgtgactgcaattattgctggattcatggttcataggcagcagttgatgtacataaacacngttttacaaaggctgaaattctgtcctagt

SEQ ID NO: 17359 - DNA, 101 bp, rice(Oryza sativa)
  misc_feature (71): n=t or g
aaagattaaggtttagaaaaatgagtataataacctatcagatgtatggttggtatttaggggtagaatanataaaattctgaattggagatgattaatgt

SEQ ID NO: 17360 - DNA, 101 bp, rice(Oryza sativa)
  misc_feature (71): n=a or g
ccaatttacgaaattccttgggcttctgagtctccgtccattcctcctgtaaacaagcaatagccagagcngtctctaggtcgcgaggacgttgcatcata

SEQ ID NO: 17361 - DNA, 101 bp, rice(Oryza sativa)
  misc_feature (71): n=a or g
tttaaaagtgatgatttactaaattttctaaatgcaccgagctaaacacctgagggctgctcttaaagctngcggcacccagcacagtaccaaaccgccct

SEQ ID NO: 17362 - DNA, 101 bp, rice(Oryza sativa)
  misc_feature (71): n=t or c
gctcgtggtggcgaggaaagattcagaactcccattgcctaatgaattgtggactatgctagcagcgaagnggatgcgaccagggttttcgatttgacgaa

SEQ ID NO: 17363 - DNA, 101 bp, rice(Oryza sativa)
  misc_feature (71): n=a or g
acgcaatacccgagtcttatcctatacatattctaaccatatgatttattatcccatgtaaccagtcgganaatcaatcattgtgggtatatggtatccat

SEQ ID NO: 17364 - DNA, 101 bp, rice(Oryza sativa)
  misc_feature (71): n=t or c
gtcaagcacatgtaggaaaatactagatggttaggtgtcatttttaagctaccgatcttcttgtggttgancggaagtaatttgtgaatgtcatatcttat

SEQ ID NO: 17365 - DNA, 101 bp, rice(Oryza sativa)
  misc_feature (71): n=t or c
aggtcgagtgcgggggcgcgccatcaggccaggtgtacctcgagaagtgctacattagctacagctactanccccatggcataccccatggcggcggcatc

SEQ ID NO: 17366 - DNA, 101 bp, rice(Oryza sativa)
  misc_feature (71): n=t or c
attcttctcaatgccgccgccgaagtcgatatcacagaccttcaaatctcacgtcctcgctatgtctctcngtcttggtgtctgtgatgacttgtcgaacc

SEQ ID NO: 17367 - DNA, 101 bp, rice(Oryza sativa)
  misc_feature (71): n=t or c
gtgttggatttggtaaccagcaccatgcaggtggcacctatgagtattgtcaatggtgctgattcaagaancggcacctttgaggtgtatggatcgcaaaa

SEQ ID NO: 17368 - DNA, 101 bp, rice(Oryza sativa)
  misc_feature (71): n=t or g
ctgcggcggcctcaaggaggaggaatacgaacaagaaacggcgactccggtcgtgaaccggacgtcgtcgncgtcgtcgctgccggcgacggcgacggcga

SEQ ID NO: 17369 - DNA, 101 bp, rice(Oryza sativa)
  misc_feature (71): n=t or g
tttatgcccacgaggaaatccgttagcagttgtgcacatctgatagatcctattgcaaccccgtttatggntgggcagtacaatccttagtgtggagatta

SEQ ID NO: 17370 - DNA, 101 bp, rice(Oryza sativa)
  misc_feature (71): n=t or c
ggacggactaaatcggattgtgaaaaaatcgcgcggacggacaaaataaactgtgatgaaagaaaaattangaatattttaattagttaagattggatggc

SEQ ID NO: 17371 - DNA, 101 bp, rice(Oryza sativa)
  misc_feature (71): n=t or c
atgcacatttggctcccctgcaaaatccatgcaaacttattttgaaagcattcttgcaatatactccctcnatcccaaaatgtttgacgccgttgactttt

SEQ ID NO: 17372 - DNA, 101 bp, rice(Oryza sativa)
  misc_feature (71): n=t or c
acaagtaaattgaaataatggagggagtacaatacatcagatttattaattgacgtctcacattgattctncttaagcagattgtgtggctcacaattgtg

SEQ ID NO: 17373 - DNA, 101 bp, rice(Oryza sativa)
  misc_feature (71): n=a or g
tacattaaaatacggtgggaggaccttattgagtaacgttacaaatgctgagccccactaacttatgtganccggccacagatacatgtttagctgtagag

SEQ ID NO: 17374 - DNA, 101 bp, rice(Oryza sativa)
  misc_feature (71): n=t or c
gtttcgccttcagagctggtggacattcttcagagaacaatcgatgagcaacgtgcatcctccagacagtnttggcctgatgagcagctagctgcagcagt

SEQ ID NO: 17375 - DNA, 101 bp, rice(Oryza sativa)
  misc_feature (71): n=a or g
tctagaatataattaagtattacctccgtcccaaatataacaagttttaactatgtctggatacacagttntccatatttataactaaaaatgtttatatt

SEQ ID NO: 17376 - DNA, 101 bp, rice(Oryza sativa)
  misc_feature (71): n=a or g
atggatttgaggaaattggacgagggaaaggctgatgattctgatgctgtaaaaagtaccaaggacagctntgaaatttgaaggttgccttttggattgtg

SEQ ID NO: 17377 - DNA, 101 bp, rice(Oryza sativa)
  misc_feature (71): n=a or g
aattgtctaaaaaaaatattaaatagtatctcgttgccataaaggttttaaaacatctgattgttgtgggnttcaattttaaaagtttttaacagtcacac

SEQ ID NO: 17378 - DNA, 101 bp, rice(Oryza sativa)
  misc_feature (71): n=a or g
ctgcttgattacacattgctcttacaatgtccaatattagcagcgtcatttccggcatcatcaggtgaganatctttttcttttttaccagcatcaatttt

SEQ ID NO: 17379 - DNA, 101 bp, rice(Oryza sativa)
  misc_feature (71): n=t or c
aaacatatattcctgacttttatatatgtttccatgttggttgtagaattgtcctacacctccttagtcanggagaaatgtgacgtatatagcttcggtgt

SEQ ID NO: 17380 - DNA, 101 bp, rice(Oryza sativa)
  misc_feature (71): n=a or g
ccgcatgcgatgctcagggcgggcggcgtcggaaaatggccgacaatgaggtcctaccggactgaggactngctgcgcaaggaggttgctgcggtgatgca

SEQ ID NO: 17381 - DNA, 101 bp, rice(Oryza sativa)
  misc_feature (71): n=a or g
aaagatttagttcagattagcagcacatcggcacgctcggcacgataaaatatatggcactgtcccaatcnttacaaatcaccactcccactgtaccaatt

SEQ ID NO: 17382 - DNA, 101 bp, rice(Oryza sativa)
  misc_feature (71): n=a or g
ttaattagaacaactaagcgaaatcatgactaccacaacaactccaccaacaacactctcacaccagcctnctaacaactataagaacgatggaggttttt

SEQ ID NO: 17383 - DNA, 101 bp, rice(Oryza sativa)
  misc_feature (71): n=t or c
gaggaggccgttgctgggcgtgaggccatccatctggaaagcaactgtgctgagcacgcggcgatggcggngagggcatccgagctggaggcctgggagaa

SEQ ID NO: 17384 - DNA, 101 bp, rice(Oryza sativa)
  misc_feature (71): n=a or g
caagcattcaagacatcacctcctcggcttccgtttacaagcatgcattattgctgattagtttgcttagngcacccacaatggttatctataggctctct

SEQ ID NO: 17385 - DNA, 101 bp, rice(Oryza sativa)
  misc_feature (71): n=t or c
tccccgctaccaaccctatccactcctctatcctaacgagcgttcagtgatgccaccatgtcctcgccatnactgctgagaccaattgctacccattgcct

SEQ ID NO: 17386 - DNA, 101 bp, rice(Oryza sativa)
  misc_feature (71): n=t or c
taatctatgtttagaaacttttgtcggttactcgctcaaattgtatggggtaataaatcggtgaagtatanttttatactgaatggacaagataagctacc

SEQ ID NO: 17387 - DNA, 101 bp, rice(Oryza sativa)
  misc_feature (71): n=t or c
gctgaattgaattggtgcagagtgaccaagaggatagcctggtttcccccggctaaaattgaaacatttcnaagtctgctgctgctgcttgcaagctatgc

SEQ ID NO: 17388 - DNA, 101 bp, rice(Oryza sativa)
  misc_feature (71): n=t or c
tcagttccgctgccgccgccggcggatagatattagtaaggaattggtgaatacgcatgttgtgtttaggnaatatggtgcctgctattaataattgaagt

SEQ ID NO: 17389 - DNA, 101 bp, rice(Oryza sativa)
  misc_feature (71): n=a or c
tatctaaatattgggtgtctgttctaataaatctttggaaacccataattatcaaatggcgtagtcagtanctaccggtagcatccggccaatcaattact

SEQ ID NO: 17390 - DNA, 101 bp, rice(Oryza sativa)
  misc_feature (71): n=t or c
acgacgctagaaactggtgacgtacaagccattgctatcgttgtagatgttaaatatgttatctgagattnacttaccagtatattttgagtagtttccta

SEQ ID NO: 17391 - DNA, 101 bp, rice(Oryza sativa)
  misc_feature (71): n=t or c
tctgggacggatggagtagaactgagaagtcagcaagagtcgtcaatgcccaagattacctcccatagatngtttaaatatgggtatgtttatttctttgg

SEQ ID NO: 17392 - DNA, 101 bp, rice(Oryza sativa)
  misc_feature (71): n=t or c
ggcgacagtggcccgttgtccgtcgctttggctctaccgctggaagagaagtgtttgtattttaatattgnttttcttgtactttgcttttccaaaatttt

SEQ ID NO: 17393 - DNA, 101 bp, rice(Oryza sativa)
  misc_feature (71): n=t or c
aacggttcatcggataatatgttcgaaataccgaataattatatccaccgattttttgcaataccacatcngatccacacctgcaccatacaattcgcatc

SEQ ID NO: 17394 - DNA, 101 bp, rice(Oryza sativa)
  misc_feature (71): n=a or g
tttgtatcttaacaacaacaagttcaacggttttgtgcctcttgaagttggagcagtaagtaacttgaaanagttgtttcttgcgtacaatactttcagcg

SEQ ID NO: 17395 - DNA, 101 bp, rice(Oryza sativa)
  misc_feature (71): n=a or g
ttcacgtcccaactaggcgaacgtggcatgccattcttcatgctcctcaaaaagtctgatgacttcacctngactccagaagcccaagcagccttcaacga

SEQ ID NO: 17396 - DNA, 101 bp, rice(Oryza sativa)
  misc_feature (71): n=t or c
aacacacaggccctgacggtgcccatgccatcggacacgccgctgtactcgatgtacaccacgcaaatcanccgtaagcttgacatgatgctgctcctgtt

SEQ ID NO: 17397 - DNA, 101 bp, rice(Oryza sativa)
  misc_feature (71): n=a or c
aatagatgcaaatctcctttgctgtctacatttttttttgcgaggaacctttgctgtctacatgtttggtntaaggatagataattatgctttacactata

SEQ ID NO: 17398 - DNA, 101 bp, rice(Oryza sativa)
  misc_feature (71): n=a or g
ctcatagagccatcacaagtcatggtgttgcagccgaatgttgtgctcatcttggaaaagaagatggacantagatgttcgatgaccctggactagttggg

SEQ ID NO: 17399 - DNA, 101 bp, rice(Oryza sativa)
  misc_feature (71): n=a or c
gaatgacagctactaatttggaatgttcacgaactttcctacgtgaagagtattgtacgtcgatccgtatnaaaaaaaatgaaccgtgaaaatcttataat

SEQ ID NO: 17400 - DNA, 101 bp, rice(Oryza sativa)
  misc_feature (71): n=t or c
agagaaggcacagaacagtcacctggaagatatgattgacaggaagtgcaatgacatgtccttacaccaanaggatgtgataaagataatgaagcttgcaa

SEQ ID NO: 17401 - DNA, 101 bp, rice(Oryza sativa)
  misc_feature (71): n=a or c
cttcacagggccgattccagcctcgctagcaaacctatcatcgcttgagttcctaaagttggacttcaacnacctgaaaggcctgatcccgtcaagcctcg

SEQ ID NO: 17402 - DNA, 101 bp, rice(Oryza sativa)
  misc_feature (71): n=a or c
attactctcgccggttaatacagtaaccaaacggacggtacaaatcacactttggcgcaatccgccggagngaaggagaaaatcccgccgtcgagatcgta

SEQ ID NO: 17403 - DNA, 101 bp, rice(Oryza sativa)
  misc_feature (71): n=a or g
ctcgtagtcgtagtggtagcagcgtaggagtagtatttccatttcgatcccttctcttgtagattcaggcntgtttaattttaggggtgaaaagttttggc

SEQ ID NO: 17404 - DNA, 101 bp, rice(Oryza sativa)
  misc_feature (71): n=a or g
tagggaacagtcggggcagccatgtccatggacaagcgaaggataacagatccaatcgcagggaggaaccnaatgtgggacggggtttttgacttaaaaaa

SEQ ID NO: 17405 - DNA, 101 bp, rice(Oryza sativa)
  misc_feature (71): n=t or c
cagcgctgcggctgaacgggttcccgtgcaagaggatagagaacgtgacggcgaacgacttcttcttcgangggctgatgaaggccgggaacacggggaac

SEQ ID NO: 17406 - DNA, 101 bp, rice(Oryza sativa)
  misc_feature (71): n=a or c
gagattgagcccgtaagggcaggtggtacagtgtgttgtcacagtagcgtacgtttgttgcttagtacttnctccattccatcatttgtactacttttcat

SEQ ID NO: 17407 - DNA, 101 bp, rice(Oryza sativa)
  misc_feature (71): n=a or g
tctatctaacagataattgatgaaggcaaggggtgggaaacaccgagggagccatatgaagtgacagcacngtaaattaccttttaaatcaactggcgaat

SEQ ID NO: 17408 - DNA, 101 bp, rice(Oryza sativa)
  misc_feature (71): n=a or c
atgaggtgagggcatgcatcccaaaagggcaaaaaattgttagcgaagttgacataaacaacatggcttanctacgagcggtcattaaagaagggattaga

SEQ ID NO: 17409 - DNA, 101 bp, rice(Oryza sativa)
  misc_feature (71): n=a or g
gattttgatgagtctggtgacgattttacggacaaggattttgagtctgatgaagctatatgggccttgtntgagcgctggtgcaaggcttacgataagaa

SEQ ID NO: 17410 - DNA, 101 bp, rice(Oryza sativa)
  misc_feature (71): n=a or g
agccttctttagctgcttctaaatgtaacgatgcatttctctcacctatcaattatcagggcaacaactanataatttgctgacaacattctcgatcagaa

SEQ ID NO: 17411 - DNA, 101 bp, rice(Oryza sativa)
  misc_feature (71): n=a or g
gcaaagggtgaggcacaaggaatggtcagcaaattcctggggataatgctagggatagcattagctaatcncattggctcttctgtatcattagctcttat

SEQ ID NO: 17412 - DNA, 101 bp, rice(Oryza sativa)
  misc_feature (71): n=t or c
tcgagttttcgtcgaaaaagacaaaaccgcctcttgttaatgttaatgggtctcgtgcagtgaatgcaacnctggttcgaaatttcggacccccggcaaat

SEQ ID NO: 17413 - DNA, 101 bp, rice(Oryza sativa)
  misc_feature (71): n=t or c
aggggaaactatagcacccaaatttggtttagtcgatacaggcccataatttatcgggtggccgcattganttacggtagggccattgctattggcagcct

SEQ ID NO: 17414 - DNA, 101 bp, rice(Oryza sativa)
  misc_feature (71): n=t or c
gttctgtagtaggtgcttgatggaataccccagtgaggaaatttgtttttgttctgtaccagagaaaaggnagcgaggagatctgtgagtgaaaaaaaaat

SEQ ID NO: 17415 - DNA, 101 bp, rice(Oryza sativa)
  misc_feature (71): n=t or c
acatgttcctaattatgagaagcaaaagtactagtagttcccccaggccgatcaccggatttctcaacgtnggcgagcatttgatcgagaggcggcacgat

SEQ ID NO: 17416 - DNA, 101 bp, rice(Oryza sativa)
  misc_feature (71): n=t or c
agagggatgaaaatccacatctcctataccagattcaacctgtttggcagctgagttttccaatttgtctncctcgttttccgtgcaaaagcttttaaaac

SEQ ID NO: 17417 - DNA, 101 bp, rice(Oryza sativa)
  misc_feature (71): n=a or g
aggtgccagaagtcatgatacctgttgttttctgcatcttgaaccgtatagcatggtttcacttatatttnttttctgcatcttgaaccgtatagcatggt

SEQ ID NO: 17418 - DNA, 101 bp, rice(Oryza sativa)
  misc_feature (71): n=t or c
ttgctgcatccatcaagctcatacctcctgcggcgctgatttgcctcgatcacacgagccttgatctcgtngatctggttggcaatctgatggcgcacgcg

SEQ ID NO: 17419 - DNA, 101 bp, rice(Oryza sativa)
  misc_feature (71): n=t or c
gtgttcaatctgttcactatagtcaccttactcttcattgacagctttgtgaccatcgattggagctccgntaagatgctgaagccgttggctgccctgtt

SEQ ID NO: 17420 - DNA, 101 bp, rice(Oryza sativa)
  misc_feature (71): n=t or c
aggaacatcgctatcaactcctttgagacaaggacgatgatgccatggacacaaatcccatagctaagctngcctatagatgaaaccaccgaagcaagatg

SEQ ID NO: 17421 - DNA, 101 bp, rice(Oryza sativa)
  misc_feature (71): n=t or c
tcagagcctaacaagggtgggctctgaccataatcccattctggtgaaccttgaaaaacatgcagtggttnagaatgctcagtccttcagatttgagagga

SEQ ID NO: 17422 - DNA, 101 bp, rice(Oryza sativa)
  misc_feature (71): n=t or c
ccttcaagcaaaaggtcatagtattcactcggatctcataacctttcacctattgaagtcggccttggtangtggatttgaatactctgactttaagacgc

SEQ ID NO: 17423 - DNA, 101 bp, rice(Oryza sativa)
  misc_feature (71): n=t or g
atggtagcagcatccgatgaaaaagccagattaagaagatcaagcaactcctcatctgagacatcgcctanctgaaaaaaaaaaacagcatagcaagttga

SEQ ID NO: 17424 - DNA, 101 bp, rice(Oryza sativa)
  misc_feature (71): n=t or c
ggtatagacagtcaatggtttccgcacactagagacgccgtttgaagccttcattagcaacagaaaccttngtcacgtctcgcattgtgacctggcacttt

SEQ ID NO: 17425 - DNA, 101 bp, rice(Oryza sativa)
  misc_feature (71): n=a or g
gtacccgatacggcgatacgtccggtactctgtcgatacggtatcggaggagtatcagtcattaaacaatnaaaaaaaagaaaaaataaatactaatactc

SEQ ID NO: 17426 - DNA, 101 bp, rice(Oryza sativa)
  misc_feature (71): n=a or g
gagttttcaccctgaatgttttatacctttaatgcccatgcataggattgcagactttcctcccttagaanagcgcaaccaaagaagcaaggcatcccatg

SEQ ID NO: 17427 - DNA, 101 bp, rice(Oryza sativa)
  misc_feature (71): n=a or g
tgccaagctgacagtagctgatgccctgattgctaacagatggattcgccgattacaaggtgccctgtccnatgaagctctgggtgaattcttccaacttt

SEQ ID NO: 17428 - DNA, 101 bp, rice(Oryza sativa)
  misc_feature (71): n=t or c
catattcttgttggatcgatgtatccaaccggtgatccagttctatcagcttcatgaattgcatactgtanaatgaacaaagaagtaatgagatttggttt

SEQ ID NO: 17429 - DNA, 101 bp, rice(Oryza sativa)
  misc_feature (71): n=t or c
cacatgggggtggctacctaggatcatcgatatcataatgcaatcttgtatctcacttggcattccagaanaataattatacttgtacgtacatggaacta

SEQ ID NO: 17430 - DNA, 101 bp, rice(Oryza sativa)
  misc_feature (71): n=t or c
cggaaaatcgtataccagagtaaacctggtcactgaatagagagttagagttactggtcgccaacccgtgngttgcacgggcttttatatgggggcatatt

SEQ ID NO: 17431 - DNA, 101 bp, rice(Oryza sativa)
  misc_feature (71): n=a or c
ggtattggtccctccaagttattactggatagctccaaaatatcggagagcgtagggatgctaagtattcnaattggaattcggcctatgaagttattgtc

SEQ ID NO: 17432 - DNA, 101 bp, rice(Oryza sativa)
  misc_feature (71): n=a or g
gtgttctttgcagccgcccagttctttatccggtgtgtaccgcatctggtatgtgcgagcaaatcctgatnggattatctccccaaacgactggaggctgt

SEQ ID NO: 17433 - DNA, 101 bp, rice(Oryza sativa)
  misc_feature (71): n=a or g
aactaaaccaggcctcagtctcaaaacggacacactttttcagctgttcgtagcatccaattccagtgttngaaaaagtacaccgaaggaccctcaacttg

SEQ ID NO: 17434 - DNA, 101 bp, rice(Oryza sativa)
  misc_feature (71): n=t or g
ttcttaatattagaaaaacccctctacattgggagcgactagtttaccgaagagaacaattcaatgaagangcattcaatagtaatgaaaaagactataga

SEQ ID NO: 17435 - DNA, 101 bp, rice(Oryza sativa)
  misc_feature (71): n=t or c
aaacgagagtttttcaagtttttgtactattgcacccactgcataagttcgcgtaccgtcaatgtcaatgnaatgtactcttaaatataataaggtaatta

SEQ ID NO: 17436 - DNA, 101 bp, rice(Oryza sativa)
  misc_feature (71): n=a or g
ccatttttgcatctagttcctatcccacttggccatcgacgcgggcaccggccaagcatttgagcactccngacgcagcatgaagttcacgcagccgaaga

SEQ ID NO: 17437 - DNA, 101 bp, rice(Oryza sativa)
  misc_feature (71): n=t or c
cagaaggattgaggctgttgcaggtgatgcatttgttgagtatgtttgtgcccgtgacaactatatgcggngcttgtgctcatcccttaaggtatgatggt

SEQ ID NO: 17438 - DNA, 101 bp, rice(Oryza sativa)
  misc_feature (71): n=a or g
aaaacgaagggttccatgtgaaaaaaacacccactgccgcttcccaaagagactgatctatactccctctntcccaaaatataagagaaattggagggatg

SEQ ID NO: 17439 - DNA, 101 bp, rice(Oryza sativa)
  misc_feature (71): n=t or c
tgggtgacagcctacgacgatgacatgcaatacgagaaattcaaggtcatggtggaggacttaaaaacctngctttatccaagatgcaacaaggagcacac

SEQ ID NO: 17440 - DNA, 101 bp, rice(Oryza sativa)
  misc_feature (71): n=t or c
tccaccgccgccgccgtctcctccaccactctccgcttcactcccacctgtccgtacaatctccctcccgncgccgccgccgtggacctgtgcccggccat

SEQ ID NO: 17441 - DNA, 101 bp, rice(Oryza sativa)
  misc_feature (71): n=t or c
tattaaagatcaaatcttagaaggaaaaaaaaatcccaacggcagaaatgtaggacggacacgtacagtanaactcaatcaataacatccactgtcgcgat

SEQ ID NO: 17442 - DNA, 101 bp, rice(Oryza sativa)
  misc_feature (71): n=a or g
atcccagatgacattgggaaacttgttcagctgaataatctaaatttggattggaacaacttgagtggaancatacctgtgagtatagggtattgtactca

SEQ ID NO: 17443 - DNA, 101 bp, rice(Oryza sativa)
  misc_feature (71): n=t or c
ttggtattgaatagggcctctttagagcgtggcatgtttcgaacacaacattttaagagctataaagcacngatagaaaacaaagagatcaccaaacgatt

SEQ ID NO: 17444 - DNA, 101 bp, rice(Oryza sativa)
  misc_feature (71): n=t or g
tgtatgaccaagacatgttgtcgtctacggattccctatatccttactgcatggagtgccttgacaggatngcggccgtcgcggtccggtgtctgaaaaac

SEQ ID NO: 17445 - DNA, 101 bp, rice(Oryza sativa)
  misc_feature (71): n=a or c
cacgtacctaagaggtcagccttttggaggagatgcatgaaggcgccatagtagtctgcgtagacgatggngacatccgagttgaccttccggaggtcatc

SEQ ID NO: 17446 - DNA, 101 bp, rice(Oryza sativa)
  misc_feature (71): n=t or g
tatgtttatagtagaaccatgacaatagtagtagtagcttttatccgtcacacattgaggtcttaaactantagtagtagcttttatttatttggcacttg

SEQ ID NO: 17447 - DNA, 101 bp, rice(Oryza sativa)
  misc_feature (71): n=a or c
aatgtcatcattctggtcattgtcaaaccgtttcttctctatgtccgtaagcatgtaggaggcatggctantagtttgatccaaagtattggagaaatcat

SEQ ID NO: 17448 - DNA, 101 bp, rice(Oryza sativa)
  misc_feature (71): n=t or c
agacggttgcggtaagtaatttgccatcaccgatctccattcaaaataatttcaaaattcaaagcgtgtangtatttcgtgagttaaacgttataaatttt

SEQ ID NO: 17449 - DNA, 101 bp, rice(Oryza sativa)
  misc_feature (71): n=a or g
aaatacacgcacgacgccaacattgtctcagccgggaagagaccaagagtccgatatggggaagaaagcgnaggcggccgccggctccggcgccggcacca

SEQ ID NO: 17450 - DNA, 101 bp, rice(Oryza sativa)
  misc_feature (71): n=t or c
ggataaaaacaacttggcatgcaaaactgatggtgcaggcttggtgtgtagtgcaattgggaaggattgtnatgataggaaaggggcaggggggaggttgt

SEQ ID NO: 17451 - DNA, 101 bp, rice(Oryza sativa)
  misc_feature (71): n=t or c
gaatggctttgaaagtgtctaaaatgtgtcctacattgtggtgcggatgacactgtacatgctgtggtgtnacccatttagttgactttgtgcaagcatga

SEQ ID NO: 17452 - DNA, 101 bp, rice(Oryza sativa)
  misc_feature (71): n=a or g
taacttcttggcaagcacccatggcactgtgctcaaactaaatcgtgaggcaaccacaacaccaaaccctnagcgcacactcttctttgctcaattctggg

SEQ ID NO: 17453 - DNA, 101 bp, rice(Oryza sativa)
  misc_feature (71): n=a or g
agtgcgacgcgccttgactagcatgcatccacgcgcccacacggattagggcctgtttagatcgtgaaaanaaaatttttagatgtcacatctaatgtttg

SEQ ID NO: 17454 - DNA, 101 bp, rice(Oryza sativa)
  misc_feature (71): n=a or g
agctaattaactagtggctttttactactgctaatttctttacgagagcaggtacaataagtagactattngccagctgtaaacatattttagcgagataa

SEQ ID NO: 17455 - DNA, 101 bp, rice(Oryza sativa)
  misc_feature (71): n=a or g
gggcaccagctgtgcagatagaagcatttcattctgtgccagcaacgtagaggagcagaatgaagatttcntgaatacaaaattcagtaatgatggtccag

SEQ ID NO: 17456 - DNA, 101 bp, rice(Oryza sativa)
  misc_feature (71): n=a or c
cgacgacgatgagctagctagtcagcatgcacatatatatggtcggtcgtaatttagatagctaagctagntagctactgacctgatcttttttttacacc

SEQ ID NO: 17457 - DNA, 101 bp, rice(Oryza sativa)
  misc_feature (71): n=a or c
tatgaacaaattcctctgtacaaaacagagaggagactcatggctcctggggctgggatctactggctagnagcaccggaggtgtgctaggctgctagcca

SEQ ID NO: 17458 - DNA, 101 bp, rice(Oryza sativa)
  misc_feature (71): n=t or c
aatcgtaaagaatcttcgcttttgtgcagattgccacaagtttgccaagttagtgtcccagatctatcatngggagattgtggttcgggatagagccagat

SEQ ID NO: 17459 - DNA, 101 bp, rice(Oryza sativa)
  misc_feature (71): n=t or c
tactcatcggtgacaggttaaaaaaaatcaatgtcaccagcgtgcatcaatgtcgggtcaaaaatagaagncgtcaccgatgagttattcgtgatgggttc

SEQ ID NO: 17460 - DNA, 101 bp, rice(Oryza sativa)
  misc_feature (71): n=t or g
cgtatgttttgtactttggtctcacatgatgtaacaggacatgcttgtagcccagacaaaccatgagaggnctctcgtgggtctcagacagaaatagaagt

SEQ ID NO: 17461 - DNA, 101 bp, rice(Oryza sativa)
  misc_feature (71): n=t or c
cgaccgccaccagcgccgatgagccacgattgccctctcttttcttgtgttcctcaatctactctcaatgncgtctctgttccatctaatttcgtcccatt

SEQ ID NO: 17462 - DNA, 101 bp, rice(Oryza sativa)
  misc_feature (71): n=t or c
tagtggtgttttcgagttatgcaatgggtgaagatatttttgaccgttttcattgtcagaaaactatgtanttatcatttatccatattctctaataaacc

SEQ ID NO: 17463 - DNA, 101 bp, rice(Oryza sativa)
  misc_feature (71): n=t or g
gctccaggcgattgatggcgacatggtgggcaagttgttgttggtcgattttccaacacttggtcgtgcanggcgttgagccgttccagcaccttagcaaa

SEQ ID NO: 17464 - DNA, 101 bp, rice(Oryza sativa)
  misc_feature (71): n=t or c
ggtccgaagaaggaaatatcgcacatattccgttcaccagagaagaggccacccaaggaactctcatttgngtttacgggcctcacgcttctgcctattgt

SEQ ID NO: 17465 - DNA, 101 bp, rice(Oryza sativa)
  misc_feature (71): n=a or g
gtgttgcagccacctcctgttccccaggctccccttcgtcgagcccaaaacaagctagaaaaccgttctcnccagtgaccagtggtgatgccatcgccttc

SEQ ID NO: 17466 - DNA, 101 bp, rice(Oryza sativa)
  misc_feature (71): n=a or g
attttgggacagattgggccctgccatttttccgcctctttctgtttgttgaagaaccttgccatcaactntccctttatcttctccaacatggtcagtat

SEQ ID NO: 17467 - DNA, 101 bp, rice(Oryza sativa)
  misc_feature (71): n=t or c
tcacttgacaaatttgtggctgcttgcattattgcgaaacttatctttttcatggaaagtttcggtactgnactcaaacacaagagacagttaagaaaact

SEQ ID NO: 17468 - DNA, 101 bp, rice(Oryza sativa)
  misc_feature (71): n=t or c
tggagctttgaatagaggttggaccaaagttcgatttgtggagtatccaagtaaccaaaggaaaaaaacantctcaggtgatactagtactaaagaaaaga

SEQ ID NO: 17469 - DNA, 101 bp, rice(Oryza sativa)
  misc_feature (71): n=t or c
gaatgcatttggtgttgtgttgtgtgggattgatcttgaactacttcatgtgcacacaggggtgagcactnggtttttcgatttaggccttattttgttaa

SEQ ID NO: 17470 - DNA, 101 bp, rice(Oryza sativa)
  misc_feature (71): n=t or c
ccaaaacctaaccattccaatgcgggaatgcgggatagtgagggcaattttgtctctggtttcatagttgnggtaaaacaaggcggaactgctataaatca

SEQ ID NO: 17471 - DNA, 101 bp, rice(Oryza sativa)
  misc_feature (71): n=t or c
aattagcaatggtaggggaaattttttttagttggctgagctagctacctgccttgctcccacagcatgcngtctaacctggccttcccctgctccttatc

SEQ ID NO: 17472 - DNA, 101 bp, rice(Oryza sativa)
  misc_feature (71): n=t or g
tgccatcctaaattagcaatggacaacatacttcagaacaagtagaaacaggtataacccactatctgagntctagtttaaacatctaacataatttacgt

SEQ ID NO: 17473 - DNA, 101 bp, rice(Oryza sativa)
  misc_feature (71): n=a or g
atggcagagggtccaggagaagcatccacaacagcagaagggagacaaaagctagaagaaaacgagggtcngggtggagtagggacggaaacctagaggtg

SEQ ID NO: 17474 - DNA, 101 bp, rice(Oryza sativa)
  misc_feature (71): n=t or c
aattctgtcttgttgatttctgaatctgtcatgtccaacagtgtgaagtctgttggaacttagggtagaanttagggctgtgtttagatccaaagtttaga

SEQ ID NO: 17475 - DNA, 101 bp, rice(Oryza sativa)
  misc_feature (71): n=t or c
gttagtggattataacgttatagaaagtatagattcctagctactccccacttaatagatcctgcctatgncacatatggatctgcgtttgttcaggagcc

SEQ ID NO: 17476 - DNA, 101 bp, rice(Oryza sativa)
  misc_feature (71): n=t or c
ggagtcgtgcacccaccagtcttaccggtgcttctcgcttaacatctcttgtattggtgcatgcattgtanatattcattgaggtgatccaaacaaaatat

SEQ ID NO: 17477 - DNA, 101 bp, rice(Oryza sativa)
  misc_feature (71): n=t or c
ttctgaagaaacattctctaaactttgcaggtgtgaaacagtcttacagccaggcttcaactgcaccatcngcataaagaacaacaaaagaaaagcaaagc

SEQ ID NO: 17478 - DNA, 101 bp, rice(Oryza sativa)
  misc_feature (71): n=t or c
ccatccggctgtacgtggaatcaggacaactagactagagcatgaatttccatcagatatcttctttgcangatgtcgtgcatcgatctctttgctaagca

SEQ ID NO: 17479 - DNA, 101 bp, rice(Oryza sativa)
  misc_feature (71): n=t or c
ccatcttccgaggttaaagacgactgtcgatgtgtgagcggggtttgtggcctcacttgtgggctaagctngagaggagagagagagagggagagagaggg

SEQ ID NO: 17480 - DNA, 101 bp, rice(Oryza sativa)
  misc_feature (71): n=a or g
atcaagagaatacagcaaggaccgcaatggtcaggcatccagggatagagattcagaaagaaaggacaganttgaacctcgagaaagcagaagagaccatg

SEQ ID NO: 17481 - DNA, 101 bp, rice(Oryza sativa)
  misc_feature (71): n=a or g
cgagagatcgcagccgatgccccggcattaagcaagaactcaacaaaaagtaaaagaaaagggtggcaacntgccgaaagttgtattgatttgattgtctc

SEQ ID NO: 17482 - DNA, 101 bp, rice(Oryza sativa)
  misc_feature (71): n=t or c
ttctgctctttccttgaatgttgggccaccgatatcagagtaggctggaccgggtattggaatggagcctntggagacgatcctgcagtccaagggaagca

SEQ ID NO: 17483 - DNA, 101 bp, rice(Oryza sativa)
  misc_feature (71): n=a or g
cgcagcagctgcagaactccaggacaaccatggctgcttacggttgttggtgtagggaactaatcctttcntacgtaaaacgaaacaactcattagcgtat

SEQ ID NO: 17484 - DNA, 101 bp, rice(Oryza sativa)
  misc_feature (71): n=a or g
ggagggattgagtcacacaaaatccctataattccctttcttaaaccccatgtatgttcgttttggctggngattttagctatcaaaatctgattaactca

SEQ ID NO: 17485 - DNA, 101 bp, rice(Oryza sativa)
  misc_feature (71): n=a or g
cggctagggcgtggggcttgctgcgcccttgcgcggcaaatggggtgatttcttatagatagaaaggaggnaaagatacataagttagattgcaaatctcc

SEQ ID NO: 17486 - DNA, 101 bp, rice(Oryza sativa)
  misc_feature (71): n=t or c
tggacgtgatgttttggatggcacaagcgttggttttgttgaaacgctagagaatgatctttctcaactgngtgccaagggcattgatgcgtgcattgcat

SEQ ID NO: 17487 - DNA, 101 bp, rice(Oryza sativa)
  misc_feature (71): n=a or g
ccgcaaccattggcaagcatcaaatttcatctttcaactcaccattcggttgcaggctttcagctcctttntcctgcccaacttagtttcgactttcgaac

SEQ ID NO: 17488 - DNA, 101 bp, rice(Oryza sativa)
  misc_feature (71): n=t or c
cataatgtttgtttataatcatttcagtcagcaatacttggagagattgtgggctcgaagaaagcgacacnaaaattgcttcagatgtatgttccttttgc

SEQ ID NO: 17489 - DNA, 101 bp, rice(Oryza sativa)
  misc_feature (71): n=a or g
accgtcacgcgccgaaagttaggcttcgtatgcatggaatagttgtagtagtggacatgtggaaggaacgnaatagtagagcgtcaaggcaatggtaccgt

SEQ ID NO: 17490 - DNA, 101 bp, rice(Oryza sativa)
  misc_feature (71): n=t or c
ttcactggtctgaccttgccagatccaaccatggatggcccatatttgggtggtgcaacctctaacttccnaattgtgtcgttgcccccaaccgatgcaac

SEQ ID NO: 17491 - DNA, 101 bp, rice(Oryza sativa)
  misc_feature (71): n=t or g
acccgctgaattaattaattaatcagccagagaaaggctgtccgtgttagggaggattatataagagcaantcatctataactaatataatagccaattca

SEQ ID NO: 17492 - DNA, 101 bp, rice(Oryza sativa)
  misc_feature (71): n=t or c
agggctatcacaaggtgtgcaggttcatcatcttcaagccacttttccaaatccctcctgtaatcatcaanccccacaagatcttcatcactgatggaaca

SEQ ID NO: 17493 - DNA, 101 bp, rice(Oryza sativa)
  misc_feature (71): n=t or g
cgctctgttctgatcttggcaaggggtataatccgtgtagcgatccgggcacggcttaaacttcttcgccngcgaaacgagatcgcgaggccttgcctgct

SEQ ID NO: 17494 - DNA, 101 bp, rice(Oryza sativa)
  misc_feature (71): n=t or g
gtggtcgcaggtgaagctaattagcgacgaagaatatgtgcgatgtggtggaacggtgacctgtaaaaaanaaaaaagaaaagaaggggtactatttggat

SEQ ID NO: 17495 - DNA, 101 bp, rice(Oryza sativa)
  misc_feature (71): n=t or c
gttagtattcacactgcaagtgtggacatattttagtatttcactactagagaaaccatcgtccaaaatcnataatagtcccgatttgaataggaaccggg

SEQ ID NO: 17496 - DNA, 101 bp, rice(Oryza sativa)
  misc_feature (71): n=a or g
agcagtctaatccagtgatttctccctttttttttcttcttccccagggtttccttcaccgttcggctgcncattgccttcccgtcggagctacttgcctc

SEQ ID NO: 17497 - DNA, 101 bp, rice(Oryza sativa)
  misc_feature (71): n=a or g
ttggtcatatgcacggtgtgctttgcttgcccaagaaacccgtcagcttcttcatttcttgacataatagncattgcaacgagctgatatttatattggag

SEQ ID NO: 17498 - DNA, 101 bp, rice(Oryza sativa)
  misc_feature (71): n=a or g
agccggaaagaggagacgaggcgaatgccttcgttgtgttgattcttcatcaatgccctattccttggctnaagggcatatatttgtagtgctgctagttg

SEQ ID NO: 17499 - DNA, 101 bp, rice(Oryza sativa)
  misc_feature (71): n=t or c
gaataggaggctagctagctaatgcgttgccccagatagagcttatagattcaactcatctccccgggggnagctgaaggatggatggatcgtaccgagga

SEQ ID NO: 17500 - DNA, 101 bp, rice(Oryza sativa)
  misc_feature (71): n=t or c
tgatgatgcagccggccgtacaggtttagagctaagcagagtacatggcggatggctactccctctgtccnaaaatataagtattttttaactctgatata

SEQ ID NO: 17501 - DNA, 101 bp, rice(Oryza sativa)
  misc_feature (71): n=a or g
atttggtgattctagtgcaagaattaagggggcttatcctttgccgttaccacctggcaaaagaattgganatgcacccaggaatctgccacgagcaattc

SEQ ID NO: 17502 - DNA, 101 bp, rice(Oryza sativa)
  misc_feature (71): n=a or g
ttagagttgaggtcttccacaaacaaaagcactcctccttccatatctccaaccaaacgctggacctgacncaagtagtacctcatacctcctcctagacc

SEQ ID NO: 17503 - DNA, 101 bp, rice(Oryza sativa)
  misc_feature (71): n=t or c
aagagaattggctggttgttatcctttgcatgtaatttgagtctatatataatgagaaaaatgatgaggcngtgggtggttgaatcaacagaaacttgcat

SEQ ID NO: 17504 - DNA, 101 bp, rice(Oryza sativa)
  misc_feature (71): n=a or g
ttttgttttgagtgaaataaagaagcgctttaactagattatttttagagagaatctatcgtgtgtcactnattttattcccgttctataatatgccattg

SEQ ID NO: 17505 - DNA, 101 bp, rice(Oryza sativa)
  misc_feature (71): n=t or c
gtcaaccgtggccacgacatcatggttaggtttgacggcgacgctggtagcctaaagataaatggcacggngtaccagctccggcaaatgcactggcatac

SEQ ID NO: 17506 - DNA, 101 bp, rice(Oryza sativa)
  misc_feature (71): n=t or g
ctagaaacccatttttttccgttgcaacgcaagaactctcggctagcaaaagtagtcttggtagaattggntcaaaaagcactatcacaatatcatacact

SEQ ID NO: 17507 - DNA, 101 bp, rice(Oryza sativa)
  misc_feature (71): n=a or g
aacggtgacccaaatttgaagcagaggtgcagaggaaattgcggggagttaataatagcttggtaataaanttccatttaaaaaactaaagcagcgtgtcc

SEQ ID NO: 17508 - DNA, 101 bp, rice(Oryza sativa)
  misc_feature (71): n=t or c
gccgcccagcttgaagagaacaatgcactggctctggccattgtatcaccaggtgattagcatgcatctgnctatactatctcccgattagataattcaag

SEQ ID NO: 17509 - DNA, 101 bp, rice(Oryza sativa)
  misc_feature (71): n=t or c
gccaatgctgctggaaaactagtcatcatctcctccaggtcttcccatgttgcttgttctgctaaagtgtnagaccattgaatcaaaacttcagaaatagc

SEQ ID NO: 17510 - DNA, 101 bp, rice(Oryza sativa)
  misc_feature (71): n=a or g
ggattttctggatttcttcaataaaacgagcaaaatgcttgtctactgacgatttcctaatccgttgaggnaatggcagcaaccgcgtgtcgcagtactct

SEQ ID NO: 17511 - DNA, 101 bp, rice(Oryza sativa)
  misc_feature (71): n=a or g
atcaactgtgacatctatttttttcttggatgttttgctttgacactttgggtccaccattcctcaagagntagtatgtcgaaccaattatgtggatttag

SEQ ID NO: 17512 - DNA, 101 bp, rice(Oryza sativa)
  misc_feature (71): n=a or g
cgcgattcgacggcagaatcagtgcgttttcccgtactccgtcccagtatttgtccaaggccccccggcanctagcacgagggcgctgcgagcgaatggac

SEQ ID NO: 17513 - DNA, 101 bp, rice(Oryza sativa)
  misc_feature (71): n=t or g
aatagaagaggaggggagagtggaaggtggagggaatacgtaagtgtgcacatacgtggttaatacccatnggtattctgttttctcttccatattctact

SEQ ID NO: 17514 - DNA, 101 bp, rice(Oryza sativa)
  misc_feature (71): n=t or g
atctcgatcattcgatctaaacctatacctttgcttgaaacctgatattccgtagggtggtgctccagaanttgacattgcaagggcaaggtgcttccttt

SEQ ID NO: 17515 - DNA, 101 bp, rice(Oryza sativa)
  misc_feature (71): n=a or g
ttgaaatacctagagcagaggtgaataggcaattttcctgatacactttgcagcggatcagatatggccanaacttctggtcttatggccagaactgccgg

SEQ ID NO: 17516 - DNA, 101 bp, rice(Oryza sativa)
  misc_feature (71): n=t or c
aaaataccatattaattgggtggggggcactcttccgccccataaaaaaaatctggtataagatatgatantgtctgatacattatagtaatattaattat

SEQ ID NO: 17517 - DNA, 101 bp, rice(Oryza sativa)
  misc_feature (71): n=t or c
tgtattattcctgagaacatggtatgaactcccaggaactcgaaaatagtaacaactgcttggggaacacnctcctatccagtctccgacggacgatttac

SEQ ID NO: 17518 - DNA, 101 bp, rice(Oryza sativa)
  misc_feature (71): n=a or c
cggttagcttctcaaacagttatagcttccgctacagtagactaaatggagttataacgactaaattgtanatgagagcaaatagctagaacccttctcaa

SEQ ID NO: 17519 - DNA, 101 bp, rice(Oryza sativa)
  misc_feature (71): n=a or g
cttttgtgttcgtcatggagggcgaacaatgttatatttggccgatggcccactctcttttcttgttgtanccgaacgcggcttttttaacatatgaaatg

SEQ ID NO: 17520 - DNA, 101 bp, rice(Oryza sativa)
  misc_feature (71): n=t or c
ctgcgtcgcgccgtcttccaccttggggacagccgatctggactcgggggctgtttggttgtttgccacantttactacgccacactttagttatgccaca

SEQ ID NO: 17521 - DNA, 101 bp, rice(Oryza sativa)
  misc_feature (71): n=t or c
ataacctctgccattagtaattatatgataatcatcatcccaatgctcttgggtccgactctgaccagtcnatattacactccaggaaatcctgtagatga

SEQ ID NO: 17522 - DNA, 101 bp, rice(Oryza sativa)
  misc_feature (71): n=a or g
ttggtagccatggctgcttgtttgaactttgaacttgaacgttggggaagaatagggaggatgcgttggtnggaagaaggaagagaacgacggtgatgggc

SEQ ID NO: 17523 - DNA, 101 bp, rice(Oryza sativa)
  misc_feature (71): n=a or g
tagactagttcgcaaatatcaatgtcatatctgcaaattcacaattggatgactatccttttgtcgggtgnatttgaatcatttcagtgtgttcttgactt

SEQ ID NO: 17524 - DNA, 101 bp, rice(Oryza sativa)
  misc_feature (71): n=t or c
ctgtgagatctgggggcgctctgttgctcatgccggggacgacaaacagaggtgccttgccagagacgagnagagctcccttgccagggatgagcagaagt

SEQ ID NO: 17525 - DNA, 101 bp, rice(Oryza sativa)
  misc_feature (71): n=a or g
gtacgcgcgcgcccgcacagccatgctaccgtgatgggatggaacagtaatagcggcagacgtgacaaatnagctacagtaaataagttatagggtcccat

SEQ ID NO: 17526 - DNA, 101 bp, rice(Oryza sativa)
  misc_feature (71): n=a or g
gacgacatcgcggcgaacaccgatatctgagacatatcgccccacgcagtacatgccgctcgtcacaaccnccagcccaccagcgctggtcgtcaggaacc

SEQ ID NO: 17527 - DNA, 101 bp, rice(Oryza sativa)
  misc_feature (71): n=a or g
acggatggagtatatagagtagctagcttttggcatgtgctattattggtgatgtggcatgtactttctcnttcttctatgatcgaatttgacatattcta

SEQ ID NO: 17528 - DNA, 101 bp, rice(Oryza sativa)
  misc_feature (71): n=a or g
gaacttgtatttgtacttgtgttactagtgccaaaattttgttttactcgactatgtagcaacacagggcnttgtgttacaggagataaacaaaggtgttc

SEQ ID NO: 17529 - DNA, 101 bp, rice(Oryza sativa)
  misc_feature (71): n=t or c
ccgtagactgcggtcttcaggttggtaactctagatgcgtgcatggcgttgaatctctgacgtgtctggcnggggccgaatgccaaggagacggaccgtga

SEQ ID NO: 17530 - DNA, 101 bp, rice(Oryza sativa)
  misc_feature (71): n=a or g
tgacgagcagtgtgccaaagcgcatgtggaggagtggaggagataccgtgtgagggccactagcatttccnatgatctcactgtttttcttatacttatac

SEQ ID NO: 17531 - DNA, 101 bp, rice(Oryza sativa)
  misc_feature (71): n=a or g
gattgggatggacttaggcttcgtcgaagcggctgaatcagtgagctaatttgtttgacgtaaaacgaatntagcatatgattaattaagtattactaata

SEQ ID NO: 17532 - DNA, 101 bp, rice(Oryza sativa)
  misc_feature (71): n=t or c
ggcaacctcttccactacgcctcctcccacaccacgtacgtcactatcactactcctgctgcattttccanacaatacgtacaaaataacaaaagcagtag

SEQ ID NO: 17533 - DNA, 101 bp, rice(Oryza sativa)
  misc_feature (71): n=t or c
ggaacactaatccctatgttgaacatcatcagcctcgcatccaagcgacataaagactgctcaaataattntattttccaattccaacaagaagcgttagt

SEQ ID NO: 17534 - DNA, 101 bp, rice(Oryza sativa)
  misc_feature (71): n=a or g
tgccccagtacactattcttcttcctacttctcttcctttttctttattctcctcttttcttctcccacanggctctgctccgccatgggcgcgttgttga

SEQ ID NO: 17535 - DNA, 101 bp, rice(Oryza sativa)
  misc_feature (71): n=a or g
agatccctcaatttgtaattgaatctaaatttcttacgtgaaccgcaataccaggtataacacgtccctcnacagccaaaaccagtgtaaataagatcctg

SEQ ID NO: 17536 - DNA, 101 bp, rice(Oryza sativa)
  misc_feature (71): n=t or c
caagcatatgctcgatcgccgatcggtcttttatcttttctgccgatcggtcttttgtcttttctctaacnctatcagacctggtaccatatagtatatat

SEQ ID NO: 17537 - DNA, 101 bp, rice(Oryza sativa)
  misc_feature (71): n=a or g
actatcacctcgtcgagcatggcgcggagcatatttccacgatgttgtattccctccatccaataatatantatagtaacctagaatagttatgttcagat

SEQ ID NO: 17538 - DNA, 101 bp, rice(Oryza sativa)
  misc_feature (71): n=t or c
atgtaccaactggaggagatgttgtcagatgacttactgatgtttgcgcttgggttgaagaagccgagcgngaacttgccattcctcgagacgagcttgtc

SEQ ID NO: 17539 - DNA, 101 bp, rice(Oryza sativa)
  misc_feature (71): n=a or g
ccttttcccttgtaccttctcttttggtgcgttagatcattagagatcaaccctactatgaggctgttggnaagaaagtattctccttggacttcctttaa

SEQ ID NO: 17540 - DNA, 101 bp, rice(Oryza sativa)
  misc_feature (71): n=t or c
tcttggcatcactagtattttcttgttttgccatccactctgttcatgattcgtcccaatataaaggctgngtttgggaggagtggttggcaacccctccg

SEQ ID NO: 17541 - DNA, 101 bp, rice(Oryza sativa)
  misc_feature (71): n=a or g
aaggtcgtccgaagagattgaaccgctactaataaccacttgatccttggcgcttttgctttagttcggcngatggacggcaacacgagtagtacacgacg

SEQ ID NO: 17542 - DNA, 101 bp, rice(Oryza sativa)
  misc_feature (71): n=a or g
cacatgccttgtacgtttaccgttctgcgaacttgaaaagttcgaatcaaggagatggtgcatttactacnctgacgtcgaccaggatcatccgtggattg

SEQ ID NO: 17543 - DNA, 101 bp, rice(Oryza sativa)
  misc_feature (71): n=a or g
agaaaatttgtcgacaaatgtataggtgattccgagaaaactctaatctgcaaggagaaagctgatagacntaaaataaaacctgggttaatcaaaaacta

SEQ ID NO: 17544 - DNA, 101 bp, rice(Oryza sativa)
  misc_feature (71): n=t or g
gatctgttcttcctcgacctaactttaccatggtctcctttacctccatttccatggtcaatcctatgttnttcttcacgcatgtacttgtgggactctct

SEQ ID NO: 17545 - DNA, 101 bp, rice(Oryza sativa)
  misc_feature (71): n=a or g
gcccatctagaagttcggccgaaccactattctggctctcgggctcaactttggcaaggagattcccaccnaccttaggagtccattcaggcccgcgcggc

SEQ ID NO: 17546 - DNA, 101 bp, rice(Oryza sativa)
  misc_feature (71): n=a or c
gaagaagatcattgaagacttttggcatgtcattgcgaatatccctagcttttgaaccgagtgcgcagcgnttgtactcacttgtgcaatgacagatgttt

SEQ ID NO: 17547 - DNA, 101 bp, rice(Oryza sativa)
  misc_feature (71): n=a or g
aagaaagctcctccagctgccgcgtccaggtggtcacgggatatgagagtgagcccattataaaagttctncaggatcagccagttgtccatcccatgatg

SEQ ID NO: 17548 - DNA, 101 bp, rice(Oryza sativa)
  misc_feature (71): n=a or c
cccaactggctgttgttccctcctcctgtccattggagccccttcccttcttagactggcctactccagtngtggggtgccccatgttaaggagagagaca

SEQ ID NO: 17549 - DNA, 101 bp, rice(Oryza sativa)
  misc_feature (71): n=t or c
atataaaccatacatgcatacatggctacatcctagatcaccatcaccgtaaatagtacttacttcgtctnataaaaaccgaatctagaaccggatataac

SEQ ID NO: 17550 - DNA, 101 bp, rice(Oryza sativa)
  misc_feature (71): n=t or g
tctcgttgtttttgagtctggttgtcttcgttaggtagcctagtgtgctttttttctcaaacgcgcaaaangattgcacgtcaatatattagaggaataga

SEQ ID NO: 17551 - DNA, 101 bp, rice(Oryza sativa)
  misc_feature (71): n=a or c
actgcagttcatggagaaacttcgtgggatatgagatggatggggtaacttacctcaagtccatagcatgncacagatcattatcccctttcgtgtaaggc

SEQ ID NO: 17552 - DNA, 101 bp, rice(Oryza sativa)
  misc_feature (71): n=t or c
gccatgccacagccctggtgcacctccattcttgagcctgaaaaccagccacacctcgagttcgcctggangagcccgggaactcgtcagccggttccgtc

SEQ ID NO: 17553 - DNA, 101 bp, rice(Oryza sativa)
  misc_feature (71): n=a or g
gtgacacttgagccatagaagatagagtagaagagataagtttaggtcataaggtgggagtggcaatgagnggagcagcatggtacgacaaacctcactag

SEQ ID NO: 17554 - DNA, 101 bp, rice(Oryza sativa)
  misc_feature (71): n=a or g
ccatgcatgattcaacaatgtttgggttgtgataccagagtctttgtcttcaatatatgagataatactgnaagggaagtggagctgcaagatacaatcag

SEQ ID NO: 17555 - DNA, 101 bp, rice(Oryza sativa)
  misc_feature (71): n=t or c
tagtgacagactgactgagcactgcggtttgttgtggcggttgggttggtctgctgttatgtactccctcngtccaaaaaaaccaacctcgtactaacatg

SEQ ID NO: 17556 - DNA, 101 bp, rice(Oryza sativa)
  misc_feature (71): n=t or g
agtcttttcgtcgggaggttgcttcgtctgagagtgatctcctacatgcgcaattgcatcagatagacaanatagggtgcgccgagccgtgaaagacttgc

SEQ ID NO: 17557 - DNA, 101 bp, rice(Oryza sativa)
  misc_feature (71): n=a or g
ataataaaccctagggatggatcggcacatgtacttagattcattcgatcaattcttttttaaggacgganggagtaagtcgaaataaaatttaaaacttt

SEQ ID NO: 17558 - DNA, 101 bp, rice(Oryza sativa)
  misc_feature (71): n=a or c
ttccatataatgtttaacccaccatgataatgcgttgctcgtgtcatgaatggctctatgttgacagtganaccaaaaaatgactaaagcatattccctct

SEQ ID NO: 17559 - DNA, 101 bp, rice(Oryza sativa)
  misc_feature (71): n=t or g
agccgaggtcgttgtgccgtttgtccgcgacgctttcacttcatcatgctggagttgttcgtgatgtcacntgaacatcacgtcggagcaccactgcttgg

SEQ ID NO: 17560 - DNA, 101 bp, rice(Oryza sativa)
  misc_feature (71): n=a or g
cgctgctaagaataggcaaattttaacgacaatggtcaagaacagcatatcactttcttcccaaaattacngcatcaatgcagtaatagtagagaaaagag

SEQ ID NO: 17561 - DNA, 101 bp, rice(Oryza sativa)
  misc_feature (71): n=t or c
agggatccatccaccactatctcctccgtttcctcgatcgatatgctatattctacttggatccatccgcngctgtcctccaggacatggatctagtcgcc

SEQ ID NO: 17562 - DNA, 101 bp, rice(Oryza sativa)
  misc_feature (71): n=a or g
cagctctttagatgtcggcgtaagtggctggttccttttgtagtttctccaacgagacagtttttacaatnattacatatggcactttgaaccttcccatc

SEQ ID NO: 17563 - DNA, 101 bp, rice(Oryza sativa)
  misc_feature (71): n=t or g
acttcatagatctttccaataattggttctctggtgagatacaggttgcttatacagtgttttctggtcanagctgccaatgaactctgaggatgacccat

SEQ ID NO: 17564 - DNA, 101 bp, rice(Oryza sativa)
  misc_feature (71): n=t or c
ctcctaggtacacttcctctccctcgttttttttatgcattgtggatgcattgtggatgcagtgtatggangaattagatgtatggatgctgtggatgttt

SEQ ID NO: 17565 - DNA, 101 bp, rice(Oryza sativa)
  misc_feature (71): n=t or c
gtcccgccattctctgcctcgagcttctcctctgtggacttctcttccatgcgcttctccaccaagctccnagacgtccccacaccaccgacccgggaaag

SEQ ID NO: 17566 - DNA, 101 bp, rice(Oryza sativa)
  misc_feature (71): n=a or g
cttcaccaccgccacgaacttgtcatcctccttcaccaccgcgaagaacttgtcctcctccttcaccaccncgacgaacttgtcctcctccgtcgaggagg

SEQ ID NO: 17567 - DNA, 101 bp, rice(Oryza sativa)
  misc_feature (71): n=t or c
ttgtgcctacacggaagcatgcaaggttgactgcattggacttgtgtgcatactcgagtgctgagggtggnggaacacctttccttcttggttcagaagat

SEQ ID NO: 17568 - DNA, 101 bp, rice(Oryza sativa)
  misc_feature (71): n=t or c
gtttatagcgagtggactcattgccaagctaggaagtcggtatgtcacaattatggcatgaactaataacntagcctctcggttggtaaaatttgccagcc

SEQ ID NO: 17569 - DNA, 101 bp, rice(Oryza sativa)
  misc_feature (71): n=t or c
tcggcgaaggggaggtaccattgaggagattttggtactgggcagtaccgagaattctcatccgttagatngagctcaatggatggctctgattacaggta

SEQ ID NO: 17570 - DNA, 101 bp, rice(Oryza sativa)
  misc_feature (71): n=a or g
tggtacacacacaaaaacagaacttacttgccctgcattagacaggctgaagaaacacgctgcagaaattntgggagaaaatcttggtaactgttggatgc

SEQ ID NO: 17571 - DNA, 101 bp, rice(Oryza sativa)
  misc_feature (71): n=t or c
agctgttttcattaagagtccttcctgtttttaataattacgaataggtcctgcaacagtactatgtgtcntgtgcttttgaggaaaagactctacagttt

SEQ ID NO: 17572 - DNA, 101 bp, rice(Oryza sativa)
  misc_feature (71): n=t or g
ctcggcgaaggacgacgagggggaggaggtggtagagtagatgagatcgagaagaaggggatcggatcgangctcacccagcctcttcttggccgtggaga

SEQ ID NO: 17573 - DNA, 101 bp, rice(Oryza sativa)
  misc_feature (71): n=a or g
gtgtcgacgcgacaggcgacgggatggcgatttgatggatggacggcgacgggacttctccatgtttcccngagggaaaccggggcgagggcggcttggcg

SEQ ID NO: 17574 - DNA, 101 bp, rice(Oryza sativa)
  misc_feature (71): n=a or g
aaaataagaatacattgtttgattatctgctccctgttgtgatattgtctgactgctctacgctgaatttntccataaggccataagagatgtgcaatgca

SEQ ID NO: 17575 - DNA, 101 bp, rice(Oryza sativa)
  misc_feature (71): n=a or g
gacttgttatggggtaaagctccaagagtaagtttaaatgtcaatgggaatcactacgataaaggctactnccctgctgatggaatatattctgaatgggc

SEQ ID NO: 17576 - DNA, 101 bp, rice(Oryza sativa)
  misc_feature (71): n=t or c
ggaagggaatgccagtggcggcactcggttgggtggaggggtgacacggtggcgatgacatggatctcttncaccgccgtcgtcgccatagacgctgcccg

SEQ ID NO: 17577 - DNA, 101 bp, rice(Oryza sativa)
  misc_feature (71): n=a or g
gaactccctacttgatcccattgcttctttggggaattgaacgtctcgtgtgattcttttaccaacgaatnaaggttagagatcaaaggattttttaggaa

SEQ ID NO: 17578 - DNA, 101 bp, rice(Oryza sativa)
  misc_feature (71): n=t or c
atccatgcataagaaaaatggatgtcgttttcgtggaatttagcttgccagtgagctgtcttccatgctantccctccgtctcaaaatataagaacctagt

SEQ ID NO: 17579 - DNA, 101 bp, rice(Oryza sativa)
  misc_feature (71): n=a or g
gtgatctccaccttcaaatccggtatgcacctcctctctatagttacttagttactctctggcggtatgcngtcaagatggtggcgcgagttcgattgaga

SEQ ID NO: 17580 - DNA, 101 bp, rice(Oryza sativa)
  misc_feature (71): n=t or c
gattgcatgtgtggagaagaaaagggatggggaccatgtttttgtggagtcctcgcatcctctgttggtanctgatgaggacatcctccactattacccgc

SEQ ID NO: 17581 - DNA, 101 bp, rice(Oryza sativa)
  misc_feature (71): n=t or c
gactgaaattatgtgaaaatgtggcatcatagttttaacaaacccgattaaaaagtttagggatgaaaganagtgtgttttcccaatatttcccaattccc

SEQ ID NO: 17582 - DNA, 101 bp, rice(Oryza sativa)
  misc_feature (71): n=t or c
gacaccacaaaaaggtttaatttggtggtcacatgatgcatatattcggcgaccttccttcttagtattcnctctatttctaaatatttaaatatttaaca

SEQ ID NO: 17583 - DNA, 101 bp, rice(Oryza sativa)
  misc_feature (71): n=a or g
tgattcagaatggatcacttcgtcagttcatcgtgcttccagtttccataaaatgcctcaagattcactgnttcagccaagatttcattttttttcttttt

SEQ ID NO: 17584 - DNA, 101 bp, rice(Oryza sativa)
  misc_feature (71): n=a or g
gatatgctactttgctactggtgtcgctgtgcagcattccctcgtcaatgtgtactgatcgatggcatcangcaggcgcatcgtgcgatcatcgtctcgat

SEQ ID NO: 17585 - DNA, 101 bp, rice(Oryza sativa)
  misc_feature (71): n=a or g
ttggtcctcgtcgttttatgcagtgccttcaccaaaaggtggagacagatctggttcatcacccaagtccncggccactccagccccgatcacaatagtcg

SEQ ID NO: 17586 - DNA, 101 bp, rice(Oryza sativa)
  misc_feature (71): n=t or c
tggagtaagtgtttggttggttcttacaactgtggcaagccacactttactaactcactgacccatatgtnataggtttattttttagccacatcttgcca

SEQ ID NO: 17587 - DNA, 101 bp, rice(Oryza sativa)
  misc_feature (71): n=t or c
cgcagatcgctcgcatttgatgcaaggcaacgatgttcgtctacatgatgatgttcaacgagggggtttgnagcaattaggtggtggagatggaggaggag

SEQ ID NO: 17588 - DNA, 101 bp, rice(Oryza sativa)
  misc_feature (71): n=t or c
tgaaagtgaagcagccacaagaatgagggtatattctggacccttctgaccgtgctggcctaactgacctnggctcagacccggtcatgtctagaccgggc

SEQ ID NO: 17589 - DNA, 101 bp, rice(Oryza sativa)
  misc_feature (71): n=a or g
atggcctatgttgagcagtatatacttacttttcgacaggtgaggtcgtcattaatatttgagatggtaantatcacagaatctgttgtaaatacttgttg

SEQ ID NO: 17590 - DNA, 101 bp, rice(Oryza sativa)
  misc_feature (71): n=t or g
accatgtactaaaaaaaaatggagtatattctttgctagctaatgctggaccgtagaagatcatgtatggnccatctacttgatattgcatcaagaataaa

SEQ ID NO: 17591 - DNA, 101 bp, rice(Oryza sativa)
  misc_feature (71): n=a or g
tcttgctgcagcttcggtcgaccttcctaaggagctaaagcaactattcatgcctgcctctttttgttccngtacatattcatcccggccaacttatgtta

SEQ ID NO: 17592 - DNA, 101 bp, rice(Oryza sativa)
  misc_feature (71): n=t or g
aaaattaagtttgaaaatttaaattttgacttattctttgctatttagacgatcggatgggagcctcaatnaatccgatccacctttgaatgaattgggat

SEQ ID NO: 17593 - DNA, 101 bp, rice(Oryza sativa)
  misc_feature (71): n=t or c
agatggactactagcaaaacatcagtatgtggtcggaataggctcacatgccatgaaaacagtctacatanggtatccagacaatgttccatttcattttg

SEQ ID NO: 17594 - DNA, 101 bp, rice(Oryza sativa)
  misc_feature (71): n=a or g
acctccgtgttagtgacatgcagaatggtgttgcgacgttccgtgaagcggcgaatgtaattggagaagcnttcgtcgttgccttgaacgatctggtatag

SEQ ID NO: 17595 - DNA, 101 bp, rice(Oryza sativa)
  misc_feature (71): n=t or c
gagaggtcaagcggccgttaagagatggacgcgagaagcgaggcggaggagagagataaacaccgtaatcnctcaactaggcacccctatctcgtcactga

SEQ ID NO: 17596 - DNA, 101 bp, rice(Oryza sativa)
  misc_feature (71): n=t or c
atgaaaatgagaagcatcaggggacatgaattacttgtgcaaattaatgttgacaaatttttagaatgcanggaggggaaatgcaccaaaaagaatggtat

SEQ ID NO: 17597 - DNA, 101 bp, rice(Oryza sativa)
  misc_feature (71): n=a or g
gctgtatcatttcgtctatctgatcatcatcatgggcaattctaactgggagaagaacaggattgctattntaccagtttatgtttacatggccactgaat

SEQ ID NO: 17598 - DNA, 101 bp, rice(Oryza sativa)
  misc_feature (71): n=a or g
gatgggttgcatgtgtttaggtgcaagaaaatcgaatcaaattgtttcaggtttttattatgatcccaccnaaacttatagcttgtggtcacttatgtcaa

SEQ ID NO: 17599 - DNA, 101 bp, rice(Oryza sativa)
  misc_feature (71): n=a or g
atgctggatgcaggatatgtaccaaacattgcgacttacaataggctgcttgatggcttacacatgggganatctatgcaattacaacaaaaatgttcaag

SEQ ID NO: 17600 - DNA, 101 bp, rice(Oryza sativa)
  misc_feature (71): n=a or g
tcatctattccttccgcccagtaatataaaaaattgttatgccatttttagcaaatattaaggaagtgctntaggaacaaagcatggagaaacatccaggg

SEQ ID NO: 17601 - DNA, 101 bp, rice(Oryza sativa)
  misc_feature (71): n=a or c
tctaagcaaagtgcaggtgttaagtttcagtgcataggcaatccctgattttcatcttaaggatggagttntgtattataagaatcatatgtggattggca

SEQ ID NO: 17602 - DNA, 101 bp, rice(Oryza sativa)
  misc_feature (71): n=t or c
tgtcccctgggctctataaatattgtccctctttgcctccatcaacatcactgcagtgcctttgagctttngttctctagagtgtctagggtgaatcttga

SEQ ID NO: 17603 - DNA, 101 bp, rice(Oryza sativa)
  misc_feature (71): n=a or g
tattggcccaattaagtcactaccctttgatgggcctaaaggattgcaaccagtgtagggaattggaaaangtacatccaaggtccctcaacttgtcatcg

SEQ ID NO: 17604 - DNA, 101 bp, rice(Oryza sativa)
  misc_feature (71): n=t or c
tgcattcccatcaagctctggttccccaagtgacaaagatgaacctcaggcattagagcatttggacaagnccaccatttgttcaactcagcaaaataatg

SEQ ID NO: 17605 - DNA, 101 bp, rice(Oryza sativa)
  misc_feature (71): n=t or g
caaaaatcctcatcttgtaagggacaaatttattttttgggattcagtcaaagacgtacgttttcaacttntgtacactactagaggggaagagagggagg

SEQ ID NO: 17606 - DNA, 101 bp, rice(Oryza sativa)
  misc_feature (71): n=a or g
aaccatatatacactgaaaaattcttgtgccttgtgacagattcagagcttgtagagatgacaagaagatnttgtcatgtaggcatcggtggacaggtcgt

SEQ ID NO: 17607 - DNA, 101 bp, rice(Oryza sativa)
  misc_feature (71): n=a or g
ttcaagtggaatcattattgcaggcgatcataattaacaaacaaaattatctcgtactccctccgtttcanattataaaacgttttaattttggtaaaagt

SEQ ID NO: 17608 - DNA, 101 bp, rice(Oryza sativa)
  misc_feature (71): n=t or g
tgagtctggtcggtgagcaatttctgaactatctagatcaccttgcctatctgaagcaccttcttccaagntttcaacctttgttgtcacttcttcggcct

SEQ ID NO: 17609 - DNA, 101 bp, rice(Oryza sativa)
  misc_feature (71): n=t or c
caacacatttttctttatcgccccctcagagcaagtttatagtttaacacatcattggactcgtcaatctncagatgttccagcaccgagcagctccagaa

SEQ ID NO: 17610 - DNA, 101 bp, rice(Oryza sativa)
  misc_feature (71): n=a or g
gggatccatctaaaaacgcaatgaaacaacaattctctttgttacttaacaagcccagcccacaaaaaaangaaaaaatatcgagtttgctgccaagaaag

SEQ ID NO: 17611 - DNA, 101 bp, rice(Oryza sativa)
  misc_feature (71): n=t or c
cttttgggacgatatcagaaccactatgaccaaaaggagaaatgacagcgccatacatagtacagtagttngctaaatctgttgtgtttcggttctggttg

SEQ ID NO: 17612 - DNA, 101 bp, rice(Oryza sativa)
  misc_feature (71): n=t or g
catggcgggcgggcggtcgatcgatcgagagtagctaggtagggcgatcgatggatggatgagtttgggcnggtgaaagggttgggggaggaagaagggtg

SEQ ID NO: 17613 - DNA, 101 bp, rice(Oryza sativa)
  misc_feature (71): n=t or c
ttcaaaggatggatgcatatcatctatgcacatttccttgagcaatttagttatgtcattggaggcaccancgactctatttaagctctgaatctgatcag

SEQ ID NO: 17614 - DNA, 101 bp, rice(Oryza sativa)
  misc_feature (71): n=a or g
acagctttgatactataccccgtcaaagatgatatacctatgacaggccgaatataatgcacccgtcacancctcaaagataagtcacctgtggggttgca

SEQ ID NO: 17615 - DNA, 101 bp, rice(Oryza sativa)
  misc_feature (71): n=t or g
aaacaatattattctaatttcctatggggtcaagaatatcggggatagaatttctgccgaacttgaaaatnggaacaatggatttaccagtttgaagggtt

SEQ ID NO: 17616 - DNA, 101 bp, rice(Oryza sativa)
  misc_feature (71): n=a or g
ggcattgcctgtggtgtttttatcctattttgtgtatgggtcttctgtttgtagggagtgtgtttggcctntcggcccctaaacctgtcttagttaacttt

SEQ ID NO: 17617 - DNA, 101 bp, rice(Oryza sativa)
  misc_feature (71): n=t or c
aatcacactctattattattatgatagctccccgactagtaacttcaagaaacagcttgatgttggcagtnatagaggaaaaagtatacacaaataatgcc

SEQ ID NO: 17618 - DNA, 101 bp, rice(Oryza sativa)
  misc_feature (71): n=a or g
aaaatttaaataagacaagtggtcaaacgtaaaaacttaaaatctatattgtgggacggacggagggagtnctagcggagcagcatgatgagagattgttg

SEQ ID NO: 17619 - DNA, 101 bp, rice(Oryza sativa)
  misc_feature (71): n=t or c
tctccttcacttctccctgatccagcctttaatgctagacctgcaacatccaccaccttcccttttactcnctctctctctctctctctctccgtcttggg

SEQ ID NO: 17620 - DNA, 101 bp, rice(Oryza sativa)
  misc_feature (71): n=t or c
aataatttcggccatgctctgttagtttatgaatccatacagctaggtctcctgccattgccaatcttgcngggctgaagctttgaaatttacatgtggta

SEQ ID NO: 17621 - DNA, 101 bp, rice(Oryza sativa)
  misc_feature (71): n=t or c
gttgtcctggaggatatcaatcaaataatccccctccatccttcagtaattggcctccaaacacagagccngaatgagcatggcaagggagcactttgtgc

SEQ ID NO: 17622 - DNA, 101 bp, rice(Oryza sativa)
  misc_feature (71): n=t or c
accacctctgcgacgcggcatagtagtaggagtattagtttggaccagaccacccacaggtttgcacttcngtagcaccatttataagaccaaaatgacca

SEQ ID NO: 17623 - DNA, 101 bp, rice(Oryza sativa)
  misc_feature (71): n=t or c
ccattgagctccatctcggccacagccacaatcatcgccattgcttcatcatgtgtgcccaggacgatgtngacctcgctctcggtcacagcaacagcagc

SEQ ID NO: 17624 - DNA, 101 bp, rice(Oryza sativa)
  misc_feature (71): n=t or g
caattcttgagtactttgtgttttcatcgtgttattcttgtaacagttttagtttatcattttccagaacnaaagaggtggattcattcactggaaggctt

SEQ ID NO: 17625 - DNA, 101 bp, rice(Oryza sativa)
  misc_feature (71): n=t or c
gacactgaaaattcacagccatgagacatcaatccatctgacttcctcagattatccatgaatgagaaacngcctgttcccgcaagacagcaactgagcaa

SEQ ID NO: 17626 - DNA, 101 bp, rice(Oryza sativa)
  misc_feature (71): n=t or g
cgccagcagctgaagtgaccaggattaagctttgctcagacgagcagctcatatacagttttttcgccaanaaagctgatcccaaggacatttttcaggaa

SEQ ID NO: 17627 - DNA, 101 bp, rice(Oryza sativa)
  misc_feature (71): n=t or g
agttgtggaccgactggaaagctgtgggtttgatccaatttcttctttataatacagctacagagagttcngtgccaagatttttacaggagttcatcata

SEQ ID NO: 17628 - DNA, 101 bp, rice(Oryza sativa)
  misc_feature (71): n=t or c
attcagtttgaggtgaagatggctgatgcatcaaacttttagaggtaattactggagcatgagcacccacntcggaaactatctttgattattcccttttt

SEQ ID NO: 17629 - DNA, 101 bp, rice(Oryza sativa)
  misc_feature (71): n=t or c
tgtagctttatgcaagttgggtttcggatcttggaaggttaggagatacagtaacccgggaagcaacaatngcctggatttcttggaagcaagctccatga

SEQ ID NO: 17630 - DNA, 101 bp, rice(Oryza sativa)
  misc_feature (71): n=a or c
tagtgaacatctgtattgaagagagcctgatcactgtgcagcacggggcttaattacgatgggggttgcancgaaaatgcttgggcatgttgggatcattg

SEQ ID NO: 17631 - DNA, 101 bp, rice(Oryza sativa)
  misc_feature (71): n=a or g
agaacatactgaatgaacaagtctttactccgtcttacgcattgccctcttctccatcatgatatgcaganagttccaccattcatatcctggctccgcta

SEQ ID NO: 17632 - DNA, 101 bp, rice(Oryza sativa)
  misc_feature (71): n=t or c
ggagtggtaatgtgatcagctgcatcagaaagctcttcccacacaaagctacccttcccaaatgcataganacttcctgtgtcactcacaagcattgtctg

SEQ ID NO: 17633 - DNA, 101 bp, rice(Oryza sativa)
  misc_feature (71): n=t or c
taggcgctctagtttttgcagtctacaaacacttgacggaatgtttatttcgttgacatgtcctcctccangaataattagtgtttctagttgctgcagcc

SEQ ID NO: 17634 - DNA, 101 bp, rice(Oryza sativa)
  misc_feature (71): n=a or c
cacggataattaaactataactaactgaagaagcaaacagatacaagtacaaacgagcctggaaaacaacntgtgacgagggctttgtgttgggttattgc

SEQ ID NO: 17635 - DNA, 101 bp, rice(Oryza sativa)
  misc_feature (71): n=t or c
gaaaatggtgatcaaagaactgaagaacaattgattttgtcaggcaattatacctcgagcatgcgccactngctccggcaatggacgtccctgacggtgcc

SEQ ID NO: 17636 - DNA, 101 bp, rice(Oryza sativa)
  misc_feature (71): n=a or g
cgcaagaggcatgaaagatcagatgaggacagcgagagtgattctgacaagaagaggcataggaagagcangaaggacaggaagaggcgtaggagccatcg

SEQ ID NO: 17637 - DNA, 101 bp, rice(Oryza sativa)
  misc_feature (71): n=t or c
caaaggcatccacaatgttgtggcatgagtaagtgccgataacaaatccgccacatttgagcctagtcacntgcacatatttatatatatgtagaatggat

SEQ ID NO: 17638 - DNA, 101 bp, rice(Oryza sativa)
  misc_feature (71): n=a or g
ttgcaaagaactatcagcaaaagatatatttgccttggccacatcaacgacaacacctaccattgaaatcnaacctaatgtccctttacgctagtccgaca

SEQ ID NO: 17639 - DNA, 101 bp, rice(Oryza sativa)
  misc_feature (71): n=t or c
ttggttcctaatggagtatccgaaatgtttgagaagtgcctggacttggacggccaacgtctcatcgagcnccctcgccatcacccccggcgtggttctac

SEQ ID NO: 17640 - DNA, 101 bp, rice(Oryza sativa)
  misc_feature (71): n=t or c
aaaggcaaaatttatgtcaattaatcggattgtgtatgcacacctttcagaacctcgatagcagatatggngcttagatgttttccatcaattgcattctc

SEQ ID NO: 17641 - DNA, 101 bp, rice(Oryza sativa)
  misc_feature (71): n=t or c
aacttctcaaatccacgacatgttgaggtcaaatatgctaccgttgcttgcccgaggccgaggacgccacngctcccgctacctggcaaggccaaggccgc

SEQ ID NO: 17642 - DNA, 101 bp, rice(Oryza sativa)
  misc_feature (71): n=t or c
aaagcatggccttttgtgtatgcatatgatgatccattggccagcttgaggattccatttggtaagacggnagctgaaccatcaagcaccaaactgctgtt

SEQ ID NO: 17643 - DNA, 101 bp, rice(Oryza sativa)
  misc_feature (71): n=t or c
gtgtggtgttaatgacaagtagaataaaatgaagcttttcacggctattcatggattacaggtaagcatgnatccattgtagtgtgcacataaaacaaatc

SEQ ID NO: 17644 - DNA, 101 bp, rice(Oryza sativa)
  misc_feature (71): n=a or g
tgcaagttgggctggacttgtaaggcccatcatcgcccatttacattttatgcaaaatatgagagaaaacntgcgtggaaagggatttgaacccatgacct

SEQ ID NO: 17645 - DNA, 101 bp, rice(Oryza sativa)
  misc_feature (71): n=a or g
gataaccctgattttctagtagaggtagataaccctatgaggatcacatgtgccactaccagacaagaatntagataggagtcaccatctctgatagctct

SEQ ID NO: 17646 - DNA, 101 bp, rice(Oryza sativa)
  misc_feature (71): n=t or g
cctagccaatatgctgtattattttcagttttttgttacagattttcggccccatcgtttcacttttgggnggaataagccaaaagatatatttgcaaacg

SEQ ID NO: 17647 - DNA, 101 bp, rice(Oryza sativa)
  misc_feature (71): n=a or g
accccgttgaaacactttggtctaaaaacacaaaaaaacacataggaggagggcacccgcggacgaagatnttagagttccgcctatgagtgtcatctccc

SEQ ID NO: 17648 - DNA, 101 bp, rice(Oryza sativa)
  misc_feature (71): n=a or c
cggataaatcagaagtcttacaatttttttattagccatatagatttgttgacgaaaaatccgcgcttggntggtggtaccagaactgtgttggcgcgaac

SEQ ID NO: 17649 - DNA, 101 bp, rice(Oryza sativa)
  misc_feature (71): n=t or c
gatgccaccacaccaataggtacaacatcagcaacatgaaccccaaaaatggcctctatattttccacagntccatcatctatcattttctttgccccacc

SEQ ID NO: 17650 - DNA, 101 bp, rice(Oryza sativa)
  misc_feature (71): n=a or g
aaaaaaaaaatagccttagagaatcttatcgtttagaagtatttaataatgtgtatgtccaaaaacctctngactaattcgcaagacgaatctaatgatat

SEQ ID NO: 17651 - DNA, 101 bp, rice(Oryza sativa)
  misc_feature (71): n=a or g
gctcgtacgccttcttgaccagaccattcttgtgcttggaaaaggtcacctgtctgttgatcttgttctcnatccgcttcagctccaccctccccgtcaca

SEQ ID NO: 17652 - DNA, 101 bp, rice(Oryza sativa)
  misc_feature (71): n=a or g
gaaatgatcccacttaaatacaaattactagtaattgatcccacgggattaaattcgcagctccgccaccncgcatttgtggggatctaagtgtgatgtta

SEQ ID NO: 17653 - DNA, 101 bp, rice(Oryza sativa)
  misc_feature (71): n=t or c
ggcattcccctgtactgtatatgaggcaacaccatgtaggctgaccttgcttggtttaaatgagccattancaaacgattgaagttgcggtggctgctgag

SEQ ID NO: 17654 - DNA, 101 bp, rice(Oryza sativa)
  misc_feature (71): n=t or c
tcctatagtaggatttgatgtccctgtaacaattgtttgttctgctagagcaaaagctgagatgtcgttcnatttcattgaaacagggcgcaacgatagtt

SEQ ID NO: 17655 - DNA, 101 bp, rice(Oryza sativa)
  misc_feature (71): n=a or g
gtaacatcaaatccaattgtatccatgaaaccaaaagttaagagtcgtgctcgtatctatgaggtatagtntctggaaatctaactacatgtaaaattact

SEQ ID NO: 17656 - DNA, 101 bp, rice(Oryza sativa)
  misc_feature (71): n=t or c
ccgccaggttccgcgccccgaggatgcccagctccaggatcccgatcgggctcttcctcagcttcttcgcngccggctgcaggtcgctgctgtagtgcgtc

SEQ ID NO: 17657 - DNA, 101 bp, rice(Oryza sativa)
  misc_feature (71): n=a or g
tcctaggcacccggttgaaaattttttgtaagctgtaagtatccatctttaccatgtcggcaccccgtcgncctaactttgtgtaccccaagcagccaatc

SEQ ID NO: 17658 - DNA, 101 bp, rice(Oryza sativa)
  misc_feature (71): n=t or g
gtcgaaagggactaaacagctattataattggtactatggaacaagtactgctgcccttgtgttatctatnattgtcatcatctacatccagaacaatgtc

SEQ ID NO: 17659 - DNA, 101 bp, rice(Oryza sativa)
  misc_feature (71): n=t or c
gatgtgggttcgtgatgctgttgtcttccgtgtagcaaacaggctgtgtatgaatccagaagtttagatcnaaacttgagtcctttttcatcacatcaatc

SEQ ID NO: 17660 - DNA, 101 bp, rice(Oryza sativa)
  misc_feature (71): n=a or c
aaacggcttggcagcaatgcaagctgagtgaaagaggaggtatggaaaaacttgttccagggcaatcttgncttcacacattggaccaaatggtgccaagc

SEQ ID NO: 17661 - DNA, 101 bp, rice(Oryza sativa)
  misc_feature (71): n=a or g
attactatattatgggatggagggagctagtactctacattataagacggagagagtactcaacatttctngaaatataagttttaaggctttattataag

SEQ ID NO: 17662 - DNA, 101 bp, rice(Oryza sativa)
  misc_feature (71): n=t or c
attgtaaaacggatgaggtactcgtatagtcatctatccaatcatggctcaggctcatgtgtgatactctntgtgtcccatattatttgtcgctttgactt

SEQ ID NO: 17663 - DNA, 101 bp, rice(Oryza sativa)
  misc_feature (71): n=t or g
acacgcattggagattgaaaaactgttgcaattgcaggcactggaggataaaaaaaagagcaattctatgnttcttgaggaggtatcatgaggtaccaaaa

SEQ ID NO: 17664 - DNA, 101 bp, rice(Oryza sativa)
  misc_feature (71): n=t or c
gcttgtcttggtaacctatcagcattgacaatcctttcattggcagagaaccagttggatggctcagtacnggcaacaattggtaacatgaactcgttgaa

SEQ ID NO: 17665 - DNA, 101 bp, rice(Oryza sativa)
  misc_feature (71): n=a or c
acacattttcatacatccaaacgacctcgaatcaaaaagtgatctactaggttgtaaatctcatcaagctntgtagatttgttataatgttcatttatctg

SEQ ID NO: 17666 - DNA, 101 bp, rice(Oryza sativa)
  misc_feature (71): n=a or g
cctgccctacgaatccatattaattttaggcagggcaaggcaagcatagcacctcttcttgttagagcagntacaatagcagcaggttataagtcagctgt

SEQ ID NO: 17667 - DNA, 101 bp, rice(Oryza sativa)
  misc_feature (71): n=a or g
gtttatccatatatatgtgtaggggaatgctaattggtatcccgttcgagtgggagatatcttaatatcangtgatatctcttagatatcatatatcccat

SEQ ID NO: 17668 - DNA, 101 bp, rice(Oryza sativa)
  misc_feature (71): n=t or c
ctcaggagtaggactactgtacttacttgtattagtattttttttaccaggcaatgaggcattcagtctcnagatgtaattactctttccgtcccaaaata

SEQ ID NO: 17669 - DNA, 101 bp, rice(Oryza sativa)
  misc_feature (71): n=t or c
cacaaatctctcctcagcacccatgactcatttcacttgtcagcagtgaaggtcctaactatgagagactnctgaggaaggcagtttggagtaggatgtag

SEQ ID NO: 17670 - DNA, 101 bp, rice(Oryza sativa)
  misc_feature (71): n=t or c
ctagtacgttatctcatattttatacgatgtctcgtaaagagtatactcccctccgtccgataaagagtgnatttttttttatttttatagaacatttgac

SEQ ID NO: 17671 - DNA, 101 bp, rice(Oryza sativa)
  misc_feature (71): n=a or g
ctcaaaccaaaccaacccttaattattccgcttgggtatgtttgttgcaatgacatgaataccaccccgtnatagtaagtttaaatatttgtaggataaaa

SEQ ID NO: 17672 - DNA, 101 bp, rice(Oryza sativa)
  misc_feature (71): n=t or c
tgatagtattttgctgctatagtttgcctttgcatttgttttaaactccctcgtcccggtttgagtgcagncagagttttcgtttccaactttaatagtgt

SEQ ID NO: 17673 - DNA, 101 bp, rice(Oryza sativa)
  misc_feature (71): n=a or g
ccgcttcaggcgatctttcactggcaggtaccacatcaccatgctgggaatctttttcttctcatccaccngtgcatcttggtcgaccacctctccatcgg

SEQ ID NO: 17674 - DNA, 101 bp, rice(Oryza sativa)
  misc_feature (71): n=t or c
gcgcactgagagaactggagatcgagagcgttagtttcttcggtaaaaaccgtactccgaataaatcgaancgattttgttcggtatttttttcctcggtt

SEQ ID NO: 17675 - DNA, 101 bp, rice(Oryza sativa)
  misc_feature (71): n=a or g
gttatggcaggaaccaaacactaggcttatcctatattatacatatatagttcatcgatcaccactaagtntagttaatgctatttctatcttctctcatt

SEQ ID NO: 17676 - DNA, 101 bp, rice(Oryza sativa)
  misc_feature (71): n=a or g
cgtcgtagggaaggccaccgtagccaccgcccgccacccaccgtgggtgaagtcgagcttgtggaagccancggcccatggcgagatggaggccaagggag

SEQ ID NO: 17677 - DNA, 101 bp, rice(Oryza sativa)
  misc_feature (71): n=a or g
tctttgcgatgaccctaaaaagaacaccaaagtctgggaagaagcagtttatacagatggctgatggttcntatttgaccgtatttgaccttccattgcat

SEQ ID NO: 17678 - DNA, 101 bp, rice(Oryza sativa)
  misc_feature (71): n=t or c
gtaggataggatggtatggaatggattcatggaattgatggagacctctagctccattattggttggaagnagtggaggtggagcttagttaccatgttag

SEQ ID NO: 17679 - DNA, 101 bp, rice(Oryza sativa)
  misc_feature (71): n=t or c
ttcacaaaaattgcatcagacaaatgaaacctcgtcaacaagcagtggaatgaaaaccgtaatcattttgnagtatgcgtctgcagtagtatcggtaatac

SEQ ID NO: 17680 - DNA, 101 bp, rice(Oryza sativa)
  misc_feature (71): n=a or g
tagacgcgagagtatagtgagcaatgatcatttgtagcactgtaagtagccgataagctcataaaggtacntctcctgctggactctatccccgaggatgc

SEQ ID NO: 17681 - DNA, 101 bp, rice(Oryza sativa)
  misc_feature (71): n=t or c
ggatgtagaaaaggctagagaacatcctagttagccccatcaagcctaccacaaactgacaagcgcttgcnctcatgggttttatcatcccccacgccacc

SEQ ID NO: 17682 - DNA, 101 bp, rice(Oryza sativa)
  misc_feature (71): n=a or g
ttaccgtcattacgtctcctatacaacgggtatgaatccttgccttgcgaagttgtggcgttgaactctcncaggtagttgttcctgcactttccatctcg

SEQ ID NO: 17683 - DNA, 101 bp, rice(Oryza sativa)
  misc_feature (71): n=t or c
gtgataggcagacttgagaccttggatttcagcaatctccgtagcaccttccagataaaatttggtgtggnagttgcaatcagctgcgctctacaaatgca

SEQ ID NO: 17684 - DNA, 101 bp, rice(Oryza sativa)
  misc_feature (71): n=a or g
cagctcaagatatataaaattgcatcctagtttgctggacatggcagtggccatgagcctatcctaagatnagatatcaaccaaatctcctgagtaatttg

SEQ ID NO: 17685 - DNA, 101 bp, rice(Oryza sativa)
  misc_feature (71): n=a or g
tacttcgcttgtacagttctaattccatgcagctagcctgatttctacattggtacaacacgagccacccntcagatgtagaggaccacgctagacagttg

SEQ ID NO: 17686 - DNA, 101 bp, rice(Oryza sativa)
  misc_feature (71): n=a or c
taatcaatctcatcctagataattacctgcctagtttgtgatagtgttatcccatccttaattgctactanaattctgggatagatgaagtatgtcttaat

SEQ ID NO: 17687 - DNA, 101 bp, rice(Oryza sativa)
  misc_feature (71): n=t or c
cgtcgtctcgccgccgtgtttcttgtactcccggcgcgcgttgatcagtggcatgaagagctccctctgcnggcggcggagggcgtagatcttctcgaggc

SEQ ID NO: 17688 - DNA, 101 bp, rice(Oryza sativa)
  misc_feature (71): n=a or c
gaattttggcggtagtaaccatgatgtttcagggaatggttcacagaaaagatctgcagtgcctttatcantgtcgacaagtaaaactcttctagtgagga

SEQ ID NO: 17689 - DNA, 101 bp, rice(Oryza sativa)
  misc_feature (71): n=a or g
caactacattcttgtttggtcaagtccacagtgtgtctccatgttgtcaagtcccttttttgcaccactgncttcacctacaaatggcagactcttgtggt

SEQ ID NO: 17690 - DNA, 101 bp, rice(Oryza sativa)
  misc_feature (71): n=t or c
gtacatatttagagagacatgtgttaacatagtcatgttaccattccagtgcaaacggacgcatatagcangagatggtataaagaagataatcacacaat

SEQ ID NO: 17691 - DNA, 101 bp, rice(Oryza sativa)
  misc_feature (71): n=t or c
gtaagagcctcggggagaaacagtgttagtagccaatgctgggtttctatcggttcgtcgatgctcatatngctcagcagtagatgttgagcagttaccat

SEQ ID NO: 17692 - DNA, 101 bp, rice(Oryza sativa)
  misc_feature (71): n=a or g
ttgaaaaatcacctagttagcgtgaagatcatgggtcgttcatggccacactttttggttgtcacaatttnttagatatgtgtttggtaattcacttccat

SEQ ID NO: 17693 - DNA, 101 bp, rice(Oryza sativa)
  misc_feature (71): n=a or g
taatggtagtattaactttgacaaatgatgtggtgtagattgcacttcaattggctgcactgatagccagnattgtatactttgattatccaaaggaatgg

SEQ ID NO: 17694 - DNA, 101 bp, rice(Oryza sativa)
  misc_feature (71): n=a or g
cttggactagggacccacaaatggtagcccagtgacctaaaccacacaggactactactgagcaagtctgngagtgcccggcctcatctctgggcacactc

SEQ ID NO: 17695 - DNA, 101 bp, rice(Oryza sativa)
  misc_feature (71): n=t or c
gcggcgccttgatcgtgtcctgacatgacatcacacacaacaacgctctgttctgttaggacacaagaaanagaagaagccaagaaacagaggatgcggca

SEQ ID NO: 17696 - DNA, 101 bp, rice(Oryza sativa)
  misc_feature (71): n=a or c
tgaaatctagagttttctaggatgattaatttgttgtgaagctttgatgtttgtaggatgatctgttggcnaatctttgtatgagaatgttggtgaacttg

SEQ ID NO: 17697 - DNA, 101 bp, rice(Oryza sativa)
  misc_feature (71): n=t or g
tcaaatacttgtttgcttcatcacttgagagatctttaggtatattgagtttagccatagcctctaattcntcaatcatgtctatctttctgcagcaaggt

SEQ ID NO: 17698 - DNA, 101 bp, rice(Oryza sativa)
  misc_feature (71): n=t or c
atggatgagattgaaggagactgccatataaatacagctccattacccttttgtagagataagttgcctgnacctcaaatattcaagggacatcgtaacaa

SEQ ID NO: 17699 - DNA, 101 bp, rice(Oryza sativa)
  misc_feature (71): n=t or c
cttgcatagatggtaatgatctccatctttgtgaccattttgatagtcactaacatgagtatacagttttnagtaatccaacatgactatacagttttcaa

SEQ ID NO: 17700 - DNA, 101 bp, rice(Oryza sativa)
  misc_feature (71): n=a or g
aaataaatcaatctagcacatgatgtcacgcatactaatactatgaatcaaaatctggacaacaactctancatcgagagtcactaactttaactactttc

SEQ ID NO: 17701 - DNA, 101 bp, rice(Oryza sativa)
  misc_feature (71): n=a or g
ctacaaagccgaattgcccttctttactccctccgaatcaaattatagaccatcctctttttaagaaaaantaaactcggtaacttttaactaataatcat

SEQ ID NO: 17702 - DNA, 101 bp, rice(Oryza sativa)
  misc_feature (71): n=t or c
ctaagtctcaagcaagcctcagcaagtgatacaaactcatcaatttctcctaggtttccttcctcaactanctgagaatccaacatatcagttgttgtctt

SEQ ID NO: 17703 - DNA, 101 bp, rice(Oryza sativa)
  misc_feature (71): n=t or c
ctcgaaaatgcttgattcgtccccccaactgtaaaatcggatataatacctatatatttaaaaattgatgnaaatcgacttattctatggtttgggaagcg

SEQ ID NO: 17704 - DNA, 101 bp, rice(Oryza sativa)
  misc_feature (71): n=a or g
gaggggcgaagaatcgccgctgctcgtggaagaagagccgccgacgtagaggattagctcacggactactnctccccgacccgtcgcggaccgctgctcac

SEQ ID NO: 17705 - DNA, 101 bp, rice(Oryza sativa)
  misc_feature (71): n=t or c
ggtacatatgccactgtactccctccgtttcataggtttagatgtttttgttgtgtactaagtcaaatttnattaagtttgatcattttttttttggaaaa

SEQ ID NO: 17706 - DNA, 101 bp, rice(Oryza sativa)
  misc_feature (71): n=a or g
tccctactctcttcctattctacggatccctacccttctacgactccgatcagtattacgaaattttactntcgcgtttctacaatcctacaaaatattac

SEQ ID NO: 17707 - DNA, 101 bp, rice(Oryza sativa)
  misc_feature (71): n=t or c
caccttgacgagcggcgtcagctggaacaggttgccgctgttcggcagcacgcagagaacgtcagcatcgncgtagttctctaggcatacgaggcagcatg

SEQ ID NO: 17708 - DNA, 101 bp, rice(Oryza sativa)
  misc_feature (71): n=a or g
ttggatgccctatcggaagagtcggattcaatcatctggagatgggagtcgtcaggagaatactcagctcnctcagcttatcagtccatgtttgtggggag

SEQ ID NO: 17709 - DNA, 101 bp, rice(Oryza sativa)
  misc_feature (71): n=t or c
acatatatttttggagagaggagggagatttaggccatttttttaatctagcttatttcttcatgttattnatatataccaacacataacgttttgaattt

SEQ ID NO: 17710 - DNA, 101 bp, rice(Oryza sativa)
  misc_feature (71): n=t or g
atctgttgtcccatttcctttctccacgtataattgggggttgtagattttgctacagaaggatgtgcttngtgcaatataggaatccttttcagagacaa

SEQ ID NO: 17711 - DNA, 101 bp, rice(Oryza sativa)
  misc_feature (71): n=a or g
ctaagaatgaagatgtgtcaagggccatgtccatcaagaacataacacaggtggaaagaggagaaaaaacncgggagcaaaattgattggggataaatctc

SEQ ID NO: 17712 - DNA, 101 bp, rice(Oryza sativa)
  misc_feature (71): n=a or g
cccttttttgcggggaatttctaagttggattgaaatgacagctggttaacaggggaaactcaggccttcnatgagacgtcctccagttccgggttctcct

SEQ ID NO: 17713 - DNA, 101 bp, rice(Oryza sativa)
  misc_feature (71): n=a or g
taggcttaagtccttgttttcccttttttttctcctcgctccccccattccctccctctcttctttgtttnccgtttgtgtaaattttattcctcttaagg

SEQ ID NO: 17714 - DNA, 101 bp, rice(Oryza sativa)
  misc_feature (71): n=t or c
gggagagagagagagagagagggagagatgagataagattggagctgttgtggagaaatgaatgggttggnggtgtctagtgagcaagtaaagatgagaga

SEQ ID NO: 17715 - DNA, 101 bp, rice(Oryza sativa)
  misc_feature (71): n=t or c
attgtagccaccattgagccgctcatcggcaatggagcttatatctcctgaggcaactttctctttgacangttgaataatgtgaccattgccttgtaaga

SEQ ID NO: 17716 - DNA, 101 bp, rice(Oryza sativa)
  misc_feature (71): n=a or g
tcacagcgtgggaaaaataattgacatcgagagtgatgggctactcataattgatattcctaaccgggctntacattggcaggcagatccatcagacatgg

SEQ ID NO: 17717 - DNA, 101 bp, rice(Oryza sativa)
  misc_feature (71): n=a or g
gggcccacctgtcagaattcagatatatcttctatctcttttcctctcaagtctcacccctctctctcccnttagatacaggcggctacggctcgcgcgcc

SEQ ID NO: 17718 - DNA, 101 bp, rice(Oryza sativa)
  misc_feature (71): n=t or c
ctaaataaaaccttgctccaagtgttggtctttcttccatttcccaaatcccaaccaccaagcaagaaaangtcccagcttaaagtggttttctatttgga

SEQ ID NO: 17719 - DNA, 101 bp, rice(Oryza sativa)
  misc_feature (71): n=a or g
ctcaactactattgtactacacggttaattacgagctatacatgagtactggtaataacaagtgtatagtntatagtatagtactctctccatctactttt

SEQ ID NO: 17720 - DNA, 101 bp, rice(Oryza sativa)
  misc_feature (71): n=a or g
cctctgtatctcacagctatacgtgtagctatagttaggtgctatctgggatttccatccaagtgcatcanatcttccttgaggctgatcagcacctccta

SEQ ID NO: 17721 - DNA, 101 bp, rice(Oryza sativa)
  misc_feature (71): n=t or c
gatggattttataggtcacattcgccgtttcaaatttcaaggaagtgagagattgccatcgcgatttcctnagattcgtttatagttatttcatggcattt

SEQ ID NO: 17722 - DNA, 101 bp, rice(Oryza sativa)
  misc_feature (71): n=t or c
acttgtgccattgccatgccagctctctctatgtgagacgacacataggctgtgtttagtgtttaagatcnaaacttcagtcattttttatcacatcaatc

SEQ ID NO: 17723 - DNA, 101 bp, rice(Oryza sativa)
  misc_feature (71): n=a or g
actactctacacactgcacagagtcacaagaacacgtgttttgttcattgctgtttagtgtggactcttcntggcttcctccttcccgctctcctctgcaa

SEQ ID NO: 17724 - DNA, 101 bp, rice(Oryza sativa)
  misc_feature (71): n=t or c
caattttagaattctagatgtagtattgatgggattataggaaaattcacctcgacagccgttgggtcctncgaggtaaggattgccttcgtaccctttgg

SEQ ID NO: 17725 - DNA, 101 bp, rice(Oryza sativa)
  misc_feature (71): n=a or g
tatcccgattgttcacatttgttccgtcttaatgaatatcttcctacattcgccccgagatctagacaagnaattattgagcacatgagccactggcccac

SEQ ID NO: 17726 - DNA, 101 bp, rice(Oryza sativa)
  misc_feature (71): n=t or c
agaccgctctcatcaccttcgcccaactcctctcttgctagatgaggagtcgccaccaccccctgtgaaanatcaagcattgctcccgctccctcccgctg

SEQ ID NO: 17727 - DNA, 101 bp, rice(Oryza sativa)
  misc_feature (71): n=t or g
agcaattctagctagtgtgtacaggtaccatggccaatacctagttcctaaacataggacaagatcagctntttgacactgctccttggcagcatccatct

SEQ ID NO: 17728 - DNA, 101 bp, rice(Oryza sativa)
  misc_feature (71): n=t or c
gtggtgctaaatacctaaatcctaggaacaattctatattcatctaacaatcatgcaagccctgatcaagnaaccacgatgtccatattgtctaaacatat

SEQ ID NO: 17729 - DNA, 101 bp, rice(Oryza sativa)
  misc_feature (71): n=a or g
ttagcatatctacggtatattgtaggacttgacactggcgaaattattggtgagacctaccagccagttcntggatgatccaacgatgaaggatgacaggc

SEQ ID NO: 17730 - DNA, 101 bp, rice(Oryza sativa)
  misc_feature (71): n=t or c
cccgcgcgcgaagcaaatgagcaaatcaatcatcggcgcagctatccgtaaagattctccagagattaagngctggaggaatggaagatctgcagcaggga

SEQ ID NO: 17731 - DNA, 101 bp, rice(Oryza sativa)
  misc_feature (71): n=t or g
tccatgttcttcctcttctcctgcaattaggtggctgctatggctgtgagattgaagggtttaatctggtncaccctgacaccgaagatttctatgggcac

SEQ ID NO: 17732 - DNA, 101 bp, rice(Oryza sativa)
  misc_feature (71): n=a or g
attatgtaagggcaaatatcctaatatataagtggaggagtctctcatggctagcttttgggtgggaaatnccctttacgatcatatacaattggtatcag

SEQ ID NO: 17733 - DNA, 101 bp, rice(Oryza sativa)
  misc_feature (71): n=a or g
agttctcagctacttgctgacatctctatcaagggacatcctcgctcaggtggcaaccttcaccaacgcancagacgtttgggatgccatcgaggagatct

SEQ ID NO: 17734 - DNA, 101 bp, rice(Oryza sativa)
  misc_feature (71): n=t or c
tgaaaagaagctccaaatcaacgggttcagacttcaaagaagagacgagcatccaatctgctcatttctcncatcagttatacttatgtaattcttgatta

SEQ ID NO: 17735 - DNA, 101 bp, rice(Oryza sativa)
  misc_feature (71): n=t or g
ttatcaccttttctcccttgtctctagttgggatggctttcttacagttccccagtatcttgacacagtcnttgtcaccctaatcgtgcataatccactaa

SEQ ID NO: 17736 - DNA, 101 bp, rice(Oryza sativa)
  misc_feature (71): n=t or c
agctccactatcagcctgcttctttcccttacccttctggccagaatgaaggaattggtcctcccaacttntcaaccaatcatgaagctgtttaacctgca

SEQ ID NO: 17737 - DNA, 101 bp, rice(Oryza sativa)
  misc_feature (71): n=a or g
tggaaggttacagaaaacaattactaggtgaagtagtggattgattagtgccaactagagattgccaactnttggcagaccactaatcctttttgtaatgg

SEQ ID NO: 17738 - DNA, 101 bp, rice(Oryza sativa)
  misc_feature (71): n=t or c
tggaatgatctaaatgaagttgaaatctttgaagacattgagaggagggaaattgaggaggccagtttttncccccttccttttcctgttttcacataatc

SEQ ID NO: 17739 - DNA, 101 bp, rice(Oryza sativa)
  misc_feature (71): n=a or g
aaccctagagtttcccgtctcagtgtctgttttcgcttgaacaaaaatccagacggatgaaaatagtcctngaattcatacgtattttttaattaggtata

SEQ ID NO: 17740 - DNA, 101 bp, rice(Oryza sativa)
  misc_feature (71): n=a or g
ccgagccaccagtcttagcctcaccacatccacaggagccgctactactatatctatcagccacctcccangttgtgagtacagtcttggttgttgagcgt

SEQ ID NO: 17741 - DNA, 101 bp, rice(Oryza sativa)
  misc_feature (71): n=a or c
aatcgaattcctaggttcttgcacaattgatcaagtggtgaattctacagccagctaaatctgaaattaancatctaacgtccttgtagtgtggtaagact

SEQ ID NO: 17742 - DNA, 101 bp, rice(Oryza sativa)
  misc_feature (71): n=t or c
gaaatactgtgtacacgagctgaacgaatacatcaatctatcagcttacattatatatatccaacaacaanagacacaattgcaaaagaaaaaaaaaagag

SEQ ID NO: 17743 - DNA, 101 bp, rice(Oryza sativa)
  misc_feature (71): n=a or c
ctgcacagaatattaaaacgctggcaggaagcgcttgaaaattcctgaatggattcttcattctcatctgnaagaccagtgtctccagaactcagcccacc

SEQ ID NO: 17744 - DNA, 101 bp, rice(Oryza sativa)
  misc_feature (71): n=t or c
tcatttatcaaaggaatagcatttcgcaattcagctctagtcttatagacttgcaactgagaaaacaggcngtaaaataaagtttccctaagaccgtggcc

SEQ ID NO: 17745 - DNA, 101 bp, rice(Oryza sativa)
  misc_feature (71): n=t or c
tggggccacctatcggcctctagcacctgttaacgaggacaggaggcacctttgtaacttctcatacgttnatgggacttataattcgttcccggtgaggg

SEQ ID NO: 17746 - DNA, 101 bp, rice(Oryza sativa)
  misc_feature (71): n=a or g
acgggagtgggctccatcacacgacggtgtcgagcggctctcccaactccatcatgttagaaaatgatagncacataaaccataaaaaacaataaatcaat

SEQ ID NO: 17747 - DNA, 101 bp, rice(Oryza sativa)
  misc_feature (71): n=a or c
tttttttttaaaaaaaaaaatatagcgatatggttttatcataattttgctagcagaattgtggaaatggncagaagcgaatatttcccctctctttactg

SEQ ID NO: 17748 - DNA, 101 bp, rice(Oryza sativa)
  misc_feature (71): n=a or g
caatctacaactcaactaacttccaatgttttcttttgatttggttcgacatcagttcaccgacagtgatnggagtgaaattcgatcgacaaaggatcaga

SEQ ID NO: 17749 - DNA, 101 bp, rice(Oryza sativa)
  misc_feature (71): n=a or g
ttaggccaattgtcaatagcctataaacaacctataagtactaaggtcgatcagattgcttttcttacaangacgacgctaacaataacatcctatataat

SEQ ID NO: 17750 - DNA, 101 bp, rice(Oryza sativa)
  misc_feature (71): n=t or c
gctaaaatgatatggcttttggaataaagacaaacatacatgaaaaccctggtccacacagcacgacatgntggggaggccaacttacaatatgccttatg

SEQ ID NO: 17751 - DNA, 101 bp, rice(Oryza sativa)
  misc_feature (71): n=t or c
agatttcaaggaacatatgtcgtgataacatgttagggattgaatagtgggctttaagattaaatccacanattttttatcactacactatcaaatgcatc

SEQ ID NO: 17752 - DNA, 101 bp, rice(Oryza sativa)
  misc_feature (71): n=a or g
gcggctgctgtcatttacatgataacccaactctcagatgataagaagcctctgaaaggtttggaacacanacccgttctatgtttaacttgcaactgttt

SEQ ID NO: 17753 - DNA, 101 bp, rice(Oryza sativa)
  misc_feature (71): n=a or c
agaatttcagcatacagcatatgcaaccaatgcatatgttgccttgggaccactgtggaagccagcactanaaggtaaatgtttctttctcgtgaactttc

SEQ ID NO: 17754 - DNA, 101 bp, rice(Oryza sativa)
  misc_feature (71): n=t or c
tcctttctctatagaactctgttcgttactgtctttggcattgtagcattgggtctatcactctaaatagnagttgatttgatgccatcatttaatacagt

SEQ ID NO: 17755 - DNA, 101 bp, rice(Oryza sativa)
  misc_feature (71): n=t or g
gcacctttacaccaccaagaactcaatcagcacaacacaaaccaaaaacatcaactcacccaacggaggcntcgtccctccctccaatgcctgggtctccc

SEQ ID NO: 17756 - DNA, 101 bp, rice(Oryza sativa)
  misc_feature (71): n=a or g
catacctcagtgagagtaaaaaaataggatcattggtgtttaccaatgtagccacacaccaatttatagantccgtctgttttacaaaatctgaatttaga

SEQ ID NO: 17757 - DNA, 101 bp, rice(Oryza sativa)
  misc_feature (71): n=t or c
acctcttgttttgaaggaattcccgtatttcgtttgataagttgtgcttcaccccatgatgctttggtcangtgactgtatttttccttgtctagttgaca

SEQ ID NO: 17758 - DNA, 101 bp, rice(Oryza sativa)
  misc_feature (71): n=a or g
agcgaattacaatttatgataccgactgaaagaagaaggcagaagtttgttgacaattacctttggaggcnggttgaatatgttgaaaggggtaacaggca

SEQ ID NO: 17759 - DNA, 101 bp, rice(Oryza sativa)
  misc_feature (71): n=t or c
tgcaactgagatttttatcaaaaacgatcaaagagagatgtttgtcaattcattgcacactcctgtaggangtttttcatggcttaagaagaagtacgaag

SEQ ID NO: 17760 - DNA, 101 bp, rice(Oryza sativa)
  misc_feature (71): n=a or g
aaagataggaaaatttactaaccgtaaaagtacatatgcacaaagtatacacatttcttgcaggactccantataggtttcggcaggagcgtcggtcgaaa

SEQ ID NO: 17761 - DNA, 101 bp, rice(Oryza sativa)
  misc_feature (71): n=a or g
tgcatgcatctttttcttctactcactattcataacttctattgtaggaccacttcaagagcaaaaagatngagatgactattaaatatataggtaactat

SEQ ID NO: 17762 - DNA, 101 bp, rice(Oryza sativa)
  misc_feature (71): n=a or g
ctccgccgctccgagcctccgatccattgctgcgagaaggctattgggtgatcagcgcacgttcctccccncacgactggacacgtgtcgcgcgcggagca

SEQ ID NO: 17763 - DNA, 101 bp, rice(Oryza sativa)
  misc_feature (71): n=t or g
tgatggccaggtggttgaagcagatgctggaatggaagcttatcgcacggctcttttttatgcttccgaanttggcaggggcgtgttaccttaaggtaatg

SEQ ID NO: 17764 - DNA, 101 bp, rice(Oryza sativa)
  misc_feature (71): n=t or c
attaattcatatcaaggacacatataaattcatcatctggagatatagctacactacttattaatccaacnacagaatctctaatatgatataggagtact

SEQ ID NO: 17765 - DNA, 101 bp, rice(Oryza sativa)
  misc_feature (71): n=t or c
gtgccacaggaatttagaaaaatcagacccatgccactgccgtcaagtttactgtcaacctccatcaactntctccctcaacttttcttcttttctcttct

SEQ ID NO: 17766 - DNA, 101 bp, rice(Oryza sativa)
  misc_feature (71): n=a or g
cagttccccatcgagaaccgagaacaaaactaaagcttaacttccttcctccttgctggcggcgagcggcngcgccgcgtggcggcgagagcgcactggtg

SEQ ID NO: 17767 - DNA, 101 bp, rice(Oryza sativa)
  misc_feature (71): n=t or c
aggtaatccacatttgagtatgctctaatggtgacaagctcccccacgtgttgaggaaaatcgaaggatangtgagggtcattgttgacccaattaagtga

SEQ ID NO: 17768 - DNA, 101 bp, rice(Oryza sativa)
  misc_feature (71): n=a or c
gagagagatagcgaagattgtaaccttgggcaggcaggaggaacactaggattgcaaagaacgacaacggnagaacaagccgggctatgatctgcgccatt

SEQ ID NO: 17769 - DNA, 101 bp, rice(Oryza sativa)
  misc_feature (71): n=a or g
ctagcgccaggcatttccgctaccaaccaccggcctgcctctagatctatgttatgattgtattcatgccntgtaggcttattgtaaaagagttactattc

SEQ ID NO: 17770 - DNA, 101 bp, rice(Oryza sativa)
  misc_feature (71): n=t or g
tccgtgcgcatgacagccgctgggatggagatgaaccaggagtgacgctttgtgttccaccagtcttgganccccatgcaagccaccaccttggatcgtgg

SEQ ID NO: 17771 - DNA, 101 bp, rice(Oryza sativa)
  misc_feature (71): n=a or g
gaacaggacttcaggagcacctggacctgcagagatatagtatcattaatacatttttttgtgaaacaatnaacataactaattaacttcattacatttgt

SEQ ID NO: 17772 - DNA, 101 bp, rice(Oryza sativa)
  misc_feature (71): n=t or c
ttgtgggccgagatggcttgcgagttttgagtattggaacaagtctactctgggtacctcaccttttgccnctgattgaatcacctcccacaaccacagta

SEQ ID NO: 17773 - DNA, 101 bp, rice(Oryza sativa)
  misc_feature (71): n=a or g
aaacttagacacctcagtgctacgtcaattggcgcagaatatcgtgtcaccgcggacgagagactgagtcngcgtgccaacgtgcattcagcgtcgttcta

SEQ ID NO: 17774 - DNA, 101 bp, rice(Oryza sativa)
  misc_feature (71): n=t or g
agcagttaaaatcacgatcattagctcgctgattgataacgaacagtggtcgtaatcatgggtaggctagngacaacactgctcgtgctgtgcttgatccc

SEQ ID NO: 17775 - DNA, 101 bp, rice(Oryza sativa)
  misc_feature (71): n=t or c
atttccagcagttggtggacaaggcgattcgccaagaaaacatgtacgataggatggaacagaagaagcgnagggctgctcatttcaaggctcaacagggt

SEQ ID NO: 17776 - DNA, 101 bp, rice(Oryza sativa)
  misc_feature (71): n=t or c
atgggatgttgtggggtagttgctctctttagctttatttctccttttactcaccagaaagactagggaangtcatcccgttcccggaacgggataactta

SEQ ID NO: 17777 - DNA, 101 bp, rice(Oryza sativa)
  misc_feature (71): n=a or g
aaaaataagaaccttgaaaacaacaagaataactgttgtttgctcctcagtaactgcttggcccaaccacntcgatacaatggccaaaccacccattgtta

SEQ ID NO: 17778 - DNA, 101 bp, rice(Oryza sativa)
  misc_feature (71): n=a or g
cctgtaaccatttggtttgaagaggatgctagtcctgttccgtcagcaccatacatcactaaatttttcgngacgtggcgcatattgccaggcatcccaag

SEQ ID NO: 17779 - DNA, 101 bp, rice(Oryza sativa)
  misc_feature (71): n=a or g
ttaagaaaataaatcgaattatatggtaaaaaaaatgtgatgggttgagaactggaggtagctaggtaagnaaattgaatggtggaagactagagtctgaa

SEQ ID NO: 17780 - DNA, 101 bp, rice(Oryza sativa)
  misc_feature (71): n=t or c
tatatctgtatagctggtcctctctctctccctccgatctctccaactagatcgaatcacttccactcatngagcgtgtgcatggatgtagggatcagctc

SEQ ID NO: 17781 - DNA, 101 bp, rice(Oryza sativa)
  misc_feature (71): n=t or c
gggagtgttctccaagatatgccctctaaatgtagacatttcaggccatttatacgaactaggaaggtagnccgcgcaaatgcgcgggcatcatatttaag

SEQ ID NO: 17782 - DNA, 101 bp, rice(Oryza sativa)
  misc_feature (71): n=a or g
ccgtgtgactttctcaagatttttccagagctgccagggccgcaagatcttgaagatctgagtatctgacnggggcttaataattgccgatcctgttaaga

SEQ ID NO: 17783 - DNA, 101 bp, rice(Oryza sativa)
  misc_feature (71): n=a or g
aaattccttcgcatggacccttctgcgaagcctgctggataggcattatctttcgaggtagctctcatctngagtccggacctggaggtgcctttcactgc

SEQ ID NO: 17784 - DNA, 101 bp, rice(Oryza sativa)
  misc_feature (71): n=t or c
acacaaaagaaaattattcagggttgccaaacagggcctgagtgtgaagtttatatcttcttgatgtctcncaatcctagaccaagattttgggaatatga

SEQ ID NO: 17785 - DNA, 101 bp, rice(Oryza sativa)
  misc_feature (71): n=t or c
ctgcttggggttatattcggtgatctctcggtgtcgaaccatgtttagaacttgaaccaccttctcatccnatgtgagctctggttcactgtccagctccc

SEQ ID NO: 17786 - DNA, 101 bp, rice(Oryza sativa)
  misc_feature (71): n=a or g
gcttgtactgtgtcccatcatcattacatgaaaatggagttgtgccgctccctgtgcctcttcccggcganatgcgacgccatcatcttctcgctgctgca

SEQ ID NO: 17787 - DNA, 101 bp, rice(Oryza sativa)
  misc_feature (71): n=a or g
aaccaaatccattcatgaagtggtctccgggtttggcatagacgcttccaaggaaaatttgcttcacaaanggttgcatcggtcatttggttcatttataa

SEQ ID NO: 17788 - DNA, 101 bp, rice(Oryza sativa)
  misc_feature (71): n=a or c
gccagacttcaagattagagctcctattctgagacaagcttctgaggcctatactggtatgatatttcagnttttccaagaagaatacgaagagtttcagt

SEQ ID NO: 17789 - DNA, 101 bp, rice(Oryza sativa)
  misc_feature (71): n=a or c
cccctcgaagaagacggtctggtacaatctccgtgcttccacactccgatcaatcgccaccctcgcgatcnccacctgccggctccacctctccaccgccg

SEQ ID NO: 17790 - DNA, 101 bp, rice(Oryza sativa)
  misc_feature (71): n=a or g
tctcttttcgaatccagacattccaagacaaggcttttttcactgttatagacagataatctcaggaaatnaggaatttggtttgaattttgtgcaggttt

SEQ ID NO: 17791 - DNA, 101 bp, rice(Oryza sativa)
  misc_feature (71): n=t or c
tggccgcattgcgtcttcgccctttgtctatccctgcaccactgcactgcaacgccatgctgggtcgcggngctgtgccacctgtaacagccctccctcca

SEQ ID NO: 17792 - DNA, 101 bp, rice(Oryza sativa)
  misc_feature (71): n=a or g
cgtggagtcaatattatttgtcgtttctaacaaacaagttgcaccgagtgtgtctgatgatatggaatacntattttttttcaagagggagtacatttttt

SEQ ID NO: 17793 - DNA, 101 bp, rice(Oryza sativa)
  misc_feature (71): n=a or g
gaaacaaagttaaatcctcaaacgatagccgatcggctatggccaatgacgtatcgtttataacctagccnatgttgcgtaaagtagatcgacagtgagat

SEQ ID NO: 17794 - DNA, 101 bp, rice(Oryza sativa)
  misc_feature (71): n=t or c
aaccctgcctcacactcatgattctcaaaatgcccagctatcatcgcattccatgatatgcagtctgtcanggccattccatcaaacaccttcctcgccgc

SEQ ID NO: 17795 - DNA, 101 bp, rice(Oryza sativa)
  misc_feature (71): n=t or c
gtacctgcttccctttggagccctcgacgttgttcagcttctcattgtcggagtatatttcccttgcctcnatctgcgacccgcctcttgctttaagctct

SEQ ID NO: 17796 - DNA, 101 bp, rice(Oryza sativa)
  misc_feature (71): n=t or g
cagcagcaaatgcagcagcttcttcttcagacatagctaggccattatcaactttaggttctagagcatgntgttgcttttgggaacgaagcgaactacca

SEQ ID NO: 17797 - DNA, 101 bp, rice(Oryza sativa)
  misc_feature (71): n=t or c
tactttggtgcgaagtcacctggagccttcaagttgttttccatgatacggtgacatggagagtcactagncatggcaatggaagagccactagcatttcc

SEQ ID NO: 17798 - DNA, 101 bp, rice(Oryza sativa)
  misc_feature (71): n=a or g
atggttacataaatggtacatcgacaccagcattgaaggcctaactaatttaacaattcgatcaccacctnatgctgtcgccagcaaaggtttcttctggc

SEQ ID NO: 17799 - DNA, 101 bp, rice(Oryza sativa)
  misc_feature (71): n=a or g
ttcttgattcagttaccgcgcattaaacctggattttttttttttgcaaatgcgcaaatccttcgggtgcnagaaattacctatcaactatttcaccatgg

SEQ ID NO: 17800 - DNA, 101 bp, rice(Oryza sativa)
  misc_feature (71): n=a or g
ataatctgagatgattacacattgttgtgttcactgatttgcaagcagccctgtatcttgttgttgtaacncacatcagagtaaactcaatcaatactcca

SEQ ID NO: 17801 - DNA, 101 bp, rice(Oryza sativa)
  misc_feature (71): n=t or c
cgcatatacatacacaccactatgcacgtacgcacaccacactcgtacatccacaagtgtgttcttttaangcgcgtttaaagaaacaaaaatggagatca

SEQ ID NO: 17802 - DNA, 101 bp, rice(Oryza sativa)
  misc_feature (71): n=t or c
ggtgggagaggaggataggctcaccgttcgattaggtataagcggctaagatcacatctggcacgaacagngcggtaggtaaatttcctgatgtgcccttt

SEQ ID NO: 17803 - DNA, 101 bp, rice(Oryza sativa)
  misc_feature (71): n=a or g
cgtctctttgaggaaactttcctcgagcggattagagggactactcgggataggtggtctcttttgacacnaatagtccgaggtgtttccataatcttcaa

SEQ ID NO: 17804 - DNA, 101 bp, rice(Oryza sativa)
  misc_feature (71): n=a or c
gacatatactttaacttgggtaaacatttgagagctcacaggagatatttcaaggccagacaaatcattgnatattcacgcttcggggtaaggagagggaa

SEQ ID NO: 17805 - DNA, 101 bp, rice(Oryza sativa)
  misc_feature (71): n=t or c
aggccggctctagatccaccagagttgctcccaccactctcaccatgtttacttgtttgcgtatgatggcnatcactcttgcaatatattataaaaaggag

SEQ ID NO: 17806 - DNA, 101 bp, rice(Oryza sativa)
  misc_feature (71): n=a or g
taattttccaactgcagttgaatgtgaaaatgctcctaccatcatatcattgtgtagcattggcctataancattgacctgttgaagtagtgagcgaaaca

SEQ ID NO: 17807 - DNA, 101 bp, rice(Oryza sativa)
  misc_feature (71): n=a or g
gcacccattagatgtaatggatctacaacggataactacagtggatcatgactctatggagtatcttacgngtgtaacggctctcgttgccgtggccacaa

SEQ ID NO: 17808 - DNA, 101 bp, rice(Oryza sativa)
  misc_feature (71): n=t or c
gaagctgatcggctacgacccgtccaagccgtcgcaggtgaacctgaggaagaacttcggcgcgttcattngcgggttgatatccttcccactgaacatcc

SEQ ID NO: 17809 - DNA, 101 bp, rice(Oryza sativa)
  misc_feature (71): n=a or c
ctcttcctgtttcctagctctatatataaaccctaccattctcctgtctctcttcatctcgttcttcccanacacgcgcgcacacacacatcttgtgtgag

SEQ ID NO: 17810 - DNA, 101 bp, rice(Oryza sativa)
  misc_feature (71): n=a or g
gatttctagagaatcacgcgtgctaatccaaatggttttatcgtggcaaaattctactcacgcataaccgnagagataaattctactcacgcagtggccca

SEQ ID NO: 17811 - DNA, 101 bp, rice(Oryza sativa)
  misc_feature (71): n=t or c
atatcaaatccctattacttatgtacggttttattcgagaataagtagaggcaacgcgacgagcaaggganaagacgagcaggtcgccaacggcatacggt

SEQ ID NO: 17812 - DNA, 101 bp, rice(Oryza sativa)
  misc_feature (71): n=a or g
actttgagacctccaaccttgagtcgtgcctaaaatggtctcaagtactcaaatcagagtagcacctcacnacttgtacctcattccctttggctataatt

SEQ ID NO: 17813 - DNA, 101 bp, rice(Oryza sativa)
  misc_feature (71): n=t or c
caaaagccaatgaaaatacacaactttctacgatgtccgccaactgctagcgttatgatgttttcgctggngggccatgtagggtaattgctaggtcttgc

SEQ ID NO: 17814 - DNA, 101 bp, rice(Oryza sativa)
  misc_feature (71): n=t or c
tgcaaatgaatttggatcacaactcaacacaaacttgtagattggattcattgatgtgtgatcctggcggngggacgtgcgacgtggagggtcgacgtatg

SEQ ID NO: 17815 - DNA, 101 bp, rice(Oryza sativa)
  misc_feature (71): n=t or c
ctctaaatgttgtctcttcggcatttatatttggaaagaaccacacacgtttcccaaggagtacccatagnatgccaaagatagcagctcttactgcaata

SEQ ID NO: 17816 - DNA, 101 bp, rice(Oryza sativa)
  misc_feature (71): n=t or g
atttagcctcagataactttttttgcacactgcgcaagttctaattcataattacaagtggctacagcacngacatctcactgtatgtacatcgatctcaa

SEQ ID NO: 17817 - DNA, 101 bp, rice(Oryza sativa)
  misc_feature (71): n=a or g
gatgttaagattttcctaacagatagcgatctttgctgcttgatgaaacctggcacgaaaatcgctctgangcaatctatagaagcctggatttctataaa

SEQ ID NO: 17818 - DNA, 101 bp, rice(Oryza sativa)
  misc_feature (71): n=t or c
agaggttgcacattctttcccacagcaaaggaaagccccacctaaaacatggcttttaaggcttctgtagnaagcttatatgcttgagaaggtaacagaac

SEQ ID NO: 17819 - DNA, 101 bp, rice(Oryza sativa)
  misc_feature (71): n=a or g
ttctccatccactcatctttgacaagattgacgacagtttccttgacctagaagcaaaacgaacttgtaanacgaacttgtaagaccaatttgactgggat

SEQ ID NO: 17820 - DNA, 101 bp, rice(Oryza sativa)
  misc_feature (71): n=t or g
gattaatcgcttactacaatctgaatctacatgattataaacgtgcctgcactgcaaaatgctatctgccntcctcctccatcaacgtgacgttgctcatg

SEQ ID NO: 17821 - DNA, 101 bp, rice(Oryza sativa)
  misc_feature (71): n=a or c
ggcgatttggcagctagggtttggagagaggctctgataccatgtgaattctataatgaaattggggattnaactgttcatccattgagttggccctaagg

SEQ ID NO: 17822 - DNA, 101 bp, rice(Oryza sativa)
  misc_feature (71): n=a or g
cactactttcactctagcagcagctgtctaatctcatcgaattcatcgttttcatgagggagtactcctgnttcgtcatgttcaactactgctagttcatc

SEQ ID NO: 17823 - DNA, 101 bp, rice(Oryza sativa)
  misc_feature (71): n=t or c
acagcgtcgcctttttatgggcagcgtgtgcgtggctttcggcggaggaagtgagggcccacccgataacngaagaagtggcatcgccgtcctgcggagag

SEQ ID NO: 17824 - DNA, 101 bp, rice(Oryza sativa)
  misc_feature (71): n=t or c
ggcgcgtgatctggcggaggcccgcgaggacctccaaaagattaaggggctggtagctggaaacgagacgnagcggcgcggactcgagcactggatgtcag

SEQ ID NO: 17825 - DNA, 101 bp, rice(Oryza sativa)
  misc_feature (71): n=t or c
ttagggtatatcctaaattcccaatcctgtgaaagatcatatgcctattcaagttccatgttcacagaaanaaacttacaatctggctgataaccttactc

SEQ ID NO: 17826 - DNA, 101 bp, rice(Oryza sativa)
  misc_feature (71): n=t or c
caccggcgctcacaaaggtggtcatcgtgcgcaagtgcatcgtgttgtgcacaagtaaggccatgcaaacnccttcggcgttgatagggagctcggaggtg

SEQ ID NO: 17827 - DNA, 101 bp, rice(Oryza sativa)
  misc_feature (71): n=t or g
aacaggaacaagaaaggggacaatgggtctccttggcagaggccacgcgaaggagcaaatgtactcaaganggttccattaaatttgacagcatacctcac

SEQ ID NO: 17828 - DNA, 101 bp, rice(Oryza sativa)
  misc_feature (71): n=t or g
atgctttaggcatgtatactcaaaatcttcgtgttctcagcctgcccttttgctggttatctagccccatntgcgggtcgctctccaacttgcgctcactg

SEQ ID NO: 17829 - DNA, 101 bp, rice(Oryza sativa)
  misc_feature (71): n=a or g
ggcagtatcatagttgcatcttcatttcagatggagacatggagttcctctggggtgagcaatcacaccanacttcaactcaagcagaatatgatggaact

SEQ ID NO: 17830 - DNA, 101 bp, rice(Oryza sativa)
  misc_feature (71): n=t or c
aaagaactgtcaggcaaacttatggttttacttattacagcatgatgaagaaagcatgtgtaagctttttnagatagggaaatgtgctagctttaccattt

SEQ ID NO: 17831 - DNA, 101 bp, rice(Oryza sativa)
  misc_feature (71): n=a or g
attgatgaagatggctgcatcgtcagcatatagggaggttctaaatcttggtgctcgtcctctaagagggntgagaagtcccagatctgttgctttctcaa

SEQ ID NO: 17832 - DNA, 101 bp, rice(Oryza sativa)
  misc_feature (71): n=a or c
gaaactctctgacatcctccaaacaaattgcatacccacatttagcatccaccatcactgcgtgaaatacngccatacattgaccatcaccatttataacc

SEQ ID NO: 17833 - DNA, 101 bp, rice(Oryza sativa)
  misc_feature (71): n=a or c
attgatttggatggagctaaagcctctgaaaagaggggtaagacgaaaaatatccttccaccggaatgatnctttttcctgcatagcatggggaggcaaag

SEQ ID NO: 17834 - DNA, 101 bp, rice(Oryza sativa)
  misc_feature (71): n=a or g
ataaatctacatctcacgatctgacaagctgtaggatatttctcagaccctcaaaatgcggcatcatcgcntccaacaaccgcgggttcaaactctgtgtg

SEQ ID NO: 17835 - DNA, 101 bp, rice(Oryza sativa)
  misc_feature (71): n=a or c
accagggaagtctgaagaacaacctgaggaaactgaagaaatggaagggggcaacaaggctgatgacgcgntacagaaagcatcagagcaggaggcggaca

SEQ ID NO: 17836 - DNA, 101 bp, rice(Oryza sativa)
  misc_feature (71): n=t or g
ccttcgagaatcatggaagaacaaggggagctacgacgaggacgaggcgggaggacgaatcctcatgtgcnagctgcgtctccgcctcagctaccgctgct

SEQ ID NO: 17837 - DNA, 101 bp, rice(Oryza sativa)
  misc_feature (71): n=a or g
tttgttctccagatattacaaagtctagcttcaacattccctcatctagtttttcctttataaagaaacgntctatctctatatgttttgttcgatcatgt

SEQ ID NO: 17838 - DNA, 101 bp, rice(Oryza sativa)
  misc_feature (71): n=a or g
gaacacccgcttatgaagatatttgagagaaattctggtcaccaaccgccagtaaaaatcaagttttgctngctgtcacttaagaaacccacatacaaaaa

SEQ ID NO: 17839 - DNA, 101 bp, rice(Oryza sativa)
  misc_feature (71): n=t or c
gtgggtgtccgacgtcggggtggccagtccattagatgaggtggctagcctaggtgagtgggcaaccgtcngagccaaagacgtgcgggccgtcccaggcg

SEQ ID NO: 17840 - DNA, 101 bp, rice(Oryza sativa)
  misc_feature (71): n=a or g
ggggagggggtgtatttgtttggtttaaatagttgaggtaatttaggggtttagagggataattcagacantgtgctagttccgtgggagggggtaatttg

SEQ ID NO: 17841 - DNA, 101 bp, rice(Oryza sativa)
  misc_feature (71): n=t or g
tgttctgtaacttcatttttgttttcgcttcaggacacagaaaatgtgacagaggatgatgataattcagncaaaaatgatgccgagaatgagataattgt

SEQ ID NO: 17842 - DNA, 101 bp, rice(Oryza sativa)
  misc_feature (71): n=t or c
aataacatagtgaaactgaagaacagataggaaataggttaatcatcctcctgaatcctgatggcacttanaaaaaacagtaccattcttttgatggctct

SEQ ID NO: 17843 - DNA, 101 bp, rice(Oryza sativa)
  misc_feature (71): n=t or c
attgggccaggcgctctcgctgctgggaaggaaatacatgccagggttgtcaagatgagtttgcatgggtnggttgatgcggttgtggagaatggggttct

SEQ ID NO: 17844 - DNA, 101 bp, rice(Oryza sativa)
  misc_feature (71): n=a or c
atccttttggtcgtgggctcgtcagatcgatggtgtgatgatgcagagtacaagtaatgctccctcagttnttaaatatttgataccgttgattttttaac

SEQ ID NO: 17845 - DNA, 101 bp, rice(Oryza sativa)
  misc_feature (71): n=a or g
ataagtatggttctacgtagatcaagagtgaaaggatatgaacaagtgttggggtaccccataataaattngtagtagatgagtctatattatgttcaaga

SEQ ID NO: 17846 - DNA, 101 bp, rice(Oryza sativa)
  misc_feature (71): n=a or g
gtaggcttaccaggtggagtaccacaacaaagtcggcgctcatcaatatgctcaacatctaatcctatganccaggctcccaaagacacatcctcattgat

SEQ ID NO: 17847 - DNA, 101 bp, rice(Oryza sativa)
  misc_feature (71): n=a or g
tggttgttgatggcttcgtctccctgcttcttgtggaacaccttgcacacaacccattcgttgggattganacgaaggtttgggtagtggttgtggaggtt

SEQ ID NO: 17848 - DNA, 101 bp, rice(Oryza sativa)
  misc_feature (71): n=t or c
tccttctgctcccaccttggcaatctgataagctgcgattctctgtttgtgggatttgtaatgcaaactanggtttatgtaatgccagattctaaggctcc

SEQ ID NO: 17849 - DNA, 101 bp, rice(Oryza sativa)
  misc_feature (71): n=t or c
gatgatcttttgtctgtactgtagctgataagtcagaccactattctggtaaagaacttgtccgtagcatntgtaggaggttagatactgaaatattctaa

SEQ ID NO: 17850 - DNA, 101 bp, rice(Oryza sativa)
  misc_feature (71): n=a or g
caatgtcttgtatatgttttcttccatcaaagaacaagtcgttttggcgtccaagttggtaactgcaccantaatcaatagagatgctgattttggtgcag

SEQ ID NO: 17851 - DNA, 101 bp, rice(Oryza sativa)
  misc_feature (71): n=t or c
cattctcaagatgggatttgcccaaacgccactcataatatatgggtattcgctgaaatgccacttcaggntttcttccatttcgaaaatatttttcatca

SEQ ID NO: 17852 - DNA, 101 bp, rice(Oryza sativa)
  misc_feature (71): n=a or g
ctaagaatcatggaacgtccgtgcaacttatcaccatcttttaaaatccgtgggttctggcctccatcgcnattttgtgcactgtccacttgttcaggctt

SEQ ID NO: 17853 - DNA, 101 bp, rice(Oryza sativa)
  misc_feature (71): n=a or g
gatcgatgctcgtttatatggttttgcacatgttgaagttgatcgatgttgtgactgcactcatttgctcntatctcttgtggtaatctaagatatagagc

SEQ ID NO: 17854 - DNA, 101 bp, rice(Oryza sativa)
  misc_feature (71): n=t or g
cggcaggtcgtccatgcacaccgtcaatatcttgtccatcgacgtcgccatctgcttccccttcatcttcntcttcgtcgtttgttccgtcgatgtcggcg

SEQ ID NO: 17855 - DNA, 101 bp, rice(Oryza sativa)
  misc_feature (71): n=a or g
aacatcagtcatgcacttcatgctgctccaactcagtggtctggcaagaaattaacagaagagttgcaccnacagtgagaaggtctcgttcctttcagcta

SEQ ID NO: 17856 - DNA, 101 bp, rice(Oryza sativa)
  misc_feature (71): n=t or c
gttcgcctctcttcctttcactttgatgtagatagtggagagcacaatgcttcacaaaagatggggctcangttccataattttggctcacatagcacttg

SEQ ID NO: 17857 - DNA, 101 bp, rice(Oryza sativa)
  misc_feature (71): n=a or g
catggaagacttctttgatggaggagctttcctgctacctaatctgagttttcgagatggttcactggccnttggagggggcttccaaccggatgcaatca

SEQ ID NO: 17858 - DNA, 101 bp, rice(Oryza sativa)
  misc_feature (71): n=a or g
acttcgccagatggtagtagtccatctgtttcagaaagtattgatatctctggcacatctccaaaggatanatcaaatgatcttctcgagaagtgagtcat

SEQ ID NO: 17859 - DNA, 101 bp, rice(Oryza sativa)
  misc_feature (71): n=a or g
ataaatcaaaacggctcaaacttgagtagttttgatcagaaaaaacgcgcaagccatgcaacaccgcctcncgcgcgcgcgctgttcgtgaaatttatcgg

SEQ ID NO: 17860 - DNA, 101 bp, rice(Oryza sativa)
  misc_feature (71): n=a or g
ctagaacaagtgatgctattgtaatccacggtggtgatcataatttgcctaagaggaagaggctcacagtnccagcaagaagcaattcaccaaaaaataac

SEQ ID NO: 17861 - DNA, 101 bp, rice(Oryza sativa)
  misc_feature (71): n=t or c
tcatcttggtctgtcgctgctccatgccaagcactcgtcgctcaagatcttcaatctggttcatcgttccngactgctgctgcttggatttccagaggtca

SEQ ID NO: 17862 - DNA, 101 bp, rice(Oryza sativa)
  misc_feature (71): n=t or c
catggaagtataaatatttttgtccctcctatcccaagaccagagaccaatgcaaatcaagctgttccagntgctcctacaggccacaggctcacacacag

SEQ ID NO: 17863 - DNA, 101 bp, rice(Oryza sativa)
  misc_feature (71): n=a or g
acttaatgtacaggatacgataaaattcgttcgttgcaacgcatgatagtacttacataaaacttattatnatacaacttaaaattgattagtacatgcag

SEQ ID NO: 17864 - DNA, 101 bp, rice(Oryza sativa)
  misc_feature (71): n=t or g
catagcgttcgtcttcgggggaaacgcggtgatgaagctgcagcagtggaactacctctaccaggacgagnataccgggctggagtgcctgacgataccgc

SEQ ID NO: 17865 - DNA, 101 bp, rice(Oryza sativa)
  misc_feature (71): n=t or c
gttgcccggtcacatatgctggtcatgctgacacaactagattttatatcgatgatttatgaggatttggnacataacctacggcttgtgttgctggcaca

SEQ ID NO: 17866 - DNA, 101 bp, rice(Oryza sativa)
  misc_feature (71): n=a or g
agttcaaagaatctagaacatgcgtggcaatgccttggatttctcagcaagtacagtcgactgatcatgangacatgatgaaatcagcattccggtgtcca

SEQ ID NO: 17867 - DNA, 101 bp, rice(Oryza sativa)
  misc_feature (71): n=t or g
tgagttgacccacaaaaaggtcaacggtcaacagcaactctgttggatgaaattttgctgaaaggtagggntgtaatttcataatgtgccctgacacgcca

SEQ ID NO: 17868 - DNA, 101 bp, rice(Oryza sativa)
  misc_feature (71): n=a or g
tccctgtgtggtggtaagctggtgggctcctgaaaccttgctacaaactcagttaaaacttctgtcacctnagggggtacactatctgattctgctgcatc

SEQ ID NO: 17869 - DNA, 101 bp, rice(Oryza sativa)
  misc_feature (71): n=t or c
aaatgatcagagaggagagatcgtacatgtgaaaaatggccttcaattgttgaaaccgactttgacacaanaacaagaacaagcacaagctcaataccaag

SEQ ID NO: 17870 - DNA, 101 bp, rice(Oryza sativa)
  misc_feature (71): n=t or c
gttgctaaattcacgatctgcaccatagatgatcccaggacattaaacaatacgctgtatctgagaccctngggaaatgtctactcaatgaacaaattggt

SEQ ID NO: 17871 - DNA, 101 bp, rice(Oryza sativa)
  misc_feature (71): n=t or g
gctgctgcgcgcatcgccagcagaaaatcgcagcatttgcaggctctcgcatcattttcagtcgccacgtnatccaggtaaagtcgtcagtctcactgcgg

SEQ ID NO: 17872 - DNA, 101 bp, rice(Oryza sativa)
  misc_feature (71): n=a or g
taagcaagctttaacctctgctcctgtacttgggttaccagatttttccaaacagttcactgtggagacanacgccagtgatgctggtattggagcagtgt

SEQ ID NO: 17873 - DNA, 101 bp, rice(Oryza sativa)
  misc_feature (71): n=a or c
cgaattgtaaaacagagtgtcgagtcaaactctgatccatgttgggactaattcgtactgtaggctcgtanagtgatgggtgggtgtattggtacgctgta

SEQ ID NO: 17874 - DNA, 101 bp, rice(Oryza sativa)
  misc_feature (71): n=a or g
tcaaattagtaaaaccttggcacttcgattcaactgggtcctcaaatatagagcatctgggttcaaaaacnggagagtccaatatgatgtctggttgctga

SEQ ID NO: 17875 - DNA, 101 bp, rice(Oryza sativa)
  misc_feature (71): n=t or c
ctgaagctccaagtgcttagccttgtggttcatgcaagatagttcgtcctgaactctctggatctcatttntcatgacatcctgtatacgaagtgaagatg

SEQ ID NO: 17876 - DNA, 101 bp, rice(Oryza sativa)
  misc_feature (71): n=a or c
gtccgcttgtctagaaatccatacttccagagaacggtggacctaatgccccatgtccgtccacggtgttncttggtgcccaacgcttttgtgaggaggtc

SEQ ID NO: 17877 - DNA, 101 bp, rice(Oryza sativa)
  misc_feature (71): n=t or c
aaccatcggtctatctccaagcgcatcatatacggaaccctaacgtcaatggaatttctgtcatactcgtngatggtatttcttagatttgggtagttgtc

SEQ ID NO: 17878 - DNA, 101 bp, rice(Oryza sativa)
  misc_feature (71): n=a or g
ttgaaaacaaattctacagctgttctatctgacagagtagcacggaatccactgatgcttgcatggatttntttgaggcttgacaaatgccctatgccaaa

SEQ ID NO: 17879 - DNA, 101 bp, rice(Oryza sativa)
  misc_feature (71): n=t or g
gccgtctatcaaaacgaacggcttagatcaatcgagcatcgggccgacctccatcgtcggactgcagcatngcttggccatgcgctggccagcggtccaac

SEQ ID NO: 17880 - DNA, 101 bp, rice(Oryza sativa)
  misc_feature (71): n=a or g
cattgattcagtgacaaccaagtgattgaaaccgtcttgcatccatcttttctcttgtcactgcagcatancacaatgattcaatgagaactttacttcaa

SEQ ID NO: 17881 - DNA, 101 bp, rice(Oryza sativa)
  misc_feature (71): n=t or c
gtcgagcgcgagcacgcgggagacaagccgctccttccttccctggatcacacctgacaccccacgtcatngacgacatctcatactgccttcgaggagag

SEQ ID NO: 17882 - DNA, 101 bp, rice(Oryza sativa)
  misc_feature (71): n=t or c
ttttttttttggaaaatcacagtaaggtatcaattgataaataaatgagggctgctacagaacgggattcngttgcaacgggatagacatattaactattc

SEQ ID NO: 17883 - DNA, 101 bp, rice(Oryza sativa)
  misc_feature (71): n=t or g
gctggcggtgagaagggaatgcgttatgccatgccaaatgctagagtaatgattcatcaacctcaaggtgnatcagaggtatgattctggggctttctgcc

SEQ ID NO: 17884 - DNA, 101 bp, rice(Oryza sativa)
  misc_feature (71): n=t or c
actaaaaaaagaactgcaaaaatgccaatacgatgtattaattaattccatgatagatcactactccctcngtttcacaatgtaagtcattctagcatttc

SEQ ID NO: 17885 - DNA, 101 bp, rice(Oryza sativa)
  misc_feature (71): n=a or g
gaccaatacgtagcacactctgtcttttgattttcctaggaaagggtccctagtctttctgtttgatgcanagtcgccaggcaatctgatgacccgatact

SEQ ID NO: 17886 - DNA, 101 bp, rice(Oryza sativa)
  misc_feature (71): n=a or g
gctaagggacttattggctatgtggattcagattttattgctgatttagataagcgaaggtcactcatagnttatgtgtttactattggtagttgtgctgt

SEQ ID NO: 17887 - DNA, 101 bp, rice(Oryza sativa)
  misc_feature (71): n=a or g
gtcgtcgccgccggactccgcctcgccgtccttctccttctaccacccttcgcctcccaactacaccctcnccgtgtccaacctctcatgccgggaccctc

SEQ ID NO: 17888 - DNA, 101 bp, rice(Oryza sativa)
  misc_feature (71): n=t or c
gaaaacaaagatcaccaacttagggaagtcgtcgccatacccgtattcacgggcaaactatgacctacatngtcctgggacacatatggttggagcgcaat

SEQ ID NO: 17889 - DNA, 101 bp, rice(Oryza sativa)
  misc_feature (71): n=t or c
gaacgtgatacagtaaagcaatgcatcataatacctagcagggaaaacactgtcatctccaacgatcttcnaatcaagcacatcagatggattaccatgcc

SEQ ID NO: 17890 - DNA, 101 bp, rice(Oryza sativa)
  misc_feature (71): n=a or g
cttaacaattatatattcttgtcgtaggttgatgggttcagatttgatcttatggggcatatcatgaaaantaccatggtaagtaagttcaattcgaagat

SEQ ID NO: 17891 - DNA, 101 bp, rice(Oryza sativa)
  misc_feature (71): n=t or c
agtaaagaggccatcaccataatgttggaaactcgccaacaagttgccctcagtgtcaatgtaaaatagcnatcgatcacagctaaccagcacaagcacat

SEQ ID NO: 17892 - DNA, 101 bp, rice(Oryza sativa)
  misc_feature (71): n=t or g
gagttgcagtgtctgaccccgagtgacagcctaggctcgaatgtgccttatagtttggacactactttatnattaaagtgatatttcaattatcagggtta

SEQ ID NO: 17893 - DNA, 101 bp, rice(Oryza sativa)
  misc_feature (71): n=a or g
gtacatccaataccagctctctactcaacttaatcacatgatgcatcctctagcatgatcaatgtgatggncactgccagagcgatccatggtttttctgt

SEQ ID NO: 17894 - DNA, 101 bp, rice(Oryza sativa)
  misc_feature (71): n=a or g
tatcttggtgattcttgggaaccttcagaaagaccacttaatagttttccttggcccagaaaggcttgagncttgagagctgaaaagttctgctggagcta

SEQ ID NO: 17895 - DNA, 101 bp, rice(Oryza sativa)
  misc_feature (71): n=t or c
attaagcatggctaagcatatataattctagcaaagtcaacataagtgactcacgctagtcagattatcanccaaggttaacaaaggacggttaacaagta

SEQ ID NO: 17896 - DNA, 101 bp, rice(Oryza sativa)
  misc_feature (71): n=t or g
cacttttcgggatgagaaagcccttcacacaggatctttgactcgagatccaatcatgaacgggggaatanccatccattccagccgcagcgcgcgttgac

SEQ ID NO: 17897 - DNA, 101 bp, rice(Oryza sativa)
  misc_feature (71): n=a or g
ggttttcagtacttagcgtgtgtttctgtccttttaggcttttgtgttttttatgacttttttgtcatgcntttttggtttgtttgaattggtgtaataat

SEQ ID NO: 17898 - DNA, 101 bp, rice(Oryza sativa)
  misc_feature (71): n=t or c
aacttacagtgccacagtgctttacattattaccttttgctctagggcaagaagtagtttctttcagtccnaaacagcaaatatcacaaatgcatcaaatt

SEQ ID NO: 17899 - DNA, 101 bp, rice(Oryza sativa)
  misc_feature (71): n=a or c
tgaatccagttatatttacgttggcataatcttttctttgttttgtcctctgtcatggtcagattcccaanggatcagtatgatcgcttctgggagggctg

SEQ ID NO: 17900 - DNA, 101 bp, rice(Oryza sativa)
  misc_feature (71): n=a or g
ggaactaaacgtgtttattattggagaatttatgtcgattaatgggatttttttcaacgcttaactattcntcttatttaaaaaattaatgtaaatataaa

SEQ ID NO: 17901 - DNA, 101 bp, rice(Oryza sativa)
  misc_feature (71): n=a or c
gggacccgacgagcaaccaaggtcagctataacgatcttcgctggagctggagaggatagggacgcaaaanccccctctattgccttgcatagcactggct

SEQ ID NO: 17902 - DNA, 101 bp, rice(Oryza sativa)
  misc_feature (71): n=a or g
tttttttttggttgatttttcacacctgtgacgggttgactgctttaactcgtttgaggtggcataatctntcacgggttctaattataactcgttagaaa

SEQ ID NO: 17903 - DNA, 101 bp, rice(Oryza sativa)
  misc_feature (71): n=a or g
aatgttcgccccccaagctatctcaaactacagttgaaagaaattacctgcgtgtagatgcagggggaggngtacgcctccggatcgcgagagacggcgtg

SEQ ID NO: 17904 - DNA, 101 bp, rice(Oryza sativa)
  misc_feature (71): n=a or c
actgaaggttggtaagcatcacctatggtatccacacatcgatcccaatttgggatttgggggttcaaaanagaaccattacaacatattcccatgcccca

SEQ ID NO: 17905 - DNA, 101 bp, rice(Oryza sativa)
  misc_feature (71): n=t or c
actaggaagtgtcatatccctttaaaatcccttgtgttttgggatagagagagtaactaattgcacagatngcgactaatttacgagacgaatcttttgag

SEQ ID NO: 17906 - DNA, 101 bp, rice(Oryza sativa)
  misc_feature (71): n=a or g
gagagagagagagagagaggccatggggagcattttacttgtcctgaacaacagtttccaccttccactantcatgctgtagcagaagggagaaatggaaa

SEQ ID NO: 17907 - DNA, 101 bp, rice(Oryza sativa)
  misc_feature (71): n=a or g
tgggcgccatcagtcctccctatatgcccctagcaaagctttcagttggaagcccatacaaaacccacctngcgaaaacggcttgcaggccgtgcgaaatc

SEQ ID NO: 17908 - DNA, 101 bp, rice(Oryza sativa)
  misc_feature (71): n=t or c
tcataggtgtatccagattcaaacgagttctaacagtctaacctgctacgtgcactgatatgacatgccangttgacgcatacgtgttaatggagcctaca

SEQ ID NO: 17909 - DNA, 101 bp, rice(Oryza sativa)
  misc_feature (71): n=a or c
cccttggccgtctcccccaaccccaccacagcaccattcatctctctctcttctagactcttcggggatgnaagggaagggagagaggttaggagcagtct

SEQ ID NO: 17910 - DNA, 101 bp, rice(Oryza sativa)
  misc_feature (71): n=t or c
ttgggtagtaccggacgagtctataagttggagtgctcggtttgcactttcgcatatacttcctccgtccnaaaatataagcattttttaaattgacacgg

SEQ ID NO: 17911 - DNA, 101 bp, rice(Oryza sativa)
  misc_feature (71): n=a or g
ggaaaataatattttgaagtttgttgtacgcttgcgtccgtgtcagatatacatatagatatggacttgcntgcatgggtgcatgtgtgcaataggtagta

SEQ ID NO: 17912 - DNA, 101 bp, rice(Oryza sativa)
  misc_feature (71): n=a or g
ccactcatcgaccaggtactacaaaactcatagtagtactgtgtgttgctgtgtgtcacttacctctgacngaccgtagagttctagctcgtcagagttga

SEQ ID NO: 17913 - DNA, 101 bp, rice(Oryza sativa)
  misc_feature (71): n=a or c
tgcagctaatcctcctgcttggtgttattgatctaacttggttcttgagctggagtaccaactccaggagntgaagtccctgctcctcttcctggagctca

SEQ ID NO: 17914 - DNA, 101 bp, rice(Oryza sativa)
  misc_feature (71): n=t or c
gtactactttcaaggtgatcaccatggggggttatgatgccatactaggtatggattggttaactcaacanagtcccatggatattgattggcaagctaag

SEQ ID NO: 17915 - DNA, 101 bp, rice(Oryza sativa)
  misc_feature (71): n=t or g
gaaaaggaataagcccatttgacatcccttatctttttgtcgagtttgagatccctaaaccgcaataccanaaatcttcaacgccctccatcttggcaaaa

SEQ ID NO: 17916 - DNA, 101 bp, rice(Oryza sativa)
  misc_feature (71): n=t or c
cttgtcaacaatcgaggattggtcagttgccttgacgccgatgatggtgcagcaagtacaagcgccgatancggtgctgtcggctgagctggtggcatatt

SEQ ID NO: 17917 - DNA, 101 bp, rice(Oryza sativa)
  misc_feature (71): n=t or c
tgaacgtgcctgcaaactccaggtgtttctcacggctcatgtagctcgtcagatcttcagagctaattccngaaggtcggggagaagacatgagtgaagcc

SEQ ID NO: 17918 - DNA, 101 bp, rice(Oryza sativa)
  misc_feature (71): n=t or g
ggtgattctgatgggacgacaccctagtcatggccggttctgaacttcatgtgttgtgaatggagaaaaangatagtgagtgtgttaatgacatatcgagt

SEQ ID NO: 17919 - DNA, 101 bp, rice(Oryza sativa)
  misc_feature (71): n=t or c
cgttaatacgagcgcccatgtcaattgtagtactttagcttggtaggccagtttgattaaaaaaacctaancagttaagttacgcccacttcataggcact

SEQ ID NO: 17920 - DNA, 101 bp, rice(Oryza sativa)
  misc_feature (71): n=t or g
tggagtagcgagcgagcgagagagagagagtgatgtaatggtgccatgtcatgggctcgcagaggtcaacntcgctctcccgtcgtcgcgtcgtcgtctcg

SEQ ID NO: 17921 - DNA, 101 bp, rice(Oryza sativa)
  misc_feature (71): n=a or g
gaaattgagaatattgatcattgaacttgatgagggtgcagcaatggcagaggccttgatcacaaaggtanttgcttgggagaaggagaggggtgccaaat

SEQ ID NO: 17922 - DNA, 101 bp, rice(Oryza sativa)
  misc_feature (71): n=a or g
caactagtgaccttgtggacaacagttcaaagcgtgcaactctccccaggtgttgtagatgaaatcatttngaggctcacaaatcatgaagaatactcggt

SEQ ID NO: 17923 - DNA, 101 bp, rice(Oryza sativa)
  misc_feature (71): n=a or g
tataagtaaatcctttccttgtactcaactggagtatccactggatgcaacgagaaactcaaaatttagcngaacgaaaactgtatctcctccagagttct

SEQ ID NO: 17924 - DNA, 101 bp, rice(Oryza sativa)
  misc_feature (71): n=t or c
gcgtcgtagccgcgcgcatcgaggcgaccaacactaacaatgttttttctcagcttggggatgtagtacantgcctctagtgagcggtgatcaccattctt

SEQ ID NO: 17925 - DNA, 101 bp, rice(Oryza sativa)
  misc_feature (71): n=a or g
cctctgttctaaatcagtgtatcctcatgatcaggggtcagttcaagaatcaactttactctcgccgtggntcaatgagttctcaaggtcgctctccctct

SEQ ID NO: 17926 - DNA, 101 bp, rice(Oryza sativa)
  misc_feature (71): n=a or g
ttacacgaaacacaagcaatggcaagtaaaaggaggagcaaagtgaatcttatcatgttcttcagttttgnctgaatcttatcacgttcttcagtcctgac

SEQ ID NO: 17927 - DNA, 101 bp, rice(Oryza sativa)
  misc_feature (71): n=a or c
tacagtagtacttactttcttcttcatcacttgatgggtagtagtactccgtagtagctaatgatcgttgnaaacgagtactacgtgtttgatgaatcgcc

SEQ ID NO: 17928 - DNA, 101 bp, rice(Oryza sativa)
  misc_feature (71): n=t or c
tagttgtccgtgcttgatttgttgtagccgccgccgctgccatattcaccggtgccggacttgttgtagcnactctcagagttgtctgtgcttgatttgtt

SEQ ID NO: 17929 - DNA, 101 bp, rice(Oryza sativa)
  misc_feature (71): n=t or c
cgtctagtcgacagtttcgagtctctaatagttggtgtgttgacttccgggttgaaatctacaattgtaantatttctttgtgtttagttaccgattcgta

SEQ ID NO: 17930 - DNA, 101 bp, rice(Oryza sativa)
  misc_feature (71): n=a or g
acttaactgtcttaaatctcaaatacaaataaagatgtaaacgggtcgatccgtggcttgatacaaataantgaggtaacactgtaaataggtttgtggat

SEQ ID NO: 17931 - DNA, 101 bp, rice(Oryza sativa)
  misc_feature (71): n=a or c
gttttgtagaaatgaaataaaaccgatctcgtgaacaacaaagcagtgcataaaaaaaggaagcataagtnagacattccttagttcttacatatctctct

SEQ ID NO: 17932 - DNA, 101 bp, rice(Oryza sativa)
  misc_feature (71): n=a or g
gacaatggctgacacatcgatggcgatgacagctgagaccaagcttgggggaggtggatccgtagccgacnagcttgggagaggccgatccatcgctggtg

SEQ ID NO: 17933 - DNA, 101 bp, rice(Oryza sativa)
  misc_feature (71): n=t or c
ggggttccgaacttagaaaagtttgccagagctctttgactgagatggttatggttcgaatggaggatgcnaaagaagccttggatagggactgaaacacc

SEQ ID NO: 17934 - DNA, 101 bp, rice(Oryza sativa)
  misc_feature (71): n=t or c
gaacttgtttacggcgttctccactcccagatactcgtacacatcgccctcaaaaacggggtgaacagatntcaggtcgtctagtccaagttcggcgagct

SEQ ID NO: 17935 - DNA, 101 bp, rice(Oryza sativa)
  misc_feature (71): n=a or g
cgtttcctgcattgcgcgcgcggcacaacaggtagatttgttggtttggtcaaccttttctctaaagtctntttgctgtccaaacttggttttgtagtaca

SEQ ID NO: 17936 - DNA, 101 bp, rice(Oryza sativa)
  misc_feature (71): n=a or g
tttccttttcaattcggttttaattcgccggatttaatctttatcgtcgccaataatgaccggccagaccntttttatcttgaattttgttcactccaatt

SEQ ID NO: 17937 - DNA, 101 bp, rice(Oryza sativa)
  misc_feature (71): n=a or g
tctgatatcttgtaggtatcagtgatacccgttcagacgaggtatacacatcaaccatctatttcaaatcnagcatctatttcaaatcgagccgtatgtag

SEQ ID NO: 17938 - DNA, 101 bp, rice(Oryza sativa)
  misc_feature (71): n=a or g
ttgtctccttcttctttctcaatctcggccgccggagcttcggtcgtgccggagagatgcccatctaactncgcaccacgaagagtggtgaggatctgcgc

SEQ ID NO: 17939 - DNA, 101 bp, rice(Oryza sativa)
  misc_feature (71): n=t or c
catacacgctcagaacacaacaggttgattacataggtcgcatacacgctcagaacacaattacataggtngcgattggaaatagaaatactgtgtggtac

SEQ ID NO: 17940 - DNA, 101 bp, rice(Oryza sativa)
  misc_feature (71): n=a or g
aattttactttgttgtctatatattggtatggaaaaactgtacgatccatattcagtctatgttcagtctntgcaaaaaccaagcaaacaagaagtttcta

SEQ ID NO: 17941 - DNA, 101 bp, rice(Oryza sativa)
  misc_feature (71): n=t or c
aaaaaaataaaagatgggagaagaggaagagagcaagagagctggcgggctgcatctagatcaaagaccgnattatgtgcgagtctttaaaatatggtcat

SEQ ID NO: 17942 - DNA, 101 bp, rice(Oryza sativa)
  misc_feature (71): n=t or c
ctcctgtcacgcatctgttgccgccgatagtccttgtgccgagctgtcgactgccgcctctactttttttnccccattgccccgctgtgccggtcaaagcc

SEQ ID NO: 17943 - DNA, 101 bp, rice(Oryza sativa)
  misc_feature (71): n=t or c
tatgcctcattccttccattcctataaaatcctatcaaatacctaaggattatagccttacaagcttattncatatgattcttattatcatgagataagac

SEQ ID NO: 17944 - DNA, 101 bp, rice(Oryza sativa)
  misc_feature (71): n=t or c
gctgccaccgttgcttcgtgccactaggagccacgccatcgtcatcactgcctccttcccgtgttacagcngccggtgagcccgaggctaagccctctctt

SEQ ID NO: 17945 - DNA, 101 bp, rice(Oryza sativa)
  misc_feature (71): n=a or c
cttgtgaagagtaaaatcccaatgtacgatagtgacgataaattgaggctattgaaccgtgaaattgttgncaatgcttatgctcgacagttcagaaagga

SEQ ID NO: 17946 - DNA, 101 bp, rice(Oryza sativa)
  misc_feature (71): n=t or c
ggaggaacatgctctagtttctctgttgtctgatgagaagtacgcaactgaaaagaccgaagatgtggacnctgatgattatgagaaacttgaggaaggga

SEQ ID NO: 17947 - DNA, 101 bp, rice(Oryza sativa)
  misc_feature (71): n=t or c
gaaacgggagcccgttgtaatcatcattgatgcatcttactagtagtacctcgttaatacactactccctncgtcccataatataagggattttgagtttt

SEQ ID NO: 17948 - DNA, 101 bp, rice(Oryza sativa)
  misc_feature (71): n=t or c
cctggggctttgctgaagagatgggaggctaatttgcgcccaatttatagaggtttttgtgtgggagccanaacaactcattccttttataaattaaatta

SEQ ID NO: 17949 - DNA, 101 bp, rice(Oryza sativa)
  misc_feature (71): n=a or g
gctgttgttgcagctcgtataatgaatgctacattagttctaccagagcttgatacaaattctttctggcnggataaaaggtatcttgttgtctgaaatgg

SEQ ID NO: 17950 - DNA, 101 bp, rice(Oryza sativa)
  misc_feature (71): n=t or c
ctatttgatagagtttcaactcataaaatttaactcaggagttggatctgaagtatatgaagtatagttgnggaacagccgaactaccgaaacccagctct

SEQ ID NO: 17951 - DNA, 101 bp, rice(Oryza sativa)
  misc_feature (71): n=a or g
atttgccaacgatgtgaatatgaaggccgaccctgtggtttcagttcacaaagtggtcaagcattctgtcngcgtcatggtattttttctctctctttttg

SEQ ID NO: 17952 - DNA, 101 bp, rice(Oryza sativa)
  misc_feature (71): n=a or g
aaaagaaaatgtggggctaatgacccaggttaccgaaagtgcatgtcgttgcatctactttctagaagggnaaaaaaaaagcatcacaacgcacacaataa

SEQ ID NO: 17953 - DNA, 101 bp, rice(Oryza sativa)
  misc_feature (71): n=t or c
accgatagcactgtaccaaccgggaattcatgcgttcagctgattatttgcctgatttgtctccctgtgantatagatgcccaaataggccacccggcatg

SEQ ID NO: 17954 - DNA, 101 bp, rice(Oryza sativa)
  misc_feature (71): n=t or c
atccatctctcgctcgccatgtttcttgattaatccttggtcgctgttgattggccagatcaccggaaganggtcgtcgtcctgcacgccggcgaggacgg

SEQ ID NO: 17955 - DNA, 101 bp, rice(Oryza sativa)
  misc_feature (71): n=t or c
agcatcataagtttattgagttctatgatgtaagagcagcagaagctgctcttcggtcactgaataaaagngagatagctggaaaacgcataaagttggaa

SEQ ID NO: 17956 - DNA, 101 bp, rice(Oryza sativa)
  misc_feature (71): n=a or g
gtagacacgtataccctaccccaatagtaaaaatcttcaaaagattgagctggtatgccttgatatttatnaagtcatgatagacacatattagtgttaac

SEQ ID NO: 17957 - DNA, 101 bp, rice(Oryza sativa)
  misc_feature (71): n=t or c
tccgcttcggccttaacactaaatccgataaatgatttaccgaatttcgtcgttaacaacggcgcagaagntgagaagataacccgacaagccaagattta

SEQ ID NO: 17958 - DNA, 101 bp, rice(Oryza sativa)
  misc_feature (71): n=t or g
ttcttccaggacaagtcgatgcttcgccacatgcatttgagatgcttcttgctcattagcacctgtagctncatgttcaggggtaacagcttcaaagctcc

SEQ ID NO: 17959 - DNA, 101 bp, rice(Oryza sativa)
  misc_feature (71): n=a or g
gtaagcttagccacctcaactctggaatcgtgtacaagtccttggggaggctcccagtaaggccattgccntcaaggaagaggtcgttgagcagcttgcac

SEQ ID NO: 17960 - DNA, 101 bp, rice(Oryza sativa)
  misc_feature (71): n=t or c
gtcagcagcaagtttctctgcaaaatatgttcccaaatatttcgtagaccacaatgaccgacttggcctcnggctccacgcctttctcggtcacctcttcc

SEQ ID NO: 17961 - DNA, 101 bp, rice(Oryza sativa)
  misc_feature (71): n=a or g
tagtaatgcaattattgggtacatctgtcgatttgtcacacgaacaaaggccagtcaaattaacatacgcnctagcaatgcaatttcgcaaacaaaccatt

SEQ ID NO: 17962 - DNA, 101 bp, rice(Oryza sativa)
  misc_feature (71): n=t or g
gtggactcactgaggagaggggtgtggattgggataatgagagaatatgtcctacggagtatgtcattganttaatttactctagtttaacgatttacgat

SEQ ID NO: 17963 - DNA, 101 bp, rice(Oryza sativa)
  misc_feature (71): n=a or g
gcgaatgacgtcatgctgccattcatgatggattgactaaatgctcttcggcaacctcattgatgcctccngtggtgcgcttggcatccacgacgtagtca

SEQ ID NO: 17964 - DNA, 101 bp, rice(Oryza sativa)
  misc_feature (71): n=t or c
acggatggagtactgaagtagagcgaaagcagcaaattttgctatagtacgagtctgttcaaattgatganatttttaaccatactattatttggtaaaat

SEQ ID NO: 17965 - DNA, 101 bp, rice(Oryza sativa)
  misc_feature (71): n=a or g
ttctaagtttctaactagatgataaataagattctgccacacgaatgctacaaacatctttgaagagaganaaaaatgaagaaatattaagatcatatttg

SEQ ID NO: 17966 - DNA, 101 bp, rice(Oryza sativa)
  misc_feature (71): n=t or g
gctggtgatgtatatgaaaggcgttcgttaattataattaagttgggcgcctagcttagcattgggtcctncacatgcagcggcgacggaatcccctgcag

SEQ ID NO: 17967 - DNA, 101 bp, rice(Oryza sativa)
  misc_feature (71): n=a or c
aattttaaattaaaaaaacaattacctgttaacagttaatatcgatttgaaaagacaagagcatcttgctnttcaagagaggcctaaacaggttttctaaa

SEQ ID NO: 17968 - DNA, 101 bp, rice(Oryza sativa)
  misc_feature (71): n=t or c
ttacataccggttgaaatatttactgttcttgtaatgtgattacagttcacaggaactacacaatactttntacaagacaatatcataaccttattattgt

SEQ ID NO: 17969 - DNA, 101 bp, rice(Oryza sativa)
  misc_feature (71): n=a or g
ttttcctttcgtttttttgggaaaaaacgtgtttttccccctttattttaggacacggtaaattgggacangaacggagagttgactctaacaaactttta

SEQ ID NO: 17970 - DNA, 101 bp, rice(Oryza sativa)
  misc_feature (71): n=t or c
aatgacaaggcaagaaaatatctgacatgcatgcggaagaagcagcctgcatcattttcacataaatttcngaaggctgatccattagcattacaattgct

SEQ ID NO: 17971 - DNA, 101 bp, rice(Oryza sativa)
  misc_feature (71): n=t or c
tgttccggcctacacatatagtgcccacctatatgtgcctttctgtagtagtgtattttgtgcctacaagnatgtggcagatgcggattcatctagcctat

SEQ ID NO: 17972 - DNA, 101 bp, rice(Oryza sativa)
  misc_feature (71): n=t or c
tgaatcaatcagcacgagagagtgcaagttattcagcacgcttgggggctttctttaccaaatatattccnggcttctagggattcttgggctgcaataca

SEQ ID NO: 17973 - DNA, 101 bp, rice(Oryza sativa)
  misc_feature (71): n=t or c
ttccctggattatcaccagctatttcactgccagttcaaagtggcaggatgcaagaaaatgaacaagctantgcaccaaattttgttgaggaaaacattag

SEQ ID NO: 17974 - DNA, 101 bp, rice(Oryza sativa)
  misc_feature (71): n=t or c
gattacttgggcctgccgtcatcgacggcttcaacatgccggtgagctttcagcctacaataaacggagtngctagaaatatggcgccatatgctactgtc

SEQ ID NO: 17975 - DNA, 101 bp, rice(Oryza sativa)
  misc_feature (71): n=a or g
gtccaagttgaaggcttctatcaaacacctaactaagttgacaaaatctctgaagccgatccctggcactnatgcggccgacgccaagatgatagatgaag

SEQ ID NO: 17976 - DNA, 101 bp, rice(Oryza sativa)
  misc_feature (71): n=a or g
acgaattgcgtttgcatttggcaattcgcatgcacatgtcatgtgtgaggccgggagaccatcacaggagnaggaggaggtactactacaactacaactct

SEQ ID NO: 17977 - DNA, 101 bp, rice(Oryza sativa)
  misc_feature (71): n=t or g
agcagttcaaaacacactccaaaacataaaataagttgacatgttgctgaatgaatacacagaaattcttnagtcaaaatcctcctcctcctcttctccgt

SEQ ID NO: 17978 - DNA, 101 bp, rice(Oryza sativa)
  misc_feature (71): n=a or g
aaacttgacctcgttgctcacaggttcaacagaggagacctcaggttcatcaagagatgaaaataccatanggtcaatagaggggatttcaggtccatcaa

SEQ ID NO: 17979 - DNA, 101 bp, rice(Oryza sativa)
  misc_feature (71): n=a or g
gtaaagtttagacctcttgttattaaactcagtccaagccatgctcaatgcttcagcaaattgggtggcancccagttctgaggaatccttttggaatcaa

SEQ ID NO: 17980 - DNA, 101 bp, rice(Oryza sativa)
  misc_feature (71): n=a or c
aataatattatcacaagcaatctttcccccgtgaattatcgcaagagtttatttatagttgtacccctttnaagaaatcatgatattgtaaccttaagaac

SEQ ID NO: 17981 - DNA, 101 bp, rice(Oryza sativa)
  misc_feature (71): n=t or c
cggttggtgcctttgcaaggaaggatgatcacggcggaaggaagagcgactcttactaaatatgtcctcanggtgtaactaatctactatctaacagcttt

SEQ ID NO: 17982 - DNA, 101 bp, rice(Oryza sativa)
  misc_feature (71): n=t or c
cagtagaaaattcaacccatttcccgttagaaaaatctacccgaggccggtctgaccgctgaggtacctgnggtctgaccgaaggcttaccgccggtctga

SEQ ID NO: 17983 - DNA, 101 bp, rice(Oryza sativa)
  misc_feature (71): n=t or c
acactggacagaccaaaagcacacttcttgggtttgatcaccagattgtttgccttcagcacttgcagtancagcctgatatgttctttatgctcttccct

SEQ ID NO: 17984 - DNA, 101 bp, rice(Oryza sativa)
  misc_feature (71): n=t or c
gtcaccgtagctgatgaacggcggcatggacgcacaagaagaagaccaaaagggtaaaatcgaatctgtancaaatttctccacctaaacaacccccgaac

SEQ ID NO: 17985 - DNA, 101 bp, rice(Oryza sativa)
  misc_feature (71): n=t or c
gtcttcttgagtgatcacgtggaatccagggatctctccacacgcagatagacttcccattaccaactctncatatgatcccttttttcaataactccagc

SEQ ID NO: 17986 - DNA, 101 bp, rice(Oryza sativa)
  misc_feature (71): n=t or c
cactttctttgtcttcagcgcgttgtcgcgcaccttggtccacgacatcatcccacacaccggtgaccatnacttggtgctccttgtgagctccgtggctt

SEQ ID NO: 17987 - DNA, 101 bp, rice(Oryza sativa)
  misc_feature (71): n=a or g
acgaaaaggatatagaaggagagggcaagagagaagaaagatccctctccctcggatagacccaccgatcngctgccatccagcggcttcgcatagactgt

SEQ ID NO: 17988 - DNA, 101 bp, rice(Oryza sativa)
  misc_feature (71): n=t or c
catttatacgaccacttataaagtccttatactaaattgtactttcctgctaagttgttgtactagaacgnttatttttcaagttattatactaaattaca

SEQ ID NO: 17989 - DNA, 101 bp, rice(Oryza sativa)
  misc_feature (71): n=a or g
gcgttgtcctgtgcggtggcggctgcggctgaagtcgccttgtcatattcagcttgtatctcttgtcttcncttggtgtcttcttcacctcgagcgtatcc

SEQ ID NO: 17990 - DNA, 101 bp, rice(Oryza sativa)
  misc_feature (71): n=t or c
gacattttgcatggcatagtcactggttatgcatgctacagtagattcagataaggacctcaacgcccaantctgctcactgctcccatcatctgcaagag

SEQ ID NO: 17991 - DNA, 101 bp, rice(Oryza sativa)
  misc_feature (71): n=a or g
tggttggcaaagaattttgtggccactgctttctcttgcactatcgagatatgcagagatgaggcgatganctgcacagggattttccttcagtggacagc

SEQ ID NO: 17992 - DNA, 101 bp, rice(Oryza sativa)
  misc_feature (71): n=t or g
aagatcaaaacctaggcatatttactcatcgtcctcgacaagcttggtacccaggcccttcaacccctctnggggaacctcagcaacagtgaccagagagt

SEQ ID NO: 17993 - DNA, 101 bp, rice(Oryza sativa)
  misc_feature (71): n=a or c
ttaggagttcaacagtggccacggcagattatgcgaaactacatacttccttaaaaaggcgaaaccaaaangtggccatgaacagaaaacattctatagta

SEQ ID NO: 17994 - DNA, 101 bp, rice(Oryza sativa)
  misc_feature (71): n=a or g
cgctcggctatttagcatgtgaccgacgggatatatatttaagtaagtgagaattattagataccacttgnaaatggttataagtggccgatggaccatat

SEQ ID NO: 17995 - DNA, 101 bp, rice(Oryza sativa)
  misc_feature (71): n=a or g
ttggtgcttcaagattttgacgagatgagttcgaggcagattttctgatgacgacttctatgattgccctngcctaggagatatgacccaaccaacgttta

SEQ ID NO: 17996 - DNA, 101 bp, rice(Oryza sativa)
  misc_feature (71): n=t or c
tgttggagtgataaatcacgcaatgaacatcgtcagtacatgtgtgattgccttacatctttgtgtgacangactgatggtctgaacgaccgccaagcagc

SEQ ID NO: 17997 - DNA, 101 bp, rice(Oryza sativa)
  misc_feature (71): n=t or c
gggacacatggagcgtagagggtgacgtagggccttcttgtagtatggcctagaagcaaggaaggcgccanggcggcgaagcttcttgtcctcgatgttga

SEQ ID NO: 17998 - DNA, 101 bp, rice(Oryza sativa)
  misc_feature (71): n=a or g
cacctggacaaatatttattcatgtgcatagccagaaataagatctttttggaatggactacaatacactncaaccaaacagggccttagagcaggtacaa

SEQ ID NO: 17999 - DNA, 101 bp, rice(Oryza sativa)
  misc_feature (71): n=a or c
caacgacaccaccggcgccggtgacgacgacatggcgtccaaggagccaagcggcgaccacgaccacgagntgaacgggaccagcgccgggggcggcgagc

SEQ ID NO: 18000 - DNA, 101 bp, rice(Oryza sativa)
  misc_feature (71): n=t or g
tcatcttccacctcctcttcatcttccaactccaactccaactccactagacgctgctcctccgaaataancttgccgctcatcatcttcaacttttcccc

SEQ ID NO: 18001 - DNA, 101 bp, rice(Oryza sativa)
  misc_feature (71): n=a or g
gcagtgatcaagtatatatgaaggtttaagaattagttggaatttcatagaaagtcgatgaaaacataaangttgcaaagataatgtaaggaatgagtcat

SEQ ID NO: 18002 - DNA, 101 bp, rice(Oryza sativa)
  misc_feature (71): n=t or c
agggtgcctttacgatgcaacattttgaccaagatctcaactttcatgccactgaggaggatcctgtgacnaaaaaggtgtctatgcaaccatgttctcaa

SEQ ID NO: 18003 - DNA, 101 bp, rice(Oryza sativa)
  misc_feature (71): n=a or g
gatgttggcgatggccacttctcgaccattacctcgccaagaactaagaatgacagcctctgcatcgccancgcagacgcgcccttctccctgccggtggt

SEQ ID NO: 18004 - DNA, 101 bp, rice(Oryza sativa)
  misc_feature (71): n=t or c
ggctctccatccttcgctccaggcttccagttccaaagctagggctttggttgcaacgaccagattcgcantaaacaggagcgccgcgcggagctccgccg

SEQ ID NO: 18005 - DNA, 101 bp, rice(Oryza sativa)
  misc_feature (71): n=t or c
tctagaaatcacacaagtttgctctcttcgcatcagttccctacacaaacttgagaagcctttcttaaggnctatttggattgttatcataccaatttttt

SEQ ID NO: 18006 - DNA, 101 bp, rice(Oryza sativa)
  misc_feature (71): n=a or g
ccagctactcaacggagggcctgaatttgctactgccgttgccattgctgctcgtggatgaggacaagcgngcggtgtcgatggtgttccgcagcatctgg

SEQ ID NO: 18007 - DNA, 101 bp, rice(Oryza sativa)
  misc_feature (71): n=t or c
acatcaagagagggattgaacaaatctccctcacaaaacttacctgaatagcgatatactccctccgtttnaaaatatttaacaccgttgactttttagta

SEQ ID NO: 18008 - DNA, 101 bp, rice(Oryza sativa)
  misc_feature (71): n=a or g
ccccccccaacccaggacacgattcggagagaagaagaagaaaccagcgcgtacgtgccgcaccttcgcanccgccgccggcggggaggggagggctccgc

SEQ ID NO: 18009 - DNA, 101 bp, rice(Oryza sativa)
  misc_feature (71): n=a or g
aatttttttaaatggttaaattgtgttagataaaagtgcaatggataaaggcggtatatatcggtttgatntagcgaccgataaaaaataccctcctctaa

SEQ ID NO: 18010 - DNA, 101 bp, rice(Oryza sativa)
  misc_feature (71): n=t or c
aggacaacgatgacgacaaggtcgcaaatcccattccccaagtttcaacatcccccaaagcagataaattntgcaagaaaccaagtaatagttgatcgatt

SEQ ID NO: 18011 - DNA, 101 bp, rice(Oryza sativa)
  misc_feature (71): n=a or g
cctagttgtccatgtatactccaccttgtgtgttttgacttttgacgtggtttaggatccaaacccacccncccggttggtcggccaggatagacgggttg

SEQ ID NO: 18012 - DNA, 101 bp, rice(Oryza sativa)
  misc_feature (71): n=t or c
acagtacagacgtatatgctcatatattaattatacacgtgcacgcactgctacaatgaacacatgcacangtacacgttgagcaccttcgaaaactggac

SEQ ID NO: 18013 - DNA, 101 bp, rice(Oryza sativa)
  misc_feature (71): n=a or c
gtgaagaagatcaaggcatccggatgcaacgtcctgctcatccagaaaagcatcctgcgtgattcagtcancgatctgtcgctccattatctcgcaaaggc

SEQ ID NO: 18014 - DNA, 101 bp, rice(Oryza sativa)
  misc_feature (71): n=a or c
tacttccaaaataatttatacaggcaatcaatatattttcatatgcgggtgagtaaaccatttatcaattngggcatgtactagaaattgatgattcaatt

SEQ ID NO: 18015 - DNA, 101 bp, rice(Oryza sativa)
  misc_feature (71): n=t or c
tcaggggtttacgaatatccagacgaacctttatacgaaggaactgccccacagcagtgccatccttttcngactccattcgcatgaattcacccacctct

SEQ ID NO: 18016 - DNA, 101 bp, rice(Oryza sativa)
  misc_feature (71): n=a or g
accctgctttaaccaagtgagtcttgatctttgtctcaatcttagcctctctagaacagctaagcccagtnattttatctttaacattttgagaagacact

SEQ ID NO: 18017 - DNA, 101 bp, rice(Oryza sativa)
  misc_feature (71): n=a or g
cttgcaaagaaggcatcaatctagctctacaatgggctctgctgccgctcattatggagtcggattgtttngtcgctatcaatatgatccagtcaccaggg

SEQ ID NO: 18018 - DNA, 101 bp, rice(Oryza sativa)
  misc_feature (71): n=a or c
cacaggggccaaaatgctccaagaacagatctacagttcttcagacaatttgtttttttgccaggtcggcnaaaggctggccgaccaatttcattaagagt

SEQ ID NO: 18019 - DNA, 101 bp, rice(Oryza sativa)
  misc_feature (71): n=t or g
cgatattgctgcgccatcagcctcatccgccgacagcattgttgtcgcatcacctggcagctgctcagttntagcctgtgtgactgctcccaaggcaggct

SEQ ID NO: 18020 - DNA, 101 bp, rice(Oryza sativa)
  misc_feature (71): n=t or c
tgtatttagaaagttggatcactgcatccttactaatttatatgtcacacaaccaggagctccatagtgcnagatcctcatttgagcaagctcgtttcaac

SEQ ID NO: 18021 - DNA, 101 bp, rice(Oryza sativa)
  misc_feature (71): n=a or g
gcattaaaccgctaaggacactggagtttaaaaacaaacaccaaccagtcagaaaaaggcctttaggtctnggaggcttagggaagtgaactcctacggta

SEQ ID NO: 18022 - DNA, 101 bp, rice(Oryza sativa)
  misc_feature (71): n=t or c
ttttttcactgttctatctgttctatttaaaatgtgactcggtagtttattgcatctggtgtagtaaggcnattctcaacccaataattaggatagtgtcc

SEQ ID NO: 18023 - DNA, 101 bp, rice(Oryza sativa)
  misc_feature (71): n=t or c
gaccaaatcccaaccaagtttatttccgtcgacaccccaaaaaaaaaaaatccccacccgatttctctctnttttttttcctcctcttccgcgagctcttc

SEQ ID NO: 18024 - DNA, 101 bp, rice(Oryza sativa)
  misc_feature (71): n=a or g
caaaggcatgatcatatcaagcaaataagagaggcgtgtcctaaacttgcgtcttctttgccaactttggntggagattcaccaatagaattcactagttc

SEQ ID NO: 18025 - DNA, 101 bp, rice(Oryza sativa)
  misc_feature (71): n=t or c
tccacccatcatttatgcaacattcaatatatattcatacatatattttacagcaaagcacgagacatcanttaggctgtgtttgaggggaggagatatag

SEQ ID NO: 18026 - DNA, 101 bp, rice(Oryza sativa)
  misc_feature (71): n=t or g
acaaggagagcatctaccagacagcatctacatggtgtgaaatccatgcaataattatttttttcgctggnccggcgaaagccggccggggtatatattaa

SEQ ID NO: 18027 - DNA, 101 bp, rice(Oryza sativa)
  misc_feature (71): n=t or g
tggaccgctttccattttatgtaccacatatatagcccggaaaatatgcagtatgcaaatcacatatgtantggaaatttaaaaactacagttggattgag

SEQ ID NO: 18028 - DNA, 101 bp, rice(Oryza sativa)
  misc_feature (71): n=a or g
tggcggcaagcttcaagaagcccatctcgaaaccaaagtaccgcagaaggaatgcccttatgggttcgccngtgtccagcatgccatcccgatcccctaac

SEQ ID NO: 18029 - DNA, 101 bp, rice(Oryza sativa)
  misc_feature (71): n=t or c
ggtttatccttcattctttgttgtgatactgggtctgaaaattgcatatctaacctatcgcttatactccntccattccataatataagtcacaaccactt

SEQ ID NO: 18030 - DNA, 101 bp, rice(Oryza sativa)
  misc_feature (71): n=t or g
gatccgccaccacaagcacggggcagcccatttaacgactactgtggctccctcaactccctcaaccaccntgtgcttgggggcggccgaatctaccaccg

SEQ ID NO: 18031 - DNA, 101 bp, rice(Oryza sativa)
  misc_feature (71): n=t or c
aggcgcccaagcctaatcgttttcgatgaatttagatcgtgaaaatgatgagaaatgatgatttagcatgnttatatgttgagctttaaaatgtaataatt

SEQ ID NO: 18032 - DNA, 101 bp, rice(Oryza sativa)
  misc_feature (71): n=a or g
acgttgaccgccagcgaaaaagatattcgagcgaaaaaaagaaaattgaaaatccgtttcccgaccaccangaaaaattgattttggagaaaaaaaaacat

SEQ ID NO: 18033 - DNA, 101 bp, rice(Oryza sativa)
  misc_feature (71): n=a or g
acttaacatgcattgagccagatcatctagaaattagtaaaatttggatcccgttcatacattgatcttantcatccttttatcatatgcgtttagaaccc

SEQ ID NO: 18034 - DNA, 101 bp, rice(Oryza sativa)
  misc_feature (71): n=t or c
gctctctctctctctctctctctctctctatctctcgtaaatcaccaagtcagagctccgattccgctctncggagatccaggacgagcaggtgcctccgg

SEQ ID NO: 18035 - DNA, 101 bp, rice(Oryza sativa)
  misc_feature (71): n=t or c
aattttgcagaaggcaacaagagaggtgatgagtggcgccatggcatcaggaaagggtaagcccatccagngctcctgaacgtggcctccacctgcatgtt

SEQ ID NO: 18036 - DNA, 101 bp, rice(Oryza sativa)
  misc_feature (71): n=a or c
gttcttcgcgttgcacctaactgttcccttctcattcgccattgatctcgcttttcggtttgtttctctcntttgagagcacccgcaatggtaaaataagg

SEQ ID NO: 18037 - DNA, 101 bp, rice(Oryza sativa)
  misc_feature (71): n=t or c
cttctagctgctgcagcttcttccagaattagaagctccccccaaacagtccagctgctgcagcttcttcnagaatcagaagctccccccaaacagtccag

SEQ ID NO: 18038 - DNA, 101 bp, rice(Oryza sativa)
  misc_feature (71): n=t or g
ctcgccttggtttcggccagcaccaacgtgccaaagcctcgtgattcgtgttgttaactgttaactaatcngattatatagtactccctccggttcaagat

SEQ ID NO: 18039 - DNA, 101 bp, rice(Oryza sativa)
  misc_feature (71): n=t or c
tcccacctcctctcctctcctctcctcctcctcttcgcgtcgaatcctcctccgagaagaggagagtacangaatcctagcgcgaggatctcgcaggtagc

SEQ ID NO: 18040 - DNA, 101 bp, rice(Oryza sativa)
  misc_feature (71): n=t or g
attactactaataaagaactcaccatcacggttgttgtaaacaatcacccgattttcagatgagaaacatntacactgcaagacatgggagacaactaata

SEQ ID NO: 18041 - DNA, 101 bp, rice(Oryza sativa)
  misc_feature (71): n=t or c
atcgacgacgaactataacaccaaagcattctggtgccatctttatctcacaaagcaaagcaggcgaaganctggaaagcgtagaggaacaaactcaaata

SEQ ID NO: 18042 - DNA, 101 bp, rice(Oryza sativa)
  misc_feature (71): n=t or c
tcttcggccgtgagtccctcggcaaggtccatcttcggcgaagcttgtatacttcatgccagggctttcgncatgtggctttcacccatgtagtctcctcg

SEQ ID NO: 18043 - DNA, 101 bp, rice(Oryza sativa)
  misc_feature (71): n=t or c
cgccagcaggtagtccagcaatggcttcttgttgtcggtcagcttggaagacatgaatctggagaccaagngcgcgcctttgccgatggaggagggcagcg

SEQ ID NO: 18044 - DNA, 101 bp, rice(Oryza sativa)
  misc_feature (71): n=a or c
gacatgttttgtcacaccaatacttgtggcattatagggttattttgcaatgccagctttcttggcgtgancaaaaggtttagatttgaaaataaaatttg

SEQ ID NO: 18045 - DNA, 101 bp, rice(Oryza sativa)
  misc_feature (71): n=t or c
acatggttgttcagaaaaaggattagcaaaatgcaacatttggtgtgcccattgacacacaagagcagggngatcattctttcatgcatctaactactata

SEQ ID NO: 18046 - DNA, 101 bp, rice(Oryza sativa)
  misc_feature (71): n=a or c
acacttgcagaatatacagaaaggcacagcatataatacctaggaagaagtctcacatggtttctcaactncagtcaaaaatagaacttgtctctcaacta

SEQ ID NO: 18047 - DNA, 101 bp, rice(Oryza sativa)
  misc_feature (71): n=a or c
gccttatgcctgatagagatgacttcccaatcagtgacctttacaccgtgatgggtgccatatctgacacngatgaggtttgccgcccgattgagatgtgg

SEQ ID NO: 18048 - DNA, 101 bp, rice(Oryza sativa)
  misc_feature (71): n=a or c
cacaagcaggtccaaacaggttttctaatatatgatatacccacccagccaattggatagcaatgtggcanaatcgttctcacgtgtatgcctcgtaggac

SEQ ID NO: 18049 - DNA, 101 bp, rice(Oryza sativa)
  misc_feature (71): n=a or g
ctccccctgatttggaccggccccctcatctcatactcaaaattctgtgtgctctttggatgaatttgctnctaattctataatactgccctctgctttga

SEQ ID NO: 18050 - DNA, 101 bp, rice(Oryza sativa)
  misc_feature (71): n=t or c
ctgcttgaaggcaaactcacaagaaaaatctccaacaggagccgtagacactcgagcacctgcttcacatnattgacgggtacgcaagggacgaagaggat

SEQ ID NO: 18051 - DNA, 101 bp, rice(Oryza sativa)
  misc_feature (71): n=a or g
atatattaccggtgctgacatatttgtggcattggatttttctgggctgtgaccacgcatgaacgcggctntggcacctcgtcgccctagtccgtttccca

SEQ ID NO: 18052 - DNA, 101 bp, rice(Oryza sativa)
  misc_feature (71): n=t or g
ggcgcgacgccggcgccttcagcttgagcaccttgatcgccatggtgaagttgtggatgaagtgtaggtantcgtgtcgacagaaggcgtgggtgaagtgg

SEQ ID NO: 18053 - DNA, 101 bp, rice(Oryza sativa)
  misc_feature (71): n=t or c
gaactaatcggaaaatgtccactccaggggtcgagtttcattcacacatttaactacaaaatagggtatanaatatcctctaacatttaaaatcggtgtaa

SEQ ID NO: 18054 - DNA, 101 bp, rice(Oryza sativa)
  misc_feature (71): n=t or c
tatatataatgtgtgaagagtgtacgtaccgtgtacggcgtacaaggacgaagcatgctctccaaccacancatcatttcttcatttttctatctgtaaaa

SEQ ID NO: 18055 - DNA, 101 bp, rice(Oryza sativa)
  misc_feature (71): n=t or g
acctttgtaaatacttcatcttgccaatcccaggaatattggaacagagttcttttctagcatttaagagncataaattgactagatgattgatgtctttt

SEQ ID NO: 18056 - DNA, 101 bp, rice(Oryza sativa)
  misc_feature (71): n=t or c
tattaattgatgtcacatggtgacgaagcagaacttctttcaaacatattgcactcttttagtcatgaganagaaggcccaaaatatcttcttttcccttc

SEQ ID NO: 18057 - DNA, 101 bp, rice(Oryza sativa)
  misc_feature (71): n=t or c
gaacaaataataataaaaaaactatgtcatcgtgcacgtagcatgctaagtaggtaagaccacgatcaaangagtcttttgaccggaatgatacattaaac

SEQ ID NO: 18058 - DNA, 101 bp, rice(Oryza sativa)
  misc_feature (71): n=t or c
tgctaacattatttggatccgccttttcttttttgcagataggtttgcagatgtggagctggatgcgttgngctcttcaatcactgctctgagtgcgagga

SEQ ID NO: 18059 - DNA, 101 bp, rice(Oryza sativa)
  misc_feature (71): n=a or g
gataacaataactttttgggacaaaaatactaagaggtatgtgcagagatagttctttgcgctgcttgatncatttgatatgtactgggagatgaggaggc

SEQ ID NO: 18060 - DNA, 101 bp, rice(Oryza sativa)
  misc_feature (71): n=a or g
tggtacacaagctttggtgcgcttagcaaaaaaaaatcgccaagaaattccttctcaacaggaacgatgtngtccctgacttcctcgggtcgcgtgcccta

SEQ ID NO: 18061 - DNA, 101 bp, rice(Oryza sativa)
  misc_feature (71): n=a or g
aagcaagtaattttgcattgttgctattaggatgctttgagacaactttggaggttagcataccccaaccntgacattcctccactgaaatcagaactatg

SEQ ID NO: 18062 - DNA, 101 bp, rice(Oryza sativa)
  misc_feature (71): n=t or g
ttctgcattttcattaggcacatagggttcatgaagagtagtcaaaccaacactatccatttcaagataantaacagtggatggtagtgttggtacatttc

SEQ ID NO: 18063 - DNA, 101 bp, rice(Oryza sativa)
  misc_feature (71): n=t or c
tttgtctgagaaggatcgcggcacgaccaaatctttgaaactgagtacgacgtcggaacgcgtaagaattnactaatttcaaacaagttaagtgatgataa

SEQ ID NO: 18064 - DNA, 101 bp, rice(Oryza sativa)
  misc_feature (71): n=a or g
gctaaactaggggcagtaacgcggtagttgtactcgatcatatcgatccatggctgcggtggcgaatggcngtgctgcgccggagtggcgggtgacggtgc

SEQ ID NO: 18065 - DNA, 101 bp, rice(Oryza sativa)
  misc_feature (71): n=a or c
taagtcttgttctcgactactctgagaggatcaccaacccaacccacaatactgtgatctgtgctgcaaanaatagttttatccttagcatcgcctataac

SEQ ID NO: 18066 - DNA, 101 bp, rice(Oryza sativa)
  misc_feature (71): n=t or c
gtgaggttgtagtattcagtcaaggcggcggaatgattttgttcttttttaagctcggcattcagacgctngatctcggccttcgcctcgctccccttctc

SEQ ID NO: 18067 - DNA, 101 bp, rice(Oryza sativa)
  misc_feature (71): n=t or c
ttcaagattaacctttcacttatagagatatatcggggagaacttgccatatttgcaacaaaaaatgtctncgtaaaaaatacgaaatgaataatcctatg

SEQ ID NO: 18068 - DNA, 101 bp, rice(Oryza sativa)
  misc_feature (71): n=a or g
accatttatttgtaattcactacatatatattgacatgtttttttccctacagagtatgcaaccgcgcagntaaatgagaaggtggacgtgtacagctttg

SEQ ID NO: 18069 - DNA, 101 bp, rice(Oryza sativa)
  misc_feature (71): n=t or c
gctgacttggtaaaaaaggggagaagatcaggagctttatccctcaccaaagaaaccgcagcctggtaacnatcactagccttgctacctggtaccaaagc

SEQ ID NO: 18070 - DNA, 101 bp, rice(Oryza sativa)
  misc_feature (71): n=a or c
ggtatacaggcatatgcctgtagctcaactccaaggatggcgaaacctcgttccatggttggtccatgtcncagagcacattttctaggacctccaaccag

SEQ ID NO: 18071 - DNA, 101 bp, rice(Oryza sativa)
  misc_feature (71): n=a or g
gtcagatataatcagattcgattttttttgtcgatttctttttcacgctttttttcacgggtggacgacgnaaacactttttaatttttaagtagtagaga

SEQ ID NO: 18072 - DNA, 101 bp, rice(Oryza sativa)
  misc_feature (71): n=t or g
tatctagaacaaatctctctgtccttgctattccacaacctagtaccatattaggtggtgtttgaatccanagatttaactttagtctctatatttagaca

SEQ ID NO: 18073 - DNA, 101 bp, rice(Oryza sativa)
  misc_feature (71): n=t or c
agtgtgggaggaggccgatcaagcgcaggagctcctcaagcagcggctgcacagcaagctcttcccgccgntgccctgacgggatacgaagggccgccatc

SEQ ID NO: 18074 - DNA, 101 bp, rice(Oryza sativa)
  misc_feature (71): n=t or c
tgcattctgatgttatgccctttcctggcattcccatctgcaatgagaacatcatctatccatgagacaanattgtaggctaaactttccagcaccctcga

SEQ ID NO: 18075 - DNA, 101 bp, rice(Oryza sativa)
  misc_feature (71): n=t or c
aatcccccatttcagctgctcgacttacatctttcctgtttgtgtaacagtaccatgggcgtggaaatggntttattcctatagcagagtatggactggaa

SEQ ID NO: 18076 - DNA, 101 bp, rice(Oryza sativa)
  misc_feature (71): n=t or c
catacccaattgtacacacctaagggagtacctgaggtggttgctgaggtggttctggagggggcgcagcnatggttactgcgaggtctaccatggagcta

SEQ ID NO: 18077 - DNA, 101 bp, rice(Oryza sativa)
  misc_feature (71): n=a or g
tttgttgctggtaccaatcctatttgtgcgtatatacttgtgaaatgagtgtacaatgggaggggtatggnagggatcaaagcaaaaaagcgaaaattcaa

SEQ ID NO: 18078 - DNA, 101 bp, rice(Oryza sativa)
  misc_feature (71): n=a or g
gcacaaggagaggaatgatctcgagcgaatctacaacagccgcctcatggtgcaacacactaggaactgcntgacactgccgcatcgcaacccgatgctgg

SEQ ID NO: 18079 - DNA, 101 bp, rice(Oryza sativa)
  misc_feature (71): n=a or c
cgcacaaacactggtctgaaatgggcccacgtgtaagtttcagtactctcgattattagtagttctgttcnccgagtcattaatcaaacccccacaagagg

SEQ ID NO: 18080 - DNA, 101 bp, rice(Oryza sativa)
  misc_feature (71): n=t or g
gtcaaaatttgtaggtaaattccttattataacctgtcattttgtagctgatacctgatgcaattttattntagttttcttaattaatctccatgaactta

SEQ ID NO: 18081 - DNA, 101 bp, rice(Oryza sativa)
  misc_feature (71): n=a or g
taagtgctcttttgctcagcaatacctggagtacttagggcacattattgggatcgaaggagtggcaactnatccagccaaaattctggcagtccagcaat

SEQ ID NO: 18082 - DNA, 101 bp, rice(Oryza sativa)
  misc_feature (71): n=a or g
ggccctgaaagacaaaggctgtctcataaacaatccctctggacctttctcatcaagcatgtggagttatnttggacctgaggtttgttcctttttatttg

SEQ ID NO: 18083 - DNA, 101 bp, rice(Oryza sativa)
  misc_feature (71): n=t or c
acatatgcaagatcgatcgaccgagccctcttgcagcgttttcatatttgttttagcttcggcttgtaaantgtaactaattttataactttttgctcagt

SEQ ID NO: 18084 - DNA, 101 bp, rice(Oryza sativa)
  misc_feature (71): n=t or c
actgatcgaggtaggattttcttcaattttataactcatcttgtcacttgacgggatcccgtccactagantttctgaagccgaaaagcagcaagtcatta

SEQ ID NO: 18085 - DNA, 101 bp, rice(Oryza sativa)
  misc_feature (71): n=t or c
tctctcatgctcaaacaagttcagggaagtgaagaaaaaacatagctgtagctgtatgtggtctcacacanaaaagaaaaaaaaacacagaaacatctgtg

SEQ ID NO: 18086 - DNA, 101 bp, rice(Oryza sativa)
  misc_feature (71): n=a or g
aaacacatttctagggaagagaatgttctagctaataatctagcgcaacaagcatccggttatcgagtcantagaggtaaattgtttatgattgaaagacc

SEQ ID NO: 18087 - DNA, 101 bp, rice(Oryza sativa)
  misc_feature (71): n=a or g
ataatgaaacacaagccatatatctaagttttgggccatgtgctcaggtttgacgactatagaccagacgnttgtcgtaaaacgatgaaccgatactagtg

SEQ ID NO: 18088 - DNA, 101 bp, rice(Oryza sativa)
  misc_feature (71): n=t or g
aaaaaggccagcggctgcacctgcctgctgcctgccgaacagacccagtccacaagctattctatttgttntaatagatactctctatttcgtgttataag

SEQ ID NO: 18089 - DNA, 101 bp, rice(Oryza sativa)
  misc_feature (71): n=a or c
aaacaaatttacttgaaggggaaatacgtagctctgatcaactgatgcccagatacatttcgatcgatatntacagacagcacaaccgcgagacataaggt

SEQ ID NO: 18090 - DNA, 101 bp, rice(Oryza sativa)
  misc_feature (71): n=t or c
aaagcacgcagacagcaacgttatgatcgtacaatttgtgttggagggtactagtagtatattaggccttnttttttcttttatggaaaagtgatatttac

SEQ ID NO: 18091 - DNA, 101 bp, rice(Oryza sativa)
  misc_feature (71): n=t or c
tcagcaagaacccacggatcatccttttgtcctagcttgctacgatccacaactgtcaggccgtagtcatngatgaatacgcctgttgtgtctctaaccca

SEQ ID NO: 18092 - DNA, 101 bp, rice(Oryza sativa)
  misc_feature (71): n=a or g
agcttggatcagggcacctcttcctgctccttgttcagcttcctcccgtcggtgagcgactcctccatctngaggatcttgttgtgcttcttcgtcctcca

SEQ ID NO: 18093 - DNA, 101 bp, rice(Oryza sativa)
  misc_feature (71): n=t or c
caaacactaccttatattgttaaaaagtgatcgttgttatgccgtcatcaccacatatcatgacgcacaangccacatatcactacaaccatcaccccaca

SEQ ID NO: 18094 - DNA, 101 bp, rice(Oryza sativa)
  misc_feature (71): n=t or c
tagagggtctgtccttatgcaaaaaaaaaaaaacacaagtataaaacgatctcatactgccactcccctcnaaataaaatgaacaaatgtagatggtctgt

SEQ ID NO: 18095 - DNA, 101 bp, rice(Oryza sativa)
  misc_feature (71): n=t or g
gcgctctgggagtttatggggatttgtgctcctggtgatccaagagtgataggaattgatggcagtggtgncaatggcaggagccccgggatttggatcgt

SEQ ID NO: 18096 - DNA, 101 bp, rice(Oryza sativa)
  misc_feature (71): n=t or g
tatttgggtggattaaagtctgatttaaattgtcaagttctcctttcagttataatttcgttttcgaattnggaatgaaattttggaacagctgtgggatt

SEQ ID NO: 18097 - DNA, 101 bp, rice(Oryza sativa)
  misc_feature (71): n=t or c
cttcttctaagcagaactaatcgtcttgactttctagaagatgggatataaaaagcaccagtttcctcttnagtacacccacctatttctaatcgtcagat

SEQ ID NO: 18098 - DNA, 101 bp, rice(Oryza sativa)
  misc_feature (71): n=a or g
taatgcagtgggttaaaatcctatccacagtattcatttaggttatgcatacttgtttggataggtccggntctacagagaaaatggattggtgcgggttg

SEQ ID NO: 18099 - DNA, 101 bp, rice(Oryza sativa)
  misc_feature (71): n=t or c
caatttgatgcttgtttgcatatgcattcttgtgctttcccgaattgttaactactgtcaagtacaatccnaacttttatttattgatgtgaaggccttta

SEQ ID NO: 18100 - DNA, 101 bp, rice(Oryza sativa)
  misc_feature (71): n=a or g
agatctccaaccaggagtccaccatgagcatgtttcgctcacacaagcagaggcacctcgattgactatcnaccttcgcacgcatgccgagcgcctcaggt

SEQ ID NO: 18101 - DNA, 101 bp, rice(Oryza sativa)
  misc_feature (71): n=a or g
atctataacaaaggcaaagattgaggttgccaatgaacgacgtgcaacggccttagaagacttgcagtcantgaagatggagctagatcaacttcaaaaag

SEQ ID NO: 18102 - DNA, 101 bp, rice(Oryza sativa)
  misc_feature (71): n=t or g
gggtatacaccttgcactctatgatatccttgtttaattggaaagtaatttttaaacacggcaagtttagntacgtgcacataggaaagaaacataattaa

SEQ ID NO: 18103 - DNA, 101 bp, rice(Oryza sativa)
  misc_feature (71): n=t or g
ttcacatctttcctttcacaagaagcatcagccgcatcttctccatttctttttctcctctgcttttgaangaactcgagaagcatcagccgcatctctac

SEQ ID NO: 18104 - DNA, 101 bp, rice(Oryza sativa)
  misc_feature (71): n=a or g
cgacgtacgagggcacgcacacgcaccccatcgagaaatccaacgacaacttcgagcacatcctcacccanatgcacatctactccggcctcacgccttca

SEQ ID NO: 18105 - DNA, 101 bp, rice(Oryza sativa)
  misc_feature (71): n=t or c
gctaaccatcgggccccttctcgtttacaatctcgtcacccttattcttttccctaacactcataacgccncctcccctcctaccaaatctagaggtttac

SEQ ID NO: 18106 - DNA, 101 bp, rice(Oryza sativa)
  misc_feature (71): n=a or g
gtcattcatggtgattggcaagtgcaatgacccaagtactggttgcaaatatagataagagtgattttacngtgcttaaaaatgtatttgatagaaccgta

SEQ ID NO: 18107 - DNA, 101 bp, rice(Oryza sativa)
  misc_feature (71): n=t or g
cggcggcggagggcagcggcggaacatacaggccgactcatcttcatccgcgaggacatggagaaagccgnaagccgggtggataaagctcaacttcgatg

SEQ ID NO: 18108 - DNA, 101 bp, rice(Oryza sativa)
  misc_feature (71): n=a or g
ccttcgtcggatggctccaacagtggcagcagttgtttatccctcgactacctcttgttcacggacatttnaggcacgtaacgatcactggcggtcaagct

SEQ ID NO: 18109 - DNA, 101 bp, rice(Oryza sativa)
  misc_feature (71): n=t or c
tgcgtagtagattagacccttgtccactgcgcggccttccgtggctgtgaacatcacccagccaaaaagcnagagcaggtacgcctccaagctccgtctaa

SEQ ID NO: 18110 - DNA, 101 bp, rice(Oryza sativa)
  misc_feature (71): n=a or c
ataaacgcaataaatttggtagaacatgaagagagccttcaactacaattcatcagttgcccgtctacatngaaccacgtagagaccaggtttatcctatt

SEQ ID NO: 18111 - DNA, 101 bp, rice(Oryza sativa)
  misc_feature (71): n=a or g
ctttagtgtcatcgtctaggtctatgtgtgaatcaacatggaggtttatgctgtaatcgtccttatcgccnatattgtcaaccccaacaatcattcttttg

SEQ ID NO: 18112 - DNA, 101 bp, rice(Oryza sativa)
  misc_feature (71): n=a or g
ccttctccccctcctgctcctgctcctcctcttcttcatcgtttcgcttagcttttctttcttcttcgtcntctcggttcactcctccgttcgatcgactt

SEQ ID NO: 18113 - DNA, 101 bp, rice(Oryza sativa)
  misc_feature (71): n=t or c
atgtatattacattattaaaacaagggtgaaaaggagtcaccgtattttgctttccatgcctagaagttancatgttattcacagaaaaaaaaagtatcta

SEQ ID NO: 18114 - DNA, 101 bp, rice(Oryza sativa)
  misc_feature (71): n=t or c
actgcagtcttggggtcttcatggctgcattgccagtttcatggcaatcaaggttgtccaaacaaaaaacntgctagttacttttagtcgtacaacatttg

SEQ ID NO: 18115 - DNA, 101 bp, rice(Oryza sativa)
  misc_feature (71): n=a or c
gagagcgatcacacgtgtgcgcagccctgcctgcgtgtgaaagatacgtgtaatgtcatatcgctcttgcngaatctatcaacttttatggggttaattaa

SEQ ID NO: 18116 - DNA, 101 bp, rice(Oryza sativa)
  misc_feature (71): n=a or g
atgctgggcttaggggatttaaagctacagacagtaatcgacaactccacgtacctcataaatacataacncatgatttaattcaaattctcagtataatg

SEQ ID NO: 18117 - DNA, 101 bp, rice(Oryza sativa)
  misc_feature (71): n=t or c
ccttctcctcttccgtgggtaaccctagagtagctcattgtatcactcatgcccctagacaataaaggcgngccgcgccactctctacctacctcttcatt

SEQ ID NO: 18118 - DNA, 101 bp, rice(Oryza sativa)
  misc_feature (71): n=a or c
tggtcttatctaatatgacatgccacgtagatttggcatgttaatgctccacgctctgccttatccatttnttgtaattttggattgtttctttggcgcag

SEQ ID NO: 18119 - DNA, 101 bp, rice(Oryza sativa)
  misc_feature (71): n=a or g
cagaattgaatccgaatcgcttgttggcagaaaccccaaaatttgcttgcccaaacttctcacactgtcantatcatgaatctgaactactgaaggcagca

SEQ ID NO: 18120 - DNA, 101 bp, rice(Oryza sativa)
  misc_feature (71): n=a or c
atatatgatcatgttggcaagattccagtctcatttctgtcatgttggcaagctgacaactggcaccctantatgttgtgttctgtctaccaaaatgtgta

SEQ ID NO: 18121 - DNA, 101 bp, rice(Oryza sativa)
  misc_feature (71): n=t or c
gctcccccaccaacctcacccttcgccggttgcttcttcatctcctcttcctccggtgaggaaagggtganggagacggcaatcgcaggtagtgagaggcg

SEQ ID NO: 18122 - DNA, 101 bp, rice(Oryza sativa)
  misc_feature (71): n=t or c
gggtcctgatgagcgatctcgccgggatctcctccattatcgcctttattcgcttctccatgacttgacgntgctcctcatcaagatcctccaatgtgatc

SEQ ID NO: 18123 - DNA, 101 bp, rice(Oryza sativa)
  misc_feature (71): n=t or c
caactagttgtttcaatttgctatgcttgtagagaagaaattgctagggcgtgatcaacaaagtcaagaanaaggcgagcacgtacatgccgcgggcgaag

SEQ ID NO: 18124 - DNA, 101 bp, rice(Oryza sativa)
  misc_feature (71): n=a or g
ggtggagaacagggcatcactatgggcatgaaagagcagcaatgaggtctccaaggagttggctgatcaantaaactcactggaagaggccaatgccagtg

SEQ ID NO: 18125 - DNA, 101 bp, rice(Oryza sativa)
  misc_feature (71): n=t or c
ggccccccaacaactgcgccaattaacgggtttgggttcgggctagatgaattgtagtaaggcgtgccgtngttgcacgcaatgcgctggggatggctctt

SEQ ID NO: 18126 - DNA, 101 bp, rice(Oryza sativa)
  misc_feature (71): n=t or c
atatgcccaaatgccactcttataaattttcattcccatttgctatccgagtctacatgtcagccttcttnccgggtccacacatgttcacaagcttaata

SEQ ID NO: 18127 - DNA, 101 bp, rice(Oryza sativa)
  misc_feature (71): n=t or g
cgattgcaaaaagctggagtgtgacggcatcccttgctctcatgtttgtgctgttcttaagtttcttggtntcggcactattcctcattgttgtgttatgg

SEQ ID NO: 18128 - DNA, 101 bp, rice(Oryza sativa)
  misc_feature (71): n=a or g
tataagatacgctaattcagacatatccttcttcttggactggatcatttgtattgccaccaaacaatccntttcgagcacaaacggcaggagggtccatt

SEQ ID NO: 18129 - DNA, 101 bp, rice(Oryza sativa)
  misc_feature (71): n=t or c
atgcccaagcttgactcagcggaggtgcttgggggacgtcaggttgggttagccaaagtggaacatgtcanagacaaccgatggcatggcaatgcccgcct

SEQ ID NO: 18130 - DNA, 101 bp, rice(Oryza sativa)
  misc_feature (71): n=t or c
tctcaactgacaacttctcgaaattttgagttgctacgtaacgtgaacatgtggccacatgggcacgcctngtgttgacgcgtgcctgaaattttctatac

SEQ ID NO: 18131 - DNA, 101 bp, rice(Oryza sativa)
  misc_feature (71): n=t or c
ttgctatggggatttaagagaaacaaaactgcacatcttctttgcttgtccttatagcctccgatgttggnagcttttgggtttccattggtttctcaatt

SEQ ID NO: 18132 - DNA, 101 bp, rice(Oryza sativa)
  misc_feature (71): n=t or c
cactactattaaaaaaattaagaaataaagtgggggggggtccacatatcatctttctcttagagcatctncaacagtctctccaaatctaactctctaaa

SEQ ID NO: 18133 - DNA, 101 bp, rice(Oryza sativa)
  misc_feature (71): n=a or g
attttccggtggatgtggggggagagagagagagagcgacagcggctggatttgaaaattgaatcccgctnattttgaggggacgacgtgcagcgagagta

SEQ ID NO: 18134 - DNA, 101 bp, rice(Oryza sativa)
  misc_feature (71): n=t or c
tcagcagctgtgaagtttgcatcatcacttccaagaaaatgtccctggctatcaacagcaccgtttgcagngctattaaacggctttctgtgcttctccca

SEQ ID NO: 18135 - DNA, 101 bp, rice(Oryza sativa)
  misc_feature (71): n=a or c
tcctccaagaagaattgtgctatgcccccccccccgatatccctatagagcgaaagagctgcctggtgatncctaggttgcagcacgtccggtcgttaact

SEQ ID NO: 18136 - DNA, 101 bp, rice(Oryza sativa)
  misc_feature (71): n=t or g
agctccaacacctgcgttccgggcagacaaggattaattatggtttgttgcaaggcgagacagccagccanccatccatccatccctacggagaagaggac

SEQ ID NO: 18137 - DNA, 101 bp, rice(Oryza sativa)
  misc_feature (71): n=t or c
ataagtttcaggaaattgagagagatctattcgtttttaaggaaaaaaaaaggcgtgtggtttaggcgccntcgacggcgcggcgggatcgggagaagccg

SEQ ID NO: 18138 - DNA, 101 bp, rice(Oryza sativa)
  misc_feature (71): n=t or c
aaaatttaagacggggaaaaaaaatattaaccgaggatggtttacttgtgggattggtcgaggcggcgganggtgtagccgaacgcggcggagtagaaggc

SEQ ID NO: 18139 - DNA, 101 bp, rice(Oryza sativa)
  misc_feature (71): n=a or g
ccaccccacaaacgaactcagcctaagccgagttgttagcattgtccattaaaatctaatagtgtggcccncgcaattacatggctagcgcctatataact

SEQ ID NO: 18140 - DNA, 101 bp, rice(Oryza sativa)
  misc_feature (71): n=t or g
ctgagtacatggtagtttcttatgccgttacagttagttgtactaggaactgagtagcaccctgaaagaanctggaggatgcatgagcggcggcaagaaca

SEQ ID NO: 18141 - DNA, 101 bp, rice(Oryza sativa)
  misc_feature (71): n=a or g
agcaagacagttgatagaatagagaaggcaactgcaacttcagctacaacatctggtgtacttatggatcnttcatatacatattctactctagagaaaaa

SEQ ID NO: 18142 - DNA, 101 bp, rice(Oryza sativa)
  misc_feature (71): n=t or c
ctatagaatcataatacccaaggttatatatcacgtgccaaaattattttggtttttatacaacttggatnataatagatggggttttatgaaatttactc

SEQ ID NO: 18143 - DNA, 101 bp, rice(Oryza sativa)
  misc_feature (71): n=a or g
cgcgccgcgcacaaggaatgagtgcttgatctgccaagcacgagtaaatatgggtgcttgatctgccatgnctgtgtttagtttctttcgaagttggaagt

SEQ ID NO: 18144 - DNA, 101 bp, rice(Oryza sativa)
  misc_feature (71): n=t or c
atcttctcagtggcacagttgatgactcgaatgattccagtgcttcctgcagctactaacaatggattgcnatcaatgtcgcaagcccagctcacagtgaa

SEQ ID NO: 18145 - DNA, 101 bp, rice(Oryza sativa)
  misc_feature (71): n=t or g
aattttggtaaaaagaaaagaaaaagaaaagaaaaggaaaaccctcttcttcgcccgccgcctgcgtgtcncgccgatctccatcaccgcgagcagcggca

SEQ ID NO: 18146 - DNA, 101 bp, rice(Oryza sativa)
  misc_feature (71): n=t or c
tgtgtgcgaatgtgtgatcagtgagtcagtgacatgtattgtagtagtatatacgtgacatctcttcatgnccgcgcgtgccatggtcgacacaatatagc

SEQ ID NO: 18147 - DNA, 101 bp, rice(Oryza sativa)
  misc_feature (71): n=t or c
attcaagtataatgtgtagtactagtactaatgcttatttgttttcttcaattccaaaccttaaatttctngcttttcaaactgttaaatgatgtatttgt

SEQ ID NO: 18148 - DNA, 101 bp, rice(Oryza sativa)
  misc_feature (71): n=t or c
tctcacaaggcacgatttcatgcatgagcatattcatgggctgttcccaaatctcggcaagtcacactaanaagggccaaatcgattgcattcagcagaca

SEQ ID NO: 18149 - DNA, 101 bp, rice(Oryza sativa)
  misc_feature (71): n=a or c
cataatacatactcaattcatatagatagataaaaataggatactggacaactttcgaagacttggacggnatcagttgcaagaagcattctgcaggacaa

SEQ ID NO: 18150 - DNA, 101 bp, rice(Oryza sativa)
  misc_feature (71): n=a or c
ccataaaggaaatatgcggcctagagcaaaaacaaaaatcttactttcaaccccggcagggagaacaaggnggggaagcccaagaacttcttcgccctcga

SEQ ID NO: 18151 - DNA, 101 bp, rice(Oryza sativa)
  misc_feature (71): n=a or g
tattttcatgctaccgagaagatatcgtgagatgaaacctcaaggtatcaccaagatatcttactatgtcngaaggtatcttccattaaactaggtggtat

SEQ ID NO: 18152 - DNA, 101 bp, rice(Oryza sativa)
  misc_feature (71): n=a or g
agggattatcaatgcaattagcattaggtatgctacaaatgagggtgtgcacgtgttttcatcctacaaanctctacgagatttatcttttactggctaaa

SEQ ID NO: 18153 - DNA, 101 bp, rice(Oryza sativa)
  misc_feature (71): n=t or g
cacgtaccaccgcgcaccgaattgaagacgaaaaagaaaaattcggacgatcgagagtaccggcacacgancgctaccagacaagataaagttttccgtgc

SEQ ID NO: 18154 - DNA, 101 bp, rice(Oryza sativa)
  misc_feature (71): n=a or g
agtagcggataatatatgacgaatgcaccctcaatctagctatatggatgttagcttgggtgagatcgcanaccggaccaaaccaaatcattggtctacac

SEQ ID NO: 18155 - DNA, 101 bp, rice(Oryza sativa)
  misc_feature (71): n=t or g
ttaatttttttgcgttggtgtgtgttgttcaatccaaatccctataggaggcgagagagagagagagaganagatagagagagagagagagagagagagag

SEQ ID NO: 18156 - DNA, 101 bp, rice(Oryza sativa)
  misc_feature (71): n=a or g
ctaaacactggacgtgccctaaggcatgctaagcaataacaagaccttaattctagatgatgcctccaagnagactgggatgctgaaagcaccgccgcagc

SEQ ID NO: 18157 - DNA, 101 bp, rice(Oryza sativa)
  misc_feature (71): n=a or c
cttcgtcgcaggagggcacggcccaagcaaagtagctgcctttggcccatgctccagtttgatcctccttncacaactaaacaaataaaggaaatgcatta

SEQ ID NO: 18158 - DNA, 101 bp, rice(Oryza sativa)
  misc_feature (71): n=a or g
tctcctgggtactatgatggcaggtactggaccatatggaaactgcccatgttcggctgcagcgacaacanccaggtgatcaaggagctcgaggaggccaa

SEQ ID NO: 18159 - DNA, 101 bp, rice(Oryza sativa)
  misc_feature (71): n=a or g
ataatcccaagctaaaagaaacagggcctaagtttatagtcaaactgtttcaagatcgaaagccgatacanccccgcgtcaggtgctgagtacggccggat

SEQ ID NO: 18160 - DNA, 101 bp, rice(Oryza sativa)
  misc_feature (71): n=a or g
taaccctgacgccgatgataagggaaaccttgttccaccctccttggtctgtaacggcttgttctgtaacngcatgtacttttcttttaaagttcacttct

SEQ ID NO: 18161 - DNA, 101 bp, rice(Oryza sativa)
  misc_feature (71): n=t or c
gtcccatcatgaaagctttatatgatatcagggagaagtgggtgcctgcgttcttcaggaaggactactgngggaggatgacgtccacgcagcgcagtgag

SEQ ID NO: 18162 - DNA, 101 bp, rice(Oryza sativa)
  misc_feature (71): n=a or c
acttatgattatacgatggcccaatatacatatatgatttgatatttgggcccataaataaggccggaagncactactccataaattccctggttgcatca

SEQ ID NO: 18163 - DNA, 101 bp, rice(Oryza sativa)
  misc_feature (71): n=a or g
cacctcttgggtgcctccgttggatcccaagctgtctcccatgtccctgggagtatacacaacagtgaacntgccagaccagtcaggatcttgtctgccag

SEQ ID NO: 18164 - DNA, 101 bp, rice(Oryza sativa)
  misc_feature (71): n=a or g
ttggatttgccgcagattttcttcagttcagagggcctcaacaatcggcaaattctctaaaatccttatcnccaacggtgacatccatcctgtctcacaat

SEQ ID NO: 18165 - DNA, 101 bp, rice(Oryza sativa)
  misc_feature (71): n=t or c
tgagctgctaccttgtgcacttgtccatggacattgccagcgctggccccttttgctcgcttccaccactngatcccctcccccgctttgggccatcacta

SEQ ID NO: 18166 - DNA, 101 bp, rice(Oryza sativa)
  misc_feature (71): n=a or g
gctcttatgcgtggggcgtatgagattgatatcagtaccgaaccagtccactctacaactaaaatattggnatccaaattttaggtgtctcttggagtatg

SEQ ID NO: 18167 - DNA, 101 bp, rice(Oryza sativa)
  misc_feature (71): n=a or g
gacggcgatggcgagttggcgactgcctataaggaagggcgtaccgcccttgaccagtgaccgctacctcngcttttatccgcttcgtgggcaaccgctcg

SEQ ID NO: 18168 - DNA, 101 bp, rice(Oryza sativa)
  misc_feature (71): n=t or c
ccaaataatgacatctcatcacatccaagttcatctcaagcgaacaaccaaacatctgcacatatatctcnaaagccagatcaaactcaggctgaacgaga

SEQ ID NO: 18169 - DNA, 101 bp, rice(Oryza sativa)
  misc_feature (71): n=t or c
aagcgtgttttggtgaaggctgaaaatgcccatttgatataatcgcattttgagttatccggagcccctcnacctcttgcctcccaaacctctattcgttg

SEQ ID NO: 18170 - DNA, 101 bp, rice(Oryza sativa)
  misc_feature (71): n=t or c
gtggtggatccggccgtggcggatccagtggtggctgtggcatccgtgatgacgatgatgaccttgacggngatggcatccatgaccacaacctgcttgct

SEQ ID NO: 18171 - DNA, 101 bp, rice(Oryza sativa)
  misc_feature (71): n=t or c
ttcctcaactacaacggaaacttcggtcctacctccgacttcatcctcttcgtcttcgagcgcaacagctncctcaacctctacctctccattgttctccc

SEQ ID NO: 18172 - DNA, 101 bp, rice(Oryza sativa)
  misc_feature (71): n=a or c
tgagaaacaagtggtgacagtgtgccttcgcgaaaggaaattgcgagcatttgttcgtcagatgcccctanatggctacatcgctcacatttggcgcctct

SEQ ID NO: 18173 - DNA, 101 bp, rice(Oryza sativa)
  misc_feature (71): n=t or c
tcatatatatatgtagcttccgttgtcaaggtttactttcagatggtgtgttcgactgttattttcgcaanagttgcggttgcagcagttcaaaattactg

SEQ ID NO: 18174 - DNA, 101 bp, rice(Oryza sativa)
  misc_feature (71): n=a or g
ggccctctcgatctccctcaacggcaaccgcgaagccctgctaactctgaattctgaataaagaattctcntacagctagttcgctgttggtcccaaccgg

SEQ ID NO: 18175 - DNA, 101 bp, rice(Oryza sativa)
  misc_feature (71): n=t or c
actgtgttgttcccgtttccgccatatatactcctctcagaccaaatcctgccattcctgttcttccttanggcccccttcgttgccgcatgtgccgttct

SEQ ID NO: 18176 - DNA, 101 bp, rice(Oryza sativa)
  misc_feature (71): n=t or c
acataagatctcaggttaaaaccacacatcctcaccactacactatcaagtgatctctacttcacaaatanaaatattgggcattttatgatttaaaaatt

SEQ ID NO: 18177 - DNA, 101 bp, rice(Oryza sativa)
  misc_feature (71): n=a or g
agagtctagaactgaacccaaaccaaccgaagcaggatatcagaaacagagcatctgctttctacagaatnttccttggaacatttatgctggagccagga

SEQ ID NO: 18178 - DNA, 101 bp, rice(Oryza sativa)
  misc_feature (71): n=a or c
gaggatacactacgattgtcatgtagatcagccttatttccaaccaaagccatgatcatatctggactacngtgtttctgaagttcctgaaaatgtaaaag

SEQ ID NO: 18179 - DNA, 101 bp, rice(Oryza sativa)
  misc_feature (71): n=t or c
tccttaataataaaaaaaaccccaaatcggacgcattttttaattattatgcttcgccatttctccgcacntgctccttctcctctccttttcctcctctt

SEQ ID NO: 18180 - DNA, 101 bp, rice(Oryza sativa)
  misc_feature (71): n=a or g
aaatttctttcagaaatgggggacctgtgggcaaataatgttggtcaacacttggttggcactcacaatgntaaagtaaggtgctctctataaaacatgta

SEQ ID NO: 18181 - DNA, 101 bp, rice(Oryza sativa)
  misc_feature (71): n=a or g
tgccgtagtttcgcaaccttgtgtggccaaaagctacagccccttaatatcgattacttcggttgggccangcatcttggacttgaggtagttgtggtgag

SEQ ID NO: 18182 - DNA, 101 bp, rice(Oryza sativa)
  misc_feature (71): n=a or g
tacatcgtccctgacataaagccaaatatgatactaccttcgtcccatttaagtgttaagtgtagttgtgngtttccgtgtccaatatttggctctccgtc

SEQ ID NO: 18183 - DNA, 101 bp, rice(Oryza sativa)
  misc_feature (71): n=a or g
aagtttctgttcaaaaaggtacatgctacagttcaacacttttcagtttttgacctgtacagcacatcgcnaacttttcaatatattatacagggctttct

SEQ ID NO: 18184 - DNA, 101 bp, rice(Oryza sativa)
  misc_feature (71): n=t or c
gggagattaaggcccacttctttttcgcacttcaaacttcaacttaccgttttccgttggtacacgctttncaaattattaaatgatgtggtttttgacaa

SEQ ID NO: 18185 - DNA, 101 bp, rice(Oryza sativa)
  misc_feature (71): n=t or c
ttggtattgtgcatcatccagccgttgagtacgcacaacggacgagaaaaaaaaaaagaaggtgatttcgntgggctggttgctcctgaacatacttttct

SEQ ID NO: 18186 - DNA, 101 bp, rice(Oryza sativa)
  misc_feature (71): n=t or g
catggcgaagaacagacattgtattgggtggcaaattccccatatggaccaggaaagtaggaaacctctangcagggttgacaatctcgataccagatcaa

SEQ ID NO: 18187 - DNA, 101 bp, rice(Oryza sativa)
  misc_feature (71): n=t or c
cgacttcgaccgcaacggcagcttctccatgtccaatttcaaggtgacatgcgtggtgtaccagccatacntcggtgtgtccggagatgttggcacgatta

SEQ ID NO: 18188 - DNA, 101 bp, rice(Oryza sativa)
  misc_feature (71): n=t or c
aaaaaacttcacaacacaggacgaagacgaaactatcaatctacaagaccgagcggcagtgatgaactgantgaaacactcacctgaaatcctgaacaagt

SEQ ID NO: 18189 - DNA, 101 bp, rice(Oryza sativa)
  misc_feature (71): n=a or g
tagggaagcatccgggcacacaaggagtacattgggatccatgaggaagcatagactgattgaaggtaacnaaatccctaaaacccatcccgccaagagac

SEQ ID NO: 18190 - DNA, 101 bp, rice(Oryza sativa)
  misc_feature (71): n=a or g
cctctaccagtccaccaagcgcatcggccaccgaatatgtcgaggtaagtactgtcacgccctgaaaatcncctaatttaataattcattctctaatgcat

SEQ ID NO: 18191 - DNA, 101 bp, rice(Oryza sativa)
  misc_feature (71): n=a or g
gccttcaagtgggcatggtttaggaaacacgtccatcaatgagttggatcagttcattaatctcaacaacnatagtaaccaaccaaattcaagtagagatg

SEQ ID NO: 18192 - DNA, 101 bp, rice(Oryza sativa)
  misc_feature (71): n=a or g
gtgattcactttaatacaatttgagatggtgcttttggtaaccgatcatacccatgcaatctcgaaatgancgtgattgtcaccgtacatatctggatcaa

SEQ ID NO: 18193 - DNA, 101 bp, rice(Oryza sativa)
  misc_feature (71): n=t or c
ccctcctcctcctccaccccaaatccctatccctatctcgatcggatcttggttattccatggtgcgttgntgattaatttgtttgaggtgagatttgagg

SEQ ID NO: 18194 - DNA, 101 bp, rice(Oryza sativa)
  misc_feature (71): n=t or c
ttccttcttgggtagttgccgaagtggtggctggagcatcactggtgtgctgaccagagcaatcaatggcnacagcggctactagggaagtagacagctta

SEQ ID NO: 18195 - DNA, 101 bp, rice(Oryza sativa)
  misc_feature (71): n=a or c
ccattcagctttataaaatctctcagcttttaccaataattgtcaagtgttcacaataactattcactgtnactgtgcgtgcgtgtctgaaaatctgcata

SEQ ID NO: 18196 - DNA, 101 bp, rice(Oryza sativa)
  misc_feature (71): n=a or g
atagcaaccctacaaatgctcctaagcctccacgtgacactataattatttctaaaaaaatcaaaagaagncaaaacatctaactgtcgatttttttaatt

SEQ ID NO: 18197 - DNA, 101 bp, rice(Oryza sativa)
  misc_feature (71): n=a or c
tgcgttagcactatcttctcttcaagatctggatgattctcttcgaccgcgattgctccggcgacctcctncacagtccgtcaaagggtttgtcctcattc

SEQ ID NO: 18198 - DNA, 101 bp, rice(Oryza sativa)
  misc_feature (71): n=a or g
tcagttaagggagtcaaagtgattttattcctatattatctcctctgctccgccggtttccgactccgacnaactgggcgcagcggagatcggagatcgcc

SEQ ID NO: 18199 - DNA, 101 bp, rice(Oryza sativa)
  misc_feature (71): n=a or g
ggggttttgattggacatgtcaggaacacatagaaatcatcgtttcttttttctctcaccgtgcatacgantcctccaatggccaattgacggtggaaatg

SEQ ID NO: 18200 - DNA, 101 bp, rice(Oryza sativa)
  misc_feature (71): n=a or g
aatccgctgctccatttttcttgcgggaagaaaatgtttctaaccttttcaaaagaacaaaaccttaagcnaagcgagcctaactcaactgattagattcc

SEQ ID NO: 18201 - DNA, 101 bp, rice(Oryza sativa)
  misc_feature (71): n=t or c
cagtgttcctcttgcactgcacgtgcttgctcctcatctttgtgcgctgcatgtatctgttcctcgtcctngtgcgccgtccgcatcggctcctcctgctg

SEQ ID NO: 18202 - DNA, 101 bp, rice(Oryza sativa)
  misc_feature (71): n=a or g
aaaaatttctctgaggtaatttctttctttctttttgaagaaccggtacaagttcgttgccaatttcattnaataaagaccgtcatttgtctattaatttt

SEQ ID NO: 18203 - DNA, 101 bp, rice(Oryza sativa)
  misc_feature (71): n=a or g
ctgcatatagcagtttccggacatgtggatatttggtcttgtcatcgtgaagtacttcactgacataatanactgggcgttgtattttgtcaccctcgaca

SEQ ID NO: 18204 - DNA, 101 bp, rice(Oryza sativa)
  misc_feature (71): n=t or c
atgcccaaaatccatagggtagatctaaaggatgagacatagataagcgataccttgaatcgaagtcaagntgacgatggtctatagtagatctgaacatc

SEQ ID NO: 18205 - DNA, 101 bp, rice(Oryza sativa)
  misc_feature (71): n=t or c
cttgtcgtctcgtattgtagtcattacacagcctttgatgcggtttcggcccacaacgtgcaggcttttcngccggtcacggcctaggctcaaacagctgc

SEQ ID NO: 18206 - DNA, 101 bp, rice(Oryza sativa)
  misc_feature (71): n=a or g
aaactcgctgctctattcacttatctgcttgcacaatctgcagtggcagcagaggtcgttcctatgaccanaggtactctaggtcaccgcgatactctcct

SEQ ID NO: 18207 - DNA, 101 bp, rice(Oryza sativa)
  misc_feature (71): n=t or c
aaaccaaaaaggattcaaaatccccaaaaaaaactgagaaaaaaatgcaaaaaaaatacctggccatgaangagatggatcaatctccaactgacagcgag

SEQ ID NO: 18208 - DNA, 101 bp, rice(Oryza sativa)
  misc_feature (71): n=t or c
ttgtcatcacagagtcgaacaaacaattacataaaaaaagggagcagatccatctgatacttgatacacanttgtgtgacgaccaaaactcatctgtttat

SEQ ID NO: 18209 - DNA, 101 bp, rice(Oryza sativa)
  misc_feature (71): n=a or g
ctgaagtcactttggccctttaaaagaataaagacacgaggtgacccggttctcgcttacattgatagcgncagccttctcgactgccgacttgtcgcaga

SEQ ID NO: 18210 - DNA, 101 bp, rice(Oryza sativa)
  misc_feature (71): n=t or g
tcattcgctattcatccatggcggccgaggtggttactagctatgccatggcttgttgctgtggtggtggnggtcgtacggcgccgccgacgacgccgacg

SEQ ID NO: 18211 - DNA, 101 bp, rice(Oryza sativa)
  misc_feature (71): n=a or g
tctgagcacacgtttggtctttcaacatatgataggcttgcatttcccggtggcccacaaggtcgagatcngagttgtcgtacagccttggtggaacgtac

SEQ ID NO: 18212 - DNA, 101 bp, rice(Oryza sativa)
  misc_feature (71): n=t or c
taatcttgaaaatccctgacaaagccatctaaatggttgatttaggaaaaacatacctccggtcgctcctngttgggtggcgacgcaaccctctatgccgt

SEQ ID NO: 18213 - DNA, 101 bp, rice(Oryza sativa)
  misc_feature (71): n=t or c
aaccttaaagcgataacactatcaaattttgatctacacatggtttttgaagggagctagcttgaagccantcatttgttccaactaaagctaataactat

SEQ ID NO: 18214 - DNA, 101 bp, rice(Oryza sativa)
  misc_feature (71): n=t or c
ggaagcaagcaggcaaacgacatggcggctctgcttttcttgtgatctgggttggaagcttctgctccttngatcttcgccatttctgaggcgttcttggg

SEQ ID NO: 18215 - DNA, 101 bp, rice(Oryza sativa)
  misc_feature (71): n=t or g
tatattacaattgacaatagaagtgcgttgagattttcgcaaggacaatacaacagatggaagattgcttngttggtttgaaaattggaagttagcattct

SEQ ID NO: 18216 - DNA, 101 bp, rice(Oryza sativa)
  misc_feature (71): n=a or g
agagcaaagagttgcacagtcgcaatcgatgttttcattgtcaccctccattctatcaccagagcacctgnttgggaatgacagatcatcgttgcgacaag

SEQ ID NO: 18217 - DNA, 101 bp, rice(Oryza sativa)
  misc_feature (71): n=a or g
taagcacatacccaattattggtaagatcttttctttctgactgagactgaagaagaagaagaaggcctgncggctgctgggtggaaattgtttttctaat

SEQ ID NO: 18218 - DNA, 101 bp, rice(Oryza sativa)
  misc_feature (71): n=t or c
taatggataatgttttaagacaacttaatacatattatcaatttttgaatgttgcattgctgtttggttgnagatctatattcaattgacatatttcattt

SEQ ID NO: 18219 - DNA, 101 bp, rice(Oryza sativa)
  misc_feature (71): n=t or c
aaaacgatggagttattaacatccaacaagtaagtactcctgctagatgaagtacagtactccctccgtcncacaatacaagggattttcagtttttgctt

SEQ ID NO: 18220 - DNA, 101 bp, rice(Oryza sativa)
  misc_feature (71): n=t or g
ggcagttctccttgccacctcggaattggttggttcaggtggtgtctcattgttagcttctttgaacgccnagtcgaggtttgtggccattgtgcgaatac

SEQ ID NO: 18221 - DNA, 101 bp, rice(Oryza sativa)
  misc_feature (71): n=a or g
gggcacttcaggatcatagttctaagccttgtgataatagcatcctttcaagtgcttggctctgctgaagnccataagacggctgtaccggcgatcttcgt

SEQ ID NO: 18222 - DNA, 101 bp, rice(Oryza sativa)
  misc_feature (71): n=t or c
atatagtccaattaaactccttcattgtcagctccagcctaacgtgggaataagcgaaacagtgtatttanaaacgaaaaataatttatgaataaaaattt

SEQ ID NO: 18223 - DNA, 101 bp, rice(Oryza sativa)
  misc_feature (71): n=a or g
cagtaactttctctcttaatccttgaccacaacgttctccaattctacatcgcatctcactctctctaccntgggcattattcttgtgtgtgtcttggggg

SEQ ID NO: 18224 - DNA, 101 bp, rice(Oryza sativa)
  misc_feature (71): n=a or g
gcaaacggtagagcgatacaataagtagaagcggaccagacattaattaggcatcccgggtcatagcccgngaaatgggatctcttgccctttatagcctg

SEQ ID NO: 18225 - DNA, 101 bp, rice(Oryza sativa)
  misc_feature (71): n=t or g
gcacgcgcgcgacaaccacctccaattctaccgctggctgtgatggagttccatgttgttacagttgatgntgttacagttgatgtgatcgagagcgagct

SEQ ID NO: 18226 - DNA, 101 bp, rice(Oryza sativa)
  misc_feature (71): n=a or g
gcttttatgcgaggtcgcaacattttggatgggttggttgtccttcatgagacgattcacgaattgcatcncaagaagcacagtgggatcattctcaagat

SEQ ID NO: 18227 - DNA, 101 bp, rice(Oryza sativa)
  misc_feature (71): n=t or g
atgagctcttggatgaatcagctggtgctaaattcttttctaaactggatcttagagctggttatcatcanattagaatggctgcaggagatgaacataaa

SEQ ID NO: 18228 - DNA, 101 bp, rice(Oryza sativa)
  misc_feature (71): n=a or c
caaagtcatcttcttgccgtgaggagacccggatactgcatattgcttcagcatcaacaggtaagaacacntggtttactctggtttcatcccaggcacca

SEQ ID NO: 18229 - DNA, 101 bp, rice(Oryza sativa)
  misc_feature (71): n=t or c
gtgtctcttaaggaattgaaaataaacaggttcgagatgaacgaatcacaggaggacatcaaacatctcangtcgctacagaaactatgtctgcatagatg

SEQ ID NO: 18230 - DNA, 101 bp, rice(Oryza sativa)
  misc_feature (71): n=a or g
tttttctctttcttcctctacgtaccctctcatcttttgttttctccgacacatagggtgacctaaacctncaggcatggctatatgtgagagcttgctaa

SEQ ID NO: 18231 - DNA, 101 bp, rice(Oryza sativa)
  misc_feature (71): n=a or g
tgaaaaatttaaagttaaactttagtttttaagatcgtactaaatttgaacacgccttagctagttggacngagagatgtatctctaccaatgcataagtt

SEQ ID NO: 18232 - DNA, 101 bp, rice(Oryza sativa)
  misc_feature (71): n=a or g
agatcatccttctcattggatagcgagatgttttggtacaccaaattccccaccctgtgctccaggttacncttctcattgtacagtctagtgttttggcg

SEQ ID NO: 18233 - DNA, 101 bp, rice(Oryza sativa)
  misc_feature (71): n=a or g
tactccatcgacatcgaccccttccgcaacgatcccttcttcaacaacaatggcttccgccccattctacncctctgagatccccgcggtaagtcgacttg

SEQ ID NO: 18234 - DNA, 101 bp, rice(Oryza sativa)
  misc_feature (71): n=a or c
caaagtaaccgaggatccattgttccttgattacataattctccattactttttcacaatcaactccaagngatattcctcctgcattttgaactctctct

SEQ ID NO: 18235 - DNA, 101 bp, rice(Oryza sativa)
  misc_feature (71): n=t or c
aatattctcctcaatcttaaatttggctttggtttgaaccgattgccttcacaatctcgtggaaatactcnttgctgattctacaaggccaattacatccc

SEQ ID NO: 18236 - DNA, 101 bp, rice(Oryza sativa)
  misc_feature (71): n=t or c
gcacccgaaagcaaacctatccaccaagacacaatgcaactattagcactacgaatccgacaataattganaacagaaattgtatttcctcttctaattca

SEQ ID NO: 18237 - DNA, 101 bp, rice(Oryza sativa)
  misc_feature (71): n=a or g
caaagattcttcagctgaaaaactgcattacttggtgcagatccaggagctaatctcttgcaaagaacaanagaaagaagatggatcataagctctttctt

SEQ ID NO: 18238 - DNA, 101 bp, rice(Oryza sativa)
  misc_feature (71): n=t or g
gactgaaggctttgcacaatataatggaagttgttcccttccatgccaaaacttttgcacaggtcattttntgttacaccagaagtcctatgacaaataca

SEQ ID NO: 18239 - DNA, 101 bp, rice(Oryza sativa)
  misc_feature (71): n=t or c
tttctgctggtcattaatgttgggatttctagtagtgaaggccttcttggtcggccttcgtcgcttctgcngccccttcgttttccccttctccaatggtt

SEQ ID NO: 18240 - DNA, 101 bp, rice(Oryza sativa)
  misc_feature (71): n=a or c
ttgcccggcgagacgcactgggatggtgtgttctcgggctcgacaagttttcacagctgttggagagatangacgtgctctgcgacgacaggaacaagttg

SEQ ID NO: 18241 - DNA, 101 bp, rice(Oryza sativa)
  misc_feature (71): n=a or g
tttcagtttctagggacaattttcattcaaattcttccccttctgattgctcgttatcgcttttgcaaatnttgagagtggaagtctacggcttaggtggc

SEQ ID NO: 18242 - DNA, 101 bp, rice(Oryza sativa)
  misc_feature (71): n=a or g
tgccgccgggaggacgacgtcgatcgcgattatagtttaatggcgcgcgcagttgcatgtagttgtcgagncagctgctgctggctgctgcgcgcgcggag

SEQ ID NO: 18243 - DNA, 101 bp, rice(Oryza sativa)
  misc_feature (71): n=t or c
gatcgtgcatgcatgcacgtggtcctggacgacttgcttggtgttgggcacggtgaagtcggcacacaggnggtgcagagtgcgttccacgccctcgtgcc

SEQ ID NO: 18244 - DNA, 101 bp, rice(Oryza sativa)
  misc_feature (71): n=t or c
ggcagggcaaagaaaagggcccaattcaaaacctgagctgcttcggatgttcttggagtcatgggctcggngagaatgccggcacaggatgcaggcataca

SEQ ID NO: 18245 - DNA, 101 bp, rice(Oryza sativa)
  misc_feature (71): n=t or g
tattttcatgatgttcacttcaaccattttctggcacaaacaggtaccataatgactatatctaaggatcnagtaaagccttctccactacctgacagctg

SEQ ID NO: 18246 - DNA, 101 bp, rice(Oryza sativa)
  misc_feature (71): n=a or g
cttaaccagaaaggctgtagatatagagaggagatccaaatgggggcatgaaaccattggaagtacttggnatgaaaacgattcctccttttctggcaaaa

SEQ ID NO: 18247 - DNA, 101 bp, rice(Oryza sativa)
  misc_feature (71): n=a or c
catgtctttccttccttcgatggtttacttcaacgagagccatgacatgttctagcaaaaggaagaaaatnaagttcattgatagtacaaatagccatggc

SEQ ID NO: 18248 - DNA, 101 bp, rice(Oryza sativa)
  misc_feature (71): n=a or g
tgcctcggcggcagagacggggaagacggatggggaaagcgaggacttgggagcagcacacaggcagggcnttgctgttgatatttcttaccaatgattac

SEQ ID NO: 18249 - DNA, 101 bp, rice(Oryza sativa)
  misc_feature (71): n=a or g
gacaccttagacactcatctagcatcgatctcaaacacattcatagcccattagccgacgagagctctcantgtacgtaagtcgagagctcgaggaggcat

SEQ ID NO: 18250 - DNA, 101 bp, rice(Oryza sativa)
  misc_feature (71): n=a or g
actaatctgttgatttgccacttgtgcgtaaatagcctgctactctccctcagatgcgttcattacatgcngggcaaaagaagatgatgtgaatcgtatac

SEQ ID NO: 18251 - DNA, 101 bp, rice(Oryza sativa)
  misc_feature (71): n=a or g
atttttgcaatgtactgctagatttccaagtatatcccacacataagaatgtatatccataaagttctcgnaaaccatattaaaaagcttgtcgtggcaca

SEQ ID NO: 18252 - DNA, 101 bp, rice(Oryza sativa)
  misc_feature (71): n=t or c
tatttgacggaatcccatccccacaatattaacaaatattaacaggtggcatatagctcccaagtccccancaccggtgccactatctgccgcaactccca

SEQ ID NO: 18253 - DNA, 101 bp, rice(Oryza sativa)
  misc_feature (71): n=a or g
atggctattaagaccgcactctagcaagaagcgccttgtacaaaaatgttttgccagtgccacctgagccntctataaaaaatacatggctcttcttatta

SEQ ID NO: 18254 - DNA, 101 bp, rice(Oryza sativa)
  misc_feature (71): n=a or c
tagagcccttgggcattacatttctcaagttgctctctgttgcatttccagttctgcctccattagagctnactgtttccctcattcgcaggccagttttg

SEQ ID NO: 18255 - DNA, 101 bp, rice(Oryza sativa)
  misc_feature (71): n=t or c
ctctggtgctgcttgcgtctcttctgcggacgcgtggttaacctgagcctggacaaacttgggtccagcgngcctgagctttggacacttgtcggcgaagt

SEQ ID NO: 18256 - DNA, 101 bp, rice(Oryza sativa)
  misc_feature (71): n=t or c
gccttggtctcatcaccaacaacaactatagtagctttggcccggaccagttcgtatccgtcgagtttganacgtacaacaacacctgggagcagcctaag

SEQ ID NO: 18257 - DNA, 101 bp, rice(Oryza sativa)
  misc_feature (71): n=a or g
aatcgagctattggcattacaagcatggcatttttatattgtgcccttgataatatacaccaccagtggcngagccaccatgattcccgggtattcccggg

SEQ ID NO: 18258 - DNA, 101 bp, rice(Oryza sativa)
  misc_feature (71): n=t or g
acttgggcatggaagcatggacgagctagacatctgaccgttccggtcgaagaatgaagttggcactgccnaagaccatcatcttcggcccagcagccgtc

SEQ ID NO: 18259 - DNA, 101 bp, rice(Oryza sativa)
  misc_feature (71): n=a or c
cattttttgagatttgggatgtgattacatgagctttgctagtgtctaacattgttgttttgaacattgtnctcctgcgtttcataacataagtcgtttga

SEQ ID NO: 18260 - DNA, 101 bp, rice(Oryza sativa)
  misc_feature (71): n=t or c
acaggtcttggtgcacgatctcatcagcatctcctgcgtgaccgccttgatgtgctcctccatgatcttgngtgcttccccatcaagatcctccaatgaga

SEQ ID NO: 18261 - DNA, 101 bp, rice(Oryza sativa)
  misc_feature (71): n=t or c
tttctcaagtttctcagccctatcctttgaaatattgtgctcgccttttataagttctgcctcttggttcnctgcaaagaaccaaagatattaaggtatgc

SEQ ID NO: 18262 - DNA, 101 bp, rice(Oryza sativa)
  misc_feature (71): n=a or g
ctcaagggctatatgctcaaactaagattctcatcggatagctatttcaggcctcatcggatggcatgaanctttggctgatcagccaaatctgccaagtt

SEQ ID NO: 18263 - DNA, 101 bp, rice(Oryza sativa)
  misc_feature (71): n=a or c
ctgactgctagaccgttacattccattttgttaatgttcagcaggactctttgcacttcagccgccgcttnagcacttcttgtacttgctttgcgcaagat

SEQ ID NO: 18264 - DNA, 101 bp, rice(Oryza sativa)
  misc_feature (71): n=t or g
tggtggacggagctcaggtaatgaacgagggaagaataaaagaagggaggaagatgagggcaagttttttnattaccttctgtaatcttgggcaagttttt

SEQ ID NO: 18265 - DNA, 101 bp, rice(Oryza sativa)
  misc_feature (71): n=t or c
caacatatataactcctcgtcttctttttgcttgttgatcacaatccattgaggctgcatatcgtcatccnaccatttgaccaatataggtgggcgagaat

SEQ ID NO: 18266 - DNA, 101 bp, rice(Oryza sativa)
  misc_feature (71): n=t or c
agacaagcagctccgatatgctattgcgattgacggactcaaccactactcaactccgaagcaagaccttngaagtgaagccttcaagaaaaaaataacat

SEQ ID NO: 18267 - DNA, 101 bp, rice(Oryza sativa)
  misc_feature (71): n=t or c
agatataggagaaaaacagcagctaaagcaatagataccctgacaaatgcatatcagtcctctgcttattnagaaaaaacaacaaatcagataattcagat

SEQ ID NO: 18268 - DNA, 101 bp, rice(Oryza sativa)
  misc_feature (71): n=t or g
ctcggcgctgccaccgccgccaccctgacccatgccacggagcacgaaatcaagggcattgggggagcctncgtcggccagggggtagcccgacagccgcc

SEQ ID NO: 18269 - DNA, 101 bp, rice(Oryza sativa)
  misc_feature (71): n=t or c
aatgctggtcttgggcttggcagcctggctgctaggggtacgtgcagatcacaggctcaacagtgacgacncaggggtgttcagtttaaggggctgtaaag

SEQ ID NO: 18270 - DNA, 101 bp, rice(Oryza sativa)
  misc_feature (71): n=a or g
tctgtgtactctttttcaacagaggaggcgtttacctcaacaccgaaaaccaaatatttatatccacgtcntctaatcacacaactcttcaagatcacata

SEQ ID NO: 18271 - DNA, 101 bp, rice(Oryza sativa)
  misc_feature (71): n=t or g
attgtctcttagtttctatcatttgccttatcatctaagaacatgcttattgtacttgagcgcatttccanaggattatttaattggtaaacaaacattga

SEQ ID NO: 18272 - DNA, 101 bp, rice(Oryza sativa)
  misc_feature (71): n=a or g
tcaaatgcttcctttgcataaccaaattgggcatatccaacaatcaagctgctccaagagaacacatcacnattgtttcccattatttcaaagagtctcat

SEQ ID NO: 18273 - DNA, 101 bp, rice(Oryza sativa)
  misc_feature (71): n=t or c
tgtttgcagatggaccaaagttggatgtacggtattgatagttggtcccaagagtatagggatggggtcgntgaattcctaagaattgtagataatgatag

SEQ ID NO: 18274 - DNA, 101 bp, rice(Oryza sativa)
  misc_feature (71): n=a or g
ggagaccaccatggcctcacggtcgcgggtggcaagagcaagtggggagatggtcctctctaagatcgtcnccggcggcgacgtcccctcccctccagagg

SEQ ID NO: 18275 - DNA, 101 bp, rice(Oryza sativa)
  misc_feature (71): n=t or c
ctgcctaatgtcaatgataaattaagcaatcaaataaataaacgttgcagctaccggatgtaattgtccangtacatgcatgtgggtccgggatagaaggg

SEQ ID NO: 18276 - DNA, 101 bp, rice(Oryza sativa)
  misc_feature (71): n=a or g
ctcgctgacttcgtagccgactggaccatcccagaggataggccagccgcccaaacggacaataaaacctngaccatggcattcgatggagcactggacag

SEQ ID NO: 18277 - DNA, 101 bp, rice(Oryza sativa)
  misc_feature (71): n=a or g
ctcggcacgatgccccatcacatcctcatccacactggctcttcatcctcaacgttgtcaagccgtcgccntctcagctctgagaagacactgctgcagtt

SEQ ID NO: 18278 - DNA, 101 bp, rice(Oryza sativa)
  misc_feature (71): n=t or c
attgatgatggagcaagatgaatgagccatgaccgagcagatccctttaacgctatcggcaaataattcgncaatgcattgtcgtctgcgctggcggtgta

SEQ ID NO: 18279 - DNA, 101 bp, rice(Oryza sativa)
  misc_feature (71): n=a or g
tatccacctttaacacagaaatcccagcattgaaactttttgtccttagctggatgacagcaagaagctgngtatatgtttcaactgctttcttaaattta

SEQ ID NO: 18280 - DNA, 101 bp, rice(Oryza sativa)
  misc_feature (71): n=t or g
tctccacatcacggctgctatttataacagttgaaattctctcttttgtgtggattccgtttgcctttagnctctgttcgtttcctggagttcccaactcc

SEQ ID NO: 18281 - DNA, 101 bp, rice(Oryza sativa)
  misc_feature (71): n=a or g
ttaaagaaaattttaaataaaatgtttcttaagaatacaccgttcaccatcttgaaaattgtgttcatgtnaaaagagagagtagccccgacgaatgaagg

SEQ ID NO: 18282 - DNA, 101 bp, rice(Oryza sativa)
  misc_feature (71): n=a or g
atgtctcgatgacagggtcctcttgttgcacacgtcgaggccgaacaagtaccgttgttcagttaccgccncatcctcctcctcgacggcgacaacgatgt

SEQ ID NO: 18283 - DNA, 101 bp, rice(Oryza sativa)
  misc_feature (71): n=a or c
ggccagccgagcacatggacaatctgagactgagacgggagatgaattgagcggtgcacatggtctccttncaaatctttctgcatctgctgccaccacaa

SEQ ID NO: 18284 - DNA, 101 bp, rice(Oryza sativa)
  misc_feature (71): n=a or g
atttgtgcaaagaattcttgggatttaatctggaaatgtgaagttccacacaaggttaagatcttctcctngagagtagccacagacagtttggcaacgat

SEQ ID NO: 18285 - DNA, 101 bp, rice(Oryza sativa)
  misc_feature (71): n=t or c
atctagggttaacgaacgcaagcaaattccagacaaaagttaagtcccggtgggagggggagagatggatnaggaggaggatgtgggtgctcaccaggatc

SEQ ID NO: 18286 - DNA, 101 bp, rice(Oryza sativa)
  misc_feature (71): n=a or g
ccactcgacaagttcgtgtaccgcggatgcaatttactcttattttaaagcatggacttaaaagaaattcnaaacttagttttccggatcggctataatta

SEQ ID NO: 18287 - DNA, 101 bp, rice(Oryza sativa)
  misc_feature (71): n=a or g
aatcgttaatttcttctacttttgaatttagattccaatcgtgacaccaaatgaagctgctcagttagccncaaaatatcgaggacagggatttcagactc

SEQ ID NO: 18288 - DNA, 101 bp, rice(Oryza sativa)
  misc_feature (71): n=t or g
tgaggatgaaatttttgaagtgttgagagggtaaaagaagggagagtattttcgcgcgtagtgctcttaanatgcccgcacgcaaaaatgggaggacgatg

SEQ ID NO: 18289 - DNA, 101 bp, rice(Oryza sativa)
  misc_feature (71): n=t or c
acttgacagtcagttaaagaaaatgtcattttgcatgctttcagggagatgagcctatccttgaggatgangatgatgacgaggatgatgatgatgacgag

SEQ ID NO: 18290 - DNA, 101 bp, rice(Oryza sativa)
  misc_feature (71): n=a or g
gcttaaacagtagaatgcaacatcactaaaactccaacaaaacaaacctacctccattttcttcaactccngtcaccggcccccgaggaaactcacctccg

SEQ ID NO: 18291 - DNA, 101 bp, rice(Oryza sativa)
  misc_feature (71): n=t or c
aacgtggggtgtgggacacatgttaggacggtttcctctagcatgagtggccttccttggaattgagatgnctccatgtccgctgcttcggtgggaatcga

SEQ ID NO: 18292 - DNA, 101 bp, rice(Oryza sativa)
  misc_feature (71): n=t or c
ccagcggcagcggcctccacccttcgtgcggcattgcgtagtgctcgcagcacactgaggaagtcgtcctnctcctcccaacgtgtcggcggcagcgatga

SEQ ID NO: 18293 - DNA, 101 bp, rice(Oryza sativa)
  misc_feature (71): n=t or c
tttcaaggctgaacaacaacaggcgattgcggtaagtgaggttctcagtgcttatgcagctgggactgganagctaataaacccagcgaaatgttctatta

SEQ ID NO: 18294 - DNA, 101 bp, rice(Oryza sativa)
  misc_feature (71): n=t or g
tcttgcactaaaagggttgaaaacgtatgtaatgtcagtgctgtagctagcaagaaacaataactgagctnttgctctcacatcacacacactaggaagaa

SEQ ID NO: 18295 - DNA, 101 bp, rice(Oryza sativa)
  misc_feature (71): n=t or g
acttaaattcaaattgaatcacctgcatgagaatgcatcaagagcttaccataagaaccactaatttcagncaatattacaattaataactgaagttgctg

SEQ ID NO: 18296 - DNA, 101 bp, rice(Oryza sativa)
  misc_feature (71): n=t or c
gcccaaaactgttatgatcataatgaactcaccacattcatggagttgactgtctatgcgccagtttcaantgctatcttacttcaattttaattttggta

SEQ ID NO: 18297 - DNA, 101 bp, rice(Oryza sativa)
  misc_feature (71): n=a or g
ggatcttgttttgggttaggctgtggtgtaggttttgggtcaggctgcggcgattgttttggatccggctntgggtttggttgaggatcttgttttggttc

SEQ ID NO: 18298 - DNA, 101 bp, rice(Oryza sativa)
  misc_feature (71): n=a or g
agagccggaagccttgcattgaagaagccaaatacattatcctcgtccgtagtcgatccattattagtgcncaaagaattcactaatttaattaggttaac

SEQ ID NO: 18299 - DNA, 101 bp, rice(Oryza sativa)
  misc_feature (71): n=a or g
cgttgttgtacttgtacacgtacggggagttccacggcagatcggacttgaacctggggacgaacacctcntcgcgctcctgtgagctggtgttggagtgg

SEQ ID NO: 18300 - DNA, 101 bp, rice(Oryza sativa)
  misc_feature (71): n=a or g
atgcattgataggttgctccagcattctttaatctgtagggcatggtgatatagcaataagctccaaacgntgtgataaacgaggtcttcaagcagtcgga

SEQ ID NO: 18301 - DNA, 101 bp, rice(Oryza sativa)
  misc_feature (71): n=t or c
ccaactaaaaaaaaaatcttagacccgtagagctatgccaaacaggaatcgtacaatccctaaaatctganggatgtggattatctgatatttttattgga

SEQ ID NO: 18302 - DNA, 101 bp, rice(Oryza sativa)
  misc_feature (71): n=t or g
gccgcgctcagggagctgcacctggtgttcgtccggttcaatggcggcgaactaaccctggacgataccangatgccgttcttggaaggggtagagatctg

SEQ ID NO: 18303 - DNA, 101 bp, rice(Oryza sativa)
  misc_feature (71): n=t or c
gagtatggacacatcgtcctacttgctagatagccctccaccaaagcgaccactttgccctctgccgaagngaccactttgcttcgtggaagcgagcacac

SEQ ID NO: 18304 - DNA, 101 bp, rice(Oryza sativa)
  misc_feature (71): n=t or g
agataatgacaggctttcggccaatacgatccgctaccataccccacaagattgatgcaaaacctcgaccnatcatatatgatgcgcctgcagcagaaata

SEQ ID NO: 18305 - DNA, 101 bp, rice(Oryza sativa)
  misc_feature (71): n=a or g
gctctaatggtggtttcttgtttcttgatttttgtttggtggtgcggcgcctccacctgcatctcccttcnctggttcgtcatggaggacgacgaactgtc

SEQ ID NO: 18306 - DNA, 101 bp, rice(Oryza sativa)
  misc_feature (71): n=a or g
tatgttatttgtacagtgtcaatgagtatcaacgaattgttttctcgcagttggagtcatggcagctgatnattggtgagtttttatagtgggccccatgt

SEQ ID NO: 18307 - DNA, 101 bp, rice(Oryza sativa)
  misc_feature (71): n=t or c
actgccaagagacagagaggaagaatttctccaaatccagccaaccaaagactcaatccgaagatggtggngaagaacttgctgtcttggtaactcgatgg

SEQ ID NO: 18308 - DNA, 101 bp, rice(Oryza sativa)
  misc_feature (71): n=t or c
aacaagcaaacagtataaatccaactattcctatccgacgtttttgctgcctcaaactttactcaggctgngttcggtacccttagttaccaacatctctc

SEQ ID NO: 18309 - DNA, 101 bp, rice(Oryza sativa)
  misc_feature (71): n=t or g
gcgaacccatctaagcctgctaattgattggatggaaatggattaattgggttggattttaatttggttanctttggattggagggaaatgggctcgtgcg

SEQ ID NO: 18310 - DNA, 101 bp, rice(Oryza sativa)
  misc_feature (71): n=t or c
gtaaaatagcacatccgtagcgctactagtggtagcttactacgtttgggttacgtacgtggttatcacgntaagtttttattatctttcaatccaccgtg

SEQ ID NO: 18311 - DNA, 101 bp, rice(Oryza sativa)
  misc_feature (71): n=a or g
atcgttgggccgtgacgatggctgtctggcatggcccggttatgccctcgcggtactactgcttgtgttgngccatgtgggctggtatgggccatggacca

SEQ ID NO: 18312 - DNA, 101 bp, rice(Oryza sativa)
  misc_feature (71): n=a or g
cccggcgattacccttcaaacgcctatgtcgcaggacgatatgggacgaaactcacccgtggaaatgggcntggcgatgacctccgtaggttggtgatctt

SEQ ID NO: 18313 - DNA, 101 bp, rice(Oryza sativa)
  misc_feature (71): n=t or c
tctgaacgtgataaaggagcatgagtctgaccaggtggggtccactgtcatggacccacaagtcaatggcncatgtccctgtttagatttcaatgtttttc

SEQ ID NO: 18314 - DNA, 101 bp, rice(Oryza sativa)
  misc_feature (71): n=t or c
ttgcgtgaactaaacacagccctagtcaaatagccttcccaatatgctccctctgttttaacattatactnagaaacaacataaacactccagatcaactc

SEQ ID NO: 18315 - DNA, 101 bp, rice(Oryza sativa)
  misc_feature (71): n=a or g
ctagttgctttgcgtggggccttacgcctcgtggttctttgtggtttctttccgtggatttctgtagattnatctctatgtcgccgtaggattgaggtatt

SEQ ID NO: 18316 - DNA, 101 bp, rice(Oryza sativa)
  misc_feature (71): n=t or c
tgtctggatatttttattttattgggggcagagggtgctaccctttggaacattaagggcccgtttagttncccaaaattttttcccaaaaacatcacatc

SEQ ID NO: 18317 - DNA, 101 bp, rice(Oryza sativa)
  misc_feature (71): n=a or g
atcatgaatcttttggtccacccaatggcccttctttcagagtgatgtcaagagcaatctccaactacatnatgcatctgttgttcgctaatcctgagatg

SEQ ID NO: 18318 - DNA, 101 bp, rice(Oryza sativa)
  misc_feature (71): n=t or c
tataatacttggagcaatagccgttcaaaaatgactaagatttagtcaaagttgggggaagagttataccntattttacagttgagagatgcaattctact

SEQ ID NO: 18319 - DNA, 101 bp, rice(Oryza sativa)
  misc_feature (71): n=a or g
ttcaccacactgagctaaaaatcggctaacgttttcgtaggttgaaacgttgtcctatcctgagaacttcnaaaaatctggaaccttgaatcggcactcag

SEQ ID NO: 18320 - DNA, 101 bp, rice(Oryza sativa)
  misc_feature (71): n=a or g
gcgagggtggcgggcaggcggaatttggccgagagagagagggaggggatttttagggttttctttttatnaaaccttttcgactttgtttatttattgat

SEQ ID NO: 18321 - DNA, 101 bp, rice(Oryza sativa)
  misc_feature (71): n=t or c
caggtttcaacgctaggtgtcatcagggtaagggatcattgggcaaaaacactttgattgtaacatgggcntaagaattggctttattgatactgtaagct

SEQ ID NO: 18322 - DNA, 101 bp, rice(Oryza sativa)
  misc_feature (71): n=a or g
agtctaaaaatgcttacattttgagacggtgcgagtataaaattgatgaaatgaacgaacaggtcggaganctcgacggcgacgggatcggtggtggagta

SEQ ID NO: 18323 - DNA, 101 bp, rice(Oryza sativa)
  misc_feature (71): n=t or c
cattggcagtgctgggagcaagatgatttccattggagtgtcgcatgtgtctctactaaatgcggctgccnagcactgcaggatacctatactttgctacc

SEQ ID NO: 18324 - DNA, 101 bp, rice(Oryza sativa)
  misc_feature (71): n=a or g
gaatggcatgtcatcaacattataaaactgctcaatacctgtgacaaggttgacgaatttctccggcaccntgtcgaacaacttcttcaccatcgcggcat

SEQ ID NO: 18325 - DNA, 101 bp, rice(Oryza sativa)
  misc_feature (71): n=a or g
aaaaatgtggtccaagcttctactaggaccttacgccatctatcgcacacaaactctcctatacatacatntgttgaccttctcctaattaattaataata

SEQ ID NO: 18326 - DNA, 101 bp, rice(Oryza sativa)
  misc_feature (71): n=a or g
ggacaaatatttgaagcaggtccttagcatagatgttaaaaggagatccagtgtgatcctcagggaagatnttggccaacatgttcacattttctctcaca

SEQ ID NO: 18327 - DNA, 101 bp, rice(Oryza sativa)
  misc_feature (71): n=a or g
catcgacgctttcctccatttggggagcggcgaagcttgacaacaaaaatgtgctagcggcgatggtggcngccttgacgcccgcatggactccacctcag

SEQ ID NO: 18328 - DNA, 101 bp, rice(Oryza sativa)
  misc_feature (71): n=t or g
ggatgaggttagtgacaataaagcacaggcataattcatttccatttcagtgctaaacaccgccatgtacnatataatgttctatatacctcgccactgcc

SEQ ID NO: 18329 - DNA, 101 bp, rice(Oryza sativa)
  misc_feature (71): n=a or g
tccgaaaataaaagatctcaaaagcaattttccttatgaaaaggaagggaaacttgactacgaaaaacaancaggtacctgaagctaggatttaaaccctc

SEQ ID NO: 18330 - DNA, 101 bp, rice(Oryza sativa)
  misc_feature (71): n=a or g
tcttcaacggctattgaagagtcgatgtgtccgatatattcatcgattcgacgattcagattttaaacctntgtatggtttttatataaggcttgtccgca

SEQ ID NO: 18331 - DNA, 101 bp, rice(Oryza sativa)
  misc_feature (71): n=a or g
cgctgacggacggcgagtcgcgctctgcgttggccttgcggtggatagaagagagatatttttctccgtcngcttgtgtggaaactcgagagaaggggatt

SEQ ID NO: 18332 - DNA, 101 bp, rice(Oryza sativa)
  misc_feature (71): n=a or g
attgccttcaaacgagctttatctctaattggcaatggcgttcactccaaattgggcccacaccccgtccnaatcgcactgcaccgattagttcagtcatt

SEQ ID NO: 18333 - DNA, 101 bp, rice(Oryza sativa)
  misc_feature (71): n=t or c
gacaataaaccgctttgtaagtcgtcttagttttaacttctctctcaatctctctgtatggatagtaaggntgtgtttaattcagcgtaaagtttgaattt

SEQ ID NO: 18334 - DNA, 101 bp, rice(Oryza sativa)
  misc_feature (71): n=a or g
taaggagggatgcatgagattggatccaccagcataacaccttcaaattgttgggtctccactcccaactnggccgaggttgtcactgggcgtatatgtcg

SEQ ID NO: 18335 - DNA, 101 bp, rice(Oryza sativa)
  misc_feature (71): n=t or c
caatatgttttcctagctctctatgtggcgctgcagtgatgaacttcgaattcgtgcagatgatttgcatngctcctccagaaaagctgcaaagcactata

SEQ ID NO: 18336 - DNA, 101 bp, rice(Oryza sativa)
  misc_feature (71): n=t or c
tatatatatatatatactatcccttaacttcatagaggattttgaccccggttgtttctaacatagcagcngagtcacagtgggctcacgtgggccccaca

SEQ ID NO: 18337 - DNA, 101 bp, rice(Oryza sativa)
  misc_feature (71): n=t or g
gggtgtgtgtctgcagatgctacagtggttgtggagagtcatgacaagtcttatccttggaatttccatanagccagcaacatgttgcagagtgacccatt

SEQ ID NO: 18338 - DNA, 101 bp, rice(Oryza sativa)
  misc_feature (71): n=a or g
accaggtaagagtttagatgaatcaggacaaaagtttgttgtctgctctctaagcttatcgcagaaactcnaaaaaccagaaacagagcctttgtccaact

SEQ ID NO: 18339 - DNA, 101 bp, rice(Oryza sativa)
  misc_feature (71): n=a or g
aataatgcaactacagatgcagtgatcctggaggtgtgcctaaccgtagacccaactgacaaatgtctcantaacctgttggttcatttcgggtgtgttta

SEQ ID NO: 18340 - DNA, 101 bp, rice(Oryza sativa)
  misc_feature (71): n=a or c
ttatatacaggaaaaatgatgcatacatcagattgtaaagggtaataagggatacaaagacagatccgtanaattatcacactatagaaactaagaaaaat

SEQ ID NO: 18341 - DNA, 101 bp, rice(Oryza sativa)
  misc_feature (71): n=t or g
gagctttaagctgccgaacgtatctgccgccaccacgaagtcgaattctctccatcgctctagcagcagcnccgacgcagcttccatatccgagcaaaccg

SEQ ID NO: 18342 - DNA, 101 bp, rice(Oryza sativa)
  misc_feature (71): n=t or c
tgtacgggcagatgagcaccatgttcgtcctccaggggaacacgctcgacgccagcatggggccgcacttntccatcccggcggcgtcgctctccatcttc

SEQ ID NO: 18343 - DNA, 101 bp, rice(Oryza sativa)
  misc_feature (71): n=a or g
atcgctgtgctactcgtgttccgttggatgaagggcttggtaagataaaaatttccatgccttccttttcnggttgtggagatccagaggattatctggag

SEQ ID NO: 18344 - DNA, 101 bp, rice(Oryza sativa)
  misc_feature (71): n=t or c
atgacgtggtataatcttgactgacaaaatgggactcacttgaaaatttcccttttcctttttttttcttncctttcctttttattttactttttcttctc

SEQ ID NO: 18345 - DNA, 101 bp, rice(Oryza sativa)
  misc_feature (71): n=t or g
atttgtaactgtcctaaccttgacctccctccgccgtccgatctaccataggcggttcagatcactagggncacgtttggatcctgggcaagggtcaccct

SEQ ID NO: 18346 - DNA, 101 bp, rice(Oryza sativa)
  misc_feature (71): n=t or c
attgtcctgttactgaattttccacatccacttatactaaaatatgtccttcaacagagcgcacccttctnagacaacaccaccagttaagaaattgttca

SEQ ID NO: 18347 - DNA, 101 bp, rice(Oryza sativa)
  misc_feature (71): n=a or g
cacatcatatttgtgagcatatttgtgaggaccgaggagccaaagtgtggctaaaattaatgcagcaatgnagggggaggagacggtagcctgaagcgcgg

SEQ ID NO: 18348 - DNA, 101 bp, rice(Oryza sativa)
  misc_feature (71): n=a or g
tctggatctaaacaccctcttagatgaaattacccttgccttcatcttgcatatcttcttgccttcccacncaagtgtgcttgctgcgacgacagggaaca

SEQ ID NO: 18349 - DNA, 101 bp, rice(Oryza sativa)
  misc_feature (71): n=a or g
cttcatgggaagggtgcagaagcagttgccctgtttgatcagatgcatatttctggggttaagccagacancataactggcttgggtgtgctttcagcttg

SEQ ID NO: 18350 - DNA, 101 bp, rice(Oryza sativa)
  misc_feature (71): n=a or g
ggtgcttttcattatgatcatactcctggtgtgtttctatcaaagtgagagcaaagagaagcgagatgacntatccaaggagcccgttgagaaagacaagg

SEQ ID NO: 18351 - DNA, 101 bp, rice(Oryza sativa)
  misc_feature (71): n=a or c
aacaacgccgtagtgctgtgcagatattattaatagcccggcatcatctcttagagggagcaaatatacancgtagcattgtgtagatgcacagttgagac

SEQ ID NO: 18352 - DNA, 101 bp, rice(Oryza sativa)
  misc_feature (71): n=a or g
aacagttcgccttagctacaatttggatacatagagtggtaattttcacccaaggtgtgaggacttcacantacaggtctaggggtagcgccaatttttca

SEQ ID NO: 18353 - DNA, 101 bp, rice(Oryza sativa)
  misc_feature (71): n=a or g
agactcatggcaacggccgatccttgccactaattgcctagctattttccgcatcaaacttcgacgtctcnctcgagatttaaagggatggagtcggagcc

SEQ ID NO: 18354 - DNA, 101 bp, rice(Oryza sativa)
  misc_feature (71): n=t or g
ctttggatgaaattgtgtgtggtggtggcaatgcaataaagcatacgcacgataaactgaaggatatgcancaaagaatggaggttattactttttattca

SEQ ID NO: 18355 - DNA, 101 bp, rice(Oryza sativa)
  misc_feature (71): n=a or g
aatggcaaagctagcttaatgagtggattgagtggtggaggtagcaacatctttgaacttaggcagcaaanactatttattatattaacgtgcaatctttt

SEQ ID NO: 18356 - DNA, 101 bp, rice(Oryza sativa)
  misc_feature (71): n=t or c
agaccatttcttccggtaggagtagatataatgttttatccacgagagcagtagatagagtacactagtanatgtcgatacatgttactccgacagctggc

SEQ ID NO: 18357 - DNA, 101 bp, rice(Oryza sativa)
  misc_feature (71): n=t or c
aatctcaatatatgttgggccagttttttaaaggttattataaggttatgtgtgcacacgttagcgcctanatttgttgtattttgtttctaagaaaatat

SEQ ID NO: 18358 - DNA, 101 bp, rice(Oryza sativa)
  misc_feature (71): n=a or g
gtcgtattgagttttggtcttctctttctcaacagcagcctgcagtctgtatgtaataaacgtgttccagngtgattttcatttgttaggaatactcctac

SEQ ID NO: 18359 - DNA, 101 bp, rice(Oryza sativa)
  misc_feature (71): n=a or g
atgtggattattacaaatacctgaaggggaggtgggccatccagccatttgcaaaaataggtttttggccntttgcaaaatcatttatgtagtagtggctt

SEQ ID NO: 18360 - DNA, 101 bp, rice(Oryza sativa)
  misc_feature (71): n=a or c
ataatggtattattttttttcttcactgaataatgcactttattttattgtaggctgtgttcgcatgcacnttttcccatcccctctccttcgttttccgc

SEQ ID NO: 18361 - DNA, 101 bp, rice(Oryza sativa)
  misc_feature (71): n=a or g
caagcaaagctagaaaaaccaagtgaaaacctcaaagctaggcaccacgcgtcaacgcatcatctccttcnatcgtctccttgtagtggctagtgtgctcg

SEQ ID NO: 18362 - DNA, 101 bp, rice(Oryza sativa)
  misc_feature (71): n=t or c
caaggtcttgcatctatacaatctataccgatacggagatgcctgagggaagatatgtgttcaatgcctangtcaaaatctccagatggaggacctgctcc

SEQ ID NO: 18363 - DNA, 101 bp, rice(Oryza sativa)
  misc_feature (71): n=a or g
gctcaaggacgtcacatgggacctcaccgatgctagcaccgttgggacatctccgtctacgtctccacccnattggctgctagacttcctccccgcgcact

SEQ ID NO: 18364 - DNA, 101 bp, rice(Oryza sativa)
  misc_feature (71): n=t or g
cattaggtgattaggataccaacatactggggaaaaaaacagcattacaaacttacagcttctatttgctngagggcccgggctgcttgctgctgctcctt

SEQ ID NO: 18365 - DNA, 101 bp, rice(Oryza sativa)
  misc_feature (71): n=a or g
gaaggatcaaaacctatcgtttggtgaatcactcgaggaaaaaaacattgcagaggctggcaaatggcccnacttgcctcgtgaccttatggcaagtgtac

SEQ ID NO: 18366 - DNA, 101 bp, rice(Oryza sativa)
  misc_feature (71): n=t or c
agagcgaaggagcagaggcgaagcacgagtccaatccaaacccgaaaaattcgcgtggcggccaagccatngacgcgagcgaaacgcacgagcgcgtcgcc

SEQ ID NO: 18367 - DNA, 101 bp, rice(Oryza sativa)
  misc_feature (71): n=t or c
tggagcaaggaatagtcggtaccattttacaggtagaggcaaagaaaaccaggaaagggttctgaactaangtacagattgcttcagttcccctattggag

SEQ ID NO: 18368 - DNA, 101 bp, rice(Oryza sativa)
  misc_feature (71): n=a or g
ggattttgaagaggaggtcgtggtgatgatgttggggcgatggcttggccggatttggtccacggaggccngcgcgacgatgatgatgcagcggtggcact

SEQ ID NO: 18369 - DNA, 101 bp, rice(Oryza sativa)
  misc_feature (71): n=t or g
ggtttacaaaacacatagtcacatagagattggcccggatttcacggaacctggatttcctgtaatggagnaaatcactcttcaaactgaatattatattt

SEQ ID NO: 18370 - DNA, 101 bp, rice(Oryza sativa)
  misc_feature (71): n=t or c
tatgtgcggttctatccaccacagtatcctacaatatgtatcccaacgctaacgaccttggtggcaagaanagagtatcacaatgggttctctggtcccac

SEQ ID NO: 18371 - DNA, 101 bp, rice(Oryza sativa)
  misc_feature (71): n=a or g
gacttcgtcgttccttgatgcttattctctccatcctagttatgttcaacaaatttttataaagcattttnttattttgaggtaagataatataaaactta

SEQ ID NO: 18372 - DNA, 101 bp, rice(Oryza sativa)
  misc_feature (71): n=t or c
cggcggcgaggcggcatatgtgtagacgcgtcgtgccgtttcctgcaggtttatatatacgtgctagctgnggttgggagggagagaatttgagagggatt

SEQ ID NO: 18373 - DNA, 101 bp, rice(Oryza sativa)
  misc_feature (71): n=t or c
actcagactcctactcatctaatcactcgtgggattaatggtgttcacacccacatacctataaattttanggttaattggatacatgccattataaattt

SEQ ID NO: 18374 - DNA, 101 bp, rice(Oryza sativa)
  misc_feature (71): n=t or c
aggtgtttgtgtttgggatttgacaagtgaagtagctggaggtaggagagatatatatacacacacacctnctgaattgtgataagcaaaaagagaggggc

SEQ ID NO: 18375 - DNA, 101 bp, rice(Oryza sativa)
  misc_feature (71): n=t or g
tgtagttgttctgaagctaagttaaaaaaatctatccaggggaatagattcattcaacaaggctgcttctnaaggttgtaacctcctgctcctgactcaag

SEQ ID NO: 18376 - DNA, 101 bp, rice(Oryza sativa)
  misc_feature (71): n=a or g
ctactgtgataaaatttcctggtgctgtaggtacaagaagctgatagtgacatggaagaaagccaggccgncgccgaggacgccggaggaagccgcgcggc

SEQ ID NO: 18377 - DNA, 101 bp, rice(Oryza sativa)
  misc_feature (71): n=a or g
ctttggtcagcaacaagaaattagtaacactctaaaagtcataggagcactggtgcatgccaaactttgtntggagattatgggtatcccatatctacacg

SEQ ID NO: 18378 - DNA, 101 bp, rice(Oryza sativa)
  misc_feature (71): n=t or c
aatctcttccatggagaaaggtctgactaaaaagtcattatcttcttgatccacccttcccctatccctcngcatatcctggctcagaaacacttttggtg

SEQ ID NO: 18379 - DNA, 101 bp, rice(Oryza sativa)
  misc_feature (71): n=t or c
gcgattgtaattttttttgttgcaatatgtaggaagtatcgcaacgagtaaatttgcgttgtaattagggngacgatattgccacgctttttgttatcgtt

SEQ ID NO: 18380 - DNA, 101 bp, rice(Oryza sativa)
  misc_feature (71): n=a or g
ttccgcctcacctccttcgcccctctttttcccctcccctcctttcctcctctctgcaaagagcttctccntgtaggcatggtggcggtggagcaggtccc

SEQ ID NO: 18381 - DNA, 101 bp, rice(Oryza sativa)
  misc_feature (71): n=a or g
ccaagcacgcgtttgatttaggtataatatggggtggaatggtcccgtgtactgtttgattgaggggatanggtcgtcatagtttttgttgggttcaagat

SEQ ID NO: 18382 - DNA, 101 bp, rice(Oryza sativa)
  misc_feature (71): n=a or g
tttagattttataactgtagattttcataatttatttctagggcatgacagcctgagcatcttcgtaaggntttcgactacttagtcctcctgatctccta

SEQ ID NO: 18383 - DNA, 101 bp, rice(Oryza sativa)
  misc_feature (71): n=t or c
tgatagagcttctagctcctgtatgtcctccctaacgtagacaacctggttagatttacaagggcagctcnggagttcttgttctgcagtccaataaccaa

SEQ ID NO: 18384 - DNA, 101 bp, rice(Oryza sativa)
  misc_feature (71): n=a or g
cctggtggttgacgcatgtagacctctacctccagaactccatgaaggaatgcgttctgtacatccaattngcgaaggctccaaccttttgagactgcaat

SEQ ID NO: 18385 - DNA, 101 bp, rice(Oryza sativa)
  misc_feature (71): n=a or g
gacccctcctaatataatgtatctgaactatactttgtctagatttattgtcctagacccctctcagattnagttttttcttttttttgacggaggaagta

SEQ ID NO: 18386 - DNA, 101 bp, rice(Oryza sativa)
  misc_feature (71): n=a or c
gtccagatgtactcctccttcaagcagaaaggaggatgatctcgtccagaccgaccgccatggaattaatncatcgatactcccaccgtcccataaaaaac

SEQ ID NO: 18387 - DNA, 101 bp, rice(Oryza sativa)
  misc_feature (71): n=a or g
gtaacatacccatttgcagtgcttggtaatattcttccacactaataccaccctgtttcaattgggtgcancttatttaacatgtcacgtgcataataaga

SEQ ID NO: 18388 - DNA, 101 bp, rice(Oryza sativa)
  misc_feature (71): n=a or g
ctcaaagaaaccctatccattcagatccggtctcctctcatatcccgtctctcttctggtgagtggcggcngcgacggtggggcccagaggaagggatccg

SEQ ID NO: 18389 - DNA, 101 bp, rice(Oryza sativa)
  misc_feature (71): n=t or c
aaaatccatataaaaacagggaagtgaataacctctcgagtagcattgtctgaccaatgttttagttcagntagtccaactttcacatattccccattgct

SEQ ID NO: 18390 - DNA, 101 bp, rice(Oryza sativa)
  misc_feature (71): n=t or c
ggtggcggccctagagaccggtggcggacggtaagtaggatggaacccgtctgcgtgtgctccttcaaccnggcaaccaagcaccaccgtgctcctccatc

SEQ ID NO: 18391 - DNA, 101 bp, rice(Oryza sativa)
  misc_feature (71): n=a or c
cacatatcttttgtcatacctcattgatatgtgggcctcgcctacataaaccacttcccaaaccactgaanttaatagtcgatttgcaccggttttcaaag

SEQ ID NO: 18392 - DNA, 101 bp, rice(Oryza sativa)
  misc_feature (71): n=t or c
tgtcacagcgaatgtggttgtggccattgaaaatggctgccgaagggcaacagcttggagttatcgcaacnataacatctacgacatcaatcactaccgat

SEQ ID NO: 18393 - DNA, 101 bp, rice(Oryza sativa)
  misc_feature (71): n=t or g
ctttgaaggttctctctatccttgccccatgagtaaactgagccaattcatctctctctccatattactgnaccttttttttcttactatacatattcttg

SEQ ID NO: 18394 - DNA, 101 bp, rice(Oryza sativa)
  misc_feature (71): n=a or c
tacatcagccacaagagggcacaatatatcctcctgaccgaattgcttgctcgcaactgcagatctcatcngcaacacaacctcctccttgttcctcacat

SEQ ID NO: 18395 - DNA, 101 bp, rice(Oryza sativa)
  misc_feature (71): n=t or c
aattgctataattttaggacggatgaagtaggtcacggtacttttggtacagcgactttgtatatagattnatagtataagaaaatctttttttttaaaaa

SEQ ID NO: 18396 - DNA, 101 bp, rice(Oryza sativa)
  misc_feature (71): n=t or c
aatgatatactaccctttaaacaaaaaaacactaacctttggattcgctaaatcacgcattcaacgccccncaaccccttctcctcgatcttccttctccc

SEQ ID NO: 18397 - DNA, 101 bp, rice(Oryza sativa)
  misc_feature (71): n=t or c
tcgcgaagtagatgacgcattactttggatgtctttgtgcttatgttgcagaaaaggtgctggtctggtcnggttacaaagttctattataccagaaaaac

SEQ ID NO: 18398 - DNA, 101 bp, rice(Oryza sativa)
  misc_feature (71): n=a or g
acaaaggggcagtcccgaatcctatggtaaaggacatcggacgtagctcttggacaaatccctcaataccnaacaagtactcaggcttgaagcgcggcatc

SEQ ID NO: 18399 - DNA, 101 bp, rice(Oryza sativa)
  misc_feature (71): n=t or c
atccacaaaaaaatcaattagtatacccggcgcatactatcagctttatacaaatgacaatcgaatattgngttactgtgttcccaaatcagataagatgt

SEQ ID NO: 18400 - DNA, 101 bp, rice(Oryza sativa)
  misc_feature (71): n=t or c
tttcgttgctcaatccagaataattattggtcgtcatgcacgcagtcactaatggactgtacttttttttntcataacggcattgccaatttagaacaagg

SEQ ID NO: 18401 - DNA, 101 bp, rice(Oryza sativa)
  misc_feature (71): n=a or g
ttttgtcatcgccaaggcctggctagctcccctggtggcatcctctttgatactcttgaaatatttgcttngagaacttcttaacttgtcaaagatttcta

SEQ ID NO: 18402 - DNA, 101 bp, rice(Oryza sativa)
  misc_feature (71): n=t or c
gtagccacataattagattactaggggacaggaagtaacagagaaatgcaaattaccagtatttttcgagnccataaagatcacccttgtgatggaattcg

SEQ ID NO: 18403 - DNA, 101 bp, rice(Oryza sativa)
  misc_feature (71): n=t or c
ggtacctatgtctttgttttgtccacaaccggcacctattagccgagcacatataagcaaccatcccactngatctgatcgagcaagaatagagcggcgcc

SEQ ID NO: 18404 - DNA, 101 bp, rice(Oryza sativa)
  misc_feature (71): n=a or g
cgcattacaacttccattgcttctgtgattcccgtgtctaccgaagtgatacatcaatatgcaagctaatntctgctcccagggtagaaaaagtcagcgcc

SEQ ID NO: 18405 - DNA, 101 bp, rice(Oryza sativa)
  misc_feature (71): n=t or c
tcaatgacaggttcattgtatctttgcctaaccgatgtcaaatcactaagatcaatttttctaaaactttncctaataatatctccaatccaatcctccat

SEQ ID NO: 18406 - DNA, 101 bp, rice(Oryza sativa)
  misc_feature (71): n=t or c
gtagggggggagggctttatgccacataagttgaaggagatgtgctgaaatgagggaggaagtagcactantagaaaaaaggtatttgctgacgggccaaa

SEQ ID NO: 18407 - DNA, 101 bp, rice(Oryza sativa)
  misc_feature (71): n=a or g
aagtaaactcaatctctgtagccatcggtgttgttccatacacgtgagttctctctctacatatacagatnccaaatcacaacaaacagatgaatgcattc

SEQ ID NO: 18408 - DNA, 101 bp, rice(Oryza sativa)
  misc_feature (71): n=a or g
tctctgtcaatggctatatacagatattcgaaactaacactcccaatccaaaatgaaaaatcacccatctnataaataaaaacccccatcgtttggctttt

SEQ ID NO: 18409 - DNA, 101 bp, rice(Oryza sativa)
  misc_feature (71): n=t or c
ttgaactaatttgatcagcaatactttttgtgatatcaaagcaggccatagcaaaagttgggatagcctgngcaacggctttaatcagtatttccttccct

SEQ ID NO: 18410 - DNA, 101 bp, rice(Oryza sativa)
  misc_feature (71): n=t or g
ctcaagactccacatgaagaggagaggaacacatgacatgaggaggaaggaggcaggcatatgcctcaatncctcaacttccatctattcactgacttaag

SEQ ID NO: 18411 - DNA, 101 bp, rice(Oryza sativa)
  misc_feature (71): n=t or c
gagtttcttgctccttgtgtcgaacatgaccatccatgttctcttgatgtggcagtatcttcttcttcttncctcgaattctcgctcctgcaccatgaagc

SEQ ID NO: 18412 - DNA, 101 bp, rice(Oryza sativa)
  misc_feature (71): n=t or g
acggtaaacccacaaatacaccacactcaagtcactactcgaaagcagttccctgatctaaagtcagaganacgtgagtcccttatagatagggcccacgt

SEQ ID NO: 18413 - DNA, 101 bp, rice(Oryza sativa)
  misc_feature (71): n=a or c
gtcgcagaaggaaacggatcctccacatgtatccattttggatccgataactgcacaggcggtatccgttnaggaaacgctaactccatgtttttccaaac

SEQ ID NO: 18414 - DNA, 101 bp, rice(Oryza sativa)
  misc_feature (71): n=a or g
ggcgtcattcaagaggcgtggtggaacttcggcttcctccattgagacatcgacggatgaacgagcactgnactcgtcatggcgacttgatggagagctga

SEQ ID NO: 18415 - DNA, 101 bp, rice(Oryza sativa)
  misc_feature (71): n=a or c
atgagaggcctagcactgaatggctttgcgcaagatgcaatcaccttgtacaaagagatgacagaggaggncgtccagccaaacgagattactttcgttgc

SEQ ID NO: 18416 - DNA, 101 bp, rice(Oryza sativa)
  misc_feature (71): n=a or g
ggcagatcaaaatcgaagcaaaaaatcagggagaattcttggtacttccagtacctctcgtcgacaccacntgtcgggttttctgcaccgcggatcctcgc

SEQ ID NO: 18417 - DNA, 101 bp, rice(Oryza sativa)
  misc_feature (71): n=a or g
ataaaataccttgttgatttgtcaaataggaaatgatcaccagaggtaagtgcaacaaggtatccccatcnagaggaatcaccaccagaggtaacaaggta

SEQ ID NO: 18418 - DNA, 101 bp, rice(Oryza sativa)
  misc_feature (71): n=t or g
gtcattagacttgagattaatcaatgattcagcttccatcaaagcatttccagtattgtcagaagcagcanctgatgctttattttgagaagcatattgct

SEQ ID NO: 18419 - DNA, 101 bp, rice(Oryza sativa)
  misc_feature (71): n=t or c
cggctttgcatagcccatccatgtaactgctatatgtgattacatctggtgtccacccttttgcagtgctntcctcaagaagggcatctacctcctcgaaa

SEQ ID NO: 18420 - DNA, 101 bp, rice(Oryza sativa)
  misc_feature (71): n=t or c
ctaagatcctactgcgataatacaaggatatacgtctagatgtaatatagagagagtgagactcacgtttnttatataggttcgagccccaaaagagtaat

SEQ ID NO: 18421 - DNA, 101 bp, rice(Oryza sativa)
  misc_feature (71): n=t or c
gaggtgttttgtagtaattcttctggaagctcccgtgatccgaagctggaggcattagaaacagtttagcnctgtttagttcacaaaacaaaaatttttac

SEQ ID NO: 18422 - DNA, 101 bp, rice(Oryza sativa)
  misc_feature (71): n=a or g
tgagctattttatgattttctgttcctattttctaacacctttgccactcaaaaggtccatctgtcaggtnttggtgattttcagttgggtcaaattgata

SEQ ID NO: 18423 - DNA, 101 bp, rice(Oryza sativa)
  misc_feature (71): n=t or c
tgttgatggttttggtgttctcaagatgggtatgcatgtgttcttcggtggaccgggccaatgtcccaatngagagaatagttgttgctttgtaatgtaga

SEQ ID NO: 18424 - DNA, 101 bp, rice(Oryza sativa)
  misc_feature (71): n=a or c
aagtatcttcttgcctgcatctgcatctgcaacctggaacagtagtactcactctgcaagtgccaagtagnagtagcgatcatgggcgttggccggcccac

SEQ ID NO: 18425 - DNA, 101 bp, rice(Oryza sativa)
  misc_feature (71): n=t or g
ggataagccctaagagagctttgctgactggaatggcacatgagatcgaatactacaaagaaaatcagaanctggcagaatggtctagcaggtatgcatag

SEQ ID NO: 18426 - DNA, 101 bp, rice(Oryza sativa)
  misc_feature (71): n=a or c
ttgttggcatgaacaccagttccttgatgatcagtgggccattgcttccacttaattatactatggtgtgntcaaaaccttttaactcactggcatggttc

SEQ ID NO: 18427 - DNA, 101 bp, rice(Oryza sativa)
  misc_feature (71): n=a or c
tgtacagtcatcataagaatgtgcatgaattgttataggctatcttctataattacgtaataattatagcntagtggttataatgacctgagtagtacccc

SEQ ID NO: 18428 - DNA, 101 bp, rice(Oryza sativa)
  misc_feature (71): n=a or g
gaacctggggggcaaagcaaaaggtaaaaaacctgaacatttctccatgattatacgtgggattcttctcngcatcccaaaatcgaaaccaattttgtggt

SEQ ID NO: 18429 - DNA, 101 bp, rice(Oryza sativa)
  misc_feature (71): n=t or c
taatttagacatatatacttgattttagtcgttttatttaggcttacccactgcccacggtttagaaaatntctggctctgctactagctactcaaatgac

SEQ ID NO: 18430 - DNA, 101 bp, rice(Oryza sativa)
  misc_feature (71): n=t or c
aaaaaaaacaaacaagaaagaaaatagaaattcgaagagaaggttccaaccaagcataccatcttctcctnctccttcctcctgccttcgttcttgtcttg

SEQ ID NO: 18431 - DNA, 101 bp, rice(Oryza sativa)
  misc_feature (71): n=t or c
aaagttgatgagatgagggcgtgccagtcagttattctgcaactgacaagatatcagtagatcaaattgcngatcggctgagaagccgatggagtagttcc

SEQ ID NO: 18432 - DNA, 101 bp, rice(Oryza sativa)
  misc_feature (71): n=t or c
ggccggtgagttggaaaggctacctccatggataccatcgcttcgaaacgtatccaggtttgctcttcgtngcaccgaactccatgctgatgccataggag

SEQ ID NO: 18433 - DNA, 101 bp, rice(Oryza sativa)
  misc_feature (71): n=a or g
tagataagtgaaaggcaaagtgccagccagaacttccattttggtgctgtcagtgttgatgggaatcatanaggatttatgaaaatttattttaagtcctg

SEQ ID NO: 18434 - DNA, 101 bp, rice(Oryza sativa)
  misc_feature (71): n=a or g
gcatcggcctcgtgactcggcgtcaaccgtgaagctagccagcccgcgcacattatctcttagtagaaganaagcctgagatttctttattccagcaagcg

SEQ ID NO: 18435 - DNA, 101 bp, rice(Oryza sativa)
  misc_feature (71): n=a or g
ttgacttgcaaactgatcgatgagtacacaataaaagtagacgtggttggcttggcaaatcccaagatagntcgattagattagtgagggaagaagtatgc

SEQ ID NO: 18436 - DNA, 101 bp, rice(Oryza sativa)
  misc_feature (71): n=a or g
tcgtttgtttttttggtgtctcttcttcttgttgttctcatgcttgtgcctttacttcaacagtgctttcnctgccccaggctgaaggtgaggcccgaaag

SEQ ID NO: 18437 - DNA, 101 bp, rice(Oryza sativa)
  misc_feature (71): n=a or g
tctctttcaggctcttgctggatttatgaggcaaatcatgcaaggatcagtgtcctttgaaccatctcagntggttataacatctggtgcaactcctgcaa

SEQ ID NO: 18438 - DNA, 101 bp, rice(Oryza sativa)
  misc_feature (71): n=t or g
agagtttccacaacatcctgttggtcagctccagccaacttcttggctccattctttgtcttcattcttgnctttgattggaaggcattcattaatacaga

SEQ ID NO: 18439 - DNA, 101 bp, rice(Oryza sativa)
  misc_feature (71): n=a or g
tgttctccccggcacgtcggatctgggagtgatcgaggctgagcggcaccgagtgccaaatccttgaccanccttgggaaagtgtggtggtacggatggca

SEQ ID NO: 18440 - DNA, 101 bp, rice(Oryza sativa)
  misc_feature (71): n=t or c
gccacccctgccaggaaggtttcccctcgacaggaacgcttaggcacaaccgctccagcgccctcgccaanggcagcgccacccgtcacttgcaccggtgg

SEQ ID NO: 18441 - DNA, 101 bp, rice(Oryza sativa)
  misc_feature (71): n=t or c
cataccaccagttcgggaggaacgaagtcggagtcaacttcattgtcgctaccgccctttcccttctttgnaggagaaggatgggggtcactcagcgagtg

SEQ ID NO: 18442 - DNA, 101 bp, rice(Oryza sativa)
  misc_feature (71): n=a or g
atcttggcaattgcctgctgatgtcatttggtgtcttcaacagttcaactactaatcgaacggatggtggnaaaaactcaaaaacttggtaaatagatctt

SEQ ID NO: 18443 - DNA, 101 bp, rice(Oryza sativa)
  misc_feature (71): n=t or c
tacactgccccaaaggcgccctgcccaagcttgcgatcctccgagaaatggtcggtcgcagctgccaaatngcggtattcgaacctcctggcgccgcctgt

SEQ ID NO: 18444 - DNA, 101 bp, rice(Oryza sativa)
  misc_feature (71): n=a or g
accccggagtaaaagatgtgtgacgcgcatttgctccgtattcacctgatggacccctctttttaccaacntcgtgggctgataggtggacccttcacatc

SEQ ID NO: 18445 - DNA, 101 bp, rice(Oryza sativa)
  misc_feature (71): n=a or c
ccttgtttcgtcgccttgccctctcagaacagtgcatttccaccgccactatccccaattgttttggcctncaccaccaacaggctccccgaaatccggcg

SEQ ID NO: 18446 - DNA, 101 bp, rice(Oryza sativa)
  misc_feature (71): n=a or g
gcatacgggttcccttgatacccatcggtgcacttgcataagtaaccagcacgggaagctgtaaagctcangttatcatcgcaccggctgtgcttgctggc

SEQ ID NO: 18447 - DNA, 101 bp, rice(Oryza sativa)
  misc_feature (71): n=t or c
gaagaggaaaatcgcctggactgaacagtgactcgttgaggcagtagagccagaggaagatgagaagtgtngtaccttttgcgggcgtccaaagcgaagaa

SEQ ID NO: 18448 - DNA, 101 bp, rice(Oryza sativa)
  misc_feature (71): n=a or g
aagctcatgtagtttcttacattaaacttttacagtcagtctaaaagcaagtttaataatattagagcaantttaataatattgtcaactaatatctttaa

SEQ ID NO: 18449 - DNA, 101 bp, rice(Oryza sativa)
  misc_feature (71): n=a or g
tcttacgtttatagctagtcaacatcaatcattcaaagaattctctacctgcaagagaccggccaatgganccgcagcgcctgaggaagaaatcgccatct

SEQ ID NO: 18450 - DNA, 101 bp, rice(Oryza sativa)
  misc_feature (71): n=t or g
ggcttgatctggtaggtggatgccgaaagcattacattcagcgggtggaacactgtctaaggtttctattnctgcaagaaatcgacaaatggctcaccggt

SEQ ID NO: 18451 - DNA, 101 bp, rice(Oryza sativa)
  misc_feature (71): n=a or g
gctgtttgaaatggtccgaagctgggtgttagaaggggagttggaggatgtgtttgcagaattcttcattnttgggcagccagtcaaggctgagtctctgt

SEQ ID NO: 18452 - DNA, 101 bp, rice(Oryza sativa)
  misc_feature (71): n=a or g
ggaactggcgaaacagaagtctgcatagcggtataattgaagcactggacaggacgaagattgccggtctnagagcgagttaccatagcatgacgctgttg

SEQ ID NO: 18453 - DNA, 101 bp, rice(Oryza sativa)
  misc_feature (71): n=a or g
ccctcaagtgcactgccttaaaagaacacaagcatgaagcatcacatgtacttgtaaggtagccgatgtcnaaaatagtcaataatcaagaaaagaaaaga

SEQ ID NO: 18454 - DNA, 101 bp, rice(Oryza sativa)
  misc_feature (71): n=a or g
gtgtcacgctcgcctctcgggtcaggaccagaccaaacgttgccgctggacactggccggtgaacccgctngacactggccggtgaaccacgctagaaacc

SEQ ID NO: 18455 - DNA, 101 bp, rice(Oryza sativa)
  misc_feature (71): n=t or c
caaacagtcgatcatacacaacaacagaattaagcacaaagtaggcaaaaacataccgcaccaggttcagntaccaactccaagctttttgccattgaaat

SEQ ID NO: 18456 - DNA, 101 bp, rice(Oryza sativa)
  misc_feature (71): n=t or c
agaattcttaactgcctagctacagactcccttgtgccttcttccctggggcaccccagccactttggcanattaaccgcccaagaaaccatcttgttaat

SEQ ID NO: 18457 - DNA, 101 bp, rice(Oryza sativa)
  misc_feature (71): n=a or c
gtttaagtatttcaaaatgttcttagctgactacttcatggttcatgcttagcttgcgtgagttttcaacnaaaaaaaaaaacttgcgtgtactgtatcat

SEQ ID NO: 18458 - DNA, 101 bp, rice(Oryza sativa)
  misc_feature (71): n=a or g
gtgctggttctgctccttcgctgtttagacgcgtaatccgcatgaacaatcctgtctcgatttcatactgntgatatttgatctgctgcgcggctgctcgt

SEQ ID NO: 18459 - DNA, 101 bp, rice(Oryza sativa)
  misc_feature (71): n=a or g
ccaaccagcataacttaactgaactgactggcatcgaccattctattcttttgctcaaaacaaccgaactnactgggattcgaccctggagttctattgct

SEQ ID NO: 18460 - DNA, 101 bp, rice(Oryza sativa)
  misc_feature (71): n=t or c
gctgtagcccctgttttgctggttgttacagacgttgcaggggctgcgaggaggccagttgatgagctccngaaaaagccgcatccctccattcctgtcga

SEQ ID NO: 18461 - DNA, 101 bp, rice(Oryza sativa)
  misc_feature (71): n=t or c
ccgaatcggagtcatcaacagagtcccaatcactgccatcatcgtcatcattatctaatttcttgatctcnatacctcggtgatgctcagcatcttggcct

SEQ ID NO: 18462 - DNA, 101 bp, rice(Oryza sativa)
  misc_feature (71): n=a or g
attagagggaatccactcagaggcatcatcagaagtaaccttctcagtcgcagcatcactctcctatacancagcatccacagcagcctcaggatcagtcc

SEQ ID NO: 18463 - DNA, 101 bp, rice(Oryza sativa)
  misc_feature (71): n=t or c
ttcttgacgtttagcaaacaatttatgcttccctgtttgtggaagtgatatagacttcatgaagctgaccnaatctgggtatataccatcagcaaggttat

SEQ ID NO: 18464 - DNA, 101 bp, rice(Oryza sativa)
  misc_feature (71): n=a or c
atcatcgaactaaaatttgtctggtatctcgtactgctaggttgcagcaaatttccatttccaacagcacntatgaaattttcccataagaactgtggatg

SEQ ID NO: 18465 - DNA, 101 bp, rice(Oryza sativa)
  misc_feature (71): n=t or c
cgccgccgccgcctccatcgccggcggcgagcgagaagggattttggggtgtggggaatggggaacgacanggagagcattttggggttttgaaaatttgg

SEQ ID NO: 18466 - DNA, 101 bp, rice(Oryza sativa)
  misc_feature (71): n=a or g
atataatattctctcatatgtaaagttacatcctcgatctatgggaacattaagatgggaacaggatttcngacttaattttccttgttacaaggcattaa

SEQ ID NO: 18467 - DNA, 101 bp, rice(Oryza sativa)
  misc_feature (71): n=a or g
atgccgccacccgctttttcttgttgttgcgcttctgagacgaggtcggggctggctttttctttggctcnccgtcgccgagctgcagttgcaccttcgcc

SEQ ID NO: 18468 - DNA, 101 bp, rice(Oryza sativa)
  misc_feature (71): n=t or c
gacggcattttaacatctaaacagtttgcgcttcatcgaaagctttgcacatgttgatgatggagtccacnacatgtgacactgtaccatagtcattgttg

SEQ ID NO: 18469 - DNA, 101 bp, rice(Oryza sativa)
  misc_feature (71): n=a or c
taatttattataatagagtagataatccttggtaataatttgctcagtgatgcaaatcaaactgggccttnccctgccgtagggctcgtttgggctggggg

SEQ ID NO: 18470 - DNA, 101 bp, rice(Oryza sativa)
  misc_feature (71): n=a or g
acatatataatcttctttaagctcttgctctttgtactgttgtatattactacctccgtttcagtttacangacgttttgactttagtcaaagtcaaactg

SEQ ID NO: 18471 - DNA, 101 bp, rice(Oryza sativa)
  misc_feature (71): n=t or c
tccatatgttacaaatccttctctaggcgtttcttttacaggggctggagtctaccacgacggccattgcnagttcatggacgagaagaccctctcagcca

SEQ ID NO: 18472 - DNA, 101 bp, rice(Oryza sativa)
  misc_feature (71): n=a or g
cgtcctccttatccatctccctgaacaatgcaatgaccttctcgtactccccattctggcaataccctccnagcagcgcgcaccgtgaaacttcattccta

SEQ ID NO: 18473 - DNA, 101 bp, rice(Oryza sativa)
  misc_feature (71): n=a or c
acgacagtacatggcattatcctgtcatgatgatttggtcggacaccagacacctcacacccacagatacntccatcctccaaatgctgcaaaacaacaag

SEQ ID NO: 18474 - DNA, 101 bp, rice(Oryza sativa)
  misc_feature (71): n=a or g
tcgttttcgtgaatgttcgcgcaacagctttttcgcaccatggacactatacatacgtgacttgggtcttntttggatcctccgagctattaaatagccct

SEQ ID NO: 18475 - DNA, 101 bp, rice(Oryza sativa)
  misc_feature (71): n=t or g
gcttccactcgccccaccatctatcaaatgccctactcctgagtcttgctaactttatgttttcaatgctncctaatgggggtccagggatgttcagtagc

SEQ ID NO: 18476 - DNA, 101 bp, rice(Oryza sativa)
  misc_feature (71): n=t or g
caaaacatgaacatctgtgaaatatagcacgtagtacgaggttgatgagaacgatactcacaaatgaatanggattatgtcattttcattttgtatgtgaa

SEQ ID NO: 18477 - DNA, 101 bp, rice(Oryza sativa)
  misc_feature (71): n=t or c
cagatttgtcggcctatttgtttgttctgttcatcgattagtggtagtgaactagtggccaggcattcttntgtactagttcacaaacctgacatgcatgc

SEQ ID NO: 18478 - DNA, 101 bp, rice(Oryza sativa)
  misc_feature (71): n=t or c
tgatgggaatgcccccctctactcctccttcctttctaaagatcagattctgacggcacatcattcccctngtcatttccaataaatccatcaagctcggc

SEQ ID NO: 18479 - DNA, 101 bp, rice(Oryza sativa)
  misc_feature (71): n=t or g
attaccgttaggaaattatcccactattttcaaggtcactcggttcggggatatacttcacacccgcgaancaaatgggcggatcgcaaagtgggccttag

SEQ ID NO: 18480 - DNA, 101 bp, rice(Oryza sativa)
  misc_feature (71): n=t or c
tcatcatcaaaacatctggtggaatttattactgacctccctcaattcattctcagcctgagattggatgngctggagttcttctttatgataagctcgaa

SEQ ID NO: 18481 - DNA, 101 bp, rice(Oryza sativa)
  misc_feature (71): n=a or g
ttatcgttttcgctttctgcgtctccattttccaccactgaatctgtaacttcttcgtgaacagaactgtntgcctcgtccacaaccactagcttctcctc

SEQ ID NO: 18482 - DNA, 101 bp, rice(Oryza sativa)
  misc_feature (71): n=t or c
gccttctttattccagcacacttcaaaaatgccaccactccctctgtatgtcttcaagatcctcccttctntaacggaccatatgtgtaggcattgatcaa

SEQ ID NO: 18483 - DNA, 101 bp, rice(Oryza sativa)
  misc_feature (71): n=t or c
gcacaagtgtgtcgtcgaaattctgggatcccagatgaaatatcacgccagatctgggttgggcgaggganggggtcgccaaggttaacagtcgcagacca

SEQ ID NO: 18484 - DNA, 101 bp, rice(Oryza sativa)
  misc_feature (71): n=a or g
acgaacactccctaaatgatcatacacttcatcacgccttagtaaccacttattaacacatttcttgcacngacaccggatcttatcattaggattctttt

SEQ ID NO: 18485 - DNA, 101 bp, rice(Oryza sativa)
  misc_feature (71): n=a or g
acgcccgcctcgtcgatctcctccgcgccgccactgatcccacaatggccaccgtcgttgaatccccttcnccgcatgcagccgtcattggagcgagcgcc

SEQ ID NO: 18486 - DNA, 101 bp, rice(Oryza sativa)
  misc_feature (71): n=t or g
ttttatatggagggagtagtagttagtaattaagggagagatgctaggcaaaccatctcaggtaggcacanaagatggatagctttgtagatatcttcctg

SEQ ID NO: 18487 - DNA, 101 bp, rice(Oryza sativa)
  misc_feature (71): n=t or c
agccatcttaatccactgaacccacttttcattaaatcctttcctctgcagaacttcaaacaaaaaactcnattgtactctgtcatacgccttctcaaagt

SEQ ID NO: 18488 - DNA, 101 bp, rice(Oryza sativa)
  misc_feature (71): n=t or g
gtcttcatcacaactgaacaatcattccaaattccagaaacagcatcacatagcactttccggttaccaanctgcaacacgatgaagcagaaagaagggaa

SEQ ID NO: 18489 - DNA, 101 bp, rice(Oryza sativa)
  misc_feature (71): n=t or c
gcaccctccacaccctcaacttcatcaccgcgctcgacaagtccctccaccgcgcccatgactccaagctnatcctccacctcgtgctccagcgccgctac

SEQ ID NO: 18490 - DNA, 101 bp, rice(Oryza sativa)
  misc_feature (71): n=t or c
attgaaaaaactgcaggagagatgatgaacaagaaaacacacataactcaccatgaaggcatgctgggtantgggagatttcctcctgacggtgctggagg

SEQ ID NO: 18491 - DNA, 101 bp, rice(Oryza sativa)
  misc_feature (71): n=t or c
agtcggctcaagctcagctcaaggtggtaaaggtattgctggtgaaccaggcgacaaaggtagtggttttnaggtaggcatggttgaagatcttggcccag

SEQ ID NO: 18492 - DNA, 101 bp, rice(Oryza sativa)
  misc_feature (71): n=a or c
cacgctgcgggtgtggtcggcgtccttgacgaaggccgcgattaaacactcccgtctcaccatgagcaacnggccagacgactccaggaggtgccagctac

SEQ ID NO: 18493 - DNA, 101 bp, rice(Oryza sativa)
  misc_feature (71): n=a or g
catgccaaaggtcactatgaagtctgttcaatgttgatggagataacatgataaaaagaaaaatgtgtganccatctctatcttagtggtcgtgccggagt

SEQ ID NO: 18494 - DNA, 101 bp, rice(Oryza sativa)
  misc_feature (71): n=a or g
ttgttgaatagattgtttggtatcaagccaatgaggtagttcctacggagattaatactactaaggttctncaggttctgcagatctgctgggattggacc

SEQ ID NO: 18495 - DNA, 101 bp, rice(Oryza sativa)
  misc_feature (71): n=t or g
ggctagaccgcggatcgaaggaggaaggggcaagtcaatgccttttcctacaaggagaagaatcggggatntcggaaactttccccaaatgagatttctcg

SEQ ID NO: 18496 - DNA, 101 bp, rice(Oryza sativa)
  misc_feature (71): n=a or c
aagaagcggaaggctccccgcgtcagactctctgtctttatatactccctccatatgaaaataactactcntaggagcaggtacaatagcaaactattagc

SEQ ID NO: 18497 - DNA, 101 bp, rice(Oryza sativa)
  misc_feature (71): n=t or c
aggaggccaagaagggccatctatccgagtatccgctgaaccgagaccggtgcgttggtgtcagcagcaanggccttaggtatgtcaaggtgcgcgcacac

SEQ ID NO: 18498 - DNA, 101 bp, rice(Oryza sativa)
  misc_feature (71): n=a or g
accatttagtttaaggttctcatatggttgattataagtcataataataatatttttaccgaccggtaccnttttcaaaatttagtttttcggattactgt

SEQ ID NO: 18499 - DNA, 101 bp, rice(Oryza sativa)
  misc_feature (71): n=a or g
ggaagagtatgttgaaggagactatatggatgacatggaagatatggaagactttgaaggcctccctggtngtgattatggtaatgtgacttccgctagta

SEQ ID NO: 18500 - DNA, 101 bp, rice(Oryza sativa)
  misc_feature (71): n=t or c
gtggcttgcgtgcatgcgtgtggaaggaaagcaggagacttaaggtgtttattttgatgaggacatcactnctttggatacgcataatactcctcaagtta

SEQ ID NO: 18501 - DNA, 101 bp, rice(Oryza sativa)
  misc_feature (71): n=a or g
gcacggagccggagctcgtcgatggtgctcatgatgctggactcccacttccgggtgtaagggcggatgcnctcgtcccggccagcggcggcggtggaatt

SEQ ID NO: 18502 - DNA, 101 bp, rice(Oryza sativa)
  misc_feature (71): n=a or g
gatcttggaggtttacagtaacacttaattaccaagagcatggccttgacatggtccttagtgaagccctncttggtgtttccttccatcttccagaggtc

SEQ ID NO: 18503 - DNA, 101 bp, rice(Oryza sativa)
  misc_feature (71): n=a or g
atgcggaaggaatttttaacggtcgtaggtcaaagataatcacggtcactaagctactcctttcgtctaanaaaactcaacctatactaaaatgtgacatc

SEQ ID NO: 18504 - DNA, 101 bp, rice(Oryza sativa)
  misc_feature (71): n=t or c
aggtggctacaacaacaacgacaacaacaactccaactgcggtggatgcgatggcaactccggtggtggcngtggagatcgtggccatggccgcggcaacg

SEQ ID NO: 18505 - DNA, 101 bp, rice(Oryza sativa)
  misc_feature (71): n=a or g
gaacccagcggaggcgctggagctgttctggaggatggtggcagaggatgcagtggtgaggcctgatgagntcacgatgatcgcggctgtgtcggggtgtg

SEQ ID NO: 18506 - DNA, 101 bp, rice(Oryza sativa)
  misc_feature (71): n=t or g
ataaaaaaatgacgtttgtgcccttgcttatttgaccctatattcttaaagcttttgttagggtggataanccaggcgatcgaattcccacgcccacaccg

SEQ ID NO: 18507 - DNA, 101 bp, rice(Oryza sativa)
  misc_feature (71): n=t or c
tctctcaattgaaaatagaaaagagaaaacaaaaaaaaatcccctcaatctcatcgttgacttgcttcacnggcgctcccagctgctcctagctgctcaac

SEQ ID NO: 18508 - DNA, 101 bp, rice(Oryza sativa)
  misc_feature (71): n=a or g
tgtggtgtacaagggaaaacttgataatggccgttcagtggcagtgaaacaatataattggagaacacagnaaaaggagttcacaaaagaagcgatcatac

SEQ ID NO: 18509 - DNA, 101 bp, rice(Oryza sativa)
  misc_feature (71): n=t or c
atacacagtagacagcagcagagccctactgtggcagtgtggtactccctccgtctataattcgtattttnattgttgttagatgataaaacatgattaat

SEQ ID NO: 18510 - DNA, 101 bp, rice(Oryza sativa)
  misc_feature (71): n=t or c
aagccctcatcaaagttgccttcggctcgcaagagaacagaagaggagaagagatactcttcgatattgtngacatcccctacaactacaacgccatcttc

SEQ ID NO: 18511 - DNA, 101 bp, rice(Oryza sativa)
  misc_feature (71): n=t or c
aataatatcaaatcaataatgctccatattgtgtatgctctctaggtctgtatgtcctctctctatctctntgaatcacctcttgttccctcggctcatgc

SEQ ID NO: 18512 - DNA, 101 bp, rice(Oryza sativa)
  misc_feature (71): n=t or c
acgttcttcttttctagcccacagcagaggaaggtatttttttctaaatagtagatctattctaatggtcnaaaataccgggtccaccaattttactgaaa

SEQ ID NO: 18513 - DNA, 101 bp, rice(Oryza sativa)
  misc_feature (71): n=t or c
cttttgctctctttgttccattagcaatatgtcatgcttagactctggaatttatcgatccacgagactgnggagggtggacttacgcatcttccttacac

SEQ ID NO: 18514 - DNA, 101 bp, rice(Oryza sativa)
  misc_feature (71): n=t or g
tgaccatcagatcactcagaaggatgaaaataaactttctgaaggatcagggtttgtgctcttcagttctnagctagctgtaattaaaattctctcaaatg

SEQ ID NO: 18515 - DNA, 101 bp, rice(Oryza sativa)
  misc_feature (71): n=a or c
agagagagagggagaggagagaagggagagagatagagttgaataggggaaaatatctgtggtgggagagngaagataggagaagtttgaaaaattttgaa

SEQ ID NO: 18516 - DNA, 101 bp, rice(Oryza sativa)
  misc_feature (71): n=t or c
acataaagttcaagctcttatcccagatgaactagtcaatgcccctactccggccgtttacctcgagcaanatcaattcaagctggagaatgccaagctaa

SEQ ID NO: 18517 - DNA, 101 bp, rice(Oryza sativa)
  misc_feature (71): n=t or c
ggtttgaccatgtcaccgaccacctcccactacagcttcagctacggtggagcaagctcatcatctgctangccacgtgcgcccactgctcctcttgcact

SEQ ID NO: 18518 - DNA, 101 bp, rice(Oryza sativa)
  misc_feature (71): n=a or c
cggccgccaacaaactgctgcgagaagtctccgtgcgcctccaaaaatcggaacttttttccttttctttnatcattatcgctttcttttctcgagtttta

SEQ ID NO: 18519 - DNA, 101 bp, rice(Oryza sativa)
  misc_feature (71): n=t or c
ggatggaccagcccctgctcctctgttcatacaacagtgacatggtacaaaaccttcagcacgattcttgnacgcgatggaataccttctgtagaacagca

SEQ ID NO: 18520 - DNA, 101 bp, rice(Oryza sativa)
  misc_feature (71): n=a or g
gtatatatggtccataagctagctagtgtacgaaaagacgaaaagtaatactatctgtatagctaactacngtagtacggtgcatgtagtacgtgtacgga

SEQ ID NO: 18521 - DNA, 101 bp, rice(Oryza sativa)
  misc_feature (71): n=a or c
tcatccgctaataagtcgctccgttttacgtatgcacaagattatttaccaacatcaacacaaagcctaanaacctaacaacttgagttatgctcaattcg

SEQ ID NO: 18522 - DNA, 101 bp, rice(Oryza sativa)
  misc_feature (71): n=a or g
acgtgaccaaagaaacgaaaaggctgtagccacaaatgttgaccttgtaagctgaatcctcgtacggcaanggtgatctttccagtatatacagcataaaa

SEQ ID NO: 18523 - DNA, 101 bp, rice(Oryza sativa)
  misc_feature (71): n=a or g
tcgcccaccgcccgcctcctcctttacaaaaacccccgcctcccacacgcacgacacgacgcttgcacttncagctgcagctagctttgcccagttttgct

SEQ ID NO: 18524 - DNA, 101 bp, rice(Oryza sativa)
  misc_feature (71): n=t or c
gagagaattgtacaacaatagaacatgccctgacaaagatgactcccaaacttcaagcagccttacactangcagctttcttgggctgttcatcatcactg

SEQ ID NO: 18525 - DNA, 101 bp, rice(Oryza sativa)
  misc_feature (71): n=t or c
gaaaaaatttataaatagcaaaactattcttatactccctcctccgtttcatcagattataagacgcaaantgtttcaaatctgactaagattatagataa

SEQ ID NO: 18526 - DNA, 101 bp, rice(Oryza sativa)
  misc_feature (71): n=a or c
gcaaagcatcatgtaaaagaactccgaagaaaagtggatgtaccactaacagtccaacctgccttgctatnaatctatctagcccaacagactaattacct

SEQ ID NO: 18527 - DNA, 101 bp, rice(Oryza sativa)
  misc_feature (71): n=t or c
cctgttgtcttggtggtgtcgactgtatcggctgtacaattggctgtgttggcgcaaacattgtagcaatntgttcctgagtaagtcgattgatgttctgt

SEQ ID NO: 18528 - DNA, 101 bp, rice(Oryza sativa)
  misc_feature (71): n=a or g
tttaagtgctacgtcagcttcatgtcatgcaaaaccggccttaatattgtcctaggactttatgtacaccncttttggaagttgatatatatataacctgc

SEQ ID NO: 18529 - DNA, 101 bp, rice(Oryza sativa)
  misc_feature (71): n=a or g
ggggagactatctatcatgtttttagattttctatttgtccttacggtcgagcacagttggcttttatctntatgagactatttgtggtttttatgttaag

SEQ ID NO: 18530 - DNA, 101 bp, rice(Oryza sativa)
  misc_feature (71): n=t or c
tctggttgcacattatgaaccaaattctcagggacaacttgagtcatgacatgctgccttggctgattacnaggcgtcatcaacccagccgatgcattcag

SEQ ID NO: 18531 - DNA, 101 bp, rice(Oryza sativa)
  misc_feature (71): n=a or g
agggataccttggtcgaggcttttggtttccaatacagtaagttccacactgttcacttccgccatcatgntaggggttctaactggcgggcggctcatac

SEQ ID NO: 18532 - DNA, 101 bp, rice(Oryza sativa)
  misc_feature (71): n=a or g
tttgcttcattgttggtagaaatggtagttcggctggagatggttattgaagaagtgaaggaactggaganagcagcaaattttagagaattcactggaca

SEQ ID NO: 18533 - DNA, 101 bp, rice(Oryza sativa)
  misc_feature (71): n=a or g
ctttgaccgcgctccgtggggatgcgtgtggcaacaacagaggcacacgggtttaaaacgacgtgattagngcatgtacaatagtatgctataagccagct

SEQ ID NO: 18534 - DNA, 101 bp, rice(Oryza sativa)
  misc_feature (71): n=t or c
caccaattcacaacacacaccatgcatctcaaacaaatttctatggtccatccggacatctcatttgtctncatggggctgggcaagacactcttggtcgt

SEQ ID NO: 18535 - DNA, 101 bp, rice(Oryza sativa)
  misc_feature (71): n=t or c
tacctcgagcaggtggccatctccatcgagacactccttgatctggccacagtgtccatcgaggaggtcancgggcggctgcgggcagtggagcaacggaa

SEQ ID NO: 18536 - DNA, 101 bp, rice(Oryza sativa)
  misc_feature (71): n=a or g
aacgaatcttatgagagcatgtagaacaaaaatcacgaacctcatatgggagcataggctgcaagcaacangaatcaaactgctgcccttccaaggtgctc

SEQ ID NO: 18537 - DNA, 101 bp, rice(Oryza sativa)
  misc_feature (71): n=a or g
ttctttatgtttggatgggggttctcggatctgccttggacagaactttgcaatgctggaagccaagatgncgctcgccaccatcctccagagcttctcct

SEQ ID NO: 18538 - DNA, 101 bp, rice(Oryza sativa)
  misc_feature (71): n=a or c
tgttcgagggcgtgctaatgtcaactatagctacttccaaaatcttttaacgcttccaacggtcgagattntaagaatatgtagttacataatccagaaaa

SEQ ID NO: 18539 - DNA, 101 bp, rice(Oryza sativa)
  misc_feature (71): n=t or c
tttgcttgcaatttcacccaatatataatacccatcacccgacgtcgcaaggagagcctctcatctcactngcaaatccaataaaccaaagcaaaattaat

SEQ ID NO: 18540 - DNA, 101 bp, rice(Oryza sativa)
  misc_feature (71): n=a or c
acaatcatctagttccagtggcacctggttacatcatcaagacataaattctcaaacgattttataagctntacattctcagcagtgtgctgcaacttctt

SEQ ID NO: 18541 - DNA, 101 bp, rice(Oryza sativa)
  misc_feature (71): n=a or g
atactaatgtgtctattatttctctatgtttatgccatgtcttattttctgcaaagcaaccgcattgaacnataattaacacattattactacatcatcat

SEQ ID NO: 18542 - DNA, 101 bp, rice(Oryza sativa)
  misc_feature (71): n=a or g
gttgtagtaacttgcatgaaccttggcaaaagttgtggaaagctcctttaataatgtcatgttgatgttgnttcatggttttgtatgtgattaccgtgtcc

SEQ ID NO: 18543 - DNA, 101 bp, rice(Oryza sativa)
  misc_feature (71): n=t or c
agcatagtggcggtgatggaggagctagtttcaaggagaaagctggtcagatgcatcgagaacttggacanggaagaactcgttcttctcctgctgttcct

SEQ ID NO: 18544 - DNA, 101 bp, rice(Oryza sativa)
  misc_feature (71): n=a or g
cctggttctaaaattattctttgtatcatggtatatcttttgagcgagtgtggtcttgccaactccaacancaccaactatagcaaaaaggcattgaccag

SEQ ID NO: 18545 - DNA, 101 bp, rice(Oryza sativa)
  misc_feature (71): n=t or c
ctgacgcgatcgcttgctggacatcgagtccacaagtggacatgtgaggatgaaatggccatggagatcgntgccagcgtgatggagagccttcttctagg

SEQ ID NO: 18546 - DNA, 101 bp, rice(Oryza sativa)
  misc_feature (71): n=t or c
tccaccaccagccccctttctcctcccgctcaaatcgtggcggatgtaccgccaaaaaggtagtctcacangagagcgcgctgtgcacctcctgcgcacgg

SEQ ID NO: 18547 - DNA, 101 bp, rice(Oryza sativa)
  misc_feature (71): n=a or c
cctttaattcatcacacgatgaaagctcaagactgcaacagatagataccatgacgtcgaaacgaaccccnaaaaaaaaacaccaccaccaaaaagcatta

SEQ ID NO: 18548 - DNA, 101 bp, rice(Oryza sativa)
  misc_feature (71): n=t or c
tttggtgcagcaagagagttctcaactgctggcctagtggtggtgctgcctggtcccaacgtcaaacactnggtgggcgtcatgtcgacacctttcccgtt

SEQ ID NO: 18549 - DNA, 101 bp, rice(Oryza sativa)
  misc_feature (71): n=a or g
cacttgacctaagaaagtctaattttgcttatttactgcagaaagcttcttatgtggttttacaaatatgngcaaatgataaaactgtaagggagagtctt

SEQ ID NO: 18550 - DNA, 101 bp, rice(Oryza sativa)
  misc_feature (71): n=a or g
gctttaggagttaagggacaagtcatacctagtattgtggttcaagcataaattatagattcagccacacnttaagatacctagaatgaaatagatggatt

SEQ ID NO: 18551 - DNA, 101 bp, rice(Oryza sativa)
  misc_feature (71): n=t or c
gtgatgacgagatcgtcgacgtacatgccgacgatgagatgtgtgtttccctcggcgcgcacatagacagngtgctcggtatcgctccgtttgaagccgag

SEQ ID NO: 18552 - DNA, 101 bp, rice(Oryza sativa)
  misc_feature (71): n=a or g
gctgtatcagatgatctggaagtttgcttccatcattcaatcattacctttcaggaagatggtccttaacntttgttgttatcaatttcttgcaaggtgat

SEQ ID NO: 18553 - DNA, 101 bp, rice(Oryza sativa)
  misc_feature (71): n=t or c
gcacctgcaacaatatcaaagtcttcactggatgacccgtttccaatatcatgaccagactttgctggtgntttcttaagtgattttcctttcttcctctt

SEQ ID NO: 18554 - DNA, 101 bp, rice(Oryza sativa)
  misc_feature (71): n=t or c
ttttcaacctcattgcacaccttacaaaagctccctggagtgccctgtgacaactcgatgagtgctcttgngccattatccatggcttcatcttcaatgga

SEQ ID NO: 18555 - DNA, 101 bp, rice(Oryza sativa)
  misc_feature (71): n=a or g
acgccatccgccgcgggcgacgtcaccgacggtgaccatgaactgtgtcgcatcggggttgtccgccaccncgtggctgaattgaaacctaacgacgaagc

SEQ ID NO: 18556 - DNA, 101 bp, rice(Oryza sativa)
  misc_feature (71): n=a or g
ctgagacttatgaagtactactcggaccatatcaaatacaagcatttttctttaactacaaaggtagcccntgtgaagcacggccatgcatcgtaggctac

SEQ ID NO: 18557 - DNA, 101 bp, rice(Oryza sativa)
  misc_feature (71): n=t or c
ttggttacttgtgtatacaaaaattcagagaatactttatcattataatcttaagggcccttttgaataanaggaatgaaaaaacggaggaataggaaaaa

SEQ ID NO: 18558 - DNA, 101 bp, rice(Oryza sativa)
  misc_feature (71): n=a or g
ggagctacagtacaagacgacgctagaatcccaaactagaaaggaaatgaagaggatcgaaccgtacgtcnaatccggagaggggggaggggggcaaacca

SEQ ID NO: 18559 - DNA, 101 bp, rice(Oryza sativa)
  misc_feature (71): n=a or g
ccaattaatagggatcctactcagcataattccatccgagttaccggggcaagctcctttccaacctggcntgatacggatcgattatttccttgtattcg

SEQ ID NO: 18560 - DNA, 101 bp, rice(Oryza sativa)
  misc_feature (71): n=a or g
ttgattacatactctgattacgtaggccgatatacgtaacaacatacctgggaggtcgatttcatgatttnttttttttacagtgaaagctatcttgcatg

SEQ ID NO: 18561 - DNA, 101 bp, rice(Oryza sativa)
  misc_feature (71): n=t or c
ttcttaggcactaaagtgatgaaagagttgtttaaagactgtagatcagtacatcctaagtggaaatgtgnagccaatctataaaagtcttgggcaataat

SEQ ID NO: 18562 - DNA, 101 bp, rice(Oryza sativa)
  misc_feature (71): n=a or g
caggtcatctggatactcccaatttagaactatatgagctacgttgcgtgcatacgtcaggcgaggaactnagcggtcaaatttttctgtaggattatatt

SEQ ID NO: 18563 - DNA, 101 bp, rice(Oryza sativa)
  misc_feature (71): n=t or c
aagggatgggtaccttcacattgagtgaagatagacatggccagtgtcggagcatatgatgccagagtccnaagaacagcagttggttgctgggagccatg

SEQ ID NO: 18564 - DNA, 101 bp, rice(Oryza sativa)
  misc_feature (71): n=a or g
taagggtactattattgataagggtactaaaacgcattagagaaaataagggtacaaaaacagcatgatcnaatgatgcaataaaccttatcttctcgctc

SEQ ID NO: 18565 - DNA, 101 bp, rice(Oryza sativa)
  misc_feature (71): n=t or g
gacgacgctagctagctagctttgcttgctttcgttttagcgctctctcctctcttgtctttgccttagcntttgcatggctcaaccttgtctttctcctg

SEQ ID NO: 18566 - DNA, 101 bp, rice(Oryza sativa)
  misc_feature (71): n=a or g
tcatgcatggtggagagaagtgagctagctagagaagtaatgaaggtgttgatgagtgaggtgatgatagnggaagaagtgaggatggattggcccagtgg

SEQ ID NO: 18567 - DNA, 101 bp, rice(Oryza sativa)
  misc_feature (71): n=a or c
tattgaattttgaaattcgcgcctgcattatctctgtttgagagagagaaacgtagagatttttctatccntgagacagaaatcgagaggggaggacacaa

SEQ ID NO: 18568 - DNA, 101 bp, rice(Oryza sativa)
  misc_feature (71): n=t or c
tcttttcttgtgttgaactttcacgaggaacagtgggcttcttttgtgccgagtttaatggaatcagtggnttaattctgcttataatgatattacattgg

SEQ ID NO: 18569 - DNA, 101 bp, rice(Oryza sativa)
  misc_feature (71): n=a or g
caaagatgtgggccacactctaaaggcagcttctttttttacaccaagtggagagaacaacaaatggcccntcttgacagctaactagttaatctcaagtc

SEQ ID NO: 18570 - DNA, 101 bp, rice(Oryza sativa)
  misc_feature (71): n=a or g
cagccgatggaatcgtatgaccaggaggaagctggatctacttttctcgaagcagtagatcaaaaatcttntcagccttggtaatatcaaaatcatacctc

SEQ ID NO: 18571 - DNA, 101 bp, rice(Oryza sativa)
  misc_feature (71): n=a or g
ttactgattgaatgatccctcctctctcaggagtcgggaacagaaaattgaattacggagtaacctattcnttgtaaacaagaaaggtggcatggactcgt

SEQ ID NO: 18572 - DNA, 101 bp, rice(Oryza sativa)
  misc_feature (71): n=a or g
tgtaatatgatacgatatgctgaccatatgattcaatttcttttgcagaatgctgcacaagaatccttccntgaaatactgcggtcaaaaggtatcttttt

SEQ ID NO: 18573 - DNA, 101 bp, rice(Oryza sativa)
  misc_feature (71): n=t or c
aactcaactaaaacttgctcaatctaatcaatcgaacacctttgaaacacggatgaacaccttcggtcgcnggtcgaacacctggagcgcgaggacgaacc

SEQ ID NO: 18574 - DNA, 101 bp, rice(Oryza sativa)
  misc_feature (71): n=t or c
atagaacatatcaatatcaggtgtaattagcaagtgtcgatgatgtgggctattctttaaaccaaaacganaatattagaagctaacgagagtatatatga

SEQ ID NO: 18575 - DNA, 101 bp, rice(Oryza sativa)
  misc_feature (71): n=t or c
gggagagggtttgattgggattgtttaagcaattctcgacataagattgaaagatccaaaccttcctcttnggagcggaaacggacgtggccaaaacatat

SEQ ID NO: 18576 - DNA, 101 bp, rice(Oryza sativa)
  misc_feature (71): n=t or c
aggtggagcagggtttaggctgctgtacaattctactccagatttcgtttctggggagtttggattctgcngaacataaccctatttaaaattgcattaaa

SEQ ID NO: 18577 - DNA, 101 bp, rice(Oryza sativa)
  misc_feature (71): n=t or c
tcctttggtagtacaacgggtaaatatagatggactgatcagtggtcaggacagcctgcttgtccgagccnagcccagtaactcctgtggacccccgtttt

SEQ ID NO: 18578 - DNA, 101 bp, rice(Oryza sativa)
  misc_feature (71): n=a or c
ggtactggatcatagctgatgtgtgcatcagtgactccgtgttgtttaaccagaaggtaattgttcactcntttcacttactttgattttagaaggtcgaa

SEQ ID NO: 18579 - DNA, 101 bp, rice(Oryza sativa)
  misc_feature (71): n=t or g
tcctctccagctcctcctttccggcaacgtccaccgcctcaggttccttcttcaccggctcgccaggttcnggtgccggtcgcggctccgcctccgccggc

SEQ ID NO: 18580 - DNA, 101 bp, rice(Oryza sativa)
  misc_feature (71): n=t or c
cgtaggtccccatgtggaccccacatgttagggtccacgtcagcaccttctctcttttccctcctctctcnctctcctcctcctctctcacattcttctcg

SEQ ID NO: 18581 - DNA, 101 bp, rice(Oryza sativa)
  misc_feature (71): n=t or c
gacatgtcgctctcacgtattccatggcctctgagacgcagcagctgcagctggctaattctggggctcgngctcgcgttcgcgtcgtcgtctacctcctc

SEQ ID NO: 18582 - DNA, 101 bp, rice(Oryza sativa)
  misc_feature (71): n=a or g
catgctagctagctcacaccacatggcgccatttctccattctctccatggacgcacatatataagcagcnaccatggtgtccatggctacctctgccaac

SEQ ID NO: 18583 - DNA, 101 bp, rice(Oryza sativa)
  misc_feature (71): n=a or g
aatattcttgcattgcacgtagctttgtttttgctcggcgtcctggttcaccatggcggcgagcttccatnccgctctcctcctcctcttcttcctcctct

SEQ ID NO: 18584 - DNA, 101 bp, rice(Oryza sativa)
  misc_feature (71): n=a or g
aaaccaaacacatgatctctatcatgtgtaccacccgctcacaagcggtgccaacaattcttagcatatanccataaatagttccataagcatgtttttat

SEQ ID NO: 18585 - DNA, 101 bp, rice(Oryza sativa)
  misc_feature (71): n=a or g
tctggtttatatgagattgatgatgaggaatcacagattacaaaggaagtaaacgaaacagacgataccgncgagatcgtagttgatgaattggacaagat

SEQ ID NO: 18586 - DNA, 101 bp, rice(Oryza sativa)
  misc_feature (71): n=a or g
cggttgtggagacgaagttgcccatcagcagcgatggcgaactccaccaactatgcagaagaagaaaccanttggtgacggtagacgaccaatgataatga

SEQ ID NO: 18587 - DNA, 101 bp, rice(Oryza sativa)
  misc_feature (71): n=t or c
ttctcatatatgcataaccatagtatgatccagtaatttacctaggtcaaacctgttacaaagcagagggnatattatactatataagaaatttcacgatc

SEQ ID NO: 18588 - DNA, 101 bp, rice(Oryza sativa)
  misc_feature (71): n=t or c
ggttttgagttattattttacggcgaaccttaaccaatccaccgccaaatcctctctggtccgagccgatntcctcaacctttgcctataaatagcagccc

SEQ ID NO: 18589 - DNA, 101 bp, rice(Oryza sativa)
  misc_feature (71): n=t or c
gatgtctcccgaattgtcgagcttggacccgatcttttgatctttgccatcatgcttcaccttgtggcttngcctgatgaggacacaactagctcggatat

SEQ ID NO: 18590 - DNA, 101 bp, rice(Oryza sativa)
  misc_feature (71): n=t or c
taaaatagttaatactcaattaatcatacattaatacgctaatggctcactacctcgttttaagttttttnccaattttctctgtctcattctcctcaaac

SEQ ID NO: 18591 - DNA, 101 bp, rice(Oryza sativa)
  misc_feature (71): n=a or c
tgccgcctccggctgaggcgaatttccagtatccaagccagtcggacataagtaagggcggggaggaagcngtgcctgcgagtttcgaccatggaaggagg

SEQ ID NO: 18592 - DNA, 101 bp, rice(Oryza sativa)
  misc_feature (71): n=t or c
cgtggagctcggggaggagccgccaccatctagtagcaagaacacaccatcccccgaggccactgtcgagncaatgcctccttgaacgagcagcgagattg

SEQ ID NO: 18593 - DNA, 101 bp, rice(Oryza sativa)
  misc_feature (71): n=t or c
acggcgtggcaaaaacggcagcggcagtatgggagatagagagagggatgggaggggagttcctcaccganggcgaacggcgcgacgagcggcggttgcgg

SEQ ID NO: 18594 - DNA, 101 bp, rice(Oryza sativa)
  misc_feature (71): n=t or g
ggaacataaggcacacctggatatggtcgaatatcacatcagcaagagcaccgtgacggagcgtcaaaatntacccattcacaggatgcctttcaatcccg

SEQ ID NO: 18595 - DNA, 101 bp, rice(Oryza sativa)
  misc_feature (71): n=a or g
ttttttatgagaatgggcccattctaccttgaccagaccgtggtctatgccttcgcccggaagctacgccncgattggcccttcaatgggacccagcgccg

SEQ ID NO: 18596 - DNA, 101 bp, rice(Oryza sativa)
  misc_feature (71): n=a or g
ccccaacttaagccataatatattgccttcatttggctgctcaagcttaaaaggcatgtcatagcaacatnatacaactcgtcttactggtgctcttgtca

SEQ ID NO: 18597 - DNA, 101 bp, rice(Oryza sativa)
  misc_feature (71): n=a or c
aaaggcacccagctgctactcatctggcctccatggaatttcgccacgacaacaccatcagcagaagaatngccacggttcaccttcaggatcgtggcgtg

SEQ ID NO: 18598 - DNA, 101 bp, rice(Oryza sativa)
  misc_feature (71): n=a or g
tttgaaacaaaatgaccttgtttatgtatctggccttctgaattcatatcataaagttgatccaagtgganagaagcatacgttctacaaggtttgtcaat

SEQ ID NO: 18599 - DNA, 101 bp, rice(Oryza sativa)
  misc_feature (71): n=a or c
tagaaaataccaatgcaagccaacctactttaagtggcggtggccacggtggaatgaaataaaatctcatntcagaataattgactacagtccaggacaca

SEQ ID NO: 18600 - DNA, 101 bp, rice(Oryza sativa)
  misc_feature (71): n=a or g
aaaattaaagacaattatagatcagattacacaatatagccgattagagattttgaaggtaacacttactnggatggtaggagcagcaggttgttcttctt

SEQ ID NO: 18601 - DNA, 101 bp, rice(Oryza sativa)
  misc_feature (71): n=t or c
atgacgatcatgtataaggcaaacattgggcctcacacacacgacttttctctgcactctttccaagaacnagtaccagttttcagtgttatcactctcta

SEQ ID NO: 18602 - DNA, 101 bp, rice(Oryza sativa)
  misc_feature (71): n=a or g
tcgctttcctgcatttgtacctgtcgctgctgattctagaaatccagaatttatttggatgaactgagagntgtgaaagacagagacagaggagaggagga

SEQ ID NO: 18603 - DNA, 101 bp, rice(Oryza sativa)
  misc_feature (71): n=t or g
taaagcatggatccaacgtgtactgacagttccatctgtcaacagttcatgtgtcaatcactatgtaacantactcccttcgggttgtttgtttggagggg

SEQ ID NO: 18604 - DNA, 101 bp, rice(Oryza sativa)
  misc_feature (71): n=t or g
tggcgaggaattacacctcagggtcctcgacgaccataccgaagatgggccagtgagatgggtattgtacnagtgcatagatgaaatccacctgttgacac

SEQ ID NO: 18605 - DNA, 101 bp, rice(Oryza sativa)
  misc_feature (71): n=a or g
ctttttttcttctgatgggcctgaaagcttcaaaagagtccctagaggtcatcgacaagcagagaagaaanttcctatggacaagcggtgaagctctgaca

SEQ ID NO: 18606 - DNA, 101 bp, rice(Oryza sativa)
  misc_feature (71): n=a or g
ccagtcggtcccaatagcggcaattaagctgctcgtcttacgatatgtagagtcagttttatctaaaatangaatggagctgagtgaaactctcttacaaa

SEQ ID NO: 18607 - DNA, 101 bp, rice(Oryza sativa)
  misc_feature (71): n=t or g
gctgctggacggcagatcagggtgactgcagagtaacgtcagggaaggccgaagtcagaagatgagtgacntcagggaaggccgaagtcagaggatccgat

SEQ ID NO: 18608 - DNA, 101 bp, rice(Oryza sativa)
  misc_feature (71): n=a or g
aattaaggagaaggaaaagaaggtaaaggaggaagaggaaaaatgtatggcggagatcaaaaaaaatatgnggataccagattctaccttggatgagcatg

SEQ ID NO: 18609 - DNA, 101 bp, rice(Oryza sativa)
  misc_feature (71): n=a or g
tacacaaaacagttaacccaaacatggaatacgttgtgtagcatacaccatgagcttcgacttcctctttncagtgataccaaatgtctcggacaagtcaa

SEQ ID NO: 18610 - DNA, 101 bp, rice(Oryza sativa)
  misc_feature (71): n=a or g
ccacgtggtggcctagtagcatttgtaaaacggaaatgctatataccggtatactgtcgggaagggtatcnacgggatacccttcgtccacctttcccatc

SEQ ID NO: 18611 - DNA, 101 bp, rice(Oryza sativa)
  misc_feature (71): n=t or c
aagctgtgcaagaacccattctgcacgtatatgaccaaacaatattagtatctattactttgcacttgctnagaaggaaataaaacagtatgcaaattaac

SEQ ID NO: 18612 - DNA, 101 bp, rice(Oryza sativa)
  misc_feature (71): n=t or c
actccattttcttgcatgtacagctcatattcttcaatgatgattcaacatatgaacaagtcaagattgtnatcttgtcaatttttcctttcatgcaaatg

SEQ ID NO: 18613 - DNA, 101 bp, rice(Oryza sativa)
  misc_feature (71): n=t or c
tgaagaacatcaaaacggagtccgaatgaaatctgggcgataattttggtgtggtatgctccctagattcngaggtaggctcgaacttgatatgatttgcg

SEQ ID NO: 18614 - DNA, 101 bp, rice(Oryza sativa)
  misc_feature (71): n=a or g
ctggcaggcgcagcattgcagatttgcaagcattactttactttggttgtgttagttaacactaaagtttngaagtttagttaaaattggtacgatgtgat

SEQ ID NO: 18615 - DNA, 101 bp, rice(Oryza sativa)
  misc_feature (71): n=t or g
gcgggcggcgcagcagtaatgtcggtgtcctgattggggcggactggagcacgtcgagcatggttgacgtncggacctcaggcggatcgaggcagtgcagt

SEQ ID NO: 18616 - DNA, 101 bp, rice(Oryza sativa)
  misc_feature (71): n=t or c
tgcatgcatatacacattgccacgtacacgtacatatatagatccaaccagcaagacaaacgttcaaactncattactccctccgtttcaggttataaaat

SEQ ID NO: 18617 - DNA, 101 bp, rice(Oryza sativa)
  misc_feature (71): n=t or c
caccgaggatcttcttcgcaagttcgatgaccaggtgctgcggcagaagatggaggacactgaccgtagcngagcaggtaaattcttttcttcctctctgt

SEQ ID NO: 18618 - DNA, 101 bp, rice(Oryza sativa)
  misc_feature (71): n=a or c
ccatggtgttgctcttggtccatgtgaccccatatataggtcttgcaggtaatgtgattggcgttggcaanagattgactcctacaggcccgaatccagtc

SEQ ID NO: 18619 - DNA, 101 bp, rice(Oryza sativa)
  misc_feature (71): n=t or c
aacccatcaattcttctgctcaaaatgcgccattgcaaagctacggccatatttatattcaaacttttttntacaaactttcaacttttccatcacatcaa

SEQ ID NO: 18620 - DNA, 101 bp, rice(Oryza sativa)
  misc_feature (71): n=t or c
atgaaaaaaaaacaagttggcttcaactgatgaagcaatattgctagcaggtacagaatcatgtgtagatngtcaaattaaagtgttgttcgctttgttgc

SEQ ID NO: 18621 - DNA, 101 bp, rice(Oryza sativa)
  misc_feature (71): n=a or g
ggtggtggccagcgaaggatgataagagaagggggtatggcagtggtcacctccatagcgggaagacactncgagaagctccgctggccaatgacgcccct

SEQ ID NO: 18622 - DNA, 101 bp, rice(Oryza sativa)
  misc_feature (71): n=a or g
acagaaaatgaccgaaagattagtgcccggatcaaaagaagtcatcaagctcgcaggaggcaacggtacgnggaccaggaagaccgcgtccacgggaacgt

SEQ ID NO: 18623 - DNA, 101 bp, rice(Oryza sativa)
  misc_feature (71): n=t or c
gaaaacgcagaaccaacagcacgtcaatgcctggagtgaaatctcaatgcacgtcaatgccttcaaacttncaactttttcatcacatcaaaactttcata

SEQ ID NO: 18624 - DNA, 101 bp, rice(Oryza sativa)
  misc_feature (71): n=t or c
tatggtcacactcttcttttttttcgcccagatggctctgcaatactttattacctcgtctaaaaatatgnattgtatttttgttctcacaccgaatgcaa

SEQ ID NO: 18625 - DNA, 101 bp, rice(Oryza sativa)
  misc_feature (71): n=a or g
ttatagcagtgcagtggcaagggttagtgcgtggtttcaatcctgaaatctagagttcaatccccaatatnctcataatattttcttaaaataatgtttag

SEQ ID NO: 18626 - DNA, 101 bp, rice(Oryza sativa)
  misc_feature (71): n=a or c
agagcctgaaaagaatacctgctcagtttgtgtgcatactattacctctaagaataaaaataaatactacntccgttttttaatagatgacgccattgact

SEQ ID NO: 18627 - DNA, 101 bp, rice(Oryza sativa)
  misc_feature (71): n=t or c
gggccatggatcaccttccttttttccatttttttaacttgatcacgcaacatttctttctgctttgaccnaattgatgactttgtcaaactccgtaggta

SEQ ID NO: 18628 - DNA, 101 bp, rice(Oryza sativa)
  misc_feature (71): n=t or g
tatggcactgttgtagtcggtgaagtcacaggtgcaggtattgcagaatatctccccaacgttatcttccncatcgtcatcttcttcttcttggctaccgt

SEQ ID NO: 18629 - DNA, 101 bp, rice(Oryza sativa)
  misc_feature (71): n=a or g
aaaaccggcaaaaaaaaccgagagaaaaagccgggcggaaaaagaaagtccgatcagcgaaaaaataaccnggcgaaaaaaacaaatctgtctgatccaat

SEQ ID NO: 18630 - DNA, 101 bp, rice(Oryza sativa)
  misc_feature (71): n=a or c
cttttaatcagtgactcagcaagtccattctgagtgtgaacatggggaactgaatgctctacattaatgcncaaggccatacaatagtcattgaatgcctt

SEQ ID NO: 18631 - DNA, 101 bp, rice(Oryza sativa)
  misc_feature (71): n=a or g
ttgtgataacatttttcacttgataattggtaataatattttcccccttttcagcttccctgctttctaantatcagttggagctaccatgacgacccaag

SEQ ID NO: 18632 - DNA, 101 bp, rice(Oryza sativa)
  misc_feature (71): n=t or c
aaagagactaaagtatcccaaacacccccttaaactatgacttttgttccagtttctcacttctccgcatnaggcatgacgagatgccctctctctcatta

SEQ ID NO: 18633 - DNA, 101 bp, rice(Oryza sativa)
  misc_feature (71): n=a or g
gtgataaatattctcatcgatgcgggttcgttgcttagttgcaactgctctagtactaggactctataaanaaggaagtttctgtggaaggttagagattg

SEQ ID NO: 18634 - DNA, 101 bp, rice(Oryza sativa)
  misc_feature (71): n=t or g
cgacatgggtgccactgatcatattactggggagctggacaagcttactgtcaaggaaaaatacaacggangagaacaaattcacaccgcaagcggagcag

SEQ ID NO: 18635 - DNA, 101 bp, rice(Oryza sativa)
  misc_feature (71): n=a or g
cgtcctcttctactcgctctccactctgaaaaccatcaaggtacatgtccctgacatgaagagcaggcgtnttgctgcgtctggttccagccacctcatag

SEQ ID NO: 18636 - DNA, 101 bp, rice(Oryza sativa)
  misc_feature (71): n=t or c
ctctgacgaggaccctcattagaggatgaggaagaggatggtgagagcgacaatgaggccaacgataggangagggtggcagaggacaaagcacccgaaga

SEQ ID NO: 18637 - DNA, 101 bp, rice(Oryza sativa)
  misc_feature (71): n=a or g
ttagaaaagtctggtaaagctagaactggtgattgagtcaatgccatttttactgcatcaaaagctgtctnctcctgttgctcccatttgtgtttgacgtc

SEQ ID NO: 18638 - DNA, 101 bp, rice(Oryza sativa)
  misc_feature (71): n=t or c
gcagctgtgctacctacctccaatggggctggtcgtggagaaggaagagagatcttccaggctgatccctnctattggtacgaaagcagctcactggagct

SEQ ID NO: 18639 - DNA, 101 bp, rice(Oryza sativa)
  misc_feature (71): n=a or g
ggagatccaccttgaggatggccctcgagtatgtgcttgtactgcgttggcatcagctctgagattgccancgctccacccactgcccttgcaccctgccc

SEQ ID NO: 18640 - DNA, 101 bp, rice(Oryza sativa)
  misc_feature (71): n=a or g
attcaaatgcttaacagcattatgacagatatgccgcaaacacaggcggtgacttgagtttggaaacactnacctaacagactttattatttcagcagagg

SEQ ID NO: 18641 - DNA, 101 bp, rice(Oryza sativa)
  misc_feature (71): n=t or c
tgcccatttgagcccccgaagcctaagacaaagcataaggttgacattgatactgtagagaagttccagangctgcgtgagcaagagcaaaaatactttga

SEQ ID NO: 18642 - DNA, 101 bp, rice(Oryza sativa)
  misc_feature (71): n=a or g
cttcctaaactttcaacagtatgtcgaacgacagtttaaaaccaaaatactcaccatgcagaccgattggngtggtgagtacgagaaattaaactcccttt

SEQ ID NO: 18643 - DNA, 101 bp, rice(Oryza sativa)
  misc_feature (71): n=t or c
gtcagcttgctattgttgcatcatagtgttgaaatttgcgagctgtgcaccaacagactgctgccattccnatgactgtaccacatcatcctccaaggtat

SEQ ID NO: 18644 - DNA, 101 bp, rice(Oryza sativa)
  misc_feature (71): n=t or c
ttatctttctagcctgctaaccatcacgtacactttccgatcccaaaatatgacaacttctagggatgaanctggacaatgtttagggtttagggatgaat

SEQ ID NO: 18645 - DNA, 101 bp, rice(Oryza sativa)
  misc_feature (71): n=a or g
agcaagaacatgaggtgtatggatgtaatatggttatcagctacagtaggtttgctcttacttcagcacantgcattgtgttgcaagtagtatggagctcc

SEQ ID NO: 18646 - DNA, 101 bp, rice(Oryza sativa)
  misc_feature (71): n=t or c
ggttcaacaacgtattttcgggcaaaatcctaaattttcccccttctcacatgcagcaccaagatctgctngatgagtcgcaaatctctgctcctgtcttt

SEQ ID NO: 18647 - DNA, 101 bp, rice(Oryza sativa)
  misc_feature (71): n=t or c
taataggagcatgatcactataaagctgtgtagtgtaggatcgagtatcctttctcgatcccttcccccanactaatcccaaccattagaaaattaatgat

SEQ ID NO: 18648 - DNA, 101 bp, rice(Oryza sativa)
  misc_feature (71): n=t or g
gctgctagggcaagtagctcgctctcgatctcggctgcgtgtgcgcgtgtttggtagcgagaggtgagagnagaagtggagagaggagaggggagaagaag

SEQ ID NO: 18649 - DNA, 101 bp, rice(Oryza sativa)
  misc_feature (71): n=t or c
gtacttgctgctttgtgagctgatctctcagataaaacaggagacccaatattgttcatagaagctgaagngggtgaatcagctggttggtgggaatcagc

SEQ ID NO: 18650 - DNA, 101 bp, rice(Oryza sativa)
  misc_feature (71): n=t or g
gtctttcagagttcattgctcgacgaatatggtagcacataggctcgtaaaagaagttgtttctctagctnttttacagggtatttgttcctaagggtttt

SEQ ID NO: 18651 - DNA, 101 bp, rice(Oryza sativa)
  misc_feature (71): n=a or g
caaaggcttacagcaccaccccctcgtcttgaagagctcggaatcagttcaaacaatttttctgatgacantgtgagctatgcaacaaaccaatgatattt

SEQ ID NO: 18652 - DNA, 101 bp, rice(Oryza sativa)
  misc_feature (71): n=t or c
taaaagactccctcttagattccctcgtgtttctgctaaatataacttaacttttctccttgttgatagtntggccagagcatttttcatacagagacaac

SEQ ID NO: 18653 - DNA, 101 bp, rice(Oryza sativa)
  misc_feature (71): n=t or c
tagcttagctggtgcaacttcatctcactcaccttggtcgttgcatgcacataaagaacaaagaaaaatanagaacaaaatagcgaggagggtggctctca

SEQ ID NO: 18654 - DNA, 101 bp, rice(Oryza sativa)
  misc_feature (71): n=a or c
cctgtcaactcctgccaaggcacggtactgttggggagattacgatgtacccattgatgcctcgtcaactnctgcccttgcgagggagcatcttgcacatc

SEQ ID NO: 18655 - DNA, 101 bp, rice(Oryza sativa)
  misc_feature (71): n=a or c
tgattggcaagccatggtgcacgtacgccacggcaatgaggaagaagaatcagatgcctaaacaacccacncattttcctgctcctgctcctgcactgtac

SEQ ID NO: 18656 - DNA, 101 bp, rice(Oryza sativa)
  misc_feature (71): n=a or g
gcgtatacgcacaagccaaagagaatttttaggcgggtagaaacaaaaatcagacccagtttcgcgcaaanaaaaaaacaaagagaagcccgggggtaaga

SEQ ID NO: 18657 - DNA, 101 bp, rice(Oryza sativa)
  misc_feature (71): n=a or c
taatttttttttcttaaagtactagtttacgcattgcttatttttgatggtgactatttaacctcctctantatcaatattaattattcagtctcatagtt

SEQ ID NO: 18658 - DNA, 101 bp, rice(Oryza sativa)
  misc_feature (71): n=a or g
ccaaattcagtgtgccctgttcagttcatcaggatatccatgtctgaccatcgaacacacgcgagcgactntcatccagttgccagccaaccagatgttca

SEQ ID NO: 18659 - DNA, 101 bp, rice(Oryza sativa)
  misc_feature (71): n=a or g
agaaatttcgttgacgccatccccttttcctcaataaaatctcgggcagggtgctagtaaactaaaagtcnacggcgttaaatatttaggaatagagagag

SEQ ID NO: 18660 - DNA, 101 bp, rice(Oryza sativa)
  misc_feature (71): n=t or c
atttcttccgatcagcaacaacggcagaagattcctgataattagaagatccaggagacagatcatctagnattggctgtttcagtatgcatgcaccactt

SEQ ID NO: 18661 - DNA, 101 bp, rice(Oryza sativa)
  misc_feature (71): n=t or c
taaaaatgactaatgtgcccctatgttaatcatttcaatgcttaaaaattgacactaaactaatactgcgnctgccattctgatatgtctgcaacaagcat

SEQ ID NO: 18662 - DNA, 101 bp, rice(Oryza sativa)
  misc_feature (71): n=t or c
caacaagcagcatgttcttcttcttctcctgtttgtccgtgacctagactttagttacaaactttttcttnaaacttccaacttttccatcacattaaaac

SEQ ID NO: 18663 - DNA, 101 bp, rice(Oryza sativa)
  misc_feature (71): n=t or c
aaacccagtggtccaacaccttcggctatagtgatccttgcacgctctatctagatcttgggaaaaactgngcgcccagtaagcaacgtcatgagttttga

SEQ ID NO: 18664 - DNA, 101 bp, rice(Oryza sativa)
  misc_feature (71): n=a or g
tctgctgccaccgccgatgggagatgatcgattgatcggaggaggaagaagcagcaacaccaatttactcnattaacagaaagagagaggaaattaaggtg

SEQ ID NO: 18665 - DNA, 101 bp, rice(Oryza sativa)
  misc_feature (71): n=a or g
ttccttgattactcggataacaaagggactaggggttattaacaatgattagattgcttatgtcttagccncttgtccctgtatagatgagaattatctag

SEQ ID NO: 18666 - DNA, 101 bp, rice(Oryza sativa)
  misc_feature (71): n=t or c
ttcaaaaaatcaaaatcggattgggatttgagggacggacaaaaatacgaacgaatagaggggtggcgaanggaaaaatacgaatcttttaagtagttaag

SEQ ID NO: 18667 - DNA, 101 bp, rice(Oryza sativa)
  misc_feature (71): n=t or c
gtcaggaagaatcaacttaggggagttgttgctcctagttgaagacctcgacgatggtggttgtttggtgnagtggttttgtgcttggctccagatctgca

SEQ ID NO: 18668 - DNA, 101 bp, rice(Oryza sativa)
  misc_feature (71): n=t or g
tctctgcaaagctcgtcttcgaaatgtaaaaggtgcgaccagttcggtttactgttctgaatttcttcgcngaattcaactccaaaacctgaatcttgcac

SEQ ID NO: 18669 - DNA, 101 bp, rice(Oryza sativa)
  misc_feature (71): n=a or g
aaaaaaaaactacatacaacaccaaaatgcatcgctaccataaattgctgccttctctaggatcaccaccncgcacagccacagcagcagctactgcctca

SEQ ID NO: 18670 - DNA, 101 bp, rice(Oryza sativa)
  misc_feature (71): n=a or g
tgtcaatgtgttgaccatgtcagtgtgttgtgcatttttttttgtgtgcaactgtgatggggtgagatgantccaggcaatttgaactgaaatatgtcatc

SEQ ID NO: 18671 - DNA, 101 bp, rice(Oryza sativa)
  misc_feature (71): n=a or g
cacttaactccgaaaattattagaaatttcggcagtctcctcctaaaattacggacatccacgacagtcanttataagataactcaataacgatataatcc

SEQ ID NO: 18672 - DNA, 101 bp, rice(Oryza sativa)
  misc_feature (71): n=t or c
atcaacatccccacactttgagtacatattaatgaggcagttcgccacaaagtatgcagatgagtcatatnggtgatgacgaagcacataagcatgaatct

SEQ ID NO: 18673 - DNA, 101 bp, rice(Oryza sativa)
  misc_feature (71): n=t or c
gcagatttcttctcgagcgaagcgatttcctcctcaagctgatccaaaccagcagactgcctgacttcacngacgcgcgctacagccagctcgacatcctt

SEQ ID NO: 18674 - DNA, 101 bp, rice(Oryza sativa)
  misc_feature (71): n=t or c
tgtgattcttggagaagtaaaggcgaggcggtgtgcttagatatcagactcactaatctcgtcggtcttcnttggggatggctttctctgggtcaggatca

SEQ ID NO: 18675 - DNA, 101 bp, rice(Oryza sativa)
  misc_feature (71): n=a or g
gaataatatatacttgtgtacgtgacgtggttcccctcagattccagcaatcccaacgggatttattctcntagatagatagatgtataaaaattgtttcg

SEQ ID NO: 18676 - DNA, 101 bp, rice(Oryza sativa)
  misc_feature (71): n=a or c
caggtggagacagaaaatcaaactaacccattgcgttctatatgacttgaaggggaaggggttttatgaantgagagatgaggaaaaaataggagcttaag

SEQ ID NO: 18677 - DNA, 101 bp, rice(Oryza sativa)
  misc_feature (71): n=t or c
gcagctattaataggtggcctccaatttagcataccatcataacttctgttaccttttcctatgcggtggngtgattcagttcgatgcccggaaggagcat

SEQ ID NO: 18678 - DNA, 101 bp, rice(Oryza sativa)
  misc_feature (71): n=a or c
taaataagttttaggcttttcgcgttgagggatagaaaagaaaacaaaaacaatatatcaagtgacgggantagttcccaactccttaaaaaaatcaccta

SEQ ID NO: 18679 - DNA, 101 bp, rice(Oryza sativa)
  misc_feature (71): n=a or c
gggttcggccgaccaaaggtccctacctcttgctaccgaccttcaccatgggctgccatgtgggcccctanggtggtgcgcagtggcttggcctcgctggt

SEQ ID NO: 18680 - DNA, 101 bp, rice(Oryza sativa)
  misc_feature (71): n=t or c
tcttaatagggatatctctgatcatacccctttaccgttgaatacaaattcttcatctctgagtaatgctnaacatagttttaagtttgaacttggttggc

SEQ ID NO: 18681 - DNA, 101 bp, rice(Oryza sativa)
  misc_feature (71): n=a or g
tcacgcaaaaattaaacctacacccatccagcgagaagctcgaaagatggcaacatcaacgctgacaaganctgttcctgttggcggtggatcccaccgtt

SEQ ID NO: 18682 - DNA, 101 bp, rice(Oryza sativa)
  misc_feature (71): n=a or g
aattttttagtatgcattaatccacatgatgtttttcattaatgccctgcaccttgttaaagtatcaagcncaacatattgcagtgcacatacagattttt

SEQ ID NO: 18683 - DNA, 101 bp, rice(Oryza sativa)
  misc_feature (71): n=t or c
acccccaaaagatgttgtggatgagtggcctgaacctaagcaaactcacacgttcttctttgttagaatcngttcatatgaggatcctagcctgaaggcaa

SEQ ID NO: 18684 - DNA, 101 bp, rice(Oryza sativa)
  misc_feature (71): n=a or c
cgcagaattataacctcgtttcattccacacgacaacacatagtgaaagcgaaatatcaccagtggccttntttttcctcgaatatggccacagagagcaa

SEQ ID NO: 18685 - DNA, 101 bp, rice(Oryza sativa)
  misc_feature (71): n=a or g
aatggttaaaacaattgatagtccaatacaactaaaagggcttgatcctcaagagttttgggaattattcnaagcatctgtgtttggtgatgagaaatcag

SEQ ID NO: 18686 - DNA, 101 bp, rice(Oryza sativa)
  misc_feature (71): n=a or g
gaatatgttgcatttttgattcctaaagaattcctttactctgtagatgcctttctggagggagtcttcantaaaagtaagcaacggttaatttaggaagt

SEQ ID NO: 18687 - DNA, 101 bp, rice(Oryza sativa)
  misc_feature (71): n=a or g
cctccgagcccggccattcatctccggcgccgtatgcatatcaatcagcaagacagcaagcgaggagacanagacaggatacttaaaatgctcggcggctg

SEQ ID NO: 18688 - DNA, 101 bp, rice(Oryza sativa)
  misc_feature (71): n=t or c
cggggcatcaataccaactaatctgtcctcgtcgacatagagagccgatagccgtggatcaaccttcacangaacactaggcccagatgccaagccatcaa

SEQ ID NO: 18689 - DNA, 101 bp, rice(Oryza sativa)
  misc_feature (71): n=t or c
aaaaaaacaatgcttaaaaaaaattcttccaagagtgattttatataagagtgaagtgcacgagcggtccntaaacttatgtgggtgtgtcatctagatcc

SEQ ID NO: 18690 - DNA, 101 bp, rice(Oryza sativa)
  misc_feature (71): n=a or g
cagccttccacctcgtcaagtgagggagcgggaggagtgctagcgcctgtcaacgtcaaccatgcctcctntgccatggcattgtcattgtcctcgccccc

SEQ ID NO: 18691 - DNA, 101 bp, rice(Oryza sativa)
  misc_feature (71): n=t or c
tttcttaactgataagtgtgcctacgattttcattacagcccgaattataaaatccaccttttatatgtanctgtatgcacatgaactggtgttgatttag

SEQ ID NO: 18692 - DNA, 101 bp, rice(Oryza sativa)
  misc_feature (71): n=t or c
aagacataatacttagaatgcgtattcaatgagcattctttgcggaagtatttcaaaaatctgtgcctgangctctcctctatcttctaagttcttaacta

SEQ ID NO: 18693 - DNA, 101 bp, rice(Oryza sativa)
  misc_feature (71): n=t or c
gctaactaatgtgggagtgaagcaaagaaaaaaaacaaatacctggagctggcaaagtcatagagacggcnggtgctggagaagacgaggaggccgacctc

SEQ ID NO: 18694 - DNA, 101 bp, rice(Oryza sativa)
  misc_feature (71): n=a or c
gaggaacctcgcatcgccaccagatctcagtccacagcaaccggtgttctctttagataactacagatatnacagatactcctcgccgtcgcttcctgatg

SEQ ID NO: 18695 - DNA, 101 bp, rice(Oryza sativa)
  misc_feature (71): n=t or c
gacacacgcaccaactgtcccggttcgggatgtttccgatatcgataagggcatcaccaatgcggtgcttnggcccatccccctagcgccgtccgttaggc

SEQ ID NO: 18696 - DNA, 101 bp, rice(Oryza sativa)
  misc_feature (71): n=a or g
tatcaaaaaaaaaaagcagcagcaggacaggggagcggagatcgaattgggagttggggaggattggattngattagattggattggggaagaagaagagg

SEQ ID NO: 18697 - DNA, 101 bp, rice(Oryza sativa)
  misc_feature (71): n=t or c
agtcttccaagatgctcataggtgcgtgcgttcataggaatctccagaatggatttgctggcccagtcttncaagatgctcataggtgcgtgcgttcatag

SEQ ID NO: 18698 - DNA, 101 bp, rice(Oryza sativa)
  misc_feature (71): n=t or c
tagttttggcacgtgtctagtgagaaagggtaatcagatggtgcagtgtgaattcaaacaaaagggagtanttaccagttaccacttcactgcagtcattg

SEQ ID NO: 18699 - DNA, 101 bp, rice(Oryza sativa)
  misc_feature (71): n=t or c
tgccaacattggtgtgggaataggaagcatccgtttccgtatcaacaggaagaaagaaaaatttgagttcnagccgaggaccgaacaatgctccatggtcc

SEQ ID NO: 18700 - DNA, 101 bp, rice(Oryza sativa)
  misc_feature (71): n=t or c
actctatcaaatcatttttgtcagcctcacttgggttcctcctaaactctaacttccactcaccaatcgcnatcattaaaaagctccttacattgtgtcca

SEQ ID NO: 18701 - DNA, 101 bp, rice(Oryza sativa)
  misc_feature (71): n=a or g
aagcacagcctttgatgccaactttttcgccaccaacttgcagggacctgattttgttgcggagtatgtantctctccagccttcacccgagcaatgaccg

SEQ ID NO: 18702 - DNA, 101 bp, rice(Oryza sativa)
  misc_feature (71): n=t or c
agttctttctagatggtagagtttatttataggcgcttgacgaggtacactagctaatatttcagtgccanaccagctagatatcacaaacaaggagtgaa

SEQ ID NO: 18703 - DNA, 101 bp, rice(Oryza sativa)
  misc_feature (71): n=t or c
tcaaacaaaattcaaatgcaccgctaacggcagatgcagatgaatgaatggcttctatagagttgagatgnacttgatagtgtagtggcaagagttgtgtg

SEQ ID NO: 18704 - DNA, 101 bp, rice(Oryza sativa)
  misc_feature (71): n=a or g
agtagatccttaaacttgctggccattttggtttttcttctaggaactattataaagcgcacggtacacancaacttcgccggcctgttcttcgggctacc

SEQ ID NO: 18705 - DNA, 101 bp, rice(Oryza sativa)
  misc_feature (71): n=t or c
tacagttcaaccatgctcagaccgtacttatataaataatgctttgtgttaaaattgcaggtctggtttgngtttccatttaagtataaaaggacctgtat

SEQ ID NO: 18706 - DNA, 101 bp, rice(Oryza sativa)
  misc_feature (71): n=a or g
ccagaggggacagacgacgataaagccaaggattatgcattgaaaacaatggggaagctgtggcgaaactngaaaacggacctgaataagaaatatgtcta

SEQ ID NO: 18707 - DNA, 101 bp, rice(Oryza sativa)
  misc_feature (71): n=t or c
ccaaaaaaagagaatgctcttcgtgtcagtgaattcagacccataagcctcatccatgcatttggaaaacncttttctaagctccttgcaaacagattagc

SEQ ID NO: 18708 - DNA, 101 bp, rice(Oryza sativa)
  misc_feature (71): n=a or c
ctgagatccctcgtttgccgtgctggatttacaggtcagtggggagttgaatctatcaatctgtactacgnatatgccttcgacaaatacatggaaggagg

SEQ ID NO: 18709 - DNA, 101 bp, rice(Oryza sativa)
  misc_feature (71): n=t or c
aacaacttttttaaaaaagaatcggtgggaccaacctatcagattccctcccctctcacctctctctatcntagcttcctcattccccaccttctctctcc

SEQ ID NO: 18710 - DNA, 101 bp, rice(Oryza sativa)
  misc_feature (71): n=a or g
agtacaaacggcacaataccatggtcgtcaggcttcgccaaggagtggaacattgtacttggagctggacngcgagaacaggagagtccggatccagggag

SEQ ID NO: 18711 - DNA, 101 bp, rice(Oryza sativa)
  misc_feature (71): n=t or c
ctactaaacctgatttattatttgcttgatgttttccacttggttgatggtgaccttactgctgtgacttnatgcacagtctgattatagtttattttatt

SEQ ID NO: 18712 - DNA, 101 bp, rice(Oryza sativa)
  misc_feature (71): n=a or g
gggcctgaggagaggcgctcttctgaaaatgttgaaactgatggggaattgggtggcctggattcacagantctgcagcctccaagttcagtgctaatgca

SEQ ID NO: 18713 - DNA, 101 bp, rice(Oryza sativa)
  misc_feature (71): n=a or g
atgagtatcaggctaggaggtttttccgtcaccgtggtactgtcattaaaactatgtctcttatgacggcngtggggggcaagttctgcacggcgtttttt

SEQ ID NO: 18714 - DNA, 101 bp, rice(Oryza sativa)
  misc_feature (71): n=t or c
ggttctgctagggattagaggatccccaaattccccctctcctataaaaagtcgtcgtcttcttcttcctntccttcgatctatatactagacctccgaac

SEQ ID NO: 18715 - DNA, 101 bp, rice(Oryza sativa)
  misc_feature (71): n=a or g
aaagatggagagttcaaagagaacttgccaatggaggaggtgtcagtcgaggagttggttgccgatgagtngaagctgatatggtttttgtcttcagaaag

SEQ ID NO: 18716 - DNA, 101 bp, rice(Oryza sativa)
  misc_feature (71): n=a or g
gaataagttacattttttaatatgtttgtttattttaagagcgatatccctccattccattccaccgatcnagggcatacgttgtcttcgtcggtgtgtgg

SEQ ID NO: 18717 - DNA, 101 bp, rice(Oryza sativa)
  misc_feature (71): n=t or c
tgatagagcatatgtattggagattgtgccaacgtttaaaacgtaagtaggaaacaacgctaggtagtaanagtaaatgtagatttgtctttttaaaagat

SEQ ID NO: 18718 - DNA, 101 bp, rice(Oryza sativa)
  misc_feature (71): n=a or g
gattttcagtaactgcagtctacagtttgaacaagtcaatggagaagagaaggaattgttttgctgaaaangagagagagaggtgtgcctctgggttgggg

SEQ ID NO: 18719 - DNA, 101 bp, rice(Oryza sativa)
  misc_feature (71): n=a or g
accgttggcattggcgtcgccactacatctcgatggtgtgagcagcagtagtaacaacgtcgttgtcatcnccgatttctgccgtagttgccaatttccac

SEQ ID NO: 18720 - DNA, 101 bp, rice(Oryza sativa)
  misc_feature (71): n=t or g
gcggcggctagggcggcgcggtggcggcgctacgatcgactgtttcgcgtgggacaagaggcaaacggaanaggacgactaggggttgctatttatagcct

SEQ ID NO: 18721 - DNA, 101 bp, rice(Oryza sativa)
  misc_feature (71): n=t or c
agatgttgctgagtccatgatttatgtctatgcaaacatctcttgttgacgctccgcgtggcattattggncaattgagctgagcaatcctctccagtatt

SEQ ID NO: 18722 - DNA, 101 bp, rice(Oryza sativa)
  misc_feature (71): n=a or g
cttgtcccggaacacaaatctgcgcaggaattgttgaaaaccacatcagcaattggcaagaaggaaaccanttggtacaaagaaggaaggaaatcatttca

SEQ ID NO: 18723 - DNA, 101 bp, rice(Oryza sativa)
  misc_feature (71): n=t or g
gatcacccctgaaagaactttacccttccctctatcagttggccacaagaaagaacagatcagtggcacangagatacaagggaaccattggttgaaacag

SEQ ID NO: 18724 - DNA, 101 bp, rice(Oryza sativa)
  misc_feature (71): n=a or g
atatgaggtcagcaccatgatgtcatgggccaagaagtagtgccttagcttccgagaggccataacgagcncgtacgcgatcttctccagctctgtgtaat

SEQ ID NO: 18725 - DNA, 101 bp, rice(Oryza sativa)
  misc_feature (71): n=t or c
gttcctttaggcacatcgaaccctagcacttggcaagtagttcgacactctcgtggcagcagtggtggtcntggcgggtgcagccggagcgcctctttgat

SEQ ID NO: 18726 - DNA, 101 bp, rice(Oryza sativa)
  misc_feature (71): n=a or c
accttaagtcctgtggattgagcaaaagtattcagaattgctttaaagcagaagagttctctttggtcagncttaagcagaatgagggtatcatctgcata

SEQ ID NO: 18727 - DNA, 101 bp, rice(Oryza sativa)
  misc_feature (71): n=t or c
gactcccgagccctcccgtgtggatggtgtcgaggacggcggtagcgacagctccatagacctctcactgnagctggcgttgaggacggtggcggtggctc

SEQ ID NO: 18728 - DNA, 101 bp, rice(Oryza sativa)
  misc_feature (71): n=a or g
tacagtagttagaaacagaggaaacagaggaatgcaaggcagagtggagcgacgtaaggttttggcatgtntaaccttgcagcttttttgtttttctcctt

SEQ ID NO: 18729 - DNA, 101 bp, rice(Oryza sativa)
  misc_feature (71): n=t or c
ggggaaggggaaggggaaggtggagggtgaaggttctacccgtgagagatccatcagctgggatgatgacnaaactaagttcatgcttgattggtacattg

SEQ ID NO: 18730 - DNA, 101 bp, rice(Oryza sativa)
  misc_feature (71): n=t or g
tagaaggaatgtatactgcggttgtcaacatttgcctcctaaccaaaatcaaaccggccccctggacgacnactactactatatacacactgggttgccct

SEQ ID NO: 18731 - DNA, 101 bp, rice(Oryza sativa)
  misc_feature (71): n=t or c
ttcaatttgattctaacaacgttgaagtgttagagttatagttgcgctataggctatgagtaatttttacnattcttgaggaagtactataggaccagagg

SEQ ID NO: 18732 - DNA, 101 bp, rice(Oryza sativa)
  misc_feature (71): n=a or g
tggatggttaaatataattaggtctacgtagcaaattaagtgatgtatataaatacacgcttgaagatacntaggaggtgaaggtggagatggaggggatt

SEQ ID NO: 18733 - DNA, 101 bp, rice(Oryza sativa)
  misc_feature (71): n=t or c
attggcagtcagactcagtcggaccaagttgaggaaggaaggaggttggagagcctcaccggatcttcgcngtgaccacaggttcgccggatcccagccgc

SEQ ID NO: 18734 - DNA, 101 bp, rice(Oryza sativa)
  misc_feature (71): n=t or c
agatattttctggtacttttatataccacttgtacatttgctctattttgagataagccatttttgccacngtggctggcgtggccaaaaggttctgtttt

SEQ ID NO: 18735 - DNA, 101 bp, rice(Oryza sativa)
  misc_feature (71): n=t or c
gatatattaattattaaattcttttcactgtctactacttgttccgtcctaaaatccagatttattgtgtnaagatgtgtcaaatttcattctaggtaata

SEQ ID NO: 18736 - DNA, 101 bp, rice(Oryza sativa)
  misc_feature (71): n=t or c
aactaccttaccgccaaatggcagcctgccattagaaggtttttgctcggatagtaaatcacgcaaagttngatctaataagtgatgtttcctatgagtca

SEQ ID NO: 18737 - DNA, 101 bp, rice(Oryza sativa)
  misc_feature (71): n=a or g
gatagggagatcatgcagtggaaagacattcttgccctcaagtacaccaagttggtttatgttggccgctngttcgacccgctccagcaatccatggatgc

SEQ ID NO: 18738 - DNA, 101 bp, rice(Oryza sativa)
  misc_feature (71): n=a or c
atattgctctcacttaagagtggctggcgttttcgtgaatctcaattatgagatgttattctagcgaaacntgtttccggctataacataatatgtcaatt

SEQ ID NO: 18739 - DNA, 101 bp, rice(Oryza sativa)
  misc_feature (71): n=a or c
cttatcattcttctacctcaagatgtcaccgtctgatctctcccggaggaatattcactatcctgatgcantagcatttcctattcatgacaaaatggaac

SEQ ID NO: 18740 - DNA, 101 bp, rice(Oryza sativa)
  misc_feature (71): n=t or c
gctaactcaggaccaggtggcgactatgtttttaccaaatccactagttgtcgatccggcacagcaacagncgattcagcagacgccaccaaggcaacagg

SEQ ID NO: 18741 - DNA, 101 bp, rice(Oryza sativa)
  misc_feature (71): n=t or c
agccactcacaacgcacgtacactcattcctatgaaagtacatacgcaaaccctatcctaggagcatcttngaagactgggccgacaaattctggagattg

SEQ ID NO: 18742 - DNA, 101 bp, rice(Oryza sativa)
  misc_feature (71): n=a or c
cggcgagggtgaaggaggaagaaaacaccatgacaggcagggaccgctgacatggcatcctggggtgtacnaaaaccagggtaaaaaccactctggggtgt

SEQ ID NO: 18743 - DNA, 101 bp, rice(Oryza sativa)
  misc_feature (71): n=t or c
tagtactgcaacaagccgaggtcgctcatttggaatgttcctttcatctcctccttgaactgtttcagctngccggggttgccgccagtgatgatgagatc

SEQ ID NO: 18744 - DNA, 101 bp, rice(Oryza sativa)
  misc_feature (71): n=t or g
taatgcgcgggataatgaagcgccggcgcagcataccttgctcgatgcacagcttggagtacgaatcaaangagaaagggagtcagtgctccttggtctca

SEQ ID NO: 18745 - DNA, 101 bp, rice(Oryza sativa)
  misc_feature (71): n=t or c
ccatggttggatcataaacgagtgcgcttcgtaattcgtattgcctgattacagtagaatactactccatncgtttcaaaatattttacaccgttgacttt

SEQ ID NO: 18746 - DNA, 101 bp, rice(Oryza sativa)
  misc_feature (71): n=t or c
gttttggattttgagaaccgcggtgctagtttttgtacggatcgatagtggatacattctctgttcggagnagggataaaaatggcttcttcttttttttt

SEQ ID NO: 18747 - DNA, 101 bp, rice(Oryza sativa)
  misc_feature (71): n=t or c
tcaaagctgaaggttctgaaagctattgctcaagagtatggccttgaatgggactcatcgaatactgaagnagagcttaacaagaaatacgaagatctgct

SEQ ID NO: 18748 - DNA, 101 bp, rice(Oryza sativa)
  misc_feature (71): n=a or g
accccactaaacacgaaaaccgagcgtttttcacccttagttatcaataccagatgaaccccccaggcccnaacagctttgcaagcggttttggtctacgt

SEQ ID NO: 18749 - DNA, 101 bp, rice(Oryza sativa)
  misc_feature (71): n=a or c
attttgcaataggtatgactaaagccccatccctacgccattcatttgattgtcccaagttaacaataagnttggacatcagctccttaataacacctggg

SEQ ID NO: 18750 - DNA, 101 bp, rice(Oryza sativa)
  misc_feature (71): n=t or c
cacggccatgatcggcttttcttgcttgcttgatgactataacctctgtcgtctttatgtgatttactggntgcagctatctagctaggacaggtgccgaa

SEQ ID NO: 18751 - DNA, 101 bp, rice(Oryza sativa)
  misc_feature (71): n=t or c
cagctgcaggattgaagctgcagtgtggctgccccaggcccagggactgggctcatgcattttttttgtangagtaaatgcgccctgttgctgtcatgtgg

SEQ ID NO: 18752 - DNA, 101 bp, rice(Oryza sativa)
  misc_feature (71): n=t or c
atatcaagaggattagggaatcgaaaccattgcgaagatgctctgataggcgtgccctagaaggtagtcancagacctagagcgagcagccaagagaagag

SEQ ID NO: 18753 - DNA, 101 bp, rice(Oryza sativa)
  misc_feature (71): n=t or c
tggggttggcggattggggaatcggcttcgagctgattggttttgactgcgccatccgatttcttcgcttntgtggaggggggcagcacggctgtgcattt

SEQ ID NO: 18754 - DNA, 101 bp, rice(Oryza sativa)
  misc_feature (71): n=a or g
agatgttttataatctctaaatgaaatttgtgaaactaaattcaggatgtggagcaataatcacacatcangttatcaacagaaacctatcagcttaatca

SEQ ID NO: 18755 - DNA, 101 bp, rice(Oryza sativa)
  misc_feature (71): n=t or c
aggttaaggatttgtcactgacatctgtctctttgatatatagtatattaggagagtgtatacacgataangtaagtgtggtatacatatgtctttctgaa

SEQ ID NO: 18756 - DNA, 101 bp, rice(Oryza sativa)
  misc_feature (71): n=t or c
gatcataaatattcaatatttaagataagattcaggggcgaacttttgaaacttagataaaaattttatgntataataattttatgatattatgataatac

SEQ ID NO: 18757 - DNA, 101 bp, rice(Oryza sativa)
  misc_feature (71): n=t or c
atggtgtacaaggctgttgtcaggcctaggagtgataccttggctgtgaagaagctttgggcaagtagcanggtggcgagcaagaagatcgacagctttga

SEQ ID NO: 18758 - DNA, 101 bp, rice(Oryza sativa)
  misc_feature (71): n=a or c
atgcttccgtgatcaaagtggctatccggagtttggtttttctgcagcttcgtcgtcttccaagctcaggntgcctcctgctgctgctgccatggtttcct

SEQ ID NO: 18759 - DNA, 101 bp, rice(Oryza sativa)
  misc_feature (71): n=t or c
ttggatgcaatgcattctccctgagatgagagcagagatggcacccctttccttccttcctgcatctccantctgtgctacttaaatttacaagaaaccaa

SEQ ID NO: 18760 - DNA, 101 bp, rice(Oryza sativa)
  misc_feature (71): n=t or c
caggtttaatcagcattggtataatccttcaagaatggacagcaggctccaaaaacatcattttcagattnaacatgagcaatgcttatgaccatgcacca

SEQ ID NO: 18761 - DNA, 101 bp, rice(Oryza sativa)
  misc_feature (71): n=t or c
ggtcatcgttgtacgtggttggggtcaccatcattctcgtagccttgcgatcaccgccgctggtaattatnatggtcgaagtcatggatctagagcagctc

SEQ ID NO: 18762 - DNA, 101 bp, rice(Oryza sativa)
  misc_feature (71): n=t or c
atctccgtatctgcaataaacaagtcatcagcctctaccagcatcaaacgatcttatgtatcagacatttngtttttgttttttgtttaaatgacactgaa

SEQ ID NO: 18763 - DNA, 101 bp, rice(Oryza sativa)
  misc_feature (71): n=a or g
gggagccacgccttctgcaccttctacgtctcaggtaactcataaatctgagggtttggctgctccagggnccatgggccaaacacccccaaattctaagg

SEQ ID NO: 18764 - DNA, 101 bp, rice(Oryza sativa)
  misc_feature (71): n=t or c
atggatgcaaatatgaagctggatagcctggatgctctgttttatttcatcttcgaaagaaaaggaaatgntttattttagataaaaactgtataattgga

SEQ ID NO: 18765 - DNA, 101 bp, rice(Oryza sativa)
  misc_feature (71): n=a or c
catgttgtgtagtgtagcctcatgtcacatccaatccaccaattattaaataatgagaatatatattggcnttaccaacttatataaaaggtgatcgaaat

SEQ ID NO: 18766 - DNA, 101 bp, rice(Oryza sativa)
  misc_feature (71): n=a or g
gcaatctgtcaaaccaaatgtaaaattggtgtcttctaaccccctaacttctattggcctggaacttttcnactaatataaactttatctatttagaaact

SEQ ID NO: 18767 - DNA, 101 bp, rice(Oryza sativa)
  misc_feature (71): n=a or g
catctatctggtgcgcctgcggttcgcttacggcaactacgataacatgaacagcgagtctgttcagttcnatctgttcctcggggtgaacaagtgggacg

SEQ ID NO: 18768 - DNA, 101 bp, rice(Oryza sativa)
  misc_feature (71): n=t or c
agacatgcatgtctaagaggaaaaacaagtatggacgtcagcacatgtagcagtacttcttctcacaattngttcgtcgctggttaacactaaaccgagaa

SEQ ID NO: 18769 - DNA, 101 bp, rice(Oryza sativa)
  misc_feature (71): n=a or g
tgcagatccacgcagggccagtcctgtatggcctaattttggggtttatgaaacttagacgatcagctgtnagctatttttcctctctcagcaacaggtaa

SEQ ID NO: 18770 - DNA, 101 bp, rice(Oryza sativa)
  misc_feature (71): n=t or c
tattattttgcgtttatatacctatgtggcgaaaatttacacaaatatacctaatccgcaggcggtcccgnactaccgttccacgggaccggtgattccgc

SEQ ID NO: 18771 - DNA, 101 bp, rice(Oryza sativa)
  misc_feature (71): n=t or g
aatgagattgtttatgggaagcagccccctccaattgaagcatccaaacgtttccttcaaagttacctatngacactgttggaaattcggcgacatccaca

SEQ ID NO: 18772 - DNA, 101 bp, rice(Oryza sativa)
  misc_feature (71): n=a or g
tctcaccgcacgccgttgtctccgtcttgcattagttgttctgatccaactttctcatctcctttcctctnctttctttcttcatagcgtgcagcacaaga

SEQ ID NO: 18773 - DNA, 101 bp, rice(Oryza sativa)
  misc_feature (71): n=t or g
ccttctttatttatttatttttggattggtttatcagacaccacgcggtaggacaaaaccactctggattnggtcaagggggtaattcatccgattttagt

SEQ ID NO: 18774 - DNA, 101 bp, rice(Oryza sativa)
  misc_feature (71): n=t or c
cttcccctaggccctcctagctatagctatttcaccgcttcgctccatccatccgttccgtttagtttgcnccaagcgcaagcgcaagcggcggagaggaa

SEQ ID NO: 18775 - DNA, 101 bp, rice(Oryza sativa)
  misc_feature (71): n=a or c
gccttggctaaagatgcagcattctccctgtctaactgaatactctttcctttgtcatctgccctgtatcnaaacactcgctgagctaaaatgccaacaat

SEQ ID NO: 18776 - DNA, 101 bp, rice(Oryza sativa)
  misc_feature (71): n=t or g
ggacatgcctcttccctgtcgatctccacaaccattatcgtcgcctatgcatgctaggtctggagaggttngtggcgtggtggctttgtctaggaccagac

SEQ ID NO: 18777 - DNA, 101 bp, rice(Oryza sativa)
  misc_feature (71): n=t or c
gtagcagcactagtactctagtagtctcgtagtcgtctaccagtatactcctaccacggagaagagaacanggtcatggcctgcttgctggtgatcacctt

SEQ ID NO: 18778 - DNA, 101 bp, rice(Oryza sativa)
  misc_feature (71): n=t or c
taaggcctttgttaaaatgaactccccttcatcgttggttttatttcttgcttttacttgtgcatcatatnctccttcaaaagagtagttattttatagta

SEQ ID NO: 18779 - DNA, 101 bp, rice(Oryza sativa)
  misc_feature (71): n=a or g
atcacagtgtgcccccttttgtagcacagttggcacttgggacggttgtcggtgttgtttccaccttgtcnctggtaggaggtgttgccgcgccctctccc

SEQ ID NO: 18780 - DNA, 101 bp, rice(Oryza sativa)
  misc_feature (71): n=a or g
agcgggtacgggagcggaggaacttgaggagggttcaaccatggtcactggcactggctccgttgtcgcgntagagcttgccctagaagaggagatccatg

SEQ ID NO: 18781 - DNA, 101 bp, rice(Oryza sativa)
  misc_feature (71): n=t or c
aacgatgctctcacctatgataatagaagagatggctggaataaaatcttttcgtgacgtcttgcaggacngcgagctgcatgacctggggtttaagggta

SEQ ID NO: 18782 - DNA, 101 bp, rice(Oryza sativa)
  misc_feature (71): n=a or g
aacagctgttcgtctgcgcagtagagctcagcgtctcatggcaaaggctgagctggtggcatacaaatctnttatggccctcaggattgctgaggctgcta

SEQ ID NO: 18783 - DNA, 101 bp, rice(Oryza sativa)
  misc_feature (71): n=a or g
tttgtcgtttttatggtgggttgaggactaaaattcagaacacatcattgattataaagaacctaattctntcaatcgtttattcgaacttgctatgcttt

SEQ ID NO: 18784 - DNA, 101 bp, rice(Oryza sativa)
  misc_feature (71): n=a or c
gtttgtcaaagatgtctttgggcatgacgctgacacttgctctgagatcacataaagcttggtcgaattgntgtgccccgatcaagcaggtgatcgtagga

SEQ ID NO: 18785 - DNA, 101 bp, rice(Oryza sativa)
  misc_feature (71): n=a or g
aaagaatagggttcttttgcttcagagaagttgtcccaaaatttctgttcccaattagtttgtgcagaccntgaatgccagtcacggctgtctgtcgcgtc

SEQ ID NO: 18786 - DNA, 101 bp, rice(Oryza sativa)
  misc_feature (71): n=a or g
acggataaacttgtgacgtggtgccacacgaagatcctaataagctcaagccccatacatatttcaattancttttcgtaagcatgcatgcttacagataa

SEQ ID NO: 18787 - DNA, 101 bp, rice(Oryza sativa)
  misc_feature (71): n=a or c
agtgttaagaataatattatgccactgcttaatgtaaaaataaaaaggttcccttcttttcagctcctgcntggatgactccatatatgcttatagtactc

SEQ ID NO: 18788 - DNA, 101 bp, rice(Oryza sativa)
  misc_feature (71): n=t or c
tcgacgtcgacggcaccaacaactccttcgtcaagaacatcgtcaccgccgtcgtgcgcgacgccgacgcngacgcggcggcagacacgccgaggcggagc

SEQ ID NO: 18789 - DNA, 101 bp, rice(Oryza sativa)
  misc_feature (71): n=t or c
cacctgggctccccaaggagaggaactaggacgtacataccctttgtcttgtaactcctttatctgcgttntaagttcctccaactcattagctggcattc

SEQ ID NO: 18790 - DNA, 101 bp, rice(Oryza sativa)
  misc_feature (71): n=a or g
ccggcggcggccgccttgagcatccagctgccgccgtccatgcctgtacgtacgtacgcacgatcggatcnagctagctctagtcgcgttcaatcgattaa

SEQ ID NO: 18791 - DNA, 101 bp, rice(Oryza sativa)
  misc_feature (71): n=t or c
ggattgccacacaacccagcgttctaaggctgagtttggataaaggagatgggaactaatctcgtacgcangaaaaatgaagcgatctattagcgtgtgat

SEQ ID NO: 18792 - DNA, 101 bp, rice(Oryza sativa)
  misc_feature (71): n=a or c
aactcattgaagcttttcagtgtgtagacatatgaaggaaagctggatggcggctccaaatattcttcaanttttgtccattttgtgagggagatagcaaa

SEQ ID NO: 18793 - DNA, 101 bp, rice(Oryza sativa)
  misc_feature (71): n=t or c
aggtgggtttcctcgggggtcggaaccggagttgaagaagaagaagacggaggtgggttttctcaggagcnggcgactggagttgaagaagatggaggtgg

SEQ ID NO: 18794 - DNA, 101 bp, rice(Oryza sativa)
  misc_feature (71): n=t or c
atatctctacaaggcacatgcacaacacaacaatgtatatatgatctctcaccaataatctgatcatgcanttgattatatgttctaaaaaaagtgtacta

SEQ ID NO: 18795 - DNA, 101 bp, rice(Oryza sativa)
  misc_feature (71): n=t or c
cggacttgacgatggggagcttcttgtgaatgtcgagcgggcgcggcctgaaggagagcctactcatggcngcaacttcatcagcgaggcctcaatggaga

SEQ ID NO: 18796 - DNA, 101 bp, rice(Oryza sativa)
  misc_feature (71): n=a or g
tcttgctgctggttgtagtaatcacttgatcctgtcacttgtgtcctctgttatctgcgctttctgaacgncatcttcatactgatgtcgaatcatagatg

SEQ ID NO: 18797 - DNA, 101 bp, rice(Oryza sativa)
  misc_feature (71): n=t or g
ttctctgattggcccttttactccatactgaaagggctcatctaagctgttaatttttgccctgctatatnatggacattctagaacaagtacgattgctt

SEQ ID NO: 18798 - DNA, 101 bp, rice(Oryza sativa)
  misc_feature (71): n=a or g
atgatagatagtaaccacgttaattttcttttcttcttggtgattgtgttgctgtaggcttagcttagtgnttattgtttaccctttggtcatgctgttaa

SEQ ID NO: 18799 - DNA, 101 bp, rice(Oryza sativa)
  misc_feature (71): n=a or c
gttttctctggtttccaaggtgatgtcgagagaagaatccaaaacaagttcagtgaagatctccatggttngcacctgctgctcctctgttcccagatcaa

SEQ ID NO: 18800 - DNA, 101 bp, rice(Oryza sativa)
  misc_feature (71): n=a or g
tttgtgggcccaactgtgccgatggtcggaagggtgggagaaaaataaaatccaactatacgccctgtttnttttaacttatgattattataatctagatt

SEQ ID NO: 18801 - DNA, 101 bp, rice(Oryza sativa)
  misc_feature (71): n=t or g
ccctatcatcctaacactgctcaatcccttgtactccgtaggagttgggtaggactattggtaagagcagntacaataacggactattagccagctataaa

SEQ ID NO: 18802 - DNA, 101 bp, rice(Oryza sativa)
  misc_feature (71): n=t or c
ctcacttcggaccctacacatcacaggatgcacacaacttctctcccccatgataacagaaaacaaaaganccaacaaaaactcttccctcctgccaccat

SEQ ID NO: 18803 - DNA, 101 bp, rice(Oryza sativa)
  misc_feature (71): n=a or g
aatttttgtgccctttttttttttgtgttaacggcacagttaccgcttaccttgggtggtagtaaaaccantaccaccacagggggaaccttagccgcagt

SEQ ID NO: 18804 - DNA, 101 bp, rice(Oryza sativa)
  misc_feature (71): n=a or g
acacatcgaagcacagttgcaggcttgcagcagtggtccagtggatacggaggtggtggcaaccggagatnacgcctccgcctccgccgccgcggcgcccc

SEQ ID NO: 18805 - DNA, 101 bp, rice(Oryza sativa)
  misc_feature (71): n=a or g
atatggcagagaataacaccaaatgcaagcagtcacctcatggaaagaggaaaatccaagtgactgtgtcntggggcccaccagctactagtctatcggcc

SEQ ID NO: 18806 - DNA, 101 bp, rice(Oryza sativa)
  misc_feature (71): n=a or g
gctttactcattggttgccggaatttttggtatgaacattccatacacctggaatgacaaccatggatacntattcaaatgggtaagtcaaccattacaaa

SEQ ID NO: 18807 - DNA, 101 bp, rice(Oryza sativa)
  misc_feature (71): n=a or g
cattataacctgaacccaaatgataaatggtatttcgtccgtttcactgtagttgccataattcctctttntagcgatcgcagagggtaaagctgaaatag

SEQ ID NO: 18808 - DNA, 101 bp, rice(Oryza sativa)
  misc_feature (71): n=t or c
cggttaaattgggccggcagggtggtcagaccaacagactggttagactatggagcttggacggttaaacngggttcaacggacgtgtggttcgttgctgg

SEQ ID NO: 18809 - DNA, 101 bp, rice(Oryza sativa)
  misc_feature (71): n=t or c
aaggcatcatcggactttggccatattgtacatgctacaccaaacggggtatttcgtcctaccttccctgntgacatcgctgccctaatccgcttatcact

SEQ ID NO: 18810 - DNA, 101 bp, rice(Oryza sativa)
  misc_feature (71): n=a or g
gcggcttctccatctcgccttgagccggtggccttgaatgtgattgctgtgattttctcctcctcctccgntcgccgatctgaggtcacctgcgagtgcgt

SEQ ID NO: 18811 - DNA, 101 bp, rice(Oryza sativa)
  misc_feature (71): n=a or g
gcgccgccgtcgtcaccctagcacgtcgccttttggccttgctagatggctgaaatgcgtcaacagtgccnacgagtgtccccctcttcctttccctcccc

SEQ ID NO: 18812 - DNA, 101 bp, rice(Oryza sativa)
  misc_feature (71): n=a or g
tagccttaaaattcttttatgctgcttcgtttgctttgttttccctgtcatttgaactgcattctgttctncatttgagcacatgacacacaataggtgtg

SEQ ID NO: 18813 - DNA, 101 bp, rice(Oryza sativa)
  misc_feature (71): n=a or g
ccttcctcctcttttggatgaggaatccaagcctgaaggcccaatagcaataggtgcaggaggaggaaccngagatgaagacgtgagatcagttggagggc

SEQ ID NO: 18814 - DNA, 101 bp, rice(Oryza sativa)
  misc_feature (71): n=a or g
tgttgctgtggatggttccgcatcgtttgtggccactgccgaggagcctatagagtgtgatagctctgacnaagcggatggtgatgagcaagaggacgagc

SEQ ID NO: 18815 - DNA, 101 bp, rice(Oryza sativa)
  misc_feature (71): n=a or g
cggtgttgactcccgcgcattttgtcgaacacctcccgggcgagccaatatcagccatggctgttggcgcngccggccagcgcgatctgcaaaaaccagag

SEQ ID NO: 18816 - DNA, 101 bp, rice(Oryza sativa)
  misc_feature (71): n=t or c
caggaaggcattcttcacgtcaagctgtcgaatggcccagttctgagagacggctaagctgagaacagtgngaaccgttgccggttttaccacaggactga

SEQ ID NO: 18817 - DNA, 101 bp, rice(Oryza sativa)
  misc_feature (71): n=t or c
ggtgggaaaagctggattcaaattaactcagtccagcgcattgttcatagcagctccctaccagtcgagcnatgcatgttctcaatatatttgttttcgtg

SEQ ID NO: 18818 - DNA, 101 bp, rice(Oryza sativa)
  misc_feature (71): n=a or g
cctatgaaaagccggcaagagagatctagcacaatctctgatctcttattatacttgtgtgatctagatgnataaagagaacaccggcttcggctaacagg

SEQ ID NO: 18819 - DNA, 101 bp, rice(Oryza sativa)
  misc_feature (71): n=a or c
cttagaaacaggatgtgttaggatgtgagtgtggtgtttcatgtgtaatagtgtgtgcgtgcgcaactgcnatgtaataaaaagggaaaaaacatcaactt

SEQ ID NO: 18820 - DNA, 101 bp, rice(Oryza sativa)
  misc_feature (71): n=t or c
tattatttaatttttttatttttatttagcttttatttaaggtcatgatgattgtttcataaatagaaaangccaatattggtcccgtagttggagcgagt

SEQ ID NO: 18821 - DNA, 101 bp, rice(Oryza sativa)
  misc_feature (71): n=a or g
ctgtcactgtcgtaggcctccacttgggggtcatcaccgttggcaacccctgagcatcctccatcgcactncctagggaaaggtggcccgcacattggtga

SEQ ID NO: 18822 - DNA, 101 bp, rice(Oryza sativa)
  misc_feature (71): n=a or g
tccttagcattattgccatgcgaatttccctgggactgagggatggttttaggtttccaatgagatctagnttgtggtactgttccactgtgcttcacatc

SEQ ID NO: 18823 - DNA, 101 bp, rice(Oryza sativa)
  misc_feature (71): n=t or c
gctgttacgatccgttttgattaagcttggtgggcccgggattagggggggcgcaaaaggtgtagtaatantagttgggttgtgtgcgtgggtgggggtta

SEQ ID NO: 18824 - DNA, 101 bp, rice(Oryza sativa)
  misc_feature (71): n=t or c
cccaaaaagacttcacttttgcctataaacctagacaggccttcgtccagattcataatgtttctttttangtaggtggtatgtaggatttatttcgatta

SEQ ID NO: 18825 - DNA, 101 bp, rice(Oryza sativa)
  misc_feature (71): n=t or g
ttggatttcccaatgtgggttgaaggaggaaatgtccacattaaagtcaatgataatgtgggtcctaactntcacgcccagaaattctcgaaccagaattt

SEQ ID NO: 18826 - DNA, 101 bp, rice(Oryza sativa)
  misc_feature (71): n=a or g
tatgcaacggaggaactcgtctagatgaaaaattaagctcccagaaattaaaattgaaaattaaggacgtnagaattgtcgacgcgtgtactctacttatg

SEQ ID NO: 18827 - DNA, 101 bp, rice(Oryza sativa)
  misc_feature (71): n=t or g
gtcctcttctcagcccagcccagcgtggtagtaccaatctcagcacctctctctttttcgttttgcttttncaaccacctactggtttcaaactgattttt

SEQ ID NO: 18828 - DNA, 101 bp, rice(Oryza sativa)
  misc_feature (71): n=a or g
actaaaaatgcagcatgcagtagttttctatgctgtaattaaccaatgcaacattccttgtaattaaccantggtttctatgctgtaaaaaatgagttctc

SEQ ID NO: 18829 - DNA, 101 bp, rice(Oryza sativa)
  misc_feature (71): n=a or g
ttgtagagacatgtaaatggttgagttaagtggtgtcctaaaaggccaccataaacaatgtaactaaaatnacatacttaccaatgcaatcatttgtgtgt

SEQ ID NO: 18830 - DNA, 101 bp, rice(Oryza sativa)
  misc_feature (71): n=t or c
atgtgtcgcaatctagatagccactcggactccagccaagacggagatgaacaacctgggtatccatcaanagtcaattcctcaaggccagggtgaggtat

SEQ ID NO: 18831 - DNA, 101 bp, rice(Oryza sativa)
  misc_feature (71): n=t or c
ctttctggcaagcggctctttcctttttcctgtgttagtattgcatcaattgcatgctttagaccctcccngatgaaggtctcaaagaagaatttctggtc

SEQ ID NO: 18832 - DNA, 101 bp, rice(Oryza sativa)
  misc_feature (71): n=t or c
aataaaagcattacattagggatatatcgtgatgctacttggtgcatcaggtggtagttgcggtagcatgntccatcttcgttgatggatggatcagatga

SEQ ID NO: 18833 - DNA, 101 bp, rice(Oryza sativa)
  misc_feature (71): n=t or c
tatatatacaccaagaagtttggttgtcttaaatacctccactgcaggaaaatgttttgaataatgatcgngatttcaaacccaaatttaacaaggtaatg

SEQ ID NO: 18834 - DNA, 101 bp, rice(Oryza sativa)
  misc_feature (71): n=a or c
acagacccaaaattcagtttcattcaacaacatttcatcaagacgacgtacgtactcaacacgatcggttntggaagatgcaaaggttgcccctcccggtg

SEQ ID NO: 18835 - DNA, 101 bp, rice(Oryza sativa)
  misc_feature (71): n=a or c
ggcctggattggtcctgccagcgcatccaaagccacctcaatctcaaagacgatgaaaatctttccaaatnaaggattcccaatcctcccatttccttagg

SEQ ID NO: 18836 - DNA, 101 bp, rice(Oryza sativa)
  misc_feature (71): n=a or c
acttcatctcctaccacaagtatgcaacgcagggactgtacaagaatgagctgttgggcttggtctttgangatattggcggtggcgggctcacgattagt

SEQ ID NO: 18837 - DNA, 101 bp, rice(Oryza sativa)
  misc_feature (71): n=t or g
tgtcacgaaacttaattttttattcatctgaaaatggaatcattattatttatatcactatcagtcctcanagtttcaacacaggaaaaaaaacattgaat

SEQ ID NO: 18838 - DNA, 101 bp, rice(Oryza sativa)
  misc_feature (71): n=a or g
aatcatccggttgaaaactgtaacaatacttacatgaagacttgtgcttcccgctctgcaaataggccgcnaatggttctgtgtacgtcaagcattgcagc

SEQ ID NO: 18839 - DNA, 101 bp, rice(Oryza sativa)
  misc_feature (71): n=t or c
tgccatgaactcagcaaagaaatcatcagggtcgctcggattgtaccggaaattactaggaccacttgagncagcagctgcggaagtccggctctgtgaac

SEQ ID NO: 18840 - DNA, 101 bp, rice(Oryza sativa)
  misc_feature (71): n=a or g
tgactctataacaacttcagactttttagggttatcaaccaccggtgacaaactgcactcaccaataggtnaagacaggattgagcgactttctaattgcc

SEQ ID NO: 18841 - DNA, 101 bp, rice(Oryza sativa)
  misc_feature (71): n=a or c
attgccatcctacactgcaaagcacgccattggagagagatcgatagatatagatggagaccccagtgatngagatgggccgggagagaaaaggaattagg

SEQ ID NO: 18842 - DNA, 101 bp, rice(Oryza sativa)
  misc_feature (71): n=a or g
aggatagatgaggtcgttctctccagtcagctatggaaaagtgcaatagaaaacagaggaaactgataganaaggggtaaaatagtctttgcacatcctgg

SEQ ID NO: 18843 - DNA, 101 bp, rice(Oryza sativa)
  misc_feature (71): n=t or g
ttttgttccccctctttcctagatttggagtctatccgagggtagaatgctaagaagcatttcatttcctnctattactgattcagtggcgttagacccaa

SEQ ID NO: 18844 - DNA, 101 bp, rice(Oryza sativa)
  misc_feature (71): n=t or c
ctacaggagggagtgaggaagttgcaggcgaggcgttcgattgtttgccgcagagaggaaggggagagctngctgctcgtctcgtctcgcttcccttgcgg

SEQ ID NO: 18845 - DNA, 101 bp, rice(Oryza sativa)
  misc_feature (71): n=t or g
gaaggcaaagtagttttgggagcaatggcatgcccaaatcttcctttcaaatcaatagatcacaatggtgnatcttcgggagatcaagttggtgccctctt

SEQ ID NO: 18846 - DNA, 101 bp, rice(Oryza sativa)
  misc_feature (71): n=a or g
tcaaattacactcagttacatagcacttacactcagttatatatacaacacttacacacttaattatgtancacttgcactaaggcacaatgcaccaaaat

SEQ ID NO: 18847 - DNA, 101 bp, rice(Oryza sativa)
  misc_feature (71): n=t or c
attgaagattttgaccgcgcatgcgaatttgtttatcaactcgggttcaatcccgcggattggggtccggnggaggtcaaaaggaggtggggcccggggtg

SEQ ID NO: 18848 - DNA, 101 bp, rice(Oryza sativa)
  misc_feature (71): n=a or c
tcttctctgttggatgagatactgacagcatatgagactttatgaaagctacacgcttacttattgccgtnaataagctaaagtgagcttgatcctgctca

SEQ ID NO: 18849 - DNA, 101 bp, rice(Oryza sativa)
  misc_feature (71): n=a or g
aatacactatatattgagataaacggaaggagaaaaatatttcggtctcatcagatggccaaatgctttgnctgatcagccatttaagcaaaataagctaa

SEQ ID NO: 18850 - DNA, 101 bp, rice(Oryza sativa)
  misc_feature (71): n=t or c
ttcggctctcagagtctgacaagaccttatccactatgggcgtccctagctgaaattctcgtaggtctctnggaggcttgtcggaacggcgtaaagggtca

SEQ ID NO: 18851 - DNA, 101 bp, rice(Oryza sativa)
  misc_feature (71): n=t or c
atttgtcgcccagactaaaattcgtcttaaaccacagtagcatgtatagaccgtcccgaactcgcaaatcngtatcaactttcgtcccaaggcaatatagt

SEQ ID NO: 18852 - DNA, 101 bp, rice(Oryza sativa)
  misc_feature (71): n=t or c
aagaatgtttgcaaattgcatcccacttaaaatcaggccaagattctttcatggtgatttgcatatcatancaatttagattaaagtattttttttgatgg

SEQ ID NO: 18853 - DNA, 101 bp, rice(Oryza sativa)
  misc_feature (71): n=a or g
ctgctgtaagattaagaaaagttgtatctgttgatgactgcgtacgtgcaaatgcaatggacagtttgccnaatggcccgtcgtcgccggtagacatggtg

SEQ ID NO: 18854 - DNA, 101 bp, rice(Oryza sativa)
  misc_feature (71): n=a or g
ctttacatgtcctggatcacaggttgaccaggaagaataattcaaccattatgcaagtgctaattcaatgntcaggtactgcatctgaacaagccacctgg

SEQ ID NO: 18855 - DNA, 101 bp, rice(Oryza sativa)
  misc_feature (71): n=t or c
tttagagtagccttcacatgattgaccttcttttgtcctgcctcttgtagtgtatctgaatagtcagagtngccatcttcaggtatggaaagaaataaaag

SEQ ID NO: 18856 - DNA, 101 bp, rice(Oryza sativa)
  misc_feature (71): n=a or g
tcatcatgctgttgctgcatcatgttgttgaagttggtgaactgcacatcaatagattgttgccattcttntgtttgagctatgtgttccgtgcagttgta

SEQ ID NO: 18857 - DNA, 101 bp, rice(Oryza sativa)
  misc_feature (71): n=t or c
aatattttttttcttttcgtttctgctcataatcctaacccggcaaaaacaatggcgttaacgctgtgggnccgcttggcccaacagaggtaagatatccg

SEQ ID NO: 18858 - DNA, 101 bp, rice(Oryza sativa)
  misc_feature (71): n=a or g
atttttcatcaattcatatacaaggaagagctccttattctttttgctgaaacagctgcacatgaaacggncaatgttccagctgtattcgcggcagcacc

SEQ ID NO: 18859 - DNA, 101 bp, rice(Oryza sativa)
  misc_feature (71): n=t or c
tcttcccatgcctgtccccgcattgggaattaatccctgtggggtcttcgtccctgcttaaaacaatatanacacatcaaattatatatgcaatacaacac

SEQ ID NO: 18860 - DNA, 101 bp, rice(Oryza sativa)
  misc_feature (71): n=a or g
attcggtgtcgtcggttaagcaagtccaaagggaaaataaggctcataatagtaatacccaatcaacgccngtacataactggcatcaccactagtttttg

SEQ ID NO: 18861 - DNA, 101 bp, rice(Oryza sativa)
  misc_feature (71): n=a or c
ggtagttgggcccatgttctgatgttttgatggagtttaggagcccagctcttgtatggatagaattcttnttcacttaagtctaaatttcctcccaactt

SEQ ID NO: 18862 - DNA, 101 bp, rice(Oryza sativa)
  misc_feature (71): n=t or c
tataaaaatttgtaaaatccacgagtacagaaaattaaacaggatactccctccagacaaaaataagtganaagcatcttttgaacatttcaaatcaacta

SEQ ID NO: 18863 - DNA, 101 bp, rice(Oryza sativa)
  misc_feature (71): n=t or c
attttaccagcatcaaaagggtacaacaatttcttaagaaaacaggtctcaggatgtgtacgctttccgcntttcaatataatatcttcagcttaataatt

SEQ ID NO: 18864 - DNA, 101 bp, rice(Oryza sativa)
  misc_feature (71): n=a or c
cagcagagtgcttttgtcccgggcaggttgatcacggataatgttttggtagcttatgagtgcttacacanaatgaaaaagaagaaaggaagaaaaggtct

SEQ ID NO: 18865 - DNA, 101 bp, rice(Oryza sativa)
  misc_feature (71): n=a or c
accaaacctgttagagattaattgatcgggagggaggcgaggagccgttggattgtcgtcatcagaaactntatactctatagaagcactccaaaaatatt

SEQ ID NO: 18866 - DNA, 101 bp, rice(Oryza sativa)
  misc_feature (71): n=t or c
tgtgtcaacggcgcctccaggaccacagggcgcctccgccttatgggcatcgatggcctctttgactcttnggcctcgtccattagcattcgccaaccgct

SEQ ID NO: 18867 - DNA, 101 bp, rice(Oryza sativa)
  misc_feature (71): n=a or c
tgggggcagttggtgtaacacgaccaataggatactcattcagttcctggaccaagtcagatgtaggctgnatggccttttcttctttgttaagtagctta

SEQ ID NO: 18868 - DNA, 101 bp, rice(Oryza sativa)
  misc_feature (71): n=t or c
gtcgaaagccttgtggctttttacgacgatgtcgtcaacatagtcctccacatttcgtcccaactgcttgnaaaggaccttgtacaccagcctggcaaatg

SEQ ID NO: 18869 - DNA, 101 bp, rice(Oryza sativa)
  misc_feature (71): n=a or g
cggtgagggaaatcggtggcaccacaactgctgattcgtctgagggcgtggatggactcatggtggccggnaacacatgttctagagtagtagaagtgctc

SEQ ID NO: 18870 - DNA, 101 bp, rice(Oryza sativa)
  misc_feature (71): n=a or g
tttcattctcacaatgttacatgtttgtttattagttgcatggtgggataactttggcaatggaactctcnagctccaaggtcttgcaaagcgagtccttg

SEQ ID NO: 18871 - DNA, 101 bp, rice(Oryza sativa)
  misc_feature (71): n=t or c
gaaaaagaactcatccactgaatcaggtagatccccttttgcaacaaagtttacatgaccataaccactcnggtctataattgcattgcttgtaatggcac

SEQ ID NO: 18872 - DNA, 101 bp, rice(Oryza sativa)
  misc_feature (71): n=a or g
tttattacgattatatctttataacaagatctcacttgataatgttttgatgggtttttagtttgttgcantcttaaatgttgcacgtagtgttaattaga

SEQ ID NO: 18873 - DNA, 101 bp, rice(Oryza sativa)
  misc_feature (71): n=t or g
attgccgaaatcttgtttcgacgacgagcattcaaatgccttggtgcacaaaccgtttcaggactcggatntactccttgatcgctgggctcgatggtttg

SEQ ID NO: 18874 - DNA, 101 bp, rice(Oryza sativa)
  misc_feature (71): n=a or g
ttaaaatttaaatccgggtgaactggttccaccacaaaaaacctaacagttgagttacactcacttcacancattagtgtccgttcctaatatacttggta

SEQ ID NO: 18875 - DNA, 101 bp, rice(Oryza sativa)
  misc_feature (71): n=a or g
aacttacgttgtgaaacggaggaagtagttcatagctaaaaagaggtcgtttctcaaataaaaaatgcctngaatcgctaatgcgtgcgcgcgtcctccca

SEQ ID NO: 18876 - DNA, 101 bp, rice(Oryza sativa)
  misc_feature (71): n=a or g
ggaagaacaggggctcttgttctggtacgactgatctacctccgaactcgcatctaaacagactcaagacnagtgggggagactactgttcaaaaatgggg

SEQ ID NO: 18877 - DNA, 101 bp, rice(Oryza sativa)
  misc_feature (71): n=a or g
aggaagttcatcacgaaagcgttgaggctatccgtcctttggggttttactttgaccttcttgtgggttcnttccgttcttgatctaccccatggagtaat

SEQ ID NO: 18878 - DNA, 101 bp, rice(Oryza sativa)
  misc_feature (71): n=t or g
taaaagagtcatggaaacagaatggaggagaaagttcactttgactccttcaaaacattaggttggatctnattcgtatccttcaattcaatcataaaaca

SEQ ID NO: 18879 - DNA, 101 bp, rice(Oryza sativa)
  misc_feature (71): n=t or c
gatcaaattttgcatgtcgattggtcaacacatgcatgtggatctggtggctggctatctcgatcgtgtgngagctgtaagcactgcctattgttccgcgc

SEQ ID NO: 18880 - DNA, 101 bp, rice(Oryza sativa)
  misc_feature (71): n=a or g
atgagcaaaactgaaaatattatggatggggctgataccatggattgtgtgagtcttgtggaacaacttcnaagatatctaaaagggaggagatacttaat

SEQ ID NO: 18881 - DNA, 101 bp, rice(Oryza sativa)
  misc_feature (71): n=a or g
ttttgtctagcaagtccacttcaagtttattgcaattcagcttgcatgctttcttgattggatagtgtgcnacagactttaaatgaccaccttttggctct

SEQ ID NO: 18882 - DNA, 101 bp, rice(Oryza sativa)
  misc_feature (71): n=a or g
tgggggcaggatttgcagcaggagaagaggatggtgaggacgttcgtgaacgtgtacggtgggcaggaganctacaccaaggaggcggtcatggcggccgt

SEQ ID NO: 18883 - DNA, 101 bp, rice(Oryza sativa)
  misc_feature (71): n=t or g
aagatgcattttagatcaaataaagttggtggttcttgactgcatgtgtgacaggttactggacctaatgnccatggactcgaaattcagggaatcagatt

SEQ ID NO: 18884 - DNA, 101 bp, rice(Oryza sativa)
  misc_feature (71): n=a or g
atcttaacctatctatgcaacgctacctattcggctattccttacagtatattgtattgtattggtcagcncacactggagcttggtcattatatgtatgc

SEQ ID NO: 18885 - DNA, 101 bp, rice(Oryza sativa)
  misc_feature (71): n=a or g
gcagacaatgaattttggatgttgcaatttctctattttgaatgttgcaccatctcctccgggtcatgctncgcccatgggtgctgcatgaccttcctcag

SEQ ID NO: 18886 - DNA, 101 bp, rice(Oryza sativa)
  misc_feature (71): n=a or g
ttgtagcaggtagagcctcccccaattagacgctttagattgtcccagtagtgtaggattctgattctggnagaagttgtagcaggtagagcctcccccaa

SEQ ID NO: 18887 - DNA, 101 bp, rice(Oryza sativa)
  misc_feature (71): n=a or g
cagattgaagatagccttgcaggaaatttatgtcgctgtactggctacagaccaataatagacgccttccntgttttctcgaaaagagatgatcttttgta

SEQ ID NO: 18888 - DNA, 101 bp, rice(Oryza sativa)
  misc_feature (71): n=a or g
tgccacctgtattctcaccaatcttgaagcaccggaaaaaagtaaagcaatttggatttttttaattagcntatacgctccgtattccagtggtgccctac

SEQ ID NO: 18889 - DNA, 101 bp, rice(Oryza sativa)
  misc_feature (71): n=a or g
atctgccatgctaatttctacctgctgctaattgcttgtgtggggatatgaatatatgatgtagaggggcnttcaagatccgaggcgcttccaattcgata

SEQ ID NO: 18890 - DNA, 101 bp, rice(Oryza sativa)
  misc_feature (71): n=t or c
acatcaacctttattgtgcttaaaatagttgatcaaacgagtatccagttacccactaaaaacacggtggnttttttcccttccaagatacattgaatttt

SEQ ID NO: 18891 - DNA, 101 bp, rice(Oryza sativa)
  misc_feature (71): n=t or c
gcggcggggcgcgtggtatggtccgtggcggcggcgggggctcgaccacccggtgaagttttttttttctnctccccgatgctacggctggtggggatcgg

SEQ ID NO: 18892 - DNA, 101 bp, rice(Oryza sativa)
  misc_feature (71): n=t or c
tattaatttattgatatactcgagcctgacagccgggacattagtattagtaggagtatataatgagtatntaatctactcaaagcagggcatgtatatat

SEQ ID NO: 18893 - DNA, 101 bp, rice(Oryza sativa)
  misc_feature (71): n=a or g
tcggtgttttaggggttgtttggtttgctcccaaagtttgccataggttgccacactttatattaggcaantttgacaaagttagtctattatttggttca

SEQ ID NO: 18894 - DNA, 101 bp, rice(Oryza sativa)
  misc_feature (71): n=a or g
aaagtctgagaaaagataatccctcaaaagtgaagctcgcaacaaagttccaggggtgaaaagttttaacntgtcacatcggatatacggacacacatttg

SEQ ID NO: 18895 - DNA, 101 bp, rice(Oryza sativa)
  misc_feature (71): n=a or g
aatggtctcaaacataggctggagcgagaacgactctagactcgttaatgtggcatgcataccaacaaggngacggaaatactggccgcaaaactggacct

SEQ ID NO: 18896 - DNA, 101 bp, rice(Oryza sativa)
  misc_feature (71): n=t or c
tccaaggaattgccgactaattgagcttttctgcaacgcggtaaaaaaagaagggaaaaggaaagctaagngcacgcagggatgctgcagcagcagggaga

SEQ ID NO: 18897 - DNA, 101 bp, rice(Oryza sativa)
  misc_feature (71): n=a or g
aactactgtgagaaaagaatgattgggaaaggctactttggtaaggtttacaaggggatcacccaggacanccagcaggttgctgtgaagcgctttgtcag

SEQ ID NO: 18898 - DNA, 101 bp, rice(Oryza sativa)
  misc_feature (71): n=t or g
agacgagttcttctgggaggcagaacgaactgcaattctcctcgtaccgaagcctctggtagatccatatnatggtcgaagtaagcagcttctgctactgt

SEQ ID NO: 18899 - DNA, 101 bp, rice(Oryza sativa)
  misc_feature (71): n=a or g
gttcggcatcactgcacggcggaaggccgatctccatctccgcccatgcctccttgtgtctgtgccaggcntctagcggacatacgtccaaccaacttgct

SEQ ID NO: 18900 - DNA, 101 bp, rice(Oryza sativa)
  misc_feature (71): n=a or g
attcttcttcaactcttcatactcgtcactgaaaagtgttcgaatttaccacttgcggaaaccaatcttcnacttatcaaacctgccgcagtacttcttgg

SEQ ID NO: 18901 - DNA, 101 bp, rice(Oryza sativa)
  misc_feature (71): n=t or c
attatctacctttaagtgttgaaggtcgagaagttataacccaagtgcagtactacggtgcggaaacatgngaaacgagatgataaggtcgtttttgtacg

SEQ ID NO: 18902 - DNA, 101 bp, rice(Oryza sativa)
  misc_feature (71): n=a or g
gatcgatattttttgcttcttttttcgtgttatgtgaagagcgttccccaggccctgtttggaggtgagtnttgtcactacacatggaaaatagaggatgc

SEQ ID NO: 18903 - DNA, 101 bp, rice(Oryza sativa)
  misc_feature (71): n=t or c
cacccagtcctcgctatgagaaccctacccccaatcctcatcagccagcaaggctttccactagatgtctnaataactcttgatgtccctttaacttgacc

SEQ ID NO: 18904 - DNA, 101 bp, rice(Oryza sativa)
  misc_feature (71): n=a or g
cacaaacgaaaaatctacctgtacttccccgtcttggtaatcttaagaagataagaaccaagaccttcganctccttgccggacttaatggcatcatacgt

SEQ ID NO: 18905 - DNA, 101 bp, rice(Oryza sativa)
  misc_feature (71): n=t or c
gagtgggaagttggttttgaacagactgtgggatctgagcgggaagttggttttgaacggattgtgggatntgagtgggaagttggttttgaacggattgt

SEQ ID NO: 18906 - DNA, 101 bp, rice(Oryza sativa)
  misc_feature (71): n=t or c
ttgcggtacttacggattgatctagttacacatcttactgaagaaataggagaactgctgtttttggaganattggatctacctcgtggtattggtacaga

SEQ ID NO: 18907 - DNA, 101 bp, rice(Oryza sativa)
  misc_feature (71): n=t or c
gttcttcctcatcttttcttcccctctttcccaagccatgtgtggcaacggtgatggcagacagtggatcngaggcaataacgaagccctccctcgccggc

SEQ ID NO: 18908 - DNA, 101 bp, rice(Oryza sativa)
  misc_feature (71): n=a or c
ttatagtcggtaatctagatagcttctattattcctctattgtaatctctatggtgtttgtccatatactngtataaactggagtatggctattacctttt

SEQ ID NO: 18909 - DNA, 101 bp, rice(Oryza sativa)
  misc_feature (71): n=t or c
tacctagctagccacctgcacacatatttcatgcaggtcggccatagatcgaacaggagagagagagagancgggcggggaagttgtgatccggttatgac

SEQ ID NO: 18910 - DNA, 101 bp, rice(Oryza sativa)
  misc_feature (71): n=a or c
cacgtcaatgacccggggtcctatgggtatcatagttctagaaaccaagcaacattaatactcactctgtntcaaaatataagcatttataaaatagcgca

SEQ ID NO: 18911 - DNA, 101 bp, rice(Oryza sativa)
  misc_feature (71): n=a or g
aagatgcttcagtagcttatggacgctaatatgttgtttctgaaatagttttcactgaaaacatgtgcagntcgtctgtggtaagagagcaggagctttta

SEQ ID NO: 18912 - DNA, 101 bp, rice(Oryza sativa)
  misc_feature (71): n=a or g
ttacactaatcctccgtacaacagatatcccattccgacacagcaggcatctttcaatgtgatgtactacncaacaaacagcgaggaagcgatgagcatat

SEQ ID NO: 18913 - DNA, 101 bp, rice(Oryza sativa)
  misc_feature (71): n=t or g
aagttcccaaagtgagctccctgaacgcagcaaatgataatttgctttccacaaacattaatacacattgncatatgtgaaatcaaagtgtgttttgatta

SEQ ID NO: 18914 - DNA, 101 bp, rice(Oryza sativa)
  misc_feature (71): n=a or c
ttgactatttatacatgcacccacctttgttgacgcggacgagtgtttcgtggacaccatagtgaaaaaanctggaccggtggtcgacccatcaccaagtt

SEQ ID NO: 18915 - DNA, 101 bp, rice(Oryza sativa)
  misc_feature (71): n=a or g
atccgcacatgaaaattgattttcgtgtgcgggcgatgctcccccatttttcggtgcgatccaacttatgnaccgcatggaaacaaaatagggtggtgttc

SEQ ID NO: 18916 - DNA, 101 bp, rice(Oryza sativa)
  misc_feature (71): n=t or c
attttaagttcagagaccgcagatggttctattcatttcagaaggcccttttgcagtcatacaatgagcangtgacacaattagaaatgtagacaagttga

SEQ ID NO: 18917 - DNA, 101 bp, rice(Oryza sativa)
  misc_feature (71): n=t or c
tgtcctccgatttccccttccgactgattcgccggatcaaataatcgcaaacgttcgtgcaccaccctttncgcttctggatggcgttgggacatccgaag

SEQ ID NO: 18918 - DNA, 101 bp, rice(Oryza sativa)
  misc_feature (71): n=a or c
tcgacgcgcctttgagcatgcaggtttattgttgctgttccccctggaattgttgccacccttgcagtggnagaagtccttaccactctcctcttaccgat

SEQ ID NO: 18919 - DNA, 101 bp, rice(Oryza sativa)
  misc_feature (71): n=a or g
cggaggaaactgtagcacataacctctgtattggcttggcacgtcttccacttcaacccttgagtggcctncaggcaatggaacaccatgtattgtttgcc

SEQ ID NO: 18920 - DNA, 101 bp, rice(Oryza sativa)
  misc_feature (71): n=a or g
atgacgtttagatggtctcatgtactgaccaaatgtcattacatcaacaccagcagccctaaccttttccntcgtgctgataacctgatcaggcgtttctc

SEQ ID NO: 18921 - DNA, 101 bp, rice(Oryza sativa)
  misc_feature (71): n=t or c
aattttgaagaaaaattttagaactaaactcggccctaatgcagagtttccgcttctactaccttcaactncaagtcattaacaaatccacaactgggcca

SEQ ID NO: 18922 - DNA, 101 bp, rice(Oryza sativa)
  misc_feature (71): n=a or g
gtatttgattaataggatatggggtcactaaccttgcgtgttatgttcagcagtttcgtcttgtacatacnccgtcagtgccaggatggtattaggaacac

SEQ ID NO: 18923 - DNA, 101 bp, rice(Oryza sativa)
  misc_feature (71): n=t or c
ctcatcagacctttgcaaaatgggctgaaatttacgggccaatctacactataagaaccggggcttcttcngtagttgtgctcaattcaactgaagtagcc

SEQ ID NO: 18924 - DNA, 101 bp, rice(Oryza sativa)
  misc_feature (71): n=a or g
tgctttgttatataaaaaaaaaacctaggctatatcgcatgagaagatctattgtttagggagagcatggncctatgagaaaacaagaatggagcttcgat

SEQ ID NO: 18925 - DNA, 101 bp, rice(Oryza sativa)
  misc_feature (71): n=t or c
catatatacactaatacacatggttcattgttgaatgcccttggcttcttgaatccagttgatgaagaatnacaacaacaaatcaacatgcatgtattctt

SEQ ID NO: 18926 - DNA, 101 bp, rice(Oryza sativa)
  misc_feature (71): n=a or g
gttatgtaggcatcctaaaagtttattgtcgtgatcggtaaagcttcacaacacgcatgtgttacctattnagtatgtgctggtgtacacaaggggttgta

SEQ ID NO: 18927 - DNA, 101 bp, rice(Oryza sativa)
  misc_feature (71): n=t or c
acgattttcataaagtcaggcggccaaggttttgcgaattaaaggacctcaaaatcatctacttacttttngctgagcgtcaccagcctttgccgtcgcta

SEQ ID NO: 18928 - DNA, 101 bp, rice(Oryza sativa)
  misc_feature (71): n=a or g
gcgccggatttgccaccttctcggtggtctccttcccgccttgtccttcgtggcaaggatgattattgctngtggtggttggatcgagcgatccaggaacc

SEQ ID NO: 18929 - DNA, 101 bp, rice(Oryza sativa)
  misc_feature (71): n=a or g
tcttgtttgtactacccaagtgcctaagtagttggtacacgtacgtgactcttatcaatgactttggttcntaaacataggtatttggcaaaatttggtac

SEQ ID NO: 18930 - DNA, 101 bp, rice(Oryza sativa)
  misc_feature (71): n=a or g
gtgtttggatagtttacatgaaaataacaaaggaatctagatgtattctagtgcgagaagagataaagagnaaaaaaataattgcattgtacttctccgag

SEQ ID NO: 18931 - DNA, 101 bp, rice(Oryza sativa)
  misc_feature (71): n=a or g
ggacgcaggggaggagattgaaggatgttgcgccgcttgtatacgcagcctccaagaaaaagaacagaacncttcaacaggcttcgcaagcgaaccaatgg

SEQ ID NO: 18932 - DNA, 101 bp, rice(Oryza sativa)
  misc_feature (71): n=a or g
ctctatttttcacctccttacagttagcacgtccctacatgataggaagttctaacacaaaagcaatgatncaaaacaaaagcaatgataaaaagtagtaa

SEQ ID NO: 18933 - DNA, 101 bp, rice(Oryza sativa)
  misc_feature (71): n=t or g
attactatttcggtatgttacccactgatcattttcctgtattttgtgttgtcaccatgtgtaccactganattttatcaaagaaatgaggacaacatgct

SEQ ID NO: 18934 - DNA, 101 bp, rice(Oryza sativa)
  misc_feature (71): n=a or c
ccctataaatgacaatcctcctatcactagcactttcatccacttctattgctttacctttaccagcaccnacaacagctttgcccttccctttgtccaca

SEQ ID NO: 18935 - DNA, 101 bp, rice(Oryza sativa)
  misc_feature (71): n=t or c
cttgtgatttctagttactgtggacagtaccattacaaagcatagtagtacttgacagaatcacagagaantcatccaacttacagttttaactttcaaat

SEQ ID NO: 18936 - DNA, 101 bp, rice(Oryza sativa)
  misc_feature (71): n=t or c
aaattggcatagctgagagagtttatttcaccaagaccttgcggcctgtagctgtgaagaaacatcctttncaccctggaatatgaccccccccccacctt

SEQ ID NO: 18937 - DNA, 101 bp, rice(Oryza sativa)
  misc_feature (71): n=a or c
ttggttcttgcaagaactaaagtatgctcttggtggaaaggttggcccctatggaaaatggacgataatgncagataggcaaaaggtaaagtttattttgg

SEQ ID NO: 18938 - DNA, 101 bp, rice(Oryza sativa)
  misc_feature (71): n=a or g
actcaacatgatattacctgtcgtaggaggaagtggttccacctccttaggggttgatacttgattttccnctgatggatacggagaatccgaacttgatg

SEQ ID NO: 18939 - DNA, 101 bp, rice(Oryza sativa)
  misc_feature (71): n=t or g
cgtagttgccatttctatctctattggtaccacatcgttgccagtcgtattcatgttgttctaattttctncgttgccaaccttcaccatctatggatgaa

SEQ ID NO: 18940 - DNA, 101 bp, rice(Oryza sativa)
  misc_feature (71): n=t or g
gttgaaactagaatgtgtaattgctccactctatgccaggaaactaggaaagttgtatgtcttgggctatnatgtttgttctagatgagatgctagctaac

SEQ ID NO: 18941 - DNA, 101 bp, rice(Oryza sativa)
  misc_feature (71): n=a or g
tttgaacataaccaattctagaaatttcaattggagacctatcaccaatcacggggaagtatcccgtgcantaccactatccagtgggagaatacaatatg

SEQ ID NO: 18942 - DNA, 101 bp, rice(Oryza sativa)
  misc_feature (71): n=a or g
gtgtgtgctgaatcaactcaccttgctggaacagtccaaaatgctctacaccagggttttgtaggttgagnaagaatctgttggaagctaatggtcatgtc

SEQ ID NO: 18943 - DNA, 101 bp, rice(Oryza sativa)
  misc_feature (71): n=a or g
aattccctttttaggaggaactaaatgccatgtttcatttttcattaatgcataatattctttgtccatgncctctttccagttcctatctcctagagcct

SEQ ID NO: 18944 - DNA, 101 bp, rice(Oryza sativa)
  misc_feature (71): n=t or g
gtgcaatatggccgaatttcaggtcgctacccgtttagttccaaagtccagactgcaccccttgtaccganttttttggcactttggccctatctaaacac

SEQ ID NO: 18945 - DNA, 101 bp, rice(Oryza sativa)
  misc_feature (71): n=t or c
ccccaattggtgaccctgatggagaaatctcccttcctgagctcatagacgccgaccgtcgtcgccttccnctccgccgcatcggcaccgccggcggaggc

SEQ ID NO: 18946 - DNA, 101 bp, rice(Oryza sativa)
  misc_feature (71): n=t or c
accataacaggcctctataatcattaccgcacatttaggagacacaagagcttttcacagataaaagaaantagtctattcttccaagagttctgttaaat

SEQ ID NO: 18947 - DNA, 101 bp, rice(Oryza sativa)
  misc_feature (71): n=t or c
cttcttctcagacttagctgtaggaggtgcagagaaagtgcctaaaacccatcgctgcaagagcgggaagnggatggattctgagatggtcacgaccggca

SEQ ID NO: 18948 - DNA, 101 bp, rice(Oryza sativa)
  misc_feature (71): n=a or c
acctgtcttgggactgagtttagcaatttgaattgaccatatatcatttctcctccataattgatcacttnggacaccattgttcctatgatattgtttaa

SEQ ID NO: 18949 - DNA, 101 bp, rice(Oryza sativa)
  misc_feature (71): n=a or g
ccacgcgccaaatgctcaggaataacttgagccaccaccgaaccatccggttgcatatgatgaaccaagtnttccgggaccgcctgatttgcagtgtactg

SEQ ID NO: 18950 - DNA, 101 bp, rice(Oryza sativa)
  misc_feature (71): n=a or g
aaatgggaaaacttgtacctgtaggtttcctttttgctgggagatgagtcatgcatcgcaaaatttgaagncacaaatggacttccagatgcacttcttcc

SEQ ID NO: 18951 - DNA, 101 bp, rice(Oryza sativa)
  misc_feature (71): n=a or g
gcagtcgtcgcgggcgcggttcccggggaagcacgagcagttcgtgttcgaccggatcgtcaaggaaggcntgccgccgcacgtcggcgccaccgtgcggt

SEQ ID NO: 18952 - DNA, 101 bp, rice(Oryza sativa)
  misc_feature (71): n=a or c
tgaatgactggtcattgaatagggaccttagagcaatgattcttccaccaaaattctactaaactgctggnagctagtatcacactagtacgaaaaagcac

SEQ ID NO: 18953 - DNA, 101 bp, rice(Oryza sativa)
  misc_feature (71): n=a or g
tgtcgtcaagctccttggttgctgccttgaagttgaagtgcccatgttggtctacaaattcgtctcaaatnacaccctctaccactacatccatgggaaga

SEQ ID NO: 18954 - DNA, 101 bp, rice(Oryza sativa)
  misc_feature (71): n=t or c
ggttgtccctgtctggttcaccgaggtcattgtaaacatcgtaccggtagatgcggtcatgctcttgatanggcccttgcctgtcctcccctctgaggtac

SEQ ID NO: 18955 - DNA, 101 bp, rice(Oryza sativa)
  misc_feature (71): n=a or g
actccatcctaaaaatcagtaacaaaattaaaaggaaatgctaaatgagggaataccgttcacagtgcccncgacggaatcgtcttgctcctcgtcccata

SEQ ID NO: 18956 - DNA, 101 bp, rice(Oryza sativa)
  misc_feature (71): n=a or c
agcgccatgcggccattagctcccctcttccttttcttcttcttctcccttgccgcctccgcgagtgacancattcttgccaactcatctctcgccgatgg

SEQ ID NO: 18957 - DNA, 101 bp, rice(Oryza sativa)
  misc_feature (71): n=a or g
gtgccgccaatgatgacaaggccaaaggcgacaatcgggaggaagaactcgaggcactcaagcttttgcangaccaggttgattacaccgttcatcatgct

SEQ ID NO: 18958 - DNA, 101 bp, rice(Oryza sativa)
  misc_feature (71): n=t or g
acaaacaacagtaaagaatagcactgaccttctcatagcaaacactttccaagctagtgcccatttttggnagatagtaattgaagtagtcagcgaaaatt

SEQ ID NO: 18959 - DNA, 101 bp, rice(Oryza sativa)
  misc_feature (71): n=a or g
tccgacatgaactttatctgaacaaggaggatgataatgggctctgccgaaagatgaaggaccctaaatgnacttgtacagagggttgaagtattgggcct

SEQ ID NO: 18960 - DNA, 101 bp, rice(Oryza sativa)
  misc_feature (71): n=a or g
catgcctccttcatcccaccacctgctggcctcctcgtcatttttgccaaaaggagaacccggacttgacngcgtcgcgtgggtggccaaagcttccctcg

SEQ ID NO: 18961 - DNA, 101 bp, rice(Oryza sativa)
  misc_feature (71): n=a or g
tgcacttttgcattatcaccttccatgccaacttgctccatttatgcattttcaccttccatgtcaacttnttctatctcatttccatctgattcatctcc

SEQ ID NO: 18962 - DNA, 101 bp, rice(Oryza sativa)
  misc_feature (71): n=a or g
aaataaaataccgttttcggaccaaaatcatggttcgtgccgactccttttaataggccaatttctacttngcccacctccttatactggctagcttgaaa

SEQ ID NO: 18963 - DNA, 101 bp, rice(Oryza sativa)
  misc_feature (71): n=a or g
ctatttgaaattataaaaatacaagttggcaagctttacgttaaaatttgcatttaaactcctcaaggcanggcgtcgactcttgtacttgcaacacatca

SEQ ID NO: 18964 - DNA, 101 bp, rice(Oryza sativa)
  misc_feature (71): n=a or g
tccaactccgtacataacatctcatggatccaaaattgctcgcctacacatgtatgactggattgtgctgnttcttctagtcgtagtagatggaatactga

SEQ ID NO: 18965 - DNA, 101 bp, rice(Oryza sativa)
  misc_feature (71): n=t or c
agcactcgccgcccgccaccgcgctctccctctccccccaattccatccctccacgccacgatcgccttcngcaaggtaaccgccctcccctcgccgccgc

SEQ ID NO: 18966 - DNA, 101 bp, rice(Oryza sativa)
  misc_feature (71): n=a or g
gttgatgtgcatttcaggtgactaatgtaatttcgagacggagctcagtttccttcaacagccagagaatnagttttatgtccattcgttcaaggccaagt

SEQ ID NO: 18967 - DNA, 101 bp, rice(Oryza sativa)
  misc_feature (71): n=t or c
attttcgtttctcaaattgacagcaacataactgcaacacgtcctacatttttcaaacaggctgaccttcnacatcaagtggattcagaccctgtttagat

SEQ ID NO: 18968 - DNA, 101 bp, rice(Oryza sativa)
  misc_feature (71): n=t or c
gggagctattccaaaactgaccaactcgagcgatagcttgcaacagccagtggcggacttaggatttgaanccagggtagacctagccaaaaaaaatccga

SEQ ID NO: 18969 - DNA, 101 bp, rice(Oryza sativa)
  misc_feature (71): n=a or g
catcccgaggttcctcgacctcacgctgatcaagtcgtttaaggccgtggtagacaagctcggggagaacngcatcatgcactcatggtgatcctggacaa

SEQ ID NO: 18970 - DNA, 101 bp, rice(Oryza sativa)
  misc_feature (71): n=a or g
gggccagatcacacggtggaagaaggggagcagcggtggaggccgcagcagcggagacgtttgatgacatngatccgagccggcggcagtgacggtggagg

SEQ ID NO: 18971 - DNA, 101 bp, rice(Oryza sativa)
  misc_feature (71): n=a or g
gtggggcgtcgttgctggtgaaagctggaatggtttctcgtgggagagacgggaggcgcgcgagagcgacngaagcgggaaggtttttgggggcggaggag

SEQ ID NO: 18972 - DNA, 101 bp, rice(Oryza sativa)
  misc_feature (71): n=t or g
gataattaacggtggaaggctcatccttcaatctcttgccaatgggtgtcatatatgaactccaaaggganattagaagcgggtttttttttctgattttt

SEQ ID NO: 18973 - DNA, 101 bp, rice(Oryza sativa)
  misc_feature (71): n=t or c
tttgcacaggaggcaaaagctggctggacatatatcagaattgcaattttcactcctgtaaagtttctttngtgtgcaaatcattttccagtgcaactgca

SEQ ID NO: 18974 - DNA, 101 bp, rice(Oryza sativa)
  misc_feature (71): n=a or g
aagcaataacttgacaacattagttagctaggaaagtttcatgctgatcaaatttcctatttcactgaacntggaacttgaattgtatgccatcaaattca

SEQ ID NO: 18975 - DNA, 101 bp, rice(Oryza sativa)
  misc_feature (71): n=a or g
gctagtcggttggagcacgctctcttggcttggtggagatgctccgaacaagcaaaagcctaagcctaagnccgtgttcttgccccaagtttcccaaccca

SEQ ID NO: 18976 - DNA, 101 bp, rice(Oryza sativa)
  misc_feature (71): n=t or c
ggtgagtctagaataaatattataccagcccaacctaaccagtccacaccatctcgtcacctcatcctcancctcacccccacttggcgccgcactagccc

SEQ ID NO: 18977 - DNA, 101 bp, rice(Oryza sativa)
  misc_feature (71): n=a or c
taacacatatggtacctatcagtatcagggcaatacccattggtgccaggctgatattgggttgtccaaantgatgaatcggacaaaagtgttagtcttat

SEQ ID NO: 18978 - DNA, 101 bp, rice(Oryza sativa)
  misc_feature (71): n=a or c
ctacggtgtcattaaactagttcgactaaaatattgtttgatagacagacatgctaatcgaatgtaggaantccagggtcttcgtggcttccggacgtcat

SEQ ID NO: 18979 - DNA, 101 bp, rice(Oryza sativa)
  misc_feature (71): n=t or c
gggttttcttgtctagatcagcctcaactgcttgctccttgcttgtgacattgtgaaggccactgatctcnagtgcacctcggagattgttcaggttcttc

SEQ ID NO: 18980 - DNA, 101 bp, rice(Oryza sativa)
  misc_feature (71): n=a or g
atggtgaccattatctttttaattacagtgtaaaaaaaaaccaaaatcgtacccatctacctttgttctanaatattgctatttatagcataataccgtgt

SEQ ID NO: 18981 - DNA, 101 bp, rice(Oryza sativa)
  misc_feature (71): n=t or c
tcactgtgccggggcggcgcgtgccgtggacatgcttgtatgaggctgtgttgagatacagacattggatncaaacttcggttcttttccatcacatcaac

SEQ ID NO: 18982 - DNA, 101 bp, rice(Oryza sativa)
  misc_feature (71): n=t or c
ttacgccgacagtagccaagtaattgcacaatattacggtgtctaagccgacctaggctcacaatctcggngatgaattctctcatcccctgcttagaatc

SEQ ID NO: 18983 - DNA, 101 bp, rice(Oryza sativa)
  misc_feature (71): n=t or g
tcctctgcactgtttggggcagcatgaacagcgcaatctttttccgactctggctcagatgaaattttctngccctttctggatcccatcagcaccttagg

SEQ ID NO: 18984 - DNA, 101 bp, rice(Oryza sativa)
  misc_feature (71): n=t or c
tacaatgaggtattcacagtttcttcaagtcttctcctctttcgcctctccatacaactattttcacggcntttggaagactgtgctgattctgacctaga

SEQ ID NO: 18985 - DNA, 101 bp, rice(Oryza sativa)
  misc_feature (71): n=a or g
gatgaagccgagggagatgaggtggtggaggatggcagaggcgagaagcgcgcgacagtggagtcggcttngggagcccgccaccttccctcccgctagat

SEQ ID NO: 18986 - DNA, 101 bp, rice(Oryza sativa)
  misc_feature (71): n=a or g
caaaaccactagtcttccaacacttgaccattccattaaagccattctcattggcccccatcctcttaccntctttaatgtcaaaagcttaatccgtcaaa

SEQ ID NO: 18987 - DNA, 101 bp, rice(Oryza sativa)
  misc_feature (71): n=a or g
gcttccagcttctaattcattttctggattccgcaactgcagtttcacgtaatatgaaccatgattttggnagaagctacggcagttagaagctcccctat

SEQ ID NO: 18988 - DNA, 101 bp, rice(Oryza sativa)
  misc_feature (71): n=a or g
aacgcaaggaactgtgtctggtcagaggttgaagtaatagcaggagaagtagctcgctctggagatgtagnctgagagggaaggtcccgtattcttcttgg

SEQ ID NO: 18989 - DNA, 101 bp, rice(Oryza sativa)
  misc_feature (71): n=a or g
acgctgaagctaatcgccaagcaactgggttaattggattagggattgaacctgttgcatcgccgttgaanagagcgtcggtcgccatgcgagcagcttcc

SEQ ID NO: 18990 - DNA, 101 bp, rice(Oryza sativa)
  misc_feature (71): n=a or g
tgtcatagaagcattatgttgactgctataacacattgctttggtttactattttactaagattggactgnttaggcttaacccatgcaggagcgacaact

SEQ ID NO: 18991 - DNA, 101 bp, rice(Oryza sativa)
  misc_feature (71): n=a or g
aactaaagttatgatcaccttatcatcaaatatgtaaagtggatcttcgtcatgctggagttccatgtaanaaacataatcttttagtttcatttttatct

SEQ ID NO: 18992 - DNA, 101 bp, rice(Oryza sativa)
  misc_feature (71): n=t or c
tcaagaagtctaacgacaagtgatgaatgtgtgtagacttcacagatatgaacaaggcttgcctaaaggangacttccctctcccaacgatagaccagtta

SEQ ID NO: 18993 - DNA, 101 bp, rice(Oryza sativa)
  misc_feature (71): n=a or g
aaagacgtacgattctcttccttgtttgcccggtaagccagaaaatctctctctgcaaagtcagaaggccntggatcacggaatggtgctcggaattgcag

SEQ ID NO: 18994 - DNA, 101 bp, rice(Oryza sativa)
  misc_feature (71): n=a or g
gttagctttaggccatagaccttgtttggagagcttgtcacagctacagtttctcttaaaagttgcttatnctagaagctatctcaaatagtccacagctt

SEQ ID NO: 18995 - DNA, 101 bp, rice(Oryza sativa)
  misc_feature (71): n=a or g
gtgatgcgtgtgctcaaaatctatttttcttggaagcatttctcttattggagtgttccggaaattttcgnatgttccgaaaatacacagaaccatgtttg

SEQ ID NO: 18996 - DNA, 101 bp, rice(Oryza sativa)
  misc_feature (71): n=a or g
gccgccatcgacagcagctggtgcaggtgcgatgcgctcaaccacatgctgaggatcatctacagggagancggcgccgccgacgctgggcaccccatggc

SEQ ID NO: 18997 - DNA, 101 bp, rice(Oryza sativa)
  misc_feature (71): n=t or g
cgccgcaacgccggcctagcattgcaaatgtgagagagactaactactactccgaattgccatgtcattcngctattctcaacttgctaagctgctgatct

SEQ ID NO: 18998 - DNA, 101 bp, rice(Oryza sativa)
  misc_feature (71): n=a or g
ccaagcagaaatgcccggagcttcgtctccgagatggatgatttcgacgtaaactatgttgtgtccgtacntgtgtctagcattgcaatggacaagaagag

SEQ ID NO: 18999 - DNA, 101 bp, rice(Oryza sativa)
  misc_feature (71): n=t or c
atcatttccacaatatttatatctaaattcattcatcatttcaacatcatttaatacatattcattcatanatcctgtagcaaagcgcggggtgtcaccta

SEQ ID NO: 19000 - DNA, 101 bp, rice(Oryza sativa)
  misc_feature (71): n=a or g
cttcctctgcttcagaacgtgctgaacaaatattgcagcaccaacacgatggagcttgatgtggatttgcngagaaagaagctgaggagagttgtcctcat

SEQ ID NO: 19001 - DNA, 101 bp, rice(Oryza sativa)
  misc_feature (71): n=t or c
ttacttgctcctatacgtggacgacattgttttgactgcttcctcagctggtcttctccgttgggctatanaggctttacaggctgaattttccatgaagg

SEQ ID NO: 19002 - DNA, 101 bp, rice(Oryza sativa)
  misc_feature (71): n=a or g
gaagcggcggacggcagccgggattccctggggaagaagatagaagggttagggaggaacataggcgaccngagcggtgagaataccacgccggagaggag

SEQ ID NO: 19003 - DNA, 101 bp, rice(Oryza sativa)
  misc_feature (71): n=t or c
ctcttgatttgtcctgtgtgattagatatgtcttgtaatttcttcatgctagctgtccgaccgacgtgtgngcgcgcgcgggcaacattttcattttagtt

SEQ ID NO: 19004 - DNA, 101 bp, rice(Oryza sativa)
  misc_feature (71): n=a or c
agcccgcactattttctcctctatcatcttgcccacctcttcctctccatcaccctgctcaatatcatccncaccttcaacctcccgctgtcctatttccc

SEQ ID NO: 19005 - DNA, 101 bp, rice(Oryza sativa)
  misc_feature (71): n=a or g
ggtcttcaccttgttcaagattggcgcgacgttgactggagcggcatctaagacaatcaaggtaacaaccntgacggcattctgttgaggtgtaaggaaca

SEQ ID NO: 19006 - DNA, 101 bp, rice(Oryza sativa)
  misc_feature (71): n=a or g
tctcgcttgcgtaggatttatgaatgattgaatatatatataggatctcaatcctactgtccgttaaagtnttgagattatagacatataatgatttaatc

SEQ ID NO: 19007 - DNA, 101 bp, rice(Oryza sativa)
  misc_feature (71): n=t or g
aataccagagacattggagacgattcaagaagaaacagagttagcagaagctgtaaatccaccttgcagtntgttagctgtagagtgggcacaccagagat

SEQ ID NO: 19008 - DNA, 101 bp, rice(Oryza sativa)
  misc_feature (71): n=t or c
gagggaaaaggcggcgcgtttaattcctggatcgcacggtgcgcgagctgccgtgcgcgacaacacgatanccctcggcttggcgcggtttgttaccaccg

SEQ ID NO: 19009 - DNA, 101 bp, rice(Oryza sativa)
  misc_feature (71): n=a or g
tatatattttttttaaaaaattatgattatataggtgacatgcatgtagaaaacgtgtggacatccactcntagggtgaaaatccatctcctcgttaacaa

SEQ ID NO: 19010 - DNA, 101 bp, rice(Oryza sativa)
  misc_feature (71): n=a or g
aacccactactaacttaaaaaacaaaaacaagaggtgctttcagctttcatcgttggtcaaagaaaccgancgaaaaaaccgggcagaaaaaagtccgatc

SEQ ID NO: 19011 - DNA, 101 bp, rice(Oryza sativa)
  misc_feature (71): n=a or g
ttgcaaggttagcaacttagcatggatgcataccgttaagagccatttgtggtctgggcacccagagattnagtgagtgggtagcaaatcatggaacccaa

SEQ ID NO: 19012 - DNA, 101 bp, rice(Oryza sativa)
  misc_feature (71): n=a or c
gtcgctgacaaccccctgaagccgaagtgaagtcctcgactgattcgccgggcttgcatcgcatggactcncacgcttggcgtagcttctgcgcatgggat

SEQ ID NO: 19013 - DNA, 101 bp, rice(Oryza sativa)
  misc_feature (71): n=t or g
agaaggccaaggttcgatccatgtcatccaaaccctagcactaccacagaaaccctatttcgatgccggtngggacttgggaaccaccctttgattctcga

SEQ ID NO: 19014 - DNA, 101 bp, rice(Oryza sativa)
  misc_feature (71): n=a or g
cctgtgctaatgcttacttatcaggtgtcatctcactttatacggttgccaaaaggtagcactatgtctgntttgattgaggacatgaaatccaaggtgaa

SEQ ID NO: 19015 - DNA, 101 bp, rice(Oryza sativa)
  misc_feature (71): n=t or g
taacgccggcaggtcatcagtagcagttgccttctgcttctttgaggattttcctttaggaggggatttgncgtcagatgacttggccctttttcttctag

SEQ ID NO: 19016 - DNA, 101 bp, rice(Oryza sativa)
  misc_feature (71): n=t or c
gtgcagtcctgcggagcgcctctcaccgtcctgctgctgctgctgctctacttccaaatgggctcaccggnccctcccttgatcgagcccagcgagcggtg

SEQ ID NO: 19017 - DNA, 101 bp, rice(Oryza sativa)
  misc_feature (71): n=a or g
gcgcgagttcttcaagtaattcatgttcttgttctatttttgccccgtattttggggatttttcgggggcngcgtttgatcgctgcggggaatgggtgagg

SEQ ID NO: 19018 - DNA, 101 bp, rice(Oryza sativa)
  misc_feature (71): n=t or c
taataagggggtgtttagatccattggtaaattttttttcatcatcacaatgaatatttgaatacataganggagtattaaatattgataaaaaaaaacta

SEQ ID NO: 19019 - DNA, 101 bp, rice(Oryza sativa)
  misc_feature (71): n=t or c
ttatgagaatacttcttactaatttagtgcgttttctggattctacaactttagtttttgagaatctgaangaaatactgaatggtttaaggaagcttcta

SEQ ID NO: 19020 - DNA, 101 bp, rice(Oryza sativa)
  misc_feature (71): n=t or g
tcattcatagctttgccaagctagcagctaaggtgatggctttaagactcactccaaggatggcggacttngttgcttgcacacagtcggctttcatcaga

SEQ ID NO: 19021 - DNA, 101 bp, rice(Oryza sativa)
  misc_feature (71): n=t or g
cattgtttcaaacagacctgatcgttgaactaatcgatgttggcgagttaggcacggagatagtggtggangcattcaactaagtggaaaaataaactata

SEQ ID NO: 19022 - DNA, 101 bp, rice(Oryza sativa)
  misc_feature (71): n=t or g
atcgtcgtcgtcttcttctttctccacatcatcctcttatcttgcattgctggttcttgtcatctccactngcctctccttgctcttcaccaacctcagac

SEQ ID NO: 19023 - DNA, 101 bp, rice(Oryza sativa)
  misc_feature (71): n=a or g
aagctagcaaggaagcacgtccttctaaaattgaagaagaggaggcacagaccgagaagtctacgccactngaatattgtgacaccacgctgctgccgttc

SEQ ID NO: 19024 - DNA, 101 bp, rice(Oryza sativa)
  misc_feature (71): n=t or c
cacacacagtacatctctggaccaaaccccacgcaaccacgacaaagaaggccgttggtgactgctcttcnggcgccatctcatctccggcggtcaacacc

SEQ ID NO: 19025 - DNA, 101 bp, rice(Oryza sativa)
  misc_feature (71): n=t or c
atagtatcatcgtacatatgtgcaggaccagtttgtaatgggttgtatcatcattaagcaggtaccgttcntgcgtttatactgtgttttttttttaaaaa

SEQ ID NO: 19026 - DNA, 101 bp, rice(Oryza sativa)
  misc_feature (71): n=t or g
ctcgacatatgccacgtcagcaaaaacaggggaaaaattgctctatactgccatggcatctactttgcacnagtttgaatagttgagagatagagatttat

SEQ ID NO: 19027 - DNA, 101 bp, rice(Oryza sativa)
  misc_feature (71): n=a or c
tccatcgtttttacgttgtaccatccgacgtcaacaaattggatgttaaaaacctcatagtgcggcgatanggtagtgtcgaagacgatgaattctttgtc

SEQ ID NO: 19028 - DNA, 101 bp, rice(Oryza sativa)
  misc_feature (71): n=t or c
taatcgtagtactctagattttcctcaaaaaaatgttattcaataaattttgtggccttggttctggttcngatcaagtcacatgcaggccagggtgtggg

SEQ ID NO: 19029 - DNA, 101 bp, rice(Oryza sativa)
  misc_feature (71): n=t or c
ttactaatcggatgtgccaccgggacagcatgttgctttctattagattgtatttctgttgctgatagcgngcgcggcactgcctcgatctcctgcacctc

SEQ ID NO: 19030 - DNA, 101 bp, rice(Oryza sativa)
  misc_feature (71): n=a or g
aaaaactaccagatccaagaagaagctatgaattgaagctagaaaagggctcacctggcagcgggacgacnatgatgtcaccggcggcgagctcgggggtg

SEQ ID NO: 19031 - DNA, 101 bp, rice(Oryza sativa)
  misc_feature (71): n=a or g
gcccggtctgattttttcgtactatggcgtatataaggctcagagatttttctggtatgggtactcctctntatctattaccagttggatggccatggcag

SEQ ID NO: 19032 - DNA, 101 bp, rice(Oryza sativa)
  misc_feature (71): n=a or g
agagccttgtgttgccagggagtggtcagacgctgatcatctaggaaagagagactgcgatggtccgttcnaatgaaaaattcagcgtgttggagataagg

SEQ ID NO: 19033 - DNA, 101 bp, rice(Oryza sativa)
  misc_feature (71): n=a or g
cctcgccgaggccgtcgacctcgccgaggcgattgtttggagagaaatttaactccaatctccccgcccanggaaataaaatgtgtgggcgtgccagtgta

SEQ ID NO: 19034 - DNA, 101 bp, rice(Oryza sativa)
  misc_feature (71): n=t or c
atcaaagaaaataggctctatcgattttgttaaacaataataaggggcactaatcactactataaaacatnaaataggtgtccgcactataggtgccgaaa

SEQ ID NO: 19035 - DNA, 101 bp, rice(Oryza sativa)
  misc_feature (71): n=a or g
cttttcgtccaccttaatttgcagaaaaagcgtgcaaaattgtgatgtcgtcagtcttcgtcctgccctangtggatgcatgatcgtatagtatatacaaa

SEQ ID NO: 19036 - DNA, 101 bp, rice(Oryza sativa)
  misc_feature (71): n=t or g
caaaccctaagtttcagtttccacatcatgttcagagaaggctatatatccgtacatctgttgaaaacgantaattaagctagaaagtgttgatctgatga

SEQ ID NO: 19037 - DNA, 101 bp, rice(Oryza sativa)
  misc_feature (71): n=a or c
acaccagtcaacactgctacagcatcaatcataccatggccatggcatacattatgcatgcttccaagatnaatcaatcaaacgtagtctctcgcttaatt

SEQ ID NO: 19038 - DNA, 101 bp, rice(Oryza sativa)
  misc_feature (71): n=t or c
actagctactccctctgtccctaaagataaagaatttcccggatttttttcgaagcatcggacgtacatangggatagagctattttttttttaaaaaaag

SEQ ID NO: 19039 - DNA, 101 bp, rice(Oryza sativa)
  misc_feature (71): n=a or g
aattcattcaggctacttcccattactggttatgatataattttggggtgtgattggattcttctccacanccctttgactctcaatctcaaaacaagaga

SEQ ID NO: 19040 - DNA, 101 bp, rice(Oryza sativa)
  misc_feature (71): n=t or c
gtggacgatgagattggattagtgggtgctacagctcctgcacgccactgtcgtcactccctctgtgcgtngtcgctgccccctccgtgcgccgccgtcac

SEQ ID NO: 19041 - DNA, 101 bp, rice(Oryza sativa)
  misc_feature (71): n=t or g
tgtggaaaatgaagaaagctatggtacaatggaacaaccatttgtgatgaaccatctcaagaaaatcagtntcaaatgtcaaaaggaagtgatgtgggtta

SEQ ID NO: 19042 - DNA, 101 bp, rice(Oryza sativa)
  misc_feature (71): n=a or c
agttgcaaatgcactaattagcatgtatggaaggtgtggtaattttgacgttgcacggaaaatatttggtntggtcaaaacaaaggatgttgtcacatgga

SEQ ID NO: 19043 - DNA, 101 bp, rice(Oryza sativa)
  misc_feature (71): n=t or g
ttattaatttgttatatgttgggtggtgtcaggagatgatcttccgtggcacagacacggtggccatcctnctggagtgggtgctggcgcggatggcgctg

SEQ ID NO: 19044 - DNA, 101 bp, rice(Oryza sativa)
  misc_feature (71): n=t or g
tttacaaccgaccgtccatgaaaaatcttctgtaactccttttctctttcaatattaataccatttggatnaccgttcttcgatcatccggcaaaatagta

SEQ ID NO: 19045 - DNA, 101 bp, rice(Oryza sativa)
  misc_feature (71): n=a or g
tttaatttttaaaaccacggtatgtctcgtggttaccacacattttttcgtggtaaccgtaccttaacacnagatgcggtaaccgcgctaaaacactgccc

SEQ ID NO: 19046 - DNA, 101 bp, rice(Oryza sativa)
  misc_feature (71): n=t or c
gcataggtctaaaatatgtgacagccaccaaccagaagagggggatgggtgagttaaatactcgcacacanccaaaaaataactagtcgtcactcacatat

SEQ ID NO: 19047 - DNA, 101 bp, rice(Oryza sativa)
  misc_feature (71): n=a or g
agagaagacactgaggcaccatccacattcccatctcatgcttacaaggttctttcttttgatgaactcanaggtcgtgcttacaggaaagatattctttc

SEQ ID NO: 19048 - DNA, 101 bp, rice(Oryza sativa)
  misc_feature (71): n=t or c
cgatttttggcgactccgctggggaaatatgctcaacgacatctcaacgttgacgccgccatgacaaagcngccatcaaccaaggcggaggtggaaccatc

SEQ ID NO: 19049 - DNA, 101 bp, rice(Oryza sativa)
  misc_feature (71): n=a or g
agatcatggatgacaaccactactttgatctgcacaagaattgggattaacaaagatggtgaggaacatcnggattaacccgaccatgggaccaacacggc

SEQ ID NO: 19050 - DNA, 101 bp, rice(Oryza sativa)
  misc_feature (71): n=a or g
agatacatttttatgtaagaaatcataaatcccctatcttccccaaataggaccctaacaccttttattcngggagacggattccttgcgcattggctatt

SEQ ID NO: 19051 - DNA, 101 bp, rice(Oryza sativa)
  misc_feature (71): n=t or c
tttttagaaatagcatcactttcaggatatggctttgcacatatgcacacatagttctattgtgctaagtntgttatgatcacatattttctctgtctgaa

SEQ ID NO: 19052 - DNA, 101 bp, rice(Oryza sativa)
  misc_feature (71): n=a or c
tcacattgcttagcttttttttggtgattaatgcaggggacttttatgctattcctaacatcactaattcnaaaattaacacccccagattgtggtctttc

SEQ ID NO: 19053 - DNA, 101 bp, rice(Oryza sativa)
  misc_feature (71): n=t or c
agagatcccatgaatttggatggcaaaacaagctattgggtgactaggaggagagacctttgaatgtgctnatttctttgatgtacttatctccctatctg

SEQ ID NO: 19054 - DNA, 101 bp, rice(Oryza sativa)
  misc_feature (71): n=t or g
gattcaataatcaatgggtctttgttttgtgtggattcaccaataagattcaatagtcaataggtctttgntttgtgtgtgtgtttttagtttgtgtgaat

SEQ ID NO: 19055 - DNA, 101 bp, rice(Oryza sativa)
  misc_feature (71): n=a or g
aagtttggatccaaactttggatctaaacacagcccaatagctttgatgccgaccacacttccctctttcngcaactcgatatgacaatgaaagcgagcag

SEQ ID NO: 19056 - DNA, 101 bp, rice(Oryza sativa)
  misc_feature (71): n=t or c
cgaaacatctaattcagggcaaaccaaaagagtcctgctttccagttggctaagtacattagaactggcanatacaactgctcacttcactgtgcaagtcg

SEQ ID NO: 19057 - DNA, 101 bp, rice(Oryza sativa)
  misc_feature (71): n=t or c
tgtatcgtagtcaacacttaaattaataagattagccccatgtagtatttttattttcgtggttgggacgntttagataaattcatgcactaaaactagcg

SEQ ID NO: 19058 - DNA, 101 bp, rice(Oryza sativa)
  misc_feature (71): n=a or g
agttcaatgcctccaacttcaacagcaacggatccatcattaagaatagacactttaccaggcgttggccnagatgcgaatttatgcactatcggcacgac

SEQ ID NO: 19059 - DNA, 101 bp, rice(Oryza sativa)
  misc_feature (71): n=a or g
gtcatcagatttggttcatattccttcaatcttcaccccgccagaagttaattcacaaaagggatccaagncttcaatttggtaaccttagtcttatatta

SEQ ID NO: 19060 - DNA, 101 bp, rice(Oryza sativa)
  misc_feature (71): n=a or g
ataccggaacatatattctatatagcgcatagtataaagcaatcatagtgtaaagcaaccagcagtagtancacatattcacatgtgctaaaccttaagac

SEQ ID NO: 19061 - DNA, 101 bp, rice(Oryza sativa)
  misc_feature (71): n=a or c
aagtttgccaatttcacgaaatttccaacaaaatatcaaagaacccattggtttttttcagacctgggcancggtgccgatgggagatcacgaagaagccc

SEQ ID NO: 19062 - DNA, 101 bp, rice(Oryza sativa)
  misc_feature (71): n=t or c
aaaacttagactttgccctggtgcaagttgccactttggtaaatatacatggaccaaagtggcatttactnttttttctaactaggatgacacgttagcga

SEQ ID NO: 19063 - DNA, 101 bp, rice(Oryza sativa)
  misc_feature (71): n=a or g
ttatttgatgaatccagcagcatacgtacgacgctgttagattatattataccggccccagggacagcatncagccatatatatatgtacgtatacatgat

SEQ ID NO: 19064 - DNA, 101 bp, rice(Oryza sativa)
  misc_feature (71): n=t or c
tctccatcaccagtagcagcatcatctccaacagcattaatagctacagctccaagaacagcatcaccagnagcaccaaagaatccatcaacacagaaggc

SEQ ID NO: 19065 - DNA, 101 bp, rice(Oryza sativa)
  misc_feature (71): n=a or c
gcagccatggatggagtaggaggagatcggggcaattgatcaccggtgattctgacgcattcgtcgccgtngctgtcgccgtcgccgtcggcatcggcgac

SEQ ID NO: 19066 - DNA, 101 bp, rice(Oryza sativa)
  misc_feature (71): n=a or g
aagcggtggcggcgctcgatattgttcttgagagaaggggaaggttggccgcggccacgacaaggtcggtngtgagattgatgcggagcccaccatcttgg

SEQ ID NO: 19067 - DNA, 101 bp, rice(Oryza sativa)
  misc_feature (71): n=a or c
cttccctcgctctctatatatagccagcccatcctgtctctcttccaacaaaccgcactatacactagctnctaccttctccaattcatccattttcacgt

SEQ ID NO: 19068 - DNA, 101 bp, rice(Oryza sativa)
  misc_feature (71): n=t or c
gttcccatccaccgtcaccattgtactctccattagtaagtcgctggccaccataagtagctgcaacagtngaggtcattctaagccaccaacctcaccgg

SEQ ID NO: 19069 - DNA, 101 bp, rice(Oryza sativa)
  misc_feature (71): n=a or g
cctagccatctacacagcatcccatccagaaacacattcatcaatatctacataccagcaccaacaacaancagacctcgagattgaaaggtttccaagaa

SEQ ID NO: 19070 - DNA, 101 bp, rice(Oryza sativa)
  misc_feature (71): n=a or g
accacgtgcactactgtggttgataaccatgcaatgcttctttatttttcatggggcaagacaaccgaacnacctttctcgcctgaggaggaggctaagtt

SEQ ID NO: 19071 - DNA, 101 bp, rice(Oryza sativa)
  misc_feature (71): n=a or g
ggtgattatgatccggcttcctgtttccattgctgggaaatatgattctatagcattccattctgttgtgnataatacatcatcaagaacaatcaagtatt

SEQ ID NO: 19072 - DNA, 101 bp, rice(Oryza sativa)
  misc_feature (71): n=t or c
tcttgtatatggtggcttgctccaacgaacatcgccaaggacatcccatatatgttcgtcttgtatgtcgngtccagagtgactgcatcaccaaagtccgc

SEQ ID NO: 19073 - DNA, 101 bp, rice(Oryza sativa)
  misc_feature (71): n=t or c
gagacatatgaacattaccccaatggaaaaacgcaagcgctgccatctcctggaagttgctttcagcaagntgaaacacctcctgggcttcctcagtagta

SEQ ID NO: 19074 - DNA, 101 bp, rice(Oryza sativa)
  misc_feature (71): n=a or g
aaattacagagcaggtgaggtcaccaagtccatcgtacaaaatgtggcaactcaagtgaagaaagaggccnccaaaagtgtggcaactgaagcgaataaag

SEQ ID NO: 19075 - DNA, 101 bp, rice(Oryza sativa)
  misc_feature (71): n=a or g
gacatggagaagctgcttgacccggagcttgcggaggcagagattgcaaagcttggttctgcatgtcaagnttggggtttctttcaggtgaggcctaatag

SEQ ID NO: 19076 - DNA, 101 bp, rice(Oryza sativa)
  misc_feature (71): n=a or g
ctcgtcggggcttggagggaggcattggttggtatgggccccattttagtaaacctgcagcatgatggagncactagtaggtgccatggtcgatggatcca

SEQ ID NO: 19077 - DNA, 101 bp, rice(Oryza sativa)
  misc_feature (71): n=a or c
gcacgatgagtcgcggtcggaggatgtcgaccttgttggcggtgaagtccagatctccaaagcggaactcngttccagaagcgaaactgatcgcttggaca

SEQ ID NO: 19078 - DNA, 101 bp, rice(Oryza sativa)
  misc_feature (71): n=t or c
tcgatgcttttcgatgtgtatttttgatgcgtttgaacaggttttgtttaatcctgatccgtggtgtcagngtgtagactgacaccgctggtctccataat

SEQ ID NO: 19079 - DNA, 101 bp, rice(Oryza sativa)
  misc_feature (71): n=a or g
taggcatccacagtcgcaccggttgatgaactggagtcaattatcccagtcattgtgagttcagatgcacngtaactgattggtctcagtaagttgaattg

SEQ ID NO: 19080 - DNA, 101 bp, rice(Oryza sativa)
  misc_feature (71): n=t or c
tggcaaagatcaacaaccgcaccaagacttcattcactcctacgatcacaacttaaaagttacacttattntgaagttcgaaagatgactaaatcttttac

SEQ ID NO: 19081 - DNA, 101 bp, rice(Oryza sativa)
  misc_feature (71): n=a or g
agatagccttttaaatttaaggtttcctttagaatgtaggattttataaatgaaaaaaaacttaggattcnagtgtcatatcatctcaaatcctatggatg

SEQ ID NO: 19082 - DNA, 101 bp, rice(Oryza sativa)
  misc_feature (71): n=t or c
attgccacagaggtggttgataatgtagttgttctcgcagtaagatggttttttttcaactttgttttatntcatgctcaaccatgatggattctataaaa

SEQ ID NO: 19083 - DNA, 101 bp, rice(Oryza sativa)
  misc_feature (71): n=t or c
caactccgccaccgtcgctcaggtccccaagatcggatagcatatatagcctatagctggctgtgctacanatacgtacgtcgacgagattatttataatt

SEQ ID NO: 19084 - DNA, 101 bp, rice(Oryza sativa)
  misc_feature (71): n=t or c
gtcttatattgttaattaagtctattttatatttctctactatttttttttcgatcgtgccgtgtcaggcnggcccaccatgccgaggggagcggcccaag

SEQ ID NO: 19085 - DNA, 101 bp, rice(Oryza sativa)
  misc_feature (71): n=t or c
ttgacaagcagagacgtcgcttcctttgggctggtacgggtgatatcaccgggggaaagtgtaaggtcaantgggcaaagacatgcttgccgaccagccag

SEQ ID NO: 19086 - DNA, 101 bp, rice(Oryza sativa)
  misc_feature (71): n=t or c
gcaatggtgacattgtcatcttttgggtaggacaccccgaacgccgcaccaaaaacgtatggcgagtcatngtcccacgaacggtaaccgcccgtgtcctt

SEQ ID NO: 19087 - DNA, 101 bp, rice(Oryza sativa)
  misc_feature (71): n=t or c
tgtactcaaaatcacttcttttcatctctctctctccaactgatgtctctgtaagattgttactgtatatngaaaaaaaaaagaaaacactgtactccctc

SEQ ID NO: 19088 - DNA, 101 bp, rice(Oryza sativa)
  misc_feature (71): n=a or g
tctctgcatttcctttggatattataaaataatatcgcgggcctctagtagctaatttccaattttttcgntgtgccacaacagatacgtgttcttacggt

SEQ ID NO: 19089 - DNA, 101 bp, rice(Oryza sativa)
  misc_feature (71): n=t or c
tttatttttcctagagaaaatcatttctctccgtattaacgaaggacagtgtagtcttctaatctcttgtntaatatctttaactagctaaaattgcactt

SEQ ID NO: 19090 - DNA, 101 bp, rice(Oryza sativa)
  misc_feature (71): n=t or g
atagctacaccctttttttttctaaagaaaagtgacgacctgactttgagttccagatggaattggaccgnatgacctcaagctgggcacggtgctcgaca

SEQ ID NO: 19091 - DNA, 101 bp, rice(Oryza sativa)
  misc_feature (71): n=a or g
gtcggcatatcttagaagtttactactactccttaaagtcttaaaattttgatgaaataattatgcaactntcgaatatttatgactgaagtatttatatt

SEQ ID NO: 19092 - DNA, 101 bp, rice(Oryza sativa)
  misc_feature (71): n=t or c
ggttttgtagtagtgagtccttccaatgaataactaaacttcgtgctaattgatacaaaaacacagtgaantgttataacaccaatagcccatgagttatt

SEQ ID NO: 19093 - DNA, 101 bp, rice(Oryza sativa)
  misc_feature (71): n=t or c
tattaaggatgatggtagtatatgcggtaaaaacgtaaagataattcacacaccacgaacgaaaccttctncaccttctgtccacgagttggacatgcacc

SEQ ID NO: 19094 - DNA, 101 bp, rice(Oryza sativa)
  misc_feature (71): n=a or g
catgacggccattgccaactcacggactcaaaaactttctcggctaaaggcactagagactgtgcgagtcnatctatttcgatgaaggataggtacgaccg

SEQ ID NO: 19095 - DNA, 101 bp, rice(Oryza sativa)
  misc_feature (71): n=t or c
agatagagctctctgtgttattacctgtagcagatgcagacggagatgaggaggatgacgccgacagcganaaggtcaacctcgttgaagcccttggggag

SEQ ID NO: 19096 - DNA, 101 bp, rice(Oryza sativa)
  misc_feature (71): n=t or c
aagggagtccggacatggaacaacattgcctcggcaacctgagttttccttgtcaactgaccaccgccacnagcctgtcaagaagctccccgcagagaggg

SEQ ID NO: 19097 - DNA, 101 bp, rice(Oryza sativa)
  misc_feature (71): n=a or g
ccacacattgcacaaccaaaatatttacttacctctatgagccgacgccgtgcaccacaacccctgcctcngcctcgcgcctacgatgcggccggagcctg

SEQ ID NO: 19098 - DNA, 101 bp, rice(Oryza sativa)
  misc_feature (71): n=t or c
tgaattttgaagacggaggcaaggttttatgtcagtacatgaatatctaaacaaatttacacaacttgctngatatgctgcctcggacattcaagatgaga

SEQ ID NO: 19099 - DNA, 101 bp, rice(Oryza sativa)
  misc_feature (71): n=a or g
cgcacggcctcccagtccgggaggtgagggaagaacgtggtgaggaaggtgaccgcgccgtcgagagatcnccccgtcctgtcgttcccatcttccgcttc

SEQ ID NO: 19100 - DNA, 101 bp, rice(Oryza sativa)
  misc_feature (71): n=t or c
agacggcgcataccgtgaccggaagaacgccatggttagcctgtatgggctgctccaaagcacgaccaacnagggcagggccatcgccgcgggcaccgtgt

SEQ ID NO: 19101 - DNA, 101 bp, rice(Oryza sativa)
  misc_feature (71): n=t or g
ctgcatcgcctgctgcaccaacgagggatacaccggcggctactgcaaaccatttacatatagatgcatgngcactaaagattgtggaggggacagtccac

SEQ ID NO: 19102 - DNA, 101 bp, rice(Oryza sativa)
  misc_feature (71): n=t or c
acccaagtcacaaggctgcagggggtaggctaggctgctagatttcttttccagaaaaatgcttcctgatnttattttcccattgaagtccctgagttgct

SEQ ID NO: 19103 - DNA, 101 bp, rice(Oryza sativa)
  misc_feature (71): n=t or c
tcggggcatcagtctccgggatccgtttcacatgcgtcgttgcatcacgcgtccggctctctgcctgccangccgacccctgcgccctcggctccctccct

SEQ ID NO: 19104 - DNA, 101 bp, rice(Oryza sativa)
  misc_feature (71): n=t or c
cttcactgattgtgataggacttgggcaagcctcccttcgcacaagcaattgaccgagcttgagctcacgnagggcttgctggctgccgccgccactggat

SEQ ID NO: 19105 - DNA, 101 bp, rice(Oryza sativa)
  misc_feature (71): n=a or g
agcagctaccatgacttctcggttacacaacatgatgtattgagggatctagcgcttcacatgagtggtcntgatgctctgaacaaccggagacggctggt

SEQ ID NO: 19106 - DNA, 101 bp, rice(Oryza sativa)
  misc_feature (71): n=a or g
tgttggcatggacacccacagcccacaggggcaaacggagaggacggagcaaacaacgtccccatcgtttngcttatttcctaataagccaaaacggctta

SEQ ID NO: 19107 - DNA, 101 bp, rice(Oryza sativa)
  misc_feature (71): n=a or g
agaagaaattcgagctgccaggaattttctgataaacaagtatgcagggcataagccaagtgttgatgcanttgagtctgcccatgacagaatcatcatgc

SEQ ID NO: 19108 - DNA, 101 bp, rice(Oryza sativa)
  misc_feature (71): n=a or g
gcatctcgatctcgatctcgatcaatctggacccaatgtccatctcatgctcgtgcacattttacaagctnctcctatgaccaatacagaatgacacacaa

SEQ ID NO: 19109 - DNA, 101 bp, rice(Oryza sativa)
  misc_feature (71): n=t or c
aggacaggtactagatcagtggcagatggaaagacaagagctgtccttgcttgctgcaagctccgagttgntgaagtcatagcatgatcttcattgccatt

SEQ ID NO: 19110 - DNA, 101 bp, rice(Oryza sativa)
  misc_feature (71): n=a or g
agtaagattagaagatgttgaacataatgcgctgtcaaattcaaaagaactagtacttaccctggtctgcncaagagccgtatgaatgacatagtttgcgt

SEQ ID NO: 19111 - DNA, 101 bp, rice(Oryza sativa)
  misc_feature (71): n=a or g
taaagacaaacagtagaattcttagtagagttctgttcatgattgttccatgcttacttgaggtggaaacnagtggattttgggttcgccgctgagaagcc

SEQ ID NO: 19112 - DNA, 101 bp, rice(Oryza sativa)
  misc_feature (71): n=t or c
acctcattgttatccctgttccaccgagtccatcgtcgtcccccaatccgtgttggcgctcatcgccgacncatccgcgcacagcaccagcttccttgcca

SEQ ID NO: 19113 - DNA, 101 bp, rice(Oryza sativa)
  misc_feature (71): n=a or g
ttggcaggcggaggatccggtgcaaacggttataatactgggtgcacggtcgcgaattgaagcagcaacantcaaagacggaatccaagccaccctattga

SEQ ID NO: 19114 - DNA, 101 bp, rice(Oryza sativa)
  misc_feature (71): n=t or g
gaggaccggcgcggcctttgtccgcaacgttgcattccctccaccagcgccaaaactttcctttttctaangaggcgaagccgtgccgtgccgtgtagttc

SEQ ID NO: 19115 - DNA, 101 bp, rice(Oryza sativa)
  misc_feature (71): n=a or c
gctcagggagggtagttagctaggcccgagtaactgatgtctacataatcggcaagtaattttccataacngactgatctcctcttgcggctctcacagag

SEQ ID NO: 19116 - DNA, 101 bp, rice(Oryza sativa)
  misc_feature (71): n=t or c
ggtttgtgatgcaagggactcccctttttgtgttcgtattaagtgcagcattatgttgagtacatatacanacacacacacacacacacacacacacacac

SEQ ID NO: 19117 - DNA, 101 bp, rice(Oryza sativa)
  misc_feature (71): n=a or g
gtagaagagggctcccttgtcctgttcatctggtgcagtcacactctgtgtaagcgatggttctttctctngactggcttcaggttcttccgcattagtaa

SEQ ID NO: 19118 - DNA, 101 bp, rice(Oryza sativa)
  misc_feature (71): n=a or c
agacaacagatcactacatcagctttcccaattgtcaccacttaagatcacccaatcgccctcacaactgnaatcaagaatgccaatgaaacttataccat

SEQ ID NO: 19119 - DNA, 101 bp, rice(Oryza sativa)
  misc_feature (71): n=t or c
acgtcggcgtcaagctgacgttctgatatgattgctctcatgtagtactaaatccgtcatattttaagtgnaaccacgagttttcgtacctaacttttaat

SEQ ID NO: 19120 - DNA, 101 bp, rice(Oryza sativa)
  misc_feature (71): n=t or c
gagactggatgcaagcgagcatccaggcaggcaaacggacttttttttcccgcttattctacttttatttnttttataaattttataataccatataaaaa

SEQ ID NO: 19121 - DNA, 101 bp, rice(Oryza sativa)
  misc_feature (71): n=t or c
ctcctcttcgtggccctcgtcacaacaaccatccgtcggtcgcctctctgccagtcgtagaaaaatctgcngccgtcggtcgcctctttgcgacccataat

SEQ ID NO: 19122 - DNA, 101 bp, rice(Oryza sativa)
  misc_feature (71): n=t or g
tcattctggaacagaggctattaaaacataagggaagcacaagtgagcactacataccatgatggtggcanacacttcaagtttagctaaagagagtgcaa

SEQ ID NO: 19123 - DNA, 101 bp, rice(Oryza sativa)
  misc_feature (71): n=a or g
ttctacatcaccgcggcatgtcaagaagaggcgccatctttcagctatcagctctcagactttccttatgnatcgagaaacaagatgtaatgcaattccgg

SEQ ID NO: 19124 - DNA, 101 bp, rice(Oryza sativa)
  misc_feature (71): n=a or g
gacgccgaccttgcctttgtgctcctcgccgccaatgccgatacccgcatccacgcctccatcatcttctngttttcttccctgccaccgccctgcaagtc

SEQ ID NO: 19125 - DNA, 101 bp, rice(Oryza sativa)
  misc_feature (71): n=t or c
acatgttcgtgcaattttgtgtgaaatgattgtctgtttgtctctgaacatagcaacaaaaagaggctcgngcaagcgcattgatttgcttggagcctgcc

SEQ ID NO: 19126 - DNA, 101 bp, rice(Oryza sativa)
  misc_feature (71): n=a or c
gcttttgtagtgtcttcttcatccttcatcacgctatccgacaatgtagcttcttccaaaagaacacagcncgcgagattgtcagcgcttctgcagatgct

SEQ ID NO: 19127 - DNA, 101 bp, rice(Oryza sativa)
  misc_feature (71): n=t or c
ctggcattatgcaggcgatgtccaatagcataccatcgcaagtgcttgcccaggtgtgatatgtatttggnactatttgctagtgatagtgcccttctaaa

SEQ ID NO: 19128 - DNA, 101 bp, rice(Oryza sativa)
  misc_feature (71): n=t or c
gccagaataagaaacaattgagtgtatttgaccagaagtaggccgcagcagatagcatcggctcattcttnttgacgtgtaataccccagaaatatccaca

SEQ ID NO: 19129 - DNA, 101 bp, rice(Oryza sativa)
  misc_feature (71): n=t or c
gcacgaagatccatgttcataattctctcttctctttcatgggtttctaaatctaactttcatttttctantttcaacctctctttctctagtgaaataac

SEQ ID NO: 19130 - DNA, 101 bp, rice(Oryza sativa)
  misc_feature (71): n=t or c
aaggcaggtaggaggcccctcaagggcataatcatacccaagatcattatatcaaccagttcataccccangcgttgcagtgggcacactataaaattttc

SEQ ID NO: 19131 - DNA, 101 bp, rice(Oryza sativa)
  misc_feature (71): n=a or c
tgttaaggttacgattgctgatggggggcttttacagtgtgaaaaacaacttcctgattgtgcttggtggntgcaaggaagatgttacaagtctaatttta

SEQ ID NO: 19132 - DNA, 101 bp, rice(Oryza sativa)
  misc_feature (71): n=t or g
tgagccgtcttctcttgtttcttagccggtgtactagattttaccagcgtcttcttctcaagggacctggntaccggcattcccttctccaggaaattctg

SEQ ID NO: 19133 - DNA, 101 bp, rice(Oryza sativa)
  misc_feature (71): n=t or c
aaagggaaagggaaagcgaaaggaaagggcgaagcaaggagcatggtggtgattgattgggctgccattgnggtgacgaaagccgaagagggccggctaac

SEQ ID NO: 19134 - DNA, 101 bp, rice(Oryza sativa)
  misc_feature (71): n=a or g
attgtcgttgctgtcgccgtcaccgcagcttgtcgttgttgtctccgatccatagctcattgtcgtcatcnccgtcgccgtcgcccctccacgtggtctcc

SEQ ID NO: 19135 - DNA, 101 bp, rice(Oryza sativa)
  misc_feature (71): n=t or c
atgggacttacggcaatcccttgatggaagggggatgcatcaagataaagaattcctctcaaggtgacaancactccctaattaccttgtactcatgccat

SEQ ID NO: 19136 - DNA, 101 bp, rice(Oryza sativa)
  misc_feature (71): n=t or c
acatcctgttaacaaatatgggatccacatttgcatccaaccacgactcatctttaatactacctctgttncaaaacaagttcatttttcacccatctcac

SEQ ID NO: 19137 - DNA, 101 bp, rice(Oryza sativa)
  misc_feature (71): n=a or g
gggatctgtgaagaggataagtacgaggaaggggaagaggaagggatctgtgagtggtgcgattgtggagnagaggataagtgagagggataatatactac

SEQ ID NO: 19138 - DNA, 101 bp, rice(Oryza sativa)
  misc_feature (71): n=t or g
tggatggttttgttgttttaggatcccataacattggggtagctatggctacagaacatggattagtggtnccaaacatcaagaatgttcaatcgctttca

SEQ ID NO: 19139 - DNA, 101 bp, rice(Oryza sativa)
  misc_feature (71): n=t or c
caaaaacctagcctactaaccatgcttccttcatctgttactcgtgtgctggatttttcattaccagcaangcgagttgaagatatctaaacacggattat

SEQ ID NO: 19140 - DNA, 101 bp, rice(Oryza sativa)
  misc_feature (71): n=t or c
gggcggcgtccatgaaaatatctatcctgttctagtgcgatggcattcattttctggaggatgctatgtcngtcactaaatagtagttgtatttcttctag

SEQ ID NO: 19141 - DNA, 101 bp, rice(Oryza sativa)
  misc_feature (71): n=a or g
aactgaacaaattgatattgtatggcaggcaaacaccaagatataccaaaatgtcttctcgtgtgttcccnatgatcacatccattctaggtatggaacaa

SEQ ID NO: 19142 - DNA, 101 bp, rice(Oryza sativa)
  misc_feature (71): n=t or g
cagggaacaaaattactcatgttagtggactctggcagtactcactccttcctggacacccaagttggatnacagttatcaggagtaactcagttgtctaa

SEQ ID NO: 19143 - DNA, 101 bp, rice(Oryza sativa)
  misc_feature (71): n=t or g
tggggagtgcgtgcacgtgagtggtcaattccatcgcggtagtacactgatgcactgccatgctcctctcncctgaagatggcaggcggggcagcgagccg

SEQ ID NO: 19144 - DNA, 101 bp, rice(Oryza sativa)
  misc_feature (71): n=a or g
agagatcttcatcttcttattattaccataaactcgtcgagctccgggtctgacgactgcccttgaaggtncctgtcttctgcacgcgagtcgagctcgcc

SEQ ID NO: 19145 - DNA, 101 bp, rice(Oryza sativa)
  misc_feature (71): n=a or g
aacttgttgaatgcaaggagtagatcaggatacccatcaaaaaggatcttcacacgttcaataacagtatnagtgttaatcctgcataaccaaagtttcaa

SEQ ID NO: 19146 - DNA, 101 bp, rice(Oryza sativa)
  misc_feature (71): n=a or c
aaaaaaaaattcctatctggaacaactttcaacttttacaatgttacagccatacatgagcatcggcaccngcatcgacacccgcaaccatgcacatgaag

SEQ ID NO: 19147 - DNA, 101 bp, rice(Oryza sativa)
  misc_feature (71): n=t or c
caccaccactttggcttcgggaatagtggggaaggaggaagagtgggtcatctagcgggcctcatcggccntggcgtagggcgaggcacatggaagaggca

SEQ ID NO: 19148 - DNA, 101 bp, rice(Oryza sativa)
  misc_feature (71): n=a or c
atccatcagctctggttcacaaaaagaaagccaagaagcataaacccaagctagccgacgacttgcctgcnttagatccatccatcgagcaagctctggat

SEQ ID NO: 19149 - DNA, 101 bp, rice(Oryza sativa)
  misc_feature (71): n=a or c
agcgaaagacttgaagaaggaagcattatgaaggggagtactcttcttctactgaatgcgtagagagctcnggattctttagcaactaggagagcgacaga

SEQ ID NO: 19150 - DNA, 101 bp, rice(Oryza sativa)
  misc_feature (71): n=t or g
taaataggttgagcgccgttgaaagacgccgacaaatcaagtctcacacgagggggaggaggcaatgctangtaatgcttcatcgtgaaaggaaaaagaac

SEQ ID NO: 19151 - DNA, 101 bp, rice(Oryza sativa)
  misc_feature (71): n=t or c
caaggacttttgaaataaaatatcgttttcggacaaaaatcacggttcgtgcccgactccttttaataggncaatttctacttggcccacctccttatact

SEQ ID NO: 19152 - DNA, 101 bp, rice(Oryza sativa)
  misc_feature (71): n=a or g
gctagttttgacggcttcatcatcactgtacattgaccggcctgcaagttgtaccccgtagagtccatctngacctcccaaaggtcttgaatcttcacgga

SEQ ID NO: 19153 - DNA, 101 bp, rice(Oryza sativa)
  misc_feature (71): n=a or g
ttcattgctccatatctgcatatcagcatctttctttcttcaacgtgttcacgtcaaaattgaaagtttgnttgaaattgaaacgatgtgacggaaaagtt

SEQ ID NO: 19154 - DNA, 101 bp, rice(Oryza sativa)
  misc_feature (71): n=a or c
ttttcctgttgcgcttgtatgtgcaggctataaggactggttgggtccacccaaatatcaatttagacaanccggagaaaaatgtggtaatttcattcatc

SEQ ID NO: 19155 - DNA, 101 bp, rice(Oryza sativa)
  misc_feature (71): n=a or g
ttcgtgtgtacaattaccatccttgttcaatgttgatctcgggagtttttttgtcgattgtagagatgctnatgacgaggatgtccagcagcgggggcagc

SEQ ID NO: 19156 - DNA, 101 bp, rice(Oryza sativa)
  misc_feature (71): n=t or c
ttcgccctgcaaatgttgtgataagattttgcttcattttcatagataaagactagtttgctactacctcnatttcaggttataagactttctagcattgc

SEQ ID NO: 19157 - DNA, 101 bp, rice(Oryza sativa)
  misc_feature (71): n=t or c
ttcccagtagaacgaagccttaccatacatggacaggtcggatctatcggtcgttcatcagttgccattgngttttgtttcaacttcagaacaccctagga

SEQ ID NO: 19158 - DNA, 101 bp, rice(Oryza sativa)
  misc_feature (71): n=t or c
ggttttatggaaccaaagaagcaggtaacattggccttgagaatgctggacattttctacaagagaagttnggggaagattttttccctatcctttatatt

SEQ ID NO: 19159 - DNA, 101 bp, rice(Oryza sativa)
  misc_feature (71): n=a or g
gtttttttcaccactttattacagtgtcggacctttctggatataataggattctttttcttaccgcgtcncatataattcatttttctttgtaatcagac

SEQ ID NO: 19160 - DNA, 101 bp, rice(Oryza sativa)
  misc_feature (71): n=t or c
tatcccgcctatgacgtgttcaaaagtaatacatatcacgttcacctcgtggaggattgatcttcacggtnatatcatattcccaacgttctccccgttga

SEQ ID NO: 19161 - DNA, 101 bp, rice(Oryza sativa)
  misc_feature (71): n=t or c
ggcggaggaggagcagcagctttgcagcgccatcccgccgcgagaagcccgcagcctctctctctctctcnctctctctctctctctctctctccctctct

SEQ ID NO: 19162 - DNA, 101 bp, rice(Oryza sativa)
  misc_feature (71): n=t or g
acatgcacagaaattacagtctctggttgttgaaggctgctctaatatatctgaacatgctgtgcagggcncagctagatcagtccagtactttcccaact

SEQ ID NO: 19163 - DNA, 101 bp, rice(Oryza sativa)
  misc_feature (71): n=a or g
aacaattttccgggctttctttcttttgaagtgtacagaagcagacgatgcgtcgctggtgctatccaccnctttcgtgatccccaccggcatggaagaaa

SEQ ID NO: 19164 - DNA, 101 bp, rice(Oryza sativa)
  misc_feature (71): n=a or g
attaatctccaagaaacgaggaatggagaagatttattacacacctattgttgtaaatcctctcaactccnttgtgagagagattaaacaaacaaagcaaa

SEQ ID NO: 19165 - DNA, 101 bp, rice(Oryza sativa)
  misc_feature (71): n=a or c
caggatgaagaaaaatctagcaaaatcaaccacctgatgggaacatgtacgaagcaaaatgaaaacttagntgttgttagagataaagaaaactatttacg

SEQ ID NO: 19166 - DNA, 101 bp, rice(Oryza sativa)
  misc_feature (71): n=a or g
ccagttcgtacatataatttcgtcactttgttttgtagagttctgacttggaaggacggcttctacaacgncgagataaagacgaggaagatcacgaactc

SEQ ID NO: 19167 - DNA, 101 bp, rice(Oryza sativa)
  misc_feature (71): n=a or g
gttgctaaggcccaaaaatttcaatgatttgaggtggataaacgaggctggcatgttaccagaaaagtttntcctctgaagatttagtgattccaaatatt

SEQ ID NO: 19168 - DNA, 101 bp, rice(Oryza sativa)
  misc_feature (71): n=a or g
caatcaggcatgttgccattgattccagaacagtgtaaacacacactctctctcgatctgctcgtcgtgtncttgcgtgcatctggcccgtgatgcatgca

SEQ ID NO: 19169 - DNA, 101 bp, rice(Oryza sativa)
  misc_feature (71): n=t or c
aaagttatcaaatatgtgcatacatttttttccaaacttgcctaaacacatataaggaatcctgttaaaantcaataatattgtcaacttaacaaaatttt

SEQ ID NO: 19170 - DNA, 101 bp, rice(Oryza sativa)
  misc_feature (71): n=t or g
gtaccttataccccatgattttgcatgaatcaccgagttattagaagttccatctgtagcattcctccagntgttcgtgcccagatcaaggtccaagtagt

SEQ ID NO: 19171 - DNA, 101 bp, rice(Oryza sativa)
  misc_feature (71): n=a or c
tgggaccgcgccgaccctatggtccactgtgttattcccccaattttttccaactcatctccttctttttncgcgcacgcttttcaaagtgctaaacggtg

SEQ ID NO: 19172 - DNA, 101 bp, rice(Oryza sativa)
  misc_feature (71): n=a or c
gctaaatttaataaaataaatagaatataggctctagctactgtaaacaagagcacaaagagcctccaatnattttctactgaagcagttcttatgcaatc

SEQ ID NO: 19173 - DNA, 101 bp, rice(Oryza sativa)
  misc_feature (71): n=t or c
tctgaaagtgaactcgacaagccatatgattcatggcatgatctagtgccatttccagttggatggcaccnaccaaagttccgtcagtttgatggaaccgg

SEQ ID NO: 19174 - DNA, 101 bp, rice(Oryza sativa)
  misc_feature (71): n=t or c
cattgggaggtcgaaggaggcatattgacatcagggatagtcttgggctgccaaggcatcgcccctaggtnctggctcatcttggccagatctagcgaggt

SEQ ID NO: 19175 - DNA, 101 bp, rice(Oryza sativa)
  misc_feature (71): n=a or g
tcctgtcccttgcacgctacgagctcgatctagcaaccactccctcgtagtaattgtttcggtggagccantctgccaatggcagcgaaaggcatctcgac

SEQ ID NO: 19176 - DNA, 101 bp, rice(Oryza sativa)
  misc_feature (71): n=a or c
acatttgcaggggactttgcactttgaagactctccttttgttgctcgtttgcctttgcggcagatgtaancacattgtaattgctcaatgaaacaacagg

SEQ ID NO: 19177 - DNA, 101 bp, rice(Oryza sativa)
  misc_feature (71): n=a or g
tcttgaatcaacaccgaaccaatcgacttgtcaccagctgataagtataacttgaaaggtacccccttttntggaggaattaaaactggtggggaactaag

SEQ ID NO: 19178 - DNA, 101 bp, rice(Oryza sativa)
  misc_feature (71): n=a or g
ctaccatttcaacatgagagagacttaccttcaaatgctccattgattcttttgtatcctccgatgagttnctagggcccatggtatttttgcccatagct

SEQ ID NO: 19179 - DNA, 101 bp, rice(Oryza sativa)
  misc_feature (71): n=a or g
aattgaaataaggtaggagtcacatcttactctcgatgggcttagcacattttttatttttctgtttttantttcaatattgatttggttactttgtatat

SEQ ID NO: 19180 - DNA, 101 bp, rice(Oryza sativa)
  misc_feature (71): n=t or c
ccgtaacacaccaattaacaaatacttcgtatgaccgaatcacgtacattcgtctgtctctcctgcttttngcaagaatccgggtgatgagctccatccag

SEQ ID NO: 19181 - DNA, 101 bp, rice(Oryza sativa)
  misc_feature (71): n=t or g
tcttggcaaggtcgtaccagacgtccttggagccgtcgcgtgtgcagtactgcaacatgttgtgctgccanatggtgccggaccaccttctgctgtcctcc

SEQ ID NO: 19182 - DNA, 101 bp, rice(Oryza sativa)
  misc_feature (71): n=a or g
taatacagaacggctgagaaatccctatggttactcttatacaaaccatgccatctgacccctcaacaatngttcaggcatgagatacagaaacagaaact

SEQ ID NO: 19183 - DNA, 101 bp, rice(Oryza sativa)
  misc_feature (71): n=a or g
tcaccaaaaaaatgtttttttaaaagcttactttcatggttgggcatttttaattgtttcgctttttgtcnatctaattcttaaaaatatcaagcgaataa

SEQ ID NO: 19184 - DNA, 101 bp, rice(Oryza sativa)
  misc_feature (71): n=a or g
aaactctggacgattccatccacctagcctcatagaaatacctaaacaaatctagaaaaggttgtaccccnaggtacatctcacatagatgagtgaagatg

SEQ ID NO: 19185 - DNA, 101 bp, rice(Oryza sativa)
  misc_feature (71): n=t or c
atatttgtgtacacatgcatgatgacggtcggttcgaaaccagttcttccctcaattggtgtgtacgagtngtcgataggtgatggtgtgttcttctttct

SEQ ID NO: 19186 - DNA, 101 bp, rice(Oryza sativa)
  misc_feature (71): n=a or g
taattacctataaatatatactacactatttatatctagtctctccagtcatatacataaatttatcttgnagttcgtactgcagctggctacaaatctgt

SEQ ID NO: 19187 - DNA, 101 bp, rice(Oryza sativa)
  misc_feature (71): n=t or g
aggtatagctgatgctattgatagaggtataaccaacggtgattctgtaggcaagcgagctatccttcctnctagctttacgggaggtagaaggtatatgg

SEQ ID NO: 19188 - DNA, 101 bp, rice(Oryza sativa)
  misc_feature (71): n=a or g
tttggcctcgtgtaccaggtcaaatgctaataaaaccaagttaacatgcgcattcctcatcacagattcgnatacagtaaaaggtgatgttgacgtagagg

SEQ ID NO: 19189 - DNA, 101 bp, rice(Oryza sativa)
  misc_feature (71): n=t or c
cgtcgactgcctcggcgcagaatatgtcgaggacaagcgccgcgacggaggggatcgatcggaggagcgangcgagggagggcaccgaccggcggagcacg

SEQ ID NO: 19190 - DNA, 101 bp, rice(Oryza sativa)
  misc_feature (71): n=a or g
atcgatttctcgatctctccacgaacaaagacgaggagaggtcccctcctgcatggaacaaaccaaaaaanagagagagagagagagagaaagaaacagat

SEQ ID NO: 19191 - DNA, 101 bp, rice(Oryza sativa)
  misc_feature (71): n=a or c
aatcgccatgataagaggctactcaaattttcaatcttctttgctaccattccatacgcgaactgttcacntttcctattagccacatcatcagccatctt

SEQ ID NO: 19192 - DNA, 101 bp, rice(Oryza sativa)
  misc_feature (71): n=a or g
taccaagcgcagtgctatgggacacctaacacaaatttcaactccttgatatggaaagtgtgggcacccgngaaatgtaaattccatgcttagctcattat

SEQ ID NO: 19193 - DNA, 101 bp, rice(Oryza sativa)
  misc_feature (71): n=a or g
gtcatggtgcgagataaatgaggtgtacaatcttacctggtgaaattctcccatctgatgtggaacttcanccgacaataagctcatggtgctttcaaaaa

SEQ ID NO: 19194 - DNA, 101 bp, rice(Oryza sativa)
  misc_feature (71): n=t or c
gatttcatgcgtcatcggaaccatcctttataagagcatgatcaccatgtgcacgagtacatagctaaccnggatgatcttgcggagtacggttatttttc

SEQ ID NO: 19195 - DNA, 101 bp, rice(Oryza sativa)
  misc_feature (71): n=t or g
ttagaagatttcaagctgttcaggactttctcagcttcgtctgggtgcccagaagtcccataagaagtcangaggatatgcatagtagcgatggttggttc

SEQ ID NO: 19196 - DNA, 101 bp, rice(Oryza sativa)
  misc_feature (71): n=a or g
aagaataggttgagaagggtaacatttgagctttccatactcactgttaagctgtgtccacagaatgtcanatgcgtagatagctgctcatagaaaatgtt

SEQ ID NO: 19197 - DNA, 101 bp, rice(Oryza sativa)
  misc_feature (71): n=t or c
aggagaaggactaccacagcaacagctaaatgggtggcaagcaaggcagttcctcttctgagaaagaatcnaggtatgggccctaaagccatgcagaccca

SEQ ID NO: 19198 - DNA, 101 bp, rice(Oryza sativa)
  misc_feature (71): n=a or c
taattggtaataactgcagtctaaactctacatccatctctttgtagctctgttccttgagtcttgctggntttgccgtctagtccttttaaagtctccat

SEQ ID NO: 19199 - DNA, 101 bp, rice(Oryza sativa)
  misc_feature (71): n=a or g
cccccggctatcctgaacattttcccccttttgtactgaccatttacttggaattggaattgacggaagcntaaatgtgatctggtgaggcttttttaacg

SEQ ID NO: 19200 - DNA, 101 bp, rice(Oryza sativa)
  misc_feature (71): n=t or c
catttgggtcccctcccggctatgatggatctgagagccagtcaccgttggatcccctcctgtggcgtctngtccagtcgccatcggatctcctcccgccg

SEQ ID NO: 19201 - DNA, 101 bp, rice(Oryza sativa)
  misc_feature (71): n=a or g
cttggtgacttgaattacagactacagggaataagctcaataccagcaaggaagttgattgaagagaatcntcaaagtgtaagtgtatgctgaaattacat

SEQ ID NO: 19202 - DNA, 101 bp, rice(Oryza sativa)
  misc_feature (71): n=t or c
gctcccactccccggtctgaagcatcagtttcaatctcaaaagtttgagtaaagtcaggaagtgcaagcancggtgccgaagtcaaagctgcctttaacgc

SEQ ID NO: 19203 - DNA, 101 bp, rice(Oryza sativa)
  misc_feature (71): n=t or c
catacagatctttgtgcttgtatgcaaacacatatgctacatgtagttagtgaaccgtggttcgaccagcnggttcacggttggaccgtcaaaccggtgaa

SEQ ID NO: 19204 - DNA, 101 bp, rice(Oryza sativa)
  misc_feature (71): n=a or c
gaatctgtgatggcagcaatggttaatgactccactaaccccccaataaagttgctcgggattgagattanccggagggaatcagaacaatcaagtagctt

SEQ ID NO: 19205 - DNA, 101 bp, rice(Oryza sativa)
  misc_feature (71): n=a or g
ttaggtctagaaaccaattaggactctaaaatctcaggccttagcaagaaaacctgagaacggacaaatcngactcggagtcgtactatgccggtctgacc

SEQ ID NO: 19206 - DNA, 101 bp, rice(Oryza sativa)
  misc_feature (71): n=t or g
ttactggtcaaatgatgcaatcaatgaaaaccatacaggggttaataatttttcatgcttgctagctgaangactagacactgcagcggctgggggttgtg

SEQ ID NO: 19207 - DNA, 101 bp, rice(Oryza sativa)
  misc_feature (71): n=t or c
tttctctctttcttcttcttcttcttcatcaacttattatctttcttaatactcttgtcttcctccgagcngcatttgctcatatcaccctgaacatgctc

SEQ ID NO: 19208 - DNA, 101 bp, rice(Oryza sativa)
  misc_feature (71): n=t or c
ccattatgactaacagtataattatcttggcacaaatcatccttgtgagtgctaagccttccccaaacaanattgtgtgtgaccatatatagctctccacc

SEQ ID NO: 19209 - DNA, 101 bp, rice(Oryza sativa)
  misc_feature (71): n=a or g
tggtcagctcagtcaatgatcgaaggcgacaaaaagggatcaaaggcttccctgcaagaatggatgtttcnccgtagtatttttgtgcgactgtaattaat

SEQ ID NO: 19210 - DNA, 101 bp, rice(Oryza sativa)
  misc_feature (71): n=a or g
cattgtattagttatttcagtggttatttagttatggccatcagcgcatgaaaaaacgagaaatccattanccattagcgcatcaaaattcagttttaatt

SEQ ID NO: 19211 - DNA, 101 bp, rice(Oryza sativa)
  misc_feature (71): n=t or c
ataaatacctgacttcccattagcagtatcaaatatcaacatgacaaatctgcatagagcttcctagtgtnatgttcctagtatggaaaatgtgaggacag

SEQ ID NO: 19212 - DNA, 101 bp, rice(Oryza sativa)
  misc_feature (71): n=a or c
tcacccacgttcttcggcacaataacgaagcagccaacagactcgctaacttcagttcaaaacgagaagcngctccttccgacgtgtttgttgaacatctt

SEQ ID NO: 19213 - DNA, 101 bp, rice(Oryza sativa)
  misc_feature (71): n=t or g
aaggatagccgatggaaatctgtaagtaagcaaagcaagaatagatgattaacagcttattgattattttnttagccgattaactactctaaagttagtaa

SEQ ID NO: 19214 - DNA, 101 bp, rice(Oryza sativa)
  misc_feature (71): n=a or g
tctgatacggcctggaatgcggtgttcagggggccaatccagaacttccaactcagttaacttgtcaagcngttggtgaaagcaggtttcattgtcctcag

SEQ ID NO: 19215 - DNA, 101 bp, rice(Oryza sativa)
  misc_feature (71): n=t or g
accttcttgctagtgttcgcttgggttgttggatcagaaggaccaaataaaacatagggtgcaaagtctcnattgatttagtagtaagtgctgtctctatg

SEQ ID NO: 19216 - DNA, 101 bp, rice(Oryza sativa)
  misc_feature (71): n=a or c
tacttgcttctgccatgttagtggcaagcactatcttccgaacattaggaggtggcttctcaaagattaanctctgcgaatatcataatacattcatagat

SEQ ID NO: 19217 - DNA, 101 bp, rice(Oryza sativa)
  misc_feature (71): n=a or g
gtgaagggtgcatcagagagacaaactgacaatatgctatctttgctttcggcagtacagaacaaaacacnacagaaactcattttcatgcatgtctcttg

SEQ ID NO: 19218 - DNA, 101 bp, rice(Oryza sativa)
  misc_feature (71): n=t or c
attattggagtatgcagcagctggatcagcagcagctatagccatccaggagaggagaaagcaatagtagnactagtagctttcattcagaaagaaaaaga

SEQ ID NO: 19219 - DNA, 101 bp, rice(Oryza sativa)
  misc_feature (71): n=a or g
caacgaggagatggatggatgtgtttgcattgcaacagtgcatgaacaagatcttttcccgtctagcagancaagaacgagagcagagcagagctgacggc

SEQ ID NO: 19220 - DNA, 101 bp, rice(Oryza sativa)
  misc_feature (71): n=a or g
agttcaagattgttttctaaaatttaatccatgtgttcttttgagcagcaattaactggtgctaagctcgntggtgcaaatctgcttggagctatcagata

SEQ ID NO: 19221 - DNA, 101 bp, rice(Oryza sativa)
  misc_feature (71): n=t or c
cgaggaggaggaggaggaggaggaggaggacggggagcgtacctccagttgatggactggagatggatggngtcggagctagcggcgaccttgagcgcgag

SEQ ID NO: 19222 - DNA, 101 bp, rice(Oryza sativa)
  misc_feature (71): n=a or c
aaattcgactcgaagtcggacttagacggtttgaccgtccatttgtcgccaatcagatcgatcagccacanaccggcgatcatactagccctatgtaggaa

SEQ ID NO: 19223 - DNA, 101 bp, rice(Oryza sativa)
  misc_feature (71): n=a or c
gggcttgttatccttgttttggatggcttcccttatcgtcgcccgagctttagcaagaccgagttctaatngctccaatttcacatcccttcgcctttgcg

SEQ ID NO: 19224 - DNA, 101 bp, rice(Oryza sativa)
  misc_feature (71): n=a or g
accgacggtagatcgacatccaattaagccaacggtaattaagtctaaccgtcgcctacgtattgaatgtnacatattctaatactatgaatttagacata

SEQ ID NO: 19225 - DNA, 101 bp, rice(Oryza sativa)
  misc_feature (71): n=t or c
tatcagctacaattcctatgtgcagtaggaacggtgttcaatcaaacaatttggaaatgttaggcgccccnaaagtgcaaatttttcatatagttggtcat

SEQ ID NO: 19226 - DNA, 101 bp, rice(Oryza sativa)
  misc_feature (71): n=t or c
taagctatcttacacattatttttacttattcttattataataaactacccacagtaacgcgcggggtttnacgtagcatttttaatatgcaaagcttttg

SEQ ID NO: 19227 - DNA, 101 bp, rice(Oryza sativa)
  misc_feature (71): n=t or c
tcagatctaggcctacggggagaaggcgctcttgaaccaaaaacagtagctagatcatctggtagccgcancatgattgatggataaactgtgctgtcttg

SEQ ID NO: 19228 - DNA, 101 bp, rice(Oryza sativa)
  misc_feature (71): n=a or g
gctgtagaaacaatcaaactaatgctagccacctacaccttggtgacagaactggatgataatctccaatnctccacaaattttcatgctccacaacataa

SEQ ID NO: 19229 - DNA, 101 bp, rice(Oryza sativa)
  misc_feature (71): n=a or g
tgtcacgttcctttgggtcttaggtaatttttgttttggcaaatttgcacgtgattaaatacccaataccnttaattctttagtgaattactacagtgcat

SEQ ID NO: 19230 - DNA, 101 bp, rice(Oryza sativa)
  misc_feature (71): n=a or g
gcagatcgaccaagcaatacacaatggccactcgggcaaacggcagctcatgctccctggccagcctcatngcggccatcttcttcctcctagtcgtctcc

SEQ ID NO: 19231 - DNA, 101 bp, rice(Oryza sativa)
  misc_feature (71): n=t or c
gaaaaaaaaatgttgtctaataaacatatgccttcttaattaacatttatttcttcatgaagctgaggggntaccttggcaatcctttcatttcctttgaa

SEQ ID NO: 19232 - DNA, 101 bp, rice(Oryza sativa)
  misc_feature (71): n=t or c
cctactgatcaacacaaaatcatcatcatcaagaacccttgcttctttctgacccacaaaattttcccgtncaatggattcgacaattcggacgaactcaa

SEQ ID NO: 19233 - DNA, 101 bp, rice(Oryza sativa)
  misc_feature (71): n=a or g
cccatagaagaaggagactatctttcaaacttgcttggtaaggaaaacagaggtagagtgattggaatagntatgggtcccactcctgcaagtcttggttt

SEQ ID NO: 19234 - DNA, 101 bp, rice(Oryza sativa)
  misc_feature (71): n=a or c
gtcactttgatgatagcgggtcaggcctcgttctttgtaggtaacggagctatcaaaaacacgagttaatnaaaaactttctacatcatcattattcccta

SEQ ID NO: 19235 - DNA, 101 bp, rice(Oryza sativa)
  misc_feature (71): n=a or g
gatcgatcagtgacatgctatacacagtgttaattgggtgaatgaagtgtattgatcacatgatatatggntgcagggagatcaggtcctccgaacgggcc

SEQ ID NO: 19236 - DNA, 101 bp, rice(Oryza sativa)
  misc_feature (71): n=a or c
gagttgacagatggtgtctgttttttacctttcagagataccgcaccatcgaaaccaaagacagagaaggncaccttgttttttacaacatcaggcgcttg

SEQ ID NO: 19237 - DNA, 101 bp, rice(Oryza sativa)
  misc_feature (71): n=a or g
gtgcacaaccactggccatcaggcacaacatgcaaaccataacacttctggtgcacagttaccttacagcngttgcaattgagcatgctattggacaccgt

SEQ ID NO: 19238 - DNA, 101 bp, rice(Oryza sativa)
  misc_feature (71): n=t or g
atccatgaccttgttgtgcttctgaaactgatggtgtttctgacgaaggccacgcactgtcacctgatttntggtgcgaaacttggagagacagagaagca

SEQ ID NO: 19239 - DNA, 101 bp, rice(Oryza sativa)
  misc_feature (71): n=a or g
gctgcagagggcgaggagctctcacgccattcgtcaggctcatgtcagccgcgacttcgtcaaaactactntatatataatacccatatggggcaccatgg

SEQ ID NO: 19240 - DNA, 101 bp, rice(Oryza sativa)
  misc_feature (71): n=a or g
tgcaggtgaacacaaacagatcactttgttatacttcagagcctacactccaggcattattgtgaactccnttgctcacatatggcttttggacactccgt

SEQ ID NO: 19241 - DNA, 101 bp, rice(Oryza sativa)
  misc_feature (71): n=t or c
acacagactcctttcagctatagttatggaagaggacatctcggaacccaatgttgtacaaagggatatantttttgaattttctaatagccatgttcctt

SEQ ID NO: 19242 - DNA, 101 bp, rice(Oryza sativa)
  misc_feature (71): n=t or c
ccttgttttcatgctgagaaatcgatggtgtgtcctttcaatgacttgcagttcttcaatctttcttttgngttgctcttgtaactcatttatgtggagtt

SEQ ID NO: 19243 - DNA, 101 bp, rice(Oryza sativa)
  misc_feature (71): n=t or c
taccatatatatataccactattggagactggtaattaggctctctggttggctacgaagcaggaaaagangaggaatggtgaagccagctggcgaggtgt

SEQ ID NO: 19244 - DNA, 101 bp, rice(Oryza sativa)
  misc_feature (71): n=a or g
gggaaaaaggaatcgtccttagtgccatctggcagcagattcatacagtttaattacacacgcatctgacnaaaaatgtttcgaaagggatattcatcttc

SEQ ID NO: 19245 - DNA, 101 bp, rice(Oryza sativa)
  misc_feature (71): n=a or g
tagctgtacctagtagtaggatcgatgatcaatggagtgcttattgctaagcctgctaatgggttgggttnaagtgggtaaaatggattggtttcaagttt

SEQ ID NO: 19246 - DNA, 101 bp, rice(Oryza sativa)
  misc_feature (71): n=a or g
aaggttaattagaatgtgattcgatctgtactgtagaatccatatattggtaacacctaatatacttgcgngcggaaggaacggaacttcagcgttttcga

SEQ ID NO: 19247 - DNA, 101 bp, rice(Oryza sativa)
  misc_feature (71): n=t or c
tttcgtgcaggatagtttgcagatgatatttccgcagttcccttaggattgtcagaatgacaaactgctantggtttgtcatgcagctctggcttatttct

SEQ ID NO: 19248 - DNA, 101 bp, rice(Oryza sativa)
  misc_feature (71): n=t or g
acttgagaacggatgtggtacaacgtttaattttgctgcattccgcacggaaaggcttttctaatcggtanctgctatcggtgcctttcagtctgattggt

SEQ ID NO: 19249 - DNA, 101 bp, rice(Oryza sativa)
  misc_feature (71): n=t or c
aatccaggagggtgtgtagttgtttcaagtagtgtgcgaagatgtggaaatttcactgttgatgcacaacnttttccattgttcaagaataatgacagacg

SEQ ID NO: 19250 - DNA, 101 bp, rice(Oryza sativa)
  misc_feature (71): n=a or c
aaggtaatttgtgtagctgcttgatcagcttacactctcttgaagtttctatatgaataccgcggcggcgngcggaggcgatggcgttgccggcgtccagc

SEQ ID NO: 19251 - DNA, 101 bp, rice(Oryza sativa)
  misc_feature (71): n=t or g
atgagtatgtctctggttgtcacgtttccaaaagaatacatgcccgtttgttttttttctttttttcttcnattaacgtagtaatttctaggccgtgaagc

SEQ ID NO: 19252 - DNA, 101 bp, rice(Oryza sativa)
  misc_feature (71): n=t or c
atgttgaaaccttaagcattttggagcaaacatccatggttgtcaaacttatattcaaattatgaatgtcntaaattactgagttcaaattttgcaaatct

SEQ ID NO: 19253 - DNA, 101 bp, rice(Oryza sativa)
  misc_feature (71): n=t or g
cagccttgaatcagcaacattatagtgatatctgtaaagaaagaagtgatgcattttgcagccacgtcaanatatatcatatttaatttttaaagaggata

SEQ ID NO: 19254 - DNA, 101 bp, rice(Oryza sativa)
  misc_feature (71): n=a or g
cttgatagaagctggtgattgaaattgcttattaatcgctatgtgctgatgtgttgcgaccagagtttgtnttttttatcaggacacattgtgtgactttc

SEQ ID NO: 19255 - DNA, 101 bp, rice(Oryza sativa)
  misc_feature (71): n=t or c
aatcaatttaggataaaatgtgttgttctagtatatgtcatgttctattctagattgattatttttggganagagacagtaagccgggagtagtagttttt

SEQ ID NO: 19256 - DNA, 101 bp, rice(Oryza sativa)
  misc_feature (71): n=t or c
tgtatttacattaattgtgtacaaagaatatatcttacctctcctcctactgcttcgagtcgaaatgaatnggagcatgaagccctagcctcaatcacagt

SEQ ID NO: 19257 - DNA, 101 bp, rice(Oryza sativa)
  misc_feature (71): n=t or c
ccaacatcttcaattctcttgtccccggggctgtgtgaatcaattaatccctctgctacccaaaggtcaancatctctttgattttatacttatgaccttt

SEQ ID NO: 19258 - DNA, 101 bp, rice(Oryza sativa)
  misc_feature (71): n=a or g
gaaagtataaatcgaatccttcctcccaagatcgcacgcaccttctgaaagacaagcatatcccacaaatncttctctaatccccatgcaccaaaccaact

SEQ ID NO: 19259 - DNA, 101 bp, rice(Oryza sativa)
  misc_feature (71): n=a or c
tacaccactcatctgggcagtttcgcatgtgcctttaacacttctagtttcctggctagtgatttgtgatnttacttttacagattttctgagtttatggg

SEQ ID NO: 19260 - DNA, 101 bp, rice(Oryza sativa)
  misc_feature (71): n=t or c
gcggtaaccctaccgcgccccggcgatttgggaaacctcggtattaggtaggcattgttatcttcactggnggagaaaccatctttggtcggtcgaccaga

SEQ ID NO: 19261 - DNA, 101 bp, rice(Oryza sativa)
  misc_feature (71): n=a or c
ctacctcttgcttctcttggctcttgtcctcggagccgccttgacctctcttattccttttgccccgcttnttcttctttttcttcttcttcttcatgctc

SEQ ID NO: 19262 - DNA, 101 bp, rice(Oryza sativa)
  misc_feature (71): n=t or c
ccactttctttgttttctcccattctttggtccatggcggcagcgaaggacctagcctatccgagcgacanaggcaagagtggcaacgccggctaccccat

SEQ ID NO: 19263 - DNA, 101 bp, rice(Oryza sativa)
  misc_feature (71): n=t or c
ccaaggctttcaagtgatttgtacctcctttgtaaagaatctcattggtttgtgggggagataaagctatngccaatgtgcgatcagtgcgtcaactgttg

SEQ ID NO: 19264 - DNA, 101 bp, rice(Oryza sativa)
  misc_feature (71): n=a or g
tttaagctctaagttgattaattctgttactcatgttggtagtgtatttcgagcctatgtactagttgcgntcgacttgatgacaacatagcatgttctca

SEQ ID NO: 19265 - DNA, 101 bp, rice(Oryza sativa)
  misc_feature (71): n=t or c
ttcttaaaaccattcaagcccattctaattccactgcaagccaagcgaagaggagtagttcatgttgaggnggaaagtggtgacgcccgcgccgaacaccc

SEQ ID NO: 19266 - DNA, 101 bp, rice(Oryza sativa)
  misc_feature (71): n=t or c
cacggagattgtggggtgatcctagtgaggtttgtggtttcttttgttgtaactttgctcagtagggcatngaattagatggtttctatatcatttttctt

SEQ ID NO: 19267 - DNA, 101 bp, rice(Oryza sativa)
  misc_feature (71): n=a or g
tatgagtgtattaggagcaatggctccacggttttgacttcctggatctcacattagactcgcagctatgnctgtgtttagttactgaaaaaagttgaaag

SEQ ID NO: 19268 - DNA, 101 bp, rice(Oryza sativa)
  misc_feature (71): n=a or g
tacgccttacggcttaccaactcgaagagatctttctgctgataacagagtgacagacacggccggggagncgcagcttgcttaggtggtgtttggatcag

SEQ ID NO: 19269 - DNA, 101 bp, rice(Oryza sativa)
  misc_feature (71): n=t or c
tcaagagtgacccttttgccgctgactttcttttgacctctcactactaccttcggatctagactctacanggtgctgcgttatgtgagagggcagtgttg

SEQ ID NO: 19270 - DNA, 101 bp, rice(Oryza sativa)
  misc_feature (71): n=t or c
agacttttgaaaacgacaccgaggatgtctgtactgattgcttcaccaaggagagtattgaaatcatcgtnggccgtcttctctttctccctggagtcata

SEQ ID NO: 19271 - DNA, 101 bp, rice(Oryza sativa)
  misc_feature (71): n=a or g
caatatatctactcctcctcatctaccccggcatcaaaacggagtaatgcatggagacggcaagcaaccancaaaaccaagcaacagcaacagcagttcca

SEQ ID NO: 19272 - DNA, 101 bp, rice(Oryza sativa)
  misc_feature (71): n=a or g
gccgagacaccttcggaaacaaaaccagaggaaagctctctcctacaacctagctgtagagctggataacnagccagctcggctcattaaagctcggctcg

SEQ ID NO: 19273 - DNA, 101 bp, rice(Oryza sativa)
  misc_feature (71): n=t or c
cattctctttgtacgcttttgtgtctttgcctcctctgtaattattatccttgtccatcagagcttccagntctcttaccttctcctctagttgagcattt

SEQ ID NO: 19274 - DNA, 101 bp, rice(Oryza sativa)
  misc_feature (71): n=t or c
atcaagttgcatcaacagataataggcatttgcgcattgaggaaatcccatgaccatgaattctgagccanatagtattgacttcgcaatcttcagagtaa

SEQ ID NO: 19275 - DNA, 101 bp, rice(Oryza sativa)
  misc_feature (71): n=t or c
caagtcccatccttctttttcaccagcaacacaggagaagcaaatgggcttgagctgggtttaatgatgcnctggagcaacatttccttaacctgcctctc

SEQ ID NO: 19276 - DNA, 101 bp, rice(Oryza sativa)
  misc_feature (71): n=t or c
cttcctatatacatagtagcggtgggtaaaaaaagacctaactgaaagaccataactgaaagaccaagacngaaaagactaagaccaagaaatttattcat

SEQ ID NO: 19277 - DNA, 101 bp, rice(Oryza sativa)
  misc_feature (71): n=a or g
atgtatatctattttatagttagagtttatctttttcgtcagagtagtagctccctggaaagaataaaccnactcgcacatcatctcctgacatatgcaca

SEQ ID NO: 19278 - DNA, 101 bp, rice(Oryza sativa)
  misc_feature (71): n=a or g
catctgaaacgtctttgtctttgtagggtggagaggaagccatgagcttctgctttctcaaataatttgtntaaaggttccattgcgagaataaaaagcat

SEQ ID NO: 19279 - DNA, 101 bp, rice(Oryza sativa)
  misc_feature (71): n=t or c
ttacccagaaaagtatgcatgtgctagtattttgaattgtaatagtgtgtgttcctatgcacatgtgatgnatcacaatatttctgagttactattgcatg

SEQ ID NO: 19280 - DNA, 101 bp, rice(Oryza sativa)
  misc_feature (71): n=t or g
aaaaaaaaatctaaatgatgagttgttttgcagaagcatgttgacaaaggtgctgatatttcagtcgcttntgttcctgtggatgagaggttattcataat

SEQ ID NO: 19281 - DNA, 101 bp, rice(Oryza sativa)
  misc_feature (71): n=a or g
atactagaatatgttttctagagttgaagtcaaccagtcaagtactcctatatatcaacccattggatcangaaaattatccaaattttacatgttacagc

SEQ ID NO: 19282 - DNA, 101 bp, rice(Oryza sativa)
  misc_feature (71): n=a or c
caaatgggccttctggggaaggaggcctggaatcagctgcatatgagagcatgcggaaagtgtttgatganatgctcgagagggatgccgtgtcttggaac

SEQ ID NO: 19283 - DNA, 101 bp, rice(Oryza sativa)
  misc_feature (71): n=t or c
ctatgttgaacagtatggtaagttctttccactcctgtgtcatgttttttggtttgccatttcaacttaanaatatcatgccctgcaaaaaaaaaaaaaca

SEQ ID NO: 19284 - DNA, 101 bp, rice(Oryza sativa)
  misc_feature (71): n=t or c
aactgcactccaagttggttactggatgtggttaaggggtatgaacaagattcccacgctaccgaattacngacagctttggctctgcaagctgactctaa

SEQ ID NO: 19285 - DNA, 101 bp, rice(Oryza sativa)
  misc_feature (71): n=a or g
ctcaatcaccgttcgactcgctgcttcccctcttcttctcccccaaaccaaaaccctcttgacccttgtcntctccgcaccgcagccgccgcaggcgaggc

SEQ ID NO: 19286 - DNA, 101 bp, rice(Oryza sativa)
  misc_feature (71): n=t or c
attcctccctggtatgggcgatggagaccaacaagggctagctcaactctgtacataaattcgtcaccaanttccactccattaacatttcccacagtagg

SEQ ID NO: 19287 - DNA, 101 bp, rice(Oryza sativa)
  misc_feature (71): n=t or c
tgggctcatggcactgctgaacaatattgccccaactaacctcaagaatcttaggaggacagcgtacaggntgacgtggttctccttctcccggtataccc

SEQ ID NO: 19288 - DNA, 101 bp, rice(Oryza sativa)
  misc_feature (71): n=a or g
acagctcaactggaagagactatcagagaaagagagtgtaaattacgttgcattgacgggtcctcttccanacttggatgagtggtctacctcagttccta

SEQ ID NO: 19289 - DNA, 101 bp, rice(Oryza sativa)
  misc_feature (71): n=a or g
gccgttgcattgctccgccttgatgacttgtatgtggattccttcgagatcaaggatgtgaagacactccngggtgagcatctgtcacgtgctattggccg

SEQ ID NO: 19290 - DNA, 101 bp, rice(Oryza sativa)
  misc_feature (71): n=t or c
cctttgtccaaatgacacaaccaacaatagtcgggtggattacaggtcggattgtcctgacgtcctcaaantgccaattgccagtaaactaggattgtcgc

SEQ ID NO: 19291 - DNA, 101 bp, rice(Oryza sativa)
  misc_feature (71): n=t or c
tcgtgtccaaccggcaacacctccacaccggtgaagacttcaatcctgtcaattatttcaccgtcgtccanagacacaatgcggaagaatcttgcaatgca

SEQ ID NO: 19292 - DNA, 101 bp, rice(Oryza sativa)
  misc_feature (71): n=t or c
agcacaattatatatagttctagtcattaattcatagatgcgtggttacatgtttatagcatacctctagnaccatcagcctcaccatactcaagaacgaa

SEQ ID NO: 19293 - DNA, 101 bp, rice(Oryza sativa)
  misc_feature (71): n=a or c
attgtgcttcaaagaatagctgatcatcctcgttgacaacatgcgcagtcccactcagtcacctaattacnaacgacttcagatgaatgagacattgatat

SEQ ID NO: 19294 - DNA, 101 bp, rice(Oryza sativa)
  misc_feature (71): n=t or c
acataaacaacatgtcaacgcacctcacgtgtaatgaaactgcgtttggatttgataggtagctctgcacntggtctttcggttgagaacacgactgagac

SEQ ID NO: 19295 - DNA, 101 bp, rice(Oryza sativa)
  misc_feature (71): n=t or c
ttgtctgacatgctcgcattcacttgcacaaccttcaatttggatgtacagaattcaaggagagatgatgnctcattatgaacctaccacaagcaattcaa

SEQ ID NO: 19296 - DNA, 101 bp, rice(Oryza sativa)
  misc_feature (71): n=a or g
ttggatttgtcttatagggaagagacaaaacaagatgaagatgatgaagcatccgagaagacaaacccacnaataagccttgaagaggaatatttggaaac

SEQ ID NO: 19297 - DNA, 101 bp, rice(Oryza sativa)
  misc_feature (71): n=a or g
ccagggtcagggtgcgtgcttgtcaatcataattaagcatcaagacggtcatcaagctctgaagttatcanttttgtgtcacaaatgttttcaataaaatt

SEQ ID NO: 19298 - DNA, 101 bp, rice(Oryza sativa)
  misc_feature (71): n=t or c
ttttggataatctgttttctagctagtttttaggaagtcaaggcttgcaaatcgttaagaaaaacaacggntatgcagattcttgcgaactatatttattt

SEQ ID NO: 19299 - DNA, 101 bp, rice(Oryza sativa)
  misc_feature (71): n=t or c
gccgcggtaccagcggccgcggaacgtgtcgagaagcaaggccttgcagtagcgccatggcttgccaaaanatgccaattcggaggtgaccttgacgacag

SEQ ID NO: 19300 - DNA, 101 bp, rice(Oryza sativa)
  misc_feature (71): n=t or g
acatgaatataactgtaaacttaagctatcaactagatgacttggtagtccacacagaaatgagccagttntcatcagtcctctcttcctaatgaaaattt

SEQ ID NO: 19301 - DNA, 101 bp, rice(Oryza sativa)
  misc_feature (71): n=a or g
aattttctttaccgtctccatttgccgcagacgactggcttatcagaatctccttcactcaagatctcacngcattgtatccaattaccgattgaagatct

SEQ ID NO: 19302 - DNA, 101 bp, rice(Oryza sativa)
  misc_feature (71): n=t or g
ttaccactcgcttcagctgaagtactccatatattgatacacaagtttggtgttacccgtgatgtacttantagtggtcccatgtgtctcgcttttatttt

SEQ ID NO: 19303 - DNA, 101 bp, rice(Oryza sativa)
  misc_feature (71): n=t or c
tagtatcacaacaattgatctcaggttccagccaagcttagttttagctattgcctagctatattttacanaacacagagagaggaactaacagggagggc

SEQ ID NO: 19304 - DNA, 101 bp, rice(Oryza sativa)
  misc_feature (71): n=t or g
ctcagacctcacacatgccggcgagccgccatctgctcctcgtcgttgctggatggggaggaagaactcgntgacctcctcggcgcccacgccgtcgccga

SEQ ID NO: 19305 - DNA, 101 bp, rice(Oryza sativa)
  misc_feature (71): n=a or g
tcagaattcatatgtcatttgtttcgcgattgaacatttgaacttgggtcttgggaacgttcggtgtgtgngcctgttcactttgatgccattttcaacct

SEQ ID NO: 19306 - DNA, 101 bp, rice(Oryza sativa)
  misc_feature (71): n=a or g
caatggcgcggatgacaaggcacgtgatgtcacggatcagtccaaggctcttggtgggaacagctgcgagnaccgcgcgctcccctctgctgtgcgtgtca

SEQ ID NO: 19307 - DNA, 101 bp, rice(Oryza sativa)
  misc_feature (71): n=a or g
ccaaccaaatagtttcagctccacctaaaatagaagtggagccgcgtggagcgctttcacagaatgaactngagaggtgaagctaggtttaggctgctcca

SEQ ID NO: 19308 - DNA, 101 bp, rice(Oryza sativa)
  misc_feature (71): n=a or g
agtagcttgttgtcaggccctaggaagcttagccaacaatacctgctttcatttaagcatttcttcccttngtagcatgcattggtaaatcagagatgtaa

SEQ ID NO: 19309 - DNA, 101 bp, rice(Oryza sativa)
  misc_feature (71): n=a or g
gtaggagtcattgagtatacacctaaccattcaatccaaaatcaaacaaccgaagactacacactccctcncaccgataagtttttctcataataacaaaa

SEQ ID NO: 19310 - DNA, 101 bp, rice(Oryza sativa)
  misc_feature (71): n=a or g
tctatagaagttccagtatctgctgtgcctcgtagcatactttgtgataagagagatcgcagtccaacatntcaccttgctgatatttcaaagagcacaca

SEQ ID NO: 19311 - DNA, 101 bp, rice(Oryza sativa)
  misc_feature (71): n=a or g
gactacaaggtagcgaaacagcaagaacaagaagagtcagatgggaggaggacctgagacggcggcggcgncgatcgggcgcgcgaggggcgccaccgcgg

SEQ ID NO: 19312 - DNA, 101 bp, rice(Oryza sativa)
  misc_feature (71): n=t or c
ttcgagactttggctctatcggcctaattaacatatcctatacacaactactccatccgtccaatataaanattttggggcaattgcaaatttaccactac

SEQ ID NO: 19313 - DNA, 101 bp, rice(Oryza sativa)
  misc_feature (71): n=t or c
tcaaacgcagcgtctgtctacagtctcaggagaaaataaaacaaagaaatcccacccccaccattaacttntccatacatggtcgtcatgcctttgttttt

SEQ ID NO: 19314 - DNA, 101 bp, rice(Oryza sativa)
  misc_feature (71): n=t or g
ttttccagtgacacaatatgatagacaagtttacaatgctgtttgcaagatcagcaagagtaattttcaanagtatagtttctttttttaatctaatattt

SEQ ID NO: 19315 - DNA, 101 bp, rice(Oryza sativa)
  misc_feature (71): n=t or c
gcaaatctttatcatttgctgctgcaaccgcaagcaaccaagagtttgtttgttttatagggacttattcnaagtccatgtcacatcggatgtttggacat

SEQ ID NO: 19316 - DNA, 101 bp, rice(Oryza sativa)
  misc_feature (71): n=a or g
tgctgggcaatagacattccttgagaagcacttggtgacatagtcaagagagggactgcagacaccgcctnagatgatgatggtgactgaagcagtagggg

SEQ ID NO: 19317 - DNA, 101 bp, rice(Oryza sativa)
  misc_feature (71): n=t or c
tatttttttgtggaataattttctactcttattcaggctgctgaaggattttgtcgaaagaataatgtccngatagatagtctatatagaagaactgatgg

SEQ ID NO: 19318 - DNA, 101 bp, rice(Oryza sativa)
  misc_feature (71): n=t or c
gcatgcatagatatgtacctgatgaagagcatcttgaagcactggtgagtagttatgcttctgacaccggngcaacgagtcaacaatcgcgacaccctttt

SEQ ID NO: 19319 - DNA, 101 bp, rice(Oryza sativa)
  misc_feature (71): n=t or g
gatgtttgctgcagattgcttgctacttccactcgaggtacaaggctggtcagtcgagcacgtataagaanaatggtttgtgctttctaccaatatcttct

SEQ ID NO: 19320 - DNA, 101 bp, rice(Oryza sativa)
  misc_feature (71): n=t or c
atgctacctatctaacattcgtctttttttttagtcaggcatcctccgctcgcaatcgcaagcaagcgggngaagcaagttggtcgcgatgaggtacgtac

SEQ ID NO: 19321 - DNA, 101 bp, rice(Oryza sativa)
  misc_feature (71): n=a or g
gcagtgatggatcctctgctgctacagtgagtgtgtacagtattatgagttagctaactcatgataggacnaatcgttcaaatcaatcgctacagtaacaa

SEQ ID NO: 19322 - DNA, 101 bp, rice(Oryza sativa)
  misc_feature (71): n=a or g
agtggctatgactcatgaacctttttaccaacacccaaatatgaaagggaagggagaaaagatgataaggnccctaatgtggggctagctctatgatgtgg

SEQ ID NO: 19323 - DNA, 101 bp, rice(Oryza sativa)
  misc_feature (71): n=a or c
aagaaaattaaacatttggacgacatagaagggtgacaaatggaagggtagccaggttaaatttcctgtcnattttgtcttgaaattgagtgaattttggt

SEQ ID NO: 19324 - DNA, 101 bp, rice(Oryza sativa)
  misc_feature (71): n=t or c
tctgtgagggaaatccacataagatcttctgaaacctaatgtatcattctgatgagcaaaccttggtgtancatagcattgtgttggatacctcttggcaa

SEQ ID NO: 19325 - DNA, 101 bp, rice(Oryza sativa)
  misc_feature (71): n=t or g
tggcgcctgatcataagaactggattgtactgctgtcaccagaacttgagtccgtctcaacttccacctgnctcacaccccattccgcggctgcttgtaac

SEQ ID NO: 19326 - DNA, 101 bp, rice(Oryza sativa)
  misc_feature (71): n=a or c
ggtcgcctctatcatccatcgatcggctcatcgcctgctgattcaattcgcatcatcacatttcatctcangttgtcgtggcctgtgaaaacagggtgtgg

SEQ ID NO: 19327 - DNA, 101 bp, rice(Oryza sativa)
  misc_feature (71): n=a or c
aattgttccaggtaggtaccttttgctagctgctgttcctctagcttatcgctgattagcgaggtagatgnatggaacatcatcaaggaataaactgtttt

SEQ ID NO: 19328 - DNA, 101 bp, rice(Oryza sativa)
  misc_feature (71): n=a or g
tcaacaggaacaatgattaaaaattattacatccgtgtcttcatcgtcatcatcagactcgttttgtcccncggcacggcggagcaacttctttagttcct

SEQ ID NO: 19329 - DNA, 101 bp, rice(Oryza sativa)
  misc_feature (71): n=a or g
cttaaatcggcagttttttcctaggggactttcaatcaatccattgaaagacgttgtatatacctctaggnatcattttaatttgttgccatttgcaagtg

SEQ ID NO: 19330 - DNA, 101 bp, rice(Oryza sativa)
  misc_feature (71): n=t or c
cttgtgaaaactgtggaaggtgtgctctgtctataaacgggccgtgatcatgggaatgattggggttacgngatgacagtatgtggtactcgactactcgt

SEQ ID NO: 19331 - DNA, 101 bp, rice(Oryza sativa)
  misc_feature (71): n=t or g
ggtccatgactaatatataagggtaggaggtcttgggggtgtggagcgacacgggtcataactgggttctnggtcggtcgatccaccctgtctaatgggta

SEQ ID NO: 19332 - DNA, 101 bp, rice(Oryza sativa)
  misc_feature (71): n=t or c
agattatgcctgtacgaagacaaaattggtgaactggaccagttactttccctagtacaaggcatgcacangagttctttaactaagctgcactgtggaat

SEQ ID NO: 19333 - DNA, 101 bp, rice(Oryza sativa)
  misc_feature (71): n=a or g
ttctccgagctcttctctcagtttgacgagcagacttcacagctatactagggatgtcctgtgtatcaccntctagttcagcttcatcactcaagatgcca

SEQ ID NO: 19334 - DNA, 101 bp, rice(Oryza sativa)
  misc_feature (71): n=t or c
gtagcagctatagcttcaaatctgatcctatagtctttagttcaattgtgattgtggagataaatctgatnctatagtctttagttcaattgcggagagaa

SEQ ID NO: 19335 - DNA, 101 bp, rice(Oryza sativa)
  misc_feature (71): n=t or c
gaagttccttgcatgccagattttgcgagttagttctccaaatcgatgaaccaatggggatttgctatgcngataattttcagggatgagaaagaaatttc

SEQ ID NO: 19336 - DNA, 101 bp, rice(Oryza sativa)
  misc_feature (71): n=t or c
acgccgaataaccagtgatgaagccactgctactgctcatctcctccattgtagtgatgacattcttactnctcctgagcggcgccggcgctctcaccgcc

SEQ ID NO: 19337 - DNA, 101 bp, rice(Oryza sativa)
  misc_feature (71): n=a or g
ccttgaagaggatccgtggaaggagtcgacctgcatcgtcgaaaccgatttactccttctgacggcttccnctgcagcacattagggttatcagctagcag

SEQ ID NO: 19338 - DNA, 101 bp, rice(Oryza sativa)
  misc_feature (71): n=t or c
cttgtttgttgttgcctttccatgagagctccatcttttggagaaattgtttggaagccaaatgtgcctgngcagcttcttgcgcatccttaacaacatgc

SEQ ID NO: 19339 - DNA, 101 bp, rice(Oryza sativa)
  misc_feature (71): n=a or g
cagtgagctagtgagctacatgtcctagctgcatcaattcagtgcaacaaatcaacattattgcagatacngttggttttggtgcaagaaataaagaaaca

SEQ ID NO: 19340 - DNA, 101 bp, rice(Oryza sativa)
  misc_feature (71): n=a or g
agacggtcaaatattgaatataattggatataaacagtttaaaactatactcttctaggatagagccacgnaggtaatattaaacttgctcctaggagagt

SEQ ID NO: 19341 - DNA, 101 bp, rice(Oryza sativa)
  misc_feature (71): n=a or g
acttggtgaatcaaccggttcaatatatagttcgagagaagaactaaggtcagattcgaaggtagatttantacaccttacttcttctccttacccgaatc

SEQ ID NO: 19342 - DNA, 101 bp, rice(Oryza sativa)
  misc_feature (71): n=a or g
ctacgtcctcctgccgctgggaagaggaacagaagaagtgcaagcaagcaaataaacaaagaggaaagagngaagttttaattgtgctttttattttttgc

SEQ ID NO: 19343 - DNA, 101 bp, rice(Oryza sativa)
  misc_feature (71): n=a or g
aagccgaaatagaaaacacatgctccaaatagccatttcgatggcacacacgaaaaacatataaatctggncatagaagagaaaaagaaacatgagacatg

SEQ ID NO: 19344 - DNA, 101 bp, rice(Oryza sativa)
  misc_feature (71): n=a or g
ctgcaaggggtcgtggtactatgtgagggagcggtcccggccgagctggcgcaaatatacccctagggagnagtaaaaccacgctccagcgtggagcgttg

SEQ ID NO: 19345 - DNA, 101 bp, rice(Oryza sativa)
  misc_feature (71): n=a or g
aacaacaatctgactgaaggtctgactgtcagtggtaatgaaaaggtggccatcttgcaatatgcaaatgncactattttcatgctgtctgataatttgaa

SEQ ID NO: 19346 - DNA, 101 bp, rice(Oryza sativa)
  misc_feature (71): n=t or c
ggcacagcttccagattacacccgaatttaccgtacgtaacctaatttaccccaaaatcacacgaatttancctcggggactcaaaggtggagctgaagtc

SEQ ID NO: 19347 - DNA, 101 bp, rice(Oryza sativa)
  misc_feature (71): n=t or g
cgtattctcagaaacttgttacttccttaggacataaacttatgttctccgactacttgttcttttcgacntgtaacattgatcaaatattttattagaat

SEQ ID NO: 19348 - DNA, 101 bp, rice(Oryza sativa)
  misc_feature (71): n=t or c
ttgcatttatatgttgcattttagtcggttatgcaccttcgcaagtttaatttgctttagcatctcgttanttctggtaaacaaatctctattatactttt

SEQ ID NO: 19349 - DNA, 101 bp, rice(Oryza sativa)
  misc_feature (71): n=a or g
ccaatccaacatcatgatttctgttgtaggagggagccgtttggagaacagctcatccacctacatctcantgacgtaacgctgcatgcagcctcccgcat

SEQ ID NO: 19350 - DNA, 101 bp, rice(Oryza sativa)
  misc_feature (71): n=a or c
cccatcctctccgtagaggacacctgggtcctcttcctgttggccatgtattggcccaagatggggttgcngccggtcgttgactgcagcttggcctccaa

SEQ ID NO: 19351 - DNA, 101 bp, rice(Oryza sativa)
  misc_feature (71): n=a or g
ttaggagtgacaactacttaaggagcctaggtgtctgtgtgtccctaagaaaaggtaaagacagatcaagnaaggaaccttagatactaggaagcatatat

SEQ ID NO: 19352 - DNA, 101 bp, rice(Oryza sativa)
  misc_feature (71): n=a or g
gaatatcacaggatgcataatttggtggtggtgtgttagtgtatagtatgtaatctggttctttcgacttnttattttggtgcaattatcttgctcaatag

SEQ ID NO: 19353 - DNA, 101 bp, rice(Oryza sativa)
  misc_feature (71): n=t or c
acgatttaaccctatgattgttgtactgaactttccatctaattcttccaatatttagtgcccgcggcaangctcggggtatagagtagtataactatatc

SEQ ID NO: 19354 - DNA, 101 bp, rice(Oryza sativa)
  misc_feature (71): n=t or c
taattctctacttggtaaactgtagaaatcttgacttgcaatcacaaaccatttagggggtgtttagatcngggagtgtaaagttttagcgtgtcacttaa

SEQ ID NO: 19355 - DNA, 101 bp, rice(Oryza sativa)
  misc_feature (71): n=t or c
aagcaccctgagaaatccacaaaatcctgtgtgacaaactgacaagctgaacattttcggcttttcgcaangcaaagtgatcgaaatggtgaagaattcag

SEQ ID NO: 19356 - DNA, 101 bp, rice(Oryza sativa)
  misc_feature (71): n=t or g
tataggaaattatttttaggttgaacttttatttataagcatacttgtataccagcttcatttaatcagtntttttttgactaaatcaccgggggagagaa

SEQ ID NO: 19357 - DNA, 101 bp, rice(Oryza sativa)
  misc_feature (71): n=t or c
ggacaatgctccatgcagaggtcacatacccatcctttattctcaggaggcatgcggcagagcgtgagggngtgccacgggtgggcgaagaaggagatggt

SEQ ID NO: 19358 - DNA, 101 bp, rice(Oryza sativa)
  misc_feature (71): n=a or c
ctgtatcagcaaaataaagagcaacataatagctatcattctggagaggtattggaggccattgcagcacnaagggtgcatcttgttctgccaccaaagct

SEQ ID NO: 19359 - DNA, 101 bp, rice(Oryza sativa)
  misc_feature (71): n=t or c
aaaggatagggaacttgaatgtggtaatacctgagtcagactcgtcaataccttgagaacatcagtatctntcatgccaatgcttctaaggaaattgattc

SEQ ID NO: 19360 - DNA, 101 bp, rice(Oryza sativa)
  misc_feature (71): n=t or c
catataggagtataagattttcatggaaatactcaacggttcaatcttcaggaacaggatactttgacttnaaggggtaacgatagaaaaacctggatcct

SEQ ID NO: 19361 - DNA, 101 bp, rice(Oryza sativa)
  misc_feature (71): n=t or g
tatcgacaaatttgtacatatcctatctaagccatcaccattacattgtgaatcttcgctaaaattcccanagcacctttcatattccacctctattcttg

SEQ ID NO: 19362 - DNA, 101 bp, rice(Oryza sativa)
  misc_feature (71): n=a or g
tgggaatacaaagcatttctccaccagtgtatgagaatgatcttttcttccgtggaattgctgtatatctntcgacagatttcgatttcttcaccgtcaaa

SEQ ID NO: 19363 - DNA, 101 bp, rice(Oryza sativa)
  misc_feature (71): n=a or c
ggtgcacagccaggtgaggcggatcaagcaggaggagggggagaaggtgaaggtggacgagacgtaccagnaccaggtgtcggagatgcggcggatggtgg

SEQ ID NO: 19364 - DNA, 101 bp, rice(Oryza sativa)
  misc_feature (71): n=a or g
acgagcagcagccattgtcatgaggacagtaaggaatattgtggacatgggaagaactgttgtttgcacantccaccaacctagtattgatatatttgaat

SEQ ID NO: 19365 - DNA, 101 bp, rice(Oryza sativa)
  misc_feature (71): n=a or g
gtcgccgacaaagatgcagccatcaatgtaagtatcttctgcttgatctgtagcaaggacctcggttgccnctttgcactttccgctctttctattccttt

SEQ ID NO: 19366 - DNA, 101 bp, rice(Oryza sativa)
  misc_feature (71): n=t or c
acgagggatcgtccggcgggaggcgcaggaggatctcttcgacgacgtcgtccatcaaactattcaactcnggcgccgccatgtcaaaagtttgattgaaa

SEQ ID NO: 19367 - DNA, 101 bp, rice(Oryza sativa)
  misc_feature (71): n=t or c
gtagttcatgagatcgagcacctaacttttcgtggcaagctaatgtgtggtagcaaacaaatactacctcngtttttaaatagatgacgccgttaactttt

SEQ ID NO: 19368 - DNA, 101 bp, rice(Oryza sativa)
  misc_feature (71): n=a or g
catcgtcgaccaaataatgcctcatttggcgacatctttaggctagcttggaaactgttgtcgtaggaganttcggcgtagggcaaacatttctcccaatc

SEQ ID NO: 19369 - DNA, 101 bp, rice(Oryza sativa)
  misc_feature (71): n=t or g
aatttagataagagtgagaataggatcgaggtgtgtttgtgaagactttgtttggttaatcccatcaaaanggaattaatttcatacctatctttcttaga

SEQ ID NO: 19370 - DNA, 101 bp, rice(Oryza sativa)
  misc_feature (71): n=t or c
aagatgaacgcgagcgtggtcgttcccttcttgtgcttcagcatctccttggtctccttctggaacccgtngaactgcccgcatcccccacccacacacac

SEQ ID NO: 19371 - DNA, 101 bp, rice(Oryza sativa)
  misc_feature (71): n=t or c
aagtaaacatccccaatgtctccacacggacttaagtgtctgtttattggttgggttgtgtttaaaattangtactaggaacactttttctaagaaaaagt

SEQ ID NO: 19372 - DNA, 101 bp, rice(Oryza sativa)
  misc_feature (71): n=t or g
ttctggttctgactctgaagttgaagatctccctgatgctattgcttctgtcaatattattcaaattactnatggtattataagtgaaagcctctcaaagt

SEQ ID NO: 19373 - DNA, 101 bp, rice(Oryza sativa)
  misc_feature (71): n=t or c
gcctttggactatggtgaatcacatgtcaaactccaaactccaaagtgcatcttatatgcaccagtcaagngaaatatactacactgacaatgagatgcac

SEQ ID NO: 19374 - DNA, 101 bp, rice(Oryza sativa)
  misc_feature (71): n=a or c
aagaagagtaacacgatccagcttcaagcctgtagctttcatcctcctgaaggcatccaaagcctcctccnccctcccattttgcgcatatccgcagatca

SEQ ID NO: 19375 - DNA, 101 bp, rice(Oryza sativa)
  misc_feature (71): n=a or c
taactatctcactcatccatccatgttagccagctgccttcttttgccagtagtcagtactcgatttgttntttcctcatctcggttgctcagttgcttaa

SEQ ID NO: 19376 - DNA, 101 bp, rice(Oryza sativa)
  misc_feature (71): n=t or c
tggcctaaagaaatcagggatgaaaattagacggttttatgaaaaagcacgatgctctcatgcttcagcangtgggccagcatggcacggcccggtgtgct

SEQ ID NO: 19377 - DNA, 101 bp, rice(Oryza sativa)
  misc_feature (71): n=t or g
ctagtagacagtgcagaaagggcaaaacacaatttacataataataataggcgaaagaaaagaaaggtatngcataaagcgaaatgagcgaaataataata

SEQ ID NO: 19378 - DNA, 101 bp, rice(Oryza sativa)
  misc_feature (71): n=a or g
ggtgaattcaccgtggagaaacggtgaatggggcaccactgccatctctaggactatcatagaaaaaaaanctcaaattccgcatatatttgtgtgtgtgt

SEQ ID NO: 19379 - DNA, 101 bp, rice(Oryza sativa)
  misc_feature (71): n=t or c
caacacagggtccagcgacggatcgcatcgcgttgcgggatcagagagaagtgcgatgactgtaaaccatnggactcctccgagcggctagtcgatcgtcc

SEQ ID NO: 19380 - DNA, 101 bp, rice(Oryza sativa)
  misc_feature (71): n=t or c
gaagtatttttgagacggagattcgttgtactatggatcatatctcgtatctgggggtgtaaagttttggngtgtcaaattgggtattatatagggcgtcg

SEQ ID NO: 19381 - DNA, 101 bp, rice(Oryza sativa)
  misc_feature (71): n=a or g
tctgtctgtgggccacgtcgtgtttttagccgcaataattcaggaaataattgggcagagagagagagagngagagaggaggggagagaagagctgaggct

SEQ ID NO: 19382 - DNA, 101 bp, rice(Oryza sativa)
  misc_feature (71): n=a or c
atctttagaaggcaaggttgagatgaagaagaccaaagatgcagttgctaatgcaactaccgcacaggaanaaaagcaaagccaaatattggaaaatggca

SEQ ID NO: 19383 - DNA, 101 bp, rice(Oryza sativa)
  misc_feature (71): n=t or c
tgacctgcctgccttcgatccatccattgagcaagctctgcacgaagaagacatcgaagatgatgttgatnaggccgcagttgaagtgagtggtatagaaa

SEQ ID NO: 19384 - DNA, 101 bp, rice(Oryza sativa)
  misc_feature (71): n=a or g
attttcttgacatctttgtaagatcctgtctaagttctgcagacaataattgaaagttttaccatagactnaaaaatcgtccatgaagacatccatgatat

SEQ ID NO: 19385 - DNA, 101 bp, rice(Oryza sativa)
  misc_feature (71): n=t or c
tctgtcacttacctgagatattggagttactgggaacttgtctgtgccaactgtgatccccttgaagagtngaataagttgctctctgttctccgtgaaaa

SEQ ID NO: 19386 - DNA, 101 bp, rice(Oryza sativa)
  misc_feature (71): n=a or g
acaagacgtcactgatgtcgctcggctagggacaccaggcaaggctttcgcctatagtctaccttcacctnctgtcatagccccgacgtcatgccaccaac

SEQ ID NO: 19387 - DNA, 101 bp, rice(Oryza sativa)
  misc_feature (71): n=a or g
attgggggaaaggttagaggtcaccaagtaagcagggtctgggagcttggggagaggcttggaaaagatgncggccgctgcttagcgtgccacaagagagt

SEQ ID NO: 19388 - DNA, 101 bp, rice(Oryza sativa)
  misc_feature (71): n=t or c
acggtcaaatactatagctattattagcaaaacatagccagtaatcctattccccaaatacatctttctcnctatactaatctcgtgaaatttcacgttct

SEQ ID NO: 19389 - DNA, 101 bp, rice(Oryza sativa)
  misc_feature (71): n=a or g
ccgcgtcgtagtcgccgttgagccgctcatcagcggccatgagaatgtctcccttgccgtacaaatcccangcccactcgaccaaccggaagataccattc

SEQ ID NO: 19390 - DNA, 101 bp, rice(Oryza sativa)
  misc_feature (71): n=t or c
ggataaggaaggcaagaaacatcactcattgtggttgtaaggccaaactggtaatagctaaacaaggacanaggtcagtggtatgtgaaagactttgttga

SEQ ID NO: 19391 - DNA, 101 bp, rice(Oryza sativa)
  misc_feature (71): n=t or c
acttgcatgggcggaaaaatttcatccggtggcatataagggattaatcgatattacctatattaaatgtnaaataagaaatactatttgtaactttatgt

SEQ ID NO: 19392 - DNA, 101 bp, rice(Oryza sativa)
  misc_feature (71): n=a or g
ccaaggttatattctcgttaaatagaaaaaaaacattgattaagtagtgattgaaaatgtccacatggcanggcaggggactcgagttaccaaccttgtac

SEQ ID NO: 19393 - DNA, 101 bp, rice(Oryza sativa)
  misc_feature (71): n=a or g
catggctttcaggtagctaaaggtgagattccaaagctctgcatgtgcttgcagaaactccggattgaacnaggagtctgccatgggtgtggtcacttgga

SEQ ID NO: 19394 - DNA, 101 bp, rice(Oryza sativa)
  misc_feature (71): n=a or g
aaatagcgattttggagaccatttcgagcagacaggccggagttctgctcgtcaaaataatttttaacccntctggaaaaattgtttttgtatggaattag

SEQ ID NO: 19395 - DNA, 101 bp, rice(Oryza sativa)
  misc_feature (71): n=a or g
attttaggtttcttctggatgtgattctgaaagacaaatgtactaacaaaggtaagcatacgaagggagcnatacactggatcaaagaaagaaaaatgaca

SEQ ID NO: 19396 - DNA, 101 bp, rice(Oryza sativa)
  misc_feature (71): n=t or c
ctatatggatagttgaatgtactcattagcatggcatactcgtcctgtttaaatcagggtttgaaacatgnatttttctttttcctatgggcccatgtggg

SEQ ID NO: 19397 - DNA, 101 bp, rice(Oryza sativa)
  misc_feature (71): n=a or g
gctacctgtttggcatctcttgtcggtgagaaactagctagctgaagtggaattatgatttataacagtanttctagttgaataattactgttctagtttc

SEQ ID NO: 19398 - DNA, 101 bp, rice(Oryza sativa)
  misc_feature (71): n=a or g
gggtggagataacgatgttgatgctgatgatgacattggtggccctatcgtgaagaagaggaaagtgcccnttaaggttgcgtggtattttcctataatcc

SEQ ID NO: 19399 - DNA, 101 bp, rice(Oryza sativa)
  misc_feature (71): n=t or c
tactaaaaaatcagaggaaaatgaaacaaattgcttgctaagcaaagcacgaagagagatagagaggaagngaagaagatgcagataactgaaaggcctag

SEQ ID NO: 19400 - DNA, 101 bp, rice(Oryza sativa)
  misc_feature (71): n=t or c
gacatggcctccttatcgccagtccacgatggcttatcatacatgctctaagaaagcggaggcctcttgtncgtggaaccgggagaaggtatagaaggggt

SEQ ID NO: 19401 - DNA, 101 bp, rice(Oryza sativa)
  misc_feature (71): n=a or g
cctcacgagtccacattttagaaacctcctcacccattgaatcaaatcgccattctgtgaaagctctaccnagttcacaccttagctgatctctggctgca

SEQ ID NO: 19402 - DNA, 101 bp, rice(Oryza sativa)
  misc_feature (71): n=a or g
tatacctccttggatcaaaagactagagtcactgttccatctagacctatcaaataacagccttatagggnggattccagcttctttaatggagatgccaa

SEQ ID NO: 19403 - DNA, 101 bp, rice(Oryza sativa)
  misc_feature (71): n=a or c
ccccagacttgccgcatcaaggagatgatgtacatgacggagccgacaccgaagtcagtcaagaccatagnaatcacccaagtcgagatctaggtcgaaat

SEQ ID NO: 19404 - DNA, 101 bp, rice(Oryza sativa)
  misc_feature (71): n=a or g
acgccgccgccgcctttggaatttaccttcgatctgactcctccgttgtgtttttttcggtgcagacccgncaggggacgcggcgatggtggccgtcccgc

SEQ ID NO: 19405 - DNA, 101 bp, rice(Oryza sativa)
  misc_feature (71): n=t or c
gacttttgcttctattcatcagcagaaactttccacttgttccatccacatctccctctccctctctctcnctctctctctctctctctctctctggtcac

SEQ ID NO: 19406 - DNA, 101 bp, rice(Oryza sativa)
  misc_feature (71): n=t or c
tacagaaacactcatggggatggaggatctagaacttctgaagcacttgcattcaatacgtctgtggtttngctgcccacctgtgatggtggtaagcattc

SEQ ID NO: 19407 - DNA, 101 bp, rice(Oryza sativa)
  misc_feature (71): n=a or g
tgtgcacgcagaatatgagggagaagggttgggaacacccagcatcgaagatggatgagactcctctaatnttgtgcagtttgcagttatgccactgacat

SEQ ID NO: 19408 - DNA, 101 bp, rice(Oryza sativa)
  misc_feature (71): n=t or c
atcaggccttgccttcttctcgtactcaagggttcccctacagtgatattaatcagtttgatcttccaccnggtgaaaagaggaagatgatactcaagtac

SEQ ID NO: 19409 - DNA, 101 bp, rice(Oryza sativa)
  misc_feature (71): n=a or g
gtacaacaaaaagatgttattagttgtgacttgactagagcttggtttatggtgtgcaaaaacatatgctnctatgattgcaggtaattgagtattttgat

SEQ ID NO: 19410 - DNA, 101 bp, rice(Oryza sativa)
  misc_feature (71): n=a or c
tatgctgacgatgttgcggtttttgcaaacccgaaacaagaagagttgacagctctttctcatatactggnatgctttgcacaagcttctgggctacacac

SEQ ID NO: 19411 - DNA, 101 bp, rice(Oryza sativa)
  misc_feature (71): n=t or c
tgctcctgctcagctgagctcgggtgagctctttctacctccaagatttcctcctcctacctccactccantcgcctcacctcagctcacctcagcgtcgt

SEQ ID NO: 19412 - DNA, 101 bp, rice(Oryza sativa)
  misc_feature (71): n=t or c
taacgtgtgaagtcattggttcctgagctgataaatatcagggagttctctatgatcctggaagcctcctnctctccgacgatgttcctgagccggaggag

SEQ ID NO: 19413 - DNA, 101 bp, rice(Oryza sativa)
  misc_feature (71): n=t or c
tggttaaaacatgagcactagtatatgtgtggggtacaaatacctcagttagaaaatgcacaggtggtcgnagaaacaaatagaataagaacggacagata

SEQ ID NO: 19414 - DNA, 101 bp, rice(Oryza sativa)
  misc_feature (71): n=a or c
ttaggaaatcggaacactttactggttaatccaaataaggaaggattggacatattggaagagcttattanattttatagttcacactattcagccaactt

SEQ ID NO: 19415 - DNA, 101 bp, rice(Oryza sativa)
  misc_feature (71): n=a or c
ggaactttgcagcctggaaaggagtgaaatgagcttcatcagtttggcccaatgctgtgatctttgatatntcctcttctatgctgcacagcaatgagaat

SEQ ID NO: 19416 - DNA, 101 bp, rice(Oryza sativa)
  misc_feature (71): n=a or g
gaagagagggacccaatgaatggctacatcgcttatatatacaaagctgccgagaattgagcctcaaatcngcgtttgccgctggcgtggcccttgccggg

SEQ ID NO: 19417 - DNA, 101 bp, rice(Oryza sativa)
  misc_feature (71): n=t or g
ccttcagcttcatgttattacctccaatatgatgattgacgctttgctcaaaggaggcagataggaatatnccatggatatgtttagtccagaataatgtg

SEQ ID NO: 19418 - DNA, 101 bp, rice(Oryza sativa)
  misc_feature (71): n=a or c
attcaggagtgaccgcaagcgcaacgctgctgctactgctgcaagaaatgcatctccggagcacgtcagtncgacgagtgtcacctcaagaaccagtggaa

SEQ ID NO: 19419 - DNA, 101 bp, rice(Oryza sativa)
  misc_feature (71): n=t or c
agatagacctgccatttatccatttctgacttttcagctctgcacctggccaggtagtaaccaccatttgntgtttcagtaccttctaagggtgcattagt

SEQ ID NO: 19420 - DNA, 101 bp, rice(Oryza sativa)
  misc_feature (71): n=t or c
cgctcatatagcaaatctccacgcgcgcaaccaccaataatttaagcgacgtgcaaatggccaaatacaanttcagacttcagtacgtataggcaacacat

SEQ ID NO: 19421 - DNA, 101 bp, rice(Oryza sativa)
  misc_feature (71): n=a or c
caagaacacgaagtatgctctacatctcgggtatcgacgtctaagatgaattggtcaaatcagaagatagngttctctgacatcgactacccttctctgac

SEQ ID NO: 19422 - DNA, 101 bp, rice(Oryza sativa)
  misc_feature (71): n=t or c
aattatcaaactagtgacatattagatactactaactgattgtaaccgtgcatatctttcagtaaactggncctttccacaaagactaattaattacttcc

SEQ ID NO: 19423 - DNA, 101 bp, rice(Oryza sativa)
  misc_feature (71): n=a or g
aagcgctcatgcaaagatacttcaagtgattcaaagaggagcttatctgaggcactaccaactgcctttangggaatgaaggctattttagtagatgggag

SEQ ID NO: 19424 - DNA, 101 bp, rice(Oryza sativa)
  misc_feature (71): n=a or c
tgcttggtccaaccaaagttgctcctttcagtgatatcattcatcacctcggctgatgagaaagagggcanagctgaagccaatagggaaggacttgactc

SEQ ID NO: 19425 - DNA, 101 bp, rice(Oryza sativa)
  misc_feature (71): n=t or c
ggccagtgttccggaatcgcactgggaaccagaatcgacagatatacagcttatttgagcactttggttgnaatgacggttcgttgcaggcttgcagccag

SEQ ID NO: 19426 - DNA, 101 bp, rice(Oryza sativa)
  misc_feature (71): n=a or c
gggttcatcctctcccacttagaacaatatccacccaacacatacattgtaagtttcatcatccatagcangattacatgagtatggtattacacttccga

SEQ ID NO: 19427 - DNA, 101 bp, rice(Oryza sativa)
  misc_feature (71): n=t or c
ttgtatttagttcttaatctgtataggttgttactagttgcccgtgtagatatatgcttcttatgcccttngtagttatcagaaaattttcccatctaaaa

SEQ ID NO: 19428 - DNA, 101 bp, rice(Oryza sativa)
  misc_feature (71): n=t or c
catttccaaatacactttcgtccgcgcgttgctgccattgcttttctttctctggcagtatgcacggtttntgctctgttgcagtacagcagcgccacgca

SEQ ID NO: 19429 - DNA, 101 bp, rice(Oryza sativa)
  misc_feature (71): n=t or c
ctactgaaaaaaagttggaggagtcgtatgcgtggactggcagtgcctgcagtatcttgctgccatatgtntcctgcagggctcggctgtgctgcaactgc

SEQ ID NO: 19430 - DNA, 101 bp, rice(Oryza sativa)
  misc_feature (71): n=t or c
agagctttgatccttgcttgagtgtgtgttgaaagtgaaggaaatgaggtccttaaatgggcaggtatgangattgtagagcatgggaattatcggaaatg

SEQ ID NO: 19431 - DNA, 101 bp, rice(Oryza sativa)
  misc_feature (71): n=t or g
ggattgtttttcccctctcctatttcatcgggtgtcatggaagatgacgcagatgccacaagatttgttgngttagctgtggccttatcaacaagtgaagg

SEQ ID NO: 19432 - DNA, 101 bp, rice(Oryza sativa)
  misc_feature (71): n=a or g
cacgtgatgagcttgttgggcttttgtagcaccactgtagacatgacttcttcccttagtcgtaggacacncacatgaggtgctcacatgcatgttagctg

SEQ ID NO: 19433 - DNA, 101 bp, rice(Oryza sativa)
  misc_feature (71): n=t or c
accacttagcaaatcaagaagcttttgtttcttcattttctgagaggagcgctttgcaggatttgtggaanatgaacttgattgatgttgctctatctgta

SEQ ID NO: 19434 - DNA, 101 bp, rice(Oryza sativa)
  misc_feature (71): n=t or g
gacaccacatggttggcgcgcggggtccgaataatggcgatgctaacgcagcaaagcgtccggttttcagnacaagcggccgcctgattgtgtgcttgacg

SEQ ID NO: 19435 - DNA, 101 bp, rice(Oryza sativa)
  misc_feature (71): n=a or g
agatgaagtagcagaagtcgtggactatgctgccgacatcgttagcgaaataagggaacaaacacctccanccgatcctccagctcctcaaagaacaccat

SEQ ID NO: 19436 - DNA, 101 bp, rice(Oryza sativa)
  misc_feature (71): n=t or c
ttggaatgggacgatacagagccaaaagtctatgaggaccctaaacctgcaaaagatgacgtgaaccaacncccggtcgatgacaagaccagtgaaaagtc

SEQ ID NO: 19437 - DNA, 101 bp, rice(Oryza sativa)
  misc_feature (71): n=t or c
cctacacctgctggcctgtgtttgtcatccctctcaaccttccacctggtgtttgcatgcagaaacacaanatgttccttagtttgattatccctggacct

SEQ ID NO: 19438 - DNA, 101 bp, rice(Oryza sativa)
  misc_feature (71): n=t or c
gtatgatcttcttcttgttcagtccagaatctgaaccttttccagcttccaaaaaattcaagcacataccnaaagaaattaccagcgaccaatagtgtata

SEQ ID NO: 19439 - DNA, 101 bp, rice(Oryza sativa)
  misc_feature (71): n=a or c
caatcgtcccaggcacatcctgatcaaagccaaactgccttgcaacacgatgcggatgtattgctcaatgnagcccatgccgacgagctcacattggcgca

SEQ ID NO: 19440 - DNA, 101 bp, rice(Oryza sativa)
  misc_feature (71): n=a or g
gactagccaagcccctccttcagttgctgccaaccctgaatgcaacattgatgaagaggacaatactatgnaggacccagattttgtagacagtgattacg

SEQ ID NO: 19441 - DNA, 101 bp, rice(Oryza sativa)
  misc_feature (71): n=a or c
aaaagtaattctaagatgaatgagtttaaaaagagggttgtgaatgtggcaattgcaaaaggagttgtccnaatagtcaatgagtatctagaagtgttccc

SEQ ID NO: 19442 - DNA, 101 bp, rice(Oryza sativa)
  misc_feature (71): n=t or c
ttcgatgttatcatctttgtgaagacgttgttggttttagacagattggccatggagaagtgcaatggcgnggtggtggcgtcggcgatcttcaacgacca

SEQ ID NO: 19443 - DNA, 101 bp, rice(Oryza sativa)
  misc_feature (71): n=a or g
cctctttatttcagggatttggtattccagtaatgaggctgctcgaaatctagagtagagatggtagcacnttcctggctgacaacgacccgcacgccctt

SEQ ID NO: 19444 - DNA, 101 bp, rice(Oryza sativa)
  misc_feature (71): n=t or g
ataaggccattgaccttctcttcaaccactggcatgtttgacaatgcaacggtctcagacggaacttctanagtaattttgaatatagcctgtaacgaaga

SEQ ID NO: 19445 - DNA, 101 bp, rice(Oryza sativa)
  misc_feature (71): n=a or g
ctctcttaccatcgcaagattcctcaccttacgagacccattcatgagaatcgtgtatgtagaaacatcangctgacagccctgctctaccatttcctgct

SEQ ID NO: 19446 - DNA, 101 bp, rice(Oryza sativa)
  misc_feature (71): n=t or c
ggatctgtcaggtttagcttgcaaacagatttgacagcctttaatcgaacgctgaatctgttgtttcatgngaggccaagcaaacaaagctttgatccgct

SEQ ID NO: 19447 - DNA, 101 bp, rice(Oryza sativa)
  misc_feature (71): n=t or c
gctgtggtttttgtgctcaatttattatgtagcaagggcttgttcgatgagccctaatgtcattcctaacncaatgactagaatggtgtctatagtattaa

SEQ ID NO: 19448 - DNA, 101 bp, rice(Oryza sativa)
  misc_feature (71): n=a or g
acaagctcagatccatcgcgatgagatgatgcagtcactgaaggctattcaggagatgctgagctcaacancgagctgttcagggaaggaagccaaggaga

SEQ ID NO: 19449 - DNA, 101 bp, rice(Oryza sativa)
  misc_feature (71): n=a or g
atgttggtacggacaaaatgatcccccacaaaaatccgcagagaagatcatgagtgacacgcgatatatgnggtaacacacgaacatcttatcaagaattc

SEQ ID NO: 19450 - DNA, 101 bp, rice(Oryza sativa)
  misc_feature (71): n=t or g
ataggctagcctcctacgaccaaaggccagagaaaatcaaatattttcataggtgggacttcacccgccancacaatttatttctactagcagtatgtcat

SEQ ID NO: 19451 - DNA, 101 bp, rice(Oryza sativa)
  misc_feature (71): n=a or g
gactatgatgcaaacgcctaaaaatttagcaaaaattcgtggaatctactgagtatgtgtacaagctactntcaaaagatgaatattttagcattaatggt

SEQ ID NO: 19452 - DNA, 101 bp, rice(Oryza sativa)
  misc_feature (71): n=a or g
gcatgattgcatcacctgcgtaacgctcgctggatggcaaactggaaggaagcttcctacggctagagagntagtactagcttgtcgcgttcgcgtgcgcc

SEQ ID NO: 19453 - DNA, 101 bp, rice(Oryza sativa)
  misc_feature (71): n=t or c
ggggaacatcgacggccgacgcgctccaccagctcgagaggaactcgaggagattgagcggcgattctggnggccggagttccctggcgacatgggttgaa

SEQ ID NO: 19454 - DNA, 101 bp, rice(Oryza sativa)
  misc_feature (71): n=a or g
gttaccattagtgatggatctcacaagctcagggtagtccgttgcaatacaacgacaatgatagcgaactnttcgtgcaagctatttgagtccgatgggat

SEQ ID NO: 19455 - DNA, 101 bp, rice(Oryza sativa)
  misc_feature (71): n=t or c
gacagctcgacggcacgtcctaatgacagttccttagcgcgttgatatcctgtttgttacaactccaactnctaaatttagcttcagaagttgggtctgta

SEQ ID NO: 19456 - DNA, 101 bp, rice(Oryza sativa)
  misc_feature (71): n=t or c
attaattagcttactcaatttgtgacatcaccctctttaatgcaaggctttgaccaaatctgaacaattantattaagtgaaattataaatttaccaccgt

SEQ ID NO: 19457 - DNA, 101 bp, rice(Oryza sativa)
  misc_feature (71): n=a or g
aggggaaggggacagtcgaagaggcctcactgtcgttgttggctcttttcggtggcacgaggaggcaaagncggagcgctagggtagggggaaacggtgac

SEQ ID NO: 19458 - DNA, 101 bp, rice(Oryza sativa)
  misc_feature (71): n=t or c
ttgtagccgatgcgtactctgccttctcgaacgaaatctctccaaatcagctttgaccccagctttgaatncggcccatggcattgccaaatttggtcgtt

SEQ ID NO: 19459 - DNA, 101 bp, rice(Oryza sativa)
  misc_feature (71): n=a or c
gctgactcatttggcacctcaatattactatctctgattagcgaagaaagccgattatcgatagagccgcnatcatcaacttcggcttcactaatctcctg

SEQ ID NO: 19460 - DNA, 101 bp, rice(Oryza sativa)
  misc_feature (71): n=t or c
gtggatgtaacagttggccaagtccacgctcacggtggcgccgccgtggtaggcgtgatagataatctgtncggagagcgccacctcggcgacaagcggta

SEQ ID NO: 19461 - DNA, 101 bp, rice(Oryza sativa)
  misc_feature (71): n=a or c
tggacttttggagctaacatggccattgcctgttgaattaatagaaccaccaacactttctgcattgtctntaaaaggctgcactttgctcgcaacagcct

SEQ ID NO: 19462 - DNA, 101 bp, rice(Oryza sativa)
  misc_feature (71): n=t or c
tatactaaccctgaaggtgctgttggttcatcaacaggaacaatggagttatccatacccatcaaatcacnaaggaggtctggcattggagcaggagcagc

SEQ ID NO: 19463 - DNA, 101 bp, rice(Oryza sativa)
  misc_feature (71): n=a or g
gccgccgtcgcaacagacgggagatgacgctgcttgtcatcagcgccgccatcacaacaaaggggacacancgcccctgttggagagctgatgtcattgtc

SEQ ID NO: 19464 - DNA, 101 bp, rice(Oryza sativa)
  misc_feature (71): n=t or g
ccccatagagtgtttgactttgtatcacatcacgtgtacaggttcgtccggatggccgcatcatcagctcnacaggagggatgtttggtcacttgactggc

SEQ ID NO: 19465 - DNA, 101 bp, rice(Oryza sativa)
  misc_feature (71): n=t or c
gatctaatcgtttagattcaatcttttcaaccaggacacatcagattggcaccgcaaaagataccaagccngggcctctcgacggcatccatgatggtgtg

SEQ ID NO: 19466 - DNA, 101 bp, rice(Oryza sativa)
  misc_feature (71): n=a or c
cctctccgcgggcgaggaggaaaaccaagtagttgttgaagtcagggaactggctgtagtgctggagctgntgccagatgcgagcctggtcggagttgggg

SEQ ID NO: 19467 - DNA, 101 bp, rice(Oryza sativa)
  misc_feature (71): n=a or g
gagcatacctcaccctgaaccaagaggtgtagttgtcgcggccgcaaatcatggatccaccaattcatccngtggcacgttcacttctagctcggagctag

SEQ ID NO: 19468 - DNA, 101 bp, rice(Oryza sativa)
  misc_feature (71): n=a or g
tgcccttctttccttattcttcctctttcttccctctcctctattccaggagaccggcgatggcagtggcnatagatggccataaggcccgaggcccgaag

SEQ ID NO: 19469 - DNA, 101 bp, rice(Oryza sativa)
  misc_feature (71): n=t or c
atgagcgccggccagcgggtgtggctaatgggcgatcgatcgccgatccccatccccctatatgctctctnccctcttcctcctccacttcttctcttcct

SEQ ID NO: 19470 - DNA, 101 bp, rice(Oryza sativa)
  misc_feature (71): n=a or g
tcatatctttggaggaccgctcgcctacgagtccaagaggaagcagaagctagccgacagggagattaacncagttcagctggaagtgccacaatacatgt

SEQ ID NO: 19471 - DNA, 101 bp, rice(Oryza sativa)
  misc_feature (71): n=t or c
tccttttgcttccaacctaaagcatagggttcttttgcttcacgagtatcgtcctgagatttctcttcctnggcaaccactggagtttgtaaagaccgtga

SEQ ID NO: 19472 - DNA, 101 bp, rice(Oryza sativa)
  misc_feature (71): n=a or g
caagtcaaaactagcggttgtgctcaaggcaaaatttaggtatgcactagttcaatgcccatgctttaggnatatatttttctatgcaagtaaggaaaaca

SEQ ID NO: 19473 - DNA, 101 bp, rice(Oryza sativa)
  misc_feature (71): n=a or g
aactgaaacatcaagaatgataatgaaatactgatagcgcatcagcctgtagcaaggaaaagatagcaaantagttgcactaaagagatggagttttcaat

SEQ ID NO: 19474 - DNA, 101 bp, rice(Oryza sativa)
  misc_feature (71): n=a or g
gtttgctgctacacctcgtacacttgttgggcaacagatagatgctcatgtttaggatgcagtgcttcagnttcatgtgcaaatcgaccctgagcatgggt

SEQ ID NO: 19475 - DNA, 101 bp, rice(Oryza sativa)
  misc_feature (71): n=t or g
acaacaacatcatgggtctgtatacgaacctagggcagcatgaaaaggttccttcagtaattgcagagatnaaaagcaatggtatcgttcctgacaatttc

SEQ ID NO: 19476 - DNA, 101 bp, rice(Oryza sativa)
  misc_feature (71): n=a or g
cataccaccaacttcttactctttccagtgaagaaagaacatagggagtatatggggtaaaaggatccacntgtcaaccaccttcaccaccatttatattt

SEQ ID NO: 19477 - DNA, 101 bp, rice(Oryza sativa)
  misc_feature (71): n=a or g
aaatgattatggcatgttttactatctggtttttgaggtgcctgttggtgtcatcacttttggtttagcantaccagcaactaagattagtcaaaatgatc

SEQ ID NO: 19478 - DNA, 101 bp, rice(Oryza sativa)
  misc_feature (71): n=a or g
tgtttaatctaactgtgcagtattgttgctggaatactactaattggaggcttatttaatgttctgtgggntaaaaacttagaggaacatgatgaactgaa

SEQ ID NO: 19479 - DNA, 101 bp, rice(Oryza sativa)
  misc_feature (71): n=t or c
atagaggggacatcagggggaggataataattgtcttgcggccttgggggcatgaactgtggatgtccacnataacctggaccaccaggagggaggtggct

SEQ ID NO: 19480 - DNA, 101 bp, rice(Oryza sativa)
  misc_feature (71): n=a or g
taaccctaacggcgaaaccagatggaatctcaaaatgccgtacgaaacacccaccaatattcctgacggtntggacattgatgcaccaagtgttgcaccaa

SEQ ID NO: 19481 - DNA, 101 bp, rice(Oryza sativa)
  misc_feature (71): n=t or c
tcttctccattcatgcttatgcatcgcatcaggaggtatgtgatctcttctagcatttcagcgctcatctnattccttacttggctatctagtagctcttg

SEQ ID NO: 19482 - DNA, 101 bp, rice(Oryza sativa)
  misc_feature (71): n=a or g
tcagtacggtatcacatataggttctatatcgctagctatccaccatagggtgactaactgacaatgttcncatcctttaaaacaaaaaaataagtgttta

SEQ ID NO: 19483 - DNA, 101 bp, rice(Oryza sativa)
  misc_feature (71): n=a or g
ctttgccctttttgcacctcgtttaggaccctacttatcatctccatcatctccctcacttgcgcttcctnaagaaggtaggctaactgacatctcatcgt

SEQ ID NO: 19484 - DNA, 101 bp, rice(Oryza sativa)
  misc_feature (71): n=a or g
tttagaaattgttcgctccacaagttggccaaatgttagcctaccattctgaagcaatccttcaagcagcncttctgactgaaagaaatataagatgcatg

SEQ ID NO: 19485 - DNA, 101 bp, rice(Oryza sativa)
  misc_feature (71): n=a or g
atgtattcctttacaaagcaaaagcataacctgtgatttttaggtagtgaacagaatcagccagcaaatantggaggaacttatagtcgatagttcaccag

SEQ ID NO: 19486 - DNA, 101 bp, rice(Oryza sativa)
  misc_feature (71): n=t or c
atctttgttttcatctccttcatttttcttcccggagtaacttggtttttgtgttctcggaatggaagagnagacctcgagagtagacttgccgaccaaga

SEQ ID NO: 19487 - DNA, 101 bp, rice(Oryza sativa)
  misc_feature (71): n=t or c
actcaagttatgcaggtttgatcgaattcgacattcatttggtaagggccacacttgtgacatgacttttnccttatcacatgggctctacatgccattgt

SEQ ID NO: 19488 - DNA, 101 bp, rice(Oryza sativa)
  misc_feature (71): n=a or g
ggttacgtgcaggggcggagctacatgtgcatggggtgcaggaacctagctcagacatttttttagctatnatttatctattttcactatatatgcacctt

SEQ ID NO: 19489 - DNA, 101 bp, rice(Oryza sativa)
  misc_feature (71): n=a or c
acatttgttgtttgcgacggtatagcaagttgcaatggtataaatgggcctcgataatccagggctgtcangccgcagctcaatttgatctctcgtagtaa

SEQ ID NO: 19490 - DNA, 101 bp, rice(Oryza sativa)
  misc_feature (71): n=t or c
ttctgctcaactagttgctcacagagcatgtacaaacagatggcatagctactcaccggggtaccctttanaacagttgacacatgaccaggagcaatccc

SEQ ID NO: 19491 - DNA, 101 bp, rice(Oryza sativa)
  misc_feature (71): n=a or c
atatataatgtaggcgacatatacacattatatatagtttatttgtcttttcttgtcgggcttgcgaatgncagccaaagtttattaagatttgagaagag

SEQ ID NO: 19492 - DNA, 101 bp, rice(Oryza sativa)
  misc_feature (71): n=a or g
gtccaccgggaaagatcgcaacgacaaagaagatcaaactgaatcctatgaagaacgggagcgcacaaganctgcagtaactgagggagaaaagcttattg

SEQ ID NO: 19493 - DNA, 101 bp, rice(Oryza sativa)
  misc_feature (71): n=t or c
gaagcgcacaaattcgcaacagctcacatgttgtacgaaccgaatagttttgtttgaagttttgaaccaancacaaaatcagatcagttttttttttttgg

SEQ ID NO: 19494 - DNA, 101 bp, rice(Oryza sativa)
  misc_feature (71): n=t or c
atttggcattttttagatataagataccattgaatgatcgacttacttctttttattggtattcgaaacanataacatattatggctaggtttcataaatt

SEQ ID NO: 19495 - DNA, 101 bp, rice(Oryza sativa)
  misc_feature (71): n=t or g
ttacgtggatgaatacgtacggagtatgagtattttcggttgagcttaggctgtgtagttggaagtttggnttaaaattggtacgatgtgactgaaaagtt

SEQ ID NO: 19496 - DNA, 101 bp, rice(Oryza sativa)
  misc_feature (71): n=a or g
acaagctgctctatagttttcaccgtccttttgttttctttatccttttttgcattctccacaggttaggntatgcgggagcactgcatatgttgcacaga

SEQ ID NO: 19497 - DNA, 101 bp, rice(Oryza sativa)
  misc_feature (71): n=a or g
ttcaggtaagactctccagcttgcatggccatgtttctgaatgtagctcatgagcttctcatcttcttcangagtccaggggcccttcttgaggccattct

SEQ ID NO: 19498 - DNA, 101 bp, rice(Oryza sativa)
  misc_feature (71): n=t or g
cagatctaggttctgggaatatctagaccttcctaccaaataacaacagtgcatttagcataacaaaaatncatagtatttctttgaaattggagcgaatc

SEQ ID NO: 19499 - DNA, 101 bp, rice(Oryza sativa)
  misc_feature (71): n=t or c
tgcagttctactaccttcttcgtcttcttctcatcaagctctatagctgtattctgtaatggtggccggtnaggtcaaagcagcagcctcgatcgcaaact

SEQ ID NO: 19500 - DNA, 101 bp, rice(Oryza sativa)
  misc_feature (71): n=t or c
gaaccccactgaaagtagatagagaggaaacaaataggcatggccactaatcaccgtgctactatatgtanctcaacacgttttgcaacacatttataatc

SEQ ID NO: 19501 - DNA, 101 bp, rice(Oryza sativa)
  misc_feature (71): n=t or c
aatttggctatgtggctctctttgtcacatgggttttctcgcatctcatcatgcaatgaccatgggccaanaatggcgcatttgccatcaacaatgatctg

SEQ ID NO: 19502 - DNA, 101 bp, rice(Oryza sativa)
  misc_feature (71): n=a or c
ttaggttctttctcagaagacagagcaaaatcaactggtgagaaagacccatcatgaagcttctcacaagnaaactcagattcagaaacaaaatcaggagc

SEQ ID NO: 19503 - DNA, 101 bp, rice(Oryza sativa)
  misc_feature (71): n=a or g
gtttgtttttcttttagtttgatagagaaaaattagtgagggtgagaggaatgaatactgtagcgcttganctagagagggaaggagtgggtagtgttggg

SEQ ID NO: 19504 - DNA, 101 bp, rice(Oryza sativa)
  misc_feature (71): n=t or c
tctttactcttgttccactttactcatgctgtaatccccaaattatgtcgtctcccgttcacaacaccatnggtctataatcgacgaaatggtaggacaag

SEQ ID NO: 19505 - DNA, 101 bp, rice(Oryza sativa)
  misc_feature (71): n=a or g
gggcagggtggtggattttattcacctcaattttttttgtagcggactctcacctgccgccatggaaaacntgattttcgctggcggacgctgttggtatt

SEQ ID NO: 19506 - DNA, 101 bp, rice(Oryza sativa)
  misc_feature (71): n=t or c
tcagacacagtaaatgaactcgtctatgacgtgctcatatctaaagtccgacagcgtctcaatgaggttgntcgcctcccaatttggtcatcggtggagga

SEQ ID NO: 19507 - DNA, 101 bp, rice(Oryza sativa)
  misc_feature (71): n=t or g
gaggtgtgagaaccaggtggttgctccaacctttggggttcaaggaagatgggtttcatgtcagcgaagcnctttccttcgtgtgagagtatgtgcgtgtg

SEQ ID NO: 19508 - DNA, 101 bp, rice(Oryza sativa)
  misc_feature (71): n=t or c
ctcaacaacaaggtcaacattttctgatctttcacggaatgaaggatgtcgctcgcagagcaattgatagntctgttaaaaaaaagaacggcaagaagttg

SEQ ID NO: 19509 - DNA, 101 bp, rice(Oryza sativa)
  misc_feature (71): n=a or g
gctggcccaccagggaggccatcgctatgcaaagtggccatctctatgcagaacgacgcgaggcacaccgntgacggtgaggagctaacacgatccattca

SEQ ID NO: 19510 - DNA, 101 bp, rice(Oryza sativa)
  misc_feature (71): n=a or c
ttcacaggcacctaccactgttctccaaaaggagccgagctacacacacacactggcagagatgactgtgntctatcgagagaaagacagggagagattga

SEQ ID NO: 19511 - DNA, 101 bp, rice(Oryza sativa)
  misc_feature (71): n=t or g
gggttccatatcaataccagtttttagctataatagtagtgtgtgtactaggcacaccaatggttcgtaangttgaatagttacaaattactttggacctc

SEQ ID NO: 19512 - DNA, 101 bp, rice(Oryza sativa)
  misc_feature (71): n=t or c
tcagcaggccacttatctttatcttcagaaacatcttttcttcggctatgtctatcaaggtccttctcggngttattgtacttctcttttgttgcagatgc

SEQ ID NO: 19513 - DNA, 101 bp, rice(Oryza sativa)
  misc_feature (71): n=t or c
tccatctttttaagtgtaacatgtccagagcaaagaacaaagaagctagactttggcctggtttagttccnaactttttcttcaaactttcagcttttcca

SEQ ID NO: 19514 - DNA, 101 bp, rice(Oryza sativa)
  misc_feature (71): n=t or c
ttctcgatcatatccttgtcagtgatcttctggccacatagacttagtctggacacaagcttgtgtaaagnggagttatacgctgtcacagacttaaagtc

SEQ ID NO: 19515 - DNA, 101 bp, rice(Oryza sativa)
  misc_feature (71): n=t or c
tcctatgttcctttctctgacggctttgacgacatatccaaactgagcatactttctggcgacgagagggnacgtagccgctgcacaagctttgaaagcct

SEQ ID NO: 19516 - DNA, 101 bp, rice(Oryza sativa)
  misc_feature (71): n=t or c
aacggcagagaggctccaaccttcagtgactgatctaaaacaacttttggccaatggtgattctgttgganaccaaagtggatcatttgtgcaatcaattc

SEQ ID NO: 19517 - DNA, 101 bp, rice(Oryza sativa)
  misc_feature (71): n=a or g
tgaagttttcacttagaactcagccttattgatagaacgtacgaacgacatgataatttcggagcccaacnttcaggcctagcataaatattttatcctat

SEQ ID NO: 19518 - DNA, 101 bp, rice(Oryza sativa)
  misc_feature (71): n=t or c
gtacattagttaaccataaacaactagggtttctgccaaactttcccatgacatctggtgatcgcactcanatggttatgacccttttttttaacccaagg

SEQ ID NO: 19519 - DNA, 101 bp, rice(Oryza sativa)
  misc_feature (71): n=t or c
acaagtcacataggttcatctgtattcagtcactagctgaaagactaggctgaaacaaggttcacaatccnaacgaaaaccagacttctcgaaccggtttg

SEQ ID NO: 19520 - DNA, 101 bp, rice(Oryza sativa)
  misc_feature (71): n=a or c
acatttaaacaatgcttgacattaatgtgctcgttgcagttcttatcacacatatgaccatcctgacatgnaaactatttcatgatggaacctccatccct

SEQ ID NO: 19521 - DNA, 101 bp, rice(Oryza sativa)
  misc_feature (71): n=a or g
tgacaaagcgaaacaattctgtttttgtttaaactctgcctgtacagctgtccattaggcttctgacgggntaagaccgaaagttcatttggttgatcagt

SEQ ID NO: 19522 - DNA, 101 bp, rice(Oryza sativa)
  misc_feature (71): n=a or c
ggttcacacatgatgcttcttcagtccaaaatttcagaacctttgtgatgaacatgtgagattaaaccagnaggaacatgtattagaagataacaagggct

SEQ ID NO: 19523 - DNA, 101 bp, rice(Oryza sativa)
  misc_feature (71): n=t or g
atcatttcggctacaaccagtaacctcgcgcggactactactgcttcattggcatagcatggcgtattttngtagataatggaaatagattacatatccgg

SEQ ID NO: 19524 - DNA, 101 bp, rice(Oryza sativa)
  misc_feature (71): n=a or c
atttaaattaaattatgacatgtacatgtaactgatgaaagaaaattaattttagtccgagtaacaaaaanaacataaaaactaaaaataattctaaaatt

SEQ ID NO: 19525 - DNA, 101 bp, rice(Oryza sativa)
  misc_feature (71): n=t or c
gctggtaggattatccatcggacttccagtcgcaggcaaccgataggagtaggttttctgggatgaatatnagcgtccacgagcaaaatgaatttcatagg

SEQ ID NO: 19526 - DNA, 101 bp, rice(Oryza sativa)
  misc_feature (71): n=t or g
ctttccctgttgagaaggcagctaccaagaggattttccttgctgagggcacaatgaatagtggagtaaangtgtccaagctgatgaactaccctgtgagg

SEQ ID NO: 19527 - DNA, 101 bp, rice(Oryza sativa)
  misc_feature (71): n=t or c
acgacttgtcactcccaaattgacggacaaatggaggtggtgaatcgaacactttctatgttgctgagaangatgattaagaagaacttgaaagaatggga

SEQ ID NO: 19528 - DNA, 101 bp, rice(Oryza sativa)
  misc_feature (71): n=a or g
actaatggccggccaaggctttcgccaaagatttcaatccaacaccacacgaccaacccaaacaacaaccnttgccggcgccagaccaccacactatcact

SEQ ID NO: 19529 - DNA, 101 bp, rice(Oryza sativa)
  misc_feature (71): n=t or c
gacacgtctaataaattttgacatataaaaataaagccataagatcatagaacggatcattaaaaaaacangaatattagagaataacctaatatcaaata

SEQ ID NO: 19530 - DNA, 101 bp, rice(Oryza sativa)
  misc_feature (71): n=a or g
acagatttttatgggctgtgctgtactgttgttccttgcagagttggcattttccaccaggagtagtatcnagtccgatgtatacagctacggcgtcatac

SEQ ID NO: 19531 - DNA, 101 bp, rice(Oryza sativa)
  misc_feature (71): n=a or c
cgctccggcggacggcacggggaatagttggatacacgagtacaaacactagccattaagccaggcctaangggccggaatgtgttgatgggccctcccac

SEQ ID NO: 19532 - DNA, 101 bp, rice(Oryza sativa)
  misc_feature (71): n=t or c
tgcctcaatgtattccaaaatgggttaacgtttaacagaacaaatagcaaatcaaggtattagtaactgantgctttggtgggagaaagcagaccaatgct

SEQ ID NO: 19533 - DNA, 101 bp, rice(Oryza sativa)
  misc_feature (71): n=t or c
gttcatccgattgtagtatttagcaacacgataaactgtctctgagacatattcaagtacaaggttgaggnaaacttcacccctctcagtcgtcgaaaaga

SEQ ID NO: 19534 - DNA, 101 bp, rice(Oryza sativa)
  misc_feature (71): n=t or g
accaagcattcttgcacattaaaccacaagtagatctaccaataaatcacaaccttaggtagcaatggggntaatcggaggggaaaaccttacctcgtcag

SEQ ID NO: 19535 - DNA, 101 bp, rice(Oryza sativa)
  misc_feature (71): n=t or c
ccaaaggtggccccctcctccgctgatgacgcctccttgcgagccggatcaaagaagaccctcgtagctcnccaaatccggccacccatccccgccggagt

SEQ ID NO: 19536 - DNA, 101 bp, rice(Oryza sativa)
  misc_feature (71): n=t or g
tccttcaggtgcctgtttggtgttgctggtgctattcagtctcaggtttacatcagtcacatctccgttancatggtctccatcatatatcttcggcatcg

SEQ ID NO: 19537 - DNA, 101 bp, rice(Oryza sativa)
  misc_feature (71): n=a or g
tgatctcccttatgttgtaaagggtatggacgtgtcatttagtggcatactgagcttcattgaagctacancaattgagaagcttaaaaataatgagtgca

SEQ ID NO: 19538 - DNA, 101 bp, rice(Oryza sativa)
  misc_feature (71): n=t or c
gctatttcttctgctcccatgggtgtgattcctgcctcaatgtttgtttcatgttcaggcgatttcctctnggtgacgaaactttggggcgatgacacctt

SEQ ID NO: 19539 - DNA, 101 bp, rice(Oryza sativa)
  misc_feature (71): n=a or c
tgtttcgtgctagatggaacgcgattaacgagaagaggataacgatggtttacgtcattttaaaccatgtnattttttaaaagttaccaaatatttacata

SEQ ID NO: 19540 - DNA, 101 bp, rice(Oryza sativa)
  misc_feature (71): n=t or c
ctaaagaaagatgtatacacctcagttatgcttatatctgtcttctttggagctcctgcttttgttgctanggtcacctttggaagttgtttgcttctagg

SEQ ID NO: 19541 - DNA, 101 bp, rice(Oryza sativa)
  misc_feature (71): n=a or g
gcgctaatccgcgtgctacagcgcggaatattagttcaaacgtagcacgccctctccttctggttttcctnttttttaccaccccacctttcctccgcatc

SEQ ID NO: 19542 - DNA, 101 bp, rice(Oryza sativa)
  misc_feature (71): n=a or g
ccccaaagagtgtgcactgtagtttacaatcggttctctgcactaggaatatctgagtgtgctggactccnacttgattcgaatctaacatcatcagatct

SEQ ID NO: 19543 - DNA, 101 bp, rice(Oryza sativa)
  misc_feature (71): n=t or c
taatcataactcttatttaggaaaaaataacatatatgctggtgagctagcgtgtgaaattctagaaaatnaatatatattgaaaataacttagctgatat

SEQ ID NO: 19544 - DNA, 101 bp, rice(Oryza sativa)
  misc_feature (71): n=a or g
tccccattagctagtgctagaagagtcgctatcacctagtcagtgtgaagtgtgactgaactgataatgcngcacaatgatgtcaaggcaatggcacaaga

SEQ ID NO: 19545 - DNA, 101 bp, rice(Oryza sativa)
  misc_feature (71): n=a or g
gccatctgtggagaggtggggatgcgaaaggtggagaggtgactgaaaaatgaattcatctcgtcaatttnattcaatttttggcatttaaaagagagatt

SEQ ID NO: 19546 - DNA, 101 bp, rice(Oryza sativa)
  misc_feature (71): n=t or c
ttcgtaggattcgaggacgaacagggcgattccagatgaatcttgtccaagaagctcagcgagccgtagangaaggtgcagccgttcaggtcgtctcccac

SEQ ID NO: 19547 - DNA, 101 bp, rice(Oryza sativa)
  misc_feature (71): n=t or c
tatggattgactttgaaggttgataagcacccacagttcagaaagtcaagatgcctttttgttgttcgcanggatggtgtttggattgatttttcatacca

SEQ ID NO: 19548 - DNA, 101 bp, rice(Oryza sativa)
  misc_feature (71): n=a or g
ataggggtatgaggatggtgatgggccaacatctgcaagtctgaggctagatgggggttgccgcccgattnagatgtgggtaaccgttgtagtcgacaatg

SEQ ID NO: 19549 - DNA, 101 bp, rice(Oryza sativa)
  misc_feature (71): n=t or g
aaaatgaattaatatgtccatgaaggcatgggtgttatcttaagtagaaatgtccgtgaatattagggaangatataatatcaaataattaaaagggataa

SEQ ID NO: 19550 - DNA, 101 bp, rice(Oryza sativa)
  misc_feature (71): n=a or g
tttagtgtttggaggggaagcgatcttacctatagaagttcaaatcccgtcactgagggttgctattcatnaaaatatagcagaagtcgaagcggcaaaac

SEQ ID NO: 19551 - DNA, 101 bp, rice(Oryza sativa)
  misc_feature (71): n=t or c
ccgccggccattgccggagctaaccaataattcgacggcgacattctcgacgggaaccgggttgtcgtatngcccgtgtctccgaccggcgacagttctcc

SEQ ID NO: 19552 - DNA, 101 bp, rice(Oryza sativa)
  misc_feature (71): n=a or g
cctgtcagcgatgatgaggtgcgttcaaagtggaatgcttagatttcgtggttctagggttaattagcacngttttggctgtttagtttgttaggtgtgca

SEQ ID NO: 19553 - DNA, 101 bp, rice(Oryza sativa)
  misc_feature (71): n=a or g
ttcatatgcatcaactccactcgtgtcacgtccatccttttgctgtcagctggtgtttttcttggaaagancaaatggggagggagaaagcaaaaggaaaa

SEQ ID NO: 19554 - DNA, 101 bp, rice(Oryza sativa)
  misc_feature (71): n=t or c
tgatcttactagcatgaaaaaaacccgttcattttcaatccacaaggattcctaacacgtgggatttcgtnccacgcaaatgagtagcgtgcaaaacctcc

SEQ ID NO: 19555 - DNA, 101 bp, rice(Oryza sativa)
  misc_feature (71): n=t or c
cccatatggagaggatggttatcatgaaaacctcacatatcgtacaacagcatgcactcaatccatgcaanagaataaagttacaatgctagagtgctatg

SEQ ID NO: 19556 - DNA, 101 bp, rice(Oryza sativa)
  misc_feature (71): n=a or g
tgttaggcgagagcaaatgcctgtggacgacggatcgatgtagtgttagctatatattcctcattggtttntgtgcacgttgtgcagagaccagaagtgta

SEQ ID NO: 19557 - DNA, 101 bp, rice(Oryza sativa)
  misc_feature (71): n=t or c
ggcattaataacttgccctgtcatattgaatcagccccctgaaaagaagatttctgaggaaaatcaacgangttatgcttttcgtattgtagacttgttgc

SEQ ID NO: 19558 - DNA, 101 bp, rice(Oryza sativa)
  misc_feature (71): n=a or g
gcctacaccagctcgccggggagtgcggcgtcacgagcaccattacggtgaaccctgacgagttctcgctnacgtcctcactcacggaactagccacggcg

SEQ ID NO: 19559 - DNA, 101 bp, rice(Oryza sativa)
  misc_feature (71): n=t or c
tttaggtgaaaggagcatatgtcatgctattgcaggttcatggatgtcttctttcttagggaaccgctatngtatctgtttttactagtttgagtatgtaa

SEQ ID NO: 19560 - DNA, 101 bp, rice(Oryza sativa)
  misc_feature (71): n=a or g
tgtgtgcatggatgctactctcaagcaaatcgaaggtgtcatatcatttttccagaggtacagaaatgaangcttcacttctagtatagatattgcaaaag

SEQ ID NO: 19561 - DNA, 101 bp, rice(Oryza sativa)
  misc_feature (71): n=a or c
tatagatgcaatattctctaagttagagaacaagatgttttttaacaagattggattcgccgggtatcgcnccctccaccccgggtatcgtctttgtcggc

SEQ ID NO: 19562 - DNA, 101 bp, rice(Oryza sativa)
  misc_feature (71): n=t or c
aaaccatccgaatccgaagaagcacaagacgaaatataggaatcttacgccggaatcgatatcatcggagngccagctcctgtggctcacgtcggcgccag

SEQ ID NO: 19563 - DNA, 101 bp, rice(Oryza sativa)
  misc_feature (71): n=a or g
gtccacaggttcatcgcatgagtctaagtagacaccatcgctccaccgctagattcaagcgtcttcaaggngatcgtgtggcagacagtgccactaaggag

SEQ ID NO: 19564 - DNA, 101 bp, rice(Oryza sativa)
  misc_feature (71): n=t or c
ccatcccaccaccctcctcctcccctctatcattgtcttacttctctcttccttatgcttcctttataacntctattcttgtataataatctctgtaatct

SEQ ID NO: 19565 - DNA, 101 bp, rice(Oryza sativa)
  misc_feature (71): n=a or g
ccatgacaaaagagaaaaaaaaacctaaactatatatggatcagtgggcagaatccacaatgccctgtgtnccgctggaacatcaacgaaatcatcccatc

SEQ ID NO: 19566 - DNA, 101 bp, rice(Oryza sativa)
  misc_feature (71): n=t or c
atcaatagcactacgacgtcttttacttgcctcgtctctcaatccaggactacccgaaattataacagctncacttatctgtcttaacgggactgcgttag

SEQ ID NO: 19567 - DNA, 101 bp, rice(Oryza sativa)
  misc_feature (71): n=t or c
ggtgtaagcatctcctctgcatagactgcatgcccagagtgtttctcatagctggcaaaactttcagcaanggaactggcatagctggtactcctgaatat

SEQ ID NO: 19568 - DNA, 101 bp, rice(Oryza sativa)
  misc_feature (71): n=a or g
gcagttggggggcttctaaatgctacgttcggaaatgcaactgaaatgatcatagcaatatatgctttganaaatggaatgatccgagtagttcaacaatc

SEQ ID NO: 19569 - DNA, 101 bp, rice(Oryza sativa)
  misc_feature (71): n=t or c
aaaataagtcgaacacatttctatggaggaagaactgtttggatggtgaatgtaggagttttagaagtgantggaaagaaaaatttaagagcaaattaacc

SEQ ID NO: 19570 - DNA, 101 bp, rice(Oryza sativa)
  misc_feature (71): n=a or c
acacggagaagtggtatactccatttccattatggaagattgaattcaattacaatgagcggtaagggtcnctttgatttagagaaaaaacataaaaattt

SEQ ID NO: 19571 - DNA, 101 bp, rice(Oryza sativa)
  misc_feature (71): n=t or c
ggcagttgagccagtcaaaccccacaatacatagtcactagcttaagggatttattaagccaaattaatcngtcattagcaaatgtttactgtagcacaac

SEQ ID NO: 19572 - DNA, 101 bp, rice(Oryza sativa)
  misc_feature (71): n=t or c
ccaaccaacgtttgttggatgccttgtgcattttgcttcataggtttctgcccacatgtaatctctagggntaatatgccgaaggaaaatacgtcggcgag

SEQ ID NO: 19573 - DNA, 101 bp, rice(Oryza sativa)
  misc_feature (71): n=t or c
attcattgaaccgccgaatatagtccctcaaacattcacctgggttgagttaaattgtgaaggtcttcctngatcgcgtggcacttgtatgtaccctgaaa

SEQ ID NO: 19574 - DNA, 101 bp, rice(Oryza sativa)
  misc_feature (71): n=a or g
ggcgttcagatcacttatgttatgttctcgttcttaaaatgaaagcttcatttttttagctactacgttcntctgaaacttcttaacccaatagcatgttt

SEQ ID NO: 19575 - DNA, 101 bp, rice(Oryza sativa)
  misc_feature (71): n=a or g
ttaggcgaccaaatagctcatcactatctttgacctgtgaagctgcttctgcagcttcctttgccatcttnatccgtgcatatgcctgaacaacaacgcca

SEQ ID NO: 19576 - DNA, 101 bp, rice(Oryza sativa)
  misc_feature (71): n=a or g
tgtacaagaggacagatcaaatgattttaatgacgaaacatgtgcttacgcaggcccttcaattgatgaanctgatcatgagtggagatcactggatggcc

SEQ ID NO: 19577 - DNA, 101 bp, rice(Oryza sativa)
  misc_feature (71): n=t or c
ctaacatgaaaatgtctaccttcaaataacaactcattcttctgatttttcaccatttcctcacaagcagncgtgttattactagcattatccaaagttaa

SEQ ID NO: 19578 - DNA, 101 bp, rice(Oryza sativa)
  misc_feature (71): n=a or c
atcgtatggacttctagttttgagaatgttatatccactaaaaactagtgttatttgagcttcttgctgtnaatacatgatgcacaccataaattgttttg

SEQ ID NO: 19579 - DNA, 101 bp, rice(Oryza sativa)
  misc_feature (71): n=t or g
ctacgtactaatagcaatgtactaatgtggattaagtacctcactgctttctactgctcgcttttacacgnttacaccgcgcacagagtagtccttaatgt

SEQ ID NO: 19580 - DNA, 101 bp, rice(Oryza sativa)
  misc_feature (71): n=a or g
gcaacccttgaagcccatggcgtccatgcagacgtgattgctactgatattgtgtcaggtcttgagaaacncctgcatggtttggttgacgttgttgttgt

SEQ ID NO: 19581 - DNA, 101 bp, rice(Oryza sativa)
  misc_feature (71): n=t or c
cttactattattatctcatatttactgtactgtccattcgatagttataaatagcaacatccgtgtgcctnccgttcttttctccaaccagagttgaatga

SEQ ID NO: 19582 - DNA, 101 bp, rice(Oryza sativa)
  misc_feature (71): n=t or g
cggaaaaattgaagggctcccctttggcagcaaaaactgtaggacggttattgagaaatcaccttgacttngagcattggacaagtgtcctcgaaagtaga

SEQ ID NO: 19583 - DNA, 101 bp, rice(Oryza sativa)
  misc_feature (71): n=t or g
agcggtcgatgagtcaaagggggagttctttggtttgggggaaattttggaatagacctggttgttgatgnagctgacggcatcgtggtccctccaagcga

SEQ ID NO: 19584 - DNA, 101 bp, rice(Oryza sativa)
  misc_feature (71): n=a or c
cgtacaggctggtgtaattccatttgccacaaattctttttcccccaagacgcgggaaattcttcccatgntaataacagcagcaaagccgcaaagcaagc

SEQ ID NO: 19585 - DNA, 101 bp, rice(Oryza sativa)
  misc_feature (71): n=a or g
cggcggaggggtgtagcagagggtgagctctaggttcatctcggcctcctcctccctgctgttcaccgccnttagactatctagctagctaagctacggac

SEQ ID NO: 19586 - DNA, 101 bp, rice(Oryza sativa)
  misc_feature (71): n=t or c
caagtgcagactaagctgcaatatatatcgtcaaacaatttgcagagcaaatctccaaagccaaacaaaanatctgatggtgctaaaaccattgagataac

SEQ ID NO: 19587 - DNA, 101 bp, rice(Oryza sativa)
  misc_feature (71): n=a or g
tcagttatatgtaactcatcttgcttaaagatgaattctaactacatggcaggtaaacccgggcgattggnaagttgatggaggatgtgcgaaccctcgag

SEQ ID NO: 19588 - DNA, 101 bp, rice(Oryza sativa)
  misc_feature (71): n=a or g
tctggtggctatggatcgcgaagccgaggccgtgcaatggactcatccgccgcccggtcagaccgagcttngctcggtcaaacttgccaggacactccgat

SEQ ID NO: 19589 - DNA, 101 bp, rice(Oryza sativa)
  misc_feature (71): n=a or g
cttgatggcaagaacgacctcttctaatgaatcgacattgtctataatgtgtctggttgccattgcacccnagtagtggagggtgcgcaacgctggcatgt

SEQ ID NO: 19590 - DNA, 101 bp, rice(Oryza sativa)
  misc_feature (71): n=t or c
tgggcctcggccaaccccacctaggccggattgatcaacaaacaagcccacgtcatctgtcgtatcgcaangatgagatatttgttgcgcgcactgcttga

SEQ ID NO: 19591 - DNA, 101 bp, rice(Oryza sativa)
  misc_feature (71): n=a or g
taataccctggatggtttaaaatgttctcccctaatttcttcctcaccataccatatgtatagtactggtnacatcaattaattgatttctctcttattca

SEQ ID NO: 19592 - DNA, 101 bp, rice(Oryza sativa)
  misc_feature (71): n=t or c
gttgcaacggccatcatgagtgcagtgtgcgactgaacataatcatttcacaggatggctgctagaccctnctttttaacaggcggcctgttccctggaaa

SEQ ID NO: 19593 - DNA, 101 bp, rice(Oryza sativa)
  misc_feature (71): n=t or g
ggtacttggtagccttggtagtgtgtatagcatagtcgtatgccccccatatatagaccattacagggtanaactgggctggtttaggggtaactcagaac

SEQ ID NO: 19594 - DNA, 101 bp, rice(Oryza sativa)
  misc_feature (71): n=a or g
acacagcaggggacacgtgcccccttactaaataggaactgccaagcttctctttcaatcttgtgtcgtcntttccaacaaacactctgttattatcctta

SEQ ID NO: 19595 - DNA, 101 bp, rice(Oryza sativa)
  misc_feature (71): n=t or g
tgtgctggtgctaaagaagacacaagtgatttccaggaggaagagatttgatagttatgtccaagaagctngaggagaaagtatgctgcggatttcatgga

SEQ ID NO: 19596 - DNA, 101 bp, rice(Oryza sativa)
  misc_feature (71): n=t or g
tgctcacggccacacatttctccatttctaatcaccttggatgcatgctctgccgccaccaaccatgtcantaatagtaatcttgtattgtcttgtgtgct

SEQ ID NO: 19597 - DNA, 101 bp, rice(Oryza sativa)
  misc_feature (71): n=t or g
ggttgtttacaccgtttttgtgggtttttttttctgatctcagcgcggcggaggtcgtcgtgccggcgagngggaaggcgatggtgccgacggacctcagc

SEQ ID NO: 19598 - DNA, 101 bp, rice(Oryza sativa)
  misc_feature (71): n=t or c
ataaatataagcccccctaggaggagaggggacaagacacaagatacaacatatacacaaaccaatacgcngccaaatatcggcattagagattagtctag

SEQ ID NO: 19599 - DNA, 101 bp, rice(Oryza sativa)
  misc_feature (71): n=a or g
acgagcagaggcggagcagcagtggagcagaggaggagagagccagttacgaaaaaggagcagcacaaaancccaaaacccatcaaagcgtcggtttcttc

SEQ ID NO: 19600 - DNA, 101 bp, rice(Oryza sativa)
  misc_feature (71): n=a or g
agcaatgcaggagaagagaaagggctttggctatgttgaattaccccaatgttcaacatttcagtcacctntttttcaatttcattcttgtcaggcctacc

SEQ ID NO: 19601 - DNA, 101 bp, rice(Oryza sativa)
  misc_feature (71): n=a or g
atagtatcattgcatatctgtgcaggattaaataacttttgcatccaattgctcgtttgtgtgcccacatnccttgatatgcatgtgggcacacaaacaag

SEQ ID NO: 19602 - DNA, 101 bp, rice(Oryza sativa)
  misc_feature (71): n=a or c
gcctgcggtgcttcatctactgaacagctgacaatctgagaactaatgtttgtgggaagagcttgtggtgnttcatttattgtatcactgtctatctgagc

SEQ ID NO: 19603 - DNA, 101 bp, rice(Oryza sativa)
  misc_feature (71): n=t or g
ccatgttgacattttcagggaggcagctaaagcaatgaagaatgaatatatggctggaaggcgcgtcagcncggttgattagaatctaggtcatcggtgtg

SEQ ID NO: 19604 - DNA, 101 bp, rice(Oryza sativa)
  misc_feature (71): n=a or g
gccagcggcaatagagaaaaaagaggaacagatcgaacctgaagcttttctggggactcaacaatttttgncaataacttggaattttcttgtgctagttt

SEQ ID NO: 19605 - DNA, 101 bp, rice(Oryza sativa)
  misc_feature (71): n=t or c
cccgggctggaagggagcagtccataagtggaagttcaactagcatgattggagacacgctcttcaaaggngagtcaaagtttacacaaatcatgcatggt

SEQ ID NO: 19606 - DNA, 101 bp, rice(Oryza sativa)
  misc_feature (71): n=a or g
ttcttttcttattctttctccacttaccctagactttatttagtgagagtatcttagtttttctttcttcntgtcaccctaccctttgaattaattaaccc

SEQ ID NO: 19607 - DNA, 101 bp, rice(Oryza sativa)
  misc_feature (71): n=a or g
ttgagaaggcagtaaaacgaccttgtacacatataaacggcaacacgtttaccttccagagatcaagtatncacgatgagttgcataaatcactccaagaa

SEQ ID NO: 19608 - DNA, 101 bp, rice(Oryza sativa)
  misc_feature (71): n=a or c
ttgaactgggacaaacttttgatggcgtcgactggaaaaccatcaataccagcaacagataggtggcgtantgttggtttcagcttcttggagctagcaac

SEQ ID NO: 19609 - DNA, 101 bp, rice(Oryza sativa)
  misc_feature (71): n=t or c
cttgatccccatttgtctcaatgacgctgttgtcagtcttgatgacatcaggtacgatggttggatgctanatcgctgaggacagagaaatggaccgtgga

SEQ ID NO: 19610 - DNA, 101 bp, rice(Oryza sativa)
  misc_feature (71): n=t or c
atcctactgtagtttacccatggtactcatctaccgcttccacagctgttgtgtatgtaggatcgaatcanaagaactaagccaaccagaggggggtgaat

SEQ ID NO: 19611 - DNA, 101 bp, rice(Oryza sativa)
  misc_feature (71): n=a or g
gtttccaatgaccatttcagtcagtattggttaccgtccgtgttagaaatggcaacggtaatatcttccgnaaataggatgaaggtttttctgaccgtttt

SEQ ID NO: 19612 - DNA, 101 bp, rice(Oryza sativa)
  misc_feature (71): n=a or g
gtgtagagtggagaccgcgcggggaaatttggggatttcgtggtgggagagcgaaattttcgcggtttggnctatgcgcggcgcgagctttgcgagttttg

SEQ ID NO: 19613 - DNA, 101 bp, rice(Oryza sativa)
  misc_feature (71): n=a or g
agcgatttactattctgattttactgtgccgaatcttttttggccgttagattcagacatagatggttcanattgtgtacagcagttaatgtgcagtccta

SEQ ID NO: 19614 - DNA, 101 bp, rice(Oryza sativa)
  misc_feature (71): n=t or g
agacaggggaacctcaacctgctggaaacaaacaattcaaccagaaaaaagataaatcccagggattaagngataatcaatcatactttttttctctcttc

SEQ ID NO: 19615 - DNA, 101 bp, rice(Oryza sativa)
  misc_feature (71): n=t or c
tctttggggtagagcctttagtacagtcaggggacatcatttagttctgcacttgcttgcaattattcagnttcttgcaatttgtagccgccaaattgatt

SEQ ID NO: 19616 - DNA, 101 bp, rice(Oryza sativa)
  misc_feature (71): n=t or c
attatttttattcatttttattcattgttagagagtcatgatggacggtcactaatacaaaaatgattttncatggcgtcaccctataatttttgcttgcg

SEQ ID NO: 19617 - DNA, 101 bp, rice(Oryza sativa)
  misc_feature (71): n=a or g
tcaactttatgattttgccctcagtttttttaactgaaatttgggtttgcccctcttccgttaggaggccntgttaattcgcttgagcttcactaaaaaaa

SEQ ID NO: 19618 - DNA, 101 bp, rice(Oryza sativa)
  misc_feature (71): n=a or c
agaaaagctctctggaatgatccagctcagagaattacaaaatgctcttagccatcaacgctcaagcatanatttatcacctcagtcaaaaaaccaaacaa

SEQ ID NO: 19619 - DNA, 101 bp, rice(Oryza sativa)
  misc_feature (71): n=t or c
agtccatctctgaaatatatattgagatcagttactattttcaatttttcatcctgaattttgaagactgnagatcatgaatggcagcacagtttcctgaa

SEQ ID NO: 19620 - DNA, 101 bp, rice(Oryza sativa)
  misc_feature (71): n=t or c
cttgcatccccaagaatgtagtctctgaccactgacccagctggctctcctggaagctccgtttgtccgtncagcctcgcgcctttctcgcagagcctgta

SEQ ID NO: 19621 - DNA, 101 bp, rice(Oryza sativa)
  misc_feature (71): n=t or c
ttcagataaatccttactttcttgacttcttggaactatggagtgaggtcaggatacgtttgaattactantgaaacatagaattattttgtaacttctga

SEQ ID NO: 19622 - DNA, 101 bp, rice(Oryza sativa)
  misc_feature (71): n=t or c
ttgctgaacaatttctgcatgtaccttaacatcgccaaatactattgcccatgaaccatgagagggatcangaaggaagtctcctgcaatgataacctgca

SEQ ID NO: 19623 - DNA, 101 bp, rice(Oryza sativa)
  misc_feature (71): n=t or c
ttggagcaatacgaggtgcattgctaggattggcaatagttgggcaacctgatgctggcaacacttgctgngggtgctgacgaaggagcatactgcctctt

SEQ ID NO: 19624 - DNA, 101 bp, rice(Oryza sativa)
  misc_feature (71): n=a or g
cagctgagccgaagggagaattcctccacggttgaactcgatgaagttgtactgccacttcagctattgcnccttggacttccgcacgtgatcgacttggc

SEQ ID NO: 19625 - DNA, 101 bp, rice(Oryza sativa)
  misc_feature (71): n=a or g
gtcgaagtagatcccagcaaggttgaagctgtccttgcttggtatcctcccaagaatgagtcagagatccncagtttccttggcctagctggttactatcg

SEQ ID NO: 19626 - DNA, 101 bp, rice(Oryza sativa)
  misc_feature (71): n=t or c
agcagctccgccgccttctcgattccctcgtccagggacttgtgcttgggtggagaagaatcggatttggncgaatcggcggcggcagcgtcgatgagggc

SEQ ID NO: 19627 - DNA, 101 bp, rice(Oryza sativa)
  misc_feature (71): n=t or c
gccccccgtagatttggaagctagcatttgatcagtaataataaactgagttcgggaagcctacagcagangagaaaaaaaatacatatacaatcgttcag

SEQ ID NO: 19628 - DNA, 101 bp, rice(Oryza sativa)
  misc_feature (71): n=t or g
gtagcgtcccgagaactgacaccgcgaacagctagccatagtttcatcccagattttaattgggctgtttnttattccaagggaaaaagatagagcaataa

SEQ ID NO: 19629 - DNA, 101 bp, rice(Oryza sativa)
  misc_feature (71): n=a or g
ttttccttgatcttttgtcgaaattgatccttcatgctttctttggaattcttgcgatgggccatttgagncatgcatacctgatattaaaagtaaagaag

SEQ ID NO: 19630 - DNA, 101 bp, rice(Oryza sativa)
  misc_feature (71): n=a or g
agtcacaactcctctcctccatcttctcctcaccacccagtaccaacaactcatctgtctcgagacagacnatgagggtgtcgaactaacagcttagcaaa

SEQ ID NO: 19631 - DNA, 101 bp, rice(Oryza sativa)
  misc_feature (71): n=t or c
ttcaattattcctgccttggtctccagtgtacttaaatcaaagacggtgaacggctgaaaataaaaaaatnaggtgcatcgactagatgcacctaattagg

SEQ ID NO: 19632 - DNA, 101 bp, rice(Oryza sativa)
  misc_feature (71): n=t or c
cacatcttttcctgcattcgataaaccctgccctttaaaacctgaaacttttgtccacatcctctctctgntattcttgaaggcacccaatttgctgatct

SEQ ID NO: 19633 - DNA, 101 bp, rice(Oryza sativa)
  misc_feature (71): n=t or c
tggagattgttagttgaatattgttgtgatccaattgattcagagatctcagagaccgcgtcatgacgagnacatatttgatttctatcacataaagggtg

SEQ ID NO: 19634 - DNA, 101 bp, rice(Oryza sativa)
  misc_feature (71): n=t or c
ggttactttgatatgagtctaatccgaggtataaaatgcagtggggcatgatgaagaatggttagaatggnttctcttcaaaatctgtgttgaggagcaaa

SEQ ID NO: 19635 - DNA, 101 bp, rice(Oryza sativa)
  misc_feature (71): n=a or g
gtatccatctggagctactgtcatcggactcttggtattccgggcttccttcagcgtcggcatcactatcnacactcctcaaccgtgtagttgtagctttg

SEQ ID NO: 19636 - DNA, 101 bp, rice(Oryza sativa)
  misc_feature (71): n=a or g
gatatcaatgtggtggtcctcatgataccgcgccttgaggtacttgacgtcactagccgttttcttcaccnaattccgtaatcggcggttctttttagcct

SEQ ID NO: 19637 - DNA, 101 bp, rice(Oryza sativa)
  misc_feature (71): n=t or c
ccaacatgttaacctccagtttcgtcttcaacctagattaccaggagacgcagagcttcgacgtcggcganaacatcgccaaaagcatcgacgagcactgt

SEQ ID NO: 19638 - DNA, 101 bp, rice(Oryza sativa)
  misc_feature (71): n=a or g
ggtgatatgaaaacattcctgttcaagttatatcctgaagcatccattttccgccctacaggagggaacanaaacctccaatgggtatgctctgttcaatt

SEQ ID NO: 19639 - DNA, 101 bp, rice(Oryza sativa)
  misc_feature (71): n=t or c
atatcatgtgtacgcgggaacacgacacatatatcaatcgatctgtcgacccctttgttttttctttccangctagaaaaagtgtagcttgatcgatatat

SEQ ID NO: 19640 - DNA, 101 bp, rice(Oryza sativa)
  misc_feature (71): n=a or g
attagtctactactccatctgtctcagaataagttaatctaatacgacacgagatgtggcatattttagantctgcttagggagcctctatcaactacagt

SEQ ID NO: 19641 - DNA, 101 bp, rice(Oryza sativa)
  misc_feature (71): n=t or c
agcacacactgccccagtggagtcatattcacgttgtcacctccattttctagctcagtatcccagtcctngagaagttggttcagtgagcggctatagtc

SEQ ID NO: 19642 - DNA, 101 bp, rice(Oryza sativa)
  misc_feature (71): n=a or g
tacttgcttgaatagtattatattcctacaacataagctaatgaacagttttttttcattgtagcggggcnaaatttggatgggattaagctggttgattg

SEQ ID NO: 19643 - DNA, 101 bp, rice(Oryza sativa)
  misc_feature (71): n=t or c
ggttctgcatggttagaatttttacacctgacaaaaatgttgacatggaacgtctttgtgcagttgatggnaaacaaattggtgctgtccagagcaaagat

SEQ ID NO: 19644 - DNA, 101 bp, rice(Oryza sativa)
  misc_feature (71): n=a or g
aaaacatgtgattcaaaaggacatagaagacagcaactgtctggacgaaaggttgatgttcggaaactccntagcgcggatgtgaatgatgcagttgaact

SEQ ID NO: 19645 - DNA, 101 bp, rice(Oryza sativa)
  misc_feature (71): n=t or c
agttcccttttccaaacagagggagtgtgcccagaacagtgagcacattgacatgtagatttaaccatganaggaacctcacaatgcactcataaatttga

SEQ ID NO: 19646 - DNA, 101 bp, rice(Oryza sativa)
  misc_feature (71): n=a or c
tactggtcattcatgcccgttagctgtatctcttcatagtatcaagatgcatgtgtagtcgaaattctgcngcttaaatagcctaatagtacccatattag

SEQ ID NO: 19647 - DNA, 101 bp, rice(Oryza sativa)
  misc_feature (71): n=t or c
gatcgattaaatccaataggatgtgaagttcatcttgattcagctgtgggggttgaggggaggggaagctngacagtcggctggagttaacctcattaggg

SEQ ID NO: 19648 - DNA, 101 bp, rice(Oryza sativa)
  misc_feature (71): n=t or g
agaaggacgccgtctacgtacatgccgtgacaacgcctccaagtcaaaaccggcgtgccttacaagtcagnccatcgccagttgtcgagccgtccgggtgc

SEQ ID NO: 19649 - DNA, 101 bp, rice(Oryza sativa)
  misc_feature (71): n=a or g
atttaaacttcggaatcagatggcctttgcctccttgatgtcctcctaagggcttttacagtgggcagagntgtaagttcagccttaacaaagccgggtcg

SEQ ID NO: 19650 - DNA, 101 bp, rice(Oryza sativa)
  misc_feature (71): n=a or c
catagtgtgaaggggcatgatccctgggctgaatggtttgagcgtgtgaacttaccaagatcccttttaanatcttcacaagaatggggtggtgtactttt

SEQ ID NO: 19651 - DNA, 101 bp, rice(Oryza sativa)
  misc_feature (71): n=a or g
gccttattcacaaggattacatataggagtattgtatcgtggtatttctgttggtatatgtcagggttacnggttaggtatatcctttacccttcgatata

SEQ ID NO: 19652 - DNA, 101 bp, rice(Oryza sativa)
  misc_feature (71): n=a or c
attaaaaacatgtcgatgtcctacgataggtaaaaaagaaggaatggaatatcactcgctggacccttganagcagcagccggtagaattaaggagcaagg

SEQ ID NO: 19653 - DNA, 101 bp, rice(Oryza sativa)
  misc_feature (71): n=a or g
tggatgatatcttgcgatgagcataggcctatttatttttctaccctaccaaaccaattaattaaattttngcactaccaattttttttagggcaaagtta

SEQ ID NO: 19654 - DNA, 101 bp, rice(Oryza sativa)
  misc_feature (71): n=t or g
aatgtacagtggtggcctccttggaataccagatggtttttttgaacagtgcagtagcctctgcgtgctgnttctctcctgttgtgccttcaactttgtat

SEQ ID NO: 19655 - DNA, 101 bp, rice(Oryza sativa)
  misc_feature (71): n=t or g
ttctggtttgaggagtgatgccataaatctgaagaaatttgagcgttcgctggtgaaggtacagttatttnagctattaacatcttttactgtgttcatat

SEQ ID NO: 19656 - DNA, 101 bp, rice(Oryza sativa)
  misc_feature (71): n=a or g
acgtctgcgaactggtctggttatagggatagttattggctcaatggctgctgcttgtggtgtacttttcncgttggtactgtgccttcacaatgtccgga

SEQ ID NO: 19657 - DNA, 101 bp, rice(Oryza sativa)
  misc_feature (71): n=a or g
caaccttttgagacgatccacgtttttcaacatgaattccctgagctgtatgctggcagaaatgcgagttntcggttgtgggttacccacaaccaccggtg

SEQ ID NO: 19658 - DNA, 101 bp, rice(Oryza sativa)
  misc_feature (71): n=t or c
gagcacttacttgggttgattaactgtcctgtgcttctctcaaatagatccaaagcctcctttattcttgntgcttgatcaatattagctttaaagaaaag

SEQ ID NO: 19659 - DNA, 101 bp, rice(Oryza sativa)
  misc_feature (71): n=t or c
gtgccagtcactttgtatcctatgaagctaactgtagcattcatttgtcggtctgttgtacacctacctgngtgccttgtgggcgttgtgctctagccatg

SEQ ID NO: 19660 - DNA, 101 bp, rice(Oryza sativa)
  misc_feature (71): n=a or g
tcttataacctaaaacggaagtagtagtaaagatggataagcgctatcttcaatggattgtcattcaagcncacccgttggccaaatttggccactcatct

SEQ ID NO: 19661 - DNA, 101 bp, rice(Oryza sativa)
  misc_feature (71): n=a or g
taaatctatttcaaccaatcatgcaacatcgtgcagaatgagagcaattcataccacatccgttataaccnttttaagttataagactttctaacattgtc

SEQ ID NO: 19662 - DNA, 101 bp, rice(Oryza sativa)
  misc_feature (71): n=t or c
cataacaaaaaaagatctactttaggatgccaaaacctacatttaagcagaaacgctcaccatggcgcggngctccggggcgaaccccgggaagcctccgg

SEQ ID NO: 19663 - DNA, 101 bp, rice(Oryza sativa)
  misc_feature (71): n=t or c
gaatcgcctgataagttcaacgggtgaatgagctgcttggattttgggttctatcgataaaccataacaanaacaacaaacaagcacctgtttcttctaac

SEQ ID NO: 19664 - DNA, 101 bp, rice(Oryza sativa)
  misc_feature (71): n=t or c
tttataactctctgttccctcatgtgcacaaccggcatgagagctagcggcatcagagcaggtacaatatnagactatataagttagctataaacatattt

SEQ ID NO: 19665 - DNA, 101 bp, rice(Oryza sativa)
  misc_feature (71): n=t or g
ccttttctcccagagaccacgtttttctctagtcatcacatgcccaagttaatgatctcgtcatgaagccntgatctccggggtggccggcaatgaggacg

SEQ ID NO: 19666 - DNA, 101 bp, rice(Oryza sativa)
  misc_feature (71): n=a or g
ttttccaaataggaaccctcaatacagaggtggcacagtaagtcatgcccacgtgggccacaaactagctngcagtccgcatggcccaacttgtggctcta

SEQ ID NO: 19667 - DNA, 101 bp, rice(Oryza sativa)
  misc_feature (71): n=t or c
cgaaaccccccgtcacccagatcgaagaagccaatcaagaaaacaaaccccaagcacagcgagaggttagnaaaaccaaccttgcttgcttcttgattcgt

SEQ ID NO: 19668 - DNA, 101 bp, rice(Oryza sativa)
  misc_feature (71): n=t or g
gaaagtggcaagagtattatttacagtcttcgagactgtaaatgtccgcatatattagaaggagaagtgtnggttacatagttattacaagtggactatta

SEQ ID NO: 19669 - DNA, 101 bp, rice(Oryza sativa)
  misc_feature (71): n=t or g
taagtgtatcgcatgattgtgaaacctgttaagtttttgatagaggctggagccatggtctgtagcagaanttaaggtttctggtgatctggagctcctgt

SEQ ID NO: 19670 - DNA, 101 bp, rice(Oryza sativa)
  misc_feature (71): n=t or c
taaactcgcccataaatagacacctaattaagcttccatcgatcaactcatcacttcatatccaactctanctcacttagcctgagctgagcaatggggct

SEQ ID NO: 19671 - DNA, 101 bp, rice(Oryza sativa)
  misc_feature (71): n=a or c
actatagaatgcacaccataaagtcaaagatatttcagctagtagctgcctacagatgcactccatttcgngcggctattggcatgtgatcacaaaagtgg

SEQ ID NO: 19672 - DNA, 101 bp, rice(Oryza sativa)
  misc_feature (71): n=a or c
tgccctatatgggccaaagatgtcagcctgtccactattttcttttcttgtcctcttcctgcctatgcttnctcgccgctgctgcctggcaccagattgcc

SEQ ID NO: 19673 - DNA, 101 bp, rice(Oryza sativa)
  misc_feature (71): n=a or g
ctttatctggattggcattcacatggttttcttcattaccctataattctgttcagagttgggctgatctngataagcagtttcatagttatttttacagt

SEQ ID NO: 19674 - DNA, 101 bp, rice(Oryza sativa)
  misc_feature (71): n=t or c
aagttgagtattattggcgacggtggccaccattggggcggtctcaactcagctatatatatatatgcccngactacacttatgatattgtagcaaactct

SEQ ID NO: 19675 - DNA, 101 bp, rice(Oryza sativa)
  misc_feature (71): n=t or g
gtaagggagaggaagtgagtggcgcgactgcaaggatagcctgtgcagaaggggctgggatggagataganatagagagagagagcataaccctgccattc

SEQ ID NO: 19676 - DNA, 101 bp, rice(Oryza sativa)
  misc_feature (71): n=a or g
cactgcgtcgctcccactctcgcacgcggcaaaaagaaaataaaaaacaaacaccgcaacacgagtacacnactcgtgctagcattggctgtcgccgtagc

SEQ ID NO: 19677 - DNA, 101 bp, rice(Oryza sativa)
  misc_feature (71): n=t or c
ggcaggcctttaagagacctgcctacgagtctgacctccatcctctcttccctctaaacatctttaatttnttccctcaaaaaacatttttcatttttttc

SEQ ID NO: 19678 - DNA, 101 bp, rice(Oryza sativa)
  misc_feature (71): n=a or c
tgtattggctaatactccgatacgactttatattaagatgctagggcaagtaaaatatactagacagaagnctaatatacttaaatgtaacaagatcttaa

SEQ ID NO: 19679 - DNA, 101 bp, rice(Oryza sativa)
  misc_feature (71): n=t or c
ccgctctccagccctccccctcgtcccctaccattatataaaccccttccacaaccccctctcccatttcngccacttaccatccacactcgacccgaaac

SEQ ID NO: 19680 - DNA, 101 bp, rice(Oryza sativa)
  misc_feature (71): n=a or c
cccaaacgaattgccccagacgggccgaacctccgcacgtgaaaatctgattcgaccgcacgggaaaatgntctgtgtagtagtacaatagcaggctataa

SEQ ID NO: 19681 - DNA, 101 bp, rice(Oryza sativa)
  misc_feature (71): n=a or c
ccatgggccacatccgacgagggtttatcacaacgacatgggttgaaggaaggaggggctgggaggatgcnacagccgctgctgctctctggcaggcatgg

SEQ ID NO: 19682 - DNA, 101 bp, rice(Oryza sativa)
  misc_feature (71): n=t or c
aacaaaaggtcttcagggatgatatctgatgaaacatttccaatgcgattttgcagagatgttcggtcgangacgatgaattcccgtcattcaagaagaca

SEQ ID NO: 19683 - DNA, 101 bp, rice(Oryza sativa)
  misc_feature (71): n=a or g
ttttctcctgtctcacttgtgataagggtagaaagttgaggatacacacctgaactactctcatcagatgncattggaacattattctttcgaatttttgg

SEQ ID NO: 19684 - DNA, 101 bp, rice(Oryza sativa)
  misc_feature (71): n=t or c
tatttttgtttgatcacaatagattaagtcattgagtagctatccttggagctggctatgacctatgtacngttcctgataatattttagaatatgaaatg

SEQ ID NO: 19685 - DNA, 101 bp, rice(Oryza sativa)
  misc_feature (71): n=a or g
aagaaataactagttgaacttgaatattaaaaggcttcttggttgacaaccgcaatacattgtcgcatttncatgtggttaatttctttgatatggctttc

SEQ ID NO: 19686 - DNA, 101 bp, rice(Oryza sativa)
  misc_feature (71): n=a or g
aaagtgcgtacgaatttgcagtgcaaattccttttgtccatgaaaacactacataaatatcgctcctctcnttctaaaatataataacttttagtgtttaa

SEQ ID NO: 19687 - DNA, 101 bp, rice(Oryza sativa)
  misc_feature (71): n=a or g
ttatgttgctagctagggtgctaggcatgcaatatatattacagtatagcttgttattttaaagagtgaantgtatgggcagtccttaaatttgtacgaat

SEQ ID NO: 19688 - DNA, 101 bp, rice(Oryza sativa)
  misc_feature (71): n=t or c
ccgcacacccggctaccaaacacatcaaagaaaatgtgggatcaatacatacatacacccaaagggctaancttccatgactgcaattaacatatcaacta

SEQ ID NO: 19689 - DNA, 101 bp, rice(Oryza sativa)
  misc_feature (71): n=t or c
tgcctcgaatatatatgtaaacagtagagataccttgccattcttttcatggtgtattttctggaaacatncatagcaaatggccagtagtcgacagcgtg

SEQ ID NO: 19690 - DNA, 101 bp, rice(Oryza sativa)
  misc_feature (71): n=a or g
atgccaatagccatcacactaccacagtcccaccagcctactcaactgatccatgtactacctccgtcctnaaataagtgcagctgtggatatccgtaccc

SEQ ID NO: 19691 - DNA, 101 bp, rice(Oryza sativa)
  misc_feature (71): n=a or g
gcttgaacatttttcgcaagtacagtggtccagttgacatttggctatcttccaccctctcctcaagctcnaaacaaccaacttatactcttgttaataat

SEQ ID NO: 19692 - DNA, 101 bp, rice(Oryza sativa)
  misc_feature (71): n=t or c
cttcactgctgtgctagaggagagaatggtagagagaatgcgagccgacgatataattatcgcccggctgnagcacgctgtacaatgaagaaataaataag

SEQ ID NO: 19693 - DNA, 101 bp, rice(Oryza sativa)
  misc_feature (71): n=a or g
agaatgttggataagtgtagaattgaagagctggtgtaccttccggtttcatgaaacgttactgttgcttncgaatttttatgtgccatgcttaatatttg

SEQ ID NO: 19694 - DNA, 101 bp, rice(Oryza sativa)
  misc_feature (71): n=a or g
ttcaaccatatgagagagagagttgataagagttgtaggcataccattcttttgggtaatctaggcgtgcnatcttggaaattagtacagctagctgaagt

SEQ ID NO: 19695 - DNA, 101 bp, rice(Oryza sativa)
  misc_feature (71): n=t or g
tccatacacaccgtcaccgagcaacctgtcctggatagcctaatgcagtacaacccacttagcttaatcancaaacaaacatcgccacaggaactatggtt

SEQ ID NO: 19696 - DNA, 101 bp, rice(Oryza sativa)
  misc_feature (71): n=t or c
atagttttgttttagtggatagcatgagatgtgcacacaagagagtgtgttgcactatactccgatccctntatcccaaaataaacaaacctcatactgat

SEQ ID NO: 19697 - DNA, 101 bp, rice(Oryza sativa)
  misc_feature (71): n=t or c
cactacctcgacgcctgcttcctctgcaagcgcgacatcacttcaaccgccacatcttcttgtgtaagtangtaccacgatcttaattaattttctctcgt

SEQ ID NO: 19698 - DNA, 101 bp, rice(Oryza sativa)
  misc_feature (71): n=a or g
tggggagagggagtggaagaggaaggggaagcggtggagaggaggaaacagagaagagcaaaaaggagtgntgcggtgagaagaggagaaaataaaggtgg

SEQ ID NO: 19699 - DNA, 101 bp, rice(Oryza sativa)
  misc_feature (71): n=t or c
ctttccccttgtctctctacacaagagccggccggaaacttcctagtgcttgatgttataaaactagcccngaaatcgacatcggtagctaaacacggaag

SEQ ID NO: 19700 - DNA, 101 bp, rice(Oryza sativa)
  misc_feature (71): n=a or g
gtatgcagtgaagtttatggaattatggaggctaagagttagaggtttgaatgggttatcaaatggggacnagtcgggaagttcatctgaggggtattcct

SEQ ID NO: 19701 - DNA, 101 bp, rice(Oryza sativa)
  misc_feature (71): n=t or c
tccggccgaccgacgaaagatggtttctccaccagtgtaagtcgcataaatagaggatggtgaggggtgangatacgaacgaagcagtagctctgttggcc

SEQ ID NO: 19702 - DNA, 101 bp, rice(Oryza sativa)
  misc_feature (71): n=t or c
agaaaagcttataatcacactgatgtcaaggttacatataccttgctttgttgtactgctgtcctagagtnatacggacctaccttacagaaaatcttgac

SEQ ID NO: 19703 - DNA, 101 bp, rice(Oryza sativa)
  misc_feature (71): n=t or c
ttgtagcttaaccatgccatatcttgctcctccttggtaagcctttcttcttcattttcttgcagaagggnttcatgttcatggtaacttgcgatccacct

SEQ ID NO: 19704 - DNA, 101 bp, rice(Oryza sativa)
  misc_feature (71): n=a or g
atagaagggaaagtgtggtaattgccaatccgattttagtgaaggtcatcatcaacatctctagttccccngtttctagtacagcttaccgtgggtgtctc

SEQ ID NO: 19705 - DNA, 101 bp, rice(Oryza sativa)
  misc_feature (71): n=a or g
cagggtgtagttcacgttggggttgctcctgctgcattgcccgcacgtctcctccactatatcctcgcccnccgccgccactgccgccggcgacgacgcaa

SEQ ID NO: 19706 - DNA, 101 bp, rice(Oryza sativa)
  misc_feature (71): n=t or g
aatggcaaaacttgaaaggtgccatgcatagggaaaaaaactgtcatgctaaacaggaaaatacatacttngtgtcaactacttcgtgggttattatattt

SEQ ID NO: 19707 - DNA, 101 bp, rice(Oryza sativa)
  misc_feature (71): n=t or c
tgctcacagttgtcctcttgcctcgtcgtgtcgcacctcatgatttacgttgttgtagtctctttttgatnaccaacaatttctattacattttgactctg

SEQ ID NO: 19708 - DNA, 101 bp, rice(Oryza sativa)
  misc_feature (71): n=a or g
aaaaataaatttcagtttgatttttctatatagccggtttatcgagtggtttcttaatttgtacgggctcnattataataacaataatcaagcggttaacg

SEQ ID NO: 19709 - DNA, 101 bp, rice(Oryza sativa)
  misc_feature (71): n=t or c
cgtcccgaacttaaatgagatagatataaaattcttgcaatgacattatccttcttggtgtaatccctaangaaaataggcaaaactccctgtcatgaaga

SEQ ID NO: 19710 - DNA, 101 bp, rice(Oryza sativa)
  misc_feature (71): n=t or c
acagcttcgagaccatcgtgatgcactgatgatgatcattgatcacccggaatgattattgccttcgtttntgtgtttaagctatagcaagtactactaat

SEQ ID NO: 19711 - DNA, 101 bp, rice(Oryza sativa)
  misc_feature (71): n=a or g
tggttggaaacaaaagtgagagatttgctccagttaaacattgtatcttctttatctccaggttgaaaagngtgctaaggtggaccttccattttggcttg

SEQ ID NO: 19712 - DNA, 101 bp, rice(Oryza sativa)
  misc_feature (71): n=a or g
gcttacgacgggtgccgcgtccggccgtgcctgcagtgtggttgatcatcatgcgtgcaatgcatatgccncgcgcagatatctcgctccatcgatccgtc

SEQ ID NO: 19713 - DNA, 101 bp, rice(Oryza sativa)
  misc_feature (71): n=t or c
ttccactaaacttcagaaagaggtttatcacttagatacttattacttatcaactgttgccaagccccttncgtggagagtaacttaatcacttactaagc

SEQ ID NO: 19714 - DNA, 101 bp, rice(Oryza sativa)
  misc_feature (71): n=a or c
aacccatgtatagaaagaaattaacaaacacaactagtgattgtatcgacaacaaaccttttggacccgtntagggtatcgcagatgttatggtacagccg

SEQ ID NO: 19715 - DNA, 101 bp, rice(Oryza sativa)
  misc_feature (71): n=a or c
aatagctcagcaagtacagtgcccgagcttggtgaactaaccagtttgagggacctcaaaataagtttgtntgataaactcagcaagtgcaagacaaaaga

SEQ ID NO: 19716 - DNA, 101 bp, rice(Oryza sativa)
  misc_feature (71): n=a or g
tggaagagacctaggttttcttctgtaaaatctccagatctgctctgtcaacatggtgcgtggtgctcggnctgcggaagaacctgtgttggaggaggtgc

SEQ ID NO: 19717 - DNA, 101 bp, rice(Oryza sativa)
  misc_feature (71): n=t or c
tcggtgttggcgagctcaaactctgcctctccaagagcctcttccatgcactggcggcctcgagctttgantaaccgcctcctcctcaatgtgccggtgag

SEQ ID NO: 19718 - DNA, 101 bp, rice(Oryza sativa)
  misc_feature (71): n=t or c
acatcggttgtgatcagagttaaagaatttaatgtagaaaatcttaccggtggagttggtttagctagtgntagtgccgatttcttcttcacaacagtttt

SEQ ID NO: 19719 - DNA, 101 bp, rice(Oryza sativa)
  misc_feature (71): n=t or g
gactagtgccagaacagccgatatcagcaacatcagctatgattaagcaggaggtgtcagcatcggcacanaatcaacctggattcaatcctcaagttctg

SEQ ID NO: 19720 - DNA, 101 bp, rice(Oryza sativa)
  misc_feature (71): n=a or g
tgagagtggactgaagagagctctcttcttacacatgtagtcaaagccacaatcttggagcaccaaatganttgcaaaacaagaaatacaatggaaatctt

SEQ ID NO: 19721 - DNA, 101 bp, rice(Oryza sativa)
  misc_feature (71): n=a or g
tgggaccaggttttttcgttttctttttaatcccgatatatacacatatctgccagtggactcgctcccgncatgtgcaccataaaaacacgaggatagtc

SEQ ID NO: 19722 - DNA, 101 bp, rice(Oryza sativa)
  misc_feature (71): n=t or g
agaaattaatgtagagagaatcagaccagctagggaggagtagaaccatgcttcgacgtaagaacaaaatngtttgcattggcatgcatgcctcgccatcg

SEQ ID NO: 19723 - DNA, 101 bp, rice(Oryza sativa)
  misc_feature (71): n=a or g
catgagtgacaagttgctacaagagcttgaacccctcaacttaggaattgtagaacacgggtacgtggctncccttgaggcacagcccatgctcgtggacc

SEQ ID NO: 19724 - DNA, 101 bp, rice(Oryza sativa)
  misc_feature (71): n=a or g
tgcagcagctgcagttgcagatgcctctacattttgggcagatccaggcttccatctgtcccacttcttcntcattctcatcatacctaaaagaattagtc

SEQ ID NO: 19725 - DNA, 101 bp, rice(Oryza sativa)
  misc_feature (71): n=t or c
gatcgatctggacaaagagacgaaacaagccaagaccatccggaggagcagttcaagggtgtcgccgccgncgcagctaagcgagttgcctagacgcgtcc

SEQ ID NO: 19726 - DNA, 101 bp, rice(Oryza sativa)
  misc_feature (71): n=a or g
gctcaagcaggtccgtctccttcctctcccatctcatcccccaagaatcttctctcccaccaatttgaatncgatagtgagcaaaaagaaaagggggcgga

SEQ ID NO: 19727 - DNA, 101 bp, rice(Oryza sativa)
  misc_feature (71): n=a or c
tacttaaaactctactactagtctagtagtaccaaattatttggtaaggctgggattagatgacatggatntgatgtaggtagctttttttagaggatgta

SEQ ID NO: 19728 - DNA, 101 bp, rice(Oryza sativa)
  misc_feature (71): n=t or c
cggttttttaatgattaaaaaccaatacttgacagtcttgcaataatgtggacggcagatgagaagacccngaaaacatgggaatgcaataagaaaaatac

SEQ ID NO: 19729 - DNA, 101 bp, rice(Oryza sativa)
  misc_feature (71): n=a or c
gggagaggaaagaacacgagcaagtacagctgagattttttttctctccagctgggtggagtgatgagtcnctttatccccttcgtacttggatgatggag

SEQ ID NO: 19730 - DNA, 101 bp, rice(Oryza sativa)
  misc_feature (71): n=a or g
gggagaaaataaaatttctaagtaggccctaattgttagtcggtgtaggattgatgatggtgtcacgtcancgtttgtgtgatggaatttaggccgtcgat

SEQ ID NO: 19731 - DNA, 101 bp, rice(Oryza sativa)
  misc_feature (71): n=t or c
catatatggacaggcaacggcatgtcgtgttcgtacaaatatcttacatcgtgtgggcacagatgatccanagccgtccggcagtaggggtctcgcatcct

SEQ ID NO: 19732 - DNA, 101 bp, rice(Oryza sativa)
  misc_feature (71): n=a or g
tggcgcttgagcggtcatgtttttcagcagtggtttcaatgaggccatgatatctgcaaatgatggccgcnattttgggtccctacaccaaatacaggaag

SEQ ID NO: 19733 - DNA, 101 bp, rice(Oryza sativa)
  misc_feature (71): n=a or g
accgtggaacgtccatcggacggtcagtactcagtagagacaaaagtggccaaccgggggattaaacaatntccgagggtttttaggagaaagtaccaacg

SEQ ID NO: 19734 - DNA, 101 bp, rice(Oryza sativa)
  misc_feature (71): n=t or g
taccacaggtgttatgacttttggcatttaaccatagggttttgtggtttaaatgtttcataaacccgccntcattcataatttgattaatttcagcatat

SEQ ID NO: 19735 - DNA, 101 bp, rice(Oryza sativa)
  misc_feature (71): n=t or g
gttcttcctgaggggacgaacggtgagattgcgctttcgctatgcgcttatgtgtttcgctatttttcctngctcgacgcttaatatggctacacctttta

SEQ ID NO: 19736 - DNA, 101 bp, rice(Oryza sativa)
  misc_feature (71): n=t or c
tggctcaacatacagagacgactagttgcatatagtcgggactcaggcgggcaagtggtgggccatctcgntgttggagggggagagcgcgaaccctactc

SEQ ID NO: 19737 - DNA, 101 bp, rice(Oryza sativa)
  misc_feature (71): n=a or g
atttttccacaaaagtaagatataatgtagatgaacggtcaaatttgatcacccatggagaaaaaaacacnataaattttattgcaagtgcattaaaaaat

SEQ ID NO: 19738 - DNA, 101 bp, rice(Oryza sativa)
  misc_feature (71): n=t or c
gttcaaccaaacctgagcaataatcttactacttaccccgattctccctcccctaaactagctacagcacngtgtcaggtactcatgaatcaatgtacagc

SEQ ID NO: 19739 - DNA, 101 bp, rice(Oryza sativa)
  misc_feature (71): n=t or c
ctgaagaaacgggtcacgtctactcagcgtcaactgtgcagaagatgaccgaatacaagcccacgactggntagcatttcattgttctattacaatcgctt

SEQ ID NO: 19740 - DNA, 101 bp, rice(Oryza sativa)
  misc_feature (71): n=a or g
agaaagttaacctcactccgagtgccatgaaaatcatggaaaacaatcatctggatgcttgaccgaatgcnctcgatgggaccagactcctgccagaactt

SEQ ID NO: 19741 - DNA, 101 bp, rice(Oryza sativa)
  misc_feature (71): n=t or g
gagcaagacttgacgatctcttgcatatccaacggtcatcgatcgatcagtacttgaagagatcggagctnaggtatctgtcggcgccgcttgggagcatg

SEQ ID NO: 19742 - DNA, 101 bp, rice(Oryza sativa)
  misc_feature (71): n=a or g
ctcctcatgggtatgatccaaatgtcttctttcatccgcagtatgcctattttggaatgcaatccaacgantacttcaacccggtacttggggctattaat

SEQ ID NO: 19743 - DNA, 101 bp, rice(Oryza sativa)
  misc_feature (71): n=t or c
atcaacttcttgtcgagatggatggttttgaacaaaatgaggtaaccttatcacatatttaacagtccatnacacagaggactttatgtaaattgtgtttt

SEQ ID NO: 19744 - DNA, 101 bp, rice(Oryza sativa)
  misc_feature (71): n=a or g
cgcctgggtcccctcgctcgtcccgcccggccgcctggtgagaaactgatgagaagtgaggctttcccacntaaaaattttacaacatttgaacacctgta

SEQ ID NO: 19745 - DNA, 101 bp, rice(Oryza sativa)
  misc_feature (71): n=t or c
attttaaggtatgatccacaattagttgtacaccattatttgtagacgtaaaattatgcccatttaaattntttacctttttgtgttcaccaaataggatt

SEQ ID NO: 19746 - DNA, 101 bp, rice(Oryza sativa)
  misc_feature (71): n=t or c
acaccttcttctccccacacgccatcgctgccttgcttcctcactagagcagttgcctccaccgtcaacanacttgcttcctcgccgggatctccaccctt

SEQ ID NO: 19747 - DNA, 101 bp, rice(Oryza sativa)
  misc_feature (71): n=a or g
ggaaggaattagtttggcctgtagaaaatgcaaaaaaaagtgctcggtgcctctccttactcgttgactcnaagacaactgagcttccaacagaattgttt

SEQ ID NO: 19748 - DNA, 101 bp, rice(Oryza sativa)
  misc_feature (71): n=t or c
ggtttggctatactctaggtgtactatcgatcgaccttgctataagctgagtctacacatggtaattaacngtacagctagagtgtgtcacggccccaaac

SEQ ID NO: 19749 - DNA, 101 bp, rice(Oryza sativa)
  misc_feature (71): n=a or c
atgggaatccaagcaattcaaaatccgaaatttgacccttcatcttaaaatctttcttaaacaaccgaganatacttgtatttagaatagaggaagtaaat

SEQ ID NO: 19750 - DNA, 101 bp, rice(Oryza sativa)
  misc_feature (71): n=a or c
tccatcgtagctttgacgcattagcaagcgaagctggtatgaatccctcaattttgttatttgacatgganaatctctcaaggtctagtaatgaataacca

SEQ ID NO: 19751 - DNA, 101 bp, rice(Oryza sativa)
  misc_feature (71): n=t or c
acgagcgtagatcggcaaagatacgtggagattaatttgcacacgcctaaaattaggtacgacgacgtctntctctcactgtttacgtcaagagcatatgt

SEQ ID NO: 19752 - DNA, 101 bp, rice(Oryza sativa)
  misc_feature (71): n=t or c
gtagtctaccactgtccgtacgaggctacagtattatactgtgtacaatagagtacgtacgtgcggtgtanagtactcgtgcggtacagtattttttggta

SEQ ID NO: 19753 - DNA, 101 bp, rice(Oryza sativa)
  misc_feature (71): n=a or c
cgtcgacatggacgtggtgaggatggaggcgtctcagctggcagaagccatcaagaagaagaagcagccgngcggggaagacgaggtcgttcggattgtga

SEQ ID NO: 19754 - DNA, 101 bp, rice(Oryza sativa)
  misc_feature (71): n=t or c
tttgacactcagcagtttttggcagaatgtaagacttgaccataagtacaccgggtgtatttttccatcanaaaccacaacatcatcaatggcgtgttcaa

SEQ ID NO: 19755 - DNA, 101 bp, rice(Oryza sativa)
  misc_feature (71): n=a or g
acatggatacatgaaaaacatcatgtaccccattcatagattccggtaactgaaggcgataagccaaactnccaactcgggcagtgataacaaatggacca

SEQ ID NO: 19756 - DNA, 101 bp, rice(Oryza sativa)
  misc_feature (71): n=a or c
acaatgggaaacttaattagatcaggtgtggcacagtataatattaatatcaacttggcagtctgcagttnaagtgaaactagccttgttctcaacttatc

SEQ ID NO: 19757 - DNA, 101 bp, rice(Oryza sativa)
  misc_feature (71): n=a or g
atacaaattgcaaaacatgttgtctgaggctgaactaccaattaaggttgaagaaattccatctgatgacnatggcactactgcttgcacgccaagtcctc

SEQ ID NO: 19758 - DNA, 101 bp, rice(Oryza sativa)
  misc_feature (71): n=a or g
tccccgtgcaggtgtcatccctaggacctcagaagcttcgcatgcacttccattttgcagctgggaggctnagggaagccggcgtcgtcatcgtgttgttt

SEQ ID NO: 19759 - DNA, 101 bp, rice(Oryza sativa)
  misc_feature (71): n=t or c
attcatggtcttaactcttaaagtcggtctccacgtatacgaaattaaagagtacgacatctaaatgatancacctccgttttttaatagatgacgccgtt

SEQ ID NO: 19760 - DNA, 101 bp, rice(Oryza sativa)
  misc_feature (71): n=a or c
aagcatggttgattctactttctcaatactcgttgttgtttatgctacatatttgtcatcgatgactattntatccattactttcgtagatcagtaatagt

SEQ ID NO: 19761 - DNA, 101 bp, rice(Oryza sativa)
  misc_feature (71): n=a or g
caaccatgatgtccttcagcgacattgttccattacaaacaccagctgagatttgtttttgtgtttctgcncggtctcaacttttcgttttctgtcctcat

SEQ ID NO: 19762 - DNA, 101 bp, rice(Oryza sativa)
  misc_feature (71): n=a or g
cctcaccggagagccgacaccagcgaatcaattgatcccgatggaagaatacaccatggaaggggtaattncacagtgggagcagcccctcgcagcagtgc

SEQ ID NO: 19763 - DNA, 101 bp, rice(Oryza sativa)
  misc_feature (71): n=a or g
tctagaatttttgcgttaaagcgaggacgagaacgaaaaacactgtaagacactttaacgcaaaaattccngaatcggatccttatccttataagctgctc

SEQ ID NO: 19764 - DNA, 101 bp, rice(Oryza sativa)
  misc_feature (71): n=a or g
cttttgacaacattcttaaatttgagatctgactcacttttgtcttttttcttgtgttccagttctccctncagatgtcgtgacacagcgggtcaaagacg

SEQ ID NO: 19765 - DNA, 101 bp, rice(Oryza sativa)
  misc_feature (71): n=t or c
gtgtgcggaaaccttctgaagcaaagtcctctcactgtctttgttttcatttcaactctagttggttgggngttgaaacaagtgatcaatgttatccaggt

SEQ ID NO: 19766 - DNA, 101 bp, rice(Oryza sativa)
  misc_feature (71): n=t or c
aggcggcaaaagggaagcaaatatttggtgtcacttaacagtggaaagacagactcgactccaacaccagntactaatctacgcagtctgaaagttgtatt

SEQ ID NO: 19767 - DNA, 101 bp, rice(Oryza sativa)
  misc_feature (71): n=t or c
tttctgcgtatatatctctagctagaaaaagtgatgccaattagcacgtttggattctcatcagggggttngttgatacatcgtcctgaacgtactaatcg

SEQ ID NO: 19768 - DNA, 101 bp, rice(Oryza sativa)
  misc_feature (71): n=a or g
ctcctacaccattgcagtgcaggcatggcatgtggttagttaccgaaaaacagtgagaactactggtgctngtgctaattcagggagccagaactaacagt

SEQ ID NO: 19769 - DNA, 101 bp, rice(Oryza sativa)
  misc_feature (71): n=t or c
gtttggacctgagcttgggtattggtttggacggcggctgctgcggccgcggctgctttgtcatattcggnttgtatttctctccttcgcttggtgtcttc

SEQ ID NO: 19770 - DNA, 101 bp, rice(Oryza sativa)
  misc_feature (71): n=t or c
cattctctaactatctagtttttaatccttttgtctctgtggtgctttatctttcatctactggggagtanaaaaaatttctgtttgcacatattattgat

SEQ ID NO: 19771 - DNA, 101 bp, rice(Oryza sativa)
  misc_feature (71): n=a or g
tttggtacaggccgactggttgcggcgacatagaattcttcaactgcaaccagcatgctagcataatcccnatccttgcgcgcttttcgcggcgccgcctt

SEQ ID NO: 19772 - DNA, 101 bp, rice(Oryza sativa)
  misc_feature (71): n=a or c
tttgtcaccattattattaggagaggacacacgagaaagagacagggatcgctcccattaccatctactantaggcatcaaacacaactaatacacacaga

SEQ ID NO: 19773 - DNA, 101 bp, rice(Oryza sativa)
  misc_feature (71): n=t or c
ggctctgctatcctttcatcatccttgaacaccttatgttggcttgtcagtctgtcgaacaggttgtgtgngctagattcttgaacacctcccttgcccaa

SEQ ID NO: 19774 - DNA, 101 bp, rice(Oryza sativa)
  misc_feature (71): n=a or g
taagtcctgtacttgatacacgtgctcacatcaacggctattttttcactgatagatgatattaacagcgngacgtccgtgataacttcgtattccggcca

SEQ ID NO: 19775 - DNA, 101 bp, rice(Oryza sativa)
  misc_feature (71): n=a or g
atttgaggaaagtaatattagataagggaatcaattttgtcccttgtaattagattaccatcggaccgccnaccgccctagctctatatagggggtgccag

SEQ ID NO: 19776 - DNA, 101 bp, rice(Oryza sativa)
  misc_feature (71): n=t or c
actgtgtgcagtgtagttgcgggccagggaatctcaagtaattttcagattgtaccttttctgtttaacangatattatatggaaccattatttgggtcgt

SEQ ID NO: 19777 - DNA, 101 bp, rice(Oryza sativa)
  misc_feature (71): n=t or c
aacttcgcggcgcagcaacaatatttgaaacgctagattacttgtaccgtgctactcttcgagccaaatgncgacgtatttgctggaccatggttggcgag

SEQ ID NO: 19778 - DNA, 101 bp, rice(Oryza sativa)
  misc_feature (71): n=t or c
aagaggagaaaggttccatgtgaacagcacttgcacatgggtaagccgattctaaaggacggggtaacccnagcagagagcacaaccacgcgcgtgccccg

SEQ ID NO: 19779 - DNA, 101 bp, rice(Oryza sativa)
  misc_feature (71): n=t or c
ccttactagatggccaagtgactaagaaggcaaaagattgaagctcttttgcaattagtttccagggcagntagaagcaaaacaattctagcacctaattt

SEQ ID NO: 19780 - DNA, 101 bp, rice(Oryza sativa)
  misc_feature (71): n=t or c
cgaataaaagcacaacaccactatagatctatacgttgctggatcttgcatgtgcgcaagcgtttcgaggnttcgagcaataaccacaagatcagctcgaa

SEQ ID NO: 19781 - DNA, 101 bp, rice(Oryza sativa)
  misc_feature (71): n=a or g
accctcctcctccatcaaagctctgagttgccttgcgccgccattggaaccaaccaagttcttctttgaanccacatacagtactccgtatgggggtcgca

SEQ ID NO: 19782 - DNA, 101 bp, rice(Oryza sativa)
  misc_feature (71): n=t or c
gagggctcatcagtcggccctagcttcaaggcgatcgacagcttcgacatcgtcgaggccctcaagaagcngagggcatcaagacgatctctacggagagc

SEQ ID NO: 19783 - DNA, 101 bp, rice(Oryza sativa)
  misc_feature (71): n=a or g
ccaaaataagttttcgcgcgggaaggagaggacaagcgcgggcaaggagtgagaaacggcgaacgaggagncactctctctcccttaaatccacatagcaa

SEQ ID NO: 19784 - DNA, 101 bp, rice(Oryza sativa)
  misc_feature (71): n=t or c
tcaaacacctggcccggccaccatgggtgactccgcaccttgccccagacaagctctggcggtgcaaaatnatggcctccctcatcctgaaaagtgcagtc

SEQ ID NO: 19785 - DNA, 101 bp, rice(Oryza sativa)
  misc_feature (71): n=a or c
gaaagttctgatcacgaaagtgaacatgtacaatgtcctgattttggtggcagcaacattactcctgatcnaacatatgtgtctcccgttagatcagatat

SEQ ID NO: 19786 - DNA, 101 bp, rice(Oryza sativa)
  misc_feature (71): n=t or c
ccttttggacttcagatgaggtatactttgcattttttggagcattttccaacacaacttctttaacctcnttattatatgatgccaaaagcttatctatt

SEQ ID NO: 19787 - DNA, 101 bp, rice(Oryza sativa)
  misc_feature (71): n=a or g
gtttactagtagttaggattgcaatcatcgtgccatgtcggtgagccggaaaggcatgcatatgatagctnggacgacgggtagctgatgtgatctgggaa

SEQ ID NO: 19788 - DNA, 101 bp, rice(Oryza sativa)
  misc_feature (71): n=a or g
ctacacatacatgcttcctccgtcttaaaaaaatcaacttcttgctacgataaatctgaacgtaacctatntttagatttagtcagaaatatgtttttttc

SEQ ID NO: 19789 - DNA, 101 bp, rice(Oryza sativa)
  misc_feature (71): n=a or g
ccttctaggactgcgacttctgagcacccttcttggtccctgcacaagagaaaaatgtttgtcttggtacnagaagaataaatacacagacaaaaaaacat

SEQ ID NO: 19790 - DNA, 101 bp, rice(Oryza sativa)
  misc_feature (71): n=a or c
caacgaaaattcagcttgcgagtgaaatgtttcagcgtcacaaaaacagttatcgcttcaagtaagccttnccaagagaagaatatagtatatcatgaact

SEQ ID NO: 19791 - DNA, 101 bp, rice(Oryza sativa)
  misc_feature (71): n=t or g
ggcgtctgctgaactggttgcagggcctgctgaattggggatccttgttgaataggctgcacaacctgttncctggacggtgtttgctgaatcggctgctg

SEQ ID NO: 19792 - DNA, 101 bp, rice(Oryza sativa)
  misc_feature (71): n=t or c
atatttaccatatagtataggctaatttacataattcttccactccgttatttctctctactcatcgacangtaaaatagggacaacatgtaccacattca

SEQ ID NO: 19793 - DNA, 101 bp, rice(Oryza sativa)
  misc_feature (71): n=t or c
tgcttctggttgaacaccctgttatttcgctccttccagatagtccatgttgcgagagtagcaatggtatngaaacctcgccgttgagagctcggtaaggt

SEQ ID NO: 19794 - DNA, 101 bp, rice(Oryza sativa)
  misc_feature (71): n=t or c
ctgcttgcttttgagttggttgctagctgcatcttagtttccaggttgtgaattagtacttcctttatccnaaaaataattaaatcctaaaaataaattta

SEQ ID NO: 19795 - DNA, 101 bp, rice(Oryza sativa)
  misc_feature (71): n=a or g
aactagtactgctagactattagttccgtagttttgttagcttttacaacttcttttttactacgagcgcngtttttaaagtgctaaaatgtacattttct

SEQ ID NO: 19796 - DNA, 101 bp, rice(Oryza sativa)
  misc_feature (71): n=t or c
acggtttgtgtgttttacctttgctgttttaacccaaatattcgtttgccctagtttggatgtctattcangggcttagaaaaaatggaatgaccaaatgt

SEQ ID NO: 19797 - DNA, 101 bp, rice(Oryza sativa)
  misc_feature (71): n=t or c
aattaaactacaaaatgcttgcacaacaccaaacagctaaagttgcttcttggaaattgctccacccattngccagatggtactgtgctgaagtatcatca

SEQ ID NO: 19798 - DNA, 101 bp, rice(Oryza sativa)
  misc_feature (71): n=a or g
tgtttcttcatgatttcttttttttttggggggagggggcggggggatgtttcatgatttcttcatgattngcgcagtcgaccgcgccgccgagttcgccg

SEQ ID NO: 19799 - DNA, 101 bp, rice(Oryza sativa)
  misc_feature (71): n=a or c
gtaatttatttattgacatgagtgctacggatttttgtgggaagtaaattctttactgggtggacaccagngggattcttttgctaaaaaaaatatatttg

SEQ ID NO: 19800 - DNA, 101 bp, rice(Oryza sativa)
  misc_feature (71): n=a or g
ggatgtgtactgtaacgtctcaatctcgtacaaccgttggaaaggcacatcagcgtcatacctgaaatgtntgtggctagcaggtgaaagcattgcacggt

SEQ ID NO: 19801 - DNA, 101 bp, rice(Oryza sativa)
  misc_feature (71): n=a or g
cgggaaaacgagaaccgttcccggcatcacgtctcttcacgacaacacaacaatgaagaacgaggaggccnctcgagccaagactgagaccgtggtcaccg

SEQ ID NO: 19802 - DNA, 101 bp, rice(Oryza sativa)
  misc_feature (71): n=t or c
gctaagttcttgtccggtgaggttgccgcgacagagacgatggagttaacatcgatcccgacatggttgcnatccttctcccattccttgttcatgtaggt

SEQ ID NO: 19803 - DNA, 101 bp, rice(Oryza sativa)
  misc_feature (71): n=a or g
cattgaatactaaaacgataaatatgaccaaaattatactcccttcgacttattttaagtgcggttgtggnggttttatgtccaacgtttaactgccgtcc

SEQ ID NO: 19804 - DNA, 101 bp, rice(Oryza sativa)
  misc_feature (71): n=t or c
aggttcagcagccacaagcgcatttcgcccagcggagccaaggaaaatttttgagatgactctcagtgcanctggcattctggtttctgatgctgcaggga

SEQ ID NO: 19805 - DNA, 101 bp, rice(Oryza sativa)
  misc_feature (71): n=t or c
catccatgtgcttcaatgcatatacgggtgcgttgtttcctcccatttcctaacttttacttcctcgctanctaaacacatgtttttgattgctcaaagat

SEQ ID NO: 19806 - DNA, 101 bp, rice(Oryza sativa)
  misc_feature (71): n=t or c
atttttccaagacaaccatggacttctgtttcctgaaactcttattttcctccgcgcgagatgaatgatcntccttgtttttctttccaaagatgttgtac

SEQ ID NO: 19807 - DNA, 101 bp, rice(Oryza sativa)
  misc_feature (71): n=t or g
ttgggtggggagtcggccagccgatctcctctccgaacgtgccgaccctcttcccagtcgcgttggtgacnccgtcgctgccgcatcggcctttgaccttc

SEQ ID NO: 19808 - DNA, 101 bp, rice(Oryza sativa)
  misc_feature (71): n=t or g
tgaacctactgccgtgaagatcgggccacccctcgtgagtgtattcgcatcacgtttgaagtcagccattntttccaatacctatattcttgctagccgtt

SEQ ID NO: 19809 - DNA, 101 bp, rice(Oryza sativa)
  misc_feature (71): n=a or g
agccagccagcagcacgggccacaactagcctttccactccacaactaagccactggtcggattggcaaancattttacaactatttatatcgaatttgga

SEQ ID NO: 19810 - DNA, 101 bp, rice(Oryza sativa)
  misc_feature (71): n=t or c
gttatttccaaatagccctgaaatagatcacctgtttggaactcgtggcctactagaaaaaatacccgtgngttgcaatgggtggaggctatgttaatctt

SEQ ID NO: 19811 - DNA, 101 bp, rice(Oryza sativa)
  misc_feature (71): n=a or g
gaggagtttagaaccttgctccttccgatgtgttcgctagaggaagttggtaactcagcgcacgaaaaacngagcggtccattagcgcgtgattacttaag

SEQ ID NO: 19812 - DNA, 101 bp, rice(Oryza sativa)
  misc_feature (71): n=a or g
catcgagttgtggtatctgtactccatccaatagtcatccagtgaaactaattccaacattgatttgaacntcttcgacttccatgtcatgtcacgagtgc

SEQ ID NO: 19813 - DNA, 101 bp, rice(Oryza sativa)
  misc_feature (71): n=t or c
aaacgagagctctgttatttttccttccaactcaacgagagcacttgggcagtggacacttgtcatgtaantgggccggatcggtatgcatattgagctca

SEQ ID NO: 19814 - DNA, 101 bp, rice(Oryza sativa)
  misc_feature (71): n=t or c
cacacacaacaccacaccacaacacacactaggattgagattggagacactaggccacagtgaagtaccantgaacgcgcacaggaaacgtgaagtaccac

SEQ ID NO: 19815 - DNA, 101 bp, rice(Oryza sativa)
  misc_feature (71): n=a or g
gcgccgacaacggagcgtggtaggacagagaagcccagggccacatctgcttatccctgctcgtgctacgnatggaggaactggaacggcgttggcggtgt

SEQ ID NO: 19816 - DNA, 101 bp, rice(Oryza sativa)
  misc_feature (71): n=t or g
tcattatttgctcctcccatttataaaagtagcagatatatgtattaggatcggagcatataaaatgtagnataattttattaggatttgataaaaaagag

SEQ ID NO: 19817 - DNA, 101 bp, rice(Oryza sativa)
  misc_feature (71): n=t or c
ggacggacttctgcgaaggattgaaccggtgagcccatagttttgcatcttgtaggcatgaatttatcagncgactgatggaaggtggaaggttctgaaag

SEQ ID NO: 19818 - DNA, 101 bp, rice(Oryza sativa)
  misc_feature (71): n=t or c
gattataacgtatgtagacacacaatgaaatgttgtatagtattcccttcatccgaaaatattagacttanttcatattttgatttttccaaataagttag

SEQ ID NO: 19819 - DNA, 101 bp, rice(Oryza sativa)
  misc_feature (71): n=a or g
aatagacaacaaacagtcctttccaaatataatcaagagctagcgatcaaagttctggctggaccacacancatacatgctgcacaagtgcacagtctaca

SEQ ID NO: 19820 - DNA, 101 bp, rice(Oryza sativa)
  misc_feature (71): n=a or g
tctgacacagcagatgtgatgcctcacaagaaggatcctgccttgcctaacagtatgaatgacacaaatcngaagagtcaggaggtcgacaagagtgggtc

SEQ ID NO: 19821 - DNA, 101 bp, rice(Oryza sativa)
  misc_feature (71): n=a or g
tgaaatgtttacttcagtatgctggtaatggtgttcgcttttttgtaatgtaaactgaatgcaattgctangccaaaaaccgagttgtattgttttgtttg

SEQ ID NO: 19822 - DNA, 101 bp, rice(Oryza sativa)
  misc_feature (71): n=t or c
attgggaccaaggaatagagatttttctacctatgaaaaggaatgtcatgagttactgttggcagtggatnagtggaggtcgtacttgcaatttggagaat

SEQ ID NO: 19823 - DNA, 101 bp, rice(Oryza sativa)
  misc_feature (71): n=t or c
gccaggaccatcacgcgcccggcacactggcgcagtactccatcaaagctctccccctctataccgacaanggcatccgatgcccaagccggcatcaccac

SEQ ID NO: 19824 - DNA, 101 bp, rice(Oryza sativa)
  misc_feature (71): n=a or c
cgcattctgctgtggtgcctttctgtgacgggctctacaggcatgccacagcttgggatgcattgaggaangatgcagcaacattggcccaagacgtaact

SEQ ID NO: 19825 - DNA, 101 bp, rice(Oryza sativa)
  misc_feature (71): n=a or c
tgtaatatttttggtcatccttgagattgcaacagctagctcagctcaaacttgattatcatcatgagtgnaatgaatgcaggcacatcggaataaaagta

SEQ ID NO: 19826 - DNA, 101 bp, rice(Oryza sativa)
  misc_feature (71): n=t or c
tatcagtgctcacgtacgtggtgtacgtacatgggtgcgcgtgtgggcaatgcatttaggtttttacatgntttgtagagtaaactggacctaaatacaat

SEQ ID NO: 19827 - DNA, 101 bp, rice(Oryza sativa)
  misc_feature (71): n=a or g
gcatgcatagaggattgctcttgtttacttactagctgattatctgtgttcttctgttagcaggctgctcnggaagaagcatgggcaaaggtctcagctct

SEQ ID NO: 19828 - DNA, 101 bp, rice(Oryza sativa)
  misc_feature (71): n=t or c
ttagtgcttctctgtgtagccctatcgctgcacctttcagtggtatactattgcatgacaattctctatanttgcattagttaattcctgtgattttgatg

SEQ ID NO: 19829 - DNA, 101 bp, rice(Oryza sativa)
  misc_feature (71): n=t or c
aggcggaaggacacgacaaaaggccacatctagtgcgaatattcggcgagtggtaggtttttggcgagtgnggctgcacggcacgggagagagagagagag

SEQ ID NO: 19830 - DNA, 101 bp, rice(Oryza sativa)
  misc_feature (71): n=t or c
gagtgcgcgcgcgggaggaaagttcaacgaagcgtcgaagcgagcccgtccacctatataaagctcgcccngtctccgcctcggcttaccattcaactcga

SEQ ID NO: 19831 - DNA, 101 bp, rice(Oryza sativa)
  misc_feature (71): n=a or g
tttaaaagcgatttcagtcgctaactcttattcgttagtcacccctttatttgattattcgatgtatcacnttttttttacattttatgacttctatttca

SEQ ID NO: 19832 - DNA, 101 bp, rice(Oryza sativa)
  misc_feature (71): n=t or g
atgactacatctggatccacgattaccacctcctcgccctcccgtccttccttcgccgtcggttcaacagnctccgcatcggtttcttcctgcacagcccg

SEQ ID NO: 19833 - DNA, 101 bp, rice(Oryza sativa)
  misc_feature (71): n=t or c
tctttttttcaatattattgcaagtggacgttattatggtccgtctataagttggtggaggattcgttcgnaaaaatcgattctatagtagtggatgcaaa

SEQ ID NO: 19834 - DNA, 101 bp, rice(Oryza sativa)
  misc_feature (71): n=a or g
tgatcaaagcaatatatatagtcatcgccacaaagttttaagtattcaacaaaggctagcagggttaaacntgcaaatccaatgttaaaaagctccaaatg

SEQ ID NO: 19835 - DNA, 101 bp, rice(Oryza sativa)
  misc_feature (71): n=t or c
cccttgatcattctccacaccctggtcgtgtaggtgcaagacacaaataggtgttcataatcttcatcaancaccaagcaaagttggcaaacctgctggtt

SEQ ID NO: 19836 - DNA, 101 bp, rice(Oryza sativa)
  misc_feature (71): n=a or g
atcgaattaaatctttagaatttagtttaacttgaattcaaaatagaaggcaccaagcaaagaaatttcgncatccaaacatcctttctagaatgaaaacg

SEQ ID NO: 19837 - DNA, 101 bp, rice(Oryza sativa)
  misc_feature (71): n=a or g
atcggtgtcggtagactggactggtagtagtagactattcttccttcgattcgattagacaaatcggatgnaatgataaaatcactcacgtgtgattctct

SEQ ID NO: 19838 - DNA, 101 bp, rice(Oryza sativa)
  misc_feature (71): n=a or g
caaataagtatttggagagttaaaagtaacaactctgttagatatgctcttagtttgagcctggctgcttncttaggttttgcatattaaatgtaaaacgt

SEQ ID NO: 19839 - DNA, 101 bp, rice(Oryza sativa)
  misc_feature (71): n=a or g
acgttgaagatcatcatgcaacatgttggtgttggttggatgaacggcgaagacgagcttgacgaccacancatagcgaagatgggaggagaaccaggtcc

SEQ ID NO: 19840 - DNA, 101 bp, rice(Oryza sativa)
  misc_feature (71): n=t or c
ctggaaagcaaagttggagctattcattctgaaatccccatctatgggtgcatccttaggaagagtcgcgnccacggaaaatctcaaaccgtagtgagtta

SEQ ID NO: 19841 - DNA, 101 bp, rice(Oryza sativa)
  misc_feature (71): n=t or c
gaggtttggtgccattgtctttagtggggagctggatacccaaggggattcccagaagagcgccttcctgntgtccccgatggtcaccgttgtggatgctg

SEQ ID NO: 19842 - DNA, 101 bp, rice(Oryza sativa)
  misc_feature (71): n=t or g
caaacaatggtaattatacgtggtgttaagtggaaacatgagtctagccatagcttaatgtgaaattttantcaataaagatggtccaaagtgaaatttac

SEQ ID NO: 19843 - DNA, 101 bp, rice(Oryza sativa)
  misc_feature (71): n=t or c
cacatggccgaaaaatacacgtacaggcattccacctattaaagtgatagcctatatattttccgccaaanaaagtgagatagccaaattaacacacttat

SEQ ID NO: 19844 - DNA, 101 bp, rice(Oryza sativa)
  misc_feature (71): n=a or g
gtccatcgagaagactgcgcagtccatcaaggtcctcaagcagattggtgcctacgctgatgccgagaagnccaaggattcggtggccatccgcgctggca

SEQ ID NO: 19845 - DNA, 101 bp, rice(Oryza sativa)
  misc_feature (71): n=a or g
cggcggtggaacgactgattttgctagcggcaagctcggtagcagagagtggtggatgggcatggaggccnagtaggttgagctcgtcgaggtaagcgtaa

SEQ ID NO: 19846 - DNA, 101 bp, rice(Oryza sativa)
  misc_feature (71): n=t or c
ctctcgagcaccctctccatctcgccgtccttctcgtacctgatcacatactgaccaccagtatcctcgcngtccatgtccgcctggccgtcgtcggtgca

SEQ ID NO: 19847 - DNA, 101 bp, rice(Oryza sativa)
  misc_feature (71): n=a or g
catgttggtgaatgtatgggccatcggtagagaccacagatattgggatgatgcggaagtatttttgccanagcgttttgaggaaatcacagttgattttg

SEQ ID NO: 19848 - DNA, 101 bp, rice(Oryza sativa)
  misc_feature (71): n=a or c
gctgtgcctcatagaaccactctctaaaattatcatctgcatcagcggtgatgggatgcttcgatctcgancgataactacagcttgttgcagaccaaatg

SEQ ID NO: 19849 - DNA, 101 bp, rice(Oryza sativa)
  misc_feature (71): n=t or c
cctggttcgctggagaggcccaggaagcggctggactggttcgacaggttcacagtggcccgaaggtgttngacgtaatgtgcggccgaaaatttggcggt

SEQ ID NO: 19850 - DNA, 101 bp, rice(Oryza sativa)
  misc_feature (71): n=a or c
tcctgaactgttgtgcatgtatcatttgttgccactgagtcattatttggattcatcagagaacatccatnattttgattaccagactatggactgattta

SEQ ID NO: 19851 - DNA, 101 bp, rice(Oryza sativa)
  misc_feature (71): n=a or g
ctcccaggcggttcgtggtccaatccctatcgctggctcgagtactacccgatctcctccctcctcctcgntgctagtacagtggaggcggcagccgtggt

SEQ ID NO: 19852 - DNA, 101 bp, rice(Oryza sativa)
  misc_feature (71): n=t or c
tgatgcttgatacatcagtaggtccattcaagattcctccagcatctctatctacctttgatgtggtaagngtcattatatgggtccccctctatgatagt

SEQ ID NO: 19853 - DNA, 101 bp, rice(Oryza sativa)
  misc_feature (71): n=a or g
attgctgagatgcgagaggggagatcgactgcgtagagaacaagttggtcgctccgattattaacagtacncatttcccccatggtgacgtccaagaccag

SEQ ID NO: 19854 - DNA, 101 bp, rice(Oryza sativa)
  misc_feature (71): n=t or c
gaattttagtgtaggcttcaatataatgggcctaaacccaattaagcatccaaactcacgtccgttttttnccctctgaatcatcattctcaccagaaaat

SEQ ID NO: 19855 - DNA, 101 bp, rice(Oryza sativa)
  misc_feature (71): n=t or g
acgtcgtcaccgagcgcgtggcctcacgttgtcacggagagagaatagggaagatagaaagagtgatcgantggtatggtttcaagtttagaaatttacag

SEQ ID NO: 19856 - DNA, 101 bp, rice(Oryza sativa)
  misc_feature (71): n=a or g
atagtaaagcacccctccctatgatcaagaccaagtttatgtatgtaaaggatgctcctaggacttgcatnggatctactcatggtttgcatcctaactat

SEQ ID NO: 19857 - DNA, 101 bp, rice(Oryza sativa)
  misc_feature (71): n=t or g
atatgttatccttttcttaagataatgttttaacggtatatcttggactgataagttctttaaatcacttnattttttttcattttcatattttttattaa

SEQ ID NO: 19858 - DNA, 101 bp, rice(Oryza sativa)
  misc_feature (71): n=t or g
ggcagcatggcagagagcttatcacttctgaagttgcattaaacctcctctatattttgaccgagaagcgnaaaattgctggtgtcgatctatcatccttt

SEQ ID NO: 19859 - DNA, 101 bp, rice(Oryza sativa)
  misc_feature (71): n=t or c
caaagctacgcacaatccctcagagacccgtttaaaatcacacacacacccgaattaaaccaattgcaaangggtactccatccaagaccaaaccacaaag

SEQ ID NO: 19860 - DNA, 101 bp, rice(Oryza sativa)
  misc_feature (71): n=t or g
cgcagcacatgaagccctgcgagagatccgcccagaatgtgttgccgtcgaacgagaagatggtgtccgtncagaagaatcctcttgtgtgtccactgttc

SEQ ID NO: 19861 - DNA, 101 bp, rice(Oryza sativa)
  misc_feature (71): n=a or g
atgatacaagaagacaacaaatttatatgcaggcataataaattatatatttataggcaaaaaccaaaacnatattctatttcaatgattttagataattt

SEQ ID NO: 19862 - DNA, 101 bp, rice(Oryza sativa)
  misc_feature (71): n=t or c
tattgttcatccctctccctctctcctctctcacggcaccttcttcttgtgaggaccagacacgactacangaggacgcacaacaagatagtggtacgggg

SEQ ID NO: 19863 - DNA, 101 bp, rice(Oryza sativa)
  misc_feature (71): n=t or c
gatctggtgtagtagtacatatagatcgagtatatcatctagctagcttctgctaattaatgcttatagcnagttaagttaaccaccctgctgccacccat

SEQ ID NO: 19864 - DNA, 101 bp, rice(Oryza sativa)
  misc_feature (71): n=t or c
aattaaaataaatatcatcacccataattatctcgttttatatagtcactagcagtgtgtaccaaggtttntcaaaccgtttttggtggggttaccgttac

SEQ ID NO: 19865 - DNA, 101 bp, rice(Oryza sativa)
  misc_feature (71): n=a or g
caggcgacgacgacatgatcgatcagccagccaaaaagcccaaaacccttgccattttcaagcttctcccntctccactacgtgtaaacgccgcatacgca

SEQ ID NO: 19866 - DNA, 101 bp, rice(Oryza sativa)
  misc_feature (71): n=t or g
gactgggaagggtggcggcgtgagagacagcgaaggggatctccaggtcgcggcgagatgggtggcgacgngagaggcggcggggcggaggatatcgtatc

SEQ ID NO: 19867 - DNA, 101 bp, rice(Oryza sativa)
  misc_feature (71): n=a or g
gttgcaggaagcgcatggaggtggtttgatgggatattttggtgcaaagaagatggaggacatccttgctngtaatttcttttggccaaagatgcaaagag

SEQ ID NO: 19868 - DNA, 101 bp, rice(Oryza sativa)
  misc_feature (71): n=t or c
atcaacaagaaagagagaaagaagaagattattcaaccaatgcactatgctacataccacacgcttttccncttttctcattaacttgatgagaagataaa

SEQ ID NO: 19869 - DNA, 101 bp, rice(Oryza sativa)
  misc_feature (71): n=t or c
ttgttacagcaattttggttttcaggaagaggaaaagcttaatcagtaattaaggcagtgacacaagggangccagcattattgacccccttggagacaaa

SEQ ID NO: 19870 - DNA, 101 bp, rice(Oryza sativa)
  misc_feature (71): n=t or c
ccacataatcatatggcaaagaaagacgcaacaacaacagttcctaagatcaagcctagatctataatacnagcatagtatggtgaagaagcatagaagct

SEQ ID NO: 19871 - DNA, 101 bp, rice(Oryza sativa)
  misc_feature (71): n=a or g
gcaaaagaaagatctgaagtctgcgctcaaggcattcgaggaggtactcctatttgatccaaacaacacgntcgccaggccacgccgagatgacctaaagc

SEQ ID NO: 19872 - DNA, 101 bp, rice(Oryza sativa)
  misc_feature (71): n=t or c
acctgaaatagattgagtatttaacatagttcaccaaccagcagtgaatgcttaccacaaatagcttatcngcgtgactgcatcgttcacattgcctaaac

SEQ ID NO: 19873 - DNA, 101 bp, rice(Oryza sativa)
  misc_feature (71): n=a or g
atagatatatttggtatttaaagcaatattcatacggaaaattttcgtacaagttgccgttttgtagtttnaaaagcatgctaacgaaaaccgagataaaa

SEQ ID NO: 19874 - DNA, 101 bp, rice(Oryza sativa)
  misc_feature (71): n=a or g
acagataacgaaggtaacgatgggaatgaagagcatgtggagaatgaggaaaatgaggggaatgaaaccgncgaaggtagctcgagcagtgatgatgactc

SEQ ID NO: 19875 - DNA, 101 bp, rice(Oryza sativa)
  misc_feature (71): n=t or c
ttgttccgaggcaaccaagtcttttatccctgttctctactcctgccgaaggctaaaactttctatatttnaggatagaggggtattattttctaactgaa

SEQ ID NO: 19876 - DNA, 101 bp, rice(Oryza sativa)
  misc_feature (71): n=a or g
ggtaaggaatatatcattacatatccgtcttttgggactcggattcggtgacatcgctatggcatggcacngtgtgacattggagcaatctggagcgttga

SEQ ID NO: 19877 - DNA, 101 bp, rice(Oryza sativa)
  misc_feature (71): n=a or c
aaacacatacacatccccttcgaagtaatcagaacaatacatcgctttacctcgtgcatatcagacagctnataaaaccagggagatatcaatcacaataa

SEQ ID NO: 19878 - DNA, 101 bp, rice(Oryza sativa)
  misc_feature (71): n=t or c
tcgaccagctggaacacgccattgcatacccacacgaggacggtgagacgccacattctccttcgaggcgncccggtgacactcatcgtgctactgctacc

SEQ ID NO: 19879 - DNA, 101 bp, rice(Oryza sativa)
  misc_feature (71): n=t or c
aaaataaatcacggacaaacaatgcttgttggtccacagtacaattcattaaggactcccagacaaaatgncattttaatttgagcatttcagggttatat

SEQ ID NO: 19880 - DNA, 101 bp, rice(Oryza sativa)
  misc_feature (71): n=a or g
cactaacatgtggttggaagcaatcctagtgttacttcacctccagataattttgcaaatccagctcatanatcagatcatcatatccatagttgaaatat

SEQ ID NO: 19881 - DNA, 101 bp, rice(Oryza sativa)
  misc_feature (71): n=t or g
attgcctatggtttcttctagcccagagattatgagaagtcagaaaaattgctctgcagtgacagctttanatggacgatatgagcttgcttggacccata

SEQ ID NO: 19882 - DNA, 101 bp, rice(Oryza sativa)
  misc_feature (71): n=a or g
cagggtttgtctcttttttttggacggagggagtacttgataccatttatattaagggttaattagatacntaccattaaaaatttaccagttttaaagta

SEQ ID NO: 19883 - DNA, 101 bp, rice(Oryza sativa)
  misc_feature (71): n=a or g
ccaagtggtaaacccaaatatgtaaaaggtaaagattccaattgacagcaaaaaactgcagctaagttctnagctttctcttcatcaacatttattgggat

SEQ ID NO: 19884 - DNA, 101 bp, rice(Oryza sativa)
  misc_feature (71): n=a or g
ggttgggcctggaatcaatggttaaatcgtgtaactgccattgcacgttatgagcacatctgccaagtgancctctgactgttctgacaggtctgaaatta

SEQ ID NO: 19885 - DNA, 101 bp, rice(Oryza sativa)
  misc_feature (71): n=a or g
ccttcgttagctcggggcagcggttgacatcatgtgccaactttcccttcaaccctaggtggggctcacantgtcttgagcacccaagggagtgtgaaccc

SEQ ID NO: 19886 - DNA, 101 bp, rice(Oryza sativa)
  misc_feature (71): n=t or g
gtagtttaatgcggtgtcgaatctggtagcacatgccaagatatcgatcctgttgaagacatcctggttgntgaagtagtaaagctcgcaatgtagaggca

SEQ ID NO: 19887 - DNA, 101 bp, rice(Oryza sativa)
  misc_feature (71): n=t or c
gcttacacttggctggcccccactgtgccgaagtcgctcgacatagggaagaagtgccgctagaagaaaanttgaacagagtctcacagaattatcatgtt

SEQ ID NO: 19888 - DNA, 101 bp, rice(Oryza sativa)
  misc_feature (71): n=t or c
actactaccatagattttcataagttgtttaatgatcgtcgttctattattgttgagcgtctcaagtctgntagctctattgctttgacatctgatatatg

SEQ ID NO: 19889 - DNA, 101 bp, rice(Oryza sativa)
  misc_feature (71): n=a or g
aggaagggtaacaccgtaaattcaaattgggccgtgagttgcaaaaccgccagtagaattggaaggaatgnaataagttcactttgactcccttaaaagtt

SEQ ID NO: 19890 - DNA, 101 bp, rice(Oryza sativa)
  misc_feature (71): n=a or g
ttgtgtctattgatgcaacacctcaaggttcaagtcagaggtcacacatcacacatcccattcaacgaccngtacattccgtacctacgtcgagcgaacct

SEQ ID NO: 19891 - DNA, 101 bp, rice(Oryza sativa)
  misc_feature (71): n=t or c
ttccatttggcaattggctgcacaagaagcagcaagggagtgactcggagtcgtaaaggcgaatatttagntgctactacctccgtcccatattacttgtc

SEQ ID NO: 19892 - DNA, 101 bp, rice(Oryza sativa)
  misc_feature (71): n=t or g
cacgcagcaacaaaccagtagaaacattttccgcgtctttaacatgaacctaatgaataaagtcatatacnccattcctaacccaatgactagtatgatat

SEQ ID NO: 19893 - DNA, 101 bp, rice(Oryza sativa)
  misc_feature (71): n=a or g
tttgtttctttttttttttgatttcgtgctagggtggggctttggtttggtttgtcttgtagttgaagggnaggagtgtcaaaaatatcttctctagattt

SEQ ID NO: 19894 - DNA, 101 bp, rice(Oryza sativa)
  misc_feature (71): n=a or g
catgccttgcaaatatttccacgtttatatatcggaattcgaaagcaatttgcccaagatcgactacatgncgacagggggctgcctatctatttttattt

SEQ ID NO: 19895 - DNA, 101 bp, rice(Oryza sativa)
  misc_feature (71): n=t or c
ttaggttggctttcctttggatgcagcgctattcggttacgatactctttgtggtatcatcgtgatattcnagtggcatcgatatgatatttttggtggta

SEQ ID NO: 19896 - DNA, 101 bp, rice(Oryza sativa)
  misc_feature (71): n=t or c
gtggggatgaacggtgaggtaggcaggatgttccgggacatggtgaaggagggcacggtggcgcccaatgnggtgacggtggctgtcgtgctagcggcatg

SEQ ID NO: 19897 - DNA, 101 bp, rice(Oryza sativa)
  misc_feature (71): n=t or c
tataaacacgcctcaggataaatcaatagtaaactttcgactcaggagaatgcaacacccaaacctcactngacatggtaattatttttagagtaaatttt

SEQ ID NO: 19898 - DNA, 101 bp, rice(Oryza sativa)
  misc_feature (71): n=t or c
tctgagtatttgtctctgtaatggagcatttaaaacaccttcttgtttgatccccgcactttgttagtacnagttatttacatgtgtctccggtgaagatt

SEQ ID NO: 19899 - DNA, 101 bp, rice(Oryza sativa)
  misc_feature (71): n=a or g
agccactattaaatttagttggcatcattcagcagtgaggctagctgggttagttttgctaatattcgtgntaatacagtgcgggacggagatggtggcca

SEQ ID NO: 19900 - DNA, 101 bp, rice(Oryza sativa)
  misc_feature (71): n=a or g
gacatacgaccaccgcagtacttcctccgtccctccagatttactgtactagcatgtgttttaggacaganaaagtatatatgacctcatatttggatggg

SEQ ID NO: 19901 - DNA, 101 bp, rice(Oryza sativa)
  misc_feature (71): n=t or c
gggtgttaactgcaacgacgcaattcagcttttaaccgcatagctgttgtactttgtatgatttgttcccnttttaagtctgaaggaccatgaaaagaact

SEQ ID NO: 19902 - DNA, 101 bp, rice(Oryza sativa)
  misc_feature (71): n=a or g
atccatgaacacaaggagagacaacattgggcagtaacacacaataagttatgccactcgctacagttagntggcaactatgtaccgttctagcaactacg

SEQ ID NO: 19903 - DNA, 101 bp, rice(Oryza sativa)
  misc_feature (71): n=t or c
aagtatatatgcagccaaaaaaaggtccccccgaatatcctccactggctcaccacgaagtgaggtgaaantagtggatagtgtggtagtaatatactcct

SEQ ID NO: 19904 - DNA, 101 bp, rice(Oryza sativa)
  misc_feature (71): n=t or c
atatatcacactgaacttgtcttgctggatgaaacggtaatcattgaccgcacaaccattctccctcttcntcgtctcccacacacacattctccctcttc

SEQ ID NO: 19905 - DNA, 101 bp, rice(Oryza sativa)
  misc_feature (71): n=t or c
gtagaggtcttgggtgcattgtagccgatgattgaaggagcgaatccgccaccattgggtaaaagtcctgnagcataattgatatttactccactttgact

SEQ ID NO: 19906 - DNA, 101 bp, rice(Oryza sativa)
  misc_feature (71): n=a or c
tctgcgcaatgtttcacttgctcaaaggttaagcattgcagtggatgtgtcagatgcattggcatacttgnatcataaccaccaaggaaccattgttcaca

SEQ ID NO: 19907 - DNA, 101 bp, rice(Oryza sativa)
  misc_feature (71): n=a or g
acgtctgatgtgaaagagtgtatatgttagagagcacaccgaatatatagttgaaaaagatgctaaggganagtgttaagtgattaattaatagattctca

SEQ ID NO: 19908 - DNA, 101 bp, rice(Oryza sativa)
  misc_feature (71): n=a or c
taatcaaagagctgaacttgtttctcgagtatccaactagctttcgtcaaccactgtccactggtgcagtnaaaaaccagaggaggtttgtaccagtagtc

SEQ ID NO: 19909 - DNA, 101 bp, rice(Oryza sativa)
  misc_feature (71): n=a or c
attaacacccatataatttccagaatcataagggccacaatacaattttgtgtggcttactaagaatgccntagcttcattcagatttccatctatttctc

SEQ ID NO: 19910 - DNA, 101 bp, rice(Oryza sativa)
  misc_feature (71): n=t or c
ccaaaatcgggggtctacactcaacttgaggagtgcaatgccgaactagatcttgaaaaacaaaagctagncgatcttccaaatgccattgaagaacagaa

SEQ ID NO: 19911 - DNA, 101 bp, rice(Oryza sativa)
  misc_feature (71): n=a or g
ttgatattagattcttttctaatatttgtgtttttttttccttgtaggcagatgatgaggctgccagggancaacttgggatccaaaggtcttgtttagtt

SEQ ID NO: 19912 - DNA, 101 bp, rice(Oryza sativa)
  misc_feature (71): n=a or g
aaagttgtaagactcttgtctgccattagagctaaatcttctctgaattgctgtcttggacttttggcatnttatacttgtggaatttcgcctgtgctcgc

SEQ ID NO: 19913 - DNA, 101 bp, rice(Oryza sativa)
  misc_feature (71): n=a or g
gcttaattgtgcctgtggtactcgatgtctccttacacaactacagcaagcttatacgagtttactcgacngtaatggcctattaaatgatcagtttcatc

SEQ ID NO: 19914 - DNA, 101 bp, rice(Oryza sativa)
  misc_feature (71): n=t or c
ctaaacgaacaaaagaacccagaggaaggttcccgttattattcccccctctaaccagccaacacttcatnatcatggataaaaagatgacaaatagctac

SEQ ID NO: 19915 - DNA, 101 bp, rice(Oryza sativa)
  misc_feature (71): n=a or c
ccacatgacacgcgtcaatgacaaaatgttgttggtgctcattgacttgacgaaaactaagcaacaaaatngtagtcaatcaaaactaagcaattgctcat

SEQ ID NO: 19916 - DNA, 101 bp, rice(Oryza sativa)
  misc_feature (71): n=t or c
ggaggcaggaggagaggagagtgatggagatggcagactgaccaacgatagtgatggcaagactcagtganggtgaccccttaactctggctgaggaccta

SEQ ID NO: 19917 - DNA, 101 bp, rice(Oryza sativa)
  misc_feature (71): n=a or c
tttaatttggactaaacatatgctatacttgggtacctgatcttaattagcggtacctgatcttaattagntggacacatattgtgaaccaattaatttgt

SEQ ID NO: 19918 - DNA, 101 bp, rice(Oryza sativa)
  misc_feature (71): n=a or c
agatatatccaagtaaatttgctaaaatcatcgatgaaactgacatagtattttctgcccccaacagagtnaggagcaggaccccatacatcagaaaacac

SEQ ID NO: 19919 - DNA, 101 bp, rice(Oryza sativa)
  misc_feature (71): n=t or c
actttttcttaagtgcaataccacataagcaccacgtaggcgtcatgttgaataaagatcacatcacgtangataaaattgttatccaaaccactctggaa

SEQ ID NO: 19920 - DNA, 101 bp, rice(Oryza sativa)
  misc_feature (71): n=t or c
tacaaggtagagttctcaataggaagggctggatctatgttggcgagcagggtgatgtcagaaaaaattanatatgtaagtcccaaaattacatactaatt

SEQ ID NO: 19921 - DNA, 101 bp, rice(Oryza sativa)
  misc_feature (71): n=t or g
ataaaaggttattagcattggcacccatataggcctcaacatctaaatatataagtactatttttgtattnaaatatataaaattgttgactttagtctat

SEQ ID NO: 19922 - DNA, 101 bp, rice(Oryza sativa)
  misc_feature (71): n=t or c
tattttttttattaatgtgggaatttttagcttccactaataaacttacccatcctaataataactatgantgcctagccaatcagtttttcaagtttact

SEQ ID NO: 19923 - DNA, 101 bp, rice(Oryza sativa)
  misc_feature (71): n=a or g
agagctcgaggagaagttctcccctgtcgtagcagaagaaaggtgcatgttcagtcattcagatgggatgngatgtatttagaaacaagccttatgcagga

SEQ ID NO: 19924 - DNA, 101 bp, rice(Oryza sativa)
  misc_feature (71): n=t or c
acaaaaactgtaaaattgctcacgataacatggatctgtcctcgtttttctttttcaacgagaaagaatcntcacctctccttggcgccaaggacgccgaa

SEQ ID NO: 19925 - DNA, 101 bp, rice(Oryza sativa)
  misc_feature (71): n=a or g
gaactaggttcaaatgaactcatattctttacttgtgcctactctagttctaaaaagggagctattttccnagactagtcttgtgctgaaatcccacgctt

SEQ ID NO: 19926 - DNA, 101 bp, rice(Oryza sativa)
  misc_feature (71): n=a or g
gtatactctattgagttcatgagagggcttatttctcctgaagtcattgcagatgtggtttatcctctttncttttgaacctatgaacactaaatgtttgc

SEQ ID NO: 19927 - DNA, 101 bp, rice(Oryza sativa)
  misc_feature (71): n=t or c
aacaaattttacttacaaattcaagcatatttgtacacggtatgtacggatcagctttgctcaagtgtctngatgccccttaggtgaaggttctgctcgtc

SEQ ID NO: 19928 - DNA, 101 bp, rice(Oryza sativa)
  misc_feature (71): n=t or c
tcattcggtgggtgcatgtaccagtcctcgtcgtttgagtggaaagagacgaacacctcgaggaccgcccngtaggtgttcgacggaatgacgagcttctt

SEQ ID NO: 19929 - DNA, 101 bp, rice(Oryza sativa)
  misc_feature (71): n=a or g
tttagttgacaccagactgtttccttctttcagaaaaaaataagcttacttatgacttttcaagggaaaanaagcttgctcataacttttcaaaaaaaaaa

SEQ ID NO: 19930 - DNA, 101 bp, rice(Oryza sativa)
  misc_feature (71): n=t or c
aaattgctttgcatttctcgagctgcaaatcacaacagagatctgaatcgcgacgtctcttgtcccttganccagttagggctggatatcgagccagctcg

SEQ ID NO: 19931 - DNA, 101 bp, rice(Oryza sativa)
  misc_feature (71): n=t or c
taattaatgatgaaaggagaggaaccaatatacatccagttcaagttacctatctgaactctgaatcagcncgttcaagtcactaatattttggttaaatc

SEQ ID NO: 19932 - DNA, 101 bp, rice(Oryza sativa)
  misc_feature (71): n=a or c
ttccaaggtgaaacgatgctctgaagtccaaaccgtgtatctcaagactgaattaactgcgtctccggctntccgctccttttcctcgtcagtcgtcggta

SEQ ID NO: 19933 - DNA, 101 bp, rice(Oryza sativa)
  misc_feature (71): n=a or c
ctccggtcctccacgaggaatcatttttctcgcggattcaattccgcggcatcaaatcgaaactgcgttangattagttcaccgagggcggtgacaaaacg

SEQ ID NO: 19934 - DNA, 101 bp, rice(Oryza sativa)
  misc_feature (71): n=t or c
gtagttttcttgttagtgaagcattagtttccttggaaatgattaaaatgttaggccaaagcctttgtaanaaaggagcagtatattaatttagatcaagc

SEQ ID NO: 19935 - DNA, 101 bp, rice(Oryza sativa)
  misc_feature (71): n=a or g
atatatatttccattcatgtaggattaatttggacggtttgttgagaagcacttgtgttttttcgtgtacngtgtttttctgaacgggcaaaagaattgca

SEQ ID NO: 19936 - DNA, 101 bp, rice(Oryza sativa)
  misc_feature (71): n=t or c
gggcagcaacatcagagggatacccaaataagatttcctagaaaccaagaactcatccaacacaaatgaanccgcccgaaacaattcccgaattcccgaat

SEQ ID NO: 19937 - DNA, 101 bp, rice(Oryza sativa)
  misc_feature (71): n=a or c
tgaacaccgtgagttcataagtaataaaccgtttgcagtggcgccattaatcttttgtttatgtgttaatntttttttcgtaaattttctgattttttaaa

SEQ ID NO: 19938 - DNA, 101 bp, rice(Oryza sativa)
  misc_feature (71): n=a or g
tcccgctttcctataatcttgtaagaaaatagaaagcccacttgtactacctcctgtatttttatggtgcngattgcagatcaatccctctggtgaaaaag

SEQ ID NO: 19939 - DNA, 101 bp, rice(Oryza sativa)
  misc_feature (71): n=a or g
aaaatataggttctcaattctataaatcaacatgaaccaaatggagcaaagattaatatgtctcttccgcnctacatccccacccacattatccaattaac

SEQ ID NO: 19940 - DNA, 101 bp, rice(Oryza sativa)
  misc_feature (71): n=t or g
agtaaacagacaagtagaggctaaaaaacccaaaagaaccatctcattgtttaagccagttaccccaaggntagcaattagcaattctgagtaggctactt

SEQ ID NO: 19941 - DNA, 101 bp, rice(Oryza sativa)
  misc_feature (71): n=a or c
gccaccgaagctcactagtaacactaaagttgtgccgccaaaaaatcagggattaatgccgtttagaaagnggcacaacttaccttatctgtggtagtgtc

SEQ ID NO: 19942 - DNA, 101 bp, rice(Oryza sativa)
  misc_feature (71): n=t or g
caactttatgaactatacttagatctttttccttgtttcaggattttgcattctattggatcaaaccaacntaaattttgaccccgtcctcaatgtttatc

SEQ ID NO: 19943 - DNA, 101 bp, rice(Oryza sativa)
  misc_feature (71): n=t or g
atgtagcacaagaaggatggaatactgtggatgcagtcatcatctatccactctgaagagtcagattgttnaatctacattaatcccagtcaaattaatgc

SEQ ID NO: 19944 - DNA, 101 bp, rice(Oryza sativa)
  misc_feature (71): n=a or g
gtgatgtgataacctacacacatgccacagatagcttcaggattaaaaccgatgaaaaaccattcgtgacnaattggagtaaccttgtaaatatgatactg

SEQ ID NO: 19945 - DNA, 101 bp, rice(Oryza sativa)
  misc_feature (71): n=t or c
aaaagaaaatgaagggacaagagaacgggtagagtaagagcaccgaagtgagcgccaacaatcatacctanggggagggcggttgaaggtccacttcgggg

SEQ ID NO: 19946 - DNA, 101 bp, rice(Oryza sativa)
  misc_feature (71): n=t or c
acagagacaccaaaaaaaaaaaggagaagaagaaacgtgctccggttttacccttgattttttattttatnattgcagaagtcctttcattttcacttgcg

SEQ ID NO: 19947 - DNA, 101 bp, rice(Oryza sativa)
  misc_feature (71): n=t or c
tattcgctaactaataaatagcaactcctactactaattatatgccgattgagagtgttgtagcgtcagtncgttaggtaattgatgcccactggtcgatg

SEQ ID NO: 19948 - DNA, 101 bp, rice(Oryza sativa)
  misc_feature (71): n=t or g
gaaaaagatgaggaagaagaaggaatagtagagcctgacatgggcctcaatatcaaagactcagagtaganaggatagatggagagatttttgttggagtg

SEQ ID NO: 19949 - DNA, 101 bp, rice(Oryza sativa)
  misc_feature (71): n=a or g
ttcttgttatagtttttcagggttgcagtgttaccttttccctttctgtattaatataaagctttgcacancaggttgtttcaaaagtttgagttttttac

SEQ ID NO: 19950 - DNA, 101 bp, rice(Oryza sativa)
  misc_feature (71): n=a or c
tcatcgagtcatctttgtttttattcctggaacctaagaggtaccgtttaagaccaacacctttgattccncccatcgctgccacccgattggtgtcggct

SEQ ID NO: 19951 - DNA, 101 bp, rice(Oryza sativa)
  misc_feature (71): n=t or g
gcttattggttttagatagaaagcgcaaaggtttgcaacaagcaccatgcaaccataggtgtttgagatanggtgtgtttagttcatgtcaaaattagaag

SEQ ID NO: 19952 - DNA, 101 bp, rice(Oryza sativa)
  misc_feature (71): n=t or c
tgaattaggccggctggctggctggccggccttgatttgtcctttatgaaacatttctacgcataatttanggaacaatattaaaggtcttccgtttgttc

SEQ ID NO: 19953 - DNA, 101 bp, rice(Oryza sativa)
  misc_feature (71): n=t or c
ttctacaacggttcagtcgccgtcttcgacgtctcccacgataaggtgtgtaatatacatgagtaaattanattggtagtatataaacttgttagctggat

SEQ ID NO: 19954 - DNA, 101 bp, rice(Oryza sativa)
  misc_feature (71): n=t or c
tgcgaggttgattgcacgttgcttcgtgcaagtcagggcgatcttgacatcgccactaatggtgatggggncgccggggctcagcatcttcatctggaggt

SEQ ID NO: 19955 - DNA, 101 bp, rice(Oryza sativa)
  misc_feature (71): n=a or c
tgccggcaaagggcattccctacaggactttgtagggcaggtagctagtgccgggaatgctttttcttggnagatgagttgccacaaaaacaactttctag

SEQ ID NO: 19956 - DNA, 101 bp, rice(Oryza sativa)
  misc_feature (71): n=t or c
taaagctattttatactagtagtgtgcactctccgtttcaaagtaagtttatttgtataacagcgagaatngaatttatttttatattttttaaaaaaaga

SEQ ID NO: 19957 - DNA, 101 bp, rice(Oryza sativa)
  misc_feature (71): n=t or g
cagttggatgaaatctccatcaaaacaccgctcgtggaggcaaaatgcaccagtattaacaattgagggangctctatatctagttttatggttaagagat

SEQ ID NO: 19958 - DNA, 101 bp, rice(Oryza sativa)
  misc_feature (71): n=t or g
cccatgtcatcacataaaattccatgtaacttgaaccgtctaaggaatgctagccagttaattccttcttnctggtacctgtagcgatccacaacattttg

SEQ ID NO: 19959 - DNA, 101 bp, rice(Oryza sativa)
  misc_feature (71): n=a or g
ttgtagttagttgtttgctttcctattttcatattaagtctagcgcatgatctggtcttccgggttgtgcngattgtgggcttgacgcacgctgcgttcgt

SEQ ID NO: 19960 - DNA, 101 bp, rice(Oryza sativa)
  misc_feature (71): n=a or g
aaagaaacatatgtagccacaagtctgccacacacaccgacactataatggactcaatgcagaacataagnaaaaaaaatttcagtagtcatgagtatttc

SEQ ID NO: 19961 - DNA, 101 bp, rice(Oryza sativa)
  misc_feature (71): n=t or c
acaaatattttccaccacgttggcactccataaagccatagtggtaatcgtaataattactaggtgattcnccgcgctttgctgcaggaattactaagtaa

SEQ ID NO: 19962 - DNA, 101 bp, rice(Oryza sativa)
  misc_feature (71): n=t or c
gccttttccttgaagaagcccaatgccttttctgtcgtcgccacaccacgcaccgcatcaaggtaccaatncattgctgcagaggaagaggccgccgtagc

SEQ ID NO: 19963 - DNA, 101 bp, rice(Oryza sativa)
  misc_feature (71): n=a or g
tatgatgattgatacgatacagtatctttctctctgtgttctcgagctagctatagctgacttgcatgatngagtaatgttgatgtcatgtacttactgat

SEQ ID NO: 19964 - DNA, 101 bp, rice(Oryza sativa)
  misc_feature (71): n=a or g
tatcgatcttaaagcaacctgtcaagctcacatcttctgcatttctttccatttcctctctacagtcaccnctctgtgtccctaatttggtgtctcctgac

SEQ ID NO: 19965 - DNA, 101 bp, rice(Oryza sativa)
  misc_feature (71): n=a or c
cactattcatgagtttaagaacatctctgagggagcttttggtagctacttcttctcctagaatcaaagtntctttcaaataatccctttcttttttggcc

SEQ ID NO: 19966 - DNA, 101 bp, rice(Oryza sativa)
  misc_feature (71): n=t or c
agtagctcatctattagctcgaagattgcatgcaataccatggctaattaattgcactgtttgtatttggnacgtggcccaaatgaactttccaattaatt

SEQ ID NO: 19967 - DNA, 101 bp, rice(Oryza sativa)
  misc_feature (71): n=t or c
caaggttgagttacctgtgagacagtaatgaagaggaacaccatccttgctctcttcatctgggccatggntatggtgatcttcgccacggcaatgccggc

SEQ ID NO: 19968 - DNA, 101 bp, rice(Oryza sativa)
  misc_feature (71): n=a or c
gatggataaactatattaaagagtctatataccccactaaactttggtaggaaattcatctagcattcttnactttaaaattatacatccaaccccctaaa

SEQ ID NO: 19969 - DNA, 101 bp, rice(Oryza sativa)
  misc_feature (71): n=t or c
catctatgaaaatggactcgacccaaacaaacttagaaaatccctccaaccgaacacatcctaaatctccnctataaggtaatttcgtgcaaaacactccg

SEQ ID NO: 19970 - DNA, 101 bp, rice(Oryza sativa)
  misc_feature (71): n=a or g
catcatagttgcacctaaaaaaagtgcacgggctagattatcgtgtcaaagcacacctcccatatcacccngatggacatattcatctagaactatgacct

SEQ ID NO: 19971 - DNA, 101 bp, rice(Oryza sativa)
  misc_feature (71): n=t or g
aactggctgataatatatagtagtatgaagaaatggtcatggagagagaggaggaagagttgttgttgttncaaccttttcttgatctcctttattaccta

SEQ ID NO: 19972 - DNA, 101 bp, rice(Oryza sativa)
  misc_feature (71): n=t or c
gagcttaattaaccccatttgatcgagtttaattagctccatgccatattcgttcgtccattaatagtacnctacactcttgttttggccttagcatgtag

SEQ ID NO: 19973 - DNA, 101 bp, rice(Oryza sativa)
  misc_feature (71): n=a or g
taccctccttaaaactttctaaattgaaacatggtagtgtcatagtgtgcatttaatgtgtgctatggtcnattttgtttttgtcatttatctgccagaat

SEQ ID NO: 19974 - DNA, 101 bp, rice(Oryza sativa)
  misc_feature (71): n=a or g
aacgagaagagtaggaggtggaaatagccacagatagagtggtggtggaaaggatgaagatgaagcaaagnggataagcataagagatggtattcttggat

SEQ ID NO: 19975 - DNA, 101 bp, rice(Oryza sativa)
  misc_feature (71): n=a or g
ctggacaaatatattgagctaaaccctgccatattcaataaaatattttcttgcctactttctgtaactcnagaaaaaataaataaatttcgaattccata

SEQ ID NO: 19976 - DNA, 101 bp, rice(Oryza sativa)
  misc_feature (71): n=t or g
ggtcctattggacatgaccagatggcagaggaacgggttgaagattttggtagtcgtttcaatgatgctancaaggaatttgtccgtctttttgaggaggt

SEQ ID NO: 19977 - DNA, 101 bp, rice(Oryza sativa)
  misc_feature (71): n=t or c
aggaagattgctgtctaatcaatatttcttgtacatgaacggacgtagcgcggaaagaacaaaggggatgntgcgagctccgtggagtgttacatgaatga

SEQ ID NO: 19978 - DNA, 101 bp, rice(Oryza sativa)
  misc_feature (71): n=t or c
cctagtggtgaggatcacattcttgctcctcgccagccagagttcaaacccccaaagtagcactttttctnatttttaggcaataaaacgaacatgggccg

SEQ ID NO: 19979 - DNA, 101 bp, rice(Oryza sativa)
  misc_feature (71): n=a or c
aaactaagcaaagcaccgcccaacgaaaagatagccctatgcttttcttgctcaagttagttaattaaggntgtgtttagatttaaagtttgaatccaaac

SEQ ID NO: 19980 - DNA, 101 bp, rice(Oryza sativa)
  misc_feature (71): n=t or c
tggctggacagcaacaaggcgatagttgggacaggtgagatcgcatgctttttacaagtacgctaccatancacgtccgttctaaaatataacaaatttta

SEQ ID NO: 19981 - DNA, 101 bp, rice(Oryza sativa)
  misc_feature (71): n=a or g
tcgtgccaccagtcaagcccaagggatcaaaaatgtagaaatagccaccagaaagaatactcaaggtatcncacacaaaataactgctaagaagtccaagt

SEQ ID NO: 19982 - DNA, 101 bp, rice(Oryza sativa)
  misc_feature (71): n=t or c
gttgtcgattaaagttgagccgaatatgtgtacgacactatttgttttgggcaatttgttaatttgtgcangtgtgttaattagcaatttaagtttctttt

SEQ ID NO: 19983 - DNA, 101 bp, rice(Oryza sativa)
  misc_feature (71): n=a or c
taagattgtgttagtggtggcattgtctactagacatatatcctcttctgccatgggattcccataaggtntgtttatagaacataaacataaatgaaatt

SEQ ID NO: 19984 - DNA, 101 bp, rice(Oryza sativa)
  misc_feature (71): n=a or g
agcgatcaatcacccgttaggacgttcgtatcaggtgttctaattgatatattgatccgagctgtcacatncttaagagttaatttggattgaggtctggt

SEQ ID NO: 19985 - DNA, 101 bp, rice(Oryza sativa)
  misc_feature (71): n=t or g
ttgtgcatgtcactgggagtgacagggtaaattaagctcacgaagtgacagggtgataagtgacatggacntcgcacaagtgcagaacagaccggccagta

SEQ ID NO: 19986 - DNA, 101 bp, rice(Oryza sativa)
  misc_feature (71): n=t or c
atcaactaacacaaagctgtctgcgctactccaaccttgacaacaatatatcataatggcattaagctaangcagagcagaaatttaaaaagaatcataat

SEQ ID NO: 19987 - DNA, 101 bp, rice(Oryza sativa)
  misc_feature (71): n=a or g
gacagaagagagggagcatgcttaggtaggtttatctgatctggaacggcgggttcccggtgccctggtgnctccggccggcgtcctggtcggcgtggcgg

SEQ ID NO: 19988 - DNA, 101 bp, rice(Oryza sativa)
  misc_feature (71): n=a or g
tacggtgttgaacgaaagtcggctttttttcttctacatgtttccgataaacccgtgagagtcggtttttntgttgaaaacggaaaaggtaccctggtctg

SEQ ID NO: 19989 - DNA, 101 bp, rice(Oryza sativa)
  misc_feature (71): n=a or g
ttggggtctctgggtgcggaagtctcctctccattcacccaccacgccgaaaggagaggatcaacaaatgntgatttgcgtccttaatggaatatttacgt

SEQ ID NO: 19990 - DNA, 101 bp, rice(Oryza sativa)
  misc_feature (71): n=t or g
aacataagggaaaccatttggacggaccgaatgaaaacatacgaattggatgaaaagagactttccaagangttgaacttcatgctaactttggacctatt

SEQ ID NO: 19991 - DNA, 101 bp, rice(Oryza sativa)
  misc_feature (71): n=a or g
cctcctcctccttcaccacctgtgcaacagatgtcaagtgactgtaccccatcgactacaggaagccaccntgttgaagaagaagaacaaccagccgctcc

SEQ ID NO: 19992 - DNA, 101 bp, rice(Oryza sativa)
  misc_feature (71): n=t or c
atgtctagcctaatatgtttgcaaattatgtctgaaccaaatgatctttctaccggccgccagcagagatngatcacaatcaagtgattctatatattata

SEQ ID NO: 19993 - DNA, 101 bp, rice(Oryza sativa)
  misc_feature (71): n=a or g
catctcagttcactgaattttacgctacaccctatactccctttgtcctacggattttaaatttttacttncaacgtttgaccactcgtcttattcaaatt

SEQ ID NO: 19994 - DNA, 101 bp, rice(Oryza sativa)
  misc_feature (71): n=a or g
ttcacttccattcaatccatcgatcccaaaaatggggcaaagcaaatctggcaccgtgaaatacgggcctntttagatcacgaaatgaaaatttttgggtg

SEQ ID NO: 19995 - DNA, 101 bp, rice(Oryza sativa)
  misc_feature (71): n=a or g
aaaatgattccacctagctagcttagcatttctattgtggtgaggcagggcctaatatatcttgcttgcancatctatatgcaagcgtaccatatttaact

SEQ ID NO: 19996 - DNA, 101 bp, rice(Oryza sativa)
  misc_feature (71): n=a or g
gcacctgacaggcgcgacgaagaaacctcaagcgcagatcgtcgtcacaagcagcgacggcaagacaacanagaagaaaaacaatccggagtttgatgatt

SEQ ID NO: 19997 - DNA, 101 bp, rice(Oryza sativa)
  misc_feature (71): n=t or c
atggttgtgggcctggtagcggtaaaggctgtggttgcggctgcggttgtggcagaggttgtggttgtggntgtggctgtggctgtggctgtgggagtggt

SEQ ID NO: 19998 - DNA, 101 bp, rice(Oryza sativa)
  misc_feature (71): n=t or c
accaatcaccagcttgggttagctagtatacctcagctccaaacacgtcaaaattgatcgacggaatgttngatcaactgtcgttacgggtgctacatttg

SEQ ID NO: 19999 - DNA, 101 bp, rice(Oryza sativa)
  misc_feature (71): n=t or g
tatgggttcaattattctacttcaccagaatacaaatttaacaatggaccaagcactgcagaatcagttgntctcaataatcaatatttgacttttttttc

SEQ ID NO: 20000 - DNA, 101 bp, rice(Oryza sativa)
  misc_feature (71): n=a or g
tcatatcacgagctcgagcgtgaaggcaaacttgctaagcccaagaagctcacagatgtgcggcccaatcntggttgtgagcctgcgacgcccacggccac

SEQ ID NO: 20001 - DNA, 101 bp, rice(Oryza sativa)
  misc_feature (71): n=t or c
gcccacctaaggccgatcaaaatttagggcccattcaaatatgggcctttgtaggcggtaaattgggcctnggatggagagagagtccagtggatcacgtg

SEQ ID NO: 20002 - DNA, 101 bp, rice(Oryza sativa)
  misc_feature (71): n=a or g
attattttttttcagtgcattgtcaacaacatacgactgccgaagaatgaggacctttaaaggctttaacncaactcgcaaagcactgtacgcttggcgtt

SEQ ID NO: 20003 - DNA, 101 bp, rice(Oryza sativa)
  misc_feature (71): n=t or c
gatctcctgcgtgttaaaaaaacatgttattggcataacccaagttctgtacactcttttaattcaaaggntgcgtgaagcgggtttagagcaatactagt

SEQ ID NO: 20004 - DNA, 101 bp, rice(Oryza sativa)
  misc_feature (71): n=t or c
tctcaaaggatcatatgttcgaggcccactcaaggaaaggatcatattagtagattagatattcatgtttnctggttcattaatccatttatggtcgatca

SEQ ID NO: 20005 - DNA, 101 bp, rice(Oryza sativa)
  misc_feature (71): n=t or c
tgagtagggctaacatttagcacaacagtttgtacgttttgatggatcctataatgtattaacaatcggtnatggacaaccctaaaaataaatatacccaa

SEQ ID NO: 20006 - DNA, 101 bp, rice(Oryza sativa)
  misc_feature (71): n=t or c
atatccaccctgtgacagcaaggtctccctgcaagcatcaacaattctacaccaggatcatcattcaccangtatgaaatctctaaacagttttaccattt

SEQ ID NO: 20007 - DNA, 101 bp, rice(Oryza sativa)
  misc_feature (71): n=t or c
ctcttcaggcggaaaattacctgctcatggtcctagaagaataattgttcctagcaggcatgcttctgatncatttgttcctgcaatgaaacgtcgttttc

SEQ ID NO: 20008 - DNA, 101 bp, rice(Oryza sativa)
  misc_feature (71): n=t or c
actttcttacttgactttctgatcaatagaaaaagccttgatgtcctcagctagttgacatgcgatccaancaaggaggcaatacttttgcctgagttcct

SEQ ID NO: 20009 - DNA, 101 bp, rice(Oryza sativa)
  misc_feature (71): n=t or c
tagactgctgcagcttctctagaggaacagtggaagctgcaagctagtagaagactaatggtattgttggngctaagcagcagctgccataactagctaaa

SEQ ID NO: 20010 - DNA, 101 bp, rice(Oryza sativa)
  misc_feature (71): n=a or c
gcattccttgtgtatgtttcttttttatgttacttccaatgtggacgtctttgcatcctcagttcactgcntttgtcagatgaggtatagatttttttttt

SEQ ID NO: 20011 - DNA, 101 bp, rice(Oryza sativa)
  misc_feature (71): n=a or g
tgctgactacagcgtaggtaaatttaatcgactaaccgagcttctctgcatgtgcgtgtacgtgctattantggtaaattgctcaaattgagttattgatt

SEQ ID NO: 20012 - DNA, 101 bp, rice(Oryza sativa)
  misc_feature (71): n=a or g
cacagtcatattaatcggcacagaaggatgttaagtgataaagtatcagaatgtttagctgattacaaaanttctaagtcctattacattaagattactgt

SEQ ID NO: 20013 - DNA, 101 bp, rice(Oryza sativa)
  misc_feature (71): n=t or c
ttgctattcgtgacgtgaatctgatggctgacaaatcgatcgttaaaaaaaacacgtcaacaatttttggntaatactacctccgtcccagaatacttgtc

SEQ ID NO: 20014 - DNA, 101 bp, rice(Oryza sativa)
  misc_feature (71): n=t or c
gacaatgataagatagaagagtggaggcgtggcgaggggaaatgacgttagactgaaagacgtactccctncgtcaaaaaaagctaacctaggcaaggatg

SEQ ID NO: 20015 - DNA, 101 bp, rice(Oryza sativa)
  misc_feature (71): n=t or c
aaccttgactctcgttttctcttgcaaggaaccgaaaacttcgtgtcaaatccgccactactggagatgcnggcaaagaggagcacaaccgatgccccatc

SEQ ID NO: 20016 - DNA, 101 bp, rice(Oryza sativa)
  misc_feature (71): n=t or g
aaaaatatgctgtcgtcgcgttacaaagatgcgaactcacgacaagtccgcgtcatgtggaagcgaacttntaatcgtcatgattttgcggacggaagcag

SEQ ID NO: 20017 - DNA, 101 bp, rice(Oryza sativa)
  misc_feature (71): n=t or c
aaaatgccacttgaacataaaacatcatccaaattcaacatttgaatatctatttttacacttacattttncatagaaaatagagaaagaccagtggcgga

SEQ ID NO: 20018 - DNA, 101 bp, rice(Oryza sativa)
  misc_feature (71): n=t or c
ggtccattgtacgtttcccacatggatgttcaccttggatgcaaatttgcattcagctccttcatgcacantcgctatgtgtctcctcgaaatatcctctc

SEQ ID NO: 20019 - DNA, 101 bp, rice(Oryza sativa)
  misc_feature (71): n=t or c
gttttgaagagctttattaggagggtgttaattcattttactgcaagtgaacttgtgttcagaatcccaantaaactcttttctagtcacttaaaaaaaga

SEQ ID NO: 20020 - DNA, 101 bp, rice(Oryza sativa)
  misc_feature (71): n=t or c
tttttattgggacggagggaatatcttgcactcaccccatagccatcaatcccctcaccctgactcacacngtggcggtgcctctcggttatgttaccttg

SEQ ID NO: 20021 - DNA, 101 bp, rice(Oryza sativa)
  misc_feature (71): n=a or g
actttgattttgcttttccatttttctttatgaatgccactttgctgtttggccccatttgactgtgatgnttttttttttgtcaatctcaaaacagctag

SEQ ID NO: 20022 - DNA, 101 bp, rice(Oryza sativa)
  misc_feature (71): n=a or g
tctgaccggccaaataaatacatatgaccatccttgtgccaccggtcggactgtctccatatggaaggtcnggttctttccaaatctggccaagttttcct

SEQ ID NO: 20023 - DNA, 101 bp, rice(Oryza sativa)
  misc_feature (71): n=a or g
tgcttccaccgtgtcgacaggacactggtccttagaactgtgcgcatatcaactctttctaggatagagantaagatatgatccggcaattggttgaatct

SEQ ID NO: 20024 - DNA, 101 bp, rice(Oryza sativa)
  misc_feature (71): n=t or c
tatcaccggtaatcaggagcatatggacagcgacaggaagagataaacacgaactcatgattaatactgcntagacgctgttgattttttatctaacgttt

SEQ ID NO: 20025 - DNA, 101 bp, rice(Oryza sativa)
  misc_feature (71): n=a or g
acgagatggatatgcttgcattctctggttgtacacatggatgttctgacgaagaaacagcagagctcacnagaatgaggtttcattcgatattgaacttc

SEQ ID NO: 20026 - DNA, 101 bp, rice(Oryza sativa)
  misc_feature (71): n=a or g
tttacactaaacactattaaaactagaaactattacaaaatagctcccttgaccaaatctcttagatattntctagacccatcccctagccactccatgga

SEQ ID NO: 20027 - DNA, 101 bp, rice(Oryza sativa)
  misc_feature (71): n=t or c
ttttgaatgagtggtataagtcaaaactattggttggttatgcatcatactctacaccaattctaaacacngtaaatataatctaatagacttgtataaat

SEQ ID NO: 20028 - DNA, 101 bp, rice(Oryza sativa)
  misc_feature (71): n=t or c
taatggcctcactgaaggttataagagcttttggcactgaatgcttgaagcaatatcttgcctggtttttngagttcattggagttgaagataaaaacccc

SEQ ID NO: 20029 - DNA, 101 bp, rice(Oryza sativa)
  misc_feature (71): n=t or c
atttgtttccaaggacaaaatcttcgtacagacgctcttatgtattcacacagtcaaagtgtttgcggtanatgcacttgccgtagagatctactccctcc

SEQ ID NO: 20030 - DNA, 101 bp, rice(Oryza sativa)
  misc_feature (71): n=a or g
accgacgcctctcctatcctctcctctccaccccacctagtcgacgcgctgatgagttcaacggtgcggcncgggggaacaatgatgagctcagtagcgtt

SEQ ID NO: 20031 - DNA, 101 bp, rice(Oryza sativa)
  misc_feature (71): n=a or g
gcccactgaccaagaccttgctggctgcaggtcttgccgtcgctacctttatctgaagccaaaaaaaaatncgtacttaatgtagaggctgaattgaattt

SEQ ID NO: 20032 - DNA, 101 bp, rice(Oryza sativa)
  misc_feature (71): n=t or c
agacaacatatttttcagctagaaggcaataacagagaggctcaaaacgcaccggacaaagggtgtggtanagccaaccttcaacttataaacaacttcta

SEQ ID NO: 20033 - DNA, 101 bp, rice(Oryza sativa)
  misc_feature (71): n=t or c
cgctagagtagaagatccaagagtgacaagtggttaagcccttcaatagatcataatcaacatttaagacntatctcctttcatggtaatgtctttgtaca

SEQ ID NO: 20034 - DNA, 101 bp, rice(Oryza sativa)
  misc_feature (71): n=a or g
aaaaggtttgtaagcgagcttagaagcttactctatctgttcacgtagtattaaaatatggccctgtttgnatcctatcttaaaattttttatccgtcaca

SEQ ID NO: 20035 - DNA, 101 bp, rice(Oryza sativa)
  misc_feature (71): n=t or g
gcggcgacgacggcgagctagtagggaagaagttgatgatcatggctagtagtgcttagcaccagaaaaanagttttggcaaatattgtggcacgttgtaa

SEQ ID NO: 20036 - DNA, 101 bp, rice(Oryza sativa)
  misc_feature (71): n=t or c
tcaattacattcccctgtctaacaggtcagtatacgtggaggatcacaacgcagtatacttccttcgtttngatactctcttcgcatacaaattctcgccg

SEQ ID NO: 20037 - DNA, 101 bp, rice(Oryza sativa)
  misc_feature (71): n=t or c
tagtagttttctcttttaaaagcctaccaaattttgataaatgtatcaaatcaaataaagccaatgctacnaaaatttaataatgccaaaatctatcaaaa

SEQ ID NO: 20038 - DNA, 101 bp, rice(Oryza sativa)
  misc_feature (71): n=t or c
atataatataatcaagcagctgccaacatccagcgatcgatcgactacctagctagaaccacacgagcgcngccgcagccacggcgccggcgaccgcgcca

SEQ ID NO: 20039 - DNA, 101 bp, rice(Oryza sativa)
  misc_feature (71): n=a or g
taattccctccttcctctccctcttcccaatcccatctcaatgagaatgctcatgctatcacattgcacgncccatggctatgcctctctccaccccactt

SEQ ID NO: 20040 - DNA, 101 bp, rice(Oryza sativa)
  misc_feature (71): n=t or g
ctcggtgcactgaatcaaatctaacttcttttcaacagcatgcagccaaatacctgcctctactgggttantggtacttgagaaagtagctggtctcacac

SEQ ID NO: 20041 - DNA, 101 bp, rice(Oryza sativa)
  misc_feature (71): n=a or g
ccagggcggatccaggaatgaaaaatagaaggggctcaacatacgggaaaaaccgacataaacatatcatntctcatacaatattacagtatcaacaggta

SEQ ID NO: 20042 - DNA, 101 bp, rice(Oryza sativa)
  misc_feature (71): n=a or g
caacagaagctacaccacaagttgccgccgccgcatcctgaacatgaacagtagcctcattaggagccgtntcactcattgccttcaacccatctttaatc

SEQ ID NO: 20043 - DNA, 101 bp, rice(Oryza sativa)
  misc_feature (71): n=t or c
atggccgccaagtttgccttgatgttatctttagttaggccatattcgtgctgaatagagagtaggacatngatgaaacctgcttcctcatcgtagtggtt

SEQ ID NO: 20044 - DNA, 101 bp, rice(Oryza sativa)
  misc_feature (71): n=a or c
tgaatgaatcgcaatgaaaatcgccttcaatttttggcaccggtgatgctgtgctgtcgcctgttcatggnaatatctgtctcgacgaggacaacctttct

SEQ ID NO: 20045 - DNA, 101 bp, rice(Oryza sativa)
  misc_feature (71): n=a or c
accaaaccgaaaaaaatagcaatgcttaaattttggttacctggttaggtttggcaaagaaccaaacgcancccaatccttctttcaactgaaaatttctc

SEQ ID NO: 20046 - DNA, 101 bp, rice(Oryza sativa)
  misc_feature (71): n=a or g
catttagcaattttaaaaaatatatcttactcgaaagggcctgtaacctagtgtagcatataaggtcctgngttcgggcgttatactttcagtggtaggtg

SEQ ID NO: 20047 - DNA, 101 bp, rice(Oryza sativa)
  misc_feature (71): n=a or g
ccagagccccgtactgaatcaactccttgcatcctccaaccaaagaaaatgttacaaggatgtcgcaaaanagggttgatatactgagtgacaccaacgtc

SEQ ID NO: 20048 - DNA, 101 bp, rice(Oryza sativa)
  misc_feature (71): n=a or c
ccgtgatgtaactcggcttcgtgacaacctcagctacttcaacttctccggtgagcattgccacgaccttngacattggtggtcgctggtgcggcgagccc

SEQ ID NO: 20049 - DNA, 101 bp, rice(Oryza sativa)
  misc_feature (71): n=t or c
tctctttacatttcatttgtttatcgaaacctgaaaaacttgaatgacattttttttctctataagacccngtttagattctaacttttttcttcaaactt

SEQ ID NO: 20050 - DNA, 101 bp, rice(Oryza sativa)
  misc_feature (71): n=a or g
tctggcgttatttgaaatttgctcacttttctacaacctggacaaaagaaacaccccatccaataattgcnattgaagaattgcatagattatatagtaca

SEQ ID NO: 20051 - DNA, 101 bp, rice(Oryza sativa)
  misc_feature (71): n=t or c
aggtcgagagtctcaccggggtctgcttcttccttgataaaatctgagacctcatcttctagaagggcctnggaagactcatgaggaggaactacagtaac

SEQ ID NO: 20052 - DNA, 101 bp, rice(Oryza sativa)
  misc_feature (71): n=t or g
acgacacacggaggaattctattcggcacggctgcaaatacagtctcattaactacatcatctactgtaanttccttaaatcatggcttgtttgtgaacaa

SEQ ID NO: 20053 - DNA, 101 bp, rice(Oryza sativa)
  misc_feature (71): n=t or c
tgacaagactgatgaggatgcattcaaggtaagccataaactggtctgcttgctcttacctgcaaaatatnaattactacttccatgtcttgatgtataat

SEQ ID NO: 20054 - DNA, 101 bp, rice(Oryza sativa)
  misc_feature (71): n=t or c
tgaatatattattatcgcaatatattagggtcaccctctcccgctctatttgagcttggttgggctgtaantgatttctcgtgtttaactgatgtagcaca

SEQ ID NO: 20055 - DNA, 101 bp, rice(Oryza sativa)
  misc_feature (71): n=t or c
catcatcaaccttgtctagttttgacacctcaacagaccacggtgcctcctcagagaataatcttttctgnctttgagcctctagcaatatagagtcacgg

SEQ ID NO: 20056 - DNA, 101 bp, rice(Oryza sativa)
  misc_feature (71): n=a or g
tttcgcgtgcggttgtttcgcccgtctggaacgaaaggtccgtgaaaatcgtgatttttttcatgcgggtnaggcaccacacgggaaaataaaaagttgaa

SEQ ID NO: 20057 - DNA, 101 bp, rice(Oryza sativa)
  misc_feature (71): n=a or g
ggaggaacgcgccgcacggttactactgagggtggtggtggggccgtggagaaaaagagaaatcgtattanggttgtgtttagataaatgcgtgtaaagtt

SEQ ID NO: 20058 - DNA, 91 bp, rice(Oryza sativa)
  misc_feature (61): n=t or g
atgaagctgaggagaatatgaccgatgatgggatgagatatgatctaggaagaggaggaanatcagtggagagaggagacatcccaaaggg

SEQ ID NO: 20059 - DNA, 101 bp, rice(Oryza sativa)
  misc_feature (71): n=t or g
gtcatataaactgattcatgcatgcacaaaagactgatcgagagaagtacggagtaggttggaaatttcgnacctcggaaatttcggtcatttcagtcacc

SEQ ID NO: 20060 - DNA, 101 bp, rice(Oryza sativa)
  misc_feature (71): n=t or g
tccgaaccgaataaaccctcaatagggataaaaaagttgcagaaattcccgaccaagaagtatcatctccntaaaaaggtacaattttcaactgttttcaa

SEQ ID NO: 20061 - DNA, 101 bp, rice(Oryza sativa)
  misc_feature (71): n=t or c
tctttttttactttgctgacagtaattggtagcctcctaatgcatatatcgttgcttttttaatgtcacgncctaaagttcccctttccagctttaaaatt

SEQ ID NO: 20062 - DNA, 101 bp, rice(Oryza sativa)
  misc_feature (71): n=t or c
actagttgctgtgacctggcactgaagatgctaaatgatgtcaggtgcaaaggccttcgacctgatatcgntgcatataattccttaatatttgggttttg

SEQ ID NO: 20063 - DNA, 101 bp, rice(Oryza sativa)
  misc_feature (71): n=t or g
tgatggatttttttaaaaaaaaaaaaaaataggttcaaacaactaatccaggggaacgcagtttgcttgtntttaaccaattcagcaagaagctcagggtt

SEQ ID NO: 20064 - DNA, 101 bp, rice(Oryza sativa)
  misc_feature (71): n=t or c
ccatggtcagctaaggcctggagaaactagggacggaagaaagcgatttcctctcgaaacgcgcaaccgcnccctacctggcgcgccagctgtcgagggaa

SEQ ID NO: 20065 - DNA, 101 bp, rice(Oryza sativa)
  misc_feature (71): n=t or c
tgttcagcaggaggcctagctacattcttccactgcgacgacctcaaaggacgtctcggagatgctgtcantgtgaaatgcttgagtgacgcaggattttt

SEQ ID NO: 20066 - DNA, 101 bp, rice(Oryza sativa)
  misc_feature (71): n=t or c
tgttcgttattctctccaacaggtatggaagaaacagtgggtccacgattgcaagataattctccgcttgntccatagaatcctaacaagaagataggaat

SEQ ID NO: 20067 - DNA, 101 bp, rice(Oryza sativa)
  misc_feature (71): n=t or g
ttaataccaggcaaattgctacagccaatggccccaatgggaataacagggattacctgttctcaatgganaaggcattgtccaacatatgtaagaaaaag

SEQ ID NO: 20068 - DNA, 101 bp, rice(Oryza sativa)
  misc_feature (71): n=t or c
gcacacttcgaactgaaagaacacattttgctcggccgtgtctttgtgttagtgcttactgtgacttgtanagcttctgttgacttaggatatgcagtcaa

SEQ ID NO: 20069 - DNA, 101 bp, rice(Oryza sativa)
  misc_feature (71): n=a or g
tgttgtcgttggaagagcagtcacacttgatggcagggtcttttgggtagttatcccagtcggaattgtcngaggctacaccgctgcagggctcaccactg

SEQ ID NO: 20070 - DNA, 101 bp, rice(Oryza sativa)
  misc_feature (71): n=t or c
ccgaagcgccgtggacgccgacgaccacaacgccgccttcatctttttcctctggctgcccctcccacccngccggagcgtcgttcctctgcaccttcttc

SEQ ID NO: 20071 - DNA, 101 bp, rice(Oryza sativa)
  misc_feature (71): n=t or g
tcaagactataatacgtgcaaacgtgcaatccatccgccacaaattataacccgtgattccattaggatanaatggccaatgggaatatgggatccttcag

SEQ ID NO: 20072 - DNA, 101 bp, rice(Oryza sativa)
  misc_feature (71): n=a or g
tataaccaatattcacatctcactatgttgctgttttctctcggggggtaaaataaaataaaaaatatccntactgtttaacacatactccctccgtttta

SEQ ID NO: 20073 - DNA, 101 bp, rice(Oryza sativa)
  misc_feature (71): n=a or g
gatatcaaggccagcaacgattaattttttatcctacaagatttgtggccttctttatcactcaatgtatntatgaaatttaaacgatatacatgtgtacc

SEQ ID NO: 20074 - DNA, 101 bp, rice(Oryza sativa)
  misc_feature (71): n=t or c
tggccgcgagaggaggccatttatcagttgcgtcttggcaatatatggtgtgttttcttgctttctgcatnaatgagagcaagtttaatagtatagccaac

SEQ ID NO: 20075 - DNA, 101 bp, rice(Oryza sativa)
  misc_feature (71): n=t or g
tgttttgcatgcggttgtacgcttctaaccacctcaggcaagacgtacatggtagcatcctttttttttangaatcgctaaccatttgttgacagaaaatc

SEQ ID NO: 20076 - DNA, 101 bp, rice(Oryza sativa)
  misc_feature (71): n=a or g
agctgagatacgaaaacgtgtatgttgtactgaccaagagacagagaaatgagaccacttaccaggaaaanaggataacatattatctgttagttatcatg

SEQ ID NO: 20077 - DNA, 101 bp, rice(Oryza sativa)
  misc_feature (71): n=t or g
ctggacctgagcccacatttatcttagggtatctctccccttattaaaagaagagtgtagagacataaagnattaaatgactcaaaactctaagtataagg

SEQ ID NO: 20078 - DNA, 101 bp, rice(Oryza sativa)
  misc_feature (71): n=t or c
atccatataccctataaaagagataggctataccctaaatcctaaccctcccaactgtttatctctttctngctattttatggcttttattgaatttggtt

SEQ ID NO: 20079 - DNA, 101 bp, rice(Oryza sativa)
  misc_feature (71): n=a or g
gatactccctcacacatttcaggtaagagatcgaatcacacatctccgtcgcaccatccgatcatcaccanggttcaatctttcgttttcagtgtttgtat

SEQ ID NO: 20080 - DNA, 101 bp, rice(Oryza sativa)
  misc_feature (71): n=t or c
cttcaactctacaatttgcaggctgccttgtggtgcatggaagtaactgaaaggaaaaaaaaagcatcctngcagatctggttggagtcgttgcggcatcc

SEQ ID NO: 20081 - DNA, 101 bp, rice(Oryza sativa)
  misc_feature (71): n=a or g
cctttttttgatagtcacaaaggtcatgtatcctattatcttgtttagatggaaaccgctggtaaaatcancagaacattcaaaataactgaatgatttct

SEQ ID NO: 20082 - DNA, 101 bp, rice(Oryza sativa)
  misc_feature (71): n=a or g
gtcgccgagcagaagatggatggccatatctctgcggattcgccttggattccggtgcatcgcaagcgcangtggcatagagaagagcattcatccgcctc

SEQ ID NO: 20083 - DNA, 101 bp, rice(Oryza sativa)
  misc_feature (71): n=t or c
cgatggaactgggaggacttcgaaatcgaattactgcgtggttgatagtcttaatcgtgagctttgttgcngtgcttcgttctgtcccaagcagagtgact

SEQ ID NO: 20084 - DNA, 101 bp, rice(Oryza sativa)
  misc_feature (71): n=t or c
gagttggacttatttttttttatcggacaaacatggttttttcgccttttttctgtggatcggactctgtncggttttttttggtttttttcgcctttttt

SEQ ID NO: 20085 - DNA, 101 bp, rice(Oryza sativa)
  misc_feature (71): n=t or c
tgaagtagcctacggtgaccatgagcaaacgggtgtagtgcagttctaagaaaaactggggtagtgcaggnattccgtcgacagaaattatctcccaacat

SEQ ID NO: 20086 - DNA, 101 bp, rice(Oryza sativa)
  misc_feature (71): n=a or c
ggtgttcccttttttcttgagtgcagatgacggcaagtcggcaacacaagacaggggatttgcttaatgtnagatgttcatactaagtcaagggatttgct

SEQ ID NO: 20087 - DNA, 101 bp, rice(Oryza sativa)
  misc_feature (71): n=a or g
cacaaaaattaacccactcccactcttggggtcctcagggtcgatcaacaccatcagcttcatcctttccnccagcgcttccatcttgattccttcctcag

SEQ ID NO: 20088 - DNA, 101 bp, rice(Oryza sativa)
  misc_feature (71): n=t or c
ggtatgcatgttaaaatggttgggagctatgcctcatcacaaggtatgaagtggtaatttgactcccctcnttgcccaatgacgaggacaggatttgaacc

SEQ ID NO: 20089 - DNA, 101 bp, rice(Oryza sativa)
  misc_feature (71): n=a or g
attgtatcactgactagtgactattttaaagcttcaaaactcatcgtattcactaaaggggaactagaacntatgaaggcattgaagttccaatgtagtta

SEQ ID NO: 20090 - DNA, 101 bp, rice(Oryza sativa)
  misc_feature (71): n=a or c
atttatgtgtaccataaactagctccagtattctgtgatgtcgaatttacctacttcagacctgtttgctntatatgtcaagtacctacttcagtacttgc

SEQ ID NO: 20091 - DNA, 101 bp, rice(Oryza sativa)
  misc_feature (71): n=t or c
ccaaataaccccactgatttggtttttttggcaatgccattgggttgaaccctgggctgttatgcagaagncggaagcaagcccaaagaaatctgcagttt

SEQ ID NO: 20092 - DNA, 101 bp, rice(Oryza sativa)
  misc_feature (71): n=a or g
aacagcatgcctttttatcttcattgtttcgatgagcgtcatacttatatagtggtttctcatgtggagtntctagacactaactagtggtatctgcatat

SEQ ID NO: 20093 - DNA, 101 bp, rice(Oryza sativa)
  misc_feature (71): n=t or g
atacatacgtacgtggagtggagaagtacgtcagagaaaacagggtgcgggaaactcttttaaatacttgngtgaacgtacatccgtttcttgcatgtcat

SEQ ID NO: 20094 - DNA, 101 bp, rice(Oryza sativa)
  misc_feature (71): n=a or c
ccctcagcttcaacccaaaagttttcaaatctgaaaattggagacttggggatttttgtatcaatctttancacacatggaacatggtcagagatattcct

SEQ ID NO: 20095 - DNA, 101 bp, rice(Oryza sativa)
  misc_feature (71): n=t or c
ggaaaggtggaatttgcacttcctcttagaaaacatccggattaaagcgccctggaattgagctgccctgntgagcttgcctaaggagcatgctcaatctg

SEQ ID NO: 20096 - DNA, 101 bp, rice(Oryza sativa)
  misc_feature (71): n=a or g
aatgctgcacgcacaccaccgcacctcatattaggcacacaagtttgcctacttgaggataaaaacggtcnaaaacgtttggaatcgataaaatctatttc

SEQ ID NO: 20097 - DNA, 101 bp, rice(Oryza sativa)
  misc_feature (71): n=a or g
gacataatctagcatgtctagataagttgtactagattatatccctttatatctagatacgttgtactagnttatgttccatcacagttctaggttgagat

SEQ ID NO: 20098 - DNA, 101 bp, rice(Oryza sativa)
  misc_feature (71): n=t or c
taggatttctggtgggcttgtggaggtagaggttggtggaggtgatggccggcgtgggaggcaaatcttangttcgagctgagaacatggtggatctctat

SEQ ID NO: 20099 - DNA, 101 bp, rice(Oryza sativa)
  misc_feature (71): n=t or c
tttctaggtatgcagtttgtgtgttttacaggttctggcaaataattttagttccttacctgtttaggtgntgtatttgcttaatgaatgttttgtgtatt

SEQ ID NO: 20100 - DNA, 101 bp, rice(Oryza sativa)
  misc_feature (71): n=t or g
tcccctctccctcatcgccttgctgtctctgcgaatcgagagagagtcagataaggtcgttaattaggttngtcaattcggctgcttgcggcgagagaaga

SEQ ID NO: 20101 - DNA, 101 bp, rice(Oryza sativa)
  misc_feature (71): n=a or g
cccataacatatgctcctaatttcattttttgtcttgaggaaatgacccttctacccccacattgacaccnttgctttgcccacagatgtacaatgattag

SEQ ID NO: 20102 - DNA, 101 bp, rice(Oryza sativa)
  misc_feature (71): n=t or g
caaccccctccccctactcccaaatggtagcagggaaaattaccctaacaggagtgatttccctggagatngaaggggatcggttggtgcaggggaaaatc

SEQ ID NO: 20103 - DNA, 101 bp, rice(Oryza sativa)
  misc_feature (71): n=a or c
atggccggagaaactgcaacgggtactcctgcagctggaatctgagctgatgtatctgaaaataaaaacantattgataaattaaccgtatcttataaacc

SEQ ID NO: 20104 - DNA, 101 bp, rice(Oryza sativa)
  misc_feature (71): n=t or g
tcgattatagtacgacatgctctatccttaaccacaaacctttgttccaatgattcgtggtactgccattnctccgctttctccatttgaatacttagcac

SEQ ID NO: 20105 - DNA, 101 bp, rice(Oryza sativa)
  misc_feature (71): n=t or c
gagaaattttgggcgtgtttggctgtcgtgtacagcgttgccctgcagcctgcacccagtcctcttgctgnagcaacaagctataacgtggctgtgaaaca

SEQ ID NO: 20106 - DNA, 101 bp, rice(Oryza sativa)
  misc_feature (71): n=a or g
acgtggtgaacaaattgatcgaccagtgtataataaaaggttacaacacataagatgccgaaaaatggacnaactaataaaaaataatttataagtttttg

SEQ ID NO: 20107 - DNA, 101 bp, rice(Oryza sativa)
  misc_feature (71): n=a or g
gttggctcccataagtatggcatgatttttcttttgtaatgtatgtctcacatattagtgactttgaaaantgtggtatggtttcattttgttggctagcg

SEQ ID NO: 20108 - DNA, 101 bp, rice(Oryza sativa)
  misc_feature (71): n=t or g
caatttacttaggatatacataccaggatatataatcgaaaatgcatttagtcggtatcccgttccaaganattggcacgggatcctctccctccctcacg

SEQ ID NO: 20109 - DNA, 101 bp, rice(Oryza sativa)
  misc_feature (71): n=a or g
ggcgacagttatactggccccgtgaaggaaacccaatgccttcaaaattttgacaatgttttcatatttcnaatcttggtatcaaatttaggcgtaattag

SEQ ID NO: 20110 - DNA, 101 bp, rice(Oryza sativa)
  misc_feature (71): n=t or g
tttctggtgattcggtggtgggctaaagaaaattcggactttatatggaagggattagaaattaggtttcntagcacaagagcaattattggtgataatat

SEQ ID NO: 20111 - DNA, 101 bp, rice(Oryza sativa)
  misc_feature (71): n=t or c
gcatgttttgtattaataaagcgtcaacgaccaaacacaaaatagatcaccatcagcaccagctgccccantattttccagcctgaatcacgtcagaagct

SEQ ID NO: 20112 - DNA, 101 bp, rice(Oryza sativa)
  misc_feature (71): n=a or g
aagccgatatgttttatacaacgtttcatcggagtttaattctagccaatgagtcattttttatagtcttnaaaagtatggcaccgtcttatgttcacatc

SEQ ID NO: 20113 - DNA, 101 bp, rice(Oryza sativa)
  misc_feature (71): n=a or g
aatcatttgaagcttgcttaacagaaaatcaaaccaaccacacttaatcagaatatgacacatcacccagnccaaaactagatggctttatccagccaaat

SEQ ID NO: 20114 - DNA, 101 bp, rice(Oryza sativa)
  misc_feature (71): n=a or c
gcaccagcttcttcgactgctcgatgccccagtagctgttgaccaccacctccttctccgcgtccgccttnttggcctccgccttggccgccgcctccgtc

SEQ ID NO: 20115 - DNA, 101 bp, rice(Oryza sativa)
  misc_feature (71): n=a or g
ggttggcgaaagatggctcggtgactgctgactcttgacagtatactcaatataatgtttttcagcttgantatttcgaactgcagttttgtctgctaaag

SEQ ID NO: 20116 - DNA, 101 bp, rice(Oryza sativa)
  misc_feature (71): n=a or g
gatgtgtttggttgctgcttgccctagagaggagttgcctagcctaaagcctacctgagaattcttagttncttgtttgtttattactaccctgaggacca

SEQ ID NO: 20117 - DNA, 101 bp, rice(Oryza sativa)
  misc_feature (71): n=t or c
aactagctactccctgtatagagtagtaaattgcaaaggtgaaagggaaaaaagaaaaacagagaccctcnttctctaaatgtttgacgccattgactttt

SEQ ID NO: 20118 - DNA, 101 bp, rice(Oryza sativa)
  misc_feature (71): n=a or g
atcgttcattccgaataacataactttgtaaactagattagcaaatggtacaaacctcaggaagaggaacnataagactatttgtgaacagcttcgatatg

SEQ ID NO: 20119 - DNA, 101 bp, rice(Oryza sativa)
  misc_feature (71): n=a or g
aagacaaagcaagtcagaaattagtcaaagggtgctcctttcaccgtcttggtcatgtactcatgttcctnctccctccgtcttaaaatataaacacattt

SEQ ID NO: 20120 - DNA, 101 bp, rice(Oryza sativa)
  misc_feature (71): n=t or c
gcatcgccgcaacacattccaccttggcctcgcctacggctaacattgtcctcctccaagtcattcccggntgtcgtccttatcgtcgtggcatccctccg

SEQ ID NO: 20121 - DNA, 101 bp, rice(Oryza sativa)
  misc_feature (71): n=a or g
atgtacggtgggaaacggtcggaaatgatatcatgtttatcaaacgattcacggctgagttgaaattttcntatttatcaatttaattaatagtggtgatt

SEQ ID NO: 20122 - DNA, 101 bp, rice(Oryza sativa)
  misc_feature (71): n=a or g
gactaaggtgggagccctttgaccacactttgactagggtgggatggtgcttagtttgctaatattgtttnattagctgagaaatacagatcccgtttgat

SEQ ID NO: 20123 - DNA, 101 bp, rice(Oryza sativa)
  misc_feature (71): n=a or g
agcagagtacgcagaggtaaatttccatcggctaaatcctctccttttgcatcagattggttttccctctntttatcttgttttcttcttctctgttcttt

SEQ ID NO: 20124 - DNA, 101 bp, rice(Oryza sativa)
  misc_feature (71): n=a or c
atgtatacagcttccttcgctcagtgcaatataaacacagatatgctgcttgctgcaataatgaaataatnaaaaaaacttgatttttcaccattcaatca

SEQ ID NO: 20125 - DNA, 101 bp, rice(Oryza sativa)
  misc_feature (71): n=a or c
gtcctgaagcggccgctaatactgaaagacttggcacgtccgtagtacgtgcactctccaggtgattttanccttttctaaaagagatataaatctaggca

SEQ ID NO: 20126 - DNA, 101 bp, rice(Oryza sativa)
  misc_feature (71): n=t or c
aatctggcgctgccgccagcagagcctctccctgaacacaccaacgcatcaatcgctggatccgtggaganggccagacgggagacgagtgagcgagcgag

SEQ ID NO: 20127 - DNA, 101 bp, rice(Oryza sativa)
  misc_feature (71): n=t or c
tgagccgtccattaccggtgattaattccatttatttccctcttaagcctttttcagttcctctataaacnacactccgtcgttgtcaacttttaggactc

SEQ ID NO: 20128 - DNA, 101 bp, rice(Oryza sativa)
  misc_feature (71): n=a or g
gagctgccgcaagattcagcactgactccttgccgtgaatcttacggtgttcccactttatctcagggggngaaagcttgccctgctgtttgtttccgcca

SEQ ID NO: 20129 - DNA, 101 bp, rice(Oryza sativa)
  misc_feature (71): n=t or c
tcagggccgcaaagttcaaagacagtgacacgatcaacaacttctaacttagattcttggaaacacacaancaacgcattggaggaaacaacagactcctt

SEQ ID NO: 20130 - DNA, 101 bp, rice(Oryza sativa)
  misc_feature (71): n=t or c
gttgtccgagtcatcattttggatgggatcaggatggggggaatcagcactggaaagagggtcaatctcgnccaggacagaagcaatgcgtgttctaggag

SEQ ID NO: 20131 - DNA, 101 bp, rice(Oryza sativa)
  misc_feature (71): n=a or g
caaaatcgcatgccgacatcgtgaaccactcctttgtacaactattagcttccaaagctctccaatctctncttttcatggtattactagtgttttttagt

SEQ ID NO: 20132 - DNA, 101 bp, rice(Oryza sativa)
  misc_feature (71): n=t or c
cagcccgtaaagcacgacgctgtctcgtcgccgtccgatccgggctcccaccatttcctgtagccctgcancgtccaatggtgagggccttggatctcatc

SEQ ID NO: 20133 - DNA, 101 bp, rice(Oryza sativa)
  misc_feature (71): n=a or g
gacagcacaacatcagacagaacgagtcaaaagcttttttgactggcacagaggtcagcagtgctgatganaccagcctctcttcagcaggttgtccaccg

SEQ ID NO: 20134 - DNA, 101 bp, rice(Oryza sativa)
  misc_feature (71): n=t or g
gttagatatatggcacctaaccctatagtagataggtgagagtctgtttgactgaatttttattggagctnaagtccaaccaaacgatttaaactctctca

SEQ ID NO: 20135 - DNA, 101 bp, rice(Oryza sativa)
  misc_feature (71): n=t or c
actgcccaatactactacagtaatcacagtatacagcagcagtactgaaaactttctactactcctcggtnattcaatgattggagcccatgttaccaaga

SEQ ID NO: 20136 - DNA, 101 bp, rice(Oryza sativa)
  misc_feature (71): n=t or c
aaatgctatctgtccgatccaaaattctcaggtatatcctaatcatgctttcgcatcactgcagttctatnccgcatcattttagttttcataacatgatc

SEQ ID NO: 20137 - DNA, 101 bp, rice(Oryza sativa)
  misc_feature (71): n=a or c
gggatgaggatggagatgggcacctgcttgggtccgtgaagacgaggcagcataaccacgcggctcctgtntgcctcgaagagaaaacagcgtcccgactg

SEQ ID NO: 20138 - DNA, 101 bp, rice(Oryza sativa)
  misc_feature (71): n=t or g
caaatatttataactagagagggcaagtttagaaaacacgcaaagagtgcaggtagatttgtcttgaaaantattatcatgatactataaattctataggt

SEQ ID NO: 20139 - DNA, 101 bp, rice(Oryza sativa)
  misc_feature (71): n=a or g
gcaacgtgctctcgaggaaaaagaatacatgcccgatcacatgaggaagcgtattattgtagtggtatctntgattccatggcctgtacgttttctttttc

SEQ ID NO: 20140 - DNA, 101 bp, rice(Oryza sativa)
  misc_feature (71): n=a or g
aggacgggccacgccaccactattcaccatttgaggatccagaacaaagaaggaagggtggaggaataagntgtactccctccgtattttaatgtatgacg

SEQ ID NO: 20141 - DNA, 101 bp, rice(Oryza sativa)
  misc_feature (71): n=a or g
attattgtccagttcaaacaaatgcatatatgatttacatcagatcaacaaacaacctcgacctgcatagngtgttttacaaaggtttcctacatttaaca

SEQ ID NO: 20142 - DNA, 101 bp, rice(Oryza sativa)
  misc_feature (71): n=a or g
gctgtaaaagaaaccaaaaatcttctcatgatcagcagtatagtaccccattagctacctaatcacgaatnattccagcacaattaaactatactcgatcc

SEQ ID NO: 20143 - DNA, 101 bp, rice(Oryza sativa)
  misc_feature (71): n=a or g
gaagcggagcaccaagccgaccgtcgctacgagagaccggtcaccaccgggtttacaacaccaccacgaancggagactctaaaaaacgacgccctcacga

SEQ ID NO: 20144 - DNA, 101 bp, rice(Oryza sativa)
  misc_feature (71): n=a or g
ttagtcgaagactgacatctggtgaataattaagtaaaacagaattacgtacaccctccgtactcgtaaangaagtcgtttaggacagcgagatggtcttc

SEQ ID NO: 20145 - DNA, 101 bp, rice(Oryza sativa)
  misc_feature (71): n=t or c
gcgagccaggtgacactgcgtgtacccgatcatatatcacagatagcgacatagcggccatgagctagcanacgcgtgtacgctgagcattcatgcagcaa

SEQ ID NO: 20146 - DNA, 101 bp, rice(Oryza sativa)
  misc_feature (71): n=a or g
acccgtaaccctgacaagcaccattgtgcatagtatcatgctctttctgtggtaacatcgtaaatcaaaantggagccagtaggaagacatgaagataagc

SEQ ID NO: 20147 - DNA, 101 bp, rice(Oryza sativa)
  misc_feature (71): n=t or c
catttctcgaattctttcaagttttgttacaagtgatactaactcataagaacacctcaggaaggcggcancaacactaatttgttagacaataaagacga

SEQ ID NO: 20148 - DNA, 101 bp, rice(Oryza sativa)
  misc_feature (71): n=t or g
gactcaaggcacgtgcgggtaagcgacgacgacattggctcaaggcagcgcgtgggcaagcagcgacagcngcggcacgagcaagtggcggtggcaggcaa

SEQ ID NO: 20149 - DNA, 101 bp, rice(Oryza sativa)
  misc_feature (71): n=t or c
tccgggggatcaggtacagggactacatggagatgcagcagagcaacagcatcaacgagaagacggcgctngacatcgttcgcgtgatgcatcaggccggg

SEQ ID NO: 20150 - DNA, 101 bp, rice(Oryza sativa)
  misc_feature (71): n=a or g
tgacgatcatcgtcgtggatacatctgcacaaaatcagataatgttctgcatttaatatcactttgtcacntgttgtttactttgctaaggatctgatgat

SEQ ID NO: 20151 - DNA, 101 bp, rice(Oryza sativa)
  misc_feature (71): n=a or g
tttggctcctacttctcacctttaacagtttctctcttttttgttaggctcttgcggcgcattgcagcgcnaagaaattcaccctggttcggctggacggg

SEQ ID NO: 20152 - DNA, 101 bp, rice(Oryza sativa)
  misc_feature (71): n=t or c
taacatggtctaatttccattttctgatacaatagatctactactacatgttaggaaacataccctcctcnccggcgcgtaaaacgaagcacatactattg

SEQ ID NO: 20153 - DNA, 101 bp, rice(Oryza sativa)
  misc_feature (71): n=t or g
agggacgagaatcgtgatctacgtgttcccaatacctgtgcatgtctgaatcgtgaactacactgactttnccaatactgtttgtcagtgtagttgcgtgc

SEQ ID NO: 20154 - DNA, 101 bp, rice(Oryza sativa)
  misc_feature (71): n=a or c
aacccttccaatgatagggacatagagttgagcttggttttgtcactccgccaccgtgttgatttccacangagagtggatgactccaggaggatccttct

SEQ ID NO: 20155 - DNA, 101 bp, rice(Oryza sativa)
  misc_feature (71): n=t or c
tactgaaataacgaactaaccctagtacataaaagcccaaatgagggcatattaaagcaacacagacattngccagccatgtcaatccattcaattatgaa

SEQ ID NO: 20156 - DNA, 101 bp, rice(Oryza sativa)
  misc_feature (71): n=t or c
gtactaggttagttttttatgggacggagggagtacaaccataccaccttatcgaatattcaaatctcganggccgaaattaggttgggttcgtttctctg

SEQ ID NO: 20157 - DNA, 101 bp, rice(Oryza sativa)
  misc_feature (71): n=t or c
aaatcttttctactactcccaatgttgcttccaccaatcaagcgaacatgtcttagcctaattacccaacnccctcccaatccagttcgacttactcactg

SEQ ID NO: 20158 - DNA, 101 bp, rice(Oryza sativa)
  misc_feature (71): n=a or g
ttatatacacacgcagaccccgccggggtaaagtcgtaaagatcaacgcagcacacatagttagcgattcnatcgtaaactttgtgccgctgcatgtgggc

SEQ ID NO: 20159 - DNA, 101 bp, rice(Oryza sativa)
  misc_feature (71): n=a or g
tccttctttacagcaccaaatcttgcagaccttacatgctggagtgttccattgcttggtctgggctacgncgttcagttaaatcttttgtcgaaaattgc

SEQ ID NO: 20160 - DNA, 101 bp, rice(Oryza sativa)
  misc_feature (71): n=t or c
aaacaaagatggccgtgagaaatagccaaagctagcatgcgtgttcagactagagaggatcatatgtagtntaactagggcgcgtgtgcagtatatatata

SEQ ID NO: 20161 - DNA, 101 bp, rice(Oryza sativa)
  misc_feature (71): n=a or g
ccttgttgcaaacagggcatacctgacaaatgtgtcacaaggctgatcagtatcaatacattctggatgcnaacatggtctcaaaaattttgtaaatctat

SEQ ID NO: 20162 - DNA, 101 bp, rice(Oryza sativa)
  misc_feature (71): n=t or c
aacgatgaacgtaagtaagcgctcttccgcaattttattcagctagcattggtttttgaggttggagtcanggcgtgcattgcccctgaggtggtgctttc

SEQ ID NO: 20163 - DNA, 101 bp, rice(Oryza sativa)
  misc_feature (71): n=t or g
actgcagttgggcagccgaacacacccattgaactcagaagtacttcctccacctaaaatatactaatgcntaacttatatatatatatatatttcataat

SEQ ID NO: 20164 - DNA, 101 bp, rice(Oryza sativa)
  misc_feature (71): n=a or g
aattttatgtgtaaaacgggtggcacccgattcgccaattgtacagttgtacatactatgtaagccgttcngcacaaaaaaagaggaaaatgaaaaaagca

SEQ ID NO: 20165 - DNA, 101 bp, rice(Oryza sativa)
  misc_feature (71): n=a or g
agggcacgtacctgtacgaactaggtaagtgacctaaccagctagatcatgttcagaataaggagaagaanccgcatgcaaacacgtagatcatatggctt

SEQ ID NO: 20166 - DNA, 101 bp, rice(Oryza sativa)
  misc_feature (71): n=t or c
ctaaacatgaactttctctcgctagaccaccttctttctccttaagtcactaaggcacttcgacacaatangatgcaacttatctttactatggatgacat

SEQ ID NO: 20167 - DNA, 101 bp, rice(Oryza sativa)
  misc_feature (71): n=t or c
caattttgttttctgcctccttaaaacttatagaacatattcatctgtaatgggtggtcggcacgcaaggnggtgcacggagggtgggctgtgggtggcgg

SEQ ID NO: 20168 - DNA, 101 bp, rice(Oryza sativa)
  misc_feature (71): n=t or c
agaggtttgttataggaacttccggctgttacagaaacttcggctgtgttctgcccataagctttcaactnatcatcctccctcgtttatcgtgtgcatgt

SEQ ID NO: 20169 - DNA, 101 bp, rice(Oryza sativa)
  misc_feature (71): n=t or c
gttttagtgagttgctgatcgatgctcccagctagagctatgcatacgcattcagctacacatatccatantcgcagttagtgagttgctagctaccgata

SEQ ID NO: 20170 - DNA, 101 bp, rice(Oryza sativa)
  misc_feature (71): n=a or g
atagttttagaagcatatgacacgaataatttggtgacgatctgcccccatcctatgagcccattcgaagnagctagtcgcgaaaaatgccaacattagac

SEQ ID NO: 20171 - DNA, 101 bp, rice(Oryza sativa)
  misc_feature (71): n=t or c
tggaatggcgcgatgacgtctctgagctcgtgctgtactggcttgagtactgtcggcttgagtaagcatgnggtgtccaggcaccatcatcggctggcaaa

SEQ ID NO: 20172 - DNA, 101 bp, rice(Oryza sativa)
  misc_feature (71): n=a or g
attcatattcttgacagaatattcaacgaccgtttgtcgcataggtgtgaatttcaagcaaaacaatatcnttttgtttcaagcatagcattaccttcttt

SEQ ID NO: 20173 - DNA, 101 bp, rice(Oryza sativa)
  misc_feature (71): n=t or c
tcagcatctgctgtgaccaacagaggaacagggaggcaaactttgccaccagttcctcgcagaagtgggcntacaccccctccgtgccacttgtgaacaga

SEQ ID NO: 20174 - DNA, 101 bp, rice(Oryza sativa)
  misc_feature (71): n=a or g
acataaaaaagaaatggagggagtacttctcattaccatggacctccttttcgatctgtggccgagtttantttcaaaatttttcttcaaacttccaactt

SEQ ID NO: 20175 - DNA, 101 bp, rice(Oryza sativa)
  misc_feature (71): n=t or c
actacttggtactagtagtaattaattaatctggataataatggcagcaaatatatacaccgtgtttagtngcaaacttttttttcaaactttcaactttt

SEQ ID NO: 20176 - DNA, 101 bp, rice(Oryza sativa)
  misc_feature (71): n=a or c
aataaacccatcagttggttgaattatacagcgaactgtgccctgcaggttgaagatctagcatgatgtcntggctgtcacattttcagggactgaaaaac

SEQ ID NO: 20177 - DNA, 101 bp, rice(Oryza sativa)
  misc_feature (71): n=a or g
gagagacaagaatgatcattagatcattctgccttctgaactttgccatcgtcattcgtcagacacagcgncatctgatcagcagagcgccaccgcccggt

SEQ ID NO: 20178 - DNA, 101 bp, rice(Oryza sativa)
  misc_feature (71): n=a or g
accacattgagctaaaaatcggctaatatgttcataagttgatacaccatcttgccctgaaaacttggagnaatccggaactttaaatcggttaggaagag

SEQ ID NO: 20179 - DNA, 101 bp, rice(Oryza sativa)
  misc_feature (71): n=a or g
acatgattgatcaggaaattctatctcaaataggcacatgattgcccagataattcaactagtctattatntgctaaaagtctttcacttaaattggtgag

SEQ ID NO: 20180 - DNA, 101 bp, rice(Oryza sativa)
  misc_feature (71): n=a or c
atgcatgatttgaataaagagaaccgttaattcaaaacagaaaaaaatcagtaaaagaacaaataatgccnagggatgttctgaattacccttcaaacaca

SEQ ID NO: 20181 - DNA, 101 bp, rice(Oryza sativa)
  misc_feature (71): n=t or c
cgcctgtgctgcgctgtgaagtgcttgggcgagtttgaacatattttgacaaactagccaagaacccatangttccaataaaaaaacaaattatgtcgtgt

SEQ ID NO: 20182 - DNA, 101 bp, rice(Oryza sativa)
  misc_feature (71): n=a or g
tgggttgatttgtcagcgtgggccgaaaagaagctagttggtgtgctgtgcttgtttacctccgttcgatnccgatccagcggcgtagcggcatcggacgt

SEQ ID NO: 20183 - DNA, 101 bp, rice(Oryza sativa)
  misc_feature (71): n=a or c
gacccagtcagccgccacgacgacgcttccatctcgcaaccgacttcctacttaattcctccgtactcatnaagaaaatcgttgagaacaatatttaagtc

SEQ ID NO: 20184 - DNA, 101 bp, rice(Oryza sativa)
  misc_feature (71): n=t or c
gaacttatttgaccatttaaatagccacaatgtcatgctagaaaaaataccttggcaatcatttaccgttncattagggttaaatttccaattattaacac

SEQ ID NO: 20185 - DNA, 101 bp, rice(Oryza sativa)
  misc_feature (71): n=a or c
agtactagaagtgtacaagtatggagcataggacttaatcagagactcagagtagcctacaaatgccaagncagaaaatcactatacatcttaccttgctg

SEQ ID NO: 20186 - DNA, 101 bp, rice(Oryza sativa)
  misc_feature (71): n=a or g
caccaaggtagtacaaaatggtttagagttactctttgcattttaggaggtctttcggccttaggaaatcntggctttgtcttatttggttacattgtgaa

SEQ ID NO: 20187 - DNA, 101 bp, rice(Oryza sativa)
  misc_feature (71): n=t or c
tatcaaagctgatatcgaagtgcccattgggctgcatcgcccatagcttgggtccactcacaatcatcacngagtaagcccaatgcctcaaaggcagcacg

SEQ ID NO: 20188 - DNA, 101 bp, rice(Oryza sativa)
  misc_feature (71): n=a or g
tgtatgctggtttattataacggtcacgcggaataaggtgtgtctagttcgtttgaaaaaaaagttaaaantttacgtgtgtagaaaagttttggatgtga

SEQ ID NO: 20189 - DNA, 101 bp, rice(Oryza sativa)
  misc_feature (71): n=t or c
ttgtaggtcaaagttactgaaaagatgggctattgtcttgtcacttgttacctcaggatttatggtacttnatctatctcaaaataagttcaagtccaacg

SEQ ID NO: 20190 - DNA, 101 bp, rice(Oryza sativa)
  misc_feature (71): n=a or g
tattttccaaccattggatcacatgtagtcctcctctgacctctcttcttccccacagaggcgcagacacnctctgtctctcagtcttgagacaagtgcga

SEQ ID NO: 20191 - DNA, 101 bp, rice(Oryza sativa)
  misc_feature (71): n=t or c
acgatccgcatcacacaactcatgatttggacggattaaacgcctaaagatagcagtttttttttctaccngtgagattgtacaaaatttgttgcattctt

SEQ ID NO: 20192 - DNA, 101 bp, rice(Oryza sativa)
  misc_feature (71): n=t or c
gttctccttttatggtgctagtatatgccacaaatgctttttttttggggtataattactgttgaatttcntaaagtgcaggaatgattcaatctagtact

SEQ ID NO: 20193 - DNA, 101 bp, rice(Oryza sativa)
  misc_feature (71): n=a or g
ttgcattatgctgatctttgtctgtgttgtgtgttaatactaacacttgtacgacatgctacagaagaagnaaaaagtacacccaaggtccctcaactata

SEQ ID NO: 20194 - DNA, 101 bp, rice(Oryza sativa)
  misc_feature (71): n=t or c
gagcaattttgttggggagcgggtggtgcgacgcgcgattaaagggaagtttggttgcatttgccgtaacntgtcagtgtcacaattccgtagctatttat

SEQ ID NO: 20195 - DNA, 101 bp, rice(Oryza sativa)
  misc_feature (71): n=a or g
ggtcttaggaaccgagaagattatcgtacggatatatcgtggtcttaagaaccgagaagattatcgtacgnttttgtaaactctgtgcggcgtccgctgcg

SEQ ID NO: 20196 - DNA, 101 bp, rice(Oryza sativa)
  misc_feature (71): n=t or c
gtatttacttaatgacgcaataatacatgctttattttgagtgtcggggagccttagtcccttttgtgtcnccgtgttcaaacaagttcctaaagttttct

SEQ ID NO: 20197 - DNA, 101 bp, rice(Oryza sativa)
  misc_feature (71): n=a or g
tttggatttccccatggtcgctgagaagactcgaatcagaaactctcgaagcagaaaactcgaaaggcgtntctatacggaagtgtttgagagaggagagt

SEQ ID NO: 20198 - DNA, 101 bp, rice(Oryza sativa)
  misc_feature (71): n=t or c
agcgagattttatatttgaaactacaggttgattaccaacaggatgaatcaaacaagctaccgaattgggntgtcaatatgtttatccaaacctatataaa

SEQ ID NO: 20199 - DNA, 101 bp, rice(Oryza sativa)
  misc_feature (71): n=a or c
actgatgtccctcagtgacagaaaccataccaaccttccctcgcatttcctggaatttgattcgtggtagngcctttgtcaggatgttagcgagttgccct

SEQ ID NO: 20200 - DNA, 101 bp, rice(Oryza sativa)
  misc_feature (71): n=a or g
ctgcctcctactgattcccttgtaattttcttcgtgcaagaggcggaagtgcatctctagcgctgctgctngtgcggccgcatattcatcgggaggcatgg

SEQ ID NO: 20201 - DNA, 101 bp, rice(Oryza sativa)
  misc_feature (71): n=t or c
ttgaggagtacagagtacctttttttttagaattcgtaagtacgtactaggtacctgttcctcctctgcancctctcgttgatgatctacttagtcaacca

SEQ ID NO: 20202 - DNA, 101 bp, rice(Oryza sativa)
  misc_feature (71): n=t or g
acagaagttggatggggaggaaacgagctctttattcacttatattcatatatgggccgaccctgatttcnctggcttggcctgcgcacgagcccgatcgg

SEQ ID NO: 20203 - DNA, 101 bp, rice(Oryza sativa)
  misc_feature (71): n=a or g
gaagaaagcatgctataaatttgtagccagctttaacacggtgtatgagaggtggctggatattaatggtntagtatatttttataactaactattacatg

SEQ ID NO: 20204 - DNA, 101 bp, rice(Oryza sativa)
  misc_feature (71): n=a or g
aattgaggattgtagtatatattgaccaaacaaaaaagatttagtacaaagtacaaactcttttaacgagnaaacattttggttaaaatgtcaaaatagca

SEQ ID NO: 20205 - DNA, 101 bp, rice(Oryza sativa)
  misc_feature (71): n=a or g
agacgataagatattaccagacaagatggaggagtcgacggcgaagagatgatgaagaggctgaggccgcngagccagccacggccagcacccagccggca

SEQ ID NO: 20206 - DNA, 101 bp, rice(Oryza sativa)
  misc_feature (71): n=t or c
tacagccctagcgagctgcaagttaactgaaactacatgccactgttacattcaacattgctatcttcatnaaattactatctgccgctgtttattcaaca

SEQ ID NO: 20207 - DNA, 101 bp, rice(Oryza sativa)
  misc_feature (71): n=a or c
gtaacagtggctgttacaaggtaaccatcttttttttccccttaacttccttaactttgacagatgtagtnaaaaagaatggagtcctgcaccgagtagag

SEQ ID NO: 20208 - DNA, 101 bp, rice(Oryza sativa)
  misc_feature (71): n=t or g
catccccccttgctccttctcgaatcctgtcaaaacgatcgcaaaatcagtaaaccacgaaacgcaagaanggcagagaccccgagagaaagagagagaga

SEQ ID NO: 20209 - DNA, 101 bp, rice(Oryza sativa)
  misc_feature (71): n=t or c
gtgcttttcatattaagttcttgctatattggacttgcttttgtgacatctgacatgtattgttgtcctcnctactgaacagatgtgccacaggcatggtg

SEQ ID NO: 20210 - DNA, 101 bp, rice(Oryza sativa)
  misc_feature (71): n=a or g
agatggcaaaaagaaacggggtcagatcaaaattttcaccggggtctttctagcattactaaggtggtaangtggtgtttgggaaggaggaactaaactca

SEQ ID NO: 20211 - DNA, 101 bp, rice(Oryza sativa)
  misc_feature (71): n=t or c
ttaccgcacaaaatttccagcgggtgcattcttctccttctatgttcacatcaatcaaagaaactccctgngcagatgagttcaatgagcaaagccatgct

SEQ ID NO: 20212 - DNA, 101 bp, rice(Oryza sativa)
  misc_feature (71): n=a or g
atcctcccgttgattctgtaccaaaccatcgactatcggctatcggctaacacatgcttttgacacactcnagactcgagcttgcaattgtcatcaacgtt

SEQ ID NO: 20213 - DNA, 101 bp, rice(Oryza sativa)
  misc_feature (71): n=t or c
cagggtccagaatttctgaaaatcgggtttatcggtgggcacccaagaaaacagtattggccaaaaatttnggccccttttgaatttgccgcggcattttt

SEQ ID NO: 20214 - DNA, 101 bp, rice(Oryza sativa)
  misc_feature (71): n=t or g
agaagtacgaatttgaaaaggaataggtcttgcttggaagaaaagggaatttggttgttgcaaagcaaggngaaaactcatcctcaagtaaggcaatagtt

SEQ ID NO: 20215 - DNA, 101 bp, rice(Oryza sativa)
  misc_feature (71): n=a or g
cgggagccaccgccgttgtcaaccccaccgtcatcgtcactgccatcttcgacctcctcccatccaaggcnggagagctcgagagccaccgccgtcgctcg

SEQ ID NO: 20216 - DNA, 101 bp, rice(Oryza sativa)
  misc_feature (71): n=t or g
ttgtgcaactgcgaaagcatgcatgattccaagctagacagtattctgttgggacatcaatcatgaccaanattatatgcaacatccaagaacagaagatg

SEQ ID NO: 20217 - DNA, 101 bp, rice(Oryza sativa)
  misc_feature (71): n=a or g
ttcaaactgctgctgttgcacccttttaattagtttttaatacaaccaggggctttgccctttctcaatgnaaaaaaaaaagaaacatcgtcgaatgcaag

SEQ ID NO: 20218 - DNA, 101 bp, rice(Oryza sativa)
  misc_feature (71): n=a or g
ttaacataggcaaaagtacttgataccatttctaacgtattccaatggtctgtttttaccacgcacacaancttttttttaaaaagagggcaaaagctttg

SEQ ID NO: 20219 - DNA, 101 bp, rice(Oryza sativa)
  misc_feature (71): n=t or c
atcagatcctgtcgctgccaccacaatgagaggagaggagaagagaacctatcgtaacctcgcaagtagtngatctgcctctaagcgacctctccgcttgg

SEQ ID NO: 20220 - DNA, 101 bp, rice(Oryza sativa)
  misc_feature (71): n=t or c
tcaattttgagcttttgatttttctgcacggaataaaagggactggaaggagtatatactccctccgtccnaaaataaataaacttatagagtttaaattt

SEQ ID NO: 20221 - DNA, 101 bp, rice(Oryza sativa)
  misc_feature (71): n=t or c
tgacgatttcgacgctgacgacaacggcgtaggagagagaaaattgaagaaaaaaaatgtgcagctgtcangtgggccccacttacttttttctctgacta

SEQ ID NO: 20222 - DNA, 101 bp, rice(Oryza sativa)
  misc_feature (71): n=a or c
tcagttaactgtatagttttctgctcatttgatgatgataggattttgatatgattgatgccatgctctgnacaacaatcaccacaccacccctggtctgg

SEQ ID NO: 20223 - DNA, 101 bp, rice(Oryza sativa)
  misc_feature (71): n=t or g
tgctgtataccgaattgaagtttacaacagtacaattttctggaagcattttttttacaaatattcccctntttctctatgttaatattgagaaatatacc

SEQ ID NO: 20224 - DNA, 101 bp, rice(Oryza sativa)
  misc_feature (71): n=a or g
gccgtccttaaaatttgaggtctctttggatttgatgaattttgcagaaattatagggaaattgaacaacngctaaaaagaaactcttgttaaggtgtgct

SEQ ID NO: 20225 - DNA, 101 bp, rice(Oryza sativa)
  misc_feature (71): n=a or g
agatctcagttcaactgtttgctttgatcaggaaggctatcataatcattcaactgtttgctttccagttnaacatcgtctagtctttgattgatcagcta

SEQ ID NO: 20226 - DNA, 101 bp, rice(Oryza sativa)
  misc_feature (71): n=a or g
ggtggagctggagctggaattgtgccaaacaggaattagaggattcattgttaagagatgagtagttagcnggtgagaagtttttccgtttctagttttta

SEQ ID NO: 20227 - DNA, 101 bp, rice(Oryza sativa)
  misc_feature (71): n=t or c
gcaagagaagaggttttggggtgggggtaatataaaaaactaaatactggatgccaccacattctacactnaatgtgatcaaagaacaaaaacaagaatgt

SEQ ID NO: 20228 - DNA, 101 bp, rice(Oryza sativa)
  misc_feature (71): n=t or c
ataatttttctagtagtggcagcttgaattgggtgtaatgtatccttgagctgaaagagatgatgactagnagctttcttgtgtgcaggatttttatgaag

SEQ ID NO: 20229 - DNA, 101 bp, rice(Oryza sativa)
  misc_feature (71): n=t or c
aacaccctcgttacgatgctatatagagagaagcaagagcaaatagtcttttttgcttttcatcccaactnacatgtataaatggtaaatgtgacgagggt

SEQ ID NO: 20230 - DNA, 101 bp, rice(Oryza sativa)
  misc_feature (71): n=t or c
agaaacagggcctaaaacaatcagcggaatcacagaaacttagtttgatgcttactttgatagttaagcanttagtgaatacttatattaggtcaattact

SEQ ID NO: 20231 - DNA, 101 bp, rice(Oryza sativa)
  misc_feature (71): n=t or g
aatgtttggcatcaaaactttctggaatacataggggagcaatctaagcaatcatcttcaagcactttcgntcacggggtactcaaaggcaacatctttcc

SEQ ID NO: 20232 - DNA, 101 bp, rice(Oryza sativa)
  misc_feature (71): n=t or g
gttaactatactatcacgaagaaagtctagcatctgttctgttgcttgccaatctgtatttaaggtgacanggacgagggctaagcacttgagacctcata

SEQ ID NO: 20233 - DNA, 101 bp, rice(Oryza sativa)
  misc_feature (71): n=t or c
cctccttcaaagttgaatgaatattatagtactctgtcagtccgaattagaattttaaagttagacacggntattaagaaaagtagataaaattaaatagg

SEQ ID NO: 20234 - DNA, 101 bp, rice(Oryza sativa)
  misc_feature (71): n=t or c
tttttaagggaaggatgaagagtgttggtagcagaggcagagtatcagttcagtttacactactactacancattagctctgctcattgcagccatggaga

SEQ ID NO: 20235 - DNA, 101 bp, rice(Oryza sativa)
  misc_feature (71): n=a or g
gctttgtgccagttatcaagcccaactgttgtgatattgcggtcctgggaaaatgattaattaattattcntgttaagaatgacaaaaggagagaatgggc

SEQ ID NO: 20236 - DNA, 101 bp, rice(Oryza sativa)
  misc_feature (71): n=a or g
taataattttgggtttactacatattctgagttataggagtaacgagtaggtataggatatttaaagaagnaaaataaatgtaaatttgttgttttagatt

SEQ ID NO: 20237 - DNA, 101 bp, rice(Oryza sativa)
  misc_feature (71): n=t or c
agggttttatatggcatgcatgcaagtaataatatcaacatattgcaccgagttttgcttcgggtgcgcgnggtgtcaatataacgcaatgtttttggtgt

SEQ ID NO: 20238 - DNA, 101 bp, rice(Oryza sativa)
  misc_feature (71): n=t or g
atgtttggtgccatcaacttggagtatgaccaatgtgcaaattattgtactacttcagaacaaaaaggctnatcagcttcagataagccagagctgtctgc

SEQ ID NO: 20239 - DNA, 101 bp, rice(Oryza sativa)
  misc_feature (71): n=t or c
aaaagtagtgtgaagcattagccttttggattaaggtgagcattcgttttggattattatagccttttgcnttagtatttgggtaccaagttttgtataaa

SEQ ID NO: 20240 - DNA, 101 bp, rice(Oryza sativa)
  misc_feature (71): n=t or c
aaacagactgaggacatggtaggatgaagggtaaaacaggaaggagaataggcgaatccttgtgtttaggngggaaatagtaaacaaaataggtaacatgg

SEQ ID NO: 20241 - DNA, 101 bp, rice(Oryza sativa)
  misc_feature (71): n=a or c
aggccgccgagctgcagcaggcgatcgagctccacagccgccgcctcatggggctgcagctgctagacttnaagtcgcgcgccgccgcggcgccgaccccc

SEQ ID NO: 20242 - DNA, 101 bp, rice(Oryza sativa)
  misc_feature (71): n=t or c
caccatatctttatatagttagtgatccttaactgatgttagtcattgtctgaattcttttttaagttagngtttattattatatttatatgtacgataaa

SEQ ID NO: 20243 - DNA, 101 bp, rice(Oryza sativa)
  misc_feature (71): n=t or c
cttgcatggtgccccttcccttcttatatatgaaatcagtacggacgcttcgcaatcgacgggtacatcanctaccattgaaaaaatagtacttagtcgta

SEQ ID NO: 20244 - DNA, 101 bp, rice(Oryza sativa)
  misc_feature (71): n=a or g
ttttttattttggtgcaaggaaaatcaatggttaatatatacgtgttttctttcatcgggcatatgttatngtgtacaaatgcggttttactgctccatcg

SEQ ID NO: 20245 - DNA, 101 bp, rice(Oryza sativa)
  misc_feature (71): n=a or c
actagcaatctcacagcctcaccaacctttctggaacctctcttagcgaaccctttgcctctaggccttantcctctgtttatggaggaggattagagggg

SEQ ID NO: 20246 - DNA, 101 bp, rice(Oryza sativa)
  misc_feature (71): n=a or g
ttatttttgtgtgtgaaactgacatgtgagtcccatggttttttttattaaattgccacgtcaatgccacntgggacgaagatctagtcaaaagagccata

SEQ ID NO: 20247 - DNA, 101 bp, rice(Oryza sativa)
  misc_feature (71): n=a or g
gttcttggttattctgatgtttggggccctgctccctttacttcaatacggggtcatcactactatatctntcggagatatgggcctgggggtatgcaaag

SEQ ID NO: 20248 - DNA, 101 bp, rice(Oryza sativa)
  misc_feature (71): n=t or c
cgtattatgccgaagaaatttcttaagagcacgacttcgatacagtaggtagcacagtactgtatcacacnttttctcccagatacaatataagagcatct

SEQ ID NO: 20249 - DNA, 101 bp, rice(Oryza sativa)
  misc_feature (71): n=a or g
taaaaaaacgtatcaatagtgatttgccgtactttcagaattaactcagcacaggaaagagactcaaatanaatcgacagcaatgacatcattcaaatgtt

SEQ ID NO: 20250 - DNA, 101 bp, rice(Oryza sativa)
  misc_feature (71): n=t or c
aaacccaaattcacatcctacagaacatttattccaatcctgagaggggaaagaatgcataagcacgatanatggagaataagtaaagcactaaatgaatg

SEQ ID NO: 20251 - DNA, 101 bp, rice(Oryza sativa)
  misc_feature (71): n=a or c
ggacatttgctccaataactgaaatattgatagaggcgagctatgactcgtgtatctgattcaactgtgcntcttctgtacaaacagcaaagagtcaacct

SEQ ID NO: 20252 - DNA, 101 bp, rice(Oryza sativa)
  misc_feature (71): n=t or c
ttagacgtctcctcgccgatcctggtcgcattgcgagaaggaatcacctccatcgcctgcaccaactcggngagcgacgacgtcaacgagaactcatcagg

SEQ ID NO: 20253 - DNA, 101 bp, rice(Oryza sativa)
  misc_feature (71): n=t or g
tcggagcagaggagaagttgggatggagagcgacgccaatcgttgtctggttgttagagaactctcccgtnttttttcttggagatgtttggcttcagtct

SEQ ID NO: 20254 - DNA, 101 bp, rice(Oryza sativa)
  misc_feature (71): n=a or g
ttgctttgcaccttatatatgtagccatcaatggatgtgttccgcaataggtagttctttcagtacaggantggcattattctttttaagtaacgaaaaat

SEQ ID NO: 20255 - DNA, 101 bp, rice(Oryza sativa)
  misc_feature (71): n=a or g
ttggttttccatggctagttagtcttgtaaggaacatgaaagctgccgaaaacaagagcaccaaaacaagnaaatagactaaccaccccctgtgccatcac

SEQ ID NO: 20256 - DNA, 101 bp, rice(Oryza sativa)
  misc_feature (71): n=a or g
gtatctaaacgaacatatcctatcctatcatagattgattcaggaggacttttagactgtgttcgggagtnagggttggcacgtaaaacgaagcaatgttt

SEQ ID NO: 20257 - DNA, 101 bp, rice(Oryza sativa)
  misc_feature (71): n=t or c
gttgtattgtgattcgaaaaaaaaaatccattgtgaaaaacatatatagacgtttctaaaagaaaactagnatggtggctcgcgcagattacgcggctagc

SEQ ID NO: 20258 - DNA, 101 bp, rice(Oryza sativa)
  misc_feature (71): n=a or g
agtgatactccaacacaaacgttttattcgtattataaactcacctctatctagtgccgtagtgcgtggcnttactagcaagaacaaatatgggttttttg

SEQ ID NO: 20259 - DNA, 101 bp, rice(Oryza sativa)
  misc_feature (71): n=t or c
gcagttagcgcagtgggtggtgacaagctctactttatgagtggcgaagtacgacaacaatttatggcttnggagaaagagaagaaagggtggatgcggcg

SEQ ID NO: 20260 - DNA, 101 bp, rice(Oryza sativa)
  misc_feature (71): n=a or c
ttaagatacaatgttaaagggttactattacatttgcctcaagcagctttggagcttggtggttcccagcnttcagtccagagaaccctttgctcaagtcc

SEQ ID NO: 20261 - DNA, 101 bp, rice(Oryza sativa)
  misc_feature (71): n=t or c
acagcatcttgtggtaaccgtccatataccgcagtaaccgcaccttactgcgaggttaccgcagccaaacngcaaaatttgaatacaaatgtttgaaaaca

SEQ ID NO: 20262 - DNA, 101 bp, rice(Oryza sativa)
  misc_feature (71): n=t or c
tacatagttttgttccaaattgtcgtgagtcccatgggaattggaaaaggattcctccattctaaacttanattttaaaagctcatgtgcaaagcaaatag

SEQ ID NO: 20263 - DNA, 101 bp, rice(Oryza sativa)
  misc_feature (71): n=t or c
aagcacctaaattagtttaagatcacttctaaaacttactccttccgttcagaatgtagcatactaaaatnagatggaatacgaatctggatatacctcat

SEQ ID NO: 20264 - DNA, 101 bp, rice(Oryza sativa)
  misc_feature (71): n=t or c
attcgcctcgtcgttaagctgagcgactaggaaggttcttgttctcactggcgactttgcagatttccgangcatctcctcctcttgcgcgtcgtcaacgc

SEQ ID NO: 20265 - DNA, 101 bp, rice(Oryza sativa)
  misc_feature (71): n=t or g
gcagaatgtgaggatagctagactgcacatggtggaattgaaaaagatcaggaacaacacaattttttttnaggggaaagggcatgagctctgccaatttc

SEQ ID NO: 20266 - DNA, 101 bp, rice(Oryza sativa)
  misc_feature (71): n=t or c
tatgaaatcggggagtacaaggacaagaaaattcctcacatacccataagttttcactcaatcccttatangctcctgaattttgcttcatcctctgcata

SEQ ID NO: 20267 - DNA, 101 bp, rice(Oryza sativa)
  misc_feature (71): n=a or c
ccatggccagccatcgacgactagtatagctagctagttgtatccattgacgtacggatccactaagttgnaaattaaaaaggaaaaaaaaaagaaggagc

SEQ ID NO: 20268 - DNA, 101 bp, rice(Oryza sativa)
  misc_feature (71): n=t or g
tttatgccaggaaaatttgagttacaagacatgtccccgttatttcatctcgatagcacgtttttcaaacngatgaatttcatgtatttttcaaaatatct

SEQ ID NO: 20269 - DNA, 101 bp, rice(Oryza sativa)
  misc_feature (71): n=a or c
cgattttcctacggagagattgtggaaggatcataactagtcctttggaaaaatcatcctcccatatttgngtgcggaaccttaacaggaccgcacgtgaa

SEQ ID NO: 20270 - DNA, 101 bp, rice(Oryza sativa)
  misc_feature (71): n=t or c
gtaactttcacctcatcattaggctaagtagtgaggaaggttttattctcacttcatgtcggcggttttgnaggtttccgacgcgtctcctccgcctgcgc

SEQ ID NO: 20271 - DNA, 101 bp, rice(Oryza sativa)
  misc_feature (71): n=t or c
ttttttgctctgcctgctataaaggacatgcacaaatcttggattttgtaggcgaatcaagaaccatttangagaaaatatatttacgcagatatgctcgt

SEQ ID NO: 20272 - DNA, 101 bp, rice(Oryza sativa)
  misc_feature (71): n=t or c
attttatagtatacaattaatccataaataaatcaactagctagtcagataattcagcctccttcagcagnttgaacaggatttaaatttgtgctccccgt

SEQ ID NO: 20273 - DNA, 101 bp, rice(Oryza sativa)
  misc_feature (71): n=t or c
tgtccaccagcacgtcggatgttgcattggtttctggactccgagacctttgaaccagcattaatggtganggtgtaatcggggtcggggaactgttccct

SEQ ID NO: 20274 - DNA, 101 bp, rice(Oryza sativa)
  misc_feature (71): n=a or g
ctctatgaaatcttttgatttaaaaggtccgggggaaacatttttgtaaatgctcgcttcaatacctgcgnggctttcgtcccttttttttcacttcctaa

SEQ ID NO: 20275 - DNA, 101 bp, rice(Oryza sativa)
  misc_feature (71): n=t or c
tatacaaaaggggaagaagaaaacctagaacgagataaactcgatatataggctgcgttctttcccacccncaacagtgctcacggaaaacggagcgatcc

SEQ ID NO: 20276 - DNA, 101 bp, rice(Oryza sativa)
  misc_feature (71): n=a or c
tggttcactttacaacttaatatcatttctctatcaaagttataaaagttatatattggctcattttaccncctaagctgaaattttgtagagccatagat

SEQ ID NO: 20277 - DNA, 101 bp, rice(Oryza sativa)
  misc_feature (71): n=t or c
caacctcatgccacttctttgggtgttcctcaatctgctttcttaccagcttcaacaacgttttattactngactcggcttgtccattagcctgagcgtag

SEQ ID NO: 20278 - DNA, 101 bp, rice(Oryza sativa)
  misc_feature (71): n=t or c
ccggctaagagaaaagttttagctatggttaccccatctccaccatatatgcaccctctcatcccaacaangtgtaccctcaagcagaccatcaggccgag

SEQ ID NO: 20279 - DNA, 101 bp, rice(Oryza sativa)
  misc_feature (71): n=t or c
ccaaccaaccccacccgtcgatgagtctcagtttgctttctctaccactaccaccacgcgacgcggccggntgctcgctgctgccacggctaaaacgcggg

SEQ ID NO: 20280 - DNA, 101 bp, rice(Oryza sativa)
  misc_feature (71): n=t or g
gaaaactttgatctccatccagttaaacttagtcttcttcatcatcgttgtttgtgacccggtgaacactntctggccatgcaagctatacttctcccact

SEQ ID NO: 20281 - DNA, 101 bp, rice(Oryza sativa)
  misc_feature (71): n=t or c
gtaacacgattctttgccactgggccacttaccacgacgattttattgcctctttagaaaggcaattttantgtctatctcggctatctggctggagaagt

SEQ ID NO: 20282 - DNA, 101 bp, rice(Oryza sativa)
  misc_feature (71): n=a or g
gaaactcacagtgcacaaaaattcgaatccactataatcaaaactgcagatccgtactgccaactagattnaacttgtgtgataaatggtaaatctagcta

SEQ ID NO: 20283 - DNA, 101 bp, rice(Oryza sativa)
  misc_feature (71): n=t or c
ggaaaggttttagtgtgaggaaggatattgtgaggcgtgaaaaaagagttggagccatcgaatacaggcantttgtttgctctaaggaggggattcgagat

SEQ ID NO: 20284 - DNA, 101 bp, rice(Oryza sativa)
  misc_feature (71): n=a or g
tttaaagaacatgagttgctcaaggcctctttatgaacttatgaactataaatgggaccaaagtaatatancaaacgacttactgcatcagacaaatcgca

SEQ ID NO: 20285 - DNA, 101 bp, rice(Oryza sativa)
  misc_feature (71): n=a or g
gcgatggatgaggaccagatgacgaaccaagaattactgtttaaagcttcataaaaacataaaggaaaagnatggtacatactttgctgaagagatggctc

SEQ ID NO: 20286 - DNA, 101 bp, rice(Oryza sativa)
  misc_feature (71): n=a or g
acatcagtaatgaagaattcactcattcagagctgataggcaaagtaattgcatatcaacattttggagtngttaagactgcagaaaatattcatgcatga

SEQ ID NO: 20287 - DNA, 101 bp, rice(Oryza sativa)
  misc_feature (71): n=a or g
tcgtggtgtcagatggttcggcctattggagagatcagctgcttctctctgatcgatggatcagatcactntactgtgctatagcaacactttacaggata

SEQ ID NO: 20288 - DNA, 101 bp, rice(Oryza sativa)
  misc_feature (71): n=t or g
gaggacgatggcgaacacgagcggcggcagcgggcgattctagatttctagggttagggttagtgtttttnattttattttttttttcagttttttttgcg

SEQ ID NO: 20289 - DNA, 101 bp, rice(Oryza sativa)
  misc_feature (71): n=a or c
gcagtccatccccttctgtttgatgcccagttgtaaactaatatcactcatgttttacggtaaaccaaacnaaagtttaggaaaattcgaatataattatt

SEQ ID NO: 20290 - DNA, 101 bp, rice(Oryza sativa)
  misc_feature (71): n=t or c
tcgacaatgcaattaacagaggctgtgggcctgtagttgtacatacagaaggggctattgcatcatccaangattctacccccgtttcaaattacttgttt

SEQ ID NO: 20291 - DNA, 101 bp, rice(Oryza sativa)
  misc_feature (71): n=a or g
cacaaccgaaggccacagcccattaggcccacaacatgaaaaccctagcttcctagcctcccacaggacancatcttctttcttcacgcgtgcgcgtctct

SEQ ID NO: 20292 - DNA, 101 bp, rice(Oryza sativa)
  misc_feature (71): n=t or c
cacaccagaaaaaatccccaaaactgaactttattgcatctcacctttctcttttgacacattgaatttgngtactgttcttttttagttattacttatta

SEQ ID NO: 20293 - DNA, 101 bp, rice(Oryza sativa)
  misc_feature (71): n=a or g
atttttgctctacgtgcaaatgcacataaattacctgttacagagtggaacattttttttttcgacattgnttatttgttttatggcactaggctttcatt

SEQ ID NO: 20294 - DNA, 101 bp, rice(Oryza sativa)
  misc_feature (71): n=t or c
tggcattcttttcttgaaatctctggtggtggagttggttcatttacttacctagattaatatttaaaacnggacatatttagtaaattctttttgatatt

SEQ ID NO: 20295 - DNA, 101 bp, rice(Oryza sativa)
  misc_feature (71): n=t or c
cagtattttactaaccaaacccatgttgaatcgccagctggtacccaagagcaaaattgtttaattttganaagtgaacaattgcaaaaatgttcctccga

SEQ ID NO: 20296 - DNA, 101 bp, rice(Oryza sativa)
  misc_feature (71): n=t or c
cgtgatctaaacatgcccggatgtaagcctgtttgcacgcacagttccttccctattttgataggtacagntgaccatcatgaaacttccaggactcttct

SEQ ID NO: 20297 - DNA, 101 bp, rice(Oryza sativa)
  misc_feature (71): n=t or c
atgtactcgctatatcacattgatttcttttttcctaaatattaccacactaacttccgaaggggcgccgnaaagcgcgccagagtgcctagttcatttaa

SEQ ID NO: 20298 - DNA, 101 bp, rice(Oryza sativa)
  misc_feature (71): n=t or c
taaggaacgcccgttgggttatttccggtcgtgacagttagcaacgaaaaaaaccataataatgggaacgnggctgacaacaacatggtctcgatagagag

SEQ ID NO: 20299 - DNA, 101 bp, rice(Oryza sativa)
  misc_feature (71): n=a or c
catttattttattgtgacttgatttatcgtcaaatgatctttagcataactttttttttacatatgcacanaaattttcaatactaccaatgatcaaacgt

SEQ ID NO: 20300 - DNA, 101 bp, rice(Oryza sativa)
  misc_feature (71): n=t or c
aggtcggacactcaaaaattcccttctccaacagcctacccagtgctcccaatcttcttctctccaacagnctacgctggcagctcgcggcacgactcctc

SEQ ID NO: 20301 - DNA, 101 bp, rice(Oryza sativa)
  misc_feature (71): n=a or g
ccaatctaaataatccatgcactcatagtaattcatgtactaagttaaatgattcacgatcataacttcangcaaaatgattcatcccaattttcacaatt

SEQ ID NO: 20302 - DNA, 101 bp, rice(Oryza sativa)
  misc_feature (71): n=t or c
gttcgtatctgattcgagattttagattttcgtttgtacatggctgtgttcggtgctctgcttcctaaccntcatcctcgttttccgtacgcacgcttttc

SEQ ID NO: 20303 - DNA, 101 bp, rice(Oryza sativa)
  misc_feature (71): n=t or g
agtaaaaaagctgggaggactggaagaggcgcccgatttttttattaaaagatcgggcgcccgatccctanatggatccatataaaatggaccttatttac

SEQ ID NO: 20304 - DNA, 101 bp, rice(Oryza sativa)
  misc_feature (71): n=t or c
ggttcatgtagccaaaattgggcacgcgttcttcgttagaaaagctgtcgagtgacgcggggaagaacgangcgactgcgctgtgggggtcgtgacctcgc

SEQ ID NO: 20305 - DNA, 101 bp, rice(Oryza sativa)
  misc_feature (71): n=t or c
ctttgagatctgacaagaagctctagcgttcattaaaaattttggtatggcttgctgaatgtgtacctganagttggtaccagttcctctaactttaaagt

SEQ ID NO: 20306 - DNA, 101 bp, rice(Oryza sativa)
  misc_feature (71): n=t or g
ggtatgtaaagttataattgtgatcttcacccgtcgtgaaacttaggtattgcaagaaacttgggtatttngcttgcaatagataaattccagtaaacaag

SEQ ID NO: 20307 - DNA, 101 bp, rice(Oryza sativa)
  misc_feature (71): n=a or g
taaaaacgtaaactgagcgtcaacttgacatgaaacaacatccagtgaagaaaacttgctgcttacttacnaatattgagaatttcagaaatattccctcc

SEQ ID NO: 20308 - DNA, 101 bp, rice(Oryza sativa)
  misc_feature (71): n=t or c
aagaaataagaaaagaaaagattctttgcatgctgcagtggcaggcaaaaaacaacgtccgatttttctcngccccgccagtcgttcgggtgtgagcattt

SEQ ID NO: 20309 - DNA, 101 bp, rice(Oryza sativa)
  misc_feature (71): n=a or g
ctccagtccctgccccagttcctgtggattcccctgtcatccaactgtgtgatgatgaggaagaagactcngaggaagaccctgaacgcacccattcagtg

SEQ ID NO: 20310 - DNA, 101 bp, rice(Oryza sativa)
  misc_feature (71): n=a or g
atggataattcgacgcttcccctacctgtcgcgccaactgtttaaactggaattcggcaatatgaaaaagngtatcgcacgagacataaaagtggatggat

SEQ ID NO: 20311 - DNA, 101 bp, rice(Oryza sativa)
  misc_feature (71): n=t or c
ttctgcatataatataatacgcacttgttggaattcaacatgatgtaccacgaaaaacctaaatgcaaacnagacaagtatctttttagtataagacacaa

SEQ ID NO: 20312 - DNA, 101 bp, rice(Oryza sativa)
  misc_feature (71): n=t or c
ttgtcttaatggaaccaaccatagctcttataaagacaattggtcttaccttccataggactctccaaatnctactaggtatataaaccaattagtactcg

SEQ ID NO: 20313 - DNA, 101 bp, rice(Oryza sativa)
  misc_feature (71): n=a or g
ggaagcagttgtattatatagaatgcatgggatgattgcaggttgtggtgctgagtagaatggagcatccncacatagtgaggctcatgggcgtgtgcccg

SEQ ID NO: 20314 - DNA, 101 bp, rice(Oryza sativa)
  misc_feature (71): n=a or g
catcaattagcaaacacgtacatgtctgtatacgcagctataaaatggagttgcatgtagaatcatcaccnacaactcctctttttaatttctataagaga

SEQ ID NO: 20315 - DNA, 101 bp, rice(Oryza sativa)
  misc_feature (71): n=t or c
cgcatcaccagacatcatcgttgccatagtccactctcttcattttttaagataaccccctctctcaactnatagatgccaaattttaatttatatattta

SEQ ID NO: 20316 - DNA, 101 bp, rice(Oryza sativa)
  misc_feature (71): n=t or c
gaatatagggtatcgatgaatgaagtgaggatgcatgaggaggtggcaagaagggtggacgaatgacttgngtcacagcggagccaggagccccagcccta

SEQ ID NO: 20317 - DNA, 101 bp, rice(Oryza sativa)
  misc_feature (71): n=t or c
cacatgaacttaattttagttcagacaaaaacctaacttatgcttcatgtaacaagtaaaactgagagtgntctctgctggttaccaattagttgtaccaa

SEQ ID NO: 20318 - DNA, 101 bp, rice(Oryza sativa)
  misc_feature (71): n=t or c
gtggcactgtgagatcatcgacagtcagactgtcagaggcatcagcagcatcaccaaggtgtgtttagttnacggtaaaattagaagtttggttgaaattg

SEQ ID NO: 20319 - DNA, 101 bp, rice(Oryza sativa)
  misc_feature (71): n=t or c
gagggttaatgtttctaatttactagattcagggtgaagggagtggtgaatgtaaggaggcttgcatttcncatcaacaattttatagccagaaagtttag

SEQ ID NO: 20320 - DNA, 101 bp, rice(Oryza sativa)
  misc_feature (71): n=a or g
actcagtactattgactcggatcaaattaccacgttagacaaatcacctactatactatcatactatcatntgatctatattgcaccgattttgacagttg

SEQ ID NO: 20321 - DNA, 101 bp, rice(Oryza sativa)
  misc_feature (71): n=t or c
gatcgttgtgggggctgctacagaaatgcctccaggggccaggaacttgaacgagctggtggcaggcctcnccacgcctgtccaagcggcgcatcttccaa

SEQ ID NO: 20322 - DNA, 101 bp, rice(Oryza sativa)
  misc_feature (71): n=a or g
gatgcaagcgggagaaattcagcacaacctcgaaggacacatagcttagacgcgagaatggcaacagaacnctgatgctcagttcaccaacgtcaacaacc

SEQ ID NO: 20323 - DNA, 101 bp, rice(Oryza sativa)
  misc_feature (71): n=t or c
tgtgttggttttaggactatctgcatgatttatctgatcatgcagcctcgtcggagaggactccaaatccnccccacaatcgctcagtcgcctttggacaa

SEQ ID NO: 20324 - DNA, 101 bp, rice(Oryza sativa)
  misc_feature (71): n=t or c
aagaagtcaaacaccatatgctttttgctggaagagtagcatctatgcattcaccaaccatattgagaatnatccaatgagcaagtctaactattggtacc

SEQ ID NO: 20325 - DNA, 101 bp, rice(Oryza sativa)
  misc_feature (71): n=t or g
tggacataggtggttgttcaaaatggactagttagcaatatgtccaaccggtccacttcgaacaactgatntaatttagagtaataaactaatacaaatat

SEQ ID NO: 20326 - DNA, 101 bp, rice(Oryza sativa)
  misc_feature (71): n=t or c
ttccatctcttgaagtatattgtatgttagtgtgaggggatgcatttgcgtgagtgtgagtgtggtgttgngtgtgtagtggtgtatacatatgcgtccgc

SEQ ID NO: 20327 - DNA, 101 bp, rice(Oryza sativa)
  misc_feature (71): n=a or g
tacttctaattggtcgtccgatccaaacataaaaatcggatggctcttgactgccttctctgacactcgtnaccacacatcagcacatgcgcggcatgcca

SEQ ID NO: 20328 - DNA, 101 bp, rice(Oryza sativa)
  misc_feature (71): n=t or c
atgatataaaaaatcaaggtaaaattggtgtcttgatctaaataaaatggggcctacatcggttccaaagncataataacttctgacataaatatatagct

SEQ ID NO: 20329 - DNA, 101 bp, rice(Oryza sativa)
  misc_feature (71): n=t or c
atattagagaaaagtacattttacccccttaacaactgcagttgaccgaaaaaccccccgaactcaaaaancggtcatttctcaccctcaactatcaatac

SEQ ID NO: 20330 - DNA, 101 bp, rice(Oryza sativa)
  misc_feature (71): n=t or g
tatatatagtggtaaattctcactcgcgtccaaccattgacatgtatcttccgtagtcagaagaatattanatcaaagccatggagcctacaagcacagca

SEQ ID NO: 20331 - DNA, 101 bp, rice(Oryza sativa)
  misc_feature (71): n=t or c
aaaaaaaaacaaaaaaaaagagaaacaattatgataacagctccagtacgtgtaaggcttaaattgatttnatagtacataaaaacaagggttaattagat

SEQ ID NO: 20332 - DNA, 101 bp, rice(Oryza sativa)
  misc_feature (71): n=a or g
catctctccgatatactctctatgtccagttttggacaatgcagtgttgcatccctttaaaatcttttatnttatgcgacggaaagagtagcacggtttgg

SEQ ID NO: 20333 - DNA, 101 bp, rice(Oryza sativa)
  misc_feature (71): n=t or c
agaaatgtgatattatagggttgaagatggaacctttgggagtatagacatggcttccacccaagggtgtngacggtgcttgacaaaaagctccgatggtg

SEQ ID NO: 20334 - DNA, 101 bp, rice(Oryza sativa)
  misc_feature (71): n=a or g
aacacgccacatacagtgggtgcgatagttttgtccagtcacgccaataaggatgatgtggacaaataatnttatcacgtcaggcagtccagcgtgccaaa

SEQ ID NO: 20335 - DNA, 101 bp, rice(Oryza sativa)
  misc_feature (71): n=a or g
ccagcttgtgatcatgttagcatgttgtgagtgtatagtactctctgttttagtgtttttgactaaatatncgacattgacttctggatatgtgtttaacc

SEQ ID NO: 20336 - DNA, 101 bp, rice(Oryza sativa)
  misc_feature (71): n=a or g
aggtaactgtagttactacagtactgcaactagccaactagttaggtgctcactccatcccataatataancgattttggatagatgaaacatcctagtac

SEQ ID NO: 20337 - DNA, 101 bp, rice(Oryza sativa)
  misc_feature (71): n=a or g
accaataaattactgaaattgtgaagcaagagctgaaattctgtttagttgaatgctctgagtctggctcntaacttgggaacgtgttcttcaaatgtaga

SEQ ID NO: 20338 - DNA, 101 bp, rice(Oryza sativa)
  misc_feature (71): n=t or c
catgatatccagttttctcttctatagtaatactttttaagggaaggttatgtagtagatgttggtttgcnttttctttctagattgctctgaaatataac

SEQ ID NO: 20339 - DNA, 101 bp, rice(Oryza sativa)
  misc_feature (71): n=t or c
gaggtacttcagcttactgtgcccaacccagaacaaagcgcgtcaatcatgagggaggcgtctcgcgacgnggtcggcaggagggactgggcgccggctgc

SEQ ID NO: 20340 - DNA, 101 bp, rice(Oryza sativa)
  misc_feature (71): n=a or g
tgtggggctttctaccttgttagtgcagcggtatccagtgttctacaaactagaggatgcccagcgcgttnctgcaggactttgttaacatcaatttgtta

SEQ ID NO: 20341 - DNA, 101 bp, rice(Oryza sativa)
  misc_feature (71): n=t or c
agatgcaggtgggcccccgttcgtgttgtaactgacttatataaatttatgagtagtttttttttcactcntctcttttattttcttcattcacgtgtaat

SEQ ID NO: 20342 - DNA, 101 bp, rice(Oryza sativa)
  misc_feature (71): n=a or g
tttttctggtctcatcattttgttactaggctacccttgataagtcgaccaaatatttatactgaatttanaatatgcaaaattatatttctttacctttg

SEQ ID NO: 20343 - DNA, 101 bp, rice(Oryza sativa)
  misc_feature (71): n=a or g
ttccttatgctttgtatctattggggccaatctctgtaaggacgtggcgcagttttctagtactccctccntcccggtttagttgtcgttggggtgtagag

SEQ ID NO: 20344 - DNA, 101 bp, rice(Oryza sativa)
  misc_feature (71): n=t or c
gcatgacgaagagggttctcgttcctgattctcaggtttcggataaaagcagaacctctgcacttctcatntacagctgaattttgtatgatggtggttct

SEQ ID NO: 20345 - DNA, 101 bp, rice(Oryza sativa)
  misc_feature (71): n=a or g
aacagggactaaacatcacctagggccgataaaatttgaaaccgggataaaaaaatcatctttaactattntggtttttgctcaacccaataaagatggtt

SEQ ID NO: 20346 - DNA, 101 bp, rice(Oryza sativa)
  misc_feature (71): n=t or c
ttcaatatatatattcttcttttatgtttaatccatttagtttgatgctcccactcttcagtcggtgctgntttataatgaaattattatgtgcattatat

SEQ ID NO: 20347 - DNA, 101 bp, rice(Oryza sativa)
  misc_feature (71): n=a or g
ttttagctgttggatgctttcttcctataaatgtggaaatttataatctctcaagaaaatccattatcgcncctgcattaattatgtactccctccgttcc

SEQ ID NO: 20348 - DNA, 101 bp, rice(Oryza sativa)
  misc_feature (71): n=a or g
tgcgccgaagatctacaattgtaatacaacatatagtttgaagctagacgtacaacttacgaaacaaatanacatgtttgatttaccccttacagttttgc

SEQ ID NO: 20349 - DNA, 101 bp, rice(Oryza sativa)
  misc_feature (71): n=t or g
ctggccatgccgttgtgagcgtcggccatggaacgaggaaagaaggaaaggaagaagaaagatacaaaagnaatgaaaatggaaaaagggaaaggaatcat

SEQ ID NO: 20350 - DNA, 101 bp, rice(Oryza sativa)
  misc_feature (71): n=t or g
ttaagaaatagatgtaggcgggaaaattgaatggtgggggttgtaattggttgaaaaggaaatgttgatgnagaagttgttatattttgggacaaattcta

SEQ ID NO: 20351 - DNA, 101 bp, rice(Oryza sativa)
  misc_feature (71): n=t or c
gtacgtacgtgagcttctacactcacacactccatacatgcatccacgcagatagacctgccgtaacttantactactactactactactactactactac

SEQ ID NO: 20352 - DNA, 101 bp, rice(Oryza sativa)
  misc_feature (71): n=t or c
gggcttttcccgaacgccatttttttcagatggcatttgcttttttcgcatgaattttttttttgctgcanggacaacggaaatattttaaattttttaag

SEQ ID NO: 20353 - DNA, 101 bp, rice(Oryza sativa)
  misc_feature (71): n=a or g
cactgatttgactagtgtagttcgtccggcgagtcccaagtttctacctcgccaaactgccatttttcccnccgatttgtcaaacaacggctgtaggtctg

SEQ ID NO: 20354 - DNA, 101 bp, rice(Oryza sativa)
  misc_feature (71): n=a or g
ttgaaatgcttcccagtattcatgtgtcaaaagatatcacaatggcaaattgtcaagcctgagggaggtgnctcaagagatactactccatcccaaaatat

SEQ ID NO: 20355 - DNA, 101 bp, rice(Oryza sativa)
  misc_feature (71): n=a or g
aacagcaccgtccccgccgtagccgccaccgtcgctgccattgctgtttttcgaaggaatgaagacagaanacagaatcgattgtaacttttttttttgtc

SEQ ID NO: 20356 - DNA, 101 bp, rice(Oryza sativa)
  misc_feature (71): n=a or g
cttcccatctactgcaatctggtattctcaactactcagatctcggtgatgagaaaggggacggctcgtcncagcccccatggtggcaggtggcaggggag

SEQ ID NO: 20357 - DNA, 101 bp, rice(Oryza sativa)
  misc_feature (71): n=t or c
tagatggagcacaatttattaatagaatctacttccataccttcaagatggataatttctatagcataganatgtaattaattatatgatagtatgctagt

SEQ ID NO: 20358 - DNA, 101 bp, rice(Oryza sativa)
  misc_feature (71): n=a or g
tagagagcatcaaggtaccgtctagatactcctcaaatataaagagtataataagcacaaaggataagaanttcataaacctaaaatctcatgactaccac

SEQ ID NO: 20359 - DNA, 101 bp, rice(Oryza sativa)
  misc_feature (71): n=t or g
atcggaagcaatccgccgcgagtcgcgaccatttcttgcgagtagtagtagaggggagagtgagtgagggncgtgctgcaatggcgactgaggaggttgtc

SEQ ID NO: 20360 - DNA, 101 bp, rice(Oryza sativa)
  misc_feature (71): n=t or c
ccgcgtgcgcgctgtcctgtacaatatctactgtccgtaataaatataaataatatgagcctatttagatngtagctataataaatcttatcaagtttcgg

SEQ ID NO: 20361 - DNA, 101 bp, rice(Oryza sativa)
  misc_feature (71): n=t or g
tctgaatgcgccaaaatcccaaacagtgcagcgtgtggcggacaggaaacagataattttcgatctcgaantccaatcgggtataaaatggaggaagtgga

SEQ ID NO: 20362 - DNA, 101 bp, rice(Oryza sativa)
  misc_feature (71): n=a or g
gtataaatcagatcgaactgtgttctcacctaaagctggtagatatataaaacttaatggaatgtgtacangagcattaccggttggattaatttgcttat

SEQ ID NO: 20363 - DNA, 101 bp, rice(Oryza sativa)
  misc_feature (71): n=a or g
cttggagtcgggaacagaaaaaggaatgggtgcttgtggctcccaagaaacgatctacctcttccctaagncggccggatcgttcttatgctcaagttgtt

SEQ ID NO: 20364 - DNA, 101 bp, rice(Oryza sativa)
  misc_feature (71): n=a or c
tgataagtttgggtgttgaatgtcctttttttcaaacaaggtttagtggaataatttggattgtcaaaaanttgtattttctaatatttgttagttataga

SEQ ID NO: 20365 - DNA, 101 bp, rice(Oryza sativa)
  misc_feature (71): n=a or g
ctttggtcgaatgtcgggtgatacttcacatgaagattgaactcgatgcttgcaaagatcaagctatccancgcacatctccacacaaggcatggtgccca

SEQ ID NO: 20366 - DNA, 101 bp, rice(Oryza sativa)
  misc_feature (71): n=a or g
gtgatcctcatattagcaagcaacaatatatcaattgagcaatgaatataacattagctagatggatgaanatgtcacctgatcttgttgacgatgttggc

SEQ ID NO: 20367 - DNA, 101 bp, rice(Oryza sativa)
  misc_feature (71): n=t or g
tggaatatcaaagtcagctgtggtggctggctacgcatgcattcatagggcgacatgttatatgctacgancagtaataaacttggaaagctgacgaggat

SEQ ID NO: 20368 - DNA, 101 bp, rice(Oryza sativa)
  misc_feature (71): n=t or c
gatttaacttggtagctcgattcccagatggtggaatcgcaattgctcccatttcagtttgttttcacgcnactcctttagtttgttttcatgttactcct

SEQ ID NO: 20369 - DNA, 101 bp, rice(Oryza sativa)
  misc_feature (71): n=a or g
cctttccctctgcaacccctctcggtggttgtctggtagatcttggcttctgttgtccgtgttggtgggcngttcagttgtggctgcgttgtggttctggt

SEQ ID NO: 20370 - DNA, 101 bp, rice(Oryza sativa)
  misc_feature (71): n=t or c
gcctgccttgccctcacgcacgtacgcgcgccgagacaaggcaggccgagttggagaatatccctacctcnagcgattccgctgtagcgtagcgcggttgg

SEQ ID NO: 20371 - DNA, 101 bp, rice(Oryza sativa)
  misc_feature (71): n=t or c
atggcgccatcggagtggtacaaggtgatgctgttcagccggcgagggacggtcgccgacggacgaatgtngaacggccgcccaccggatccaccccaaag

SEQ ID NO: 20372 - DNA, 101 bp, rice(Oryza sativa)
  misc_feature (71): n=t or c
agataacaccatttactttttattaaaaatttgttgtgggtgaaatgggacctagggtgccccattctccnagaaaaattaataattaatctactattaag

SEQ ID NO: 20373 - DNA, 101 bp, rice(Oryza sativa)
  misc_feature (71): n=t or c
aactacaattcttgttaataaggtactaagtgtagcggatgtacaattaagcagtgccttctgatgtgctngacgtaagctagaaatactaaccttttcag

SEQ ID NO: 20374 - DNA, 101 bp, rice(Oryza sativa)
  misc_feature (71): n=a or g
tgtatgctttctcagctatgctatatttatgcagactgcaccatcatttagcatgatgtttaaccattgcncagtttcatatttgttcaggacactcctgc

SEQ ID NO: 20375 - DNA, 101 bp, rice(Oryza sativa)
  misc_feature (71): n=a or g
ggatggacaactggctcattctacagagttttacaacggacttactgtttcgtcccggaatcacttggacnttactgctgggggtgccttcttatcaaaga

SEQ ID NO: 20376 - DNA, 101 bp, rice(Oryza sativa)
  misc_feature (71): n=t or c
tatagcataaccagtagcatgctaaagatatcataagcatcatgaacatgaacatatagcaagaacgcaantgacttgcgactaacaggactaacagcgct

SEQ ID NO: 20377 - DNA, 101 bp, rice(Oryza sativa)
  misc_feature (71): n=a or c
aatttgggccgtattcccaggagcaattcaccagcagtttgggccggaatgggatagcctcgaactcaccnagattaattgggccgagtatttaatgggcc

SEQ ID NO: 20378 - DNA, 101 bp, rice(Oryza sativa)
  misc_feature (71): n=a or c
gcttactggaagaaaagatgcaggtaaaattgggctcaatttggtggggaaaacaccaaatttttccatgntatggccattgagaggtttaggaaaaacac

SEQ ID NO: 20379 - DNA, 101 bp, rice(Oryza sativa)
  misc_feature (71): n=a or g
gcccacctaaccgcatttagtgcaggccgagcaagcgcatgcatgactagcctgtgaccagttcgtgaccngccgaatgacaggtgggacggtggcaagcc

SEQ ID NO: 20380 - DNA, 101 bp, rice(Oryza sativa)
  misc_feature (71): n=t or c
caactatataatgctatctcctctttccctttatttctcattatcgatcgtctcaatatttatgatctaanattcacacaagttatttcttgtggccatta

SEQ ID NO: 20381 - DNA, 101 bp, rice(Oryza sativa)
  misc_feature (71): n=t or g
tgacgattggtggctagggttttaatttgctactccctttcgttccaatatataagtacaatctaaaacanatgtgacgatatatccagattcatagtttt

SEQ ID NO: 20382 - DNA, 101 bp, rice(Oryza sativa)
  misc_feature (71): n=a or g
ggctgcacaagaggtgcccaaaagagttagcccccctctgtttctctttagcaaaaagaaagaatagaagngttcagttcgagttgatgaacaataactgg

SEQ ID NO: 20383 - DNA, 101 bp, rice(Oryza sativa)
  misc_feature (71): n=t or g
tatttaactcaggaatgaaagaaccttgttatagggcttgtttactttgttattattttcggttctaccanttttgttaagaggacaaacaaaatatagta

SEQ ID NO: 20384 - DNA, 101 bp, rice(Oryza sativa)
  misc_feature (71): n=t or g
cttatgaaaatgattaaaaaagatgcaaaattaaaaagtattgattgcaataccaagcactacaaaaaaanttcgtctatcgactaaatacataaaaaata

SEQ ID NO: 20385 - DNA, 101 bp, rice(Oryza sativa)
  misc_feature (71): n=t or c
caaaattaatttgataggaatgatgcgccatgaaagatttccaaacctaatttaccaataaagatgctcangtttacatactacaacagatggattaatgt

SEQ ID NO: 20386 - DNA, 101 bp, rice(Oryza sativa)
  misc_feature (71): n=t or c
tactccataggaaaggtatatggacactcctaagtgaacactccattttttaaaatacatatactccctcngtttttttaatatatgacgccattaaattt

SEQ ID NO: 20387 - DNA, 101 bp, rice(Oryza sativa)
  misc_feature (71): n=a or g
gagaaaaaatgacgccaagacatggtcactttgccaaaccatctccagattcccacgttcggctttgtggngaaataaaaagattcgtcaagaaaaaaatc

SEQ ID NO: 20388 - DNA, 101 bp, rice(Oryza sativa)
  misc_feature (71): n=a or g
taaagcgtatgcccttttcccaatggtattctcccgcttcactatcaaagaattaatttctaacttaactntttagaaaatatttagaatctggtatattg

SEQ ID NO: 20389 - DNA, 101 bp, rice(Oryza sativa)
  misc_feature (71): n=a or g
cattgtgctcatctgatcaagagctataaataatttgcttattttggttcttagtctgtcagactgattcngaacgtgttctatgtgaatattgcagagct

SEQ ID NO: 20390 - DNA, 101 bp, rice(Oryza sativa)
  misc_feature (71): n=a or g
acataggctaggtccttccatctagtatttgtaaatctattttctaaagctgtgtcgaagcaagatttcancaataataaaagggggtggctgtcaagcta

SEQ ID NO: 20391 - DNA, 101 bp, rice(Oryza sativa)
  misc_feature (71): n=a or c
ggttgccgcctcgagctccggggtgccagatctagtctctaggtggttgaggaccattagatctggatggncaccgagccccaatctgctcatctcgttca

SEQ ID NO: 20392 - DNA, 101 bp, rice(Oryza sativa)
  misc_feature (71): n=a or g
ggggtgttgtttgataacaaaatggtgtcttctcctttgcagataattactttagttacccggtggctacncacgtggactatcctccacaaaccgggact

SEQ ID NO: 20393 - DNA, 101 bp, rice(Oryza sativa)
  misc_feature (71): n=a or g
aggagagcccaccattgtagaattggtttttgctgcagagctgggcctccagatccaatgtaaaaaaagcncgcggaagaaatttggcgcgggtgagggat

SEQ ID NO: 20394 - DNA, 101 bp, rice(Oryza sativa)
  misc_feature (71): n=t or g
attacttaatttcccaaattgaattaacattggtgtagggttagtactttttgtgaggccgtgacggcggnggtggggatgaacagaattgattgcccgat

SEQ ID NO: 20395 - DNA, 101 bp, rice(Oryza sativa)
  misc_feature (71): n=a or g
tggtactagtacacggtgacgttgtgccaggtagattaacggcgtgtttaattcgcgaaataaaatttttnagtgtcacatcggacgtttgaccggatgtc

SEQ ID NO: 20396 - DNA, 101 bp, rice(Oryza sativa)
  misc_feature (71): n=t or c
tccccgttcgagagcctcaccacggagaacctgaggttcctgtcgtccaagcaggcactgttcgacctggncgccttccgccagcattaccaggtcaggat

SEQ ID NO: 20397 - DNA, 101 bp, rice(Oryza sativa)
  misc_feature (71): n=a or c
gattccacatgacaatctaatcggacaatccagcgattgagaaaaagaacgggaagaaaaataggaacaanagcgtgaagctgccagcgccgtcgtcgcca

SEQ ID NO: 20398 - DNA, 101 bp, rice(Oryza sativa)
  misc_feature (71): n=a or g
cgtcataatcgagttcatcgatgacgtttggaaggactccggccaggggcggatctacagtactcaggtcngtgtcaggcgacaccgatgacttttggcaa

SEQ ID NO: 20399 - DNA, 101 bp, rice(Oryza sativa)
  misc_feature (71): n=t or c
cggggaagaggaacaacggaatcataccccatttacacaaatgctattgtgacaggcggttgatgcagggngttcattgcataaaatacttcagactgatc

SEQ ID NO: 20400 - DNA, 101 bp, rice(Oryza sativa)
  misc_feature (71): n=t or c
ataaacaaatccccaattttaacgttcaaattcataaatttgggggaacaatgggttataagattaccgtncgatctacgaatttcaccgattaaaacgaa

SEQ ID NO: 20401 - DNA, 101 bp, rice(Oryza sativa)
  misc_feature (71): n=t or g
tgtccgctcaaaaaaatagaggaaaaggctatacacaaattttcttactgaactctaaaaaatctaaattntttacgactctcatccagttaaatcaagcg

SEQ ID NO: 20402 - DNA, 101 bp, rice(Oryza sativa)
  misc_feature (71): n=t or c
ggttcacaatctctcgctgtaccttgaaagatatattgcacattgactcatgcatcatcaaccggtcatanatattttttcgaaattgctaaacaacatcc

SEQ ID NO: 20403 - DNA, 101 bp, rice(Oryza sativa)
  misc_feature (71): n=a or g
gtttaggagtgtcaatttgctcgttttcagttaccatgtttcaggaaccgcaaaaggtgtgttttttcaanaactttttttatacaagttttctttaaaaa

SEQ ID NO: 20404 - DNA, 101 bp, rice(Oryza sativa)
  misc_feature (71): n=t or c
ctgtttttgctgtttctcctaaaccgtttatcggattcgagcaaaactagcggcgttaaaaaaatatcaangatgactacaaactttatttaggacaactg

SEQ ID NO: 20405 - DNA, 101 bp, rice(Oryza sativa)
  misc_feature (71): n=t or c
tgcatgataaatttaacatttaatgtcttaacttttgtaacacaataacttaggtcctgtttagattacanctaaaatttttcaccatattacatcaaacg

SEQ ID NO: 20406 - DNA, 101 bp, rice(Oryza sativa)
  misc_feature (71): n=t or c
catcaaaaggaactcatctggcctaatgctagttatgagtggaagcacttaagcctacaagatttcaaaantgtggcaaaatacataacattcgctctaag

SEQ ID NO: 20407 - DNA, 101 bp, rice(Oryza sativa)
  misc_feature (71): n=a or c
gtgttgggtggaagaaaggtaggagacaaaagagatagaaccatttatatgggcctgttcactttgatacnaaaaaaaaaccttaccaaaatttggtatta

SEQ ID NO: 20408 - DNA, 101 bp, rice(Oryza sativa)
  misc_feature (71): n=t or c
aaacttgttataaggatgtaaaatactccacgataaaagcacccattacgtcagttaatataagggataangctacacatatgactctgcatttacaatgt

SEQ ID NO: 20409 - DNA, 101 bp, rice(Oryza sativa)
  misc_feature (71): n=a or g
cacacgaaaaaaaaaataaaatggaaaaaaacaccacagcggcacctataggcgcagggcgcggcatctcngcggcgcggcgtgtgctgctcttcggctga

SEQ ID NO: 20410 - DNA, 101 bp, rice(Oryza sativa)
  misc_feature (71): n=a or g
gcttaatgagtgtaggtgagaatagtcccaatagcgaactggcgttgacgttgacaaccctcaaggtgaancaagaagatgacattcttagtggtgtatta

SEQ ID NO: 20411 - DNA, 101 bp, rice(Oryza sativa)
  misc_feature (71): n=a or g
tttgataaaacttacataaaaaatagcaacatataaccctgaattagtttttagcattgaatgtattttcntagtaagtttattttgtgttagaaatatta

SEQ ID NO: 20412 - DNA, 101 bp, rice(Oryza sativa)
  misc_feature (71): n=a or g
gcgaaaatagctatatttttgctagtggccctcttaatctgaccaccagcgaagatctatttttgctggcngtttccacgtataaccgctagagaaaaaaa

SEQ ID NO: 20413 - DNA, 101 bp, rice(Oryza sativa)
  misc_feature (71): n=a or c
gatgtttatgagagaaatttcttgcaaaaggtgagggcttttgattggtaaaagattgagaggggtccctnccccccaaacaaaacacaaagaacaggagg

SEQ ID NO: 20414 - DNA, 101 bp, rice(Oryza sativa)
  misc_feature (71): n=a or g
ataggtaccattgatgggacatgtaaaaatactgataagttttaaatagcaaaatttattacaggacactnaaaatttatataatttacttgtagacataa

SEQ ID NO: 20415 - DNA, 101 bp, rice(Oryza sativa)
  misc_feature (71): n=a or g
atatacttataaaatatggtatttacagctaaagagcatgtctaatggttgttaatactgatctctcagtnttgattaggaatattcgttgacatggaaaa

SEQ ID NO: 20416 - DNA, 101 bp, rice(Oryza sativa)
  misc_feature (71): n=a or g
gggaagctgggatctcggatgggacggagtgtccgcgataaggtatactaggtaaatggtaacgaggcgcngtggcgattgaatgttactaagtaggttcg

SEQ ID NO: 20417 - DNA, 101 bp, rice(Oryza sativa)
  misc_feature (71): n=a or g
gaacccatgtgagtcgattcaagagctatacactcacttggcatctaggcgtattatcctgattttacacnataaaaaaaacaattgcatgtgctccatct

SEQ ID NO: 20418 - DNA, 101 bp, rice(Oryza sativa)
  misc_feature (71): n=t or g
aaatcacgtttattttcactggtggatgtcttaagtgctcgctagtgaaaattgattttcactggcggatncttatatcccacacacataagcatccgcaa

SEQ ID NO: 20419 - DNA, 101 bp, rice(Oryza sativa)
  misc_feature (71): n=a or g
tgctatgtgtaagtaggactacatgtcatattagatggaatgggatccgtagagcgtagttctgtagggcnagctgttacaaccgaaccaagtgagcaagc

SEQ ID NO: 20420 - DNA, 101 bp, rice(Oryza sativa)
  misc_feature (71): n=t or c
tttggtttgctactaaaatttttgcccaaatgagttcaaattctatactactcctatcgttagaaaaaaanaagtatttctagattgtctagcaattacta

SEQ ID NO: 20421 - DNA, 101 bp, rice(Oryza sativa)
  misc_feature (71): n=a or c
ggcggggggagcagactctgagctccgatgagtgatgaccgttgccacaactgtttctgctgctgaaaaantcgagaagccgttggaacaaagctgcagag

SEQ ID NO: 20422 - DNA, 101 bp, rice(Oryza sativa)
  misc_feature (71): n=t or g
ttgcgctcgtgctgttcgtcgtatgcatcgtcagctgttttgaggatgccaccgcccagtacagcggatcntccaacaacggcgcggcggcgacgggcccc

SEQ ID NO: 20423 - DNA, 101 bp, rice(Oryza sativa)
  misc_feature (71): n=a or g
ggagatgagcaaccttttcctatacataccactgaattgtaataggagaagaaccctaatgccaaaaagangaccacattgaagacatcaatgctcgcgcg

SEQ ID NO: 20424 - DNA, 101 bp, rice(Oryza sativa)
  misc_feature (71): n=a or g
ttgtaacagaagggaatataaaaaaatggcacaaaaaaaactaaaacaaattccattgaattaattttcantaataaatagaatgaatgtacatgaatatt

SEQ ID NO: 20425 - DNA, 101 bp, rice(Oryza sativa)
  misc_feature (71): n=a or g
ggattaaatttggtagatgacatacggtaaaaaggaaaggaacaatatgtcattaaaaacagaggaaaatnatttatattgattttggacggctgagattg

SEQ ID NO: 20426 - DNA, 101 bp, rice(Oryza sativa)
  misc_feature (71): n=a or g
tgagcctttttttttaatcgatctttttcattctctccttccgagttccaacgcgtggcgctgcgtattcncgagccttccggttgtgactcatgtaaacc

SEQ ID NO: 20427 - DNA, 101 bp, rice(Oryza sativa)
  misc_feature (71): n=a or g
ttcctccttctctctagtctctcacagtcttatcctctcggtagcgcctgatgaggacataactagctcgnatataatcatgactaccttatatattaatc

SEQ ID NO: 20428 - DNA, 101 bp, rice(Oryza sativa)
  misc_feature (71): n=t or c
tttttattaaattttaatggctgaaaatcatttaaaaagattttagttggaatatgtttttgtcacacatngaaatatcgagatttcgtggttttcgatcg

SEQ ID NO: 20429 - DNA, 101 bp, rice(Oryza sativa)
  misc_feature (71): n=a or g
gaggagaattccatctaaagaagaattgggctcacaatctcatcaaaacaccagaaaatggacccaatcantttagaagtggataagggagaacatagtag

SEQ ID NO: 20430 - DNA, 101 bp, rice(Oryza sativa)
  misc_feature (71): n=t or c
gcgttatagaataaattaaaagtcagtccctaaactaatagtaacctccaattttaccagacttgaggaantcatgtgcaaaagtatcaaacatatcatac

SEQ ID NO: 20431 - DNA, 101 bp, rice(Oryza sativa)
  misc_feature (71): n=t or c
agcactctcgctcttcttcccctgaggtttaggctaactgagagccgtccttttcctcggtgggcaaggtncttcttttatagttcaaggggataccacat

SEQ ID NO: 20432 - DNA, 101 bp, rice(Oryza sativa)
  misc_feature (71): n=t or c
aaatgttcgtgtcatgcaatacgtattcatcttcttgtacatcgatccttgtttctaaaatgcctatttgnttaattgttaatttggaatgtagttgatag

SEQ ID NO: 20433 - DNA, 101 bp, rice(Oryza sativa)
  misc_feature (71): n=a or g
tgaagattggttcatgcttaaaacaatagtaaagaatgcagtaattagtgggacccatatcaattaaaaantatatttgctgttaccataaatgataataa

SEQ ID NO: 20434 - DNA, 101 bp, rice(Oryza sativa)
  misc_feature (71): n=a or t
ctttgtattctgaacctgatgaagaaacacatggttattgtctcgagcctgcatcattagacttccttacntcccaataaaggctaattaaccactactaa

SEQ ID NO: 20435 - DNA, 101 bp, rice(Oryza sativa)
  misc_feature (71): n=c or g
atataagggcgattaggtcattgaaatacagtacttaattggtcgtttttttacgcttttgatggtaccangttgcgtatctacaacgcttaagcaaaaaa

SEQ ID NO: 20436 - DNA, 101 bp, rice(Oryza sativa)
  misc_feature (71): n=a or t
caaggtttgcgcgagatctggaccgttggatcgggcaatggatggttcagattaggcgagcccatcttgtnaccgaggttttgtagggctttatggcagtt

SEQ ID NO: 20437 - DNA, 101 bp, rice(Oryza sativa)
  misc_feature (71): n=c or g
cgagtacagcgagaagctgccgtatatgcggtagaagaagagcgccgggatcgccgagaacgtgaagctcnccgccgtcagcgcccgtgcgtcgaggcggt

SEQ ID NO: 20438 - DNA, 101 bp, rice(Oryza sativa)
  misc_feature (71): n=c or g
cagaagtctaatttatgtccctattgctacagtagtttcttcaagttccagtcgagcccggcctacggggnctcctggttagaacagacgcgctagataat

SEQ ID NO: 20439 - DNA, 101 bp, rice(Oryza sativa)
  misc_feature (71): n=a or g
ccattgttgctgattatgttgattatttccctgtgatacgatgtatgtatattgctatgagtcagagatgnaggtagtactgggttctttatataggaggg

SEQ ID NO: 20440 - DNA, 101 bp, rice(Oryza sativa)
  misc_feature (71): n=a or g
caatggaccaacctttagagggggaaaatatagttaaaatactggtttacagttcttgcattacttagtgncaataccccgatgcatgacttggtataaaa

SEQ ID NO: 20441 - DNA, 101 bp, rice(Oryza sativa)
  misc_feature (71): n=a or g
caatgtcaaatttgacgaggatgcagttaatctctcagaaatacaggtggaaggtactccaccattgacanatgatcgacaacctttaggaaattccttgc

SEQ ID NO: 20442 - DNA, 101 bp, rice(Oryza sativa)
  misc_feature (71): n=a or g
gccacaagacgctgctaacaagatccttttcttggatgaactgctcctggtcggccaacaattggtgactnggccgtggtgtgtcgtgggagatttcaacc

SEQ ID NO: 20443 - DNA, 101 bp, rice(Oryza sativa)
  misc_feature (71): n=t or c
aatcaaggagatctcacagagtatgagaagacaaagcagcgcttgccgatcatgaagacattccaatgganccctggtcagattgactctgattatggtcc

SEQ ID NO: 20444 - DNA, 101 bp, rice(Oryza sativa)
  misc_feature (71): n=t or c
aaatttgatgttttttttcttttctttcagattgaggatgcagaaaaggctccgagtgtgaatgaacgtcngaaactgagacacgagacagcctctgtgcc

SEQ ID NO: 20445 - DNA, 101 bp, rice(Oryza sativa)
  misc_feature (71): n=t or c
gagcaagactgtggtaggactcaggaccgtcaaatatagtggtagaggttcttactagcgagtgttgtggnggcagtagtcctcggttacttggcgacgac

SEQ ID NO: 20446 - DNA, 101 bp, rice(Oryza sativa)
  misc_feature (71): n=t or c
tctacatgcatgtcagctgcatgaacttgtccatgaggaccaggttcttctacaataatctcctcatcatngcacaggtcaacatagtctattattgtcat

SEQ ID NO: 20447 - DNA, 101 bp, rice(Oryza sativa)
  misc_feature (71): n=a or c
cataatggcctgagtctgcacttctccctttgtgcgtcaaaacagcaattaaatcatagatgccagtcaantgtttctttggcacagaagaatcggctgca

SEQ ID NO: 20448 - DNA, 101 bp, rice(Oryza sativa)
  misc_feature (71): n=t or c
agccgttgcatcgcgatcctcacttcctcctcatctttttccctcaatgattggaacagaaaattgtcgangtattcaagaatgttgcttgccatcctcca

SEQ ID NO: 20449 - DNA, 101 bp, rice(Oryza sativa)
  misc_feature (71): n=t or g
tggagttgctgggacggctcttcgtgggaaccctcgtgctgacctgattcgtttgggcgtggttgatttgngtcttagtttttggtggactttgagtccct

SEQ ID NO: 20450 - DNA, 101 bp, rice(Oryza sativa)
  misc_feature (71): n=a or g
attatggtgactatgcccaccgaaaatatggtttctgaatacttcaccatctctgaaaaacagatgtcgtncctatggcgtaatgtccctttgaatctcac

SEQ ID NO: 20451 - DNA, 101 bp, rice(Oryza sativa)
  misc_feature (71): n=t or c
accagtggcatgatcagttgccgattgctgcatggcaacttcgagaagcctgaaggcctctacaacatctngtacttcaacctgtagacaagtgaagaatg

SEQ ID NO: 20452 - DNA, 101 bp, rice(Oryza sativa)
  misc_feature (71): n=a or g
gctcagggacccaatcccgcccacgctctgctgctagattccgttcgtcgtccaactgaaccaggtattgngcccgctcccgagcgaactcgccaactacc

SEQ ID NO: 20453 - DNA, 101 bp, rice(Oryza sativa)
  misc_feature (71): n=t or g
gtctagctcaaaatttcgaagttccagtagtagaagataaatttgaagttccagtagtagaagataaggangtaatagagagtaatgcattagaagaacca

SEQ ID NO: 20454 - DNA, 101 bp, rice(Oryza sativa)
  misc_feature (71): n=t or c
caccagcgttgtcttgacaagtttcactggctgaaacccaatctgaatccgtagagaagatcagcaagctngaagcatctgcatttatcaagtgcagtgag

SEQ ID NO: 20455 - DNA, 101 bp, rice(Oryza sativa)
  misc_feature (71): n=t or c
gtacaatgatgataccaacaaaacagaatacaaccacgatgataattgccgtgaggttggcattgcttagncatcgggtatcagatctggatggaggaggc

SEQ ID NO: 20456 - DNA, 101 bp, rice(Oryza sativa)
  misc_feature (71): n=t or c
ggatggtcaatggagatcatcatggcattgcagccaacacatatgaccgatcacaacgttttaccaccacnaccaccaccacttgacatgagtgaggcggc

SEQ ID NO: 20457 - DNA, 101 bp, rice(Oryza sativa)
  misc_feature (71): n=t or g
cacgtaaatctacctttggatatgctgtgtttcttggtgacaatctcatctcatggtcctctaagcgtcanaatactgtatctcgttctagtgctgaagca

SEQ ID NO: 20458 - DNA, 101 bp, rice(Oryza sativa)
  misc_feature (71): n=t or g
tgcacaagtaaagttgcaagtggacatatgcgtgacaacatgttactgaatggagccggacctgcgaatgntgcaaatcctccttgccagtgtgaggttgc

SEQ ID NO: 20459 - DNA, 101 bp, rice(Oryza sativa)
  misc_feature (71): n=a or c
agacgtaaggtgtgggaacggtgatgttccactgcagcctgttcaagatgttcttctccatggcgaggatntgctgccgcgagtaggcgttgtcacagacg

SEQ ID NO: 20460 - DNA, 101 bp, rice(Oryza sativa)
  misc_feature (71): n=a or g
tcctccagaaacctaatcctttttgtcacttagggtgttcaagtttgttcttgggcgttcttggtcctttngggttccaaaggcgacttctttcgagagga

SEQ ID NO: 20461 - DNA, 101 bp, rice(Oryza sativa)
  misc_feature (71): n=t or c
aggctgtcggagactccctggaataggtagcagctctcgatagcactcttgaacatgtgcttcatgacgcncgaccgcacagccttgggcagctctgacaa

SEQ ID NO: 20462 - DNA, 101 bp, rice(Oryza sativa)
  misc_feature (71): n=t or g
atatggtacttatgatacactgcatcccgagaccattgaacagtgtagagctagtacaggagagaaacacngatctgagtcttcacttcttgtagtcaacc

SEQ ID NO: 20463 - DNA, 101 bp, rice(Oryza sativa)
  misc_feature (71): n=t or c
gcggctgcccgtctaatcgccattaatgaggggatttttgccttgcatttgagctcggaccggttcttctnacaccggtccgtatgagagatccccaccca

SEQ ID NO: 20464 - DNA, 101 bp, rice(Oryza sativa)
  misc_feature (71): n=a or g
gtgcctcgacgagacaccgccactggatctggcgacccttgccacaccattgtcgcgactcgttgccatcncgccatgccccaactcgccgcaatcgtcgc

SEQ ID NO: 20465 - DNA, 101 bp, rice(Oryza sativa)
  misc_feature (71): n=a or g
atggatggagacggaggagaaaggtggtggactgcttttcggctttaggaaaaagagagaattcaaagacnagttccaatagggaataactagtgcccctt

SEQ ID NO: 20466 - DNA, 101 bp, rice(Oryza sativa)
  misc_feature (71): n=t or c
aagatttgagcctacttcacacagagcatgataatctttcattacatcagggaccccttccacattaaccnacacagtatgcagcttacccacagcctcag

SEQ ID NO: 20467 - DNA, 101 bp, rice(Oryza sativa)
  misc_feature (71): n=t or c
ataagagtttcctgccatgttctcatgcacgcctctctgagcgaagacgattacaatactctccaagagcncagatgggaaataagttgcggtagttgggg

SEQ ID NO: 20468 - DNA, 101 bp, rice(Oryza sativa)
  misc_feature (71): n=a or g
tagttaatttccaggccagtgtcctgagcaaaagtattaagtaaagccttgagacaaaaaagttctctctnagaagcctttagaaagacaagtgtatcatc

SEQ ID NO: 20469 - DNA, 101 bp, rice(Oryza sativa)
  misc_feature (71): n=a or c
tgcgcacgcaacaaataatatgattcgcgagataattactgctgacctttccatcgtcgtcgattttacangagaacttttgccaagagtcactgaacacc

SEQ ID NO: 20470 - DNA, 101 bp, rice(Oryza sativa)
  misc_feature (71): n=a or g
taatctcatcaaaaacacacacaaaagcacacgaaaatttcaatgggatcgaagctttcgtgcatctaccngccggagagtgacatcgtcgtcgagtcgga

SEQ ID NO: 20471 - DNA, 101 bp, rice(Oryza sativa)
  misc_feature (71): n=t or g
aagttgagatattgcttgcgatcgttagaagttcaccgtcgatatgtacgacatgccgggcttccacccgnaagggatgacgttgctggcgacgagcgtct

SEQ ID NO: 20472 - DNA, 101 bp, rice(Oryza sativa)
  misc_feature (71): n=t or c
gcctactggtgttcgaatgagtaggatgggatgtgcttatccccacatgcaaaacgaaatgtctcattagnatatgtttaattaaatattatatataattg

SEQ ID NO: 20473 - DNA, 101 bp, rice(Oryza sativa)
  misc_feature (71): n=a or g
ggctccaactgcctttattcgtgcaattgctaccttgccctctgttagcactctggtcctgagtacttttngttgtcgtttgtagggatgtcgatgtcgag

SEQ ID NO: 20474 - DNA, 101 bp, rice(Oryza sativa)
  misc_feature (71): n=a or g
atgaacaaactctgaataatgttatgagcaattctgccaattcaccgttggtcagatacagatacaggtcnacaagaaggacaaggccgggcaccatttga

SEQ ID NO: 20475 - DNA, 101 bp, rice(Oryza sativa)
  misc_feature (71): n=a or g
cttcagtcgggcttcgatcaccccaacagttttatccctgtgtctctaggtataagtggctctgtcgttantatggctagtgaaattctggttaacagttg

SEQ ID NO: 20476 - DNA, 101 bp, rice(Oryza sativa)
  misc_feature (71): n=t or c
atatcacatcgcaccgcaacacacttgttttatgccaaagcaaaaatcctctcccatcttccatctctctntccctaggacgcgcagcgctgtttattcct

SEQ ID NO: 20477 - DNA, 101 bp, rice(Oryza sativa)
  misc_feature (71): n=t or c
gattgggtggcaagaattcaaaggcacacaaatcagatggcatatcctcaaatttcttaggccacggtccngaaacacatatggccttggtaggtcttgca

SEQ ID NO: 20478 - DNA, 101 bp, rice(Oryza sativa)
  misc_feature (71): n=t or c
gggataccttgcagccatgcaatttctagcctcaggtaccagagaatcaatgctgagtcagtattgccagnttgttatagtgtacaagcattttcaaatgc

SEQ ID NO: 20479 - DNA, 101 bp, rice(Oryza sativa)
  misc_feature (71): n=a or g
tagttaggttggttctttctcgtcgggtcttttatgtaagttgggttcttctcgagttgggaatctgctgntgagattccatggttgttagagtggatggc

SEQ ID NO: 20480 - DNA, 101 bp, rice(Oryza sativa)
  misc_feature (71): n=t or c
accatccgccattgaggaagttattcagggaatgcccggtgaaaaagttattcagggaatctttcggactntcatggacattgatgactgcaagattcaga

SEQ ID NO: 20481 - DNA, 101 bp, rice(Oryza sativa)
  misc_feature (71): n=a or g
caaggtacgtagttgtgtcaaaaattgccgtagtttacacgcttttggagatttctgtgatgttgattcantgtcaatacaggagaagggagacgccagga

SEQ ID NO: 20482 - DNA, 101 bp, rice(Oryza sativa)
  misc_feature (71): n=t or c
tgaaatccgtgcctgcaaggaacgcggaattcaacgtgcttctcctactcgtgatgttcattgtcccattnacaagacaaggacacacgacctctcgagct

SEQ ID NO: 20483 - DNA, 101 bp, rice(Oryza sativa)
  misc_feature (71): n=a or g
ttcaagccctgtacagagtcctcgaagactgagtagtgtagactttttgtccactgcaacatccacccaangtgccaatttatcgtcagcacagtcagtct

SEQ ID NO: 20484 - DNA, 101 bp, rice(Oryza sativa)
  misc_feature (71): n=t or c
acgttttgtatatattccatacaagtacaataagactatggatgaaaggttgcccagtaggggcgattaangatctgtgggtggagacatgagcgccacct

SEQ ID NO: 20485 - DNA, 101 bp, rice(Oryza sativa)
  misc_feature (71): n=t or c
ggacagctgctgttgtagaagtgctgcgtctttctcagaattaagaagggagatggtgttctgaagctcanatgataattcttccattctcgaatttctgc

SEQ ID NO: 20486 - DNA, 101 bp, rice(Oryza sativa)
  misc_feature (71): n=t or g
gctactgtgctagcacttgtcctcgactgtgtttcagtatcgtagcacttgacaataagcacaactaattnttgtgttttcatctaattttcttctcaact

SEQ ID NO: 20487 - DNA, 101 bp, rice(Oryza sativa)
  misc_feature (71): n=a or g
ctggattgacgaattcaacgattttgacgtctctcagcattacggtatttggaagtggtttgtgaccaacntgacttgtgaaaaggctaaaaaatcatctg

SEQ ID NO: 20488 - DNA, 101 bp, rice(Oryza sativa)
  misc_feature (71): n=t or g
gattaattatcctgattagagagtaattaaattaatcaattagaatcggccaggcttcctggaaatgcaanaccattcagtctcgcagcctcgccacgcga

SEQ ID NO: 20489 - DNA, 101 bp, rice(Oryza sativa)
  misc_feature (71): n=t or c
cctgcctcatcaacaagccctttctgtgcacatgccgagaccattatagtccatgtcaccaagttcttgcnaggcatcttgtcaaagatcacccgagccat

SEQ ID NO: 20490 - DNA, 101 bp, rice(Oryza sativa)
  misc_feature (71): n=a or g
tatttctttttgttacgtaggcttcaatttgcacaggaatattctggccagtttttgtgagcaatagccanttctgaatccggtgatcactgacaatggcg

SEQ ID NO: 20491 - DNA, 101 bp, rice(Oryza sativa)
  misc_feature (71): n=t or c
ctaatggcttctttacggtcggaggcgaaacgacgaaggctctgcttgatgggtttggcctccgggcgcangttcagggcgtgctcggcgacttccttcgg

SEQ ID NO: 20492 - DNA, 101 bp, rice(Oryza sativa)
  misc_feature (71): n=t or c
aattcagttccatacaagaattttgcctacaaaaggaagtacatacacaaagccacatataggattagccngttcttcatctaagacaagataagacatat

SEQ ID NO: 20493 - DNA, 101 bp, rice(Oryza sativa)
  misc_feature (71): n=t or c
cattgtgataagttttgttttgtacctacatcatttattaaaattggcttctttcttgtcagaagctcaanaagtatcactccaaaactatacacgtcact

SEQ ID NO: 20494 - DNA, 101 bp, rice(Oryza sativa)
  misc_feature (71): n=t or c
aagaccacttattttataatgtggttgtcccaggcaatggtagacaagggtacgctaatcaagcaaacaanatgtatctgtttcctgggtatgacaactgt

SEQ ID NO: 20495 - DNA, 101 bp, rice(Oryza sativa)
  misc_feature (71): n=a or g
ttagagttctgcatcttgcattcactgaagaaagcgaacagtttgttgatatcatccgccatctccgcgcntttgttagcagccctcctgtgtaaataaat

SEQ ID NO: 20496 - DNA, 101 bp, rice(Oryza sativa)
  misc_feature (71): n=a or g
ttggccttgcaacgttgtgcatcatcacgatactcacgttgccagacatggttaattacgcgtcaattttnttcccactctaggttcttttagttcatggt

SEQ ID NO: 20497 - DNA, 101 bp, rice(Oryza sativa)
  misc_feature (71): n=a or g
gcgggctacggaggggataagggaaatgcgggacgatctaaaacattggattggatgatcctgggccgttngattggatgatgaatgaggaatataacatg

SEQ ID NO: 20498 - DNA, 101 bp, rice(Oryza sativa)
  misc_feature (71): n=t or c
aaggatctcaatgaacagataaagagagctgaaacctcacttgaagagaggaagaagctctcttcatctgnctgtcaggctctcagtgatgagaaggggtc

SEQ ID NO: 20499 - DNA, 101 bp, rice(Oryza sativa)
  misc_feature (71): n=a or g
tttctatgttgtcatagccatgagaggcgtctacattttcaccacaatattcttccttctcatgccaacanttgctcttgcaaatcatagaaaacccttcc

SEQ ID NO: 20500 - DNA, 101 bp, rice(Oryza sativa)
  misc_feature (71): n=t or c
cgatcgttggcagagctgccatcgatccaagaactgtcactaggtagcaacgggctatcaggtgagattcnacctgctctgggcaatctcactggcctctc

SEQ ID NO: 20501 - DNA, 101 bp, rice(Oryza sativa)
  misc_feature (71): n=a or g
tgcgtatcaaagcaatgaaccgatgatagacaggaactcctcaaattgatatgcagccatacatcggcaangttttcgataacacaactcggtttcaaaaa

SEQ ID NO: 20502 - DNA, 101 bp, rice(Oryza sativa)
  misc_feature (71): n=t or c
agattcttccggtgaacccattgttcgaaacatcaatgatctccgcagattgttgtccccacacccacgcngggaggttgccggtgagcgtgttaccgtga

SEQ ID NO: 20503 - DNA, 101 bp, rice(Oryza sativa)
  misc_feature (71): n=t or c
gaaaaactatgaaggaatgaaaataaatactccgtaatatatagtagccattcctctacctcttgccttgnagttgatcagcgagcttcttcttgagggct

SEQ ID NO: 20504 - DNA, 101 bp, rice(Oryza sativa)
  misc_feature (71): n=t or c
catttactctttgtgttcatgagaattggcatgcagctagctagcagcattgctgaacctgaatgctgatnagttcagaaaaaatcagatatgagcgccga

SEQ ID NO: 20505 - DNA, 101 bp, rice(Oryza sativa)
  misc_feature (71): n=a or g
aggctctgacgagatgcagcagggcgtaaaggttgatacgactcgggtcatagagaacactgctagcaccntcgacagcgagacgcccgtagagcaaaaga

SEQ ID NO: 20506 - DNA, 101 bp, rice(Oryza sativa)
  misc_feature (71): n=t or c
gctcctgtcaatctcaaactaatcttaatttgtccatgttgtctcaatgacacacatatgggctctagacncatgtatatatcattcagagaagagagaac

SEQ ID NO: 20507 - DNA, 101 bp, rice(Oryza sativa)
  misc_feature (71): n=t or c
aatttaaaattgtcaacccacgtaaccgctagatctggttacatacaacacgagccatcacatcatttatnaattaacctagactccttagtctgaggctc

SEQ ID NO: 20508 - DNA, 101 bp, rice(Oryza sativa)
  misc_feature (71): n=t or c
tgattctcgtccctgcagaaccagatacctcgtacctccatcgactatcaataccagtttgttttgactcncttggcagtttgcaaggcagtttcagctta

SEQ ID NO: 20509 - DNA, 101 bp, rice(Oryza sativa)
  misc_feature (71): n=a or g
ctgatccatttctatcattcagattgcggaaacacaaaaatacgcctatatggcagcaaggcaagctgtgnttgaatataatactgaaaatcttcagccac

SEQ ID NO: 20510 - DNA, 101 bp, rice(Oryza sativa)
  misc_feature (71): n=a or g
ggttcggtcccatgccgccagtcggtctagccctgtgcaaaaggcttgggtcttttccaaatctgacctgnacttgcgataaatatatcccagtgctaaat

SEQ ID NO: 20511 - DNA, 101 bp, rice(Oryza sativa)
  misc_feature (71): n=t or c
acaccattttacatggcttcttgccgtgcagcctctcctaaggcagccatcgtcgttgccgtctgcatccngctgatcctgtcttcctcctccgtcggccc

SEQ ID NO: 20512 - DNA, 101 bp, rice(Oryza sativa)
  misc_feature (71): n=t or c
cagttttgttctagccacactttgtcaccatttgccaataaatgttgttacacttgccaaagttgaggcgnctaagagaatcttgctacatttttatgagc

SEQ ID NO: 20513 - DNA, 101 bp, rice(Oryza sativa)
  misc_feature (71): n=a or g
accaatttctgagttatagtggtgacaagggctaaattctggtggagcggttaagttgccaacctattctngggggtgtttggtggttggagggtggccat

SEQ ID NO: 20514 - DNA, 101 bp, rice(Oryza sativa)
  misc_feature (71): n=a or g
tcctgttaaccaccatataaatctccccaaaagtgaagtctttcaccacttatgcatgccaagaggtttancaagatggctcggccgtcgtcgtcgtggtg

SEQ ID NO: 20515 - DNA, 101 bp, rice(Oryza sativa)
  misc_feature (71): n=a or g
tggactcgccgataggaatgtgggaggttcctcttgccgatactgatgtgttttctctttgtcgatattgntgtgatcgccctccatagtactccctccat

SEQ ID NO: 20516 - DNA, 101 bp, rice(Oryza sativa)
  misc_feature (71): n=t or g
attatgcttggatggtaacagtctcgaaggaagtttgcctagctcggttggtaatcttgccccacagcttnagtggttgtggctcaagcaaaacaaaattt

SEQ ID NO: 20517 - DNA, 101 bp, rice(Oryza sativa)
  misc_feature (71): n=a or g
ctcattagtaagaagtagaacacatcaagaaatctagcattcagaaaacatatctttagctggaaaacttncctccaggaagcgcttccttgcttcgtcta

SEQ ID NO: 20518 - DNA, 101 bp, rice(Oryza sativa)
  misc_feature (71): n=a or g
gatttcgggagccaccggaagcgaatcgagcttcctgaggagagggcccatggcacctagggagaaactcnccggagcatccatgccgccaagggaataag

SEQ ID NO: 20519 - DNA, 101 bp, rice(Oryza sativa)
  misc_feature (71): n=a or g
aaatccatactatccaaactggttggtgcctaggatcaatttgagatgcctttctaaataaaacacgggcngtatttggagatgagtagttgtattccagt

SEQ ID NO: 20520 - DNA, 101 bp, rice(Oryza sativa)
  misc_feature (71): n=t or c
aaggtcggtggtttgtcttgtgttccttccgctgcctgccatctctcgaattgatttaaatcacagagttngagttcctttaaagctggtaatgcaggctc

SEQ ID NO: 20521 - DNA, 101 bp, rice(Oryza sativa)
  misc_feature (71): n=t or c
acggaagtttcagagatattgcatcataggacgacaaagagaagtggaaccttttgctttgcagaagttanttcacatatataagtcataacgaactttgg

SEQ ID NO: 20522 - DNA, 101 bp, rice(Oryza sativa)
  misc_feature (71): n=a or g
agcatttagcttatcagtcattttgtcgtacggtgcttcaagatgttttgccatcctctcaggtccatagnaacgcactgcgccctggaggaacttacaag

SEQ ID NO: 20523 - DNA, 101 bp, rice(Oryza sativa)
  misc_feature (71): n=t or c
ctcgacacaattgagaacctcacatccatcttacccaaatgttcccatgactctcgtggtaacatagttgntgtctgaaccgaggagcttggcgaggccaa

SEQ ID NO: 20524 - DNA, 101 bp, rice(Oryza sativa)
  misc_feature (71): n=t or c
ttttcttatttgccgctggaccaatacgcatcggtctggaagagcaaagcattccattcatttcagtcatngcacgagcttgctctgtaggatcaccaaat

SEQ ID NO: 20525 - DNA, 101 bp, rice(Oryza sativa)
  misc_feature (71): n=a or c
agccttatgtccaccgccatgccgcaatcaccattgatgcgataaatgtatggtatgaaattcgttatctngctgaaggtggcagccccgtcgacaagcaa

SEQ ID NO: 20526 - DNA, 101 bp, rice(Oryza sativa)
  misc_feature (71): n=t or g
tcggcgtcggcgctgcacccaaagtgaacaccgggaacacggtgatgaggctgatgttgttctcctccgcnaatttgcatgctgccttctccatgagcacc

SEQ ID NO: 20527 - DNA, 101 bp, rice(Oryza sativa)
  misc_feature (71): n=a or g
agcagcaactgtatcctttgcctcttatgaacagcgtcagtggcgacggacaatggccttggcctttgatnggcggtgatggccctggtctctggtgagat

SEQ ID NO: 20528 - DNA, 101 bp, rice(Oryza sativa)
  misc_feature (71): n=a or g
acggacggaaattgtaattagttttttattagtgcctaaacacggggcttctaatgggcgattgggtagcnatcgatccccctccctccctccacctggtt

SEQ ID NO: 20529 - DNA, 101 bp, rice(Oryza sativa)
  misc_feature (71): n=a or g
agcacactataacacaagaacagatgttgccgaccgttgtctatgtaaagggacagagaagccggagattnctcgaggacaggcacggaggccatatccag

SEQ ID NO: 20530 - DNA, 101 bp, rice(Oryza sativa)
  misc_feature (71): n=a or c
ctctattcgcaactaaatatgcattccagtgttgatttgaagaaaagtatttgccagaaagaagcttacanaatagtcatcaatttttttagcgtacaagt

SEQ ID NO: 20531 - DNA, 101 bp, rice(Oryza sativa)
  misc_feature (71): n=a or c
aatgtgccgccaccgagatcgaacacgagcaccatcctccccttgttgctgacgggcatcttctcgagacngtaggcgagggcggcggcggtgggctcgtt

SEQ ID NO: 20532 - DNA, 101 bp, rice(Oryza sativa)
  misc_feature (71): n=t or c
caacagtactgagtacagactagcatgtgcttaacttgaagaaaatgtacatgtcctggagcctggagcangaatgttcgtgcaagtatagcaattcagag

SEQ ID NO: 20533 - DNA, 101 bp, rice(Oryza sativa)
  misc_feature (71): n=a or g
cctttgtgcgaccgtgtataatagaatggtcaacacagatgcagatttggccgatcggtttgaagacattncggcccgtatgtgcgacctggcagcggagc

SEQ ID NO: 20534 - DNA, 101 bp, rice(Oryza sativa)
  misc_feature (71): n=t or c
ctgggtgagaagaagtactactgtccgttcaaggattgctcggcgttgctgatcaatgacaacgacggcgnggagaagaagatcagggagacggagtgccc

SEQ ID NO: 20535 - DNA, 101 bp, rice(Oryza sativa)
  misc_feature (71): n=t or c
cgatggacatgtctccaagtccgactatatgaactgagaatatgtcgctgtgttcctggcgtggcgtcatnagaaatagagagatgggagggtgggcgaga

SEQ ID NO: 20536 - DNA, 101 bp, rice(Oryza sativa)
  misc_feature (71): n=a or g
gccgctccttgagcaatttgcacagtcgcggtgtacttcccaccaaacaaggagtagagagattgcaagcncctagtcgtggcagaggaagatgaggagta

SEQ ID NO: 20537 - DNA, 101 bp, rice(Oryza sativa)
  misc_feature (71): n=a or g
gcactgctagattttaggcagggagacgagggaacgtgtacaaatttttcgtggcacacaactagcaaatntcatgaaaaattctatagaaaaattggaca

SEQ ID NO: 20538 - DNA, 101 bp, rice(Oryza sativa)
  misc_feature (71): n=t or c
aatatgcaacgcgtgctccatgtccatagcgttcttgccttttccgttggtatcccgtgtgctgacaccantgctgacgccaggacgaccaccaccttctc

SEQ ID NO: 20539 - DNA, 101 bp, rice(Oryza sativa)
  misc_feature (71): n=a or c
gcgcacctcggaacttggtcttctccatctcggcgagcgctagcgcctcctcctctgcgtgttgtgcctcntctagctgcagcgccccctccagtttcagc

SEQ ID NO: 20540 - DNA, 101 bp, rice(Oryza sativa)
  misc_feature (71): n=a or c
ggtggaaggggaaaatccaagggtgggagcagtatcatgagccactcccctatccacggtgtgtccaacgnggagcccgactccatggctcgacgaaaagg

SEQ ID NO: 20541 - DNA, 101 bp, rice(Oryza sativa)
  misc_feature (71): n=t or g
cgggaggtaggggagcagagcaagcgagcgagagtgattagggaggtaattaaattaaattagcctttgtntaatcataatggttggctgttagcgacgtg

SEQ ID NO: 20542 - DNA, 101 bp, rice(Oryza sativa)
  misc_feature (71): n=t or c
ctgaatgtctgaaactgaatgtgtggggagttgcagatctacgtggttgattcgatggacagggaaagganaggagtagccaaggaggagttccaggccat

SEQ ID NO: 20543 - DNA, 101 bp, rice(Oryza sativa)
  misc_feature (71): n=t or c
gaggcgtttgcaactgtaatgtcacggctgcgccagcacttgttggatgcaaatgtagagattaattacanggagtacttagatttgatgaaactggaagt

SEQ ID NO: 20544 - DNA, 101 bp, rice(Oryza sativa)
  misc_feature (71): n=a or g
gacgtttcgcgggacagggcgcgtggcggctttgaattggcgcggtgggtccttggcaactatcgccaacntggtcatgcgctggaatcgcgggtgtactg

SEQ ID NO: 20545 - DNA, 101 bp, rice(Oryza sativa)
  misc_feature (71): n=t or g
cttctcatcactctccgcaggtcccggcttctcatcttcatcgattgaagtagcagctgccactaccttcngaggcggcggcttgaaggcattgccgcctt

SEQ ID NO: 20546 - DNA, 101 bp, rice(Oryza sativa)
  misc_feature (71): n=a or g
gaagcgccagggctgtgtggggtaaagcaacaccatcctgcatacatcaaggaggacaatatattggtacntaagcagtatctagaaagctaaagaaaagc

SEQ ID NO: 20547 - DNA, 101 bp, rice(Oryza sativa)
  misc_feature (71): n=a or c
acctcacgattttcctgaattcctgcaaaaaaaaaaaacagatgcacgtctacactttcccaactcatatntctcgttttccacgcgcacgcttttcaaac

SEQ ID NO: 20548 - DNA, 101 bp, rice(Oryza sativa)
  misc_feature (71): n=t or g
taaagaagaaaaataaatggtgacttagctttttagtgttcccccggtaatagcagatgtagccgatgtgnggagaaagtcgtccatcaatcccaataaaa

SEQ ID NO: 20549 - DNA, 101 bp, rice(Oryza sativa)
  misc_feature (71): n=t or c
gacccatctggcagtttgtaaaatgtgcttcttcaacctaaagggaggtgagcccagcacaatcttcaatntattgtgagacaagtctatatactctaagc

SEQ ID NO: 20550 - DNA, 101 bp, rice(Oryza sativa)
  misc_feature (71): n=a or g
agtagtaccagcagcagcatgatcagtgatctccatgtagttcagaagagtgtgattgaagaacagctgcngcattcggatgccgcggggcctcccgcgat

SEQ ID NO: 20551 - DNA, 101 bp, rice(Oryza sativa)
  misc_feature (71): n=t or c
aaacatcatttatacctgtgttcttgtgtgcctctaaaagcaatgagtatggattgtggatcaggggcgantccaacaaaagcctggtcagaattatatat

SEQ ID NO: 20552 - DNA, 101 bp, rice(Oryza sativa)
  misc_feature (71): n=t or c
tgctttaggcacttgatggaaaacttgacaaagaggaaaactggtacagtttatggtaacttgtggccagntgctagagcttttaggtctgagatctatga

SEQ ID NO: 20553 - DNA, 101 bp, rice(Oryza sativa)
  misc_feature (71): n=t or c
ctatgtcctaatggctgcattcagtatgtgttcttggcgatttttaagtgccatggtcagtatctagtacncattagtctgatcgttatcaccctcaagaa

SEQ ID NO: 20554 - DNA, 101 bp, rice(Oryza sativa)
  misc_feature (71): n=a or g
tgattgtgatgatgaatatgctttagctaccactaaccacgcaggaggacaagataatgatgacatcgagnaagtccatttgcatccagagtcgctagatc

SEQ ID NO: 20555 - DNA, 101 bp, rice(Oryza sativa)
  misc_feature (71): n=t or c
aaagcttgctagaaaatgcaacggattgcctcttgcacttgcagttctggggggttatctgtccaaaaatntaaacatacaagcatggtcagacatattta

SEQ ID NO: 20556 - DNA, 101 bp, rice(Oryza sativa)
  misc_feature (71): n=t or c
atgtacaacagaggtgatccataaagaaggaaccctctagaggaaaaaaaaagcatcacaaaaagcgatgngcaacaaaaagacctcctaggagcagctaa

SEQ ID NO: 20557 - DNA, 101 bp, rice(Oryza sativa)
  misc_feature (71): n=t or c
accaccaaggcagtgctcaatggcactcctactaaaccagaacgtgtgttcccgggtaccacaagtttgtncgcgccctcaattatctcagctgctagggc

SEQ ID NO: 20558 - DNA, 101 bp, rice(Oryza sativa)
  misc_feature (71): n=a or c
acatttgtttcgtcatgtgtatctttgacgctacgaaaccaagttgcacaacattgagctcttatgtcagntacaattaagataaaacatgaaacatgaaa

SEQ ID NO: 20559 - DNA, 101 bp, rice(Oryza sativa)
  misc_feature (71): n=a or g
ggagaccgagatgaccaaacacacaagctttgatcgatctctcccacacggctcaaacgcgcatacacgtnaacacacaagctttgatccttctgttcgcc

SEQ ID NO: 20560 - DNA, 101 bp, rice(Oryza sativa)
  misc_feature (71): n=a or g
attcagcaggggaaaattaacttgatccatttgccccgagcttatgtggtgtaatcaagtttagtgggacncgtatctcttatatctagttcagttctgat

SEQ ID NO: 20561 - DNA, 101 bp, rice(Oryza sativa)
  misc_feature (71): n=a or g
acgctggacccttcttataaatctctgggtctgaagtagccctaagatgcgacatcccaattgcccatagnttgttctccacaacaaacacaataggaagc

SEQ ID NO: 20562 - DNA, 101 bp, rice(Oryza sativa)
  misc_feature (71): n=t or c
tggaagcagattcggttccggagcccaaccgacttttggtatgggtggaggaggtgggtttggagcgggtnacggatttggagccggagccggaggttggg

SEQ ID NO: 20563 - DNA, 101 bp, rice(Oryza sativa)
  misc_feature (71): n=t or c
ctcttatgacctgccaaatagaaaagaagtgcaaagtgcacacccacatgtgacttgatgtacatggctangtgcttgtcaacctctgcttttactttgcc

SEQ ID NO: 20564 - DNA, 101 bp, rice(Oryza sativa)
  misc_feature (71): n=a or g
gccgttgtcacaatgtcctggttagtcagtctgttggcttctttggaaggttctgaatgacaaacaaaccntgttgtcgttcctccaaatttgtaccgttt

SEQ ID NO: 20565 - DNA, 101 bp, rice(Oryza sativa)
  misc_feature (71): n=t or c
aaataaaagccgcacaataattgagcacgtttgagagagctagcaagtagttatacggtactccctccgtncaaaaaaaaaaagtttatgtcataccaaat

SEQ ID NO: 20566 - DNA, 101 bp, rice(Oryza sativa)
  misc_feature (71): n=t or g
atcacatctgcatatcttccctgcaaccgtgtgaagaaggatcacaactcattcttctcttctgtcagtanagagagagagagagagagagagatcaagaa

SEQ ID NO: 20567 - DNA, 101 bp, rice(Oryza sativa)
  misc_feature (71): n=a or g
catgggataaaattctcaccgaccccacccaaacgggaatattgccgtttagataatagatagaaatccancatatatccataagtgaatatacacagaag

SEQ ID NO: 20568 - DNA, 101 bp, rice(Oryza sativa)
  misc_feature (71): n=a or g
ctgagattcacttaattttgattaaaagttcgtttcacgtacatattttgcagcacaacgtagaacagaancatatatcggtttaaatgtatatattgact

SEQ ID NO: 20569 - DNA, 101 bp, rice(Oryza sativa)
  misc_feature (71): n=a or g
tccttctagttacttggaagggtttactccagtgaagtctattgggtcaatgtcagcatcatatctcctanttccctcaccaagcatgcgatacctttcgc

SEQ ID NO: 20570 - DNA, 101 bp, rice(Oryza sativa)
  misc_feature (71): n=a or g
ataagcaggaactgggaatcactgaattatgccatatcatacctcgcgaaattccaccggagttgcggccncagctgaattccgcagcagccatgccatgc

SEQ ID NO: 20571 - DNA, 101 bp, rice(Oryza sativa)
  misc_feature (71): n=a or g
acgaagaagaggatgaaaggagcagatatgcttgtttgttgtttgtttgctgctactactagttgatgagnaattcagccgggatgatggtgcatccggca

SEQ ID NO: 20572 - DNA, 101 bp, rice(Oryza sativa)
  misc_feature (71): n=a or g
gataaaatagtactctcagttaggacgtcttcatcggaatgctatcctactttctcctcccttagaaaccngaaaagattgtcgaccaccaccaaacgcca

SEQ ID NO: 20573 - DNA, 101 bp, rice(Oryza sativa)
  misc_feature (71): n=t or c
ctgcttcagtttaatatacggcatattccatcccagagccagactactcttaaaagacaaattgttgtttngatcgtgacttttttttatacgtaaaagaa

SEQ ID NO: 20574 - DNA, 101 bp, rice(Oryza sativa)
  misc_feature (71): n=t or c
gcgtatttacctgcctcggcctccagctcacgcactattgacttggtgatctcaccggctttttcaccggncgtcatgtgcacctcacgaaggctcgcgag

SEQ ID NO: 20575 - DNA, 101 bp, rice(Oryza sativa)
  misc_feature (71): n=a or c
ggtgattaagtttcttcccatacaagtgctcgagctgccatgtctgattcatctgtttggagtgttcaagntccaagatgctgaccagcaaatgaggaagc

SEQ ID NO: 20576 - DNA, 101 bp, rice(Oryza sativa)
  misc_feature (71): n=t or g
aaaaggattaattgttttgacacgaacacgtgagatatcaattcaccaatttgtgatgatgcggaactaanggcctgtttgaaatagcatattaacagtat

SEQ ID NO: 20577 - DNA, 101 bp, rice(Oryza sativa)
  misc_feature (71): n=t or c
agtgttcttgcaaaatgaactaagaagattgagttaggttttggatactccacaacttaactccagatccnataactcttaaaattaaattgaggagttct

SEQ ID NO: 20578 - DNA, 101 bp, rice(Oryza sativa)
  misc_feature (71): n=t or c
tctcaggtcttagtaaggaaacccgagaaccacaataaatcaaaatcagagtcagactccatcggtatgancaccggtcagaccggccccccaccatcagt

SEQ ID NO: 20579 - DNA, 101 bp, rice(Oryza sativa)
  misc_feature (71): n=a or c
gccatttcaacctagagtctcccttctcctggcccacaaaaatcttgctaatcactaaggtccgtcacatnaaaccaattaaccaactaaccaacattatt

SEQ ID NO: 20580 - DNA, 101 bp, rice(Oryza sativa)
  misc_feature (71): n=a or g
gcctctcgctgatgggtgctattttgctcttgtttatctcattgatctccatgatctacaccatcctccantactacaaccgtcggcagtaggattggcac

SEQ ID NO: 20581 - DNA, 101 bp, rice(Oryza sativa)
  misc_feature (71): n=t or c
ggtcgtcttttggaggacgaagttcgaggttgcagagctcgaacgatccgtcgtaatcgtgaagaaggacnaggccatcgagacacttcgaggttgcgagg

SEQ ID NO: 20582 - DNA, 101 bp, rice(Oryza sativa)
  misc_feature (71): n=t or c
aaaatatttgacagagcttagtggagacgccatagccatgcaccatgtcctccctagtcattttttacttngtccaattgctctctctctctctctcattt

SEQ ID NO: 20583 - DNA, 101 bp, rice(Oryza sativa)
  misc_feature (71): n=a or c
gttggtgcaccctgttaagagaattatactgtatatgtttcctgtagatataatatactacctacgtttcngaatataagtatttttagggtttgacacgg

SEQ ID NO: 20584 - DNA, 101 bp, rice(Oryza sativa)
  misc_feature (71): n=a or g
agtatgcggctaccaagctaggttataaccctgaaggaggcaatttgatccggttttaatatttgggtaanattatatatctgattttatagttgaggaat

SEQ ID NO: 20585 - DNA, 101 bp, rice(Oryza sativa)
  misc_feature (71): n=a or g
aattattctaagcaataaccatattcaaggaagcatccctccagagattggtctcctttccaacctttctncactatttattcgtaacaatcaactcactg

SEQ ID NO: 20586 - DNA, 101 bp, rice(Oryza sativa)
  misc_feature (71): n=a or g
ttgcacaaactgacaatcttttgcccatccttacccagccatcactcagaaagatctttaaagatggcctntgtttactacttccccaaacaaatcacgaa

SEQ ID NO: 20587 - DNA, 101 bp, rice(Oryza sativa)
  misc_feature (71): n=t or c
gtcaaaggaagagaacaggacagatgtaaggtacggcagatcctcgaacatcctggaacgaaagtggtcgnaattgtaggaatggccggggccgggaagac

SEQ ID NO: 20588 - DNA, 101 bp, rice(Oryza sativa)
  misc_feature (71): n=t or c
cttaaaaaatgtcaatcacttttcttattgcataatcactacggttctcatagctccttcgtagattaagnaaaaaaaactattctaacttacattttttt

SEQ ID NO: 20589 - DNA, 101 bp, rice(Oryza sativa)
  misc_feature (71): n=t or c
ttatgtagcggaaagatgcaatgcgcggtatcatcagaacctaacttatctttaacagacatgatttttanataacatccaaggcatcatgtgagataaat

SEQ ID NO: 20590 - DNA, 101 bp, rice(Oryza sativa)
  misc_feature (71): n=t or c
cagaattattttggagataagttccctctactccagggacttgccttgaatgacaacaaatttcatggtcncattcctttatccctttccaactgttcaat

SEQ ID NO: 20591 - DNA, 101 bp, rice(Oryza sativa)
  misc_feature (71): n=a or g
tgggattccccaatcattctatttctcaagcacacaaaaattaggcccttagaaattagcattgctttgcntgtttatgcaaattagaacctttctttgta

SEQ ID NO: 20592 - DNA, 101 bp, rice(Oryza sativa)
  misc_feature (71): n=t or g
ctgaatgatgcgagagatccgatgagagcggctatcggaaggaagcaagctgcacacttccactagtcttngtcgggacgggcgatgtgggcggaggtgac

SEQ ID NO: 20593 - DNA, 101 bp, rice(Oryza sativa)
  misc_feature (71): n=t or c
tttgtagctagatagctagtttcctcattgcacaaacttggcataaagcagtcgctcgaactcctccatcnttcgtgcctccatacacatgagcacgcgca

SEQ ID NO: 20594 - DNA, 101 bp, rice(Oryza sativa)
  misc_feature (71): n=t or g
cgtcgccgcctgccccagcccgctccacagtgccatggcactaagacatataaggattctgttctttgttnctaacaaacggatcgacaaagatgaaatgc

SEQ ID NO: 20595 - DNA, 101 bp, rice(Oryza sativa)
  misc_feature (71): n=a or g
caattcgatcgattctggcaatttggttggattagggagggattggctaaatttgcatcatacaacatcgnacgcatctgcacctggttgtgttgttgggc

SEQ ID NO: 20596 - DNA, 101 bp, rice(Oryza sativa)
  misc_feature (71): n=t or g
atttcttggtagcatactttgcttcgcttctagatctattgtgagatatctcagcctaattaatctttctngtatcttgacatgtatgtacggcatgatgg

SEQ ID NO: 20597 - DNA, 101 bp, rice(Oryza sativa)
  misc_feature (71): n=t or c
gcccaagcgcccaatacaaaatatttgcctccattttggtcactcgcggagccaaatgaagcacgctgatncaaaattggacacacatacttcacctccat

SEQ ID NO: 20598 - DNA, 101 bp, rice(Oryza sativa)
  misc_feature (71): n=a or g
atggtatcagagccaacaatccgtgggattccaggccaggaggcaaggtggatgacacacagtggcagcancgacgtccagaggctagatccaagcattgg

SEQ ID NO: 20599 - DNA, 101 bp, rice(Oryza sativa)
  misc_feature (71): n=t or c
cgagggtgtacctgtcgagggtgacgaggagaagcccacgccacctagtgtagttcccagagatgatgtcnagggtgatgggcacgacggccttgttgttc

SEQ ID NO: 20600 - DNA, 101 bp, rice(Oryza sativa)
  misc_feature (71): n=t or g
tccactggagttttctttattgcccattaagaagttatcggaggcactattagaactaggatggtaaaaangtcaatttcatattataagtcgttttggat

SEQ ID NO: 20601 - DNA, 101 bp, rice(Oryza sativa)
  misc_feature (71): n=t or c
gatttcattatagacaggaggagtgcaagagtactcgggtagagaaggagaagggttatggatgtaaaacnagatcgaatgccagcccttattggatgatt

SEQ ID NO: 20602 - DNA, 101 bp, rice(Oryza sativa)
  misc_feature (71): n=t or c
gattttgactttgcttcaacagatataattgggttatgaattagtagtacgcagtagcaattgtattctcntctgtctatcctaatactacctctgttttt

SEQ ID NO: 20603 - DNA, 101 bp, rice(Oryza sativa)
  misc_feature (71): n=a or g
tggtgggatttccagtcttttcgacgtgtcgtgtcaccggatccatttctttgttgccgttgttgttgttnctgtttggttggttgccgagaagctggcca

SEQ ID NO: 20604 - DNA, 101 bp, rice(Oryza sativa)
  misc_feature (71): n=t or c
tggatttatcagttggctgcaatctccggtgacattttcctgctgtgtattattcggtgtgtgtttctggncgtgcggctgtaggcacttggatgaaattg

SEQ ID NO: 20605 - DNA, 101 bp, rice(Oryza sativa)
  misc_feature (71): n=a or g
actaagcaaaattcaacaccggaacttggttggtgtcataacttgctgctcttgccctaatttgaaccaanatgacttcaaagcccttgtgttcgagttca

SEQ ID NO: 20606 - DNA, 101 bp, rice(Oryza sativa)
  misc_feature (71): n=a or g
atatatctcatcaccaaaccaatcttttgaaccatatggtggaagttacgactagaattccatcgatgctntagaacaatcatgacgatagtatgattcat

SEQ ID NO: 20607 - DNA, 101 bp, rice(Oryza sativa)
  misc_feature (71): n=t or g
cggagacttggaatacaatgtgatcttgcagccacatctgaatcagcactttctgctctattggaatcctncaattcaaggttcggtttctttgtgtatca

SEQ ID NO: 20608 - DNA, 101 bp, rice(Oryza sativa)
  misc_feature (71): n=t or g
ctttttccatgactcaatccccagcctcactatgcataaagttttttttggataccccacaaaaaaagggnttttttttgacaattcataaactagttggt

SEQ ID NO: 20609 - DNA, 101 bp, rice(Oryza sativa)
  misc_feature (71): n=t or c
aaggttgcaaccaataatttctgtgaggaaagcaaacttggagaagggggttttggagatgtatttaaggnattgcaatcttcaactgttgaatcatctgt

SEQ ID NO: 20610 - DNA, 101 bp, rice(Oryza sativa)
  misc_feature (71): n=t or g
attagcaatgcttaatttccactgtttttgttttgctgttatgtcttcctgtttttttttttctgtgcctnccctgaccaaatttattaagattgagagaa

SEQ ID NO: 20611 - DNA, 101 bp, rice(Oryza sativa)
  misc_feature (71): n=t or c
gtatttaccaaatacctcaaactcccaaccacacttctgtatagggtagcatccacaacttcacctgagcnattcttactcaacttgagtggagactccat

SEQ ID NO: 20612 - DNA, 101 bp, rice(Oryza sativa)
  misc_feature (71): n=t or g
tctctgtcggaaccttttcagggtcatgtctataatgccactttgctaagccacgggtttgcatttagctnagttgaggcaacatgagcttgggacccgca

SEQ ID NO: 20613 - DNA, 101 bp, rice(Oryza sativa)
  misc_feature (71): n=t or c
aaaaagacagtgagatttatcatcatctcaactaattgactgacacgtgtcgaaatggcaacaacacatantccctccgtccaaaaaaaaaaagtaaaccc

SEQ ID NO: 20614 - DNA, 101 bp, rice(Oryza sativa)
  misc_feature (71): n=a or g
ggtggtggcaagcagcagatggcgagagcgagatgggatcggagaattgatggcgcgcagtgtggtttgtnatgtaatggcggacagtggtaggttggagg

SEQ ID NO: 20615 - DNA, 101 bp, rice(Oryza sativa)
  misc_feature (71): n=a or g
cagtcgatggtgccatttgttacgctttgccaagttagacatcaatttactcttagccatttcttccggcnaggtcttgaacttaacaaattcgtcccatt

SEQ ID NO: 20616 - DNA, 101 bp, rice(Oryza sativa)
  misc_feature (71): n=a or g
gctgccgctgcgcagcatgatttggatgtgtatgtggttggagtcttttcccacacatttggccggataancccgacatgatttcctaaccgcgcgcgctt

SEQ ID NO: 20617 - DNA, 101 bp, rice(Oryza sativa)
  misc_feature (71): n=t or c
tccttccacaataagagataagtccaacttcaatgcgtttatccccagcaaaataccaccagactgaccangaggagggagacaatgccagataaaatctg

SEQ ID NO: 20618 - DNA, 101 bp, rice(Oryza sativa)
  misc_feature (71): n=t or c
ataaagatgccttgcatgcatacgtgttgtttggtcatgcggttaagccatgggactgatatgccgatgtnggatttatccctgcacggtgatacgtgtat

SEQ ID NO: 20619 - DNA, 101 bp, rice(Oryza sativa)
  misc_feature (71): n=a or g
gacaatgcttgaagatgctgccatttcgtttggacgtttgcccattccgtcttctcctcgcttctctcacnttccgttcgtgatgacaagcccatcacggc

SEQ ID NO: 20620 - DNA, 101 bp, rice(Oryza sativa)
  misc_feature (71): n=a or c
agttcaggccatggaatattgatgaggcacaccggcaattctataatggtgtctcgttgtttgggccttantgagagcacgtcctcagctactggaattgg

SEQ ID NO: 20621 - DNA, 101 bp, rice(Oryza sativa)
  misc_feature (71): n=t or c
tgctacgggatattttaagtgactactccctttcctttcctctaggtagattccacgtggtgaacgtgtgntccctcctggtacccagcacagcacaggct

SEQ ID NO: 20622 - DNA, 101 bp, rice(Oryza sativa)
  misc_feature (71): n=t or c
gcctttctacttactcaagccaaacccctagtgcaaaaaaccaaacaaaagaagccaccatcacctacaanagggtgttccggaaagcggaaatcagcctt

SEQ ID NO: 20623 - DNA, 101 bp, rice(Oryza sativa)
  misc_feature (71): n=a or g
taaaataaacttattccaaggaagaacacggtggactgatcgcgccttcaaggggtggcacggtacaatcngagtcttttttagcattgcctaggccatag

SEQ ID NO: 20624 - DNA, 101 bp, rice(Oryza sativa)
  misc_feature (71): n=t or c
cagggaaagttcacagcaacagtggctgttaggaacttgggaacctgacggccattgcacaggcatacacnacaaaatgatgtctgaaatttgtgaatgat

SEQ ID NO: 20625 - DNA, 101 bp, rice(Oryza sativa)
  misc_feature (71): n=a or g
tagatagttggaggggcttgattcgatattaaggtcgcgtaaatgcgacgcgatgacgccgtctatataancgcagtgggccaacctcgaaacgcacaccc

SEQ ID NO: 20626 - DNA, 101 bp, rice(Oryza sativa)
  misc_feature (71): n=a or c
gggagaagcccagtggcatgccacgccatgagacaagagaggtaggagcagcaagaagcagcaacctactngagcaatatctcctgcctcctttcaccaca

SEQ ID NO: 20627 - DNA, 101 bp, rice(Oryza sativa)
  misc_feature (71): n=t or c
gagaggagaggagaaggatgcaagccaagacgaaagaaccgcccggtcagccagcttaaaacggtttgccnaaagcttggcgtcgttggcgcagcagcgga

SEQ ID NO: 20628 - DNA, 101 bp, rice(Oryza sativa)
  misc_feature (71): n=t or c
aaccaaaatattttgcagattttgtgttgtgtacgtactcgtgttacgtgacagagatgagagatggcggnaactgctggttggttggtttggagttggcc

SEQ ID NO: 20629 - DNA, 101 bp, rice(Oryza sativa)
  misc_feature (71): n=a or g
ccactggggcagaatgttggaggagaggagagatgcttcttgttggcttcgcagccaagaaagaagggagntggattctagtagctcgagtggatgtccac

SEQ ID NO: 20630 - DNA, 101 bp, rice(Oryza sativa)
  misc_feature (71): n=a or c
atcttatcaaagttatcatatacctcagctatgtctgaaccatgatcctctctgtatctctgaaacgttgncctgagctgggacttgctccgagtggtcac

SEQ ID NO: 20631 - DNA, 101 bp, rice(Oryza sativa)
  misc_feature (71): n=a or g
ctctccgagctgaccctgatatgtttctcagcccctgatgaaagcaaaattgtcgggcatggactattcgnggatggcgctggtgcaatcatcgttggcgc

SEQ ID NO: 20632 - DNA, 101 bp, rice(Oryza sativa)
  misc_feature (71): n=a or g
cagagacggcgccccctgcactgcgtaaaaaacatgggtctgattcatatgggcttgatgggtcagatggntgacgttctcttttgaatcgattttgctat

SEQ ID NO: 20633 - DNA, 101 bp, rice(Oryza sativa)
  misc_feature (71): n=t or c
ttggcaccttgaatccatgcgccatgtcactgcaccgtgaaatgcctaatatacctccactccgtaacgcnaaaaatatttttggtaaatggtttataggg

SEQ ID NO: 20634 - DNA, 101 bp, rice(Oryza sativa)
  misc_feature (71): n=a or g
aaaaagcccagccgatataggtgaactgcatcatcgattcagattgaagaagatatatgatagataggtgngcaaatatatcaaccgaaccagagcgatcc

SEQ ID NO: 20635 - DNA, 101 bp, rice(Oryza sativa)
  misc_feature (71): n=a or g
tggtggattttacttctagctatatatggatatcagcaatgccatgcatcacccatgcaacggacgtaaantttaagtgatatctgtgtgcataagtaaat

SEQ ID NO: 20636 - DNA, 101 bp, rice(Oryza sativa)
  misc_feature (71): n=a or g
tacgtttttaaatattcagatattcttttaggatgtagtcgtacttcagttaaggcggattccttcagttncattacagtgtttcctgtatatctttcatt

SEQ ID NO: 20637 - DNA, 101 bp, rice(Oryza sativa)
  misc_feature (71): n=a or g
atttggataacaacaggattcatggaatcttacctagttccattggcaatctcccaggaagcttgcaaacnttatatatgaccaacaacagaattgcaggg

SEQ ID NO: 20638 - DNA, 101 bp, rice(Oryza sativa)
  misc_feature (71): n=a or g
gaagaataatgggcagctctccctatagatgagaagccttgttctaacggtatgtgctcccttcttttccnatgcataactttcgaagattcctcgttctg

SEQ ID NO: 20639 - DNA, 101 bp, rice(Oryza sativa)
  misc_feature (71): n=t or c
cgagcagtcgtcatatgtctcgtcctcgagcaccggtgtggctgcaggcatgacgaggaagggcaagatcnggccgccgctgcagtcgtcctcgtggttag

SEQ ID NO: 20640 - DNA, 101 bp, rice(Oryza sativa)
  misc_feature (71): n=t or c
cgggatgaatttatcaggacgtgacatgtttggacctgacgtgctgaaggaagctgaacagcaagtcaagntgatttgagaccgtctgaagacagctcaga

SEQ ID NO: 20641 - DNA, 101 bp, rice(Oryza sativa)
  misc_feature (71): n=t or g
ttctggtattaatccttggtttccacctttggaaaactaacatatgttgctccagcacgccatggttgttncctccagtgagctttctcctgcccatcaat

SEQ ID NO: 20642 - DNA, 101 bp, rice(Oryza sativa)
  misc_feature (71): n=a or g
ggaaaagttgaaggttgtttggcagtatttcgttggtgaatcaaagtgtacgtcctaccaatcatcacgancaaggcttagctgcagaacgaacccgcaaa

SEQ ID NO: 20643 - DNA, 101 bp, rice(Oryza sativa)
  misc_feature (71): n=t or c
aaaaaaataccaaccgtacccctcctcttttttctcatttcgcctgctcctctctccgccttgtctcctcngctggctcctctctctgtctcatctcctct

SEQ ID NO: 20644 - DNA, 101 bp, rice(Oryza sativa)
  misc_feature (71): n=t or c
gctggtcaatcaccccctccacccacgtggccctctacaatcaccacactcactttattgctccatgcgcnggcctccgcctccacctctgctccacacca

SEQ ID NO: 20645 - DNA, 101 bp, rice(Oryza sativa)
  misc_feature (71): n=a or g
tccgtctctgttactcagcatgcattgagtcacatcatccataataaaaggaaatgcctctatggtcacantaaactctaaaacatttgatttttctgtat

SEQ ID NO: 20646 - DNA, 101 bp, rice(Oryza sativa)
  misc_feature (71): n=t or c
ggctcaaaaatatctctgtcttcgccactggggtaaggatatgctttgcaattgcttggggtaataagtgntgttcactattttattgattatccatgtaa

SEQ ID NO: 20647 - DNA, 101 bp, rice(Oryza sativa)
  misc_feature (71): n=t or c
acttctttttccccaaatatgttaaatttatgcacttcgctggaaggaagctcaaaatatgtcaacgttancaatcatgcggtactttaaatggaaccttt

SEQ ID NO: 20648 - DNA, 101 bp, rice(Oryza sativa)
  misc_feature (71): n=t or c
cggaagaagcctgaaaagaggatccaccaacagttgacgcaggtggcagagttgctagttcttgcccttcntcagaaatagctgtgcaataaatcaaggag

SEQ ID NO: 20649 - DNA, 101 bp, rice(Oryza sativa)
  misc_feature (71): n=a or c
acagcccctgttgataaggcccagaagacagtccctattgcaagcactgttgggcgatcatagtgaagggngaggatacctgccaagggagatgctatcga

SEQ ID NO: 20650 - DNA, 101 bp, rice(Oryza sativa)
  misc_feature (71): n=t or c
ctcaagaacctcctcctgaagttctggaggttgatgttgcttgatctctgttacaggtggaaagaacagcntcttgtatgactccaacgctttcttcgagc

SEQ ID NO: 20651 - DNA, 101 bp, rice(Oryza sativa)
  misc_feature (71): n=a or g
ctaattggggtttccaattgttttcctttcatccctcctgctcgctcctttctttcagttttctcaatctntctgcgaagtaaagcaagcataagacaagg

SEQ ID NO: 20652 - DNA, 101 bp, rice(Oryza sativa)
  misc_feature (71): n=a or c
ttgagtgtattgggtatcccgggacaagaaagttgtgcaattttgcaaggttactaatgtctccaggcaantgaaaacaattatcccatttttccagatcc

SEQ ID NO: 20653 - DNA, 101 bp, rice(Oryza sativa)
  misc_feature (71): n=t or g
attagcgcgcaagcggcgggactggaggcggcggctgcatcggtcggcaggtttgctcttgttaattgttngacattgatggctataagggctgttgggct

SEQ ID NO: 20654 - DNA, 101 bp, rice(Oryza sativa)
  misc_feature (71): n=t or c
cctggttgttaagccagctactattcgtgttgttctcagtattgcagcttctcggtcgtggcctattcatnaacttgatgttaagaacgcttttctacatg

SEQ ID NO: 20655 - DNA, 101 bp, rice(Oryza sativa)
  misc_feature (71): n=a or c
atcaaacctctgactaagtttttctttctaagaccctgtgaccaattcacggaaccaagcccataccatangtacagttgcaagctctgattaattattat

SEQ ID NO: 20656 - DNA, 101 bp, rice(Oryza sativa)
  misc_feature (71): n=a or g
aaacagcatcaggacaacaacctgcctggaattcctcagccagtaaccaccatacaaaatctggagcaaancttcggctgtgtttagatccaaacttcagt

SEQ ID NO: 20657 - DNA, 101 bp, rice(Oryza sativa)
  misc_feature (71): n=t or g
tgaaaactttgaactgattagttgagcaaaagaaaattactacatgtgaacgggtcttgcagggcgagagnaggaggaggaaggtgcatgctccatggtga

SEQ ID NO: 20658 - DNA, 101 bp, rice(Oryza sativa)
  misc_feature (71): n=a or c
ggagatggatagctgaagggttcattagtaaagtgaagggactaacattggatcaagttgctgagaactanttcaatgatctcgtaaacagaagcatgatc

SEQ ID NO: 20659 - DNA, 101 bp, rice(Oryza sativa)
  misc_feature (71): n=a or g
tcctcgtgtatccatatactccgtacacgatgcattggatgggatcagcattcagcataattttgttacgntgggtcccgtcccattgaccttgcgaccga

SEQ ID NO: 20660 - DNA, 101 bp, rice(Oryza sativa)
  misc_feature (71): n=a or g
ctgtccgaactaagagggataagatttgagaaggacgccttgccccacatggaaagaatggaaatcgaatnttgccagttgagatcagggattgttggcat

SEQ ID NO: 20661 - DNA, 101 bp, rice(Oryza sativa)
  misc_feature (71): n=a or c
ctccaacgtctaggaagagggttgcaggtacccaaatcaacaaggataatcctgagcctgatgatgactcnactgagcaagagatggggacatttaagaga

SEQ ID NO: 20662 - DNA, 101 bp, rice(Oryza sativa)
  misc_feature (71): n=a or g
tcgacttctctcttttttcggtcttagtgattttggattcgtcctgtaagagagccgtctgtggtcggcancgggcgccgccacgtttggggatctgttgg

SEQ ID NO: 20663 - DNA, 101 bp, rice(Oryza sativa)
  misc_feature (71): n=a or g
gttcgaaaattgttgagcctcaacaacgctactaaatgtcatttcaatttgtggtacccaattaggtattntgtgttctctatagaaaatatagcattaaa

SEQ ID NO: 20664 - DNA, 101 bp, rice(Oryza sativa)
  misc_feature (71): n=a or g
atttgaatacatgggcaatgcatcttctaggttctaagatggagcattttgtatggtcaagtctatggctnaagcaacttggaaacctcatctcggtgaaa

SEQ ID NO: 20665 - DNA, 101 bp, rice(Oryza sativa)
  misc_feature (71): n=a or g
aagttcaatagtgggagacttgtcaccactacggagaagattgctcgaatcaattgctcgaactagattancttcgacatttttctcaaccaccgttgcag

SEQ ID NO: 20666 - DNA, 101 bp, rice(Oryza sativa)
  misc_feature (71): n=a or g
tcgattgatcatgtttgtgtgcttgtgagaaatccagggcaaaagtgaaggagacgaggagccttgggacnacaggcttgttcttggtgtttgtgacggct

SEQ ID NO: 20667 - DNA, 101 bp, rice(Oryza sativa)
  misc_feature (71): n=t or c
acttttcactcgacagtcaactggaacagagcaccttggccactttatacaaggtatgataaaaaaatagntatgtacttctttcgtttcatattataata

SEQ ID NO: 20668 - DNA, 101 bp, rice(Oryza sativa)
  misc_feature (71): n=t or c
ctcagcgcgcttcagccatccttcaacttcattcctccgctgcataccttttcgcatagggctgtccaacntggtctcaactagggatgaaaacggtcggg

SEQ ID NO: 20669 - DNA, 101 bp, rice(Oryza sativa)
  misc_feature (71): n=a or g
atggacagtgatggtggacaacgaacgaagcagttgatagtatgtggtggttgtgatccgtagaggtgaanatggtacgacgacgagcggcacggactagt

SEQ ID NO: 20670 - DNA, 101 bp, rice(Oryza sativa)
  misc_feature (71): n=t or c
gggctgggctccatgccgatctccgtaatattccttactttcgaggtgctcctcgcaaaactcgtccactngctttctctctctcgcgttgcttcctaccg

SEQ ID NO: 20671 - DNA, 101 bp, rice(Oryza sativa)
  misc_feature (71): n=t or c
atattattactaataaatatgttttttataccatcaagataaccctccttccgattggttcattttaacgnaatttgttacacctgcctatgaattaatac

SEQ ID NO: 20672 - DNA, 101 bp, rice(Oryza sativa)
  misc_feature (71): n=t or c
gccgccacggaaggagtgcctctgcttcgtcggcggcgggatgggagaccagcagtgaagagtgtgaccgncgcgcgcctcctcccaatccctctactcca

SEQ ID NO: 20673 - DNA, 101 bp, rice(Oryza sativa)
  misc_feature (71): n=a or g
gaaggtgggtgctgctgaagagaggacacaactgtcgagaaggaagaggagatactggcaaaagtcaaagnagatcaattgcatccacagaggcatatctc

SEQ ID NO: 20674 - DNA, 101 bp, rice(Oryza sativa)
  misc_feature (71): n=a or g
aaagctcgttatcggtttttcatagcttgcgtgtaaatcatctctttttgaatgctttatctatgagtttnggtgtatccatttttcttagattattgtgt

SEQ ID NO: 20675 - DNA, 101 bp, rice(Oryza sativa)
  misc_feature (71): n=t or c
ggaggtgatctgattctcgaagcttagggggtttagtagataaactgggtacttcagggtagttaaaatgnattttttttcctagtctattatttttgtct

SEQ ID NO: 20676 - DNA, 101 bp, rice(Oryza sativa)
  misc_feature (71): n=a or g
cctcgctttggctgggctttcttaattgttgtttggtttgggctgatacacgttggttacttactggcccngaaaaaaaaatgtatgcaattatttcgttt

SEQ ID NO: 20677 - DNA, 101 bp, rice(Oryza sativa)
  misc_feature (71): n=a or c
agagatcgttaaacccttcgctgagaaagttttctcggggatcaaggtagtatggcagatactcgatcatntgccgaggatgaaaccaagcgccctacgga

SEQ ID NO: 20678 - DNA, 101 bp, rice(Oryza sativa)
  misc_feature (71): n=t or c
gattaagtgaaaattgtgtgagggaagtagtagttaaaaacgcttgtatttacaaacaaatgttaagcgcnagaagtgtactccctccggttacataattt

SEQ ID NO: 20679 - DNA, 101 bp, rice(Oryza sativa)
  misc_feature (71): n=a or g
tctctcttctccctcccctcacctccatcagagaatgacggtgagcgaatgcagttgggtctaggcaacgnagggggagccgaggatggcggcaggcaagg

SEQ ID NO: 20680 - DNA, 101 bp, rice(Oryza sativa)
  misc_feature (71): n=t or g
tggaaacgcttcgacaagtgtatagagtagtacatttgtgtggcagttgtaaaatctctggggagaacctncgaatagaacaagtatcctaaccaagttcc

SEQ ID NO: 20681 - DNA, 101 bp, rice(Oryza sativa)
  misc_feature (71): n=t or c
tcagaacagggcatggccttcagtttccggttgaccaggcaaggcacaaattcatgttccctttccattgnctcttcagttgagtagctgattgtaatttg

SEQ ID NO: 20682 - DNA, 101 bp, rice(Oryza sativa)
  misc_feature (71): n=a or g
cctccttttcctccgttacctcctccatgtccaactcttcttcatcgtcctcccaaaattcatcatcctcntcatcaaattgatcattttcatctaccccc

SEQ ID NO: 20683 - DNA, 101 bp, rice(Oryza sativa)
  misc_feature (71): n=a or g
acaaagcttcacccatatatatccatcacaattcacaagtccttactcctaagtatatagctcaacaagtntggtttaagatatacgtagctaaaagttgt

SEQ ID NO: 20684 - DNA, 101 bp, rice(Oryza sativa)
  misc_feature (71): n=a or g
aagaacctcaaatgccacaatgactgcaaatattcgtaggaaattagaactcagatgctagcacatgaccnaaaaaagctacatgcaaatttttactacct

SEQ ID NO: 20685 - DNA, 101 bp, rice(Oryza sativa)
  misc_feature (71): n=a or g
tctcactcagagcgcatcagtaaatttcggaaatcgcaacacagattcgtacggagtacttaataaaacgnaaaaaaaaagaagaaaaaaactaattgcag

SEQ ID NO: 20686 - DNA, 101 bp, rice(Oryza sativa)
  misc_feature (71): n=t or c
tccgttgtgttgttgctgctgcacgcgccttaataatatcagtaaattttgatacttcatttgtatatganggcatatatcttggcgtatgatacatccat

SEQ ID NO: 20687 - DNA, 101 bp, rice(Oryza sativa)
  misc_feature (71): n=t or g
agagctagaaatacctttgagtgaaccttttcggtcataaccagaacctatagagatgacatatgatgagntcgatagaatagagaagtgtgagattccca

SEQ ID NO: 20688 - DNA, 101 bp, rice(Oryza sativa)
  misc_feature (71): n=a or g
tctattatgtttccgtattgtttttgttcttgcattttcttcaagataacaccagttgccatagcaaactntcctgtgcccccaacaatagcccaatcacc

SEQ ID NO: 20689 - DNA, 101 bp, rice(Oryza sativa)
  misc_feature (71): n=a or g
acatcctccgggcggcagccatcaaggcgctgggctccttccggagcaaccccagcaactgagcttagatngccatggctgctctgctgctgctggcctgg

SEQ ID NO: 20690 - DNA, 101 bp, rice(Oryza sativa)
  misc_feature (71): n=t or c
ggatcagcgacttgcggctgcaactggcaattgcgcacgaaatcatcctccagcttgatagggcgcttgangaccgcacgctgtcggtaggagaacgcgcc

SEQ ID NO: 20691 - DNA, 101 bp, rice(Oryza sativa)
  misc_feature (71): n=t or c
gcattacctgtaaaggacaccaccaccctaatcaagaccatcatgatggtgtcgacaacatggtccctacngtaggcaatcaccggacatgatactgccgt

SEQ ID NO: 20692 - DNA, 101 bp, rice(Oryza sativa)
  misc_feature (71): n=t or c
tttttttttttttttttttttttgcagttggatggcttaagtgcccatatgtgaatgccctacccgtatanaaaattctgatactttcacagacacctggg

SEQ ID NO: 20693 - DNA, 101 bp, rice(Oryza sativa)
  misc_feature (71): n=t or g
tgaaactatgatataagtaaaaatggcaaataaatccctgctttataccttgctgcttatgtcttcagatnctcttgtttgcctaaaaagtttacctagat

SEQ ID NO: 20694 - DNA, 101 bp, rice(Oryza sativa)
  misc_feature (71): n=a or g
gggtgaggtatggaataaaattattgtaactgatggcaatgaaatggttaattataggaggacgaggtatngaataaaattattgaaaccgatggtagtgg

SEQ ID NO: 20695 - DNA, 101 bp, rice(Oryza sativa)
  misc_feature (71): n=t or g
cctgcagaggcaactttagaccagtggttagtggtggcgacagtggtagaattctgccgaggctgttgaanctgacgtcaaggatgatgatgctgcctgat

SEQ ID NO: 20696 - DNA, 101 bp, rice(Oryza sativa)
  misc_feature (71): n=t or c
ctagtcccataggcttgccggagatgggggaaaggaatcttcggagctggagtagaaagagttgggattgncggagcacaaattgcgatgtaaatctttag

SEQ ID NO: 20697 - DNA, 101 bp, rice(Oryza sativa)
  misc_feature (71): n=a or g
ttcaagcgagacatcactagcgaccacttaggacttctcacctcgtggaggcaagatgaccatgactgctnccggtggagaggcataacctgtagcaacct

SEQ ID NO: 20698 - DNA, 101 bp, rice(Oryza sativa)
  misc_feature (71): n=t or g
gcaatgacaccagcaacaagctccccctaccaggtcaacggcagcaacaagcccaacggggagcagctcancagctggtttcaagccaatgtcgttccctc

SEQ ID NO: 20699 - DNA, 101 bp, rice(Oryza sativa)
  misc_feature (71): n=t or c
ctcatttttacctacgtataaggatttcagaaaaaatttatgcctgggtagagtgaattggcgggcacctntcatttttctgcttagaccaatttcgtgtt

SEQ ID NO: 20700 - DNA, 101 bp, rice(Oryza sativa)
  misc_feature (71): n=a or g
aaccctaacaacacacacataaacattacattattcaccgttcggcatgggcaagaatgcccttagccctngccaaaccccagtcatacaattcttctcta

SEQ ID NO: 20701 - DNA, 101 bp, rice(Oryza sativa)
  misc_feature (71): n=t or c
acgtcgaggagcttcatcgccttccacgccaaggtcgtcgggtgcaatatgcggccgaaggagatatcaanggcgtcatcgaacgccgcgaagaacgcgtc

SEQ ID NO: 20702 - DNA, 101 bp, rice(Oryza sativa)
  misc_feature (71): n=t or c
tgaagatagggttccaactgatgttgaggatgatccattggctgctgccagacaagctgacccagatgtangaaccctttgtacttcgcacaacagaaaca

SEQ ID NO: 20703 - DNA, 101 bp, rice(Oryza sativa)
  misc_feature (71): n=t or c
ccagtttttttatggactatcccaatatagatcctatgggaatattctctgttagggaccatctatctcgnctgtgctcaaaccaaacacaccgaaaaata

SEQ ID NO: 20704 - DNA, 101 bp, rice(Oryza sativa)
  misc_feature (71): n=a or g
ttaagaaacccttcgagtcgtgcaattcgtattacctcgggatctgtctgagacagttgggctctcgccantgtgctcgtacatggtgcatggtgggcctg

SEQ ID NO: 20705 - DNA, 101 bp, rice(Oryza sativa)
  misc_feature (71): n=a or c
ttataaggagtatagaaaagatatattgcgctaaagcatccacatgtcagtcacgctcatcaccaactttntactatattgcgggaagaaaaaaaaaggca

SEQ ID NO: 20706 - DNA, 101 bp, rice(Oryza sativa)
  misc_feature (71): n=a or g
acacccctccccccctcctcctggacttcattgctccctttgctcagacctcccactcactcgaggatggnggacgactaggcttgccactgccgcttgtc

SEQ ID NO: 20707 - DNA, 101 bp, rice(Oryza sativa)
  misc_feature (71): n=a or c
agaatcagagactgatgatttaggaagagaatgtaactccgtttctttcttggtagggcctttaccactgncagttgaatctcctaaaatgttaacaggta

SEQ ID NO: 20708 - DNA, 101 bp, rice(Oryza sativa)
  misc_feature (71): n=t or g
ggttcaatttgttttgtatctcttagccacaacatcaaatattttgaccctcaacaattagtattaaactnatgcaatttgacttccacttgttagcctgg

SEQ ID NO: 20709 - DNA, 101 bp, rice(Oryza sativa)
  misc_feature (71): n=t or g
catttgggcagttcgggctgcacgtaagcaatttggccttcatgagctgcctgcagcctgcaggctgctgngtagctgaagttggtacgagtatttttttt

SEQ ID NO: 20710 - DNA, 101 bp, rice(Oryza sativa)
  misc_feature (71): n=a or g
cgtttctggcacagagcggcataaaaggcataggagttggtttggccactgtctcgcttggagtctatctncagtccacaccctgttttggataatcaacc

SEQ ID NO: 20711 - DNA, 101 bp, rice(Oryza sativa)
  misc_feature (71): n=t or g
ttcatgatgctctttttgtacaccagaaattgacaggtggtgtaatgctttcgaggaacaatgactttatngtcttctacagaggaaaggatttcttgtcc

SEQ ID NO: 20712 - DNA, 101 bp, rice(Oryza sativa)
  misc_feature (71): n=t or g
acagggagcatcacctatcatagctacttttgctaactagagacatttctacctggattcatctctggttntccatttcattctttttcatctcataaaac

SEQ ID NO: 20713 - DNA, 101 bp, rice(Oryza sativa)
  misc_feature (71): n=t or c
tctaacgccattgatacgcagaatctgtgtcacttacgcaagagaacagcatgattaaactctaaatatgnaaagttgtaccatagtagatgtatgtgaaa

SEQ ID NO: 20714 - DNA, 101 bp, rice(Oryza sativa)
  misc_feature (71): n=a or g
acgatgctcagaaagctgccgacaaaatagcggttgatgtggtagagcgattccaagataccgatctctgnccgactggtcctgacagttctgatgatgaa

SEQ ID NO: 20715 - DNA, 101 bp, rice(Oryza sativa)
  misc_feature (71): n=t or g
tattccatccccaccgctccctccttcacctctggcaaaggcagctcccccttgcatctccatcaatgccnctcccctccatttccagtgaagctgctccc

SEQ ID NO: 20716 - DNA, 101 bp, rice(Oryza sativa)
  misc_feature (71): n=a or g
tttgggccctccgttattttttttttctttcttatttttattgtaacacgtgagtgccacgtcagattaanattgggttaacatgtaacatggacaccaca

SEQ ID NO: 20717 - DNA, 101 bp, rice(Oryza sativa)
  misc_feature (71): n=a or g
cactgtccgctactcctttccaatacttcagggccacggaaaccacgtcccttcaagttcgagaatttttngacaaggataccaggattcaaggacgttgt

SEQ ID NO: 20718 - DNA, 101 bp, rice(Oryza sativa)
  misc_feature (71): n=t or c
gaccgcaaactatatggtatttatgaagctgcgagcaatggcaagttctgtcctgaatcaaatgcatggtnacaagatggcaagggaaagaccagctatcc

SEQ ID NO: 20719 - DNA, 101 bp, rice(Oryza sativa)
  misc_feature (71): n=a or c
tgtcccttctgttaaaaatatttttcaccaatttcacacatgttggtaaaaatattaatattctcactttntaaaaatcctaatgtaattattcatctctt

SEQ ID NO: 20720 - DNA, 101 bp, rice(Oryza sativa)
  misc_feature (71): n=t or g
ctcaagcaaagaactaggaagaggcggtcatggcactgtatacaaggggatcctcaaagacaacagaatantagccataaagcgctcaaagattatgaata

SEQ ID NO: 20721 - DNA, 101 bp, rice(Oryza sativa)
  misc_feature (71): n=a or g
caggaggctctactatcagctgggaaactttcaagaacccaacagacaccatcctggtcacacaagcgctntcccctggaatgaagctccgcagccgactc

SEQ ID NO: 20722 - DNA, 101 bp, rice(Oryza sativa)
  misc_feature (71): n=t or c
gcatcattcggggttgcagcattaattttgctgatcccattccccacgaccactagatatggaggtgtaangcagctttgcgcaggggatgtcatcgggca

SEQ ID NO: 20723 - DNA, 101 bp, rice(Oryza sativa)
  misc_feature (71): n=t or c
ggtgattacccaaccagatttttcccttatgccttatgatgccctgttgcagctgaaaatcccccattccngactgactcaaactaagttcagcgagcaaa

SEQ ID NO: 20724 - DNA, 101 bp, rice(Oryza sativa)
  misc_feature (71): n=a or c
atctttaaatatgttcatagatccaaatccaaatcaattgatgcttcggatggtaaggtcgtcggtgcttntgcattctctactactggtgcctcctccca

SEQ ID NO: 20725 - DNA, 101 bp, rice(Oryza sativa)
  misc_feature (71): n=t or c
tgcgcacaccttctgcacatccatggccaccctgtttgcgaacaccacatggccgaggtagttgatctgcngttcgccgaagtggcacttggagcgcttca

SEQ ID NO: 20726 - DNA, 101 bp, rice(Oryza sativa)
  misc_feature (71): n=a or g
ttaaactagattctaggctatgttcagagatattggtagaaacttgtatccttgaaacgtaaaacgatggnatagattagtgtataattaattttgtatta

SEQ ID NO: 20727 - DNA, 101 bp, rice(Oryza sativa)
  misc_feature (71): n=a or g
tctggtcgagcacctggcggcccatgaacagtagccgactgggagaatcacaaaaaagaagaaaagggaanaaaagggaaaaaaaagggaaagatggaggg

SEQ ID NO: 20728 - DNA, 101 bp, rice(Oryza sativa)
  misc_feature (71): n=a or c
actgaagaaggttttgcgcagttagagtttttttatgcagaacaagccaacccagaaaacgttactttggntcagcaggagctgaccaaatcttttcaaaa

SEQ ID NO: 20729 - DNA, 101 bp, rice(Oryza sativa)
  misc_feature (71): n=t or c
ttttcttaaaataaaaatgagatcattcttgactgctcaattttaaatctcaaaccacaaaggctgtgttnttaggtgagtgttgagagccctcacatcca

SEQ ID NO: 20730 - DNA, 101 bp, rice(Oryza sativa)
  misc_feature (71): n=t or c
gaaacttcactttcttgccgaccatgttgaagagtgactagcatggcgggttgttggacctcgcaggcggngccctcggcgatgagaccaagcaggcggaa

SEQ ID NO: 20731 - DNA, 101 bp, rice(Oryza sativa)
  misc_feature (71): n=t or g
gattggtgtccgcaactcaatattctcaatatatgccgcagatcacacctagacaatggaggttagcatcngcaagccagatgacgggcaatcgcttcttg

SEQ ID NO: 20732 - DNA, 101 bp, rice(Oryza sativa)
  misc_feature (71): n=a or g
tattgattgcaatttggaatgcaagagccaacaggtgaattggcatactagcttagataggaaggagatancaaatactcacctgtttgttattctgtcta

SEQ ID NO: 20733 - DNA, 101 bp, rice(Oryza sativa)
  misc_feature (71): n=a or g
cagagagactctggctgctgccctgaatatggattctgaccaacagtgtgccccgcaatccgttgaaaccntgtcacatgttggatctgctagcgagaaca

SEQ ID NO: 20734 - DNA, 101 bp, rice(Oryza sativa)
  misc_feature (71): n=t or c
ggtaagtgaggattaatcaagcttaatctcaccactaatcaatcatcaccaccatctaatttaacgaccanggtccagtaggcccacccccacacgtgggc

SEQ ID NO: 20735 - DNA, 101 bp, rice(Oryza sativa)
  misc_feature (71): n=t or c
aataacggccttttactgttcctaatcaggactatttgtcgacatagaagagatcgagaaagagaagaganaaaacattattgctataggtaacggctcaa

SEQ ID NO: 20736 - DNA, 101 bp, rice(Oryza sativa)
  misc_feature (71): n=a or c
tccccaagctgcacgcccgccaactgctcgacagaatatcgccaaaggtaccgcacgccgccgccatcatngatccactggtccgaacgccgcaacatcgc

SEQ ID NO: 20737 - DNA, 101 bp, rice(Oryza sativa)
  misc_feature (71): n=a or g
ccgtgttgctaataccccatcttgttgagttcgaaacatagtatgatgcctctcctaaattcgtgtcgtcnggttcgtaataagatttatctgagcctata

SEQ ID NO: 20738 - DNA, 101 bp, rice(Oryza sativa)
  misc_feature (71): n=t or c
gcgacgaggtaaggatttagggttaggttttttggtttcttttatttctttttctttggatttctttcccngaaccgatctaatcgctagggtttggctct

SEQ ID NO: 20739 - DNA, 101 bp, rice(Oryza sativa)
  misc_feature (71): n=t or c
gatgcgatcgcggggaaggggaccgaaatgagagaggggaggtggtatttataggcaccgggcaagccttngaggagaaggaaggagcacgggcgcggtca

SEQ ID NO: 20740 - DNA, 101 bp, rice(Oryza sativa)
  misc_feature (71): n=a or g
tgtttcgtcggaggcgttgcgatgattggttacggttatcttcagtctccacgcagccattggtatggggnagatttgtttcacaagtcaaatcaggatga

SEQ ID NO: 20741 - DNA, 101 bp, rice(Oryza sativa)
  misc_feature (71): n=a or g
tgccctctgtcgtactcctacccaaaaccataaccttcatccatagattctctactaaagacagggaattntcagcgacggcaaaggataggtgaggagct

SEQ ID NO: 20742 - DNA, 101 bp, rice(Oryza sativa)
  misc_feature (71): n=t or c
ttaagctcccttatactccctctgtccctacatatataagggattttaggtgatatgacgattcgtagtcntaggatacgtctcatccattcaaaatcttt

SEQ ID NO: 20743 - DNA, 101 bp, rice(Oryza sativa)
  misc_feature (71): n=t or c
agtgaaattgattatcttcttggagtggcctaagacattcatgttgcgcatattttaggtgcttctttttnggtgattgctctgcaaagaagaatccaaaa

SEQ ID NO: 20744 - DNA, 101 bp, rice(Oryza sativa)
  misc_feature (71): n=a or g
gtttgctcgagcacggctagctcgttgacagccctatacacgaaaatggcgacatgggctgcagggggttnacttcatgtcagtgccgtgacgttatttat

SEQ ID NO: 20745 - DNA, 101 bp, rice(Oryza sativa)
  misc_feature (71): n=a or c
gataattatataagtcagcatgaacagaatccttatgaaccacaatactcttgtctggagaggttaaagcntgttcatcagtagatatgctgactgccgaa

SEQ ID NO: 20746 - DNA, 101 bp, rice(Oryza sativa)
  misc_feature (71): n=a or g
tctacaccagttgacaccaatgcaaagttgtcctcctctgatggctcacctgttgtagatcccactgactntcacagtttagctggtgctctacattattt

SEQ ID NO: 20747 - DNA, 101 bp, rice(Oryza sativa)
  misc_feature (71): n=t or c
tgtaagacatgaaacacatagagagacaatatgtggacaagccaatagcggcctgatggcctcatcttttngtttatacttatgcttatcagctaaatttt

SEQ ID NO: 20748 - DNA, 101 bp, rice(Oryza sativa)
  misc_feature (71): n=t or g
acaggacggcatcatggctcatggatcatcatcaaccaggaaaggggacaagatcaaggcctagggactangagaggcgatacctatactgctcgaggaag

SEQ ID NO: 20749 - DNA, 101 bp, rice(Oryza sativa)
  misc_feature (71): n=a or g
catctaccgtcgatgatccggctaacctgaagtggatttagctggtcttttttcgggtgattgtttcaatnttttcattctatgtatatggttgtttcatt

SEQ ID NO: 20750 - DNA, 101 bp, rice(Oryza sativa)
  misc_feature (71): n=t or c
tatcgtcgtgccaatggtttatgtttcaaatgtggtgagaagtatagtcctactcatgtgtgtggcaaagntgaaggggttcagttgaaggccatggaatt

SEQ ID NO: 20751 - DNA, 101 bp, rice(Oryza sativa)
  misc_feature (71): n=t or c
atcaacggaagaacgaggtgttgctccacttcttgcttcgtcatcggcttcttcactcgttgcatgtttgngccatcgattatcccgtgcggtccacagcc

SEQ ID NO: 20752 - DNA, 101 bp, rice(Oryza sativa)
  misc_feature (71): n=a or g
tatcttcattaagatgacaacagcttttgtcattttactagttagtggcttcgcaagtctcaaacaatttnagaaacccgagggcggcatccttggccttc

SEQ ID NO: 20753 - DNA, 101 bp, rice(Oryza sativa)
  misc_feature (71): n=a or g
aaatttcagtgtgccagtattcacaaggatagatatagaggatttttttttttacaaacggtgccagacantgtgttcctattaaatatacttcacgatat

SEQ ID NO: 20754 - DNA, 101 bp, rice(Oryza sativa)
  misc_feature (71): n=t or c
atgcatatcagggaagctggaaaggggtgctcaaatgagaaaccatttttgcttcttcagaagatgacgcnggtacaacttttgttattttgatgaaaatt

SEQ ID NO: 20755 - DNA, 101 bp, rice(Oryza sativa)
  misc_feature (71): n=t or c
accgagctccggcgccgccgatctcggatgccaaggcgggctacaggtaggtgattttctttttgttcccnaatcagttttttttcgatttaattatttcg

SEQ ID NO: 20756 - DNA, 101 bp, rice(Oryza sativa)
  misc_feature (71): n=t or c
agtacatgcacgctaaggacatcgatcgggtataaggcgcactagggatagctataaaatatctatcttanagtattatatactaaactttctacaaacac

SEQ ID NO: 20757 - DNA, 101 bp, rice(Oryza sativa)
  misc_feature (71): n=t or c
caataatagagccaaccgttggcttgttgtatcatcaataactaactagctaaaggcacatacgttgcagnggatattatataagatataaaagcaaaagc

SEQ ID NO: 20758 - DNA, 101 bp, rice(Oryza sativa)
  misc_feature (71): n=a or g
ctcgactaatctttactgtcgaaccaacttcagttgtcaccgaccaatcttctgatccttatgattgatantcaccacccgcgtagcatagcagccatcat

SEQ ID NO: 20759 - DNA, 101 bp, rice(Oryza sativa)
  misc_feature (71): n=a or g
tagttcaaaacatatatgtggtgtgaacctggaaactgtattagatctaaggccccttttcaatcgtaagnatgaaaaaaaaatgaggaatagaaaaaaca

SEQ ID NO: 20760 - DNA, 101 bp, rice(Oryza sativa)
  misc_feature (71): n=t or c
agactactcgatccattggattaacctgtagtactaactagacggtgtaaacaagcttagcatatgctcancgtaaaaaaattcaagcaattaatccaaca

SEQ ID NO: 20761 - DNA, 101 bp, rice(Oryza sativa)
  misc_feature (71): n=a or g
acagatactatactatatccagaagttgcctttacaggtgacacaaagtctgattttattcttgacccacnaaatgcagatgccctgagagcaaaagtcct

SEQ ID NO: 20762 - DNA, 101 bp, rice(Oryza sativa)
  misc_feature (71): n=t or c
aactgactgtcatctggccatttttcagaaccagatgctctttccacatcttcgacagctacatgattgcngcttcattaaggatgttactgtccctgatg

SEQ ID NO: 20763 - DNA, 101 bp, rice(Oryza sativa)
  misc_feature (71): n=t or c
aaatcccgagttgtccaagtatctagcagaagttagaaagttggagcgtaggtttgatgggctcgaagtgngccatgtctatcacaaagataacgccgatg

SEQ ID NO: 20764 - DNA, 101 bp, rice(Oryza sativa)
  misc_feature (71): n=a or g
cacggtagccaggattgcaagagattttctagccattccaacttctggtagaccatctcctcagctgatgnccgagatcacaagccattttcgccgctacg

SEQ ID NO: 20765 - DNA, 101 bp, rice(Oryza sativa)
  misc_feature (71): n=a or g
gtaggtgggtgtcgagcaccatgtaatcttagttcttggtgatttcctccattaaacttgacagcctctcngacactgagtctccatcttcacatttatga

SEQ ID NO: 20766 - DNA, 101 bp, rice(Oryza sativa)
  misc_feature (71): n=a or g
gaaccggtgggcatcggacgatcatcacgtgatctccgactcttcgatggacggccacagtttgctctctnactaacttggcgagggaattgggtcaaagc

SEQ ID NO: 20767 - DNA, 101 bp, rice(Oryza sativa)
  misc_feature (71): n=a or g
tttccgtcttttcaattccggtcaatatggtctataacaattgtcttggatgtctccattcgatttgcacnagaaacaagtggattttcttctctctcgcc

SEQ ID NO: 20768 - DNA, 101 bp, rice(Oryza sativa)
  misc_feature (71): n=a or c
tgttgtttagggtgccaataaaaaccgaagggtttagtttccaactagatccgtggatctagtgtctcatnatctcccaattttccctatattgtttcttt

SEQ ID NO: 20769 - DNA, 101 bp, rice(Oryza sativa)
  misc_feature (71): n=t or c
gacctataagtgggttcgtgggtcgaccacttgcatttctaatgttgtgcactagtgcttaccatcaccanggatctccgacgtctgtgttgagtaggagt

SEQ ID NO: 20770 - DNA, 101 bp, rice(Oryza sativa)
  misc_feature (71): n=a or g
tcagtctttatattctctatgacctgcaactgtgcttacatggaccaagaaagtttcatcaatctattcanagttattagaatatctgtaagaactctttg

SEQ ID NO: 20771 - DNA, 101 bp, rice(Oryza sativa)
  misc_feature (71): n=t or c
cgtgctacttgcgttcgaccaccccatccatgacgccaccgcggagaccatcaagacggctctcgctcaancactcgtccactactatcctatcgccggcc

SEQ ID NO: 20772 - DNA, 101 bp, rice(Oryza sativa)
  misc_feature (71): n=t or g
acgccaagatagttagcaaggagctactcaactaacagctggttagtccttttttcttgtgtccagctgangtaagcttgcacaaatacctataaatagac

SEQ ID NO: 20773 - DNA, 101 bp, rice(Oryza sativa)
  misc_feature (71): n=t or c
tcgccctctcctcctcctcggtacatacagacgcgtcgcctttaaaccttcttggcttctcctcgcgtcgngttattggttgccgatgggatcgatgccgt

SEQ ID NO: 20774 - DNA, 101 bp, rice(Oryza sativa)
  misc_feature (71): n=t or c
catgccccaagtttaaatgtagaatgtacgaggagcttctagccgttagagattaattagctaccaaaagntcccccaacaagcgctatatcatttaccct

SEQ ID NO: 20775 - DNA, 101 bp, rice(Oryza sativa)
  misc_feature (71): n=a or g
caacttcaggggacgagaagcaggtttcgtgaacaatggtaactaccgtgatggtgataacatgaggaacngattcagaaatcagaacgagtactcagggc

SEQ ID NO: 20776 - DNA, 101 bp, rice(Oryza sativa)
  misc_feature (71): n=t or c
tagatgcatgatgatatccccatttatcacatcattttatatcatgcatcaggttgttgtccccccccccnctctctctctcttgctctgaaatcaaggag

SEQ ID NO: 20777 - DNA, 101 bp, rice(Oryza sativa)
  misc_feature (71): n=t or c
tgcagtccagccagcttgaggtggtcgtcaaggacaaggacgtcctcaaggacgacttcgtcggccgcgtngtcttcgacatgaccgacatccccaaccgc

SEQ ID NO: 20778 - DNA, 101 bp, rice(Oryza sativa)
  misc_feature (71): n=t or c
gaagcggaagaagacgtacctaaatgtccttggtgtgtgctgctccaaggagggcgtcgaggtgctaatgnggctgccggcaccggcgatggagaggctgg

SEQ ID NO: 20779 - DNA, 101 bp, rice(Oryza sativa)
  misc_feature (71): n=a or g
gacaacttgggggtgtttagatccaccaccggcaaaaaatttttgccccgttatatcgaacgtaacacatntatggagcattaaatattaacgaaaaaata

SEQ ID NO: 20780 - DNA, 101 bp, rice(Oryza sativa)
  misc_feature (71): n=t or c
cactgttgttggtctttcttatacttgatgaactctactaggaggcttttattattcgcgtaaatggactncttccgggtgatgagttctaggagcacaag

SEQ ID NO: 20781 - DNA, 101 bp, rice(Oryza sativa)
  misc_feature (71): n=t or c
ctaccgaaaattcgtcaaattaatgcacacagattatttcgccatcgttttgggcatcccatggatcccangtttctccctcgcagaaacattctggcgca

SEQ ID NO: 20782 - DNA, 101 bp, rice(Oryza sativa)
  misc_feature (71): n=a or g
tcgattttcttctttgcactacctgaaattgagtaactgtaatgttattggtgtcattcctgcaggggggnctttaagggatctagaaattcgggtatgca

SEQ ID NO: 20783 - DNA, 101 bp, rice(Oryza sativa)
  misc_feature (71): n=a or g
tcaagtacagttacaaaattttcttcaattgatcgggagagaatgaagtcgagaactatatcatgaactcnacatcctctggcttcaccatcagattctat

SEQ ID NO: 20784 - DNA, 101 bp, rice(Oryza sativa)
  misc_feature (71): n=a or g
gttgtactgacaaaacagaatgaaaatgctcattaattgatctgtatgtgagttacctgctataatttttntcttcaagttcgatcctgcatataataagc

SEQ ID NO: 20785 - DNA, 101 bp, rice(Oryza sativa)
  misc_feature (71): n=a or c
gaggagtaattaattaattccctaattgagaattagcaggagaaacaaggtcactaactcgatccccagcntctcccagataattagctgctgatgattaa

SEQ ID NO: 20786 - DNA, 101 bp, rice(Oryza sativa)
  misc_feature (71): n=a or g
atagggtgtaaaattttagggtgggatccaaagagaccctatatacactaccaaagcttcgagtcatatcntattgtaagtcttcctaggcaagtccgttg

SEQ ID NO: 20787 - DNA, 101 bp, rice(Oryza sativa)
  misc_feature (71): n=a or c
agggaacaaaacaattgttgagtttgagtatatcccttgctgtcacctgcatagattaccaaaccttcctngttcctaccgagacttccgttctacttcat

SEQ ID NO: 20788 - DNA, 101 bp, rice(Oryza sativa)
  misc_feature (71): n=a or c
actctgttttacatgtgcccaggccgtggccgaagagaagtttaagctttgtgtcaacgcatacaattctntctgcaatgtcctcaaggctgcttagcttt

SEQ ID NO: 20789 - DNA, 101 bp, rice(Oryza sativa)
  misc_feature (71): n=t or g
tcagaaagaaccctctccagcctacctgcctgcatattctgttctcatgattgggggaaaataaaatccgncacccacaagaaaaaaaatatctaccatct

SEQ ID NO: 20790 - DNA, 101 bp, rice(Oryza sativa)
  misc_feature (71): n=a or g
tctcattatttgacctacaaaattttgcaggttcaaataattcaacaggaaacaaaagataaactatgttngaaattcacaaacaatggtatctgcagtac

SEQ ID NO: 20791 - DNA, 101 bp, rice(Oryza sativa)
  misc_feature (71): n=t or g
atgtggtcgggtgtgcgtgggaagggctcaaaatcaaagaaattcgccaggtaccgctcgtacgcctcttntttggctttcctcgcctcaatcttcttctc

SEQ ID NO: 20792 - DNA, 101 bp, rice(Oryza sativa)
  misc_feature (71): n=a or g
gtcgtccaaaaagctgttgcaaaggggcacatgaagaagagatgatttgacgtttcttcccctgtctggcngattgcacattgaggtgattggaggattat

SEQ ID NO: 20793 - DNA, 101 bp, rice(Oryza sativa)
  misc_feature (71): n=a or g
ctcagctatttgtaaattttcatcaagtatatcagcagatgttccatatgctaacattcgcaaagcagcantgcatttgagtaaaggagaaaatccaactt

SEQ ID NO: 20794 - DNA, 101 bp, rice(Oryza sativa)
  misc_feature (71): n=a or g
accgggccttcactccaccactgtatttgtgaatgtaggagtacgatgttacatgtgtagtgtgtaatttntactaaaagaatgtagtgataacaccgtat

SEQ ID NO: 20795 - DNA, 101 bp, rice(Oryza sativa)
  misc_feature (71): n=a or g
taacctgtggggcgaaatgattcttttggctgtaacccatttaggcaaaatggtcttttttggccacttgncgaaacaacaagcaaaggtggtgtatgtgg

SEQ ID NO: 20796 - DNA, 101 bp, rice(Oryza sativa)
  misc_feature (71): n=t or c
tgatggctcttgcttatcttggttcttactcctgtgttctctccttaaagatttgtcatcatttcgccaancaccgcgtgatctatcagatgtgccatcac

SEQ ID NO: 20797 - DNA, 101 bp, rice(Oryza sativa)
  misc_feature (71): n=a or c
taattgcatgtaatgcatgaactgtaattagtgtttgtttgaggagcgattctcgatcttctgctctctantgatagtatcatgacaaaatttggtacaag

SEQ ID NO: 20798 - DNA, 101 bp, rice(Oryza sativa)
  misc_feature (71): n=t or c
atgtcgccactggtagtagacgccagagtgacgattaccacttaccaaacgcaccaacggcgttatcatcncgtttctcatgttgtagatgccagagtcgc

SEQ ID NO: 20799 - DNA, 101 bp, rice(Oryza sativa)
  misc_feature (71): n=t or c
atgccactgaaatagtgaaatatatataatgctctactctacttgcaggatggcgtcagaacccaaaaagnaacctgagctcgttgatggtcctggaggag

SEQ ID NO: 20800 - DNA, 101 bp, rice(Oryza sativa)
  misc_feature (71): n=t or g
gcatttcctaataataactgtggtagtagaatattgtttacggcacaacatgagtggatagctgggtggtntttgtctaattataatggggttgtgcataa

SEQ ID NO: 20801 - DNA, 101 bp, rice(Oryza sativa)
  misc_feature (71): n=t or c
agctataggataccgcatgaactcactcttgagggaaaacaccctataaacgtgattatttgctaatgganacaacgcctattaaaatattaattttcagt

SEQ ID NO: 20802 - DNA, 101 bp, rice(Oryza sativa)
  misc_feature (71): n=t or c
ctgtggctttagcttgtggcttcaatccccagttatgctcgaatgcttggagtagctcttcaaatgtttancaatgtgtcttccacaagacacaggtgtgg

SEQ ID NO: 20803 - DNA, 101 bp, rice(Oryza sativa)
  misc_feature (71): n=t or c
gaacaagaagaggatgatatacagctgattgacggtgtattaggcatctttgatgatctaagcaagccatngtgtaaaccgttcagaagtcgcattgatgg

SEQ ID NO: 20804 - DNA, 101 bp, rice(Oryza sativa)
  misc_feature (71): n=t or g
taaaacgttatccagtcattgtcatctacatctgaaatgaactccacaattatcaatgtccttgcagatanatttccattttctgtaattcttgaaaggtt

SEQ ID NO: 20805 - DNA, 101 bp, rice(Oryza sativa)
  misc_feature (71): n=t or c
gagcgaagggagctggcaaccctgtcctcacctcctctgtcacaacgccctccactcatcttctttcgcgncgtcggatcccgcacccgcttgccggcttc

SEQ ID NO: 20806 - DNA, 101 bp, rice(Oryza sativa)
  misc_feature (71): n=a or g
tcctactatgttcgtggactggacctggccatctggccatgccttgaaaagacctgtctagccctttcacngtgcaagttcgtggcgcgttacctggtcta

SEQ ID NO: 20807 - DNA, 101 bp, rice(Oryza sativa)
  misc_feature (71): n=t or c
tccgctttcccagtagaggctccagtaggcaggttaggtcaggtcaggtacggacgcatcccctcgattcncctctcccctcactttctctctctctctct

SEQ ID NO: 20808 - DNA, 101 bp, rice(Oryza sativa)
  misc_feature (71): n=t or c
caccggcgaccagccgcgacaatggatccactggctgccatgggccgagtacacctacaacacggcgtacnaaacgtcactacgggataccccgttttgcg

SEQ ID NO: 20809 - DNA, 101 bp, rice(Oryza sativa)
  misc_feature (71): n=t or c
tccggtgtcgtggattgagcttgttacatgtgactagaatcttctttgcttccatcatgtaaatatattcntggtcataagaatataatgctaacagaatc

SEQ ID NO: 20810 - DNA, 101 bp, rice(Oryza sativa)
  misc_feature (71): n=a or g
tcacgaggaattcgtcacagaaggtcatatttcttgtagtggggagagacgatggtagctgtcgagccccntcaaacttaaggagcttggaggcaagagga

SEQ ID NO: 20811 - DNA, 101 bp, rice(Oryza sativa)
  misc_feature (71): n=a or g
agggagagtggagtactagatctttgtgtaacacatcaccccgagtagcacaatagtaggctgtaagtcanctgtaagcacatgtgaagtagagaagagaa

SEQ ID NO: 20812 - DNA, 101 bp, rice(Oryza sativa)
  misc_feature (71): n=a or g
gcatggttggaaaaaaaatgtgatgaggaaagtttgggagtaaaatgtgataaatttggtagtagtggctnccctacctgtcacacaggtaaagactaata

SEQ ID NO: 20813 - DNA, 101 bp, rice(Oryza sativa)
  misc_feature (71): n=t or c
tgctagctcactttgcacgggacgttctattggttccggcttcttctgtctcttcgtagcatgcatttagngtggttggaagaattattgaagaaaggagg

SEQ ID NO: 20814 - DNA, 101 bp, rice(Oryza sativa)
  misc_feature (71): n=t or c
gtgagggttcttcgcagcctgcgaaaaaaaggtcgtaccgagcaagcagtactgaaagctgtgaatcaggnctgtggacttgaattcagtaggatatccga

SEQ ID NO: 20815 - DNA, 101 bp, rice(Oryza sativa)
  misc_feature (71): n=a or g
ctgcaccggcggcgacgagccggagagagccagcgtctctcataaaaggagattaaaagttactacctccnttttaaattataagactttttaacattgct

SEQ ID NO: 20816 - DNA, 101 bp, rice(Oryza sativa)
  misc_feature (71): n=a or g
gcgaactctaccaaagaagaggagctgaacagcaccaaagaagagctgaaaaacaccaccacaaaagatgngatggacaccaccaacgaggaatcgtccga

SEQ ID NO: 20817 - DNA, 101 bp, rice(Oryza sativa)
  misc_feature (71): n=a or g
ccatgcctaccatagcaacctattggccagtcctcatactcataccccatcagctcatagaaaagtgctcnctcatctgttattttatagagaaaaaaagg

SEQ ID NO: 20818 - DNA, 101 bp, rice(Oryza sativa)
  misc_feature (71): n=a or g
aaaaggaaaaaagatgtttttcccgtacaagggcatgtgcactaggtgatgttttttctccccgaacattnttctgttgtagttatcctgatgtacctcca

SEQ ID NO: 20819 - DNA, 101 bp, rice(Oryza sativa)
  misc_feature (71): n=a or g
ataagattggtaggatgtattacatccatccttctgcaggcgaagcatattttatgaggatgttgatcatntacgtaaaaggcactagaagttatgaggat

SEQ ID NO: 20820 - DNA, 101 bp, rice(Oryza sativa)
  misc_feature (71): n=a or g
atgatagtaacacggaatatgagaagcgcgagaatcacaccgtgcaacaaatgcattgctttgatattggnggcttatgagaaggtgaacaggctagaagg

SEQ ID NO: 20821 - DNA, 101 bp, rice(Oryza sativa)
  misc_feature (71): n=a or g
tgaagatgaaggcctctccttcttgggctgattgctcttctcctctttctctctccctttcctctttctcnagaggaaaggagagaagagaagagagagaa

SEQ ID NO: 20822 - DNA, 101 bp, rice(Oryza sativa)
  misc_feature (71): n=a or g
gcggacgacggtgttaatcagctacgaggactacgacggcaagctcaagagccagttcgacgcgtcggccnccgtgaacaccatcgccaccggcgcggggc

SEQ ID NO: 20823 - DNA, 101 bp, rice(Oryza sativa)
  misc_feature (71): n=t or c
tttgttgcttactcttcttgttgatggcaatgttgcagatggctgcagatagtgtgaggaagaagaagacntgggctccatggaggagactgagctgaagc

SEQ ID NO: 20824 - DNA, 101 bp, rice(Oryza sativa)
  misc_feature (71): n=t or g
ctacataaaattcaactactccagaaaattgcagaaattgatgtgtacaatggggtatccaggtatattgntaaaatacaataatcctacatatctgaagt

SEQ ID NO: 20825 - DNA, 101 bp, rice(Oryza sativa)
  misc_feature (71): n=t or c
aggcaaagcgtgacgggatccactagcaggccccttttctgcccatctccaacgccctagcaaccaccatngcttttcctcgccactgccaagctgcgtca

SEQ ID NO: 20826 - DNA, 101 bp, rice(Oryza sativa)
  misc_feature (71): n=a or g
ccgatccagctaaaaagatcggaccagacgcaccgtataacacttgccccaaattacaaccaacatacatntcgtttctttttcaacaaccaatgcatttc

SEQ ID NO: 20827 - DNA, 101 bp, rice(Oryza sativa)
  misc_feature (71): n=t or c
taacatttggcaaggaagatgcacctgcccaaaggaatgagtcaagatgcaatggaatggaaagaataaanaagaagaagggaagtgtacgaaacaaagaa

SEQ ID NO: 20828 - DNA, 101 bp, rice(Oryza sativa)
  misc_feature (71): n=a or g
tcggtggtgacgacggatccgacgcgcagcacgacgacgtgaacgtccggccggtcgttgaggatgatgtncttcgccgcctccgccggcagccccacaac

SEQ ID NO: 20829 - DNA, 101 bp, rice(Oryza sativa)
  misc_feature (71): n=a or g
aattggaaagaggggaagttgaaggagaggagaatggcaaaatggagaaaacccacctctgatgtcctgancatcaactcggatggggccttccacagcag

SEQ ID NO: 20830 - DNA, 101 bp, rice(Oryza sativa)
  misc_feature (71): n=a or g
tccagggatcctagaggaagaagttaagggatggtcccacttggaaggagatcaagtaaagctcttatgtntaatcttatagctgaggtaattaaatcaaa

SEQ ID NO: 20831 - DNA, 101 bp, rice(Oryza sativa)
  misc_feature (71): n=a or g
actttactggacagtcttttcatgtcattgaaactaaacattgtacctcatgtttgacagcatgcctacanagacggacgcttggaagaggtcatactgcg

SEQ ID NO: 20832 - DNA, 101 bp, rice(Oryza sativa)
  misc_feature (71): n=t or c
ttttttgttcattctccataacaaatatacttgaattgtcccaaaagaaataggtttaactgcatcgcccntctctttctgaatgttcagaccaagttctt

SEQ ID NO: 20833 - DNA, 101 bp, rice(Oryza sativa)
  misc_feature (71): n=t or c
cataagcattgcatcatttttgagttcttagatgattacactgcgataagtatgcaacaaaaaagctaacnaattagaggggactagctttattgtgcaaa

SEQ ID NO: 20834 - DNA, 101 bp, rice(Oryza sativa)
  misc_feature (71): n=t or c
atcgaattgttgtgaatctagatggcctgtagcatcagcaatccaaccatcgtgtgccgggaacgaccgancgttttacatagacgaaaataagatttaat

SEQ ID NO: 20835 - DNA, 101 bp, rice(Oryza sativa)
  misc_feature (71): n=a or g
attttgggatggagggaatacatagagaaaaaggtccagcatctatgtattcgctagttagcgtgtgtgcncttgcttatcttacgagctacgttggagat

SEQ ID NO: 20836 - DNA, 101 bp, rice(Oryza sativa)
  misc_feature (71): n=t or c
ttatggaggggcgtcgaaaaggttaagggttgtttcaatttttgggatttgctatttgtattatttcttcnaaccctttgtttcttatccttttagagttt

SEQ ID NO: 20837 - DNA, 101 bp, rice(Oryza sativa)
  misc_feature (71): n=t or c
taccggtagttactgactacgccatttgataattatgggtttccaaagatttattagaacagacacccaanatttagatacgtctttcttagacaatcacc

SEQ ID NO: 20838 - DNA, 101 bp, rice(Oryza sativa)
  misc_feature (71): n=t or g
ccaaattctggtgattggcaagtctactatgggtttaatggtgaagccagacttacaggttactatccaanatctctgtttacaagcttgtcatataaacc

SEQ ID NO: 20839 - DNA, 101 bp, rice(Oryza sativa)
  misc_feature (71): n=a or g
gcaaattgtaagcttttctctgtgctgtccagttacgtctagtaattccttatgtttaaagactgatattngtctttggttgtgtgtgatgtgcttcttgt

SEQ ID NO: 20840 - DNA, 101 bp, rice(Oryza sativa)
  misc_feature (71): n=t or c
atgacaggtgggcctaggggttatttaacttttttatttttgctgacaggtggcgccacgtgtactagctnaaatcaaaaccgctcagaacggtgttggtc

SEQ ID NO: 20841 - DNA, 101 bp, rice(Oryza sativa)
  misc_feature (71): n=a or g
taaggtccatcgactgtccgtgcagtcaatggattcagaatcagattgcacaatattaatggagggtgggntcattcctgctcgcctggctcacgttcgat

SEQ ID NO: 20842 - DNA, 101 bp, rice(Oryza sativa)
  misc_feature (71): n=t or g
ctgttgtagaacaattacagctaagattgtttttacgacccttgtgggaatttgcaagccatatatgtatncaagtattcaccatgatgtaccaatagata

SEQ ID NO: 20843 - DNA, 101 bp, rice(Oryza sativa)
  misc_feature (71): n=a or g
tctcagtacgaggtatgacatgatctgtgtctaggtttcagctctagaatttgagtcttttcgagacggangaagtatatgtcaactttctctcactcttc

SEQ ID NO: 20844 - DNA, 101 bp, rice(Oryza sativa)
  misc_feature (71): n=a or g
attcagtaccgttgtggtagccattagcaccgccactttttcatggttacagttaaaagagtttgtttagnttgtagccaaaataaaccttataattttgg

SEQ ID NO: 20845 - DNA, 101 bp, rice(Oryza sativa)
  misc_feature (71): n=t or c
ttgaaaaaaaatcatatggatctacgtttacatatatattttattctgcggaccccgaggaggtctagtgncttgtggggcgcctggcagccctgtcgcat

SEQ ID NO: 20846 - DNA, 101 bp, rice(Oryza sativa)
  misc_feature (71): n=t or g
tgtgcactgctgatattggtgcccataggccaacgatggctgctgtggtcgtgcagttgaaggagagcctngcattggaggaagctcgtgcagacagtggc

SEQ ID NO: 20847 - DNA, 101 bp, rice(Oryza sativa)
  misc_feature (71): n=a or g
tttttctcgcgaaacaagaggaggaagacgatgaggcgaagagagagggaaggacagagaaaaagaagggnaaaaaaaaagaaacactctccaatttggaa

SEQ ID NO: 20848 - DNA, 101 bp, rice(Oryza sativa)
  misc_feature (71): n=a or g
attgcgatattttacatgtatgcaaggaatatataataagagcagtcttttcaacgtcctttgcacttacnagttacaactcattttactagtaataatac

SEQ ID NO: 20849 - DNA, 101 bp, rice(Oryza sativa)
  misc_feature (71): n=a or g
atccatttggtgacattttcactcacgtaagagtggacattcctttagtatccgtaaattgcactggcccntttttaggttttcaatgtgaattcactcta

SEQ ID NO: 20850 - DNA, 101 bp, rice(Oryza sativa)
  misc_feature (71): n=a or g
ggttctaaaccgagagtaaagagtatttctccaccagtataaacacaattgcataaggagtattcctctcntaatatagtaacatagtattagatatgata

SEQ ID NO: 20851 - DNA, 101 bp, rice(Oryza sativa)
  misc_feature (71): n=t or c
aactgaatctccttgatgagcagaatccatttttttaacttccggtgacccctcctctccaagctctccancttcctcctgagttacgacacttatatgct

SEQ ID NO: 20852 - DNA, 101 bp, rice(Oryza sativa)
  misc_feature (71): n=t or c
aacgagctaacgttttcattttaaagaaaaaaagaaaacggacaaaagttctgctgggcttcgttggaagngagttcgttagtgggcctaggcccaaatac

SEQ ID NO: 20853 - DNA, 101 bp, rice(Oryza sativa)
  misc_feature (71): n=a or g
tttgtagtaaagccgctcaagatttctcataataacacacaactcctaactcacgtggacgtgggtcaccntatctcgcatgagagtccaatccaaccatc

SEQ ID NO: 20854 - DNA, 101 bp, rice(Oryza sativa)
  misc_feature (71): n=a or g
ggaaacgaacagagcctaaatgaagtgcacctagactactgctgctactgttataagactttttagcattntccatatctatttatttatctatctattat

SEQ ID NO: 20855 - DNA, 101 bp, rice(Oryza sativa)
  misc_feature (71): n=a or c
tttgttaacatgcatgatggaaggcagatcagtcctagttttggtagtttttcaataacagggttgtaatnatctattttgttaaatataatttgcgttgt

SEQ ID NO: 20856 - DNA, 101 bp, rice(Oryza sativa)
  misc_feature (71): n=a or g
tcgaggagaagataacattggaataaagagtgactgaaagagatcacttgtgctagggcttcaatcaaacntggtgttaaatatgtgatcgaattttaggc

SEQ ID NO: 20857 - DNA, 101 bp, rice(Oryza sativa)
  misc_feature (71): n=t or c
cgccgtagtttccctcaaaaataatttgttttctatatgtttgaccaccaatatgcattggaatatattanctccgttccaaaataagtgcagccataaat

SEQ ID NO: 20858 - DNA, 101 bp, rice(Oryza sativa)
  misc_feature (71): n=a or g
aaatacgctcataagtagtaagagaggaggaaggagaaggtcttgccgttgacaatgagacaacgccattnttttatttgaagccttcaaagtcccctcat

SEQ ID NO: 20859 - DNA, 101 bp, rice(Oryza sativa)
  misc_feature (71): n=t or c
caccctgtccctctactcctttgtctgggcatcgatttcctccatgtctgcgagcctctcaagcatcgagntcatgctgcgaagctcgctctcgaggaacc

SEQ ID NO: 20860 - DNA, 101 bp, rice(Oryza sativa)
  misc_feature (71): n=a or g
atgcacgtctttgtccaattgaccttgcatttccctctggtaatatcacccgtgcctgcccagaggaagtngcgtcgctgcttgtctagctgctcgaggga

SEQ ID NO: 20861 - DNA, 101 bp, rice(Oryza sativa)
  misc_feature (71): n=t or c
agaagcaaatctggacccgaagcaggcttatttgaacaccaacctatccacctacatgtactacacagaanagtcttcttgcatgatctcatacatgggat

SEQ ID NO: 20862 - DNA, 101 bp, rice(Oryza sativa)
  misc_feature (71): n=t or c
acagcctatatgtttgtccacgcatggatgtcggccggtccaatcatggctcatacaatagatctgaactntgtgtgctcaaagcatcagcagcagcaatg

SEQ ID NO: 20863 - DNA, 101 bp, rice(Oryza sativa)
  misc_feature (71): n=a or g
gaccaagctatgtagataaagggtagaacgattgcagtgaaaatcttctcactctacaataccaacatccntaaatcctaacgagcgatcggtctctctcc

SEQ ID NO: 20864 - DNA, 101 bp, rice(Oryza sativa)
  misc_feature (71): n=a or c
ctggccctaatcttcccttgcctaactctgccaaggataacaagaatagtagcctcattaaggtattcatntctctctctctctctctctctctctctctc

SEQ ID NO: 20865 - DNA, 101 bp, rice(Oryza sativa)
  misc_feature (71): n=t or g
cagccctggattttttttttgactaaaaacagccctggatttcgcagtaggacgatacttttcagggatanaatttatatgttggtcgtatttgccacttg

SEQ ID NO: 20866 - DNA, 101 bp, rice(Oryza sativa)
  misc_feature (71): n=a or g
aactaactttggtggcattgggtattcagttctaattggttggttctgtctctttgacacttgggtgttcntttgcatgcaatctttgttttaatttttaa

SEQ ID NO: 20867 - DNA, 101 bp, rice(Oryza sativa)
  misc_feature (71): n=a or g
acggaccaaaccagactatgaatggtcgactgagagtctgatatattactcttcttgtctcaaaatataanagatttagtactatgagaatatttttgggc

SEQ ID NO: 20868 - DNA, 101 bp, rice(Oryza sativa)
  misc_feature (71): n=t or c
aaatgtggcacctgatccgttattatactatactaggtgtaggaacgaatggagtacttcagtactccctncattacataatataagaaacaactactttt

SEQ ID NO: 20869 - DNA, 101 bp, rice(Oryza sativa)
  misc_feature (71): n=a or g
cttgcgccccccccccccccccgaccgaacaaccaaagccgaaatagaatccaagaaaaaggaaggaaganaagagagcgcaagctcgccccgcccggccg

SEQ ID NO: 20870 - DNA, 101 bp, rice(Oryza sativa)
  misc_feature (71): n=a or g
tactaattggttagggtttggtccagaaatagtttgattgatgtatagatgcatgtaaagctcattgtgcntgagtgttcacagaagaggagcgattgcat

SEQ ID NO: 20871 - DNA, 101 bp, rice(Oryza sativa)
  misc_feature (71): n=a or c
attacagaagctttcaagtatctgaagacaagcgacagtgatgagaggatggagggctccaagaaggtgtntgaagacgaggagcaggccctgaaggtgag

SEQ ID NO: 20872 - DNA, 101 bp, rice(Oryza sativa)
  misc_feature (71): n=t or g
ggccggttcggagaggaccgtggtttggttcaggagggacctcaggatcgacgacaacccggcgttggccnccgcggcgagggacggcgctgtgctccctg

SEQ ID NO: 20873 - DNA, 101 bp, rice(Oryza sativa)
  misc_feature (71): n=a or c
aaaattaaattggttgaggactttttgatccacccaatctcctcttctcttttttcccccaaaatcgaatngaataaaagcttatcgacctgccatgatca

SEQ ID NO: 20874 - DNA, 101 bp, rice(Oryza sativa)
  misc_feature (71): n=t or c
agttaaaagttttccaatccaaccatgctatgagcctatgaccatgcttattagtgtctgttggcctaagntgtcttcactattcttgccaagtatagagt

SEQ ID NO: 20875 - DNA, 101 bp, rice(Oryza sativa)
  misc_feature (71): n=t or c
aattgttgtttgctccattatctgggcccatattgttgccacctaattccatatgctgctgataagtgacngaattattacagtagggccaacactaggtt

SEQ ID NO: 20876 - DNA, 101 bp, rice(Oryza sativa)
  misc_feature (71): n=t or c
tcggctactacgttcctctgcctcagatggggccgctagggatgccggtggaatatgcagttgtggggttncatcttggcgagttccgcatgccgccaccg

SEQ ID NO: 20877 - DNA, 101 bp, rice(Oryza sativa)
  misc_feature (71): n=a or c
ttcacaacgccgtctacacatcccttttccttaccattttgccatacatgctgcacaagtctaagaggcangccgaatttcagcgcgacttgcttcgaaac

SEQ ID NO: 20878 - DNA, 101 bp, rice(Oryza sativa)
  misc_feature (71): n=t or g
acctcttgattaggttatttatgttgtaaaggaggtatccaacttgtcttagtggtcatcacatttagcanatctcgagggtgcccttgcaaatcaagatc

SEQ ID NO: 20879 - DNA, 101 bp, rice(Oryza sativa)
  misc_feature (71): n=a or c
catgctgacacaactagattttatatcgatgatttatgaggatttggcacataacctacggcttgtgttgntggcacacagagatcctctcaatgccctcg

SEQ ID NO: 20880 - DNA, 101 bp, rice(Oryza sativa)
  misc_feature (71): n=a or g
acctccttcagctgggagggaaggatgcggcggtccgagagctctagtgagggacagaagcttattgcgancttctcaagtgaagcaatggctcccaagcc

SEQ ID NO: 20881 - DNA, 101 bp, rice(Oryza sativa)
  misc_feature (71): n=t or c
tgtttttgcaggcactgtctttggattcttggcaatgcaaatactctagcgagtagcaaagaccatttggngtgagatagtggctgatgcaaagaacagag

SEQ ID NO: 20882 - DNA, 101 bp, rice(Oryza sativa)
  misc_feature (71): n=a or g
gtctaaggtttttcttttccaggtttggtactccttccggatggagggaattttaacagaattgttcgctntaatggaacagattcttgtaaatgtttttt

SEQ ID NO: 20883 - DNA, 101 bp, rice(Oryza sativa)
  misc_feature (71): n=t or c
aggacaggcatcgacaacacctaaggaaggaggggaaagggattatagagagaaagagggtgcacagtgangggcattgcaagccggaggacgggaaggag

SEQ ID NO: 20884 - DNA, 101 bp, rice(Oryza sativa)
  misc_feature (71): n=t or c
taaaataacaagctagctctggcaacaaagaattttcataaatataacacggcctctcccaattcactggngagaaaatatataccaaaaagaaaaaagtc

SEQ ID NO: 20885 - DNA, 101 bp, rice(Oryza sativa)
  misc_feature (71): n=t or c
cctcactcacacccgcccctactgtcgccgcacgcctacctcctcattaccacccctacccgctacatccncccacctgtctccgccatgcctcctcggcc

SEQ ID NO: 20886 - DNA, 101 bp, rice(Oryza sativa)
  misc_feature (71): n=t or g
gtccaatgcacaggcaacatcaagtagtatggtcactcttcgatgcagattcaagtgcctctggtctgctngatcatttgtttcagggtgtatccaatctt

SEQ ID NO: 20887 - DNA, 101 bp, rice(Oryza sativa)
  misc_feature (71): n=t or c
ctactaaatatatgttttgaggcaaaggatccatttacagaccatgctcatgaaatagaattagagcaagngtaaggaaatttgatgtgctgcctctaaga

SEQ ID NO: 20888 - DNA, 101 bp, rice(Oryza sativa)
  misc_feature (71): n=a or g
tgggagagtgatattttcccggttggtgctcaccaagcgggattaaagatatgattcgggactaaagtttnttggggcctgacaactattgaatcaggact

SEQ ID NO: 20889 - DNA, 101 bp, rice(Oryza sativa)
  misc_feature (71): n=t or g
gatggtacaagttacagattacaaatagttaattacacgacaacaaatgaaacatcacaaaagcacgacanacaggaaggagcaatcaaagtgatcaaaca

SEQ ID NO: 20890 - DNA, 101 bp, rice(Oryza sativa)
  misc_feature (71): n=t or g
tctcggggcactaggagaggaaccggcgggtgcaagcgaagagtctccttgatgaacaatcctaggtaggngaggcgactcgcctgaatgtcctcctctcc

SEQ ID NO: 20891 - DNA, 101 bp, rice(Oryza sativa)
  misc_feature (71): n=t or c
tggtaaattatccagatgcttgagaatgctggtttccatgatgtcattgctgaagaccgcaccgatcaggnaatccccctctggagctacactggctgcat

SEQ ID NO: 20892 - DNA, 101 bp, rice(Oryza sativa)
  misc_feature (71): n=a or g
aattcttttgcgatttcgcaaaagattgatgtattgatatatcttgctctgtgctgatcaggtagagattnttgaagatagaagaggtggttgtttctgct

SEQ ID NO: 20893 - DNA, 101 bp, rice(Oryza sativa)
  misc_feature (71): n=t or c
acgcttaagggttcttccgcctttcccttgcatgtaagcatggttgtttctgacattatcaccagtcctantgtgaagatagtctgaggctgcatcatgaa

SEQ ID NO: 20894 - DNA, 101 bp, rice(Oryza sativa)
  misc_feature (71): n=a or g
ccgctgccgccactgccgaaaagtcattcccgaacgtagactaaacgtgaatgaacgtgaaggagcaaacnaaatgcgaacgaacgtacgtgaacgaaacg

SEQ ID NO: 20895 - DNA, 101 bp, rice(Oryza sativa)
  misc_feature (71): n=t or g
caacacacatatatatatatactccgtactcatatctcaagtcctacatgaagggtgtgtttagattatgngtgtaaagttttggcgtgtcacatcgggta

SEQ ID NO: 20896 - DNA, 101 bp, rice(Oryza sativa)
  misc_feature (71): n=t or c
gatcaattctagggccatcggatcatgagagtcgccacacgagggccatttatccttttgagagttctatntatggcacaaaatttttatcacatttaatg

SEQ ID NO: 20897 - DNA, 101 bp, rice(Oryza sativa)
  misc_feature (71): n=t or c
ttcatggagtcaccatttttatttatggcgaagaaaataagaaagcttgtcaagatgcatttggaggtccntaggtaataaccgcttgcaaaaatatattt

SEQ ID NO: 20898 - DNA, 101 bp, rice(Oryza sativa)
  misc_feature (71): n=a or g
ctctggcttcgccgccccacgccacgtacaacccgtccaccaccctacttccccaatccattgtcgaaacnccatcttccctgcaaacccgagctctaccg

SEQ ID NO: 20899 - DNA, 101 bp, rice(Oryza sativa)
  misc_feature (71): n=a or g
aaggtttacgcccgaggacatcatcactacgccaaggaagatgggttatgttgagaacgacaagggttacntcgaggaggaatcagcacatgcccaaccaa

SEQ ID NO: 20900 - DNA, 101 bp, rice(Oryza sativa)
  misc_feature (71): n=t or g
ttttatcatagtattatgtcagattgaaacattttttctttttgggggtgagggggggggggtgttaatanatagttcacaaatatgatagggagtcactt

SEQ ID NO: 20901 - DNA, 101 bp, rice(Oryza sativa)
  misc_feature (71): n=t or c
gaagagcagaattttgtactgttggaggaagtacccaatgaaggtggttcttctttcagtttcttcttacngatggtcttgcatcggaagactggcttaac

SEQ ID NO: 20902 - DNA, 101 bp, rice(Oryza sativa)
  misc_feature (71): n=t or c
tttgggctatactctgccaaggtcattccgttttcttgtagtgcttgcgctgcatattgcagcaactagtntacagctgtaatatgcaacgcaagcgggga

SEQ ID NO: 20903 - DNA, 101 bp, rice(Oryza sativa)
  misc_feature (71): n=a or g
tcacagatctcctcgctaccttttctctggtacagaacaaaaacaaatttcctcactggggtattccatcnagcacctactacagaaccctcattgtaggc

SEQ ID NO: 20904 - DNA, 101 bp, rice(Oryza sativa)
  misc_feature (71): n=t or c
acagtgtgtgtgcataggattagatatcatgaaggccaattgattgccgagtgcaatcgaatattttcttnttagaaaaaaaatgaattggcagagtgaga

SEQ ID NO: 20905 - DNA, 101 bp, rice(Oryza sativa)
  misc_feature (71): n=t or c
attgtcactactcatcggctcatcgccgttgccttcaaccctcaagttattcaagttcatctttctgcttnaaactacaccctccgtctaaaaaaattaaa

SEQ ID NO: 20906 - DNA, 101 bp, rice(Oryza sativa)
  misc_feature (71): n=a or c
tcgagaccagcactctccaggagtaggcgatcacgacgtgcatctgcatgctgtccctgatctggaggccntccacgaccagatggttgcacctcctgaag

SEQ ID NO: 20907 - DNA, 101 bp, rice(Oryza sativa)
  misc_feature (71): n=a or c
tatgcattgacactgaaatgcttcttttccagccaaacttggttctgcaccttgcatttcttctcgcacantggcgtaggataagcaggttcgcatcctgg

SEQ ID NO: 20908 - DNA, 101 bp, rice(Oryza sativa)
  misc_feature (71): n=t or c
agctatttgaaaccagagggagtatattcaacaattctggaaccttgaaattcatcataggaggttggcancctgagtaatcgtaggagtaccacccgcgc

SEQ ID NO: 20909 - DNA, 101 bp, rice(Oryza sativa)
  misc_feature (71): n=t or g
ggatggatccttctcgcaccggatcttggtcttcttcatgtacaccttcaccaatttgcgccacgcccccncccgcgcccccgccccgccagcctccttac

SEQ ID NO: 20910 - DNA, 101 bp, rice(Oryza sativa)
  misc_feature (71): n=a or c
accgtaatacctgtggtgcacaaagaggcattgtgtgcatgttcggatgcatgtagatctggtttggttgnattggggcagatgaaaaagcctgcaaaaca

SEQ ID NO: 20911 - DNA, 101 bp, rice(Oryza sativa)
  misc_feature (71): n=a or g
accccgtagtttttgttcaccctaaaaaggtgctcttaaaattatgggctacaatagtgtgtgtgtgtgtntgtgtgaattccagatctgcctatcatcat

SEQ ID NO: 20912 - DNA, 101 bp, rice(Oryza sativa)
  misc_feature (71): n=t or c
ccatatatatgactgctacctgttgcactctatatatcttgggaatgagtccaacactcaatccagagagnatcaaaaccacaagtgttaattgcatctga

SEQ ID NO: 20913 - DNA, 101 bp, rice(Oryza sativa)
  misc_feature (71): n=a or g
aacctcattaacaaatatcgtgcccctagtgtcgtcgtcttgtttggaactcatatggtgtttctttcgcntttgatttccgatggttttttcgggctagt

SEQ ID NO: 20914 - DNA, 101 bp, rice(Oryza sativa)
  misc_feature (71): n=a or g
aggtgacttcctcggagatggagatccaaggaagcgacaagaggagatccccagagaaaaggagcacgaangttgaacaggaggcggtgagaatgagggtt

SEQ ID NO: 20915 - DNA, 101 bp, rice(Oryza sativa)
  misc_feature (71): n=a or c
gtcagaaatgctgctttgagatctaaatcacgtcagcagaagggtaaagaagaattgtgtcagattagacntcaaactgcttctgcttttgttaatcggtc

SEQ ID NO: 20916 - DNA, 101 bp, rice(Oryza sativa)
  misc_feature (71): n=a or g
actttgatgattaaaatggttcaagtggcagttgatttcagttatagctccagcaggtgctttgaagcatnacctgacagggtagaaaattaacattaact

SEQ ID NO: 20917 - DNA, 101 bp, rice(Oryza sativa)
  misc_feature (71): n=t or c
agactttttttttaagaaaaactatatcatttcggcaacaccagaatgaccagcgtaaaacacttgccagntttttaattgattttgacactccgtttagc

SEQ ID NO: 20918 - DNA, 101 bp, rice(Oryza sativa)
  misc_feature (71): n=t or g
gacagggattcagagaattaagatgaatggtgctttatggattcctattctgccccctccagttgttgatnctcgttatcagggactgtgcctacagtgtg

SEQ ID NO: 20919 - DNA, 101 bp, rice(Oryza sativa)
  misc_feature (71): n=a or g
tattgatgacacgagcacatgcgagcagtaattaattcacgtgcggaatctgtggtgcaaagttgatcctnacaactcgacgaaacgctttatctataatg

SEQ ID NO: 20920 - DNA, 101 bp, rice(Oryza sativa)
  misc_feature (71): n=t or c
tcccttcaatccaattgagctatttggactagaatgtccaagtgaggtgactctagactcaataacgaggnttgaaatgccgaagtctcccaaatatgcat

SEQ ID NO: 20921 - DNA, 101 bp, rice(Oryza sativa)
  misc_feature (71): n=t or g
tatcctcttttcttcctaataaacagcattatcaatgtggcgttgagatggtacggagggatttacttacnggacactggaaaccttatctgcaacgtgct

SEQ ID NO: 20922 - DNA, 101 bp, rice(Oryza sativa)
  misc_feature (71): n=t or c
gcaacaacaaaagcttacttccatggtatgtccccagctaacattctgtctccatcattgtcttcatatantaaagtgtatacaccagttccatccaacaa

SEQ ID NO: 20923 - DNA, 101 bp, rice(Oryza sativa)
  misc_feature (71): n=t or c
tttctagagcttccgcttgtcagaaactcacaatgcaaaatcatctccctcacgggttcacattctctacnataataacattatcattgcaaatacttcaa

SEQ ID NO: 20924 - DNA, 101 bp, rice(Oryza sativa)
  misc_feature (71): n=a or g
cgccgccgctgcgccggcgagcatggtgcagcagtcgcagtatggtgtgatacccaacagtaataacagcncgcaaagctatggttctgggagtgtgggtg

SEQ ID NO: 20925 - DNA, 101 bp, rice(Oryza sativa)
  misc_feature (71): n=a or g
agatcattgacacagctgatcactgaaaatatatatgatggatgagtggatgagacggcgtgcgtacgtcntggacgcactcgaaggcggagatcatggcg

SEQ ID NO: 20926 - DNA, 101 bp, rice(Oryza sativa)
  misc_feature (71): n=t or c
tcaagagtggcacctgtagctcataatggccttttaaggatgccatctggaaaatcagcatctctcgcagngcaagtttgcaattctgttagaccaagcac

SEQ ID NO: 20927 - DNA, 101 bp, rice(Oryza sativa)
  misc_feature (71): n=a or g
tgacctgccaaatgtcctcacgtgcaaatcgtgatcccatcaaaggcccactatacttacatgccttcatncgcgacagtttgtatttattgttaaaggcg

SEQ ID NO: 20928 - DNA, 101 bp, rice(Oryza sativa)
  misc_feature (71): n=a or g
tggtaaggaaattacagtttgcattgtgttctctccgtagtttttctcaaaggcatgtatatgttatcacntgaaactatttatacttctttaaaagatct

SEQ ID NO: 20929 - DNA, 101 bp, rice(Oryza sativa)
  misc_feature (71): n=a or c
cttcccagcatggcagaggcctcggatcaacacagtgtatgtaaccacgttagggacatagcccttaacangcataccatcaaacaccgttactgcatcct

SEQ ID NO: 20930 - DNA, 101 bp, rice(Oryza sativa)
  misc_feature (71): n=a or g
ccgttgaagcaggcaaggtatcttgaggtaactaagctctttgcaatctgtgagttccaactgctctaacncaaaggaattggaaaaaaggcaccctaatt

SEQ ID NO: 20931 - DNA, 101 bp, rice(Oryza sativa)
  misc_feature (71): n=a or c
tgacttttccagtcagtttgtggggttatccgttattgtaactttccaaactccgaagcgcatgcttcgcnaggggaagctggtccttccggcaaagcaga

SEQ ID NO: 20932 - DNA, 101 bp, rice(Oryza sativa)
  misc_feature (71): n=t or g
aaacataacgcaaacgtccatttacgtttccatcatactcgttctgcaagcaagttcgctatcagggcaancagcgatgctgaccactactgtgtttttct

SEQ ID NO: 20933 - DNA, 101 bp, rice(Oryza sativa)
  misc_feature (71): n=a or g
actgataagatttctgcgctaaaggctcaacgcagagctcatggtttatgttatatttgtgctgagaaatngtctcctactcacaaatatgctaatactgt

SEQ ID NO: 20934 - DNA, 101 bp, rice(Oryza sativa)
  misc_feature (71): n=t or c
gatattgggtattgagacacatcaaatatccatgaaagaacaaactcattctccaccgatctctagctctnacactgcaatgcacgagcactttttctact

SEQ ID NO: 20935 - DNA, 101 bp, rice(Oryza sativa)
  misc_feature (71): n=a or g
cgtatttgctaacgagattcagtcaagcctctcggttatgattaagggtgggtagaaaaaaacaaagctcncatgacaaatggttcaaagttgtttgattt

SEQ ID NO: 20936 - DNA, 101 bp, rice(Oryza sativa)
  misc_feature (71): n=t or c
tcacgatttttctttttgcaagcgggtagcataagtgaccacacgcaaaaaagatttttgcatacaagtgngtctcctgcatgcaaaaataccgattttta

SEQ ID NO: 20937 - DNA, 101 bp, rice(Oryza sativa)
  misc_feature (71): n=a or g
aacacaatcatacactatatatcaagggttgagaaacagacacagccttaccgtgaattagtctgaccacnatctggtgcacacttatcaattaggttcca

SEQ ID NO: 20938 - DNA, 101 bp, rice(Oryza sativa)
  misc_feature (71): n=a or g
ctatgacaacgaccaaaagcgtgcctggggataattttcagaatcgctatctgtatcatcactttctgtcnatgaagctgctagatcagcgatgtccaata

SEQ ID NO: 20939 - DNA, 101 bp, rice(Oryza sativa)
  misc_feature (71): n=t or g
tcgttcatgctgacaacaagacagacacaacatgtgaggtgtggcctcagcctcacaatcttgtcttcttnagcagccgtccaaatggtgatgagcggtga

SEQ ID NO: 20940 - DNA, 101 bp, rice(Oryza sativa)
  misc_feature (71): n=a or g
taaaatttgtggagtacaacagcccaaccatacctggagcaattcttactttcaagccatatgatattcantcaaccattggtaaattcggtatcttgctc

SEQ ID NO: 20941 - DNA, 101 bp, rice(Oryza sativa)
  misc_feature (71): n=a or c
cacctgcagtcacagccacccccctcacttggatttaccagaaaattttaccccatggatcatccgtattncctgatatgccaagatactgtttgtttcag

SEQ ID NO: 20942 - DNA, 101 bp, rice(Oryza sativa)
  misc_feature (71): n=a or g
gtgaagccacaaaatgagacagtgagcaatgtgtcgtcaaatggcggatacgggcatagttcatcactacnacttaagaatcgtcgatttacgtacaatga

SEQ ID NO: 20943 - DNA, 101 bp, rice(Oryza sativa)
  misc_feature (71): n=a or c
agctctatgtgtgtgtacagctagcaatggctttgatgcgggcgaagagttatactgaaacatgcccatgngacaaaagcccaaaaaggaaaaaaaataac

SEQ ID NO: 20944 - DNA, 101 bp, rice(Oryza sativa)
  misc_feature (71): n=a or g
tccatctcctcagggggtaaagcatcctgcaaaatgtccttacccacttattcattgtctatcagcgagcnaagacatgagaacaagatagcatttcagaa

SEQ ID NO: 20945 - DNA, 101 bp, rice(Oryza sativa)
  misc_feature (71): n=t or g
acattccgtaaccaaaaggaatgtttgtgagaaggatatcaatctcactctaccatttgcttttttttttngttaaacaaatgttgatgaactttttagcc

SEQ ID NO: 20946 - DNA, 101 bp, rice(Oryza sativa)
  misc_feature (71): n=a or g
attgtactcaaatgtaattatgtaaatacttaccgagttattatacccatgggctgaaagttttgtaatanttaaatgaacacagctcccaaattcttgta

SEQ ID NO: 20947 - DNA, 101 bp, rice(Oryza sativa)
  misc_feature (71): n=t or g
atccatggcactcactactttcttcagagaagggttcttgatggagctcttatctgcaattcttggcgatnttgtcagcagatcaataaccttcatgatcg

SEQ ID NO: 20948 - DNA, 101 bp, rice(Oryza sativa)
  misc_feature (71): n=a or g
gctgacgaggaaagatgaaagatcgtagttcaaaaggcgttgtacctggaactgcttgggcttcttcttgngaaggatcttggccggcagcacgcgcagct

SEQ ID NO: 20949 - DNA, 101 bp, rice(Oryza sativa)
  misc_feature (71): n=a or g
tatgctagatctatataagcaccaaacacataacatctctgacaagcccacatacaaacctgtcacagttnacctctttcctatgacgggtgttgagtttg

SEQ ID NO: 20950 - DNA, 101 bp, rice(Oryza sativa)
  misc_feature (71): n=a or g
ctttcctaatatagcaagttccattgattaaggcatctctagcatagagagcgaagtactcacaacatccnaaaatgtaaaaagaaatgttgtctcacaaa

SEQ ID NO: 20951 - DNA, 101 bp, rice(Oryza sativa)
  misc_feature (71): n=a or g
ctctggtgccattattcctacttctacggcgattggattgcacttttacccaatttgggaagctgcatctnttgatgagtggttatacaatggcggtcctt

SEQ ID NO: 20952 - DNA, 101 bp, rice(Oryza sativa)
  misc_feature (71): n=t or c
aaaaaactttgcgcaggctagcaaattgcccaactagccttgtgacctcatggcaagggtacgatatcggnggatataggttttacacgatgttcaaggtc

SEQ ID NO: 20953 - DNA, 101 bp, rice(Oryza sativa)
  misc_feature (71): n=t or c
aaaggagtgcctcatcaaattggtcatgatcaatccaggatgaacacagttaatagtgatgttcgctcctncttcctgtttcatcaatggcacagatcaaa

SEQ ID NO: 20954 - DNA, 101 bp, rice(Oryza sativa)
  misc_feature (71): n=a or g
caccttgatgtcaagtcagcctttctgaatggcgagctagaagaggaggtatatgttgcacaaccagaagnttttgtcaagcaaggtagagagcatctcgt

SEQ ID NO: 20955 - DNA, 101 bp, rice(Oryza sativa)
  misc_feature (71): n=a or g
ataacacaaaagtatagcaaagaaaaacatataattttaacgggaatacaactgcaaaatagtttattacnaaacatgagaaaatacagaaacaatcattt

SEQ ID NO: 20956 - DNA, 101 bp, rice(Oryza sativa)
  misc_feature (71): n=t or c
attgcccttagctcacgcttcttctcaatcaagctttgcaaggttagaaatgctaaagcaaatctagtcanacccggccttatggtatctctcttcttcgt

SEQ ID NO: 20957 - DNA, 101 bp, rice(Oryza sativa)
  misc_feature (71): n=a or g
ggtagttagatacccatggcgattatttatgtgaaagtagtcccgcaagggaaagagaatttgaaacaaanccataaaaaatggaaaagtctaaatatcct

SEQ ID NO: 20958 - DNA, 101 bp, rice(Oryza sativa)
  misc_feature (71): n=a or g
cacatctaaatgtggcaaatggttaaatatctccagattggcgggtgttttcaacggacaacctcgggttnagatgtatttttcttcatacccctcgcact

SEQ ID NO: 20959 - DNA, 101 bp, rice(Oryza sativa)
  misc_feature (71): n=a or g
aggtttctaataatatttgtacaccagctcagaacggttttttcttttttcaaagtttcctcgcagggaangatgaagatcagcttggcaaaggcatccca

SEQ ID NO: 20960 - DNA, 101 bp, rice(Oryza sativa)
  misc_feature (71): n=a or c
cgaggcccaaaccgaacgagctgcaacttcttgggccatggtagtattttggcccaaatttagagaccagngcaaaacactcgtcgtcgtcgccgtcgcgt

SEQ ID NO: 20961 - DNA, 101 bp, rice(Oryza sativa)
  misc_feature (71): n=a or g
gccccaactgaacagggcgatgatcggctattaataagtgatccgaacgagactttcgatgaacggcatgncactgaacaattccgacttccgtgccccct

SEQ ID NO: 20962 - DNA, 101 bp, rice(Oryza sativa)
  misc_feature (71): n=t or c
ccagaacttgaccacgtctcttcaacagatcatccagaaggagcagaccggagagtttgtccctcgatggnagcatgacgagctaaccgaagctttgggaa

SEQ ID NO: 20963 - DNA, 101 bp, rice(Oryza sativa)
  misc_feature (71): n=a or g
gacgacgagatcgttagcaacagtggccacgagtcaagatgctgtatatatgtatggatgagtcatcagtntgatgcatgatctcacatctcgtcactgat

SEQ ID NO: 20964 - DNA, 101 bp, rice(Oryza sativa)
  misc_feature (71): n=a or c
tatatcttatagaatttcctttgtaggactctgttgcagacccacagtcctgattcatcatatctagcagnaaaggcttcatggttacattttatctaaag

SEQ ID NO: 20965 - DNA, 101 bp, rice(Oryza sativa)
  misc_feature (71): n=t or g
cttcggtggtgggcttcggttctgcgttggaactgatctcagcaaggttttgatggcaacattcatacacnctttagttacaaaatacaggtaccatttct

SEQ ID NO: 20966 - DNA, 101 bp, rice(Oryza sativa)
  misc_feature (71): n=a or g
ccgccaggttcaggttcgctaacgccatttgcacattttgcatggccgagacaagcataccagtcagttcnggttgttgtttgaacacctcgtttcccacg

SEQ ID NO: 20967 - DNA, 101 bp, rice(Oryza sativa)
  misc_feature (71): n=t or c
ttgattcaaacacaagattgatcaacttgatgtaagagaagtcttggaaaataagaagatactccctcctntgtttatgttttatgttataagtcatttga

SEQ ID NO: 20968 - DNA, 101 bp, rice(Oryza sativa)
  misc_feature (71): n=t or c
actggcagatagtagctgtagagatgaggtgcataccggatctgaaggtggagatcactggagtagagcgnggagaggcagcggatctggcagcgaggaag

SEQ ID NO: 20969 - DNA, 101 bp, rice(Oryza sativa)
  misc_feature (71): n=t or c
ttattgtgattgtataacatcaccggactgacgaatcgcagttacagcatgcatggtactccctccattcnaaaatataaggcacaaccacccttaaccca

SEQ ID NO: 20970 - DNA, 101 bp, rice(Oryza sativa)
  misc_feature (71): n=a or g
ttcaacgcacctctcccccaagatgcaatcgacgcgcttgaacatctcttcggactcaacaaggaggagcngcggcagcggatgcggtgctggtgaagtac

SEQ ID NO: 20971 - DNA, 101 bp, rice(Oryza sativa)
  misc_feature (71): n=a or g
tgtcgctctggtatctgacggtttcaaccagctgcaatatgcacactctcaatcaacagacaaccaaacanaccccatctcggcgatcacccactccggct

SEQ ID NO: 20972 - DNA, 101 bp, rice(Oryza sativa)
  misc_feature (71): n=t or c
atacggcggaggcgctgccggacgacgtggtcgtcgacgagatccaccgtgcaccaccgtccgcatcaaanggctcggcgacgaaagctcggaggagcagc

SEQ ID NO: 20973 - DNA, 101 bp, rice(Oryza sativa)
  misc_feature (71): n=t or g
gtccaagtgagctagcaataaaaaggggagctgataaacgaccaatcatccctatctcacctgtcaagacngcaggtgggagctgtagctgccttgctgag

SEQ ID NO: 20974 - DNA, 101 bp, rice(Oryza sativa)
  misc_feature (71): n=t or c
gagggatgcgaatgagattcaacctatatttgagggcgtaaaaatggactctttgagtttcaatcgtgttngtgaactgcaataccgaaaatcttgacccc

SEQ ID NO: 20975 - DNA, 101 bp, rice(Oryza sativa)
  misc_feature (71): n=t or c
taacagcgaacacacgagtggtttggttttggttagttggtttgggtggagcagtgtactccttccgtccnaaaaaaaaaaagacaaaccctgaattaatt

SEQ ID NO: 20976 - DNA, 101 bp, rice(Oryza sativa)
  misc_feature (71): n=a or c
atgggcagagcgagagctatacatcgcatcgtcatcagcagcaagaagacgatgaagttgaagagtgcagntgacgacgagcgcctcgccggattttatct

SEQ ID NO: 20977 - DNA, 101 bp, rice(Oryza sativa)
  misc_feature (71): n=t or c
tatgacttggcaatgcaagtcaaccaaccaaacaaccctctcaccaaccaactaaaaaacggagatatgangcatgcgtggggacggcgcaccatataatc

SEQ ID NO: 20978 - DNA, 101 bp, rice(Oryza sativa)
  misc_feature (71): n=a or g
gccatgcatgactctactcatacatgcaggcctgtttctttccccaattttctttccttcccttctgactncaattgatgaatgtgtatagattacgacaa

SEQ ID NO: 20979 - DNA, 101 bp, rice(Oryza sativa)
  misc_feature (71): n=t or g
aagtggaggttgacaactggatcgttggaactaacaacttcactgtactatggcaagatagtgaagagcangcaatgctcggtcgctccgtcatagtggac

SEQ ID NO: 20980 - DNA, 101 bp, rice(Oryza sativa)
  misc_feature (71): n=t or c
gatccggggcgaggccaccatgtagatggggagagaggcatgaatatggcttcagctcgggagcttcttgnagccaccatctccatcgtcatgtcccttac

SEQ ID NO: 20981 - DNA, 101 bp, rice(Oryza sativa)
  misc_feature (71): n=t or g
gtgcccggcgcgaatgtcggcgtttgggtttcctccgtctccggggaggaagggaacattggacggaacanggtcgtccaccggggtccactccgcgatga

SEQ ID NO: 20982 - DNA, 101 bp, rice(Oryza sativa)
  misc_feature (71): n=a or g
tagctacattcatctaccttcagaaaaacccgcactaatttgtatgcttcacacgttaaaatattgagatntaaagttggagggagagaattaatctgaaa

SEQ ID NO: 20983 - DNA, 101 bp, rice(Oryza sativa)
  misc_feature (71): n=t or c
gccccggcgcggcatcacaaaacgacggataagataatatagatggcgagtccgctgtcgatgagggaggncactgattccttgattgatttctttctccc

SEQ ID NO: 20984 - DNA, 101 bp, rice(Oryza sativa)
  misc_feature (71): n=t or c
aacatgtcttctcttttacactgtaaaatatccatcttaccactaggggcaccattgcggtcttttatggnccctgttacaataggggtaacttggacttt

SEQ ID NO: 20985 - DNA, 101 bp, rice(Oryza sativa)
  misc_feature (71): n=a or g
attcttactttttgtcttttttgttctgcaggttatggacaagcacttgtcaattctcgcgaaacagcatntagaaacacgttttgtgaaagttcatgctg

SEQ ID NO: 20986 - DNA, 101 bp, rice(Oryza sativa)
  misc_feature (71): n=a or g
tcgggcttagactctggctgtggttctgtttttgcttctggcttggattctggttctggttttgactttgngtatgactttcgctctggcttcggttcagc

SEQ ID NO: 20987 - DNA, 101 bp, rice(Oryza sativa)
  misc_feature (71): n=t or c
gtgctgagagcgcagagcaaccgcaggagaaagaagcggatcttggattcacgaacagagaagaggagtcnatggaaaaaaaggggagtgtttgctcgata

SEQ ID NO: 20988 - DNA, 101 bp, rice(Oryza sativa)
  misc_feature (71): n=t or g
ttgataatcagtgaaacgttcagttaagatgcatgattgacatcctctttttgtttgcttgttgtagctgncagacattgaactagcaagtaaacagaagg

SEQ ID NO: 20989 - DNA, 101 bp, rice(Oryza sativa)
  misc_feature (71): n=t or g
cgtccccagaagcggtgatcggggctatgaaaaccgttggaacctggatgggtgaaatccgaacttatttnctccgagctcatctaccggaagaagatgtg

SEQ ID NO: 20990 - DNA, 101 bp, rice(Oryza sativa)
  misc_feature (71): n=t or c
cgttatttgtacatgacattgttactcatgatgtactgattcgttaggaaaaagatatctatcggttatancatctctattttaaaatgtagcaagtttgt

SEQ ID NO: 20991 - DNA, 101 bp, rice(Oryza sativa)
  misc_feature (71): n=a or g
atgattggcatgatcctcgatcgatctcttttgactgcaaattaaatggcgaccaaataatgcgaacccancatatataccgtaccgtactcaattaaaag

SEQ ID NO: 20992 - DNA, 101 bp, rice(Oryza sativa)
  misc_feature (71): n=a or g
gttgcatgttcattggttgtgttacacgatgaatgagtttacaccttgatcctggtgaaaaaagaaataanacttttttggaagaaaggaatacattacat

SEQ ID NO: 20993 - DNA, 101 bp, rice(Oryza sativa)
  misc_feature (71): n=t or c
attgtttcacatacgaaagggtgtttacccttttcgccaactttgtgtgttttgctgagtcttaactttgngctttgccatttaccctttctatactgtct

SEQ ID NO: 20994 - DNA, 101 bp, rice(Oryza sativa)
  misc_feature (71): n=a or g
tagtaaaagaaaaacatttgcaaaaaggagtaaaggacatgagtgcgcaatatggctcccaagctagcctnccgaaaggggccaccgtagaaaaactggtc

SEQ ID NO: 20995 - DNA, 101 bp, rice(Oryza sativa)
  misc_feature (71): n=t or c
tccaatacaaaatataagattgggatggcattgccaggaacgatgaaaagcacgagacacacatgtagcangggcggcatctttgaatgccattagggagt

SEQ ID NO: 20996 - DNA, 101 bp, rice(Oryza sativa)
  misc_feature (71): n=a or g
cctccatgagcctctaacttctaatgatgctgtgggaacttcttgtaaagctaccacttccaatcctgctntaagtaaaagttatgttggagatgagatgg

SEQ ID NO: 20997 - DNA, 101 bp, rice(Oryza sativa)
  misc_feature (71): n=a or g
tcacatgaacgtagtattcgtgagtaccaggatttgaactctcatttaagtagtgcacccacagctagcantactccaccacacaactggtgctcccctca

SEQ ID NO: 20998 - DNA, 101 bp, rice(Oryza sativa)
  misc_feature (71): n=t or c
attggatcgaaaatgaacgtacgagattcgtccactttgagcatgatgacgtggataaatctcatatattnatttttcgatccaacggtagtttttaggat

SEQ ID NO: 20999 - DNA, 101 bp, rice(Oryza sativa)
  misc_feature (71): n=t or c
gactaaagatcaaaatttttataactgggactaaaaacaatcttgtataaagtggattttgccagaccgancaaagatgatttctccaccaatataaagtg

SEQ ID NO: 21000 - DNA, 101 bp, rice(Oryza sativa)
  misc_feature (71): n=t or c
ttcttcttataacttgcaaatttgaactccaaaacagttgcaggaaccagcacctgctcctctccagcaanctcatctacagcaaccaccctttcatagcg

SEQ ID NO: 21001 - DNA, 101 bp, rice(Oryza sativa)
  misc_feature (71): n=t or c
ctctaattatttgtttggatacagatgtgtccactggccattttggctagtgtggcaatcacgtggaaacntacttattcgcgttgtttcatattataagt

SEQ ID NO: 21002 - DNA, 101 bp, rice(Oryza sativa)
  misc_feature (71): n=t or c
cagaaagaaagggctgacattgaaaacatgctgcagaccataaaaaacacgtggaggaaagcaggtgtgangattgtttctgatgggtggtcagattttaa

SEQ ID NO: 21003 - DNA, 101 bp, rice(Oryza sativa)
  misc_feature (71): n=t or c
tctttgagtttagaaagtatagcgtctggggattctatccatttggggattgatgaagttggtttttcttnccacgactttttttttttcgggagtgaagc

SEQ ID NO: 21004 - DNA, 101 bp, rice(Oryza sativa)
  misc_feature (71): n=t or c
gggtctctttgtcttttctgcctttgattgagtactcctacaagacaccgccacctggaccccacctctcnttttctttctccctcccatttttttaagga

SEQ ID NO: 21005 - DNA, 101 bp, rice(Oryza sativa)
  misc_feature (71): n=a or g
agcaatgagaattttgctcaaagtaagatttttgtggctcctgaggactctgagagtgaaggcacaatcantgagaatctatttgaaatttcgaacatgaa

SEQ ID NO: 21006 - DNA, 101 bp, rice(Oryza sativa)
  misc_feature (71): n=t or g
agtgaagctccatcggctgtgcaattattcttccaacatctccgaatgatccgaaggtgttgtgccacttntttcattgttggtctttgatctatttccaa

SEQ ID NO: 21007 - DNA, 101 bp, rice(Oryza sativa)
  misc_feature (71): n=t or g
agctccattcagcatgcgtgtggtaggagtttaatttagtttttatgcgtcacactgcaagatgcatgaangttcttcttctcctatatatgtatattaat

SEQ ID NO: 21008 - DNA, 101 bp, rice(Oryza sativa)
  misc_feature (71): n=a or c
ccgcaataatagtaataataataataatccccagataagaattgagtttatgactactcccatagaccccnaaaaaaaaaggaaaagggaaaagaaagtat

SEQ ID NO: 21009 - DNA, 101 bp, rice(Oryza sativa)
  misc_feature (71): n=a or c
acagttaaaattactgacctccaatttaaggatgaggtgcagcactgaaaatgtgttcatacctggagagngacaataacatcttgggtatctagacctga

SEQ ID NO: 21010 - DNA, 101 bp, rice(Oryza sativa)
  misc_feature (71): n=t or c
attgcatggtttgtccaagacacggctaagctgcagccagatgctaatgaaaatgctgtaacgtgtaaatntgttgggtggatgctgcagagtgctcgccg

SEQ ID NO: 21011 - DNA, 101 bp, rice(Oryza sativa)
  misc_feature (71): n=a or g
ttttagtcgttcaaatgtgaggcgaaatatacggcgaaaggcgatactagtattttagtttttcgattatncggcgaagaaaggtgagtactacgtagtac

SEQ ID NO: 21012 - DNA, 101 bp, rice(Oryza sativa)
  misc_feature (71): n=a or g
tggaagcaagattcttgataatggaagcatacagatcaaaatcagctttgtacttgcagcagctagcctcnatccacttctctgcaaggcttgtggccacg

SEQ ID NO: 21013 - DNA, 101 bp, rice(Oryza sativa)
  misc_feature (71): n=t or g
atcatgtctactaccaaaggtactagatccgatacttacggtactatactaacatcatcatggtacctacngggcatcatgtttggtaccgaaggtaccag

SEQ ID NO: 21014 - DNA, 101 bp, rice(Oryza sativa)
  misc_feature (71): n=t or c
catacgatcagcaatcacagcttcgagggtgtttcacgagaaacgagatcagcagaaattagtaatagcancatgacgagggactgatcaacaaaaactac

SEQ ID NO: 21015 - DNA, 101 bp, rice(Oryza sativa)
  misc_feature (71): n=a or g
gtagagcaagccaaagaatacttaattgttccatcaacatctaaccagctggccttagttatcccactctncaagcgagttcgcggcctgacgggttcaga

SEQ ID NO: 21016 - DNA, 101 bp, rice(Oryza sativa)
  misc_feature (71): n=t or c
attggcatgcatgtaggaacatgaggcaactcaagtacgtgggcaacttccacccctacgacaccgccttnaagcgcgactgcaaggccggcaagctccca

SEQ ID NO: 21017 - DNA, 101 bp, rice(Oryza sativa)
  misc_feature (71): n=t or c
gagcaatgcttgatgtttcacagggggtggtggcgactcctcatctagcaagagaggagttgggcgaaggngatgagagcggtcttggcgaggaaggccga

SEQ ID NO: 21018 - DNA, 101 bp, rice(Oryza sativa)
  misc_feature (71): n=a or g
cggccaaaattccactgggttttctgctacttttgagccataaatccccgagaaaccctaactaacaagtnattttccatcgcaggattacctcaagacgg

SEQ ID NO: 21019 - DNA, 101 bp, rice(Oryza sativa)
  misc_feature (71): n=a or c
ggagacgtaatgacagtaagagtaaggtggttagaggacatcctctcgataacaggtgggttgtcccgtanaatccttatcttctacggatgtacaactgt

SEQ ID NO: 21020 - DNA, 101 bp, rice(Oryza sativa)
  misc_feature (71): n=t or g
tgggctccaaaagatgtttgattctctcgatgaagttactgtcgagcctgactatgatccttcaaagaaantaggcccctggaggcacgcgaccatcaagt

SEQ ID NO: 21021 - DNA, 101 bp, rice(Oryza sativa)
  misc_feature (71): n=t or g
tgtcattagcctcgagatgggtgatattgatgggccaagagtgatcatgggctgagatatcaggaagtctntgttctgtgctaatcggccgtcaatcaaag

SEQ ID NO: 21022 - DNA, 101 bp, rice(Oryza sativa)
  misc_feature (71): n=a or g
tcttgcgcagcctttgcccgcgcctccctatgggatgaccacggatcagacaacacttgaatagaatcacngaaacctaaagattcgtctacttacttctc

SEQ ID NO: 21023 - DNA, 101 bp, rice(Oryza sativa)
  misc_feature (71): n=t or c
aaccttgatgaggactttttggcgaagcgttgtaatcttggatatcgagccagacgaattgtaatgcttgnacgaagcattgtagaaggaaagatatgcct

SEQ ID NO: 21024 - DNA, 101 bp, rice(Oryza sativa)
  misc_feature (71): n=a or g
gcattggttcggtcaagcttgtgcgttgtattggcagtttaccttgcattcatcgtctatcttatcatgcnaaatacctcactgtattctcgcctccgctc

SEQ ID NO: 21025 - DNA, 101 bp, rice(Oryza sativa)
  misc_feature (71): n=t or g
atatgtgcgcactgtgtgtgtgtatggactagttcaggccaagtccaacatttcagctataaagggattanaaaaattaagttgatggatgagtcttcatc

SEQ ID NO: 21026 - DNA, 101 bp, rice(Oryza sativa)
  misc_feature (71): n=a or g
agatatcctgcatctgcatagcccaccatggttaagtctcgttgccttggaaagaagaggccgagatcttncgtaccctggaggtacctgagtactgtctt

SEQ ID NO: 21027 - DNA, 101 bp, rice(Oryza sativa)
  misc_feature (71): n=t or g
aggagtctcgcctacatgcaaacggaaaatggtgaacattcaatacgtgagacttgttgcatgcctacatncatagaacaaaacgatgcacgtgtttatcc

SEQ ID NO: 21028 - DNA, 101 bp, rice(Oryza sativa)
  misc_feature (71): n=a or g
ttcatccaacttattcactacagaacagactgatggctctgattgcattacaaaagaaggcgtacttgaangtgaaacacctcctatgcaagttgatgaga

SEQ ID NO: 21029 - DNA, 101 bp, rice(Oryza sativa)
  misc_feature (71): n=t or c
tggatttcactttcacgagtcctagaaacttaccaaatgcaaacagttctccgaaacaaacagcagaccantggggcaatcagtagaagacactggtgtca

SEQ ID NO: 21030 - DNA, 101 bp, rice(Oryza sativa)
  misc_feature (71): n=t or c
ctttcccaggaaaaagccagcgcaaaagcataccagggagcacttcgcagtgatcttttagatacccaatnaactcaggcaaggatattttgtcacgttca

SEQ ID NO: 21031 - DNA, 101 bp, rice(Oryza sativa)
  misc_feature (71): n=a or g
atttatttattttgcgtgtatatagtgttttgcacctgggaagagtaacggaatgcatgatcaacttgcantattcattcttggcaaaattctcttgtgac

SEQ ID NO: 21032 - DNA, 101 bp, rice(Oryza sativa)
  misc_feature (71): n=a or g
cactaaccttgaatggttaaaaattgaacatcacataagctagcttagcgcaaggctaatagtataactcnctactagctccaattcatttatagtcaatc

SEQ ID NO: 21033 - DNA, 101 bp, rice(Oryza sativa)
  misc_feature (71): n=t or c
ttccgttttagctgatatggtaatcaagtcaatataagacccacgtaaacctcacatgtgagcgcatcaancttctttcacttctatccttacatgcgctt

SEQ ID NO: 21034 - DNA, 101 bp, rice(Oryza sativa)
  misc_feature (71): n=t or c
ggaaaacgggaccgtgaattaatagcaacagtaattgagcactaggtttaggcgttcgccatggattgatnggagaagatggaggctcaggcagaggtgta

SEQ ID NO: 21035 - DNA, 101 bp, rice(Oryza sativa)
  misc_feature (71): n=a or g
gcgaaaacactctgttcactataaaaaccgacttacttccttctatagtaggttcaattttaacctttttntttatctcaaaataggttcatttttataat

SEQ ID NO: 21036 - DNA, 101 bp, rice(Oryza sativa)
  misc_feature (71): n=t or c
tgatgttgagtccttataagtttattggacttcaaggaagtgttaccagctgtcatgagggtcaatcctgngctcttcctgcctttgatggccgaatatgc

SEQ ID NO: 21037 - DNA, 101 bp, rice(Oryza sativa)
  misc_feature (71): n=t or g
ttcccatctctccatttttgttaattctgtttgctggatattttcaggttactggaatccgccctttgaangaaggtagcaaccctccaaagtattcgcag

SEQ ID NO: 21038 - DNA, 101 bp, rice(Oryza sativa)
  misc_feature (71): n=a or g
gataggaattggatgcagaaatggttctacgtcaacaacccctattcctccgaagatgctcaggcgaactngctaccttttgagcattctgctgtcaccat

SEQ ID NO: 21039 - DNA, 101 bp, rice(Oryza sativa)
  misc_feature (71): n=a or g
cgacgaagaggaggaagaggatgaggaagacgaagatggtgctgacacagataaggaatgcaaagagcaanctcgtgattcagcggtttccactaaagaag

SEQ ID NO: 21040 - DNA, 101 bp, rice(Oryza sativa)
  misc_feature (71): n=a or g
gaaaagaatgcggaaaggaataaaaccgagaaaaagggccaaaaaaaagagaaaaggggcgaaaaaaaacngggacggacgaaaataaaatcagaagcctt

SEQ ID NO: 21041 - DNA, 101 bp, rice(Oryza sativa)
  misc_feature (71): n=a or g
tcaggggccatggcatctttagtcaaccggggctaaaaatcatgactttagatctttagttctttagttcngttggtagcaccaaccggggctaaagataa

SEQ ID NO: 21042 - DNA, 101 bp, rice(Oryza sativa)
  misc_feature (71): n=a or g
atgtcctaaaatcaagaagaagctattgaagtttcctgaccaggcaaacatttgttatgtcttgcctgctngaaagggaatattccaagtccaagaaagac

SEQ ID NO: 21043 - DNA, 101 bp, rice(Oryza sativa)
  misc_feature (71): n=t or c
ctaagaaatcacaggaagttttcaatcacgccaagctgcggcatatattgtaactaggatagccaaacttnggtgtagccacacagcagaacagtggttca

SEQ ID NO: 21044 - DNA, 101 bp, rice(Oryza sativa)
  misc_feature (71): n=a or c
tgaagaaggtctcgaaattctgcaagctgaaaacagaacaactcccaaggtgttgacggctgttaaatacnaaattaacgccgtcaatacctgtataaaac

SEQ ID NO: 21045 - DNA, 101 bp, rice(Oryza sativa)
  misc_feature (71): n=a or c
agcatcaatggcatctcaaaacagctaaccatcaccaaattctgtatcagggtgatcatgttgggaaaagnaaattatgtattagtgtacaaaagtacaac

SEQ ID NO: 21046 - DNA, 101 bp, rice(Oryza sativa)
  misc_feature (71): n=t or c
atcatcatggtgcaaaacacagtccatagaccaatcacaaatcctatgctcatcccgaggtagagagatcncatatggcttctatcttcatagaaactttg

SEQ ID NO: 21047 - DNA, 101 bp, rice(Oryza sativa)
  misc_feature (71): n=a or g
gtagcttttgtgtggtgtatctgtagagatgctttgagtaagaacaacattattcctctttgctttatggntttttttcaagctgatagagactagggttg

SEQ ID NO: 21048 - DNA, 101 bp, rice(Oryza sativa)
  misc_feature (71): n=a or g
tttcttgatcattcctcggaagtgctcgtcaggtgatgcccgcattggaagatccttcatggatgttcgcntggtgaagagcaagtccctgcccatgattg

SEQ ID NO: 21049 - DNA, 101 bp, rice(Oryza sativa)
  misc_feature (71): n=a or g
atgccaagaatggaaccaacagcccaaataattaaaaactccctcaattcagaaggaaggcctttgcactntacccacaccttcggaaccacatatttcac

SEQ ID NO: 21050 - DNA, 101 bp, rice(Oryza sativa)
  misc_feature (71): n=t or c
ggaagtcaggtaaaaaatatatttaaaattattatcaccgattttcgatgatctgccagcagctaaccacnggatagggccagcagctaaccatcggcgtg

SEQ ID NO: 21051 - DNA, 101 bp, rice(Oryza sativa)
  misc_feature (71): n=a or g
aggcttcttggttacagttcatcgcgatcgatctcatcaatcatcatcaatggatctttggtttctgatcnactctgaagaagaaacctgggtcaaagaat

SEQ ID NO: 21052 - DNA, 101 bp, rice(Oryza sativa)
  misc_feature (71): n=t or g
ggcggccggcggcgacgacggagtggcaggcagtctggccggcggaattgctgtcgaatcctctgctttcntgctgcaggcaggcatgcatgcagctgcag

SEQ ID NO: 21053 - DNA, 101 bp, rice(Oryza sativa)
  misc_feature (71): n=t or c
caaaaatcccttatgagtcctgtagctgtttaataagtaaagataggagcccatcatcacctggacattcnttcggacatttgaatcctctgaagaatctt

SEQ ID NO: 21054 - DNA, 101 bp, rice(Oryza sativa)
  misc_feature (71): n=a or g
agtttggcgcccagggtttccgtttttctaagcacccagggaagatgagcaaaacaggtgcgacggaagcngaagaggcataggggggggggtgagattat

SEQ ID NO: 21055 - DNA, 101 bp, rice(Oryza sativa)
  misc_feature (71): n=t or c
actatcagatccacgacgaaccgctgtgaggactgtttatggaaggaagtttaaattccaagtggaccaangtcgaaatgctagatatatgaagcaagaga

SEQ ID NO: 21056 - DNA, 101 bp, rice(Oryza sativa)
  misc_feature (71): n=a or g
agtatcatccggttgtaccaataggattcgatcttcaccataaagaatctggcgagtatatgttgtgcccnaaagtcctctgtttaggcaacatttggcaa

SEQ ID NO: 21057 - DNA, 101 bp, rice(Oryza sativa)
  misc_feature (71): n=t or g
acatacggaatactccaatatctgctgattctgatgcttatgaatctgcccattttcctcttaatggcaangaagaggctcctgcagctcaggtccacaga

SEQ ID NO: 21058 - DNA, 101 bp, rice(Oryza sativa)
  misc_feature (71): n=t or c
tctttatttgtctagcgaaggcttttttttatctacagaaagtactgcataacaaccatttttgttggtcntgcctttgtttgtttcatctgtatgaaatt

SEQ ID NO: 21059 - DNA, 101 bp, rice(Oryza sativa)
  misc_feature (71): n=a or g
caatttttttttacttacggggctttatcatgcacattcaacaacttttctacttacggggctttatcagntaaggcaaaggcattactagcaggggaggc

SEQ ID NO: 21060 - DNA, 101 bp, rice(Oryza sativa)
  misc_feature (71): n=t or c
ggctcagtttttagctttctcaaaaaaaagcagggtaatgaaaagttgtgcatcaaacataaaaccggatngaaaactattttgcaccatattctattttt

SEQ ID NO: 21061 - DNA, 101 bp, rice(Oryza sativa)
  misc_feature (71): n=a or g
tgtgtcgggtgaagattccctgatttgaacatcatttggtgaaatcacaacactttacttctttcctaccntcagaattataaaccacttttgctcatgtt

SEQ ID NO: 21062 - DNA, 101 bp, rice(Oryza sativa)
  misc_feature (71): n=t or c
ggtcggggaatccggtatccatgtggggtttccaacaggcacctaagtaggtattttagtagtgcctattnattatatgagaatggtatagtggcaaatgc

SEQ ID NO: 21063 - DNA, 101 bp, rice(Oryza sativa)
  misc_feature (71): n=a or g
caagacctcagctggctcttccgacaacggctcgaacccgtactacatggtcaagctggcagggataaaanccggcggcgcgccgctccaggcagcgtcga

SEQ ID NO: 21064 - DNA, 101 bp, rice(Oryza sativa)
  misc_feature (71): n=t or c
ggatagtttccaaggaggtgcaatgtcctggaatgaattctctgctgctgtgaagaaggcacaccagcatngcatgggtcagccgacagaaagaaaggtca

SEQ ID NO: 21065 - DNA, 101 bp, rice(Oryza sativa)
  misc_feature (71): n=a or g
gaccagctcaaacaagaaaggagcgttttcagccaatactttggcccaacacaaatagtaggtagcagacnagaaagaaaacatgcgaacttagatgtaac

SEQ ID NO: 21066 - DNA, 101 bp, rice(Oryza sativa)
  misc_feature (71): n=a or c
atcagatgttcgatgcttttcaggactcggaagcaattgattgtgaagtattcctttcagttcggcttgangtagtcctctcagaccattgccgcatataa

SEQ ID NO: 21067 - DNA, 101 bp, rice(Oryza sativa)
  misc_feature (71): n=t or c
agatggagagagtaaatcttaaggtctgaattttgcaatattggagtcctaatttttcgtcggatgtgatntgccaattttcacggagaatactaccttaa

SEQ ID NO: 21068 - DNA, 101 bp, rice(Oryza sativa)
  misc_feature (71): n=t or c
ctgcagctttttcaccgagacggaaaggtgagcatccgtatcgtggcgaaattattggcttccctgatgtncaggcaaacagcagccagcctgcttctact

SEQ ID NO: 21069 - DNA, 101 bp, rice(Oryza sativa)
  misc_feature (71): n=a or g
tcagctgcagcgatctgttcctctgccaaccttaacatgtaccacctccttctaaaataagtgcaaccgtnaaaatctgtgtccaacgtttgaccgtccgt

SEQ ID NO: 21070 - DNA, 101 bp, rice(Oryza sativa)
  misc_feature (71): n=t or c
agggaataacacatatactgtactccataagtatccacttaaagagccgatcgagtgtatatactcgtatngtcttctaaggaggtcgccatccgatgctg

SEQ ID NO: 21071 - DNA, 101 bp, rice(Oryza sativa)
  misc_feature (71): n=a or g
tgaggccttggagaagaaaaggtgcgattattcaatctttctttctgcatgtccctccttctccttctccntcccctcccccggtggtgcagcgtgccata

SEQ ID NO: 21072 - DNA, 101 bp, rice(Oryza sativa)
  misc_feature (71): n=t or c
tggataggcttgtcatctgaaagttcctttattttctgaaggttatcactttccaaacctttgcatggagnatcgataaatgacttgctgtctcttgctgg

SEQ ID NO: 21073 - DNA, 101 bp, rice(Oryza sativa)
  misc_feature (71): n=t or c
ttgacacgttggtcagggactcacatttcattctcacaaatgatggtatttttcaactcatacatctttangatggtattctcctaatatttgctatctgc

SEQ ID NO: 21074 - DNA, 101 bp, rice(Oryza sativa)
  misc_feature (71): n=a or g
ggtgagggacggaagctcgatggcatctccccaccgatgagacaggttcatgaggaaccagaggaggcctngtgaggaagtggagtgtaacgccccgatat

SEQ ID NO: 21075 - DNA, 101 bp, rice(Oryza sativa)
  misc_feature (71): n=t or g
tccctagtcctcgggtcctgcaccctatgcaccacaccctcgacttcctcccgatcttgtcgaggcacttntagtgcttcatggtgggtggccacaatgac

SEQ ID NO: 21076 - DNA, 101 bp, rice(Oryza sativa)
  misc_feature (71): n=a or c
catttctaattttacgtgtccagatgcgaagatggaggcattgggagaacgccatcaaggcagatggagantttggtaggacaattacgatgaatatttat

SEQ ID NO: 21077 - DNA, 101 bp, rice(Oryza sativa)
  misc_feature (71): n=t or c
attcattgaagaagtattacaacatcgacagcacaacaactaatagctagcttggcacaactacagctcantgaaactcgatattgtactggaagcccaaa

SEQ ID NO: 21078 - DNA, 101 bp, rice(Oryza sativa)
  misc_feature (71): n=t or g
gacatgtcaaatacaattacagaagaatgctccacgccgctcaaaaaggaaagcgcaagctgcacctacanaaagggaaccaactgtggaagccgcatctg

SEQ ID NO: 21079 - DNA, 101 bp, rice(Oryza sativa)
  misc_feature (71): n=t or c
tatcgtaatatagtggagccatatgggtgctcataagacccgctttgtttaggattaggttttaaatcagntttttggcttatatgatttataagccagta

SEQ ID NO: 21080 - DNA, 101 bp, rice(Oryza sativa)
  misc_feature (71): n=a or c
attggatggttcatcatctggtcaacttcacctttcactttctagaatgaaggaaaagttaaaggatgatnctgttttgtttgatattctcatgttttatg

SEQ ID NO: 21081 - DNA, 101 bp, rice(Oryza sativa)
  misc_feature (71): n=a or g
atgaagggtgatagatctcctctttgctactagtgataagttctcaacaagcaactgagttcctctagtcncgccctagataccttaaccttcaatccgtg

SEQ ID NO: 21082 - DNA, 101 bp, rice(Oryza sativa)
  misc_feature (71): n=a or c
gcctcgcatatctttcctcattcctcgatgctcctccggtgtccggtggtggcgctcgtccgaaaccgcanggagggaaggacgcccgtgactttgtagcg

SEQ ID NO: 21083 - DNA, 101 bp, rice(Oryza sativa)
  misc_feature (71): n=a or g
aaaatgggaaaacccaaaagaatgaaacaacgtcaagtgaactacaaaaggcttcgcggcatatggtgagnatgtcagtggaccgcatggtgatggaccaa

SEQ ID NO: 21084 - DNA, 101 bp, rice(Oryza sativa)
  misc_feature (71): n=t or c
tggttcgaaagaagaaaggaagatctttgaggagctcttctgcagaacaggcactagcggagcaagcaccngccatccacgccgggatggaaagagcagtt

SEQ ID NO: 21085 - DNA, 101 bp, rice(Oryza sativa)
  misc_feature (71): n=a or c
ggctaccaaaaagcccgaaaggactaaagaaaaataaagaaaaaagcacagagggcgaagggcctcacacntcagggtggtcttggcctccgttgtttttg

SEQ ID NO: 21086 - DNA, 101 bp, rice(Oryza sativa)
  misc_feature (71): n=a or g
gctcaggaggtacaccatccctgacctggtcacctacaacatatggctgacatactgctcgaagaagaacngcgtgaaagccgcggagaaggtctacgatc

SEQ ID NO: 21087 - DNA, 101 bp, rice(Oryza sativa)
  misc_feature (71): n=t or c
tgtccgaacaacctacgtcggatgccgaacaagaagcattgctgacaaaccatagtgctattcaccatttntcctagctatatgattatcacagtgctatt

SEQ ID NO: 21088 - DNA, 101 bp, rice(Oryza sativa)
  misc_feature (71): n=a or g
gcaataattcgttacgtaattataaaatcggattctttgtcaggtagttcgctaatctcggatagatccgnaacagttgtttgctaaccccaacttgattc

SEQ ID NO: 21089 - DNA, 101 bp, rice(Oryza sativa)
  misc_feature (71): n=t or c
cttagaacacatgttcttcctcctctcttccactatttcaatctccctctccatctcatctcaattccttngatccatcaccttcaacccacaaatgactg

SEQ ID NO: 21090 - DNA, 101 bp, rice(Oryza sativa)
  misc_feature (71): n=a or g
tgcctgtgttatccttccgtagtccttaaatggcgtgagtcccttctggacatatttcttattcaggttcnttttccagtttcgccacagcttccccatag

SEQ ID NO: 21091 - DNA, 101 bp, rice(Oryza sativa)
  misc_feature (71): n=t or c
tgcctttatcagaggccgttccatccatgagaatttcatttttgtgaaggggttggccacacaattccatngaaatcacaaggcgatgcttcttttcacac

SEQ ID NO: 21092 - DNA, 101 bp, rice(Oryza sativa)
  misc_feature (71): n=t or c
atcaaaacatatgtttttttaatctgatggtgtcactaatcatgtcactagcacaggcgagtactttctcngtccaaaaataaccgaatctactatctccg

SEQ ID NO: 21093 - DNA, 101 bp, rice(Oryza sativa)
  misc_feature (71): n=a or g
aagtgcattaggcgaaaaccatgcaggtatgtattccacagaagaggagagaaggcagaaggctaggtatnatgttaaaggcaaagggaagctgtatttgg

SEQ ID NO: 21094 - DNA, 101 bp, rice(Oryza sativa)
  misc_feature (71): n=t or c
ctaacctcctcgaccaaactaacatcgatagataaatctttgacactccgagtagttgagtaatccttganactctgaatagaactagtaaacttcctttc

SEQ ID NO: 21095 - DNA, 101 bp, rice(Oryza sativa)
  misc_feature (71): n=a or c
ctagatacttctttccgtcgatatcatatacatacgaaccctgcatgtataaggtaaggtgagcatctganaaatatagttcaccccttctattttggtag

SEQ ID NO: 21096 - DNA, 101 bp, rice(Oryza sativa)
  misc_feature (71): n=t or c
agatgtacctgtattttgtgtgccatagatcagtacgtagaaaacaaacccaacccagcccgttcttcaanatgcgatctgcttaccatctgatgcctccg

SEQ ID NO: 21097 - DNA, 101 bp, rice(Oryza sativa)
  misc_feature (71): n=a or g
atgatcatcagaactgatactctgtccatctatagcagccttcccaacaagtagtgctatcagaactggtnccccaactgtctttttgagattccaaaaca

SEQ ID NO: 21098 - DNA, 101 bp, rice(Oryza sativa)
  misc_feature (71): n=a or g
gcatcctgtcaactcaagttcagatgttattgaactaatgagaacaggacttgagaacagatctgtaggcncgacagcattgaatgaaagaagcagcaggt

SEQ ID NO: 21099 - DNA, 101 bp, rice(Oryza sativa)
  misc_feature (71): n=a or g
cgcacgcaacagagaaaaaacacccatgcaccgcatgcatgctagtagcttgtaccgatcgaagatacctngctggctacctaactcatcgtcgtgcatgc

SEQ ID NO: 21100 - DNA, 101 bp, rice(Oryza sativa)
  misc_feature (71): n=t or c
gaaaactctttaaagatggaaggatctgcattcacatctgagcacaaaacttcattggatgccccatcatnctcaaaagcacaagaacaatttccaagctc

SEQ ID NO: 21101 - DNA, 101 bp, rice(Oryza sativa)
  misc_feature (71): n=a or g
agaagtggaagaggaaaacaaaaggagatcatatattcatatgctccttttgggttaggctcagattctcnaattggcggtcttgatattatgcaaaagta

SEQ ID NO: 21102 - DNA, 101 bp, rice(Oryza sativa)
  misc_feature (71): n=t or c
acttttcgtaggataaaaaaactaacaagtaggtgctactgtactatcttcctccagagaggccactcatngtgccaatggtcatcatcgtctctgatgga

SEQ ID NO: 21103 - DNA, 101 bp, rice(Oryza sativa)
  misc_feature (71): n=a or g
ttgcttgatgaagactaaatattgttgtttatccatgaagagaatataccggcgatctcaagctaagtccnaaacattagagaagctagtgcctcaccttg

SEQ ID NO: 21104 - DNA, 101 bp, rice(Oryza sativa)
  misc_feature (71): n=a or g
gtgcgcgcgtgtgtgggaagaacgagatgaagagagacaggagaatggtagggtttatatatagagctagnaaacaggaagaggatttgatttgagtcaga

SEQ ID NO: 21105 - DNA, 101 bp, rice(Oryza sativa)
  misc_feature (71): n=a or c
caaaggtgtaattcatcttccatatctgcaggtatcctgcgattcttcaaaatctaaaaatggattactancgctacttcgtcccgagtgttgtggcaatt

SEQ ID NO: 21106 - DNA, 101 bp, rice(Oryza sativa)
  misc_feature (71): n=t or c
cttgattttgatgagtttgctcttccggaattctcataaggcagcaagatgtaaaatgacaaggaactganttcctctaaagtttgaacacgagttccttg

SEQ ID NO: 21107 - DNA, 101 bp, rice(Oryza sativa)
  misc_feature (71): n=t or c
ttgtgtaaagtgtcagattctaatggtgcgcaaaagttcatgtggtctggttcagtgcttggtacaaaacnactctgatgcacaccattatgatgcataac

SEQ ID NO: 21108 - DNA, 101 bp, rice(Oryza sativa)
  misc_feature (71): n=a or g
tgggatttctatcatggagtcgattggagtgcacttcagcaacgcccccatgcgagtggttgcttgatttnggcaagggtggtgctcatgacacccatgtt

SEQ ID NO: 21109 - DNA, 101 bp, rice(Oryza sativa)
  misc_feature (71): n=a or g
acattttagctacacaccacctgtttccaccatgtgtgtatcccctaatacaaacttagacactggcatcngcttaaactcgacctaaagtaaagtaaatt

SEQ ID NO: 21110 - DNA, 101 bp, rice(Oryza sativa)
  misc_feature (71): n=a or g
tgcgtggatgaaaaaataattaagtggaggggtagtggttacgtgaactgcaaatggaggtgaaatgtccntatgcgggcctcttaacagtcctgcctacg

SEQ ID NO: 21111 - DNA, 101 bp, rice(Oryza sativa)
  misc_feature (71): n=t or c
taagtaaacttgtatttagaaaaatcttccccaattgcttgacttctcttgtgcctgtataaaggtccgangattggcgatgaagaagaaattcttcgaat

SEQ ID NO: 21112 - DNA, 101 bp, rice(Oryza sativa)
  misc_feature (71): n=a or c
cctggtgaatttcctcaaggaagtgcaaggattaatccagttaatgggcaccaaaatggcgggcagatgancatactgcgaccacttccccgtgctcgttc

SEQ ID NO: 21113 - DNA, 101 bp, rice(Oryza sativa)
  misc_feature (71): n=t or c
tacttcatttgggaaaaaaccgccaccgttcacaatgtataggtcatcaaaatgctttaccagtgaaaagntcatcccatatattctcactgagccgttcc

SEQ ID NO: 21114 - DNA, 101 bp, rice(Oryza sativa)
  misc_feature (71): n=t or c
aaataatcaaagaattaatcaggataggatggcacgaatcttatagcatcgaagcacgaatcttggcagcngggatagtccgatagcgcccaagcggatag

SEQ ID NO: 21115 - DNA, 101 bp, rice(Oryza sativa)
  misc_feature (71): n=a or g
tctagtccatatgacaacaattcagtacctgtagtaatttgggctgcttggagagtatgcatgtgaaggcntgtacttgaccgaagaaggattgtagcttg

SEQ ID NO: 21116 - DNA, 101 bp, rice(Oryza sativa)
  misc_feature (71): n=t or c
tttcaaactgggccttcaaacccgataaaatcttatattcctccgttccgtttccaagagacctcatgctnttttacatgtttcaaacagcagttgtgttt

SEQ ID NO: 21117 - DNA, 101 bp, rice(Oryza sativa)
  misc_feature (71): n=a or g
tccaatctccataaaaaacacaacgaagctctacacatcgcttttctggccatttgtaatcctaggcaccntaagatacgtactccctccgtcccaaaaaa

SEQ ID NO: 21118 - DNA, 101 bp, rice(Oryza sativa)
  misc_feature (71): n=a or c
aaatcttggaggttctgaacagtgatcctgtctcaatagctaccgagtactatacaactttcgtaagggantgccatactgaggataaggtataatcagga

SEQ ID NO: 21119 - DNA, 101 bp, rice(Oryza sativa)
  misc_feature (71): n=a or g
atataatggatggaattatacatggatgcatgtagagtaagagtagtagtagctgctaggtcccgacgtanccgaagccgacgatgaaggcggcggccgac

SEQ ID NO: 21120 - DNA, 101 bp, rice(Oryza sativa)
  misc_feature (71): n=t or c
ctgaaaaataggctggaaagagctttctcttccagaaataccccaagctcaattttcttctctacacaacngaaaggtggagcgttggcgaaggaccaacc

SEQ ID NO: 21121 - DNA, 101 bp, rice(Oryza sativa)
  misc_feature (71): n=a or g
caatacaaaaactgctatttacaatcggaagggtgctcaggtcaagtcaatctcttcatcaaaaactgcancccagcggtggactgggcaaatggcagatt

SEQ ID NO: 21122 - DNA, 101 bp, rice(Oryza sativa)
  misc_feature (71): n=a or g
tgagccgaccgtacctcagaaagaaacgactcaagtggcggacacccaagacatagctatgattgaagccnactggagagagcccctcatacaatttttaa

SEQ ID NO: 21123 - DNA, 101 bp, rice(Oryza sativa)
  misc_feature (71): n=t or c
gcctcgcacgccaggaagcgaacccccatggctgcgccgatgtccctcacgaagtgctccgtggggacctngctgacggccaccggaatagccatggctgc

SEQ ID NO: 21124 - DNA, 101 bp, rice(Oryza sativa)
  misc_feature (71): n=t or c
acgggatgtaacacatcctaatactataatcgtttaggatgtgttacatctgtcagcaggcgtggtgcaangctttcacctccactggaccaggcaccttc

SEQ ID NO: 21125 - DNA, 101 bp, rice(Oryza sativa)
  misc_feature (71): n=t or c
tgcgccttgtaataaaaagaaagaaaaatgttgctcgtcaagggattcgaaccagggtttaccttaccgcnggtaaccgcgcggttaccgcggttaccggg

SEQ ID NO: 21126 - DNA, 101 bp, rice(Oryza sativa)
  misc_feature (71): n=t or c
tcttggaggtggatccgtacaaatggcctatgccgtctcatcaagcattgctgctaacgccccagaggtgnctaatgggcaggatccctatattacagagg

SEQ ID NO: 21127 - DNA, 101 bp, rice(Oryza sativa)
  misc_feature (71): n=a or c
cttaaaattatcggtagtgtgtatttctaaccgcacttatattctccgcaatcaataccaaggctcagttncattcttcaactccaaacttcaacttcctc

SEQ ID NO: 21128 - DNA, 101 bp, rice(Oryza sativa)
  misc_feature (71): n=a or g
acgaattagattcggcctattttaatgggaatcaaagtggactttttctgttacggaaatgctatataccngtataccgttggacgggatacccttcgtcc

SEQ ID NO: 21129 - DNA, 101 bp, rice(Oryza sativa)
  misc_feature (71): n=t or c
ggtggggatgacggttgaaggacgacgatggtgattgggcttttgccatgatggtcagcattgggagccanggggtttaattaccctgacttgttggcgcg

SEQ ID NO: 21130 - DNA, 101 bp, rice(Oryza sativa)
  misc_feature (71): n=t or c
tgcgaccgcaaccgcctcttcctcttcctcttcttcatcttcatatataccatcagcggcactgaacgctntctgcatgccaggccgctgtgttgccggac

SEQ ID NO: 21131 - DNA, 101 bp, rice(Oryza sativa)
  misc_feature (71): n=t or g
tgcttgctttgctgctacttccagggggtaggaatagttactccgtaaagaccgtaatactctctctttgnaaaaaaaaaaactaacctagatgaaaatga

SEQ ID NO: 21132 - DNA, 101 bp, rice(Oryza sativa)
  misc_feature (71): n=t or c
tttgtcaagcaattccatgatgtctgacttgataacctcccagcaacatctgaagaaggtgcctgtgaagncgtctggcccaggtgccttctcagcaagca

SEQ ID NO: 21133 - DNA, 101 bp, rice(Oryza sativa)
  misc_feature (71): n=t or c
ggcccttctgtatcatcagcactcagcatactgagttctgccggatcagaaagcaacttagtcctatctgntccatcagcaataattttctgggacataag

SEQ ID NO: 21134 - DNA, 101 bp, rice(Oryza sativa)
  misc_feature (71): n=t or c
ctatcgcttacactcacccggatctttcccaaaccaaccttgccaaccccagatcgagcatctgagcagcngccggcacactctgcctcctcctcctcctc

SEQ ID NO: 21135 - DNA, 101 bp, rice(Oryza sativa)
  misc_feature (71): n=a or g
ttcctggatctagccatgttggaacatatggccacaatgccttgcatgctactgtgagaaatggaaatgcnggtgagaattatatggactatggactaaat

SEQ ID NO: 21136 - DNA, 101 bp, rice(Oryza sativa)
  misc_feature (71): n=a or g
cttcaaatagattaagttgagtgtatacagagtatctcattgttttgttaacgggtcattataagccgtancactaattgatgacttaaaatttaatattg

SEQ ID NO: 21137 - DNA, 101 bp, rice(Oryza sativa)
  misc_feature (71): n=a or g
cttttgttattggtcatgatgagcgacaattttgtaacgagtagttgtagcttttgttgaagccaatgtcngattttatccattaattatctaaaaataac

SEQ ID NO: 21138 - DNA, 101 bp, rice(Oryza sativa)
  misc_feature (71): n=t or c
tggcagtagcacagatgtgaagaagacggtggcggcgcagatggggaagaaggaagcaactacacatgccnaggtaagaagaaggagaacgagggtaattt

SEQ ID NO: 21139 - DNA, 101 bp, rice(Oryza sativa)
  misc_feature (71): n=a or g
gactagtttcatttgcagagatgcagtcccttcttccaggtcttgttcgcttcatttccgttttgctgtcntccgaagattgaagcaacaatcaagcctcc

SEQ ID NO: 21140 - DNA, 101 bp, rice(Oryza sativa)
  misc_feature (71): n=a or g
ccaaaggtgacgctgataataatatcatcttcaatgataaggtccatgagattcccaaaactccagaaccngagagcgccttctgcaaatgaatggtagca

SEQ ID NO: 21141 - DNA, 101 bp, rice(Oryza sativa)
  misc_feature (71): n=a or c
gtttgttcaaggccagactttcctggaagctaaaggaactggaagcttgaaaaagagaagaattgagcagngtatggaacaaggtcagacaattaaagatg

SEQ ID NO: 21142 - DNA, 101 bp, rice(Oryza sativa)
  misc_feature (71): n=a or g
gtacttgcatttctggccattatcagatcgatgatcttcgcttagctagagcacttgaaataacacaagcnccagcatatatattaattacaattaatcat

SEQ ID NO: 21143 - DNA, 101 bp, rice(Oryza sativa)
  misc_feature (71): n=t or c
caacttaacctacacctgcctataacgactcaggcatcagaaaacgtgatctgatcatatgcgtgtgatgngaaatggaaggatcgtcgtaacctggtagg

SEQ ID NO: 21144 - DNA, 101 bp, rice(Oryza sativa)
  misc_feature (71): n=t or g
cacctccatttgtccagaattatagttagggatcttgatactagtcacaagctttctgtatggaaggacancaaacatggtcagtgatagagaaatgctag

SEQ ID NO: 21145 - DNA, 101 bp, rice(Oryza sativa)
  misc_feature (71): n=t or c
actttttatttatttaacaggtgcccaggttcatagactctagaaaatgggtggtattcagaggacgaagnaaacataaggccttgtttagattgaggaaa

SEQ ID NO: 21146 - DNA, 101 bp, rice(Oryza sativa)
  misc_feature (71): n=t or c
atgcatgacgacaaattaaagcacgcaagagcatctgctgctgtctaaatttagcccgtgtgaggtggcgncgtcctatcatatcggatgaatttagagaa

SEQ ID NO: 21147 - DNA, 101 bp, rice(Oryza sativa)
  misc_feature (71): n=t or c
cttggcgatctccagcacagccgcgaaaccggtgatgaccgctagaaggaagaagaaagggaaggttgtgnaggtcggcaatggcttttcggacaacgagg

SEQ ID NO: 21148 - DNA, 101 bp, rice(Oryza sativa)
  misc_feature (71): n=a or g
acaaaaatgatgactctgaaaaagttggcagcaagggggtgactggaaaaccaagaaggcaagctaacccnaagaagaaaacatccagtcgtcccatgccg

SEQ ID NO: 21149 - DNA, 101 bp, rice(Oryza sativa)
  misc_feature (71): n=t or c
cgaagtgaagtgaaggcctatcgcctccgtgagacgtggacacgtgtcacacgtctctctctctctctctntaaccaccgccttcctccttttctcggggt

SEQ ID NO: 21150 - DNA, 101 bp, rice(Oryza sativa)
  misc_feature (71): n=a or g
catcatggtcaaatgttcatgtcctaaacattgatctactattgcctgggatctgtgaagtacaattatanttcagcaacaactcgtggttcttaagcctc

SEQ ID NO: 21151 - DNA, 101 bp, rice(Oryza sativa)
  misc_feature (71): n=a or g
gtgtggcgtgatacatttctccagtctgatgacacccggattattaccctatctgcctatcaacccatagntcgaggcatgttaaaacattcgtggtatgt

SEQ ID NO: 21152 - DNA, 101 bp, rice(Oryza sativa)
  misc_feature (71): n=t or c
tacagtgacagaattcctgtaagcttgctcttcatattgctcagttatgttgtttccttcattgtggtttntttgctctaatttgttacatatctaatgta

SEQ ID NO: 21153 - DNA, 101 bp, rice(Oryza sativa)
  misc_feature (71): n=t or c
gaagcacacgacaatctatatggttgtgtttcaaacttcaaactcccctccaggattcagcaaacttcaantggcctcacccgcggcggctgcggccgccc

SEQ ID NO: 21154 - DNA, 101 bp, rice(Oryza sativa)
  misc_feature (71): n=t or c
taggtcaaggagctggaagcgggagcaccctagcgtgaagagcctactgccgatctggaagtatactgggncgccgtgctgatcgccgccgtgccgaggga

SEQ ID NO: 21155 - DNA, 101 bp, rice(Oryza sativa)
  misc_feature (71): n=t or c
ataaaagaaagcaaaacatcacaaaacactagctttttttaagtagagaaccaatcggttttcatttaatntggtggacccattattttcaattattagat

SEQ ID NO: 21156 - DNA, 101 bp, rice(Oryza sativa)
  misc_feature (71): n=a or g
tcccgggaagggaagactcacacatgcattaagttttagttaaattaaatttacacatggcagtcctaccnatggcggcaccactataggcactcgcccct

SEQ ID NO: 21157 - DNA, 101 bp, rice(Oryza sativa)
  misc_feature (71): n=a or g
aggcccccttgtgatgcaagatccaggctcagaagtagaccagattcctgccttcatcttcggtgaaagcngaatagactcaacgcaatagattggattga

SEQ ID NO: 21158 - DNA, 101 bp, rice(Oryza sativa)
  misc_feature (71): n=t or g
gtttaggaggcatacttggttttgaggcactgaacttatgtagtattcctcatctctaaagctctgtaacntccgcttattaccacaaacatctgaaatgg

SEQ ID NO: 21159 - DNA, 101 bp, rice(Oryza sativa)
  misc_feature (71): n=a or c
tcaatttgatgtccggccttgggttcagtctgttaagattatatagtttcacgcagcatacacacacacanaaaaaaagagaaactgttttatagcatttg

SEQ ID NO: 21160 - DNA, 101 bp, rice(Oryza sativa)
  misc_feature (71): n=t or c
tttttaaaatttaaaatttgagggtcccaatttgcatttcgttccgggcctccaaatcgtagagatggccnggccctactatttaatgctaccatcaattt

SEQ ID NO: 21161 - DNA, 101 bp, rice(Oryza sativa)
  misc_feature (71): n=t or g
ccatcggttcacgacgtcatctagcgtgtctctgtgtgagagatagggtcatttgattgataaattttcangattttacagagttgacaaaataacgggga

SEQ ID NO: 21162 - DNA, 101 bp, rice(Oryza sativa)
  misc_feature (71): n=a or g
gacatacttgcaaatcgatatcaagatatactagtagaactatttctagcgagcgggccgtttacctgatnttgttttcaagctttcttgatctccgacgc

SEQ ID NO: 21163 - DNA, 101 bp, rice(Oryza sativa)
  misc_feature (71): n=t or c
ctacatttttttgttgcaccaggaattattgattttaccatgacttccgagggcacatgcacaacccagtnccatagtgcagatggttttgaagggcacca

SEQ ID NO: 21164 - DNA, 101 bp, rice(Oryza sativa)
  misc_feature (71): n=a or c
aacataatgctggtcgaaactggatggaaacgcacccactttgaacttcaaatctatgaaagaatccctcnttacagcaaccaccgacctctttaaatcac

SEQ ID NO: 21165 - DNA, 101 bp, rice(Oryza sativa)
  misc_feature (71): n=t or c
aaatttgcttgagctgaacagtttgtctccctccttttccttttcagctgcagcttcgatggtctctgctngactcatgagccggggaggcttgtcctaaa

SEQ ID NO: 21166 - DNA, 101 bp, rice(Oryza sativa)
  misc_feature (71): n=t or g
ctgcgccggcggacctcggccaggatctggtcggcatcgcggctgtggtattgcaaacagatttgtggatnctatgatggccgtgcgccgttcagccgttg

SEQ ID NO: 21167 - DNA, 101 bp, rice(Oryza sativa)
  misc_feature (71): n=a or g
ggggattggtttctttccctccaatttgacccgccatgtttcttcgggatttctttctttcgatgcgtttntgcttcgctgatagtagtagcggtttgttt

SEQ ID NO: 21168 - DNA, 101 bp, rice(Oryza sativa)
  misc_feature (71): n=t or c
tgacaattgagccgacaacaatcttggccgacgcgttgttcagtgtttgatacaagtagccgagaaggatnttgcctaagggaaattgcttgctggagcat

SEQ ID NO: 21169 - DNA, 101 bp, rice(Oryza sativa)
  misc_feature (71): n=a or c
gtcagtccaaatactccgtcacagtgtcttgtcttatgcaacactatacttgatcacgggtcatagctttntcatcatttggagacggtcctgcatcgcac

SEQ ID NO: 21170 - DNA, 101 bp, rice(Oryza sativa)
  misc_feature (71): n=a or g
aggaagagggacatcctccctgcagcaggcaaacaatgttgacagaaaactagatgatgctgatccacgcnctgccagaaattattgtgcacctcaaatta

SEQ ID NO: 21171 - DNA, 101 bp, rice(Oryza sativa)
  misc_feature (71): n=t or c
ctacgagttcactagatatgatcgcaagcttgcagaggtccagtgacgaggagtcgtgacgacctttgctncgattcctatctcttgtcatcccctccatg

SEQ ID NO: 21172 - DNA, 101 bp, rice(Oryza sativa)
  misc_feature (71): n=t or c
aggaatcatctattgatcctttcatatctctcagggctaatttcgatatgtgcggttatatgtgggctgtntacccaagctctacttagcagcacctcggc

SEQ ID NO: 21173 - DNA, 101 bp, rice(Oryza sativa)
  misc_feature (71): n=a or g
gtcgaacaccgtcatctcgactgccagactcttgccttcccgttgccgactgacaaagggcaatgtgacgnccccgtcggtgccgaagacgttggcccccg

SEQ ID NO: 21174 - DNA, 101 bp, rice(Oryza sativa)
  misc_feature (71): n=a or g
tcagaaataacatgtatatgtccgaaacaggagataggagtctatgacttactagaaatgaccaaaggatncgctaggtcctagcggcgctgatgttggtc

SEQ ID NO: 21175 - DNA, 101 bp, rice(Oryza sativa)
  misc_feature (71): n=a or c
agttctggcttgatcagcccgtctaattggattgtttcccatattggcctgcaaatcatagctgaactgancagttttcctacagcctggtggggttaact

SEQ ID NO: 21176 - DNA, 101 bp, rice(Oryza sativa)
  misc_feature (71): n=t or c
catgagccctacgaggacaaagaaaatattgacccaaacgcgcaacatggagatgatttgcttagtgctanacaactaaacaagaaggaggttcagtcaaa

SEQ ID NO: 21177 - DNA, 101 bp, rice(Oryza sativa)
  misc_feature (71): n=a or g
gtggccgaacagcggctcggaggttgatcggatccacgtttctttccctgcaatcctttaccctaaacacncacggacgcaaaagcaagagctgcctaccc

SEQ ID NO: 21178 - DNA, 101 bp, rice(Oryza sativa)
  misc_feature (71): n=a or g
tatcttgagctgctgcttttctacaacggtgaaaacattgtgtgggtatggcatcttatttctccaatctnaaggttacttcttcgttgggagcttgctcc

SEQ ID NO: 21179 - DNA, 101 bp, rice(Oryza sativa)
  misc_feature (71): n=t or c
gacatgctcaatatctataggacattcaggatctgcatgatggtggcatctatcagtggtaaacttgaaangcgcacatctcgaagcccttttgtcgagct

SEQ ID NO: 21180 - DNA, 101 bp, rice(Oryza sativa)
  misc_feature (71): n=t or c
gatatatgatctcatccatatatatggagagatcggcaaccaattcaggacacgacagttgtgttgtaccncacatctttctcaaactcacggcgatccta

SEQ ID NO: 21181 - DNA, 101 bp, rice(Oryza sativa)
  misc_feature (71): n=t or c
gtcctcgtcgtgatctcctgcacaacaccatcaccaaccttactcttgcagctctccccttcgctctgagntcgctggccgaccccggcgtcggccgccgg

SEQ ID NO: 21182 - DNA, 101 bp, rice(Oryza sativa)
  misc_feature (71): n=t or c
gtgaccgcggctgtataattgttaggattggcgatcctactagacatggtcaaatccgtggtggttcttgnatcaggcagcgacgagccgactccggccaa

SEQ ID NO: 21183 - DNA, 101 bp, rice(Oryza sativa)
  misc_feature (71): n=a or g
aaaccatacaatgctttatccaatttacatacataattaggtttagaggatgactcaaaaccaggaggttnttgcatatagacttcttcttgtaagaatcc

SEQ ID NO: 21184 - DNA, 101 bp, rice(Oryza sativa)
  misc_feature (71): n=t or c
ttgtcggtgatcgggaaagacaagcctactacattatgaaagaccgggtgtttgctcacacgcgggcatangatccggagctattaaaaaagataggtatg

SEQ ID NO: 21185 - DNA, 101 bp, rice(Oryza sativa)
  misc_feature (71): n=t or c
tccaccatcattagctgctagctggtgaccaccatcgtcgctcccactctgcctaggccgtgtttagtttnccccctattcctaactttccatcacatcat

SEQ ID NO: 21186 - DNA, 101 bp, rice(Oryza sativa)
  misc_feature (71): n=a or g
gaggcgtgcgtgtgcgtacgtcctcacgctgatgaggcaagcaggactgaactgggctcctatcgtggttntggttgtaggctgttcgtgcttcaatggcc

SEQ ID NO: 21187 - DNA, 101 bp, rice(Oryza sativa)
  misc_feature (71): n=a or g
tagtggccactgattaattatgatagaatcctgtttgtccgtgatctgacagaacatctgggtatggaggngattgaaacttttggccacttcccttcaga

SEQ ID NO: 21188 - DNA, 101 bp, rice(Oryza sativa)
  misc_feature (71): n=a or g
caggatggatgctgctgcgattcactagactgcaggcagcttccggccgggtactacactgtggtatagtngtgtccatcttttaactcgacgcaacgcaa

SEQ ID NO: 21189 - DNA, 101 bp, rice(Oryza sativa)
  misc_feature (71): n=a or g
atgtagattaggatgcgtttatgcatgcggaatcttggacatgtctaagcaatttctttactttcacgatnggtgttgcagtttcttttctcgtggacggt

SEQ ID NO: 21190 - DNA, 101 bp, rice(Oryza sativa)
  misc_feature (71): n=t or g
ttctcctacacttcaaatgcactgtctttggatagataaaatttgagaggatgtggaaattttcagcaganaagatcatattttgttgaacattgcattgc

SEQ ID NO: 21191 - DNA, 101 bp, rice(Oryza sativa)
  misc_feature (71): n=t or c
tggaaatcatgcaaccatcagaataaaagaacctatcagaagcacatatcaaatcatgcaaccatcagaanaaaagatttttacagttctatcaccatagt

SEQ ID NO: 21192 - DNA, 101 bp, rice(Oryza sativa)
  misc_feature (71): n=t or c
gaaaggaaggtatgatagataggcatctcttaagtttcgattttatcctcttgccttgctgccacattaancttgaaaaggacaagggaaatgttcctcgt

SEQ ID NO: 21193 - DNA, 101 bp, rice(Oryza sativa)
  misc_feature (71): n=t or c
gcatcctgggcatgtgtctcactcccttggactgggattgtgaaattctccaccgtaaactccacatacgngtcctgatctccttcttcatcagtgttgct

SEQ ID NO: 21194 - DNA, 101 bp, rice(Oryza sativa)
  misc_feature (71): n=a or g
cgcggttgacaaaccggctcttctggtagtcgttgatcttgatgacctgcttccagtagttggccacctcnggaaggccattgcactcgcagatgtacaca

SEQ ID NO: 21195 - DNA, 101 bp, rice(Oryza sativa)
  misc_feature (71): n=t or c
gttttgttattggtgtagttgctatcattttagaggttcccatctcgcaatttaggtccatcgtttgtggnagcagaaaactgttcgttgactaaggtcag

SEQ ID NO: 21196 - DNA, 101 bp, rice(Oryza sativa)
  misc_feature (71): n=a or g
ttgtagaaacttaaccttaagaacgaaaggagcaatggagctgaacactaaagatgctactgcaaatccantgaagagacctatctggaacaaagagaagg

SEQ ID NO: 21197 - DNA, 101 bp, rice(Oryza sativa)
  misc_feature (71): n=a or g
tgtgagatgtatatatgggcatacccttggtattggatcaagctggttagcattgtttccaaagtcgatgnccaaaaaagcaaccataggagaatcaccgt

SEQ ID NO: 21198 - DNA, 101 bp, rice(Oryza sativa)
  misc_feature (71): n=t or c
ggaagtcgtacctagttatttaacgttgtttgtgttgatagccgtgatactggcacgaatgtgcaggcatngtgagctgtaattttcgatatatgcaacaa

SEQ ID NO: 21199 - DNA, 101 bp, rice(Oryza sativa)
  misc_feature (71): n=t or c
aataggaacatcaagataatgatcaagaaagttagcattctgttcaggatcaagaagttccaacagtgcantggctggatcaccagaataccctctcccta

SEQ ID NO: 21200 - DNA, 101 bp, rice(Oryza sativa)
  misc_feature (71): n=t or c
gctcagtccttggggatgattccggcaattgccaatttgcaccagcaagcatcctttggcgatgtatcttnggaagatcgtggtaatctcatcaaggaaaa

SEQ ID NO: 21201 - DNA, 101 bp, rice(Oryza sativa)
  misc_feature (71): n=t or c
cttgatctctcttttactggtatcaaagatctcccggaggcatttggtaatctataccatctccaggtacntgatctgcggggttgtataattgagaagct

SEQ ID NO: 21202 - DNA, 101 bp, rice(Oryza sativa)
  misc_feature (71): n=t or c
caatttctgcaaccatgtcatataccggctatcaaaatgataagcataaagggatgccaggagttatcgtngatatcagctgaaagatttggaggttttcg

SEQ ID NO: 21203 - DNA, 101 bp, rice(Oryza sativa)
  misc_feature (71): n=t or c
gccttctgtctgacggtcagacttcctgaccggaatcctctcggacacaaaaatatgacgtgtcatggaanacaggcattctgtcttttttttttaaggct

SEQ ID NO: 21204 - DNA, 101 bp, rice(Oryza sativa)
  misc_feature (71): n=a or g
ccatcttcttttggtcagaacttggctgctgctgcatgtacacaaaacgcgtatactagcaggtacaatancagactataagccagctataaacacatttc

SEQ ID NO: 21205 - DNA, 101 bp, rice(Oryza sativa)
  misc_feature (71): n=a or g
ttccaatacactttgtcgtgaacagctatatttccccgacttgatcaagggtgtgtttagttgggaaaagnaaatttttggtgtcacatcgaacgtttgac

SEQ ID NO: 21206 - DNA, 101 bp, rice(Oryza sativa)
  misc_feature (71): n=t or g
gattgagggtgagctgaatttgaatttcacctgatgcaatgagctgatgaacttgtgtgcattcaccaatngtgcggcacatacgatgtctgattctatca

SEQ ID NO: 21207 - DNA, 101 bp, rice(Oryza sativa)
  misc_feature (71): n=a or c
ttagccaagatcgagcaacagtaactgtagaccactgacaaaacattgcatgcaagcgaaagcaacacaantgttcttgcatgctactcaagcagaattaa

SEQ ID NO: 21208 - DNA, 101 bp, rice(Oryza sativa)
  misc_feature (71): n=t or c
tcgatattctggaaattttgaattggataaaccatgagatgagaaatgaggcgatcaattgctcaaaattnggtaggtttgtttgaaattcaatgatattt

SEQ ID NO: 21209 - DNA, 101 bp, rice(Oryza sativa)
  misc_feature (71): n=a or g
attgaaataaattaggagtaaaagttaagctctgtttagattccaacctattttttagactcgatcatatnaaacgtttgaacatatgtagagcctttggg

SEQ ID NO: 21210 - DNA, 101 bp, rice(Oryza sativa)
  misc_feature (71): n=a or g
gtggccatatggggagaaggaatagtacgtggggctcactatccgtaagtgattttggatagacaagtttngccaatgaggtgagagatttgggcagtcgg

SEQ ID NO: 21211 - DNA, 101 bp, rice(Oryza sativa)
  misc_feature (71): n=t or c
agacaatcaaaaccatccctgcctcctaataggaaaattccccacggaaaaacaggaaacgaggctccatngccatctctaataccactggccatggcatg

SEQ ID NO: 21212 - DNA, 101 bp, rice(Oryza sativa)
  misc_feature (71): n=t or c
gtaattctgtcccgcgcggaggtggtgtggcgggagatgctggtggcgagttgagcccgtggcatagcagnctcacgacggaggctacgaggttggccttc

SEQ ID NO: 21213 - DNA, 101 bp, rice(Oryza sativa)
  misc_feature (71): n=a or g
caaacaaggaatgcatatgacttatcttggttcaggctctgttactgtcacatcatttagtgacatggccntcgagtgcttggccgtggagtcggttacag

SEQ ID NO: 21214 - DNA, 101 bp, rice(Oryza sativa)
  misc_feature (71): n=t or c
ccattgtcatgccaacacaccgagaggattgcattatgttacgggctaatttccgtgcgtgttcatgatcngatccgtatctcaaagaattttaggatgtg

SEQ ID NO: 21215 - DNA, 101 bp, rice(Oryza sativa)
  misc_feature (71): n=t or g
acaaatcaataaaaatggtcaagcctttcatacagatagatcaggtactaaactatacccaatcattttgnacagttctaacgatctaaactaaaccacgc

SEQ ID NO: 21216 - DNA, 101 bp, rice(Oryza sativa)
  misc_feature (71): n=t or c
ccaatagcaccagcaacatccccaacgagttcataaacatagcttctgtcgagaaacgcccgatcattttngcgctctgcatgaagatcgacttctccaga

SEQ ID NO: 21217 - DNA, 101 bp, rice(Oryza sativa)
  misc_feature (71): n=a or g
ccgttaatatgcagtatctacccaagctacaacactgctccctgtagcattcgcacggtcggtggtatctngtactgaattgtagcagtatagtagtacag

SEQ ID NO: 21218 - DNA, 101 bp, rice(Oryza sativa)
  misc_feature (71): n=a or g
tagaggaaaataagttagccatttgcttcggtagcgacatagtacgaagtacgcctactgacctgggggtngcttctgccaggcgtggtgccacggattgg

SEQ ID NO: 21219 - DNA, 101 bp, rice(Oryza sativa)
  misc_feature (71): n=a or g
tcaaaagctagaaacctatcttttgtctattctcactagttgattagtactagaaagcttctgcgctcagnaaatgtggcatcgatagtcactcggcctgc

SEQ ID NO: 21220 - DNA, 101 bp, rice(Oryza sativa)
  misc_feature (71): n=a or g
catctcctgtgttgatggtgcccttgtggcctgaaaagtcatggtaactgaagcctccctgaaaacaacanattaaaattagttaagaacaacagttaatt

SEQ ID NO: 21221 - DNA, 101 bp, rice(Oryza sativa)
  misc_feature (71): n=t or g
tgtttcgaaatttagtgctcgaggcttggttgaagaatttgtttgtcttggtatccaaccgctcacggccngatggaatatttctctagggcagatgctga

SEQ ID NO: 21222 - DNA, 101 bp, rice(Oryza sativa)
  misc_feature (71): n=a or g
gacgactgtgtcgatatctcttgatattaacgaagttattacggacgtcccgctgccgacgggtatgtacntcggttaccactgaaaaaataaatagtcgt

SEQ ID NO: 21223 - DNA, 101 bp, rice(Oryza sativa)
  misc_feature (71): n=a or g
gcagcggctagtcgcaggcagctactgtacctggcaggcgagcaggcccattgtatctgctcttatcacangttacaagacaaatacattaaatatgtata

SEQ ID NO: 21224 - DNA, 101 bp, rice(Oryza sativa)
  misc_feature (71): n=a or c
tggatcaccttatttcacggcttgttcgcgaggactccgtgactgagtaatgaagatccttttttccccgnaaaaaaaaaacatgcatggatcacctgtat

SEQ ID NO: 21225 - DNA, 101 bp, rice(Oryza sativa)
  misc_feature (71): n=t or c
gtgattaacaccaaacgatcaccttcctgatcaagcctttttcctgtgcatttgctttccctatatgtacncattgataatactataagttctctaaggca

SEQ ID NO: 21226 - DNA, 101 bp, rice(Oryza sativa)
  misc_feature (71): n=t or c
tatattatagcatgcaaagctaaaagagactcctatctgtacagagcaaactgctgaaggagcatttctgnttcagagctgagcaattattttgttctgtt

SEQ ID NO: 21227 - DNA, 101 bp, rice(Oryza sativa)
  misc_feature (71): n=a or g
aaccaaatactttatagaacatattataatatagatttgtagtagtaagatgtgtcagaactatcctatancaatctaatactggatagaatatattataa

SEQ ID NO: 21228 - DNA, 101 bp, rice(Oryza sativa)
  misc_feature (71): n=a or c
taatatttatctaagtcttgtggaagaaaagaactggacctgagtcatgcattcgtgcgtctggactgacntgtagattcatggccgaccatcgacttaca

SEQ ID NO: 21229 - DNA, 101 bp, rice(Oryza sativa)
  misc_feature (71): n=t or c
tctggtgtaattcgtttattactctattttcaggccaggcaaatagttggttcagctatacttgtgaaagntggggatagaccaaaaatggaggaagatga

SEQ ID NO: 21230 - DNA, 101 bp, rice(Oryza sativa)
  misc_feature (71): n=t or c
atcccaaccctccctccattcccatcccccgtgcgcggtgtgttacttttctattttttttatttcttganaattaaaattaaaattatcttagtgggcaa

SEQ ID NO: 21231 - DNA, 101 bp, rice(Oryza sativa)
  misc_feature (71): n=t or c
ggagtgagaacgcggccacgcattctcacctccgcgcgcggctccacctgctcacagctcaccagtcaccncgaagacctccccgacgacggacgaccccg

SEQ ID NO: 21232 - DNA, 101 bp, rice(Oryza sativa)
  misc_feature (71): n=a or g
tatcggtggcgactgacgagtgtagttgattgagagcttagcttggagcatttcttatacgacgcaggaancttaaccacgaaggcttacgtacgtactcc

SEQ ID NO: 21233 - DNA, 101 bp, rice(Oryza sativa)
  misc_feature (71): n=t or c
aggaggaacacgagcatgcccagaatggaggcagagacgagagaggcgtcactgcgcacgcgctcatcganggaggacatcgccgtgctggagacaggggt

SEQ ID NO: 21234 - DNA, 101 bp, rice(Oryza sativa)
  misc_feature (71): n=t or g
ttaatttttttcacgatgatagatggggaaccaacacatttagacttctgtgagccaaaaaaagagagtcntgcttgacttgatgaatcgagccaattcta

SEQ ID NO: 21235 - DNA, 101 bp, rice(Oryza sativa)
  misc_feature (71): n=a or g
aattttatggattttttttttattttgttaattaaggtggatccctgacggttggatcagcgtgtgtttcngagatgggtgtagtcgagattgagcccgta

SEQ ID NO: 21236 - DNA, 101 bp, rice(Oryza sativa)
  misc_feature (71): n=t or c
actcagtggactctaaacaagcctgttttggatagaggacagtaaacttgaagttcaacacaaaggactcntattgatttgtagaaccatgaagtatactc

SEQ ID NO: 21237 - DNA, 101 bp, rice(Oryza sativa)
  misc_feature (71): n=a or g
ttgatcccatgaacacattctgatcgaattcccataaactcagatgcacatgagaaccggatccaatatcnttcaagtcaggtctggaaagtgtcaagcaa

SEQ ID NO: 21238 - DNA, 101 bp, rice(Oryza sativa)
  misc_feature (71): n=a or g
gacgtcagcgatgactcatgaggacctggagtaggattacccaacaatgctgtcatcagatgaagagaganagggtgtagacgacaatggcaccattgtcg

SEQ ID NO: 21239 - DNA, 101 bp, rice(Oryza sativa)
  misc_feature (71): n=t or c
atactctagcctatatagccatcatctcattgatatattctcataggatttcctctcctaaattagaactngatgaccgtcaattttacatacgtatatga

SEQ ID NO: 21240 - DNA, 101 bp, rice(Oryza sativa)
  misc_feature (71): n=a or g
gcaatgagagcagaatagcttttgtgtcactctctctttaggcttagccattccattccatgtacagcaancaaacaacgttagcccggtcccaactccca

SEQ ID NO: 21241 - DNA, 101 bp, rice(Oryza sativa)
  misc_feature (71): n=t or c
agattttggggtgatcaagagtcagtggagagtcctgcggggaattcctttatatggagaggaagctgctnagacgaagattatagttgctacttttgctc

SEQ ID NO: 21242 - DNA, 101 bp, rice(Oryza sativa)
  misc_feature (71): n=a or g
tgaaagaactacaaactctggagactgttgaagccagcaaggacttagctgagcagttgaagaaactcatncaactaaaaagtgtatggattgacaacata

SEQ ID NO: 21243 - DNA, 101 bp, rice(Oryza sativa)
  misc_feature (71): n=a or g
ttctctgaatttgaataaaagttagaccgtttggtagagcttctgattcttaaaaaaactgtaactgccanaaactcccataaacaggtccgaagagacca

SEQ ID NO: 21244 - DNA, 101 bp, rice(Oryza sativa)
  misc_feature (71): n=a or c
agaagtgtgccaataacgttatgaaaaatagttgagtaagaacacacctgccgttggcgctggactcatangcaaaacaagaaccaagaggaagcacaaat

SEQ ID NO: 21245 - DNA, 101 bp, rice(Oryza sativa)
  misc_feature (71): n=a or g
atttatattgaggtatccatattgatgtaaacctaagttttacgatggaccaaacttacacgcacatttcnctaacaaaggcccgttagttttcaatgatg

SEQ ID NO: 21246 - DNA, 101 bp, rice(Oryza sativa)
  misc_feature (71): n=a or g
atttttactttacgtaaaacaagacaacttattaatatatgcttcactcgtcctaaaatatactccctccnttccaaaatcccatatattttaaaatagag

SEQ ID NO: 21247 - DNA, 101 bp, rice(Oryza sativa)
  misc_feature (71): n=a or g
gctcaagcgtcgccttgactcctctctcccaagcagcgtgggcagcagagagatagatgactcaatggcantgaccaatggagcggaccagccgtcatcct

SEQ ID NO: 21248 - DNA, 101 bp, rice(Oryza sativa)
  misc_feature (71): n=a or g
ccctctcctccaacaaccttcgtcacattcgcaacctccactcccatgactgcaaggtggtgctgacatgntgagctagatgggaagtaggatggtgagag

SEQ ID NO: 21249 - DNA, 101 bp, rice(Oryza sativa)
  misc_feature (71): n=t or c
gtagcaatagccgtgaggtgtgagatcatttcagctaggctcagataactgtataaaaaagttccaacttncctaaaaatacagatgggagtactgctagc

SEQ ID NO: 21250 - DNA, 101 bp, rice(Oryza sativa)
  misc_feature (71): n=a or c
ggccatgcatctcagctgacttgcatgccagtgtacgcttggtagatcagtggtgttgacttttgacacangtggaatatttcgatgtgcgtacgtgcgtg

SEQ ID NO: 21251 - DNA, 101 bp, rice(Oryza sativa)
  misc_feature (71): n=t or c
tgtggccttaggctgagtttgaaggagcatttgggctgaaagtttctttaatttaccatgttcacgctttnaaaactgttaaacggtatatttcgtataaa

SEQ ID NO: 21252 - DNA, 101 bp, rice(Oryza sativa)
  misc_feature (71): n=a or g
cattcttggactaactgaaacatctccctttctattatactgttggtattcaatatttccttgcttccctnatatcaaagattggggctcatcccttccat

SEQ ID NO: 21253 - DNA, 101 bp, rice(Oryza sativa)
  misc_feature (71): n=a or g
tcgtgtgctgatcacagtgttaatccagtgctaatcgcaatcactgtgttaatccaactaaataactggtnctttttatattactagtaaaatgcccgtgc

SEQ ID NO: 21254 - DNA, 101 bp, rice(Oryza sativa)
  misc_feature (71): n=a or g
tgatgtttgcatttgacagttgacacgaccttggcgttgatatggcaaacctgtttacctgtccactgccncggtgcaccacacccttcaccggcaattcc

SEQ ID NO: 21255 - DNA, 101 bp, rice(Oryza sativa)
  misc_feature (71): n=a or g
tagtcgtgtccgggcgacgttgtgcttggtggcccatttgacttggtgcattaggaatcattgggatcagntgcagtgcatgcccatttgcccgtttacat

SEQ ID NO: 21256 - DNA, 101 bp, rice(Oryza sativa)
  misc_feature (71): n=a or g
tttccgtttctgaaattttaggaaaaatttcaaccaacactttctgtttccagaaacatgtccggaaaccngaaacattctgaatcattttcatccgtacc

SEQ ID NO: 21257 - DNA, 101 bp, rice(Oryza sativa)
  misc_feature (71): n=a or g
cgttatcatgccgctataatacgaagtgttttggttgccaagttggcttggtcggtttagttcctggacgnaaccgactagtacaaattggaaaaacagaa

SEQ ID NO: 21258 - DNA, 101 bp, rice(Oryza sativa)
  misc_feature (71): n=t or g
agcattactgatttatcttgactttccaatgttatataggtatccttccgatccatacgatcggtactggngggcagaggacagtaacccaatgtggggtt

SEQ ID NO: 21259 - DNA, 101 bp, rice(Oryza sativa)
  misc_feature (71): n=t or c
ttctctatatcaatgcttgcttctctgcaggttgcaagtttagctactgtgtcactgatttgtttctcgtngtccgctatactagcacttgttaccaatgt

SEQ ID NO: 21260 - DNA, 101 bp, rice(Oryza sativa)
  misc_feature (71): n=a or g
gaacctgaaaatgccatacaacgatcccaaccagattccgtgtgatgtggaaatggatgaacattgtgagncatcaactttaggtgatgtacgtaccaacg

SEQ ID NO: 21261 - DNA, 101 bp, rice(Oryza sativa)
  misc_feature (71): n=t or c
acgattgttacgatgatgtcagcaaccgttgtcctcattactcctttggttctcgcgcttttccctccatncattgaggtgttgacataagtctatcagct

SEQ ID NO: 21262 - DNA, 101 bp, rice(Oryza sativa)
  misc_feature (71): n=t or c
aaaataacagaacgagtgagtagcatctggccatctgcagttgacattgctacactttactccttccttcncgttaaaaaaccaataatctaatatcggat

SEQ ID NO: 21263 - DNA, 101 bp, rice(Oryza sativa)
  misc_feature (71): n=a or g
caggcagtgatcatgcccattgatgtagaaatcgacaccgttttcctgtgaaatcatcgtaaatttcatcnaatgctcatatgcgaaaccaattggtagaa

SEQ ID NO: 21264 - DNA, 101 bp, rice(Oryza sativa)
  misc_feature (71): n=t or c
accactcctccgacgaggtcctcaactacgaccaggtataccaagtcctcaacttctagcagccatagggnctgtttggaggagcttttagctgctgcaac

SEQ ID NO: 21265 - DNA, 101 bp, rice(Oryza sativa)
  misc_feature (71): n=a or g
tcatcagaaaaaaaatgaaaactaatgacaggaataatttaattacacctcttctccgaagggccggtttncaccagaagagatctttgaggagaaaacgg

SEQ ID NO: 21266 - DNA, 101 bp, rice(Oryza sativa)
  misc_feature (71): n=a or g
aaggaaagaaaaagcaatgatccgctcggatcaaaagatcgaaaccttaacccttgaaccttaccttgtcnccggccgaacgttgacgccggcaaaggggt

SEQ ID NO: 21267 - DNA, 101 bp, rice(Oryza sativa)
  misc_feature (71): n=a or g
agtattttagaacaaagaggcgaacataaatgggggaaaacacggaacattgattggatagcagggcattntggtcattatttgaaaattctgaagacaag

SEQ ID NO: 21268 - DNA, 101 bp, rice(Oryza sativa)
  misc_feature (71): n=t or c
tgttagtcctaattcgaatgtagtttggctagagctatttgtggctcccaaacggaacatatcattagcgnatgattgtttacatattaaatattatatat

SEQ ID NO: 21269 - DNA, 101 bp, rice(Oryza sativa)
  misc_feature (71): n=a or g
tgcagctaaaacagttgatgctaatgaagttgcgactgctacgaacattagcaccctaagcttcaccctcntaagcagaggagagccgacagctctccatc

SEQ ID NO: 21270 - DNA, 101 bp, rice(Oryza sativa)
  misc_feature (71): n=t or c
actccgatagcgtattctgaaagtagcacaaattaaatggtaaatcctaaaagcattgcgtattcgatggnatattctgaaaattctcgcccgcctatccg

SEQ ID NO: 21271 - DNA, 101 bp, rice(Oryza sativa)
  misc_feature (71): n=a or c
aagtcgacggcgatgaagagccaatccttcagcatggcgggccagccgcaacagtagacgaagaagaagangaagaagaagaagaagaagaagatgccgcg

SEQ ID NO: 21272 - DNA, 101 bp, rice(Oryza sativa)
  misc_feature (71): n=t or c
ccctcctgccccatccaatgtgcgccaccaccttccccaacttccacctcctgggcgactggatcttgacnagaagaactccgagaacaagggcgaggccg

SEQ ID NO: 21273 - DNA, 101 bp, rice(Oryza sativa)
  misc_feature (71): n=t or c
cttctatttttagggtttatttgacacggttccagctctagccctacctctcctaaccagacagaatcaantcacctaaaataggaccataggagtggagc

SEQ ID NO: 21274 - DNA, 101 bp, rice(Oryza sativa)
  misc_feature (71): n=t or c
gccagttggagtcagcgagcgtgctgcagtagttggtcggaactggggagatggcggagtgcgaagccgtnaggatgaggcggtcgatgggcctgagggag

SEQ ID NO: 21275 - DNA, 101 bp, rice(Oryza sativa)
  misc_feature (71): n=t or c
ggggctttttatgttactgtaactggtacgtatcttcagttacatgacagttgacattttaagttaggganaattgcttctttgaccctattctgaactat

SEQ ID NO: 21276 - DNA, 101 bp, rice(Oryza sativa)
  misc_feature (71): n=t or c
catgtctccacccgagccttcacttgcaacaacttctcatcgaactattctctgagctcttctctaagctncgcacgaagttgttccttaaggcgtgcata

SEQ ID NO: 21277 - DNA, 101 bp, rice(Oryza sativa)
  misc_feature (71): n=a or g
gcattatttatcttttatggccggtaattaatggcagttacgctgattcgggtaggtaattaatggaaagntaaatattggagccatcatttcccttattc

SEQ ID NO: 21278 - DNA, 101 bp, rice(Oryza sativa)
  misc_feature (71): n=a or c
atgcccaacaacaaagaaaatggtgatgatcagtttggtgcgtggaccaaattggttattcacaggaggangaatacgagcccattgatgacaccaagttg

SEQ ID NO: 21279 - DNA, 101 bp, rice(Oryza sativa)
  misc_feature (71): n=t or c
acatcttccttcttgatagctctatacttgatattaccacgcgcattagtaaattcgccagtcccacccanaatagaccactctccaactttctcttcact

SEQ ID NO: 21280 - DNA, 101 bp, rice(Oryza sativa)
  misc_feature (71): n=t or g
gcagtaatttacatttaatctagaatctaatagcctaattagtgtgtgctctccattgatcgactcatcanggcgctacagcttgcagcacactcaaggaa

SEQ ID NO: 21281 - DNA, 101 bp, rice(Oryza sativa)
  misc_feature (71): n=a or g
aaaacgcattatcattacataaattggttcctaaaatctgcaatcacttaaaattgtaagatcacatactncaagagagtatctagccaggatatgcagtt

SEQ ID NO: 21282 - DNA, 101 bp, rice(Oryza sativa)
  misc_feature (71): n=a or g
aaaaagaaaagcaccagaagaaagtgatgttgctgagtctagcgactgtatgattactagccctggatttnctgtcagtccaatgctcactccagtctctg

SEQ ID NO: 21283 - DNA, 101 bp, rice(Oryza sativa)
  misc_feature (71): n=t or c
attatttgtatgaatatccaccaaatcatcatccaagtaatggtctagatctggccttttggttgcagcanggcactaaaggctggataagaaatcatttg

SEQ ID NO: 21284 - DNA, 101 bp, rice(Oryza sativa)
  misc_feature (71): n=a or c
cgctcaaaactgatgtagttctatcacatgtcaattcgtcagctttattttcaatctcctgatttaccctnatattcttgacaacagtatcaaaaggatct

SEQ ID NO: 21285 - DNA, 101 bp, rice(Oryza sativa)
  misc_feature (71): n=t or c
aggtagtcctacactgcgacttgaagcctagcaatgtcctattcgaccaagacatggttgcattggtggcngatttcgggattgcaaaactgttatgtggt

SEQ ID NO: 21286 - DNA, 101 bp, rice(Oryza sativa)
  misc_feature (71): n=t or c
ccggactagagggagagaggaaggggagagaaaaggctgactagtgggtttcacgtcagtttctaccctangttaccatgttggcatgccacgtaagcaaa

SEQ ID NO: 21287 - DNA, 101 bp, rice(Oryza sativa)
  misc_feature (71): n=a or g
tcaacttgagtcttctttgtgcatttggattttttttgttggcattgcatattaggacccatgagcataantaaagcaaacctataatcacacttgagcaa

SEQ ID NO: 21288 - DNA, 101 bp, rice(Oryza sativa)
  misc_feature (71): n=a or g
catcatatgagtttagtgttgtgatgtaccagctcatcaagagaaattacaccattcaattatttaatccngacacattatccccatcctcctgttttaag

SEQ ID NO: 21289 - DNA, 101 bp, rice(Oryza sativa)
  misc_feature (71): n=t or c
gcctttccaattgttaccagctccaaaggtgaaccaagcaattccgcggaaatatttcttggcaggtacanatgcttatggcccaagtaatcaagatcagc

SEQ ID NO: 21290 - DNA, 101 bp, rice(Oryza sativa)
  misc_feature (71): n=a or c
attttaactatggtacaacaagtcttgtcgactatgtcaggcagcctatcctaacaatattctggaaatantggatgctagcgcaacctacaatggaaaca

SEQ ID NO: 21291 - DNA, 101 bp, rice(Oryza sativa)
  misc_feature (71): n=a or g
gaagaaatccaaaagcaagagcaaatcctcctcctccgacgaagaagatgagaagaaatcaaaatccgagngccaagccgcggccaaaccaaaggaagaag

SEQ ID NO: 21292 - DNA, 101 bp, rice(Oryza sativa)
  misc_feature (71): n=t or c
agcgcaaacgaaacacagtgatgaataaatttggtcgaacactcgagaaacaggtgcatcgacactgtcanggctgcggcttcactgttccattgttgtgt

SEQ ID NO: 21293 - DNA, 101 bp, rice(Oryza sativa)
  misc_feature (71): n=a or g
aattcctcttcctttactagtgattccttgtttttctttttggtgtcaatgttatgccatatccattgctngccaccgtcgttgagagtgtagcctgctgc

SEQ ID NO: 21294 - DNA, 101 bp, rice(Oryza sativa)
  misc_feature (71): n=a or g
aagcgggtcgccctgacgcaaaccacgcgactgagcaaatgtattcaaaagggatccattaaatttgaccnagtatctcaccgaggttatgcaagtcataa

SEQ ID NO: 21295 - DNA, 101 bp, rice(Oryza sativa)
  misc_feature (71): n=a or c
gtcacagtttcttcgaggttagttgttgtactggtgccgctaatccacacatgtctcagtccttcactagnagttccattggtgccaggtttcacttcacc

SEQ ID NO: 21296 - DNA, 101 bp, rice(Oryza sativa)
  misc_feature (71): n=t or c
tatgcatactttatatatgctctagtaaatacaaaggctgcgttcgggaggggtcctcctccccggcacgnaaaacgaaacacgtattattgcatagttaa

SEQ ID NO: 21297 - DNA, 101 bp, rice(Oryza sativa)
  misc_feature (71): n=t or c
cgtgtgggtccctcacccctctgccaggtgggcaccacccctcgaattgattattcctaacaacattccgnggattaattttcttaccactaataatctca

SEQ ID NO: 21298 - DNA, 101 bp, rice(Oryza sativa)
  misc_feature (71): n=a or g
tattcttgtatatgtttcttgtttgctactaactatggtagggttacacaaagagtttggagttgttcgtnctcaatgtggacattttcaccttcgacaac

SEQ ID NO: 21299 - DNA, 101 bp, rice(Oryza sativa)
  misc_feature (71): n=t or c
atgcacgtacgtacctgtacacagcacacgtaaagcaaaccgtactctttcttgaaattaaacacgacggnatacaaccgtactctattatagtagtatat

SEQ ID NO: 21300 - DNA, 101 bp, rice(Oryza sativa)
  misc_feature (71): n=t or g
cactgaaatctgtgggagcaaaagggatggttgtagggcacacaccccagactcgtggagtgaattggtanctgttgttctcacttgggtaatttacaact

SEQ ID NO: 21301 - DNA, 101 bp, rice(Oryza sativa)
  misc_feature (71): n=t or c
gacagcgccaggacgtggcccaagaagacctgcggtgggccagagttgaatctagctggtccacgggttcnagtgcggctggactgggaggggcgacgggc

SEQ ID NO: 21302 - DNA, 101 bp, rice(Oryza sativa)
  misc_feature (71): n=a or g
agacatggaagacacccggaacttgtgaataacagcgcatcacatgctctcaacttgatgaagacaactcngttgagtatcatccctttgcctcctgttta

SEQ ID NO: 21303 - DNA, 101 bp, rice(Oryza sativa)
  misc_feature (71): n=t or c
gggtttttatattctgataaatatcttttgatatttgctccgatttgtgttagcttcgtttgcaggtttcngatttcgattctgaaagaaaatgataacag

SEQ ID NO: 21304 - DNA, 101 bp, rice(Oryza sativa)
  misc_feature (71): n=t or c
atcaccattcgtcacaaaaagtgtggctgtaatcaagcccaaactctctgacagaaagctcgatcagaaanacacaggtatatcctgcaaattatccctct

SEQ ID NO: 21305 - DNA, 101 bp, rice(Oryza sativa)
  misc_feature (71): n=a or g
tatcaatgcggcctgctgaggcagaatcggacggtagtacagtatcatttagcaacttttggactttgagntttacgtggctaggaataagttcattttag

SEQ ID NO: 21306 - DNA, 101 bp, rice(Oryza sativa)
  misc_feature (71): n=t or c
ggttttcttgacgtggcgcttatgtgacggtgttgaggtgatcttcgtttcacgtgacgttgatatgatgnttatgtggcactagaattaaaaaaaatata

SEQ ID NO: 21307 - DNA, 101 bp, rice(Oryza sativa)
  misc_feature (71): n=a or g
aggagattaccaaattgccgtataaaaaacctagaagtgttcatgggtgctataatatcgatgaatatgantttcgaaaaaaatgtgaatatgcaaaaaag

SEQ ID NO: 21308 - DNA, 101 bp, rice(Oryza sativa)
  misc_feature (71): n=t or g
ttctgaatctggtgtactggactgcttgagaccaaatatagaagatgatgcactgatcagcttatcgtctntatttgaagcaagtggcaattgtgacacag

SEQ ID NO: 21309 - DNA, 101 bp, rice(Oryza sativa)
  misc_feature (71): n=t or c
tcgcgtccggcgccggcgagggatcatcggctgcagtgcctggcctggtattcggctgtgggcacgcgaanagaggggtcttcacctcaaacgagaccggc

SEQ ID NO: 21310 - DNA, 101 bp, rice(Oryza sativa)
  misc_feature (71): n=a or g
ataaagatttatgtgtgtttcttaaaatgtatcaggacgtagggatgttcatatattttttgaaaaatacncacaaattcttatatttagtttgaaacaga

SEQ ID NO: 21311 - DNA, 101 bp, rice(Oryza sativa)
  misc_feature (71): n=t or c
tttttcttcagttttgacgatcctggtccacatggagcaggcagatattctgatcatatgctacctgaaantgttaagagagattggagaaaaggtgcaca

SEQ ID NO: 21312 - DNA, 101 bp, rice(Oryza sativa)
  misc_feature (71): n=a or c
gtggaggaggcgtcttctttgtcatgtgttgtggtaccacgagaggaatttgcatcatttgtagcacccgngcctggccatgccttttctgtccttgattt

SEQ ID NO: 21313 - DNA, 101 bp, rice(Oryza sativa)
  misc_feature (71): n=t or g
aaacaatgtaggaggcataaatttttgagatggtaaatgagaagtgcatcacctagagtagcaattttttntttgatacgatcgatcgatctttgcaccaa

SEQ ID NO: 21314 - DNA, 101 bp, rice(Oryza sativa)
  misc_feature (71): n=a or g
cggtcgacgacatgagccattgggtcatgcgtctgtagcgttgcaaaactcttataaatctcaaccttttnatttaaatagatgaaacttatagaaaatct

SEQ ID NO: 21315 - DNA, 101 bp, rice(Oryza sativa)
  misc_feature (71): n=t or c
tatttaaaaaattcaggatttcatatgatgagattgtcaatgatctgtgcccagtatgctcctctctctcnctccctccctccctccctccctgtcttcgc

SEQ ID NO: 21316 - DNA, 101 bp, rice(Oryza sativa)
  misc_feature (71): n=t or c
gtgactttaactccagaatgacccccaaaagctgatttgtggaaagcttgtatcagtttgttcctgatatnagtagtactgccaacatatatcctgttttt

SEQ ID NO: 21317 - DNA, 101 bp, rice(Oryza sativa)
  misc_feature (71): n=t or c
ttccgaaattctacggtcctatgcgcaaaaggtttccacgctgggagttatgcgcgtaatttttagaaaanctaggagcctttctgcaaaatcgccaatct

SEQ ID NO: 21318 - DNA, 101 bp, rice(Oryza sativa)
  misc_feature (71): n=t or c
agaaatgtttatgctcagaaaattaaaaagctgcagcctaactacagactcacccaaatccaaatgccttntcctttccgcactgaaggagacagtattag

SEQ ID NO: 21319 - DNA, 101 bp, rice(Oryza sativa)
  misc_feature (71): n=t or g
atccttcaaaaagctggctgtggctgccggcattttatcgtcgtcatcgtccacacgtacggtgagtcgantgagctagccatagctagctatgaagaagg

SEQ ID NO: 21320 - DNA, 101 bp, rice(Oryza sativa)
  misc_feature (71): n=a or g
tagaagcgggagagagtcaaggtaacaagatagccggtgttctcttgacgaaagaaaagccctttgagtgngatgccttgctccagcagttgatgccaacc

SEQ ID NO: 21321 - DNA, 101 bp, rice(Oryza sativa)
  misc_feature (71): n=t or c
ccagcttgcgggtgtgcctttttctttatttatttaccacagtacacccgtactcatcgctataaacacanatactccagaatttgttactcatcgctata

SEQ ID NO: 21322 - DNA, 101 bp, rice(Oryza sativa)
  misc_feature (71): n=t or c
ggaaaataaataaaataaattgtgctcttagtctacgacaacagttccacgtgcataatgtgttccattgnatcatcaatatttttaatatacgtacagaa

SEQ ID NO: 21323 - DNA, 101 bp, rice(Oryza sativa)
  misc_feature (71): n=a or c
tacggtatgtcacccgtgtgggccccatgcggtaattcattccgcgctcgtaataaataaggcattttcgngtctggtgccctcgggccgtgttgatttaa

SEQ ID NO: 21324 - DNA, 101 bp, rice(Oryza sativa)
  misc_feature (71): n=t or c
aaccctttgtcccgggttacaatcgggacgcctaatccggaactaaaaaagatgtccaatttttaagtccnggttggtgttaccattcgagactagattta

SEQ ID NO: 21325 - DNA, 101 bp, rice(Oryza sativa)
  misc_feature (71): n=t or c
ctcagtacaagatgacaaaaggcactctatcattcatacttcggtctaccatgtgtttatttgaagtgganactattactctctatacataagacttcgct

SEQ ID NO: 21326 - DNA, 101 bp, rice(Oryza sativa)
  misc_feature (71): n=a or c
aaggtgagtgacagcaacggcagacatatcttgtcgtatgagtcatgctggggccaatagtatattcgagnaatactgcatcactgccttttttcagcatg

SEQ ID NO: 21327 - DNA, 101 bp, rice(Oryza sativa)
  misc_feature (71): n=t or c
ctttgatatatgcatttgttttcatatatgcttgtcatgattcaaaattcagaagcaatatatttactccntgttagtaggttagttatagttcacattta

SEQ ID NO: 21328 - DNA, 101 bp, rice(Oryza sativa)
  misc_feature (71): n=a or g
ctgaaccagaataccgaatatctcgaccctcctcacccaccccaaaactatattaagaccagtgcaatttnactcacgtcggtgaaattgcactggtttta

SEQ ID NO: 21329 - DNA, 101 bp, rice(Oryza sativa)
  misc_feature (71): n=a or g
caaacgagccttcaatcaactcagatgcccggaaaacctagaacgccttgtcaagctgttgccttagatcnttgtgttagtttgcctgtttaagtttggtt

SEQ ID NO: 21330 - DNA, 101 bp, rice(Oryza sativa)
  misc_feature (71): n=a or g
tttttaagcactgtaaaatcactcttatctatatttgcaaccagtacttgggtcattgcacttgccaatcnccatgaatgactgataggtactaccttcgt

SEQ ID NO: 21331 - DNA, 101 bp, rice(Oryza sativa)
  misc_feature (71): n=a or g
caagagaggtctatgtaggtcagattcttgaggctacaaacggaggctgggattggtctggctatatgganacttggcaaggagaggccagtgacctgacc

SEQ ID NO: 21332 - DNA, 101 bp, rice(Oryza sativa)
  misc_feature (71): n=t or c
agatggtgtggtcgaggatgttgatgaagatgatactgaggagcaagaatctccaggatgcaacaatttcnaagactaggttgattatgctgttcaacatg

SEQ ID NO: 21333 - DNA, 101 bp, rice(Oryza sativa)
  misc_feature (71): n=t or c
cgaaagaaagcgaagagcccggccctgtgttcggctcctgttggaaactaaggctctgttcactttgatgncatttttgatcttaccaaattttgataaag

SEQ ID NO: 21334 - DNA, 101 bp, rice(Oryza sativa)
  misc_feature (71): n=t or c
tgaagatagtgatgataccactgatccttgtcctgataactttcttatttcagaacattacaaatgggccntggatgagctattcatcaaacacaactttg

SEQ ID NO: 21335 - DNA, 101 bp, rice(Oryza sativa)
  misc_feature (71): n=a or g
tcatcactagcttgcattgtcggttctgacctctggctttgcaagaaacaatcatctaggtcctctagctnccctgccttcacctttctcttagtctcctt

SEQ ID NO: 21336 - DNA, 101 bp, rice(Oryza sativa)
  misc_feature (71): n=a or g
gtcacattccgagcatctctcatccacttgagttgtggtactatcgagcctcttgtcatcactatctgtanttaaaggtgtatccaccacctcaaaaccat

SEQ ID NO: 21337 - DNA, 101 bp, rice(Oryza sativa)
  misc_feature (71): n=a or g
gtataagggcatactgtttcagtagcaaagagagcttttacaaggccttcttggaagagcaactccaccanctctttaattaatggaagcaatccagaatg

SEQ ID NO: 21338 - DNA, 101 bp, rice(Oryza sativa)
  misc_feature (71): n=a or g
tcagaaagtcaacccgtcttactgcatgtagtataacataatgtgcatgggcatcagggactaacgaatgnttcatgtcagcgtgtgatgcagtgatggcc

SEQ ID NO: 21339 - DNA, 101 bp, rice(Oryza sativa)
  misc_feature (71): n=a or g
aagaatttatgtacaacatccgtcccaaaataattgtaatccaaattgtttagtaaatattaaggggtctnttcgctgcagctaaattgtagttgttgtgt

SEQ ID NO: 21340 - DNA, 101 bp, rice(Oryza sativa)
  misc_feature (71): n=a or g
caagagaaacaagaggaaaaaaagacactgtacaatcatgaacgtgcttaggctatagtacgagtacatgngaatgcgatcactgcagcacctttggcact

SEQ ID NO: 21341 - DNA, 101 bp, rice(Oryza sativa)
  misc_feature (71): n=t or c
caccgtactcagcaagccatgggcatgaataatgtaagtaatgcaacagagtacaagggattcatttatangggttattttgcagtaaatcagcatttcaa

SEQ ID NO: 21342 - DNA, 101 bp, rice(Oryza sativa)
  misc_feature (71): n=t or g
cagagtcgcgcgcccttctctgcccttcctccccgcacacaagaatgagaggaagaagagagaaaagaaanaagaagtgatctgacaagtgggtcccacct

SEQ ID NO: 21343 - DNA, 101 bp, rice(Oryza sativa)
  misc_feature (71): n=t or c
ctgcgtttgagaacattaattattgggagttaattgcaacaagaacagatttaatttgttagggcacccanaatgataatctatagcctctctacaaaaag

SEQ ID NO: 21344 - DNA, 101 bp, rice(Oryza sativa)
  misc_feature (71): n=a or c
ctagtgtcaaacacccaaccattcattacagccgctgcatcctgaggcccccttgaactaccaactccctnaacagaaatggtgttgtgttcaatggcaaa

SEQ ID NO: 21345 - DNA, 101 bp, rice(Oryza sativa)
  misc_feature (71): n=a or g
cgaggctcttgtagacgtcgtggttggtgaaataacgaagctcgtgaagtagaggcattatagtttgccgntgccaaagataataaagatgaagtcgctcc

SEQ ID NO: 21346 - DNA, 101 bp, rice(Oryza sativa)
  misc_feature (71): n=t or c
gtgatccgtccggaaaaattgatttttgcaggcggacgacgatcttacccccggttgctattttcgtaggnggccatttgggttcgagggacatatccacc

SEQ ID NO: 21347 - DNA, 101 bp, rice(Oryza sativa)
  misc_feature (71): n=t or c
gaagtggttttggagatgatggatttctagacggtgaacagggactactgctttgtcgggaccggtcagancgggtaagtgctgccggtcagaccagcata

SEQ ID NO: 21348 - DNA, 101 bp, rice(Oryza sativa)
  misc_feature (71): n=t or c
catagggtttgagttaatcagtccatttcagtggtcactctatacaaggagaccacaatttttttggattnttttgtgcttgtatacagaaaaagctatct

SEQ ID NO: 21349 - DNA, 101 bp, rice(Oryza sativa)
  misc_feature (71): n=t or c
ccaaatttctcctgtccgctgaacatagcaagatccaggccttccctttgtcacgcttgtacaaaaatggncatgttgtcaagagttttgtaaaattgaag

SEQ ID NO: 21350 - DNA, 101 bp, rice(Oryza sativa)
  misc_feature (71): n=t or c
gggattatgcagtgcaccaacaggcaacagcatgccgccgtatggcctcctttttttttaatgcttctgcntatcttaaaattaatttttaaccttaaatt

SEQ ID NO: 21351 - DNA, 101 bp, rice(Oryza sativa)
  misc_feature (71): n=a or g
cagaacgataaactcctattcgcgtctgctttgaaaattaagattggtaatggagacacaataaaattctnggacaacgcatggcttgatgggcgctggcc

SEQ ID NO: 21352 - DNA, 101 bp, rice(Oryza sativa)
  misc_feature (71): n=t or c
agtgattatgtgttgaatttggttttgcctgttctttgtgtacacatggaacatagcgatggttctatctntggtgatctgcatagcttctaaatgtctga

SEQ ID NO: 21353 - DNA, 101 bp, rice(Oryza sativa)
  misc_feature (71): n=a or c
cacaaccaaacgaacagtacccgccgggccacgggcatgtttgtaaattttcctcccgtggctgccatctntcgcagcatctgcccttttgaactcgccaa

SEQ ID NO: 21354 - DNA, 101 bp, rice(Oryza sativa)
  misc_feature (71): n=t or g
aggtctcttcaataaagcatgatcatctgcagaaggttgtactaagagatcatctattgggtacttaattngaacatttatgtgttcctcatctgcaaatc

SEQ ID NO: 21355 - DNA, 101 bp, rice(Oryza sativa)
  misc_feature (71): n=a or g
caaatgaaagttgcaacacaacatgttattccatctttacagggtgccaccccatgttgctcataacaacncaaaccgacaagccagcagtctaagcgacc

SEQ ID NO: 21356 - DNA, 101 bp, rice(Oryza sativa)
  misc_feature (71): n=a or g
cattgtgatcatggaaaggccaaaggcttctatccaaaattcaatctaattttggaaattccaagggtagnataaaggtgacatacaaaagaaagaactaa

SEQ ID NO: 21357 - DNA, 101 bp, rice(Oryza sativa)
  misc_feature (71): n=a or c
gtggtctcgctgcgcgcggctgccgtgacggaaagccccaggttcttgtcttcttgattctagatacccgncatcttcctcagcaaatcaaccactttctg

SEQ ID NO: 21358 - DNA, 101 bp, rice(Oryza sativa)
  misc_feature (71): n=t or c
cctttcaaaccccaaaacaattgtttgcttgggttgcaaccatatggtggaaagctgtcatatatgctagnattgctcatgtatgtttttctcacatttgc

SEQ ID NO: 21359 - DNA, 101 bp, rice(Oryza sativa)
  misc_feature (71): n=t or c
atctcaccatctaactggaacaatgaaatttacccacagagtctccgacatctttctgaacgaaaagctangatatacttggaggtcgtttttaggctttt

SEQ ID NO: 21360 - DNA, 101 bp, rice(Oryza sativa)
  misc_feature (71): n=a or g
gctcttttaatttgatttgcaggaaaccccaatccgcaaacaatcatcgacatgaaggcattggttgaggntttgtacgagagcatgcgcaatttgatttg

SEQ ID NO: 21361 - DNA, 101 bp, rice(Oryza sativa)
  misc_feature (71): n=t or c
ttcttcttatgatgctaattatccacaatctgagatttcttcttatgatgcgcaagggcggtcagaccggnggcaacttcacacgcggcaggtgatcttca

SEQ ID NO: 21362 - DNA, 101 bp, rice(Oryza sativa)
  misc_feature (71): n=t or g
tctttattttttccaatctactcagcatgactaaattgcaagctactctcgactaccactttttctactantgctcatttaccctctacccctttgccatc

SEQ ID NO: 21363 - DNA, 101 bp, rice(Oryza sativa)
  misc_feature (71): n=a or g
tccagatgaggtgttggcagtctctggcggtggcgaggcggtggtggattgtcggaagttcttccccgtgncgctgagcacggcagcagggacggtgcagc

SEQ ID NO: 21364 - DNA, 101 bp, rice(Oryza sativa)
  misc_feature (71): n=a or g
atatgtacgtactactcctaccgtatactgtaactacctaatcacaaaaatctgttgctactaaatctcanctaaaattaattgctcatagtacgtagtag

SEQ ID NO: 21365 - DNA, 101 bp, rice(Oryza sativa)
  misc_feature (71): n=a or g
aaaccccaggctggcctgctattttctcaccatccccccccgcactcttcacttttttaccgcttgacgcnctctgtgctttcgtcatttgcccacctctt

SEQ ID NO: 21366 - DNA, 101 bp, rice(Oryza sativa)
  misc_feature (71): n=a or g
cttaaatattcttgggatgagaatcttcaatccaattcaatacttctctttgtcaaactcggtagcttttnactaataatcatactaaacatatctatgct

SEQ ID NO: 21367 - DNA, 101 bp, rice(Oryza sativa)
  misc_feature (71): n=a or g
gttgcaaacatctgtggtatctattcaagctgttgcaccaggccctactgctaaggttatcccggccaccncaagcaaaaggaacccggtcgttgcaccca

SEQ ID NO: 21368 - DNA, 101 bp, rice(Oryza sativa)
  misc_feature (71): n=t or c
actacacatagatgagtaggtgaccatgctcctcgtgagatccagacaggtctaggctgaggtatcttgcnagagtcttaggctgtgtttagatctaaact

SEQ ID NO: 21369 - DNA, 101 bp, rice(Oryza sativa)
  misc_feature (71): n=a or g
ctactgctcgcttcctcaattcaatagtttgagcaactaatgaatctgctactgtcgggagtgaattctantccctcgaagggatattccgttgtatacct

SEQ ID NO: 21370 - DNA, 101 bp, rice(Oryza sativa)
  misc_feature (71): n=t or c
ttctcaaacctcgagtctattacaaacacaaagggtacacttttagtagatatcggtagaaaaggaaatanattgtgaataggaggacacgggatgaagtc

SEQ ID NO: 21371 - DNA, 101 bp, rice(Oryza sativa)
  misc_feature (71): n=t or c
ataaccaactaggcggctcctaactgtgcagagcattaaggcaactgcccatggacaagacaaagacgaanggaatttagaccgaattaagggacgtggac

SEQ ID NO: 21372 - DNA, 101 bp, rice(Oryza sativa)
  misc_feature (71): n=t or c
accttttttatgtcatgaatgaatactgaaaatttgtaagactcgggctgccaggcttcattaaggaaacncattggggttacaaactgagattccttcaa

SEQ ID NO: 21373 - DNA, 101 bp, rice(Oryza sativa)
  misc_feature (71): n=a or c
ccgtgtgggcgacttaagccaaccgcacgagataatatcgtattagcccatgcggttggcttaagatgccngcacgggataatgcattttcccatacaggc

SEQ ID NO: 21374 - DNA, 101 bp, rice(Oryza sativa)
  misc_feature (71): n=a or g
cttctctgcagttactgtgttatatatctctgatggaagcatcaaagattagctgcctacaggtagatgancagcttgattcagtccaattttacctgaca

SEQ ID NO: 21375 - DNA, 101 bp, rice(Oryza sativa)
  misc_feature (71): n=t or g
cccggattacatgaggacgtggacggagatcatggagggccacgatagtttcatggaggccgtggaggacngctccaagcccgcgaggatcaccctggagg

SEQ ID NO: 21376 - DNA, 101 bp, rice(Oryza sativa)
  misc_feature (71): n=a or g
aggttcttgcggtgctagagcatgcaaaccaagcagacaaatccatcaaatctttgtggccaagaacgtgncaaaggaaaggaagcaaaagatttgacaca

SEQ ID NO: 21377 - DNA, 101 bp, rice(Oryza sativa)
  misc_feature (71): n=t or c
ctcctgaggatctttgggagaccatacttgggccacagtgtgatcaaactggttggtgcgtggacatactngggggatagtgtaaagaagaacctttgcaa

SEQ ID NO: 21378 - DNA, 101 bp, rice(Oryza sativa)
  misc_feature (71): n=t or c
gtgtagagacatataagatctacatcttaaaataacaagttagggaggagcccaggacctgaccgggtccnagcccccctcaccttgttatgtcatacctt

SEQ ID NO: 21379 - DNA, 101 bp, rice(Oryza sativa)
  misc_feature (71): n=t or c
acactttgacatgtgcatgatcaaaatgtactcccatcccacgatatagcgatgggacgtatcctaataanataaatttaaacataaatttaaacagtaca

SEQ ID NO: 21380 - DNA, 101 bp, rice(Oryza sativa)
  misc_feature (71): n=a or g
tctagattgtaaagcttcacaatcaatccctttcacttctaatgatgctagtcttactgagaaagatgctncccgtatatttgcacctgcagtttttaaga

SEQ ID NO: 21381 - DNA, 101 bp, rice(Oryza sativa)
  misc_feature (71): n=t or c
ttatccgtttgcacccttagatagacttgtttaactttcgagccaagcctgacatttttgtccacctatcnattgtaggacaacccctgatgataactaaa

SEQ ID NO: 21382 - DNA, 101 bp, rice(Oryza sativa)
  misc_feature (71): n=a or g
actaactgagctgcaaaatgtacaagatccaaggaaattaagaacatatataccttactaaattgtcatcntcagggctagatcccacgttgctccgaaca

SEQ ID NO: 21383 - DNA, 101 bp, rice(Oryza sativa)
  misc_feature (71): n=t or c
tcactaatctgataacctcatattcaaatgctgtttccttttttttgggggaaatgcatcctcttactccntctgtcccattataagtacaaccataagtt

SEQ ID NO: 21384 - DNA, 101 bp, rice(Oryza sativa)
  misc_feature (71): n=t or c
acaatcaacattgccaccttaagctcgttgatggcaccatagcatccacctaagctttggtcactatcatngttcctatctttagcttcttgacaacacca

SEQ ID NO: 21385 - DNA, 101 bp, rice(Oryza sativa)
  misc_feature (71): n=t or c
agctatttcacttaccgaaacgtaatggaaaaatgtgaacaaaaccacttgggtatggtaaataaagcgcngtactgaaattccaatccaagcatgacatc

SEQ ID NO: 21386 - DNA, 101 bp, rice(Oryza sativa)
  misc_feature (71): n=a or g
aacgatgatggtgtgatatgtttgcgtgttgagttacagattacatatagcgggttataacttataaaatnaagtatacgggcgggcaactagtgctgatg

SEQ ID NO: 21387 - DNA, 101 bp, rice(Oryza sativa)
  misc_feature (71): n=a or g
aggagcacgtacgatggaaacgataggaagcagcggcatcaaaacgaagagttgattatatactggtgganaaaccatctttgatcggtccagcagatttc

SEQ ID NO: 21388 - DNA, 101 bp, rice(Oryza sativa)
  misc_feature (71): n=t or c
attgaacatttgaactgggacttgggagttaaaagaggtatctagagtgacacatcacatgttgttacggntttgcttggagttgttgtatattatgatgt

SEQ ID NO: 21389 - DNA, 101 bp, rice(Oryza sativa)
  misc_feature (71): n=a or c
gtcaagcttctgaccgataagatgcaaatattcgtccacaatgtcttcgatcccatgtacaagtactcgtncctcctccacccagatttcatatgtctggt

SEQ ID NO: 21390 - DNA, 101 bp, rice(Oryza sativa)
  misc_feature (71): n=a or g
aaaaaaattaaaaatagccaaaaacggtacagttgaaaacggtacccctatacgaaaacggcattcggtcnatcgggaatttccgtgaccgttttcatccc

SEQ ID NO: 21391 - DNA, 101 bp, rice(Oryza sativa)
  misc_feature (71): n=t or c
aggtcgcctttgaagcggctcatctcaaccactacatgctcttgtgacaaccggtcgaatcctagcccgangttcctgccaactctcgtgacatggcggcg

SEQ ID NO: 21392 - DNA, 101 bp, rice(Oryza sativa)
  misc_feature (71): n=a or g
gggcaacagtctaaatccgcgtatttcttgtggtacaatgtacaataatttacacatgcatgaatcttttnaacacttagagataatggacatatcagttt

SEQ ID NO: 21393 - DNA, 101 bp, rice(Oryza sativa)
  misc_feature (71): n=t or g
acggacgtaatcaacgataggaacaacaaaagggggaatgagatatattcatggctagaaacaagctatgngtacacctcgagtttttttttagcgtcatt

SEQ ID NO: 21394 - DNA, 101 bp, rice(Oryza sativa)
  misc_feature (71): n=t or c
cttcactagtacagtctgacatcagttggcaaacattatcgtccaacaaaacacaaagaccatccttcagntctttcattgggaacaaccaatgcaaaagc

SEQ ID NO: 21395 - DNA, 101 bp, rice(Oryza sativa)
  misc_feature (71): n=t or c
tatttgttagtgctgttatcatataatgtgtctttgttagagcaccagtaaggacacccgcaatggttatntataggctatctacaagagatccatgtcaa

SEQ ID NO: 21396 - DNA, 101 bp, rice(Oryza sativa)
  misc_feature (71): n=t or c
aatgaaatggaattacagaacaaaacagtgatgattgatgcatatggaccagaaaaagctctgggactttnggaggagaatggcttgttagcacgatggtt

SEQ ID NO: 21397 - DNA, 101 bp, rice(Oryza sativa)
  misc_feature (71): n=t or c
ttttgacacattccttctggctagtgacaaaatatcagaaacacggagaaggcactggtacagaagagtanatcagatttcaacattcattcactcaacat

SEQ ID NO: 21398 - DNA, 101 bp, rice(Oryza sativa)
  misc_feature (71): n=a or g
agaagggcctcgggagactcatgagggggaactgttgtaacctcgtcggctggctcaatttctgggagagngtcggtcaaggcgatccttgcccgtgagaa

SEQ ID NO: 21399 - DNA, 101 bp, rice(Oryza sativa)
  misc_feature (71): n=a or g
aaaggatcaatctcattaacattctcacgttttttcaacaactagttgagtgccttgcgttgctgcagganaaaaatagtaaattaaaatcacaatgagaa

SEQ ID NO: 21400 - DNA, 101 bp, rice(Oryza sativa)
  misc_feature (71): n=a or g
caactgcaagatattaggggcataaagataagctggaaacaacatagtttgctgatcagatagaaatcacngtagctgatactagctaatactacatacta

SEQ ID NO: 21401 - DNA, 101 bp, rice(Oryza sativa)
  misc_feature (71): n=a or g
caaacaccgatgatatagccaagagtcaggagaacatatatcatttaggtgagataagaatgataaaactncgtattactctgtacaagtagagattgtat

SEQ ID NO: 21402 - DNA, 101 bp, rice(Oryza sativa)
  misc_feature (71): n=a or g
agaggggtgtttggttcattccctcattttgttacgcaatatttatgccatatcatattccctccgtcccntaatatatgagattttgagtttttgcttat

SEQ ID NO: 21403 - DNA, 101 bp, rice(Oryza sativa)
  misc_feature (71): n=a or g
acacatctaggaatagaataagaaaatcaccttatgaaatcatgaagttgatttatagtagctgacatatntaaggtctgaaaaggggtaaaatcacatat

SEQ ID NO: 21404 - DNA, 101 bp, rice(Oryza sativa)
  misc_feature (71): n=a or g
ggttgtactcagctacgatattaagcaatttcctccctcagctcttgaaacatgataaatttttttctctntggtaaataaggacaatatagaaatagatt

SEQ ID NO: 21405 - DNA, 101 bp, rice(Oryza sativa)
  misc_feature (71): n=t or c
gggaggctggcggcggcacgagatacgaaagctgaagcagcgaactccgcagccgcagccgaggcagaggnagagaaggctaggagggagtgggtggggtg

SEQ ID NO: 21406 - DNA, 101 bp, rice(Oryza sativa)
  misc_feature (71): n=t or g
tttggcatttaggtatgcaaattgcatcttctacatcttgcgagttgcatactgttttgcgatacttcaanacacaatttcagtggctagagtatgtattt

SEQ ID NO: 21407 - DNA, 101 bp, rice(Oryza sativa)
  misc_feature (71): n=t or c
catggcggtggcagatctggtgggtagaggacattgtggaataggagaaataggatagggaagcggtggcngagatggagaagggagagggggaggcacag

SEQ ID NO: 21408 - DNA, 101 bp, rice(Oryza sativa)
  misc_feature (71): n=a or g
gctgctcaggcttgacaagcgatttactgagttcatgcttgtatttcacttccgtctttgggattggtgcncctcgtagcaattgatccgtagttagcccg

SEQ ID NO: 21409 - DNA, 101 bp, rice(Oryza sativa)
  misc_feature (71): n=t or c
gagagcatctctatgggtgtgccaatacttgcattcccaatggcagctgagcagaaactgaatgcaaaatntgtggttgatatgctaagagttgggctcag

SEQ ID NO: 21410 - DNA, 101 bp, rice(Oryza sativa)
  misc_feature (71): n=a or g
ttcgatctgggccgaagtcgcgcgggcggcaataccgatttgccgtcctccatggtggctacgtcttgatnaagattgatcgatctcgccggatcgaaaat

SEQ ID NO: 21411 - DNA, 101 bp, rice(Oryza sativa)
  misc_feature (71): n=a or c
gcttcgattttttttttaccttttaccaccccagcaaaagaatccaacgaactccaagaattgcagagaanctatgctgctatgctgccgcctgcaggtcg

SEQ ID NO: 21412 - DNA, 101 bp, rice(Oryza sativa)
  misc_feature (71): n=t or c
tcaagccgacgcctttgggattcttgtgactgggtgtttgatctgctcagagtcttgtggttccacgttgnaggtcaccctcttcttagccatctccgccc

SEQ ID NO: 21413 - DNA, 101 bp, rice(Oryza sativa)
  misc_feature (71): n=a or g
cttctgatgaaacaagtgcttatttgcatccactctttctgattttgaagaccatcggtttacgcagcaanaacttcaagcatgcaagcctatactgatac

SEQ ID NO: 21414 - DNA, 101 bp, rice(Oryza sativa)
  misc_feature (71): n=t or c
ctagtctgatcaatcactttgtctcacgccatttggataatcaccttgtcatagccaagaaccgcctttanaccgtcttgacaatctatgccactgcagcg

SEQ ID NO: 21415 - DNA, 101 bp, rice(Oryza sativa)
  misc_feature (71): n=t or c
cgaaaacggaaatccgttatatagcagcccccttgatttatggtgtttggttgtggagatccatgttgatntattttcttttatgctgtagatttgtgatg

SEQ ID NO: 21416 - DNA, 101 bp, rice(Oryza sativa)
  misc_feature (71): n=t or c
caagaacatcgacgtcgcgaacacggtttcgcggtcgatccgggcaggggcaatctggatcaattgctacntcggcttcgaccccgacgtgccgttcgggg

SEQ ID NO: 21417 - DNA, 101 bp, rice(Oryza sativa)
  misc_feature (71): n=t or c
cacaaagaggataccggagagagccagttcgtggtgatggatgccatgtctccagaactggaaattgttgnagcggtgcagctgcctgcccgtgttcccta

SEQ ID NO: 21418 - DNA, 101 bp, rice(Oryza sativa)
  misc_feature (71): n=t or c
taatttggagagatttggtgatgctgcaagagaattcctcccattttctccattttttcttgctccaccanacaacaggtgaagaactccctgtcctccaa

SEQ ID NO: 21419 - DNA, 101 bp, rice(Oryza sativa)
  misc_feature (71): n=a or g
gcagatgcagaagaggtccaagaggataatagcgaagagagtgattataactggggttcagaggatgacgntgctactgacacctgatattgttgccagcc

SEQ ID NO: 21420 - DNA, 101 bp, rice(Oryza sativa)
  misc_feature (71): n=t or c
cacatgggatgtaaaccaagttaaccccccacgtaagtgccacataggatgaaatcacctccaaaactgcngggggagtcaatttgcaacggttttgtgag

SEQ ID NO: 21421 - DNA, 101 bp, rice(Oryza sativa)
  misc_feature (71): n=a or c
aggtaagggtatctcaacagtaaataatacttcacaaaaaagatgttcattacatgatgattttactactncagctgccgggaagattgccagtgaccgct

SEQ ID NO: 21422 - DNA, 101 bp, rice(Oryza sativa)
  misc_feature (71): n=t or c
gattatgatctcaaatgcgtcttttgcaagttcatagatcctgataacatctctggacaagtttaaaaacnagctatatattttactctttttcattcttc

SEQ ID NO: 21423 - DNA, 101 bp, rice(Oryza sativa)
  misc_feature (71): n=a or g
aatgaatgactgcaaccaacaggaatcttgtcacattcatgaagcatgcagcccatacttgctaatagtgnaagatcttgcaaaaacagattctttagtga

SEQ ID NO: 21424 - DNA, 101 bp, rice(Oryza sativa)
  misc_feature (71): n=t or c
acatgttggtcccatatgtcagtcttaataatcccttaacccatatctctgtgtctctcatcccttaaccnataacttcttcactcagttctccatctcag

SEQ ID NO: 21425 - DNA, 101 bp, rice(Oryza sativa)
  misc_feature (71): n=t or c
ataacaaagtgccaatgttttgtgctgtgtgtatatatgttgacgaagttgggccgcaaacgaggtaaaantacaaccccgtcaatatatgtgtgtatatg

SEQ ID NO: 21426 - DNA, 101 bp, rice(Oryza sativa)
  misc_feature (71): n=t or c
tctggtgtggataagatccggttgaccggcggagaaccaaccattagaaaggatatcgaggatatctgttngcatctttccggcttgaaggggctgaaaac

SEQ ID NO: 21427 - DNA, 101 bp, rice(Oryza sativa)
  misc_feature (71): n=a or g
gtcactttatctgctatttatctttcgtctggtataaagtcgcaacaacaaaagcagtgcattcatgatgnctaccttgtggtagggtgtttagtctcttg

SEQ ID NO: 21428 - DNA, 101 bp, rice(Oryza sativa)
  misc_feature (71): n=t or c
aatctttggtttcccaaaatagagttatatataactttatggcatcgagccttattggttgcctatattcnctactaagacaaaacggtttattagagaat

SEQ ID NO: 21429 - DNA, 101 bp, rice(Oryza sativa)
  misc_feature (71): n=t or c
cacttgcgcacctcgtcgtcgtaaacacgggcacgaagagcgccgaagaaatctgcatgcagcaattcgancattcagtttcagtttcctttaattttaat

SEQ ID NO: 21430 - DNA, 101 bp, rice(Oryza sativa)
  misc_feature (71): n=a or g
atggcgcttcccacggtggcgatagcttgtgttgatctctggtggtttgcacttggcgcaggactaggtcnccaaccgagaatgagcggtcgtgaacattg

SEQ ID NO: 21431 - DNA, 101 bp, rice(Oryza sativa)
  misc_feature (71): n=t or c
gtttaaacccaccacttagagattgtggatcttcttccaatgaaatgccattcagaccaacctagcatgtnatgcatagcacaaattatgtcaagggtaaa

SEQ ID NO: 21432 - DNA, 101 bp, rice(Oryza sativa)
  misc_feature (71): n=a or g
aacgcattgtttagtagtttggaaagcgtgcggatagagaacgagtgaggtgagttagggaaagagggggnaaaacacagtattagaagtgtttatatttt

SEQ ID NO: 21433 - DNA, 101 bp, rice(Oryza sativa)
  misc_feature (71): n=a or g
agatggcaacacaagactatgctcaagttcatcttactctatatttggattcccaatttgcccaactacancacttgccaaaagaaagaataatgcacact

SEQ ID NO: 21434 - DNA, 101 bp, rice(Oryza sativa)
  misc_feature (71): n=t or c
catcaatgcaagggtgaggctatggaagcctatgatagaagacatgtacaaggaagaaacgaagccggaancatctgatggcaacaacaaattaaacccta

SEQ ID NO: 21435 - DNA, 101 bp, rice(Oryza sativa)
  misc_feature (71): n=t or c
tttagatcattaaataaataattgttttaaacaaaaaagcattccaccctccctgtcctcatgcggtgtgngtcgttcgttttctcttatttttctattta

SEQ ID NO: 21436 - DNA, 101 bp, rice(Oryza sativa)
  misc_feature (71): n=a or g
cagaagtgaagcattgttatggagttagagttagaaccatacccaacaaacatgccgcttgtagtacttgncttgggaattttaattttttaattagaaaa

SEQ ID NO: 21437 - DNA, 101 bp, rice(Oryza sativa)
  misc_feature (71): n=a or g
tctcggtttattctttagaaaaaatcaagatttaaccatggcgggatatgctgatgctggatatttgtcanacccccataaagcattgtcacagactaggt

SEQ ID NO: 21438 - DNA, 101 bp, rice(Oryza sativa)
  misc_feature (71): n=t or c
ctatattgaccgttggatttactttgcagtccgatctggtgcaaatgaactgactattgacctaagtccangatggtatgctcatcctcgtgatgtcaaat

SEQ ID NO: 21439 - DNA, 101 bp, rice(Oryza sativa)
  misc_feature (71): n=a or g
aaaaagataaaaaagacaaatatatcctattcaatttataatgcaagttaatttaggtggaagatttgatnaatttacaccgttagatcaaatatactgct

SEQ ID NO: 21440 - DNA, 101 bp, rice(Oryza sativa)
  misc_feature (71): n=a or c
cacttatgtggtgatctgatggatgaggttatggatgaggaaactagtcacctaagttgtgactctaaaanagttcttaaagcttataagtcaaaatcaag

SEQ ID NO: 21441 - DNA, 101 bp, rice(Oryza sativa)
  misc_feature (71): n=t or c
ttcttctgcaacttcattccagcagcaaacgatggcggaggaacatcaaagccgacgtcaatattcactanatcctccaacaccatgtccttggtccaacc

SEQ ID NO: 21442 - DNA, 101 bp, rice(Oryza sativa)
  misc_feature (71): n=a or c
tcaaaacgcaaaaaaaaaaaaaaaaagaaaagaaaaagaccctcgcttccgtttcctcctctcccaaactngcctcgcctcgccttcccgcccgccgccgc

SEQ ID NO: 21443 - DNA, 101 bp, rice(Oryza sativa)
  misc_feature (71): n=t or g
tgacgtcacacgagagatgtcactagataacttcaaggatgaggtgtccaaggtgtttcatgttgaggttncagatgtgtcactgaaatactttctcccga

SEQ ID NO: 21444 - DNA, 101 bp, rice(Oryza sativa)
  misc_feature (71): n=a or g
attacaagagttggttaaccaggctaatgcaacctgaactggttaaggtccaactaataggctgtgacaancataacttttgtccatgttttttatggatc

SEQ ID NO: 21445 - DNA, 101 bp, rice(Oryza sativa)
  misc_feature (71): n=a or c
agatcaaacatgcatgtgctaccgtggtactggcagtgtgtgctataaataaatatggtaccgatgcaagnaagaaacaaaacgcatgggaaagcaaagca

SEQ ID NO: 21446 - DNA, 101 bp, rice(Oryza sativa)
  misc_feature (71): n=t or c
atcttgtctcagttcctttcggaatttctgttggaggctccaaacgctcgaataatgaagcgttatattanggaagttcgtttcttaaatattatgattac

SEQ ID NO: 21447 - DNA, 101 bp, rice(Oryza sativa)
  misc_feature (71): n=t or c
tccctacggaactccacatatcagccttagagtagggataaattctagcacattttgtcttggtgaggatncaaaaataaaatattcatccttgagaaata

SEQ ID NO: 21448 - DNA, 101 bp, rice(Oryza sativa)
  misc_feature (71): n=a or g
gataatgccccattacgtgactgcactaacccaaatgtttctcacgtgcagattgtaacagcaggatacgngtctctgtaagggactactactgctacaaa

SEQ ID NO: 21449 - DNA, 101 bp, rice(Oryza sativa)
  misc_feature (71): n=a or g
gccatcgccgcccccccccttctcttgcgtcgtcgccgccgtcgcgtcaccggatctcatctccctcctcnccccacacccctacttgtctcctccccacc

SEQ ID NO: 21450 - DNA, 101 bp, rice(Oryza sativa)
  misc_feature (71): n=t or c
tatccctccatctaaatgggccaacgggcctaagaattagatattaagtctatatatcctccctcaacttngaattaaattttatgatactaaatgaactc

SEQ ID NO: 21451 - DNA, 101 bp, rice(Oryza sativa)
  misc_feature (71): n=a or c
cccgcaccgatgcggtgccagccttgagcggagtaaggaaccggtatcgcgtagctgtaggggtagttcgnggcgagcgcgtcgccgccggcgaacaccgt

SEQ ID NO: 21452 - DNA, 101 bp, rice(Oryza sativa)
  misc_feature (71): n=t or c
cccttggagtgaaattgagggcaagagagcccatgatcctatcttccaaaactacttcagccaaaactgcngccaatctgttgatggtttctgcaagaaga

SEQ ID NO: 21453 - DNA, 101 bp, rice(Oryza sativa)
  misc_feature (71): n=a or g
ggagccttcaacagtcgaatcagaacctgaactttctaattcaacttattcgactgacgaagtagttcccnagccgtcatccattgcgaaagaagaaattc

SEQ ID NO: 21454 - DNA, 101 bp, rice(Oryza sativa)
  misc_feature (71): n=t or g
ccttgttgccgccgttaattagtgcatccgtttttcttgggatgtggttatgcatctacctcgtcacgtgntttattttagccctcaaacttctacttctc

SEQ ID NO: 21455 - DNA, 101 bp, rice(Oryza sativa)
  misc_feature (71): n=t or c
cgtcttataccatatgctcccagaatgatcatggcgacctaggcagacaaggatgaagcaatgggcatcangtttcctctgcctttggccaaaccctatgt

SEQ ID NO: 21456 - DNA, 101 bp, rice(Oryza sativa)
  misc_feature (71): n=t or c
ccccgttgctagatccgaagtctccacaacagatttggctagggtcaaataaccgacgtggcttgggacgntgggagaaaggtggagtgggtgacggcagt

SEQ ID NO: 21457 - DNA, 101 bp, rice(Oryza sativa)
  misc_feature (71): n=t or g
ttgttatccaacaataagtttgatcccttgatatcccgatgcaatacattattattgtggcaatgctcaanccctgacaatagctgctgcacatagcattt

SEQ ID NO: 21458 - DNA, 101 bp, rice(Oryza sativa)
  misc_feature (71): n=t or g
aagatggttccttttttttgttttaccttgtcgctgactgaacgctggtggccttggtcgatggaagaatnatctccagatgatgcaacgaatgtgtgaag

SEQ ID NO: 21459 - DNA, 101 bp, rice(Oryza sativa)
  misc_feature (71): n=t or c
tggagaatttattgggtacatgaattcttacttacgagttaggaacgaccagtcctgacgtaccttttgtnatcgaaaaggaaaaaaaatatttgctcaaa

SEQ ID NO: 21460 - DNA, 101 bp, rice(Oryza sativa)
  misc_feature (71): n=a or g
tctagaaactaacaatggaggtgaaaaataaatatatttggtctgatcataaacaagtggtaagtaccatncagaactcaactgtgttaggctatcctcta

SEQ ID NO: 21461 - DNA, 101 bp, rice(Oryza sativa)
  misc_feature (71): n=t or c
agtcagtcatgtaaactagtgatactttttgatgaagtacttggtacagctacatatgtaggcaaatctanactttctataaagttaaaccccactaaatc

SEQ ID NO: 21462 - DNA, 101 bp, rice(Oryza sativa)
  misc_feature (71): n=t or g
tttctttgagataaaggctgtgagtgaaatagagccagctctcaagaaacagcttataatttccactgctnttatgactgttggcattgcccttgtcagtt

SEQ ID NO: 21463 - DNA, 101 bp, rice(Oryza sativa)
  misc_feature (71): n=t or c
ccgacgaccacaccaaccatacccctcggcatcaacaacttcaccgcttccgctgcccaagcacttcaggncggcagaatcggcaccagtgttttagcgaa

SEQ ID NO: 21464 - DNA, 101 bp, rice(Oryza sativa)
  misc_feature (71): n=t or g
catccttggggaacgccttgtcgagagaaaccttattggcagtccggagatcggcgtcgtcttcgccgtcntcggcccactcgggcgccttcccgggccag

SEQ ID NO: 21465 - DNA, 101 bp, rice(Oryza sativa)
  misc_feature (71): n=a or g
gattaaacacgggtccacaggattgcaaccacacacccttactactgcattatcaagtgtatcttgccatntacttcctccgtcccaaaaaaagacaaact

SEQ ID NO: 21466 - DNA, 101 bp, rice(Oryza sativa)
  misc_feature (71): n=t or c
atcagccatagaagatttacgttttttatctagatgtgctatagctatgacctgataaagtattaatggtnaggaaggtctgacaaagacatatgcatata

SEQ ID NO: 21467 - DNA, 101 bp, rice(Oryza sativa)
  misc_feature (71): n=t or c
ttctaagttacattcaagccacatccaagggtgagtgcaccccttggcgttcaaaacatctaagaacacantgtaaacttcatcatttaacatttaatgaa

SEQ ID NO: 21468 - DNA, 101 bp, rice(Oryza sativa)
  misc_feature (71): n=t or c
caaatcgtcgtgtcaggaccagctgcgacatccctctgccgcctcttcctagaccggctgcgacatccctncgccaccgctcgccgccgtccacccccgcc

SEQ ID NO: 21469 - DNA, 101 bp, rice(Oryza sativa)
  misc_feature (71): n=a or c
gatgtcgtagccaacttctttgccaaagatgggcacggtgacctcgtacaagccatcgatagctatctccnactctggcgcgtggaagaagtggtcggagc

SEQ ID NO: 21470 - DNA, 101 bp, rice(Oryza sativa)
  misc_feature (71): n=a or c
tcaaggagctataaatgacattttgtctcctgtgtttaggaaatatgccttagttttctttgatggcattntaatcagcagtcctgattataatactcatg

SEQ ID NO: 21471 - DNA, 101 bp, rice(Oryza sativa)
  misc_feature (71): n=t or c
gtcatgataggaattaggcaagcactgaattatattgaagatggagaaagaggtaccaaaaaatttattgngaatttccgtagcttctagtacccaagata

SEQ ID NO: 21472 - DNA, 101 bp, rice(Oryza sativa)
  misc_feature (71): n=a or g
agtccagcaaacgccaccaaggcaacagcctccgcggccgattcagtaaacgttgttaagatagcaaatcnttcagccgattcagcaccaaggctcaatga

SEQ ID NO: 21473 - DNA, 101 bp, rice(Oryza sativa)
  misc_feature (71): n=a or g
cgggaaaccacccttcacaactacaacaacgacttccaacttcaccaccaacaaagacaagagttggggcnagcagagcagcagaaaacacctaggaggaa

SEQ ID NO: 21474 - DNA, 101 bp, rice(Oryza sativa)
  misc_feature (71): n=t or c
gaaccacggatccttgaaggcgacgaggtcgttcggcggtgtgaaccagcagtgttgcaccgacaacgagngatgcgccctgtgcgggtggatcaggacca

SEQ ID NO: 21475 - DNA, 101 bp, rice(Oryza sativa)
  misc_feature (71): n=t or c
gatagtatgtttacctgaccaatgggaagctttcccttccgcttccttgtgttggagtcttgcaagacaantggttttgttgcaggaacttgatcgttatt

SEQ ID NO: 21476 - DNA, 101 bp, rice(Oryza sativa)
  misc_feature (71): n=a or g
ggtgtcggatatccaggacagtacgcgtatatacttccaatgacactatatatccgacatggaatggtgcnagaaagcggtgttaacggtaacaggatcag

SEQ ID NO: 21477 - DNA, 101 bp, rice(Oryza sativa)
  misc_feature (71): n=t or c
ctaccccattctagtattgtcaaaatcttgtttcgacgccgaggtaagttcttcacccattatcaccgacnatcctttgcaaaactcgctcgaaatcaata

SEQ ID NO: 21478 - DNA, 101 bp, rice(Oryza sativa)
  misc_feature (71): n=t or c
gatgtcgaaggctaaaaatactaacctttcggcagaatgggcagctgaagttgaggcagaattaatacagnaacaattgaatggacggtacaaattaagtt

SEQ ID NO: 21479 - DNA, 101 bp, rice(Oryza sativa)
  misc_feature (71): n=t or c
aactacagtaaccatgtgaacataggcattgtgaacataccttatcgtatttatggatcctccgtatatangtaggtaatcacacataaattaatacagag

SEQ ID NO: 21480 - DNA, 101 bp, rice(Oryza sativa)
  misc_feature (71): n=a or g
agttaggctgtgttctttccagtggtggtatgtaaacctgcaactactagtagtgtgtgtttcagaagaangggattgaggagattgagaagatacgcaaa

SEQ ID NO: 21481 - DNA, 101 bp, rice(Oryza sativa)
  misc_feature (71): n=a or g
gcagaggagcgttgggctttcgatgatggcgacggcaaaatcaatggccgcagccacatacataagagttngttccagcgtcatgcatgggcttcgaacaa

SEQ ID NO: 21482 - DNA, 101 bp, rice(Oryza sativa)
  misc_feature (71): n=t or c
ccgaagaagaagaagcagcagcagcgaatcgaacaaacaatacaaaacccacgcgacgcgactcaagactngcacccaaatccattcccacccaccggatt

SEQ ID NO: 21483 - DNA, 101 bp, rice(Oryza sativa)
  misc_feature (71): n=t or c
gaggggcgaggccacgacctccacaacacggctgcgtcgttctcccacacgccgctcgtcctgaagttgtnagagagttgcagaagaacgtgtgtccaaag

SEQ ID NO: 21484 - DNA, 101 bp, rice(Oryza sativa)
  misc_feature (71): n=a or c
cccgatcaccaccacctaccattggagctaccaataccaataccgtcaagttcagctcagtcctcaaggantccacctccattgacgatgacatcatgctc

SEQ ID NO: 21485 - DNA, 101 bp, rice(Oryza sativa)
  misc_feature (71): n=t or c
attcgaacataattattgtttgggttcatttttacttcctacttttcaagatgtctcgccaaaccgtcagnggctttgccattatactcctctacggctcg

SEQ ID NO: 21486 - DNA, 101 bp, rice(Oryza sativa)
  misc_feature (71): n=a or g
tagaaaaagaaataagtgctgatatgccccaattggtgaattattaccgagcgcatactacccttttacgnaaagagatcgagaaaacaacgagcacaaga

SEQ ID NO: 21487 - DNA, 101 bp, rice(Oryza sativa)
  misc_feature (71): n=t or g
ggaacgaaatgtaattgcaagaaatggtgatgaaatgcaaatgcaggtggtgttcgaaatcctggtgaggngcctgatcgggctggaggcaggggaggaga

SEQ ID NO: 21488 - DNA, 101 bp, rice(Oryza sativa)
  misc_feature (71): n=a or g
atcttggacagcatcacaacacgcatgaatgtctctattctgtctatataatgctgcctctggttctattnctcgatcaggagggcatcaatgttgcgctt

SEQ ID NO: 21489 - DNA, 101 bp, rice(Oryza sativa)
  misc_feature (71): n=a or g
cagaagaaggcaatcctggatgaaagatacaatattgcagggcatttcgcagttggtgctggacatgttantccttctgaagccattgaccccggtctgat

SEQ ID NO: 21490 - DNA, 101 bp, rice(Oryza sativa)
  misc_feature (71): n=t or c
tgtgcatatcacgtccgatttttctttgctgcatcggacgtccgaccactagcatttttgatatacgagancttatggtttaggccacctatttgaccacc

SEQ ID NO: 21491 - DNA, 101 bp, rice(Oryza sativa)
  misc_feature (71): n=a or c
ttataccaaccgggaataaaaataattggggtctgtcttgaacccgacaatgtcttgaacccgacaacttnttgaaccaggactaaaaatgatcttgaacc

SEQ ID NO: 21492 - DNA, 101 bp, rice(Oryza sativa)
  misc_feature (71): n=t or c
ctgtcaggtgattccacgtgagagcgagctccgatctaagttatcgatatcagcaaggaattttgcgagcnggccagccggataagaacaacatcctctaa

SEQ ID NO: 21493 - DNA, 101 bp, rice(Oryza sativa)
  misc_feature (71): n=a or g
gctcgttcaatctactctaatctatctctataggaagggaaacccaaaccataatgcaaagccgtctcgcngaggagttgcgagcgctgaagttcgaccgt

SEQ ID NO: 21494 - DNA, 101 bp, rice(Oryza sativa)
  misc_feature (71): n=t or c
acaccgtcatcaacagctcttccgagatcatccagtatactatcagtgctgcctcttaagacagcaatagncaccgagtttcgaccttcttcattcttgag

SEQ ID NO: 21495 - DNA, 101 bp, rice(Oryza sativa)
  misc_feature (71): n=a or g
cttacaccctgctggaccatcttctgaaacaattctagaatgaagaacagttcctgtgacctcctcatccngacatcagttgcagaacgccctcctctaga

SEQ ID NO: 21496 - DNA, 101 bp, rice(Oryza sativa)
  misc_feature (71): n=t or c
tatccaatataatggtatagtccctcatggggaaacatatgtgtttgacgtcatatcgttaggtttaaggngtgggccagccacctaatagctctaggtca

SEQ ID NO: 21497 - DNA, 101 bp, rice(Oryza sativa)
  misc_feature (71): n=t or c
cttctcctcctcggttctgtatctccggccgtgctcgctcatccccagtcctcaaattttgccttcatggncacctcatccaccacattgtcctcctcggc

SEQ ID NO: 21498 - DNA, 101 bp, rice(Oryza sativa)
  misc_feature (71): n=t or c
tgccatcggcgatggcggcacgctgcagtgggccatccaaaacttcatccgcgccagtgactacatcacgntgttgcacgtctgcccgccagcgaggttgc

SEQ ID NO: 21499 - DNA, 101 bp, rice(Oryza sativa)
  misc_feature (71): n=t or c
aaggaagaaaaagacatgcatgtctaagaggaaaaacaagtatggacgtcagcacatgtagcagtacttcntctcacaattcgttcgtcgctggttaacac

SEQ ID NO: 21500 - DNA, 101 bp, rice(Oryza sativa)
  misc_feature (71): n=t or c
ctaccaaaatgtgtaaagtaggtagctcgaccaaaaccaagcctccttactacatcgcaccaccgaccctngtgatcaagatccataagttatagtagcac

SEQ ID NO: 21501 - DNA, 101 bp, rice(Oryza sativa)
  misc_feature (71): n=a or g
ctggttgagtgtctcaggcttgacagttccaaacgtcaacccttgtcgcaacgatgatctgtcattcccantcaggtgctctggtgatagaatggagggtg

SEQ ID NO: 21502 - DNA, 101 bp, rice(Oryza sativa)
  misc_feature (71): n=t or c
gtcaactttcataaatcatgtatgattcccatcattgatcatgaagagaaattgcagatcctagctggaantttaggctgccaaattggttctctaccctt

SEQ ID NO: 21503 - DNA, 101 bp, rice(Oryza sativa)
  misc_feature (71): n=t or c
tatggagtgtaaaacgtctatgtaagcagggctaagcagtaagtaaataatcacgtgtaacgtaatagacncaggtaacaaaggtatgtaaatacataagg

SEQ ID NO: 21504 - DNA, 101 bp, rice(Oryza sativa)
  misc_feature (71): n=t or c
cttaggtgatattcagccccagcctaccacctacatgtcaagttcctacgataaaaaacaacagatcaatnacagaagacacgagatttaacgtgaaaaac

SEQ ID NO: 21505 - DNA, 101 bp, rice(Oryza sativa)
  misc_feature (71): n=t or c
gtactcccaagaacagtaatgcacatcaacaagaaacagtagacaagccaagaaacggatacctccgcgcncgcccaaatcaagaacgtgacgaaagcgaa

SEQ ID NO: 21506 - DNA, 101 bp, rice(Oryza sativa)
  misc_feature (71): n=t or c
cttctactaggattctcttacattcatatcttccggtctgttcttcaaacttttgaaatttcgactccctntaaatttgacttattttccatacacgcacc

SEQ ID NO: 21507 - DNA, 101 bp, rice(Oryza sativa)
  misc_feature (71): n=t or g
gtcgaccgacgggtgcaatggagcgaataagtcaaaagtttcttcatttcagcaatccacgggcccacctntctacctccacggaaggtagaaagggaggt

SEQ ID NO: 21508 - DNA, 101 bp, rice(Oryza sativa)
  misc_feature (71): n=t or c
atatgatttcttcgtccaaggaggacagaggaaaactgacaacaggaatcccagtcatgctgtattttttnccaagttacatgagttatgtcttcaaggaa

SEQ ID NO: 21509 - DNA, 101 bp, rice(Oryza sativa)
  misc_feature (71): n=a or g
acccaaggtctgcaccactatttaaaggacagctacagctacagagcacgatttaaactagtactccctcnttactcgcaaaggaagttatcttggacaac

SEQ ID NO: 21510 - DNA, 101 bp, rice(Oryza sativa)
  misc_feature (71): n=a or g
gaggataaaatgttgttcatcaccccttgaaaagtggccgaagcaatggtaagaccaaagggaatgacacngaattcaaagtggccatggtgagtacggaa

SEQ ID NO: 21511 - DNA, 101 bp, rice(Oryza sativa)
  misc_feature (71): n=t or c
tttatcttgaagaactcgtcctccacttcattccctgcttcaccctccaatcctaattcttccttttcctnctcctctgattcctcttcatcatctacatc

SEQ ID NO: 21512 - DNA, 101 bp, rice(Oryza sativa)
  misc_feature (71): n=t or c
atcagccatgacctagtggcaagtggctaacgtgtttgatccacctaaactttgaggtgtgctatgttatngacctcagcggtgttaaagttctatagctt

SEQ ID NO: 21513 - DNA, 101 bp, rice(Oryza sativa)
  misc_feature (71): n=t or c
tcaaagcggcaatgcctcctccaaacctaaaactctatactctatagcccaatccgctcatttctttctcngactcctcaatcattgtcccctgcaccaac

SEQ ID NO: 21514 - DNA, 101 bp, rice(Oryza sativa)
  misc_feature (71): n=a or g
ctgaaaaattctagatttgtagacacgtggttagcgatgtatgtattagacatgtgcaaatgtagagatgncaatgcattgaacagatacctggtaaatgt

SEQ ID NO: 21515 - DNA, 101 bp, rice(Oryza sativa)
  misc_feature (71): n=a or c
tctagagtagttacttttcttgttgaaacttgcaaaggccttgggttttgtcactggaaaccgttgtcttncccaatgctaattttgaaggggaaacaagg

SEQ ID NO: 21516 - DNA, 101 bp, rice(Oryza sativa)
  misc_feature (71): n=a or g
ctgggttatgaatggcatggggtggagcagcgtgcaggctgaactttttctgcatgtcggtgttgtcatcngggaagaaggttgtcgagctgagaaggaag

SEQ ID NO: 21517 - DNA, 101 bp, rice(Oryza sativa)
  misc_feature (71): n=a or c
tctctatcttgagtgtgtgaaggagcctcaacgcagagcagggaagacttccaagcattataccccctagntctgccaaagtatgaagaatatgtaagcca

SEQ ID NO: 21518 - DNA, 101 bp, rice(Oryza sativa)
  misc_feature (71): n=t or g
gaagtttttagcctcaattgatgtgacgaaccttaacaccgttgttttatgtatttattaggtgctcgaangaatattgaagataaatgcaaacaatgttg

SEQ ID NO: 21519 - DNA, 101 bp, rice(Oryza sativa)
  misc_feature (71): n=a or g
cccagtttcctatctaagggcaatcacagtgtgtcaccgatttttgccattgctcgtatgccacgtagatnaagaacctcgtaagcttcatacttcacagt

SEQ ID NO: 21520 - DNA, 101 bp, rice(Oryza sativa)
  misc_feature (71): n=a or g
agtgagaagcgcatatgggctcgcatgtaaccttgttaatatggagaccagttctagttcttcttccgcangatgcaaaagaatgtggaatcttatatggc

SEQ ID NO: 21521 - DNA, 101 bp, rice(Oryza sativa)
  misc_feature (71): n=a or c
cagcagctaaaaccaactataaatagtattgatgaacttcggaaaagcggggaaaacataggataccacgntggttcctttgtcaaaaaccttttggaaga

SEQ ID NO: 21522 - DNA, 101 bp, rice(Oryza sativa)
  misc_feature (71): n=a or g
gtgtctatcaacagagatatttcacggcgctgggaagatactagagaaacctcccaacatgagaagtgatnaaccatccatattttgtcaaactgtttaca

SEQ ID NO: 21523 - DNA, 101 bp, rice(Oryza sativa)
  misc_feature (71): n=t or c
tttttaaaagattgaaacattttcgatctatttagcgaaatattttcagtctacttagtgacacagcgtcnaatttttgagaaaaaaatcggacgcctgat

SEQ ID NO: 21524 - DNA, 101 bp, rice(Oryza sativa)
  misc_feature (71): n=a or g
ggttaatttgttcgtaaatattcataaaatttgacaaagagaaaggaataaaagataaaggaatggtgcgntgcagggtactcacagcacgagcgaagtcc

SEQ ID NO: 21525 - DNA, 101 bp, rice(Oryza sativa)
  misc_feature (71): n=a or g
aattcataaaagtaaagatttgaaaatttgaaatcgctttaggatactctttgaaatagggcagatcactngagcctcgccaattgtgcccggaacccctc

SEQ ID NO: 21526 - DNA, 101 bp, rice(Oryza sativa)
  misc_feature (71): n=t or c
catttcgaacatgaactcgtttttcaaagtttcgcctagatggcgccttaggaagagcacagtcgttgccntttctgcgtcggtgcagttggagccaggaa

SEQ ID NO: 21527 - DNA, 101 bp, rice(Oryza sativa)
  misc_feature (71): n=a or g
tggacgcaagcaaatgtcacttggttttaggcgctgtgactttgagcacgccgtgtatgctcgaggtgagngaacacaccgcttgcttgttggtgtttatg

SEQ ID NO: 21528 - DNA, 101 bp, rice(Oryza sativa)
  misc_feature (71): n=t or g
aaggcaaggttagatcagctatccattgggccggtgcctattcaatccaatatagatcggctagaatctcnaaggattgaggtcttggctcagcttgaaga

SEQ ID NO: 21529 - DNA, 101 bp, rice(Oryza sativa)
  misc_feature (71): n=t or c
agtaaaagatttattaacatccgggaaatgtttggacaagattttatattagaacaactatctgatcacanacgcaatacgaaacattggtagaatgcaca

SEQ ID NO: 21530 - DNA, 101 bp, rice(Oryza sativa)
  misc_feature (71): n=t or c
ttttacgtgtgagaaggtgaagtttccaaactccatagttcgtttccccttggtcccaactcaccatcctngttttcacgcgcacgttttttaaactgctg

SEQ ID NO: 21531 - DNA, 101 bp, rice(Oryza sativa)
  misc_feature (71): n=a or g
aaaagagcgaaacagaagagtgtttgaacacaggttcaaaaggccggagcagctggtcagtgatgcgaacnaagaaatctctatttggaagtccgtcgaaa

SEQ ID NO: 21532 - DNA, 101 bp, rice(Oryza sativa)
  misc_feature (71): n=t or g
aagttcactctattccaaatgccctttccttcactaagcaagagcatatcaagtcattaagcttgtcccantgttcagacataatggttcggtttgatctg

SEQ ID NO: 21533 - DNA, 101 bp, rice(Oryza sativa)
  misc_feature (71): n=t or c
gcacatataagtcacattcgtaggagatatgatgggccatgtcctggcctgattgcatatacagcactgcntgctgcacggcatgagcggataggccaggg

SEQ ID NO: 21534 - DNA, 101 bp, rice(Oryza sativa)
  misc_feature (71): n=a or g
atagattggagaatccctttgaatagaatatttgaaagatccagtcttggggttgaccggaagattcggcngcaagcgttcaattattatatcgccgaaat

SEQ ID NO: 21535 - DNA, 101 bp, rice(Oryza sativa)
  misc_feature (71): n=t or g
agaaatgagaagtgagtttccacgtgcagttcgttagaaaaacctccttagttgcctttatgcttatgcanagaaaaaggacaacatgccactccgaatcg

SEQ ID NO: 21536 - DNA, 101 bp, rice(Oryza sativa)
  misc_feature (71): n=a or g
aacatatgatgcttggacagttcgtggagtaagtgcctactgtggttgcctttggcttgctgcccttcaanctgcagcagcgctggcccgcacccttggac

SEQ ID NO: 21537 - DNA, 101 bp, rice(Oryza sativa)
  misc_feature (71): n=a or g
aattagctacctataaaaaactacttccgatgaatctaagtgttttcatggggtcttaagatgcccgactnggtaaatattcatccccaggcgctgttctt

SEQ ID NO: 21538 - DNA, 101 bp, rice(Oryza sativa)
  misc_feature (71): n=a or g
aatacgactgatacgggaacaactgcaaacagctcaaaatagacaaaaaaaagttatgcagataatagganaagggatcttcactttgatataggtgactg

SEQ ID NO: 21539 - DNA, 101 bp, rice(Oryza sativa)
  misc_feature (71): n=t or c
acttgttctttttttttatgtacacttattcttttttgatgaattgctgttgctgctgctacccctgctgnccctgtgccccttattcatttttttatgca

SEQ ID NO: 21540 - DNA, 101 bp, rice(Oryza sativa)
  misc_feature (71): n=a or g
ataccgtcgcccttcgcctaggagttcgttggggaggagagaggtggcccgatctgcgcagagagagaganagagaaagagagagaggaaaggcgatgccg

SEQ ID NO: 21541 - DNA, 101 bp, rice(Oryza sativa)
  misc_feature (71): n=t or c
tactgcagcaaggcatgaactagcagctttgaggcttgtggcatctaaggatgaagcaaaaattattggantgaagccaagtaggctagagaaacagagat

SEQ ID NO: 21542 - DNA, 101 bp, rice(Oryza sativa)
  misc_feature (71): n=a or g
ggtgaggacggggttggacgccgacctgttcacgaggaacgcgctgattagcttctactgcaggatcgggnactgccgttccgggaggaaggtgttcgatc

SEQ ID NO: 21543 - DNA, 101 bp, rice(Oryza sativa)
  misc_feature (71): n=a or g
tagaccatatttgatccagtcttttcaatgcgttgtatgagtacgcacccccagcaccgccaacttcttcnccgctggagatcttatccattatcatctaa

SEQ ID NO: 21544 - DNA, 101 bp, rice(Oryza sativa)
  misc_feature (71): n=a or c
caacctcctcctcccctcgccgcgacagcgcgagccgctccaaccggctgacccaaaaacgaaaacaaaangaaaaaaaaactgagatgaacgaacacctg

SEQ ID NO: 21545 - DNA, 101 bp, rice(Oryza sativa)
  misc_feature (71): n=a or c
ccatgcttaacaaaataactattcaatgatggaactgttgcccgaataaagcactgcccttgctcaagaancccaagctcatcaagacagcccatcaacca

SEQ ID NO: 21546 - DNA, 101 bp, rice(Oryza sativa)
  misc_feature (71): n=t or c
tagttcatacatgtgagcattggaagaattacatatatccaccactgcagggcagcacttgattccacggngaatccatcggtcgactactttatagtcgt

SEQ ID NO: 21547 - DNA, 101 bp, rice(Oryza sativa)
  misc_feature (71): n=t or c
gggaaaacaagttgtttctaaagttaagcaataaggacttgtcttagtttcgtctttagaaatttagagtntagagtaaatgtaatttagggttaaatttt

SEQ ID NO: 21548 - DNA, 101 bp, rice(Oryza sativa)
  misc_feature (71): n=a or g
gagtacatactaaatgacaatatacgtgagaatccaagttgggtttaagcatgcactccctgttttgtttncggcctactggactgggctgcacgtccatt

SEQ ID NO: 21549 - DNA, 101 bp, rice(Oryza sativa)
  misc_feature (71): n=t or c
gagcccttgggcattacatttctcaagttgctctctgttgcatttccagttctgcctccattagagctcantgtttccctcattcgcaggccagttttgtg

SEQ ID NO: 21550 - DNA, 101 bp, rice(Oryza sativa)
  misc_feature (71): n=a or g
ggccgaagaggatacggagggcaagaactattcgccaggttacaccccaagtccggatcatccggaaactngcgtggcctccagctcgtcaccccttcgcc

SEQ ID NO: 21551 - DNA, 101 bp, rice(Oryza sativa)
  misc_feature (71): n=a or c
aacacatgtttatttaatgtaaattactgtcacggctttaccttgcagtgtgtttttcattaaaggaaaantatttacataagagagaaacagggggagca

SEQ ID NO: 21552 - DNA, 101 bp, rice(Oryza sativa)
  misc_feature (71): n=t or c
acgtgggagtccacgtcagcggaaaacccaaactagtagttttttttcattttaactaccatggtagcatnattatattttctctcatataatagcatata

SEQ ID NO: 21553 - DNA, 101 bp, rice(Oryza sativa)
  misc_feature (71): n=a or g
taaccctagaatcctggaaaacgctcacgatgatgaatcagaagctgttgctcggtggaggtttgatatanccaaacaccagtaatcttgtaagtatgtcc

SEQ ID NO: 21554 - DNA, 101 bp, rice(Oryza sativa)
  misc_feature (71): n=t or c
cctatgttgtgagaatttatggaatgaaggagatgcaagcaaacccacattgccaacaaattaatgaccangtgaaaaacataacatatcaagacattgta

SEQ ID NO: 21555 - DNA, 101 bp, rice(Oryza sativa)
  misc_feature (71): n=a or g
cacaggccatagtcacagcgtttttcatcatcaaggtgagcaaacacctttgcctcttcgacgtgaagcgncgacggcgacgccggtggcggggtgccacc

SEQ ID NO: 21556 - DNA, 101 bp, rice(Oryza sativa)
  misc_feature (71): n=t or c
cttagaaagggacttgtttttctaattaaacttctttagggtttaactacgttcataaaaaaagaaacatntgtaacaccaaattagtttaattaaatata

SEQ ID NO: 21557 - DNA, 101 bp, rice(Oryza sativa)
  misc_feature (71): n=a or g
aaaaattgggatggtgagggctcgaacaatgtagaagttgtgtcggggtatatataaagaatggcaatganttgaacaagatagaattcaataccatataa

SEQ ID NO: 21558 - DNA, 101 bp, rice(Oryza sativa)
  misc_feature (71): n=a or g
attaatgaaaccttacaagttacaaccacctgaattccctacatactctctcttctctactacttaaaaantaagaggtgcttccatcgtccgttaaaaaa

SEQ ID NO: 21559 - DNA, 101 bp, rice(Oryza sativa)
  misc_feature (71): n=t or c
ccatcattgtatatgtattgagctcaggctcacagccatctctctccattctctggaatagattataagcntcttctatcttctcagattttataagatgg

SEQ ID NO: 21560 - DNA, 101 bp, rice(Oryza sativa)
  misc_feature (71): n=a or g
ctactactgcctaacgcatttcttaattatttcccttactctactgaaggccaatcaaccaatcgattgcntttaaaggatatgattgattaaactaccgc

SEQ ID NO: 21561 - DNA, 101 bp, rice(Oryza sativa)
  misc_feature (71): n=a or g
tgtgtgttctgttttcttgttttggatgttgttgttcagttcttggtccggacgaattacctgaacaagcnatcacatttctacagtttgagatttcaggt

SEQ ID NO: 21562 - DNA, 101 bp, rice(Oryza sativa)
  misc_feature (71): n=a or g
cctcgttcacctccttgccggctctttcatggtggttgcgacggccggaggtggaagaggcagggcagtgncgggcagcggcgaccgtggaggaggagggc

SEQ ID NO: 21563 - DNA, 101 bp, rice(Oryza sativa)
  misc_feature (71): n=a or c
caaacttaggcctctggaaaaacaccttcaaatcttggccatcagccgagaaaagttggccaacttggtanaagcgggtatcggctagcaagcagacccat

SEQ ID NO: 21564 - DNA, 101 bp, rice(Oryza sativa)
  misc_feature (71): n=a or c
tggtcatccacataaatcttccgttggacttcagtagccactaattgtgtaaaacacaaagcttgggacancacagggatagaacatcatctctcaggccc

SEQ ID NO: 21565 - DNA, 101 bp, rice(Oryza sativa)
  misc_feature (71): n=t or c
ctacactcatcacagcattgcagcgtcaccgtcttaattgtgcctacaaaaaacgtacagcccgaccacantacgtacactgctaccagtagcattctcac

SEQ ID NO: 21566 - DNA, 101 bp, rice(Oryza sativa)
  misc_feature (71): n=t or c
atggagcacccgacggcgtacttgttcttcctctcgtcattctgcttctcttctcccatggcagctgcgtngtcttctccttcttctccttgtgtacttct

SEQ ID NO: 21567 - DNA, 101 bp, rice(Oryza sativa)
  misc_feature (71): n=a or g
atttcaagcactttttgactctcttttcaatgtcattttcatctttccctcgtggtgcttgtttgctatcnatctctcgctgtatttagccttggacggag

SEQ ID NO: 21568 - DNA, 101 bp, rice(Oryza sativa)
  misc_feature (71): n=a or g
aagagcaaaccataaactctccttcaagtattttggtccttacaagatcatttctcgagtgggtcaggtgncttacaagttacagcttccatctggcagtg

SEQ ID NO: 21569 - DNA, 101 bp, rice(Oryza sativa)
  misc_feature (71): n=a or g
cacacatttcagtattccacccattatagcactgtaacttatcttgtttgaatgtgataattttagggggnaaaaaaatcagaaatcatgcttttctcatg

SEQ ID NO: 21570 - DNA, 101 bp, rice(Oryza sativa)
  misc_feature (71): n=a or c
cggtggcataaaattgggcaataacctccttgcaccaaggttgatggagggtcataaaattgtggacacanatctcctcacacatggcaatcatagagttg

SEQ ID NO: 21571 - DNA, 101 bp, rice(Oryza sativa)
  misc_feature (71): n=t or c
gcaacatactcttggacaaaaatttcaatgctagattagcagatttcgggctgtcgagaactgccgacaanggaacaatacaatcgtcaatggttgtagga

SEQ ID NO: 21572 - DNA, 101 bp, rice(Oryza sativa)
  misc_feature (71): n=t or c
ttacgttctctccgaattgataatacttatcgttttggagcggtattttgtctgacggatcggaggtggcngggtgatggaggaggggaagcggaagcggg

SEQ ID NO: 21573 - DNA, 101 bp, rice(Oryza sativa)
  misc_feature (71): n=a or g
tccgatgtatggatgaataaaaacgagtggttgcatgcttcaatgtgttgctaatattaatatcggtcatngcttcttgtatttctgaagtttgtacttgc

SEQ ID NO: 21574 - DNA, 101 bp, rice(Oryza sativa)
  misc_feature (71): n=t or c
tgattattggtgggcctaattctggcgcgataagcgcagcccgagtccaccagagctggaaattccccatncccatcccaccgccgctgctccacctcccc

SEQ ID NO: 21575 - DNA, 101 bp, rice(Oryza sativa)
  misc_feature (71): n=a or g
atccaagaccaagggaagcacaagtgttgtgttggtggagtagctccattttcacaggaatttaaatcctnatatccacaaatattacctagcacggtatc

SEQ ID NO: 21576 - DNA, 101 bp, rice(Oryza sativa)
  misc_feature (71): n=t or c
caagctggtctccatcactgcccctgctattggtgatgaccccattcaggtgtatggcttcatggctgttngagatcatatggattgcttgcgcaactatg

SEQ ID NO: 21577 - DNA, 101 bp, rice(Oryza sativa)
  misc_feature (71): n=t or g
atgtcattgagttcttgttcatatgctgttcattttctttcctaccgtaaatatgagcaaaaccatccaanataggccagaattttactggctagcacaat

SEQ ID NO: 21578 - DNA, 101 bp, rice(Oryza sativa)
  misc_feature (71): n=t or c
gtaatctagttctataccccgtgaaattcgggggctttttttttctgggtggtgttcatcccggatttggntggggtttgtctaaaattcgagcttggttt

SEQ ID NO: 21579 - DNA, 101 bp, rice(Oryza sativa)
  misc_feature (71): n=t or c
ttttatattatttcatataaactgctcactatcttaccaggatgaacttctggggatactccacgataaantttttttcaccaatgataagatattcatca

SEQ ID NO: 21580 - DNA, 101 bp, rice(Oryza sativa)
  misc_feature (71): n=a or g
agtcgggttgttgagcaacgtggacaaatcaagttgtccgcatacattaagtgcaattacattttctcttnggcattgactaccaccagatggtgttggtg

SEQ ID NO: 21581 - DNA, 101 bp, rice(Oryza sativa)
  misc_feature (71): n=a or g
tggaggaacttgcctgtgagctgcattgacttgtgaagggaaatgtggctgaggatatgctggaacaagcngacgtgggtgaaatggcatgtcatgttggg

SEQ ID NO: 21582 - DNA, 101 bp, rice(Oryza sativa)
  misc_feature (71): n=a or g
taaacaagttcaaggacccctaacttagaagttatttcacctcggccctagggctggatgaaaaactcatngtttgtttgctcgagccatcttgagctggc

SEQ ID NO: 21583 - DNA, 101 bp, rice(Oryza sativa)
  misc_feature (71): n=t or c
ctgttccaccactcaatgaatcgctcgattgcctagttttggggctctttccatgttcatgctcaatttcnagtagatttttcatagcaacttgttgacca

SEQ ID NO: 21584 - DNA, 101 bp, rice(Oryza sativa)
  misc_feature (71): n=a or g
ggaaaatatttggacgattatattctccctaattacaaatgaatatatgttgatttagactcgtggacgcngttcaaatgactttgttgtccttcatttgt

SEQ ID NO: 21585 - DNA, 101 bp, rice(Oryza sativa)
  misc_feature (71): n=t or c
ctgccgatctgcaagggactatctatcctactggcgccacaatgataaaccccttgggttgaagccctccntgtttgagatctcattttcctttcttcaat

SEQ ID NO: 21586 - DNA, 101 bp, rice(Oryza sativa)
  misc_feature (71): n=t or c
caaaatgattaacttaaattttgcgtgcaaataatcctttggattacctgcagggcgagcgccgaagtccnagaggcagcaggtggtgtcgaacagcttga

SEQ ID NO: 21587 - DNA, 101 bp, rice(Oryza sativa)
  misc_feature (71): n=a or g
tgccaatgcatgcacaaattaattaacgacacacagtcgttgtagttagtagctcactctcacatctctcntgacaaaatttttcacccgtcacatcgaac

SEQ ID NO: 21588 - DNA, 101 bp, rice(Oryza sativa)
  misc_feature (71): n=a or c
ttcaacgaaagttgcacattggaggcactagactttagtgacaataggattgaaggaaatttgcctagatntattgcttcttgccgaaaattggaggtcct

SEQ ID NO: 21589 - DNA, 101 bp, rice(Oryza sativa)
  misc_feature (71): n=t or g
tcttctgtctgatcattgtatgcttcctcttatgaaagttaatatgcagggcacaaagcaaacaagcatcntattgaaattactggctaaagaaaatatat

SEQ ID NO: 21590 - DNA, 101 bp, rice(Oryza sativa)
  misc_feature (71): n=t or c
aaaacattgtgaacattaaaaaggatgggaaagttatgatggaatataaggagagttcaactattgtgtangcattttgctttatgttgatatgtcatata

SEQ ID NO: 21591 - DNA, 101 bp, rice(Oryza sativa)
  misc_feature (71): n=t or g
ccattggttagtgatgttggtggtttctatcttggctaatggaagcttgccaagtgacaagagaaatgaancaacaagaagctactatagaacaaaacccc

SEQ ID NO: 21592 - DNA, 101 bp, rice(Oryza sativa)
  misc_feature (71): n=t or g
tccagcgtatccggacatatgtttgtttagatacgctggactaggtaatatcccatctctaattagattgntttttttttgggacgggggagtacatgtgc

SEQ ID NO: 21593 - DNA, 101 bp, rice(Oryza sativa)
  misc_feature (71): n=t or g
agctcacctttcattatcgatactcccatcttgcagaggatcaaaacttgccgagagtgtatccctctaanatcagctaggttgattttctagccaagaag

SEQ ID NO: 21594 - DNA, 101 bp, rice(Oryza sativa)
  misc_feature (71): n=a or g
tcgatggccggttcggctttttgcactatggctctgggcatccaagcaatcctggagtatctcaaactctnggatatccttatgtcaatccaactatcgga

SEQ ID NO: 21595 - DNA, 101 bp, rice(Oryza sativa)
  misc_feature (71): n=a or c
cccagccatagataatgcttgtagctgagtgcagttggttaagctatccatgaaatcccaatcttgcttgntacgagcatggagctgattcatctcaagat

SEQ ID NO: 21596 - DNA, 101 bp, rice(Oryza sativa)
  misc_feature (71): n=t or c
ctatttgttcatcagtcaaattgtccactgttactggaatcgtcttgtttgacctccttagatatattgangaagaaagttgtcctactgggcgtgccaaa

SEQ ID NO: 21597 - DNA, 101 bp, rice(Oryza sativa)
  misc_feature (71): n=a or g
ctcagcgttccggaactcattcgggacaaaataatcgacgctcatggcaaaagaaaacggcaaatgaactntctgttttagagtaattaatacgtactatt

SEQ ID NO: 21598 - DNA, 101 bp, rice(Oryza sativa)
  misc_feature (71): n=a or g
gatcgaggttagagttgttcaaggatcaagcggtttttgcggaagaattgtcgcgaggaccgatggttacnacgacgatgtggtgtttgctgattccagta

SEQ ID NO: 21599 - DNA, 101 bp, rice(Oryza sativa)
  misc_feature (71): n=a or g
tgctgaaccattcaactagggcagctcttatgtcagccaggtcctatatgtatcagtagaagatttagggnatgtttggttgatgcctaacattgccataa

SEQ ID NO: 21600 - DNA, 101 bp, rice(Oryza sativa)
  misc_feature (71): n=a or c
ggtagcccctgtacgattatgtacttggcccccttcttcagcaatgcctgccatgcatccaattattgttntctctctcgaaggacagaaggtaggtaaaa

SEQ ID NO: 21601 - DNA, 101 bp, rice(Oryza sativa)
  misc_feature (71): n=a or g
ttaataccaatcacatgtcccatatatgatacctgctgctgggcaaaggaacactttgagaacttcacctnccaatgatccttgcgaagtagttggagaac

SEQ ID NO: 21602 - DNA, 101 bp, rice(Oryza sativa)
  misc_feature (71): n=t or g
attcgagaccatgtaccaagtccaaacctgtccttccaagaggacctaattattcctctgctgccagactnatagtacctaatttaattactcctccatgc

SEQ ID NO: 21603 - DNA, 101 bp, rice(Oryza sativa)
  misc_feature (71): n=t or c
aattcaataacttgtcaaatgtcctcgctgcagacatacatcttcactgacactctctcagttatccagangttgtcaggtgaataatccccttttagttg

SEQ ID NO: 21604 - DNA, 101 bp, rice(Oryza sativa)
  misc_feature (71): n=a or g
gatgactcctaccagatgttgtggcgctctcctcgaccgaattgcatttcctgctcaagctgttgttgcanttccgcatatggcgttgttgcagtactccg

SEQ ID NO: 21605 - DNA, 101 bp, rice(Oryza sativa)
  misc_feature (71): n=a or c
aaaaacccgtaatgtaagaaaatgctcaccgatatgtaatctaggacatctgcggcagcaacaactgatgnagatattcgcttggctggctcaacagaata

SEQ ID NO: 21606 - DNA, 101 bp, rice(Oryza sativa)
  misc_feature (71): n=a or c
taagtaactgaaattactctgacataaaattatttgaaaatgtaactgaagcatcaaaatataaaacaganattatttattactacatcagttttgaaatg

SEQ ID NO: 21607 - DNA, 101 bp, rice(Oryza sativa)
  misc_feature (71): n=t or c
cagtactgaaactacgctcatcactggtggaagaagtagttcttcttccttattctccttttcgtacaggnacagggttcttggtctttgttggatcattt

SEQ ID NO: 21608 - DNA, 101 bp, rice(Oryza sativa)
  misc_feature (71): n=t or c
cagccatagctagccctgatcgatccaattctgagttcttgaccgacaaccatggcgtccatgaccgccgncgccgccgtcctgctcctggtcttcttgct

SEQ ID NO: 21609 - DNA, 101 bp, rice(Oryza sativa)
  misc_feature (71): n=t or c
aatgcattcgatcacagtatcaaattcctatgttgtgtttcttatctgaaaaagatggcaatccgttgtcnatttcagctgctccacaaagaaggtggcaa

SEQ ID NO: 21610 - DNA, 101 bp, rice(Oryza sativa)
  misc_feature (71): n=a or g
cgagtagtgacggcagtggttccacgacaagcggcggcggcagcaacaacctcatcctctgacgagaagcngcgggctcccctggtccttgatggccggat

SEQ ID NO: 21611 - DNA, 101 bp, rice(Oryza sativa)
  misc_feature (71): n=t or c
ttatgcttggctgaactgtaaagagctctccacacctgctttctatttgagttaatggagctcctatggtnagtaactgaatcatgttccccaactggacc

SEQ ID NO: 21612 - DNA, 101 bp, rice(Oryza sativa)
  misc_feature (71): n=t or c
taaacttgagggttccagtggatgatattgtacaagccaagcatgctcatgcaaatcaaccaggctaggantattggtgcaaagagaaatccgacacgatg

SEQ ID NO: 21613 - DNA, 101 bp, rice(Oryza sativa)
  misc_feature (71): n=a or g
gtacaaacatttttaatagtgtttgttgtgacgaaatgtcttaatcacatggatggcggggtagctggctnttgcagtagcattaactgccaactgtgcgc

SEQ ID NO: 21614 - DNA, 101 bp, rice(Oryza sativa)
  misc_feature (71): n=t or c
atataaatatttttaaaatatcttctacatatgtcctattttaaatgcatttttaaatttccgtgtccaangcctgtctgtccgtcttatttaaaaaaatt

SEQ ID NO: 21615 - DNA, 101 bp, rice(Oryza sativa)
  misc_feature (71): n=a or g
ggggatactcttaggccttaactacttagatcatgatgctgtttcctaagggttacaatgttttacctccnttaggattgagtcgactagacgttagacat

SEQ ID NO: 21616 - DNA, 101 bp, rice(Oryza sativa)
  misc_feature (71): n=a or g
aattatcactaataaaatactaatgatcaagattaggtgaatatcattgggccagatgagacaatccaacnacttccaatattccctctcttggccgctct

SEQ ID NO: 21617 - DNA, 101 bp, rice(Oryza sativa)
  misc_feature (71): n=t or c
cgggataccttcacaaccattaacgacgtatggatttccatgaaaaccatccatgcatttgcacttggtanccaacataagcataagtagagtcgacacct

SEQ ID NO: 21618 - DNA, 101 bp, rice(Oryza sativa)
  misc_feature (71): n=a or c
tttacaatcgccttgccaatctttgtctgccatgaatgaattgttgcatccctacttccaaatgctttctnagaaaataaagtccagcaatcatcttcaga

SEQ ID NO: 21619 - DNA, 101 bp, rice(Oryza sativa)
  misc_feature (71): n=t or c
attttcaaccaagtataagcaggagatccttcatcaaatccatccaaacaaaataagccaaccaatggaantgctttggctgatttggaaaaggtctgtcc

SEQ ID NO: 21620 - DNA, 101 bp, rice(Oryza sativa)
  misc_feature (71): n=t or c
gctattagcagtcacatgcatttctttcgcaacggaaaaaaaacagacatgctatatttatggcgacacancttgatcacagtcggttaatctgaccgttg

SEQ ID NO: 21621 - DNA, 101 bp, rice(Oryza sativa)
  misc_feature (71): n=t or c
cttgaaggcctggaggcaggtctctgcctctgcctctgcctgagacggttcagaaacattttgcaggttgnccgaccccgctgagactgcgatggctatct

SEQ ID NO: 21622 - DNA, 101 bp, rice(Oryza sativa)
  misc_feature (71): n=a or g
gattaataagattaagaagcttgaaggggcgcgagatgaagtcgccaatgctgccactcctttgatccaanccatgttttataataacaatggtccaagta

SEQ ID NO: 21623 - DNA, 101 bp, rice(Oryza sativa)
  misc_feature (71): n=t or c
tgacactttgggctgagatccatgtgttatggctcaggagaggcaaaaaaaaaaaggcaggatgtggaccnagaacaaaattggtcgagaatgatacaacg

SEQ ID NO: 21624 - DNA, 101 bp, rice(Oryza sativa)
  misc_feature (71): n=a or g
gaataagcggttagttgtttctttcctagattattagagcagattattggtttgcaagtctaaagagggantggggtggcatggtgggtaatttttcaccc

SEQ ID NO: 21625 - DNA, 101 bp, rice(Oryza sativa)
  misc_feature (71): n=a or g
gcccttgccatggcaatagtggcacttataatcaccatacctgccccttgacttgcttctactagtggctncacctttcttcggacctcggtttttgcttc

SEQ ID NO: 21626 - DNA, 101 bp, rice(Oryza sativa)
  misc_feature (71): n=t or c
cgttgggtcccacctcctccgacttcgcctcgtccactccaccacgccgccgaaagccgcaactctccacngccggctcggcgtcggcgtccgagaccgag

SEQ ID NO: 21627 - DNA, 101 bp, rice(Oryza sativa)
  misc_feature (71): n=a or g
caggacatgtacgccataatccatgtagtatatatgaagtcggtgtacatgctgctttccgtattttaatntatgacatcgttgactttttaaacaacgtt

SEQ ID NO: 21628 - DNA, 101 bp, rice(Oryza sativa)
  misc_feature (71): n=a or c
cggcggaggtgatcgatcgaccttacctcaaatcagctacctgaaaatttgctcgcacacgcacattattnttgcaacatccagtgctaacgttgccttaa

SEQ ID NO: 21629 - DNA, 101 bp, rice(Oryza sativa)
  misc_feature (71): n=a or c
agaaaccaaaagtctcaaggttataactggctaggttcccaccagctaaataagacaactcaaccctacangcgcgtaccttaattaacttgctagagagg

SEQ ID NO: 21630 - DNA, 101 bp, rice(Oryza sativa)
  misc_feature (71): n=a or g
tgcgttttgggtggtgaattttgattttgattcttttttttttctggatgcagatgagctcgggacggtgntgttcttgcacgggttcccggagatatggt

SEQ ID NO: 21631 - DNA, 101 bp, rice(Oryza sativa)
  misc_feature (71): n=t or g
catacacagcggcagacggcaagtgcaatggtggatccaacagcgccgcaacaatcaagggctacgaggangtgccagctaacaatgaggccgcactcatg

SEQ ID NO: 21632 - DNA, 101 bp, rice(Oryza sativa)
  misc_feature (71): n=a or g
acagctggacctaagctctggaaaatccctgatgggcaaacacaccgaatgattttgtccaacaaatatcncatgctcccgaagggctgctgctgcaaccg

SEQ ID NO: 21633 - DNA, 101 bp, rice(Oryza sativa)
  misc_feature (71): n=a or g
ttccgacacgatcaacactattgccgatgtagatggcccttcagtgcccttaggtagctcatgttctttcnccttatcattcaacggtttctttagaggag

SEQ ID NO: 21634 - DNA, 101 bp, rice(Oryza sativa)
  misc_feature (71): n=a or c
tttttaaagcatgcagcattcctggctttccaaataacccaaagaacagcagcaatcccaactaccactanctttttatcttctttattaaatcacaaagc

SEQ ID NO: 21635 - DNA, 101 bp, rice(Oryza sativa)
  misc_feature (71): n=t or g
tcaaatgcactctgaattcagtgggttttgctgagctgaacattttgttactggttgagagtgtagcgtgnctcagccacttcccgctgcttgaagtttgt

SEQ ID NO: 21636 - DNA, 101 bp, rice(Oryza sativa)
  misc_feature (71): n=a or g
gcagatccagggcgacacaatttgccggacgcaaaaggatgataagccaaaagtgtcgggatacgcgtagnctacgatagcataaatcaaaattttctatc

SEQ ID NO: 21637 - DNA, 101 bp, rice(Oryza sativa)
  misc_feature (71): n=t or c
aactctccgaggtgcattaaaaataatgaagtcctctcctccagcatcatgatccactcgatctcctctcnctctctcctctcaccctcatccaagtctgc

SEQ ID NO: 21638 - DNA, 101 bp, rice(Oryza sativa)
  misc_feature (71): n=t or c
ggcgatttcaggcctggcggcccttcagcgcctggaacttatggtcaaccaccagcacctggaaattatgngcaaccacatccaccaacttatcctggaag

SEQ ID NO: 21639 - DNA, 101 bp, rice(Oryza sativa)
  misc_feature (71): n=t or g
aaggctcttgccaaagtacacttgttttgcttgaaaaaggaaggtgttgaggcattccttgcactgctccngcgtcaggtccggcacgcactgcgcgaacc

SEQ ID NO: 21640 - DNA, 101 bp, rice(Oryza sativa)
  misc_feature (71): n=a or g
tccctttacgtagagtttatctctctttggattctttatgaacccgccaagtttcctataacggccgtgtnctctacaaagataaaatatttaattaagct

SEQ ID NO: 21641 - DNA, 101 bp, rice(Oryza sativa)
  misc_feature (71): n=a or g
tggtgatagtggttcaaacgcaattctgtggaatgcgttgatgaacatgtattcacgtgttggatgtgtcnacaatgcagaacatgtgttcttcgagattg

SEQ ID NO: 21642 - DNA, 101 bp, rice(Oryza sativa)
  misc_feature (71): n=a or g
ttagcttttcttctattgatccaaggacccattctctaagtttgatattgataagattgctcgcttgactnaaatatatgatcaagatttctcaaatgctg

SEQ ID NO: 21643 - DNA, 101 bp, rice(Oryza sativa)
  misc_feature (71): n=a or g
ttaccgagatattttttgtgtgctcagtgatgatctgtctgcctctgctcaccactggcatgaaggtgtgngtgtaaagtttataaagtatacggatacac

SEQ ID NO: 21644 - DNA, 101 bp, rice(Oryza sativa)
  misc_feature (71): n=t or c
ttacggatattcatattaagctaaatgacaacagccaacaacgttccaagctgccactactacaatacccnatttttccggtcggtcgtatttattatccc

SEQ ID NO: 21645 - DNA, 101 bp, rice(Oryza sativa)
  misc_feature (71): n=t or c
acggtgatgccggatagaaataataatgcttctaattgcattaatagcatgcaacaccaacttttccctgnattgagaaaggtaaaatgcattcctaaaaa

SEQ ID NO: 21646 - DNA, 101 bp, rice(Oryza sativa)
  misc_feature (71): n=t or g
acacgacagagtgacagagcacgtacttgtacacttggtcatcttaagctcaacccagcattcctggctangagtattagtgtgcaagcatataaagcaaa

SEQ ID NO: 21647 - DNA, 101 bp, rice(Oryza sativa)
  misc_feature (71): n=t or c
tatggcacaactagcagcatgtgtgagtaactgaccacaatgttagatgagaaaattttatacattctctncaccgtaactttgaactcaagggaattggg

SEQ ID NO: 21648 - DNA, 101 bp, rice(Oryza sativa)
  misc_feature (71): n=t or c
gcagagggaggcaaggcggaatgcggatgccttcgcgatagcagaaaacatgcatgagttacggcttctgnagattgcaggtcataacctgaccgagatag

SEQ ID NO: 21649 - DNA, 101 bp, rice(Oryza sativa)
  misc_feature (71): n=a or g
tactcctttatggcatgccgaccgcacctcctctttataatcactaggatttttaatatcaaacctaaccnttattggtgttttcttttatagtttttaaa

SEQ ID NO: 21650 - DNA, 101 bp, rice(Oryza sativa)
  misc_feature (71): n=a or g
agatgatatggattccttcatggatgatgacagcgacgatgaatactacatgtttgctgggctaggtatcntcgttgtgatatcttaatgtctctttttca

SEQ ID NO: 21651 - DNA, 101 bp, rice(Oryza sativa)
  misc_feature (71): n=t or c
aagttaataattgaaataaataatcggataaagctggcgtctgccgactatatatatactccctccgtttngaaatatttgacaccgttaactttttagca

SEQ ID NO: 21652 - DNA, 101 bp, rice(Oryza sativa)
  misc_feature (71): n=a or c
aatgctgatttcagtgatgatatcagttcatctcctttccagaagcctagacaaagcactttcgaagctanggatacagtacatgcaggtaaaactgtttt

SEQ ID NO: 21653 - DNA, 101 bp, rice(Oryza sativa)
  misc_feature (71): n=a or g
ttcaaaacctaaatcgctcgaaacaatattcgggggttgtatgtccagttttaattagggatggcaatggntcgggtcgggcacgggtagagcaaaaccat

SEQ ID NO: 21654 - DNA, 101 bp, rice(Oryza sativa)
  misc_feature (71): n=t or c
gtgatgctattgtttcatatctgtttcccaatagtcgataaacaggaaacaatggaagagaccattctcantggtgatgatctcatgcgtgagccaccatc

SEQ ID NO: 21655 - DNA, 101 bp, rice(Oryza sativa)
  misc_feature (71): n=a or g
gctgctccaaacaaaacaagaagaatcgattccggaatcagattgccacaaaacatatttatatacacccnacttgccctctctagagatataaatgccat

SEQ ID NO: 21656 - DNA, 101 bp, rice(Oryza sativa)
  misc_feature (71): n=a or g
gctgtggtattagattttaaggatttcactttgtgaaactccctctagtcacatttatttgatgctgggantactaaacttagtacacccagcgtcaaata

SEQ ID NO: 21657 - DNA, 101 bp, rice(Oryza sativa)
  misc_feature (71): n=t or c
agaggacatcgtggaactcgaggaatttggccgtgcataccaaatcttaatcttccatgcatggtttcacngacaagttctactgagacatgcatggcgtc

SEQ ID NO: 21658 - DNA, 101 bp, rice(Oryza sativa)
  misc_feature (71): n=t or c
actctgcatctcaaacccaacttcttaaagaacaaaaaacgatcagccatgaagagcggcagcctgctgangctcaccctgggagccctcctcctcgccgg

SEQ ID NO: 21659 - DNA, 101 bp, rice(Oryza sativa)
  misc_feature (71): n=t or c
ccgatgctgatccatccattcaccaacggactaaccatccattcatttgtctcggacacattgatctccangctgttgggtacatggcaggcttgctggtc

SEQ ID NO: 21660 - DNA, 101 bp, rice(Oryza sativa)
  misc_feature (71): n=t or g
tctatgaggctgcaatcacgctcggcaggaatatcaagaactgtcaacgccgccttctcttcccatgtganctcccgcttacgcttgcctgcaacaattgc

SEQ ID NO: 21661 - DNA, 101 bp, rice(Oryza sativa)
  misc_feature (71): n=a or g
caggctctaaagaggcccatctataggaataggcccgcctatgaaagattttcataggcatgccttgaacngaacctctatacattttcacatacggatat

SEQ ID NO: 21662 - DNA, 101 bp, rice(Oryza sativa)
  misc_feature (71): n=t or c
accctactgataaacacattttggtctgtctttctggaacaggatggtgatctcgacgttgatctcgttgngaccgatgttttcccgatggccatcctttc

SEQ ID NO: 21663 - DNA, 101 bp, rice(Oryza sativa)
  misc_feature (71): n=t or g
tgtgccgtagagttcctggttcttacttatttgtttttttccccccgtttagtgtgcatttttgtaaatanaagattaaggatactatgcttcccagcaga

SEQ ID NO: 21664 - DNA, 101 bp, rice(Oryza sativa)
  misc_feature (71): n=a or g
actgctagttcagccagtggtgcaaccgatccagcaacaagctgtacagccgattcagcaggcaccgccantccagccgatagtgcagtcggttcagcaac

SEQ ID NO: 21665 - DNA, 101 bp, rice(Oryza sativa)
  misc_feature (71): n=a or g
atcaaacatccatttgaaataaaaatgatttatctggccgcatggccacattcctcacttccatcacatgntttatctttggagagcttttgccatgtttg

SEQ ID NO: 21666 - DNA, 101 bp, rice(Oryza sativa)
  misc_feature (71): n=t or c
tgtcctaatcggcggcgtggttgtggccacggtcacaagtggtccatagcccttactaccacggtggatantggcatgaggatgcccatcatgcagtcctc

SEQ ID NO: 21667 - DNA, 101 bp, rice(Oryza sativa)
  misc_feature (71): n=a or g
agtgttagtgtccggtgaagcatacgggagcaacattgccactttgatgtacaaatcacttgtgaacactngggatgagttgtacattatgtacacaacct

SEQ ID NO: 21668 - DNA, 101 bp, rice(Oryza sativa)
  misc_feature (71): n=a or c
cgcgcaagcattggcatcaggaggatgggtgagcttgatccaaaagcatttgctaatgcttgcacacaaanactgactaaaaaacagcttgattctgcgct

SEQ ID NO: 21669 - DNA, 101 bp, rice(Oryza sativa)
  misc_feature (71): n=a or g
attcatttgcttgagttccacgctttgatcgagacgatggtcatcgatgatacgatgaagagcttttgccntctatttgatgagtagtgacgtagtgtagt

SEQ ID NO: 21670 - DNA, 101 bp, rice(Oryza sativa)
  misc_feature (71): n=t or g
tatttagatggcggagggtagcgattaggcaacaacgacttggcaatgagcagtggccaaaagttttggtncaaatgtgcaatgcacggcgatgaaatatg

SEQ ID NO: 21671 - DNA, 101 bp, rice(Oryza sativa)
  misc_feature (71): n=a or g
gaggaaatactactttgatttggtggaggaagtagtagtttgatttggtggcgaacttacatctttccaanagacacgaatattaggaaaatgacctaata

SEQ ID NO: 21672 - DNA, 101 bp, rice(Oryza sativa)
  misc_feature (71): n=a or g
atttagtatgggatgcgacatctgttagtactacttcctctgtcaaaactaacctcatattaggatgtaancatttgtatgtccagatttgttgcactagt

SEQ ID NO: 21673 - DNA, 101 bp, rice(Oryza sativa)
  misc_feature (71): n=t or c
ggtgtcgttcttggccatgtacacccacacgtgccgcgacgtgccattgtagtcgacccagacgaagtagntgccgtcgtcagtggtggtgttgctgggcg

SEQ ID NO: 21674 - DNA, 101 bp, rice(Oryza sativa)
  misc_feature (71): n=t or c
aattctcctgtgaatgtggtctgtttgtttgtcgcggtatatacatggactgtggagtgtatatactactncctccatcccaaaatatttgacgccgttga

SEQ ID NO: 21675 - DNA, 101 bp, rice(Oryza sativa)
  misc_feature (71): n=a or g
agcacaatttcttggctcaattccaaatgcttttctaatgatgttactaatttgctcttccatattctcangccttggttgtggatttggtggcctaagaa

SEQ ID NO: 21676 - DNA, 101 bp, rice(Oryza sativa)
  misc_feature (71): n=t or c
atcactgtaggaaaccaaatctagattggagaggatattatcacatgatgcgtgccttgatcgtgttttgntggacacgatcgtctcacgcacgcgaggac

SEQ ID NO: 21677 - DNA, 101 bp, rice(Oryza sativa)
  misc_feature (71): n=a or c
ggcgcgaacattgtagctacctgctcctgggtcagtcgattaatgttctgtccaacatgctgtggttgctntctggtcaagacatgaggattaatcacctg

SEQ ID NO: 21678 - DNA, 101 bp, rice(Oryza sativa)
  misc_feature (71): n=a or c
caattagttgaaatcgaaaactttttgtgctatttttgataccaatcgacctgatttatgtgctaaagatnaaaatttgtcaaacttcaagcgagtaatta

SEQ ID NO: 21679 - DNA, 101 bp, rice(Oryza sativa)
  misc_feature (71): n=t or c
ggattcatatttatgagcgttgatgtggctattcggataggttttaaggctcacacaagtgctaaggagangtggaactatctcaaacagagatacactca

SEQ ID NO: 21680 - DNA, 101 bp, rice(Oryza sativa)
  misc_feature (71): n=a or c
ccgtgtttggctgaattcgtagtccaatacatattagaggcaaatttgtcacccccatgtctagcactccntccgtttcatattacaagtcattttaatta

SEQ ID NO: 21681 - DNA, 101 bp, rice(Oryza sativa)
  misc_feature (71): n=t or c
tgctaaactggacagtacctccttttcgatattgcaactagcgtctcggaacagctctactctttgagaangggagatcccttctaactcatttggaagga

SEQ ID NO: 21682 - DNA, 101 bp, rice(Oryza sativa)
  misc_feature (71): n=t or c
tcatcacggtcggagacaacaaaattaaacagcgcataaggtttttgtggcaacacttcaacgaggacgcngctgacgaggtcgatatcaaacaccgagga

SEQ ID NO: 21683 - DNA, 101 bp, rice(Oryza sativa)
  misc_feature (71): n=t or c
agggagtaactgactgcgaatccaaccaaccactctctccggtcacaaacacttgatttttggacaagatncagttaaacctttgaaagtttgaatattta

SEQ ID NO: 21684 - DNA, 101 bp, rice(Oryza sativa)
  misc_feature (71): n=t or c
gcgtccttacttatggcaaggactgggagcagagtttacacgacggagtagacggcatcagtgaacccagngagcccgagggacatgaagatttcaactag

SEQ ID NO: 21685 - DNA, 101 bp, rice(Oryza sativa)
  misc_feature (71): n=a or g
aaagttttatatcattaaattcatgcataaatgagagagaattgaaaagagagaatgaaacgggcgactantctatcgcccggcggtagcacagttgcaca

SEQ ID NO: 21686 - DNA, 101 bp, rice(Oryza sativa)
  misc_feature (71): n=t or g
tctatttcctccctcatctctttagattcctcaactattttcttcctgcttactggaccgtgccgtgccgngccgggccggcccaccgtgccaagcaatca

SEQ ID NO: 21687 - DNA, 101 bp, rice(Oryza sativa)
  misc_feature (71): n=t or g
tcgagagttcgagcctctctcaccccaactttttttccgcttatttttttttgcaactccttaatccttcngtgacacaaattacatttttattttccttt

SEQ ID NO: 21688 - DNA, 101 bp, rice(Oryza sativa)
  misc_feature (71): n=t or c
cttgccaaagaagattggcgcaagcaaaggattgttggccgagaaataacgcatggcaagccaagcctgtngagtatcgttggtcactcgtccaacgccag

SEQ ID NO: 21689 - DNA, 101 bp, rice(Oryza sativa)
  misc_feature (71): n=a or c
agctaggagttccaactccaatggtacaggacatgcttccgtgtcggtggcgttcatgttcatcccgttcntttccaccgctagagcgctactgtaggaac

SEQ ID NO: 21690 - DNA, 101 bp, rice(Oryza sativa)
  misc_feature (71): n=t or c
acataattgagtccatctcaccgcgtaccgcttctttcctttccaatagtcacatcaggagatgaatatgnctcttcaatggttcttggagtatcatccac

SEQ ID NO: 21691 - DNA, 101 bp, rice(Oryza sativa)
  misc_feature (71): n=t or c
atgcaattcaaaacaagcagcagacggaaaacgcttggacgtattgatcacactgtagtttcaatcaagantgccatctaccggacgcccaatatagtttt

SEQ ID NO: 21692 - DNA, 101 bp, rice(Oryza sativa)
  misc_feature (71): n=t or c
caaacaccccgaccaatggagagtgagcttgagaagccatatgaagcttggcatgatttagtacctttccnggcagggtggcacccacccaagttccgtca

SEQ ID NO: 21693 - DNA, 101 bp, rice(Oryza sativa)
  misc_feature (71): n=a or g
catgtttatccttcaaatcaagaaatatatgggtctgtgaatcaaggcagaaatctcctcagcaatgggantcatggggaaatgggagagatgcatcggag

SEQ ID NO: 21694 - DNA, 101 bp, rice(Oryza sativa)
  misc_feature (71): n=t or c
gtggcacaggtaactgcacaagtagccaatgcattgagtgcaaatcaacaaggccaggtttcatcatctgngcagaacacagtagatcagggatctcgctc

SEQ ID NO: 21695 - DNA, 101 bp, rice(Oryza sativa)
  misc_feature (71): n=a or g
aaagggtaatgaagatgcgtcgcaaagattgggatccttccttggagccagatgttctgatttataactcngtaaggatggcgcctgatgtttttgtttta

SEQ ID NO: 21696 - DNA, 101 bp, rice(Oryza sativa)
  misc_feature (71): n=a or g
atttcgtgctagaatatatgtaattttgaaaacgttatttcaatcaacccttttattggcggaagttgggnctttatcccatcatgtctattttaaattat

SEQ ID NO: 21697 - DNA, 101 bp, rice(Oryza sativa)
  misc_feature (71): n=t or g
tgatggttaacgcagctgcatgctccgcgttttgatcaccaggcactgcagcatggagctgatccaacagnctactcgcacgcgctgcgaaccgcgttaag

SEQ ID NO: 21698 - DNA, 101 bp, rice(Oryza sativa)
  misc_feature (71): n=t or g
gtgacgccggcgatgccaagcgggaacaagctgttccttctcctcgtcgataacccattggcatcccactntcatcaatcattacgcctccaccagtcaac

SEQ ID NO: 21699 - DNA, 101 bp, rice(Oryza sativa)
  misc_feature (71): n=t or c
atcgataattcttagaaattcctgataggtcttgctatctttatcgagagaatccaagacgttgacttcantgtactttggatagagaagaaagactatca

SEQ ID NO: 21700 - DNA, 101 bp, rice(Oryza sativa)
  misc_feature (71): n=a or g
tggagcagctgcctggatacggagacgcataccgctcgcgccgctgctccgacttgagatgaacgtcatcnacgatgtcggtggcgtcgtacatggcatcc

SEQ ID NO: 21701 - DNA, 101 bp, rice(Oryza sativa)
  misc_feature (71): n=a or g
tgaacagggcctaaccttggacgtagctctcctacctcctctcgtggcacgtaaacaaaccatattgcacnacagactggttttgcgcctatttcactgaa

SEQ ID NO: 21702 - DNA, 101 bp, rice(Oryza sativa)
  misc_feature (71): n=a or c
ctcacgacctcaccggtgcaggttcgtcagagaagaagacaggaaacgagcgctcgtcagccgcctgctcnagtactcgctcgtgcaccatgcccttggaa

SEQ ID NO: 21703 - DNA, 101 bp, rice(Oryza sativa)
  misc_feature (71): n=t or c
atcaaagcatgttgcaccgcgtagtcgatccgatcctgaaaattgttaaattgtggctgcagtccattgcnatctggaccaagatcttcaactgctccctc

SEQ ID NO: 21704 - DNA, 101 bp, rice(Oryza sativa)
  misc_feature (71): n=t or g
ggctagtgcagcgaggtttaaaggttgagtgcttgggtttgatacttggtgggctcattattttttttttnctgattttgcatggcgcttgtgtgcgtatt

SEQ ID NO: 21705 - DNA, 101 bp, rice(Oryza sativa)
  misc_feature (71): n=a or g
tctctttttttcctcgatttagatagtatcttctaagcagctccaactttcagtggcggaaccacctctcngactggtcagatggccaccaagttccccca

SEQ ID NO: 21706 - DNA, 101 bp, rice(Oryza sativa)
  misc_feature (71): n=a or g
acccaaaagttcccaagacaaagtgtgtcatgatatgctagacacccatgtgcctgagaaaagtatgtccnctgtttcaaacaaagatgagacttcttcag

SEQ ID NO: 21707 - DNA, 101 bp, rice(Oryza sativa)
  misc_feature (71): n=a or c
gttttgtggcaagtgaggtgttggtatgcggctaatgttgaagaatatatcggcactgcagttgttgttgntgttgctcccaatatatcggcagcacgagg

SEQ ID NO: 21708 - DNA, 101 bp, rice(Oryza sativa)
  misc_feature (71): n=a or g
agccaagtggaaggcataccctccgctgaatacagaaacaattcaccatgctcaagtacgtgatgggtatncgagagtgtcggtggaccgtgtgttagatc

SEQ ID NO: 21709 - DNA, 101 bp, rice(Oryza sativa)
  misc_feature (71): n=t or c
ctcgtatgatgtcaacggagtagtacccaccttcaccttcgtcaaggctgggcagaagattgacatgatcnaaggagccaggtgtgacatcccggctcagg

SEQ ID NO: 21710 - DNA, 101 bp, rice(Oryza sativa)
  misc_feature (71): n=a or g
taatctctaaatacgttatctaaaggccaaccaggagttgctgcggatgaacgggtcggtgtgttctttcntgttaaatggttaaatgcaaacacacatca

SEQ ID NO: 21711 - DNA, 101 bp, rice(Oryza sativa)
  misc_feature (71): n=a or g
caattttgaccacttaaagaagagctaaattaacctctctgtgcgctttatcgtcaatgagaagagatttnttttggttttttttacttttgaataagaac

SEQ ID NO: 21712 - DNA, 101 bp, rice(Oryza sativa)
  misc_feature (71): n=t or c
gtcgggtcctttgaggatgttgtatgacatcctaacccaattagaatattgcatgtgtgtctcatgagagntgtatacgcatgtttagctatgtgggaccg

SEQ ID NO: 21713 - DNA, 101 bp, rice(Oryza sativa)
  misc_feature (71): n=a or g
cttaatgaactctaatgcagcatctcccttatgtgtgtgaggatcaggttctctgtttgtaagttcaactnattcggacttgccttttcctttgaaatgat

SEQ ID NO: 21714 - DNA, 101 bp, rice(Oryza sativa)
  misc_feature (71): n=t or c
atttctgcaacttatggttttaaagaagctagccgagaaatgcatactggcatttgtggctgcaaacaacnagtgccaactgtaaacctgcagaagccaat

SEQ ID NO: 21715 - DNA, 101 bp, rice(Oryza sativa)
  misc_feature (71): n=t or g
atgcaatttttcttttagctatttcttatcataccctacaggtaattctcaaaatcggagagatttacaangacacaatagcgatataagtatgactccct

SEQ ID NO: 21716 - DNA, 101 bp, rice(Oryza sativa)
  misc_feature (71): n=a or g
gcatcgtctgcgcagccagagcatcatctgcgctaggatgtctgtttgagataaataggatgaaacaaatncccagtttactgtctgaagtagctgatctg

SEQ ID NO: 21717 - DNA, 101 bp, rice(Oryza sativa)
  misc_feature (71): n=a or g
cggcgtggtgcactggtgtggtgtgtacgcggcgaggataagctagcacttgtataccagtactccctctntttcaaaatgtttgacaccgttaacttttt

SEQ ID NO: 21718 - DNA, 101 bp, rice(Oryza sativa)
  misc_feature (71): n=a or g
ccctccctctatcccaaaataactctacctaggagaggatgtgatccaggttaagttttttttaggtcacntcacatcccttgctaagttaagtttctttt

SEQ ID NO: 21719 - DNA, 101 bp, rice(Oryza sativa)
  misc_feature (71): n=t or g
ccacttaaatagtaccaagcacaaaataaaatccatagaacaaaaatacaggagggcaagggctcaggcanacagaagcagcagaagcccagacatatatc

SEQ ID NO: 21720 - DNA, 101 bp, rice(Oryza sativa)
  misc_feature (71): n=a or c
aatcaaaaaaaccaaacaactactactccctcatagggatgaaatcggattagtttcggtcagatctcgcntttctcatattctaacctatattttgttag

SEQ ID NO: 21721 - DNA, 101 bp, rice(Oryza sativa)
  misc_feature (71): n=a or g
gataacttcgacaattttaaaatatgctgatatgattttctagaggtggctgttgaaatagagtatacctntttgcgcacattttgaacgtaatttgtttt

SEQ ID NO: 21722 - DNA, 101 bp, rice(Oryza sativa)
  misc_feature (71): n=t or c
gcgttgagctcattaggtcttccactgcgtccggtaagggagtcttttatagcattgtacaccctaagttnctaagttcatgtattcttagcaacatggtc

SEQ ID NO: 21723 - DNA, 101 bp, rice(Oryza sativa)
  misc_feature (71): n=a or g
acatggatgatcttctcggtgaactcccttagcaactttgcagaaacatacatactacgtatgtcttactngctcttatgttgatttctgattttattttc

SEQ ID NO: 21724 - DNA, 101 bp, rice(Oryza sativa)
  misc_feature (71): n=t or c
tctcactcgaggaaccagagcactttgacatgttcttcagcttcagagcccagctgtacgcacttcttacngagaatctgccatgtttgatcggatgccat

SEQ ID NO: 21725 - DNA, 101 bp, rice(Oryza sativa)
  misc_feature (71): n=t or c
cagctatatactaattcaaattttgagacggatagagtagcagtctttataacagtggaagcgtttgtttnaagggtttgttggaaccatatcaccctaat

SEQ ID NO: 21726 - DNA, 101 bp, rice(Oryza sativa)
  misc_feature (71): n=a or c
tccgcaataacggcatcaagcttctgcgccatctcttgagtcaagttgttcttccagtctccaaccttcgncttcctaaaaaacgacgagttctccatcgg

SEQ ID NO: 21727 - DNA, 101 bp, rice(Oryza sativa)
  misc_feature (71): n=a or g
ggccgcacagccgaaacagacgtggaactcgtctcgacgaaacacagatgggtagatcgcaaattcggctnttctaaagccgaatagatttgtcccctgcg

SEQ ID NO: 21728 - DNA, 101 bp, rice(Oryza sativa)
  misc_feature (71): n=t or c
aggtgggctttttgagacctccaactcatgtattttacttaaattgtgaaaggcaaccatctcatcaaggnattccagatgatgatcttctttgatttcca

SEQ ID NO: 21729 - DNA, 101 bp, rice(Oryza sativa)
  misc_feature (71): n=t or c
aaactaaaatgacagctccgcactgccccaacatcattttcttgtactccatacgtctcataatataattntgagtttttactttgtaatgtttgaccact

SEQ ID NO: 21730 - DNA, 101 bp, rice(Oryza sativa)
  misc_feature (71): n=t or g
tctccaacatgggagtgaaatgccctgaaaaggggcatgagtgatactatgattagccaaagcaaccatantattcaagttaaatatggtttttaacgttg

SEQ ID NO: 21731 - DNA, 101 bp, rice(Oryza sativa)
  misc_feature (71): n=t or c
gagtgtcaaattatgccacatgtatatcatgcgaatctgttcacgccattgaaaggcccttgtcttaggcnctatttgtttcagcttaagattattataat

SEQ ID NO: 21732 - DNA, 101 bp, rice(Oryza sativa)
  misc_feature (71): n=t or c
gtaaacagaatattaccggtgacagcctgtgtatgctgggctagaagggaagttgaggagttagcattaantatggcacttctgagtttggatggagtaaa

SEQ ID NO: 21733 - DNA, 101 bp, rice(Oryza sativa)
  misc_feature (71): n=t or c
atttctgcaacgttggttcctttgatccctttgcccgcccctctccctcgcaaattttgtttaaattcagncaatttgctcaatgtttgaaaagttgacga

SEQ ID NO: 21734 - DNA, 101 bp, rice(Oryza sativa)
  misc_feature (71): n=t or c
gcgcgagcggcgagagccgcggttcgcatcgctgctactactaccgcatcgtctccttcttccccggcacnggcggcggcgctgtcacggacgccgagcct

SEQ ID NO: 21735 - DNA, 101 bp, rice(Oryza sativa)
  misc_feature (71): n=t or c
ggctgggaatggatgggggattgatgcggtggatgcgcgaatgatttctgtggagttttggaaggtggatntgggagaatcggagaaccctagttccgctg

SEQ ID NO: 21736 - DNA, 101 bp, rice(Oryza sativa)
  misc_feature (71): n=t or c
tcgaccattaaattcgaagctgaggacgcaagcaaggcatcctctgtcagcaccggtggtttagctgctantgctgaggccgtcacgaagtatatgaggga

SEQ ID NO: 21737 - DNA, 101 bp, rice(Oryza sativa)
  misc_feature (71): n=a or g
caatgtaaacattatcgtgatataattaataaagatgtctcttttaagttgcggagccaaatcaacccccngacccggcccctccggggccccgcagtggg

SEQ ID NO: 21738 - DNA, 101 bp, rice(Oryza sativa)
  misc_feature (71): n=a or g
ccgttgttgtcgaacgcagcctaagatgatttggctgcttaattatcatattgacatttatatttttctcntatataacagctcctctaggaccgatggat

SEQ ID NO: 21739 - DNA, 101 bp, rice(Oryza sativa)
  misc_feature (71): n=t or c
acagattatcaatctaggaacatactcctaaaagattctgttggtatccaaagcactctaccgagggaaancgaaagcagggctgaaattacaaatgacga

SEQ ID NO: 21740 - DNA, 101 bp, rice(Oryza sativa)
  misc_feature (71): n=t or c
tactcacacttgtaaactcacacatacaaacccaatcattacgagcacctccaaatgctgagccgtcaggnatatcttgggattgatgaagactcatgggt

SEQ ID NO: 21741 - DNA, 101 bp, rice(Oryza sativa)
  misc_feature (71): n=a or c
cctccactggccagcaactaataaccaaccaggcccctgaaaaaacatatttcttacagttcagtccctcngccgccgctggctcgcttctccggccaccg

SEQ ID NO: 21742 - DNA, 101 bp, rice(Oryza sativa)
  misc_feature (71): n=a or g
ttgtttctacgcttagagaaaatttctttgagaagaaactcctcttcgcattcgctacaaagcatcgaagngggggttatttagtctcttttattactatg

SEQ ID NO: 21743 - DNA, 101 bp, rice(Oryza sativa)
  misc_feature (71): n=t or c
catgcgccggggtagaaaactccatggccactagctccaattgttgacaagccggaatgatagttccctgnaaattgaccttctgaaggatagcccatgag

SEQ ID NO: 21744 - DNA, 101 bp, rice(Oryza sativa)
  misc_feature (71): n=t or c
ctgatgatatggttttttttttcaaaaatacaacttgtaaaattatggtcttgaattaaaaattatactcnctccattccaaattgatctacatatttcat

SEQ ID NO: 21745 - DNA, 101 bp, rice(Oryza sativa)
  misc_feature (71): n=a or g
tctgtctgcaaagattttacagagtattttcactgaaaagttcataagggaaattggactgaagtcattcngggactagggagaattcttttttgggatca

SEQ ID NO: 21746 - DNA, 101 bp, rice(Oryza sativa)
  misc_feature (71): n=t or c
atatttcaaatattggtttgtctgtatgagttgtctcatggttattccctttttgttttgtatgagttgcnggccatacttgagtatagactccacagccc

SEQ ID NO: 21747 - DNA, 101 bp, rice(Oryza sativa)
  misc_feature (71): n=a or g
cgcgaaaattacttttggcccgtatgttaaaattgtttttttactagtgcacgtggttagcatgaaaatcncatggttatcgcgaggtatacctaatttta

SEQ ID NO: 21748 - DNA, 101 bp, rice(Oryza sativa)
  misc_feature (71): n=a or g
tagaagttagaaagattattaccagcaaagaaaactggagcggcaactggagtacccttcatatgtgaaangtaaaacaaagtgtagatatgaggcagtag

SEQ ID NO: 21749 - DNA, 101 bp, rice(Oryza sativa)
  misc_feature (71): n=t or c
ctttactcccccaattaatcaactgtctggcattatgaccttgcctggcctgatgcggcaaactggacggngacctctgcttgcagttgcagctgcagctg

SEQ ID NO: 21750 - DNA, 101 bp, rice(Oryza sativa)
  misc_feature (71): n=a or c
actgagcatgtggaggttcccttggcatggcagaagacaatatcaatggacctaatgatagtatcaccatnacacacgctccacgacttcatcccaggccg

SEQ ID NO: 21751 - DNA, 101 bp, rice(Oryza sativa)
  misc_feature (71): n=a or g
tgccatgcagatcaaggtgcaggtaagctccatttcttgtggtcaaatttttcatgcaatttttgtgaatngatgggggattttcataaatggagcaacaa

SEQ ID NO: 21752 - DNA, 101 bp, rice(Oryza sativa)
  misc_feature (71): n=a or g
aaagaagcagtttcacgtacaggaacacctccaagtggtgtcttcagatttagacattggaggaattacancactttgagaaagtgcaaagccactaacat

SEQ ID NO: 21753 - DNA, 101 bp, rice(Oryza sativa)
  misc_feature (71): n=a or g
tcagcccatcgtggtcgatcaatctgcgccgcctcaacatcactgtgtgtgcaggaacaagaacttaattnccggtggccatggtgacgtgttatcatgag

SEQ ID NO: 21754 - DNA, 101 bp, rice(Oryza sativa)
  misc_feature (71): n=t or c
aaaatgaattaatggaacgctggagtttagtgtcacaattgctctagttgactcgacacggtaataggtancctcgcacaaggtgttctcaagtggttgac

SEQ ID NO: 21755 - DNA, 101 bp, rice(Oryza sativa)
  misc_feature (71): n=t or c
aagaacaactagaagtcaaagaacgcaatggagaggcgtcctctgcatctgcatctcctcctcttcttctnggcatggctactgctgctgctgctgcaagg

SEQ ID NO: 21756 - DNA, 101 bp, rice(Oryza sativa)
  misc_feature (71): n=a or g
tgcttgctctcattagtttaatcttcgaggagaagatcaaatggtacgctgctgtgatttggttgtgttgnttgtttgatgatagtcttagtccttatcca

SEQ ID NO: 21757 - DNA, 101 bp, rice(Oryza sativa)
  misc_feature (71): n=t or c
cacattctaatgtgcctccactgtataaaggaagagaaagacatactttattctacctgatagcgtatcanggatccgtgcaccaataatcctttctccag

SEQ ID NO: 21758 - DNA, 101 bp, rice(Oryza sativa)
  misc_feature (71): n=a or g
gacgtaaactaaacacacccaaagtaaaggctttctataatgccatcaatacgtaaccatgcatgtgacangcttttggactagtttaaaaaatagcgctc

SEQ ID NO: 21759 - DNA, 101 bp, rice(Oryza sativa)
  misc_feature (71): n=t or c
agcgtgcaccattgttttttgtttgtttttcacaccagtgacgggttgcacgctatttcttttttttttgntgggttaaagacatcagtgacgggtcacaa

SEQ ID NO: 21760 - DNA, 101 bp, rice(Oryza sativa)
  misc_feature (71): n=t or c
tctaggttccatcaatgtgcttctttggattcctttctgccatgtagtggtcagggacaggttatttttcntgcttggtcatagagggtctcgtcttattg

SEQ ID NO: 21761 - DNA, 101 bp, rice(Oryza sativa)
  misc_feature (71): n=t or c
tcagcttggctgctatcatgactccaaaaataagtttttaatgacaccattttcatcgagctgggcgtccnagtaaaactttgggttttgcaacgtgcact

SEQ ID NO: 21762 - DNA, 101 bp, rice(Oryza sativa)
  misc_feature (71): n=a or g
gacggtgagctctcaggcacgatgggcttgcgatgagtatagagcacgggattaatccatttcagatcctnaagggaatagcctagaacagcgcgatgttt

SEQ ID NO: 21763 - DNA, 101 bp, rice(Oryza sativa)
  misc_feature (71): n=t or c
gaaaccactgatagtagtaaacaaaatgaaagctatttgattaccttttagtttgaagcatcttcaggatnatgtattgtatgtcttttgctgaagaaaaa

SEQ ID NO: 21764 - DNA, 101 bp, rice(Oryza sativa)
  misc_feature (71): n=a or g
aagaatttctagcatcactactccaaaactgtaaacatcaccttgttctgtaactatcccagattcccggnattccggtggttcatagttcaacagtgaat

SEQ ID NO: 21765 - DNA, 101 bp, rice(Oryza sativa)
  misc_feature (71): n=a or c
tgcaaaaaagaaaaaaaattcgcccccaccgttccatatcataagtctcattgacttttttaaatcaaacnttttaaaaatttgatcaagtttatagaaaa

SEQ ID NO: 21766 - DNA, 101 bp, rice(Oryza sativa)
  misc_feature (71): n=t or c
ggaagagcttccacatgatctaaagaactgttttctacactgcaccatgtttccagaggactacttgatgncaaggaagaggctagtgaggcattggctga

SEQ ID NO: 21767 - DNA, 101 bp, rice(Oryza sativa)
  misc_feature (71): n=a or g
cgaagcaagtgattcttcagcagatgacatcccactcagctcggtggtacgattcatggcgaacaaacacntactgctgcttcacgctgggggtgatagca

SEQ ID NO: 21768 - DNA, 101 bp, rice(Oryza sativa)
  misc_feature (71): n=a or g
gaaaccgtgaatggcttttggaatatctctgatgctgcggctagactgccaatagtaaacagcttcagttngtgctacagaatggttgatcctccttgcgt

SEQ ID NO: 21769 - DNA, 101 bp, rice(Oryza sativa)
  misc_feature (71): n=a or g
tacataaaatatcctcactaactaaagacactcatagggacacttgtctcttaatggagaccacaactagntgggttcctcaaaatccgaaacaactacgt

SEQ ID NO: 21770 - DNA, 101 bp, rice(Oryza sativa)
  misc_feature (71): n=t or c
catgagttcgtcaaataagcattccatctcgctctgatgtagcttttttttccagactacccaaaatctcngcctgagcttcagtgcactcagccatcctg

SEQ ID NO: 21771 - DNA, 101 bp, rice(Oryza sativa)
  misc_feature (71): n=a or g
tcacccccctctagtcgacttctcgatcctacagtgagcatcagggagactaaatcggggatccctacctngcgcgtgcgcgcccctggtgctagtttttg

SEQ ID NO: 21772 - DNA, 101 bp, rice(Oryza sativa)
  misc_feature (71): n=a or g
atcccgctttgcggcaagcgactcaattgtggacctcgcctcttcataatcggagaccacattaccatacnagtgtttcaattcagacatctccgcctcga

SEQ ID NO: 21773 - DNA, 101 bp, rice(Oryza sativa)
  misc_feature (71): n=a or g
gtacgtgtggctgggcttctacttccactcgtgcgtgtcgcaggggaagcagccttcctgggcgatgtcantgatctggacccccgtgtcgtagacctcgc

SEQ ID NO: 21774 - DNA, 101 bp, rice(Oryza sativa)
  misc_feature (71): n=t or c
gagcggcgaggaggaggtggccatggcgcctgaatgcgtaacctggtacaaaaatcagcaagagaatcaanaaacaggatgcaagtttcattgcagataac

SEQ ID NO: 21775 - DNA, 101 bp, rice(Oryza sativa)
  misc_feature (71): n=a or g
tgtgtgaattttacagcaagtaacactagtacgctagaccttgtgacaccagtggattgctttgggcgttngccagtaaaaaagttaattagtgacaacag

SEQ ID NO: 21776 - DNA, 101 bp, rice(Oryza sativa)
  misc_feature (71): n=a or g
taacttttaggatgtacctgcaagcattacacacgactttttggaataggtagttccttcccctagaaccntacttgagagtttcctacctcatacggctc

SEQ ID NO: 21777 - DNA, 101 bp, rice(Oryza sativa)
  misc_feature (71): n=a or c
aaaatttcaaaatatttttgaactttggtaattgtgccatccatggtctaataaatttcagcttaaaatanaacttatacaaagagtaacaaaaagagaga

SEQ ID NO: 21778 - DNA, 101 bp, rice(Oryza sativa)
  misc_feature (71): n=t or c
aaaccaatccactggggcacggccgcacagtgcatacagtgcagttgcagagtcgtaattagggcatccanaatgtagtctaaaactagttcataagcaat

SEQ ID NO: 21779 - DNA, 101 bp, rice(Oryza sativa)
  misc_feature (71): n=t or c
cttgcatcagtgcatatcatctgttatgtaacttgtgcatgtctataactgtgacaggtcaagaaaggtgngagcgccttcaaaaatgatcctcttaagca

SEQ ID NO: 21780 - DNA, 101 bp, rice(Oryza sativa)
  misc_feature (71): n=a or g
tcaggtgggaagcgcagggctccgccgaaggcggagaagcttgttgatcatcaccttggtgtggtgaaggncgctgtagcgaagcatccagggcacccact

SEQ ID NO: 21781 - DNA, 101 bp, rice(Oryza sativa)
  misc_feature (71): n=t or c
tggacggcgatccggcgaggcccgcccaggtggcttggctacactacaccatgcaacagcaaagccgctcntgctcctcctcgagaaaaaagaaaaaaaga

SEQ ID NO: 21782 - DNA, 101 bp, rice(Oryza sativa)
  misc_feature (71): n=a or g
gatctgtctgccagctcaaggtactgaagcagttgggggcttggatcatgctcagattgatccatcatttncaaatgcaaactatcaaggtactcattcat

SEQ ID NO: 21783 - DNA, 101 bp, rice(Oryza sativa)
  misc_feature (71): n=a or g
ggcgccctaacgtgcttcgcaatgaaggagttgcactggttgctaccgatttcgtggcggtggaaccgtcncatgtactccatctcctcctcccggagttc

SEQ ID NO: 21784 - DNA, 101 bp, rice(Oryza sativa)
  misc_feature (71): n=a or g
ccttgtgtttctgaaattttatattgagcatcaccgtcttggtaagtatgagttttgtcctctctggaaantttaaaaggattataatattttaccttctt

SEQ ID NO: 21785 - DNA, 101 bp, rice(Oryza sativa)
  misc_feature (71): n=a or g
gctagtatgtcatctttgaacatgaactaaggttcacatggcttttgatttgtctagtccaggttcgtacntatacggctctgtgtacaattctattggat

SEQ ID NO: 21786 - DNA, 101 bp, rice(Oryza sativa)
  misc_feature (71): n=t or c
aatcagtgcagttttaatgcaagttgaccttcctgttgcgttcttgagtaaagctcttggtcctcgcgcanagtgtctttccacatatgaaaaagaaagtt

SEQ ID NO: 21787 - DNA, 101 bp, rice(Oryza sativa)
  misc_feature (71): n=a or c
cggcatttacagagtatggggatcgttggtagaaaacatttttctagtagaattttccatatttggtgcgncatcgctcgaccatcttgttaaagtcacca

SEQ ID NO: 21788 - DNA, 101 bp, rice(Oryza sativa)
  misc_feature (71): n=t or g
tgaaagagtgttggacatgaatttcacatgtacacaaagtaggatctcccattatctcagaaacactccangtaattctattgtatagcgcattcttatac

SEQ ID NO: 21789 - DNA, 101 bp, rice(Oryza sativa)
  misc_feature (71): n=a or g
cgattcagctcaatctgggtttgatttggctggattgtgttggtcttagtctattgtgtgttggggctatnctccagttttggagcttggatctgtttagg

SEQ ID NO: 21790 - DNA, 101 bp, rice(Oryza sativa)
  misc_feature (71): n=a or g
aatatctatactgttgtggcattttgtgctggtaacaaaataatggaactttacagactgcagcttgggantattctttggaaaagcttggttcatggaat

SEQ ID NO: 21791 - DNA, 101 bp, rice(Oryza sativa)
  misc_feature (71): n=a or g
aggagaaatacagagttgctgttgcagctgatgaaagttgtcgtagtttgcttgatgctcagaaaataatngatggaaatcttgctcatgttattaacatc

SEQ ID NO: 21792 - DNA, 101 bp, rice(Oryza sativa)
  misc_feature (71): n=t or c
ttttcctccctgggccagccccttccctcactcggtccggcccaccccctctccccttgaagtctgtttcncatcctttcttccccagccagccggttgaa

SEQ ID NO: 21793 - DNA, 101 bp, rice(Oryza sativa)
  misc_feature (71): n=a or g
atgaaaaattaattttctcgaattagtccgcccccacccccctcccccacacgttggcggaaatcccgttncggcccaaaaccaacggcccgcacgttggc

SEQ ID NO: 21794 - DNA, 101 bp, rice(Oryza sativa)
  misc_feature (71): n=a or g
gaaaatttctttctagcaatttttttccattcatgcacaaatatcgaggcaatccgattgacacaaatctnaaagttttggaggcaaaaaccttgcggaag

SEQ ID NO: 21795 - DNA, 101 bp, rice(Oryza sativa)
  misc_feature (71): n=t or c
gattcccttgtcgtctcatgaattccactccatgacatgtaaccaagctcatcagtggaacattcagcatnactaactgcagaggctgcagttctggtttc

SEQ ID NO: 21796 - DNA, 101 bp, rice(Oryza sativa)
  misc_feature (71): n=a or g
ttacactgccaaggcacaattctgtgaaaatggtcaattccatgatgttgtgatagagtgtgacaccgtcngcctcaaggatccatgtcttgagatacggg

SEQ ID NO: 21797 - DNA, 101 bp, rice(Oryza sativa)
  misc_feature (71): n=t or c
tcttcttcttgccctaataagaaggcttctgaagccatttctgatgaaaagaaggctaatgttgactcagncacagcatcgtcaaagaaaaggcggacatg

SEQ ID NO: 21798 - DNA, 101 bp, rice(Oryza sativa)
  misc_feature (71): n=a or g
ttaggacgtggccattgtgacagtccgataactgccacggtgccagtgccaccgtcgccagccaaccatcncggagaaggaagcaaagggagaagtcgcca

SEQ ID NO: 21799 - DNA, 101 bp, rice(Oryza sativa)
  misc_feature (71): n=a or g
ttgtcatcgtgtaatccatgcaataaaacttaaattttcaaatgattaattaataaaaaatactccctccnttttaagttataagatgttttgactttaat

SEQ ID NO: 21800 - DNA, 101 bp, rice(Oryza sativa)
  misc_feature (71): n=t or c
ctctagggataatggcaggggtaatggtaattttgtttggcaaccgaaaaagatttcgccggctatcttgnaacctcctcatcttctccaatatgcaaccg

SEQ ID NO: 21801 - DNA, 101 bp, rice(Oryza sativa)
  misc_feature (71): n=t or c
tagattatttggtaggagaaagtactttctccttccaaaaataatcaatttaaaagaagatgtgacctctnatagaacaatacgctatattatatatattt

SEQ ID NO: 21802 - DNA, 101 bp, rice(Oryza sativa)
  misc_feature (71): n=t or g
caattggctgcatcagcttccttatccctgttatgggattgctgttctggtggaggcataggcgaaaccancaaattctttttgatgttgatggtaagcaa

SEQ ID NO: 21803 - DNA, 101 bp, rice(Oryza sativa)
  misc_feature (71): n=t or c
ttcgaaaggttgtacacactacaagattttgacaaatgaaggggcgtcgtcccttggtcctgcaagagatngatataaatacagatggtcaacattatcgg

SEQ ID NO: 21804 - DNA, 101 bp, rice(Oryza sativa)
  misc_feature (71): n=t or c
tgaatatttttgcgtgcgggccacttaataggcctgcttgtgaaaatatgctcatttttgtgtacagcccnttaagaggcccgcctacgaaaatagatttt

SEQ ID NO: 21805 - DNA, 101 bp, rice(Oryza sativa)
  misc_feature (71): n=a or g
atgcaaaccaagacatgttctgattcctacaaacttctgcagctactgctactactgaagaacactgatcncggtgccaacaaggcctcggatttggcccg

SEQ ID NO: 21806 - DNA, 101 bp, rice(Oryza sativa)
  misc_feature (71): n=t or g
caagtttcactcatcctcctctaagatttcacttagctcggaggagaattggtgagaattcaccgcaagtnacacgggttcatcatcacagaagaatggtc

SEQ ID NO: 21807 - DNA, 101 bp, rice(Oryza sativa)
  misc_feature (71): n=t or c
aaatgcaagtcctggttccaatgaaagcactcatggaccccctcacatatcgggcctgttcactttaatgncattttcaaccttatcaaattttggtaaag

SEQ ID NO: 21808 - DNA, 101 bp, rice(Oryza sativa)
  misc_feature (71): n=a or g
ggttctgttcagggaagattaactgtggattctttacttactgattattagtctttacagtctagcgtgtnaaaccgtgaatgccacttctgtgtttcatt

SEQ ID NO: 21809 - DNA, 101 bp, rice(Oryza sativa)
  misc_feature (71): n=a or g
ctacacgaataattgcacagtacctttcacgaatctacggtttgtttggtttcggtcaggagacggatcangcgtcgcgaaacgtttcgttgcatccgtcc

SEQ ID NO: 21810 - DNA, 101 bp, rice(Oryza sativa)
  misc_feature (71): n=a or g
tcatcgatcagcacctatttccttcatcctaaaaaaaaatctataatgggacttgatattttctggtacantagatctggatagatactactccctccgtc

SEQ ID NO: 21811 - DNA, 101 bp, rice(Oryza sativa)
  misc_feature (71): n=a or g
tagagataaaaaaaatcagaaaaaagtgaaaagaaaaggaaaaaaggtttaaaaagggttaaaaaaaaggnaaaaaagtggaggagacgcgcgcgccggcg

SEQ ID NO: 21812 - DNA, 101 bp, rice(Oryza sativa)
  misc_feature (71): n=t or c
gaaaaagttgggaactaaacaagggcctaaatgaaaagaaacgacacgaactgacgttttactatattcanggcgcggattctttatcttgtctagcttta

SEQ ID NO: 21813 - DNA, 101 bp, rice(Oryza sativa)
  misc_feature (71): n=t or c
cgtgacatccaagatgaaatgtttcaattgtaatgaatatggtcattatgccaagcaatgtcgcaagccangacgccaacgccgaggggaagcaaatttgg

SEQ ID NO: 21814 - DNA, 101 bp, rice(Oryza sativa)
  misc_feature (71): n=t or c
atggcaggcatcaggaatcgagcaatcagctcaaaccatcaggattgtaccagcacagtttggactgccanagctcggttgcaacgtcaggaattgcttgc

SEQ ID NO: 21815 - DNA, 101 bp, rice(Oryza sativa)
  misc_feature (71): n=t or c
gcacgcacaaaggtgccacgacctttgcaccactgccgatgtcttcttcatcagccatcaataagagaganacactgtcgatgggatacccatggacttat

SEQ ID NO: 21816 - DNA, 101 bp, rice(Oryza sativa)
  misc_feature (71): n=a or g
aactttgctttgcctctcccacccacccaaaaagcaatgggcaggtagagtgaacaaacgccgaaatcttnaaggtcctcaagataagatagtacaacatg

SEQ ID NO: 21817 - DNA, 101 bp, rice(Oryza sativa)
  misc_feature (71): n=a or g
aaccaaattcctaaactggaactcagccttgtaaagtggaaaattatcaacgctgactcaggcttcactancctgaactttcatctgtaacttgctctgac

SEQ ID NO: 21818 - DNA, 101 bp, rice(Oryza sativa)
  misc_feature (71): n=t or c
aaaatatttcttaggtgatgatcatatctcacactaaccctttaaccaaacactctaaaaatagtggcggncatatcatattcaggtatatcccatcaagt

SEQ ID NO: 21819 - DNA, 101 bp, rice(Oryza sativa)
  misc_feature (71): n=t or c
aattcatcaatatttggaaggaacaaaacattcagtaatcagtgtcgatcactcgggcatcgaattaccgngatatagagcgcctccaagcacgggaaaca

SEQ ID NO: 21820 - DNA, 101 bp, rice(Oryza sativa)
  misc_feature (71): n=a or g
aaccctcttaaaaaaaaggggcaattttgtttttaccccaactttgatattcaatgttgattttacccctnttttttagggtttcatttttgcccctactt

SEQ ID NO: 21821 - DNA, 101 bp, rice(Oryza sativa)
  misc_feature (71): n=t or c
ctgcagtggttcttcagcaacatcacagcaccactgcttcatcttccatcagcaagtgcgcagcgattcangcccgttccccttacctatcaccgccgcga

SEQ ID NO: 21822 - DNA, 101 bp, rice(Oryza sativa)
  misc_feature (71): n=a or g
cttttaaaattaaaggtaaaaaaaaagcagatgaacatcaaccgagtaaccgacagaggacagacagacgnccgaatatgccgctgcagtgcttcttcctc

SEQ ID NO: 21823 - DNA, 101 bp, rice(Oryza sativa)
  misc_feature (71): n=a or g
cacactccttccctcgctaatcttcatagggcctgtttaatcgctacttgacggaagctcgctacttgacngaagctcctatagtctttttatttagagga

SEQ ID NO: 21824 - DNA, 101 bp, rice(Oryza sativa)
  misc_feature (71): n=a or c
caagagactgccaaaattttcatcgttttagcttaactcacatattgtgcataaccaaacgcttcatcacnacttaagaatgatttcagcttgcacaatac

SEQ ID NO: 21825 - DNA, 101 bp, rice(Oryza sativa)
  misc_feature (71): n=a or c
gcaaggcttctttgtaaatactaaattaacttattggaaccagatgagaaaacctactcttgataattagntgtcagttgtaaaaagtaaacaaaaatcga

SEQ ID NO: 21826 - DNA, 101 bp, rice(Oryza sativa)
  misc_feature (71): n=t or g
tccattggtgcaaggtgatgatgaaatcaagggtgaacagccaaatactgatgcacctttaggggattctnattccttatccgctgcaagtaatgataata

SEQ ID NO: 21827 - DNA, 101 bp, rice(Oryza sativa)
  misc_feature (71): n=a or g
gtattgagttttggcttcccttgcagaaagaagaacgtcgtgtggaacttcaagtgggattacggtgagcnagcgggaagccactcctgggaggcagtctg

SEQ ID NO: 21828 - DNA, 101 bp, rice(Oryza sativa)
  misc_feature (71): n=a or g
aagatcaactgcagaagatctgaccgataaagcaggatcagagaccatgtcacttaatcttggaagtaganctttcagtatttcatgactttgcggattgt

SEQ ID NO: 21829 - DNA, 101 bp, rice(Oryza sativa)
  misc_feature (71): n=a or c
agagcccaagcatcgcggagagctgagttgctggtctgtagagcatgtttggtatagctataagactcctnaatttaatttaaggagttgagtctgaagta

SEQ ID NO: 21830 - DNA, 101 bp, rice(Oryza sativa)
  misc_feature (71): n=a or c
gtgctgtgcctgacgtactacgattaacgggcggtacgagccgatccaagagcaagttcaatagtatagtncactgctagctccaatttatctatagtcaa

SEQ ID NO: 21831 - DNA, 101 bp, rice(Oryza sativa)
  misc_feature (71): n=a or g
tggtgtgtgtttgcgaaccctagctttcgctggcgcagctttggcactgtagcgaaaaatggggaaaacgnaggagatcgcaatgaggaagacgaagcggc

SEQ ID NO: 21832 - DNA, 101 bp, rice(Oryza sativa)
  misc_feature (71): n=t or c
gcaaacctcttccatctctcgcagaataacatcgcgctcacgttcaatgcgggactcttccaactttgagngctgcagaatgtccgcaagaatattaagtg

SEQ ID NO: 21833 - DNA, 101 bp, rice(Oryza sativa)
  misc_feature (71): n=a or g
tgagtaagatgaaatggtatgagatcaagttgttttgactacgcgctagggaatgatagagaagcttaccncgaagtttgtcgctttccaacgggtcctga

SEQ ID NO: 21834 - DNA, 101 bp, rice(Oryza sativa)
  misc_feature (71): n=t or c
ttaaatttttaaaatgtattttttggtctctaaatttgtcttatggactccaacccactctatacgctgangtggcataccatagcggctcctacgtgtca

SEQ ID NO: 21835 - DNA, 101 bp, rice(Oryza sativa)
  misc_feature (71): n=t or c
cggcccacaggcggcagtcagattggctccgggatggaaatcggcgctttcctaactttgcaatattttcngatcttgatcctagttgccaaatttagata

SEQ ID NO: 21836 - DNA, 101 bp, rice(Oryza sativa)
  misc_feature (71): n=t or c
gtggaataataatttggagtttttcccaatgatatccctagcaagaatcaaatttgctcagaagggtttcntggaaattttctttttggcagcttggcaca

SEQ ID NO: 21837 - DNA, 101 bp, rice(Oryza sativa)
  misc_feature (71): n=t or c
gctgactgagatgattgcatcctgcagagagcagcttaagcctaaccattagctggtaaaatggatgttangcccatgtttaattcacccccaactacccc

SEQ ID NO: 21838 - DNA, 101 bp, rice(Oryza sativa)
  misc_feature (71): n=t or g
gattttctcatttttttgaattttttttggttcctcggtactagtgacacgctgtcctttgtgcaacagtncttctcgattggcccatcagaactggtagc

SEQ ID NO: 21839 - DNA, 101 bp, rice(Oryza sativa)
  misc_feature (71): n=a or c
tcactcacaactccggaacaaatcccagttgcacggaggaaccaaaaaaaaaaaaaagcttatcctttctncccccgccgccgctgaaaggcgccgccttt

SEQ ID NO: 21840 - DNA, 101 bp, rice(Oryza sativa)
  misc_feature (71): n=a or c
accatagctagatctcgtcggtcactttgtcaatgattcggtgcggcagagtctctaagtttctgaaaacnatgctattcctctctttccaaatatcccag

SEQ ID NO: 21841 - DNA, 101 bp, rice(Oryza sativa)
  misc_feature (71): n=a or g
ggtttcaaaaattaatacggttgttctcttccatttctcttcaagaagcatgtggcaatcagtgtgagctnctgaggaggtgtagtgatctccactgccac

SEQ ID NO: 21842 - DNA, 101 bp, rice(Oryza sativa)
  misc_feature (71): n=t or c
caaacgggtggtcaacttgaatggaagtcgtggtagaatgttgcatcttatgacatcatctgcgatatcantgtgtaatgccttctctaatattcttggag

SEQ ID NO: 21843 - DNA, 101 bp, rice(Oryza sativa)
  misc_feature (71): n=a or c
atcgtggaaactgacagcctggagcttttgaagcttgtcggcgctggtagcagtgacagatcagagctagngtttttggtcaaggaggttagagacccctt

SEQ ID NO: 21844 - DNA, 101 bp, rice(Oryza sativa)
  misc_feature (71): n=a or g
ctctcagggagctcaaggagttcaaggtgatggtttccaaggagttcaaggtgacggccctaatcaagacngcgatgcaacacagtctagatcagggtgcg

SEQ ID NO: 21845 - DNA, 101 bp, rice(Oryza sativa)
  misc_feature (71): n=t or c
gggactacagaggagtgggatggttacaatcaggcgctattgtgcactattctagctaaatcttttgcccngcatcctatctaaatattgatttcatccac

SEQ ID NO: 21846 - DNA, 101 bp, rice(Oryza sativa)
  misc_feature (71): n=a or g
acaatggtggtgttgacgggagctcgacagcgttggaagatcggaagagcgagcgcggtgttggcctgttnggaagatttcggctccgactccggcgaggg

SEQ ID NO: 21847 - DNA, 101 bp, rice(Oryza sativa)
  misc_feature (71): n=a or g
gcctttcttgccttgaacattgtggacatagggtatggagacataccttatttccaccatggtaatggtantgccattatggtccatcttgataacggtag

SEQ ID NO: 21848 - DNA, 101 bp, rice(Oryza sativa)
  misc_feature (71): n=t or c
accaccatttggcatttttgtaggtgtcactgaatggctagaacaatgggttcaacacctacctactgctnttaccaaacaaatggtgttggcgctttaaa

SEQ ID NO: 21849 - DNA, 101 bp, rice(Oryza sativa)
  misc_feature (71): n=t or c
catatatagggatgagtgtggtagaccgacctacggtaatccttacctaccttggttaaggattgttgtanccatgggtcgacctcgcttgtagggtctgc

SEQ ID NO: 21850 - DNA, 101 bp, rice(Oryza sativa)
  misc_feature (71): n=t or c
acctggtaaacattattgcagtactggttggctgtgtttttttggctgtctggtccaaccacagcaagatnacaatagcaaagcaagaccacagcaagatc

SEQ ID NO: 21851 - DNA, 101 bp, rice(Oryza sativa)
  misc_feature (71): n=t or c
ccattcggacgaggcggcaactccgtgttgacggtcgttgttatcgattcgaccatcaatattaccaaaanagaggagaactagtgatgcttgcaatgcat

SEQ ID NO: 21852 - DNA, 101 bp, rice(Oryza sativa)
  misc_feature (71): n=a or g
tttatatttaaaaaaactacttaagtactgtaaaatcacttataacacggtggatatcaccgtccgtgctncgttaaaagtccaaacagctgaagaaatca

SEQ ID NO: 21853 - DNA, 101 bp, rice(Oryza sativa)
  misc_feature (71): n=a or g
aatcacttcagtttctaaggtgaacaagtggctgacatcacttattgtatgacagtgtttgtcccctcagntattaacaacaatgatagttgtggggagcg

SEQ ID NO: 21854 - DNA, 101 bp, rice(Oryza sativa)
  misc_feature (71): n=t or c
ggtttagatgaaaaaaaagaaacaacaacaggatatctgcaactaggtgacagaggagaggaggctgatangtggaaccggcggataaattaaaaatttag

SEQ ID NO: 21855 - DNA, 101 bp, rice(Oryza sativa)
  misc_feature (71): n=t or c
cctttcgtatttactagtatttagagttttctcaataaaatgtttggaggatttgttaatctacactaatngctagtccgtattgcatggatattgttatt

SEQ ID NO: 21856 - DNA, 101 bp, rice(Oryza sativa)
  misc_feature (71): n=t or c
ctccccaccgtctacggggacaagtacattgtccgggtgatgatatctaggaacagccagatgatcagctngttgtggccgacgttgccgcagtttgccct

SEQ ID NO: 21857 - DNA, 101 bp, rice(Oryza sativa)
  misc_feature (71): n=t or g
aagaaagcaaaaagagagagggatcttggtatcttacttgcatctgaatgtgccacctccatggagaagangaggaggaggatggagaagaagagaggcag

SEQ ID NO: 21858 - DNA, 101 bp, rice(Oryza sativa)
  misc_feature (71): n=a or c
tcaactttgaaatattgtagtgagacacagagactagctagagctgagtctcaattaataattagcggtgnataactgataagaaaaacccttagattttt

SEQ ID NO: 21859 - DNA, 101 bp, rice(Oryza sativa)
  misc_feature (71): n=t or c
agaattaatgaataagttctgcaacggatcaagcctatcataacaagcatcacaaaccctttgcggattcngctcacggaacttggctggcaacagacatc

SEQ ID NO: 21860 - DNA, 101 bp, rice(Oryza sativa)
  misc_feature (71): n=a or g
tcaggcatccacaattctaccgccgccttgagagactggtattcagctctcctctgatctgcctccacctncctccgttcaaactcctccatccgcctcaa

SEQ ID NO: 21861 - DNA, 101 bp, rice(Oryza sativa)
  misc_feature (71): n=a or g
taaatgtaagtccattcatgcatagccttaattgtcccctttcatgttttgctgaaacgccagtaaattcntattacagagaatccatctcaggaatgagg

SEQ ID NO: 21862 - DNA, 101 bp, rice(Oryza sativa)
  misc_feature (71): n=a or g
ctttttccctctttgcatcttaatgcatcatttgcatgagtggatctgtcaatgatttcgaacagctttcnggcggatgtgattcgtcgtgtcgccagctc

SEQ ID NO: 21863 - DNA, 101 bp, rice(Oryza sativa)
  misc_feature (71): n=a or g
gacatcctcgcgtctccgacatcggcatcgatttcagctttgactttctcgtctcgttgagcgcgacttcngcttgatcacccgattaagcgcatggacat

SEQ ID NO: 21864 - DNA, 101 bp, rice(Oryza sativa)
  misc_feature (71): n=t or c
tgccatgtagtattgctaataactgactatttcatagagttgacagccactagatcacgctgccacacatngaacacattatgtgcaacccatagcggcac

SEQ ID NO: 21865 - DNA, 101 bp, rice(Oryza sativa)
  misc_feature (71): n=a or g
ttaatcaagcccatttcctctataaccacagaggatgagagggattcctacctagaagatgctcgcaatcnatcaggtagcaacactgacgagtcagaact

SEQ ID NO: 21866 - DNA, 101 bp, rice(Oryza sativa)
  misc_feature (71): n=a or g
tgtaccgtgtaatatgaataaaatcggatgatctaggcaacgacgtatgtgatatctacacggacttagcnagtttcattcgcttggtatcaacatcacac

SEQ ID NO: 21867 - DNA, 101 bp, rice(Oryza sativa)
  misc_feature (71): n=t or g
cttgcaggagtttcagatcgatctatattttttgcgggttcagatcgatctatatatatctcgccgatgtnttggaagcatatgcatctctgggtagcacg

SEQ ID NO: 21868 - DNA, 101 bp, rice(Oryza sativa)
  misc_feature (71): n=t or c
acatgcagccatgcacagcccctgtgcaagcccctttttcttctcctccgtgaacttgtgaaacccattangaagatctcccgatatgatgtccatccact

SEQ ID NO: 21869 - DNA, 101 bp, rice(Oryza sativa)
  misc_feature (71): n=t or c
agctccatctccttcctctcttcttccctttgctttgcttcagctgcagctatagcttagctaagattgcntgtgtgtgtgagagagagagagagcacagc

SEQ ID NO: 21870 - DNA, 101 bp, rice(Oryza sativa)
  misc_feature (71): n=t or c
cgctcagccacgttggcgaagagttgacgtggaggagagagggaaaaaagcgaatggcttgcaaaggtttntcgtgtcttatagaaggcatgatagcctcg

SEQ ID NO: 21871 - DNA, 101 bp, rice(Oryza sativa)
  misc_feature (71): n=t or c
gtggcgtcagggtccgctccccagcagaggagctcgctcccacgaagggatgcgcgattccactttgccgngagcccacgcgaggcgaggaaacgacggct

SEQ ID NO: 21872 - DNA, 101 bp, rice(Oryza sativa)
  misc_feature (71): n=a or g
cggaagaggagaaaagctaaacatgacttctcatgtcaagttttctaccccctacaaactcaaaaaacaanatttggagagagtcgtccctccaaacaatt

SEQ ID NO: 21873 - DNA, 101 bp, rice(Oryza sativa)
  misc_feature (71): n=t or g
gactactcgccttctgatctgaaggcaatcctccttgtttctccgaaccgtgtccaccgcctccttgatcntcagagccatctgcgtgatatgcttcaagc

SEQ ID NO: 21874 - DNA, 101 bp, rice(Oryza sativa)
  misc_feature (71): n=a or g
agaactaccaaacttaagaaaattgtgatgtttaagtgttatgagaacatacctcgggagcttcttgaganaaacttcaatacctcatcaatcaaaattac

SEQ ID NO: 21875 - DNA, 101 bp, rice(Oryza sativa)
  misc_feature (71): n=t or c
acatacaggacgcactatagtcaatgggtgaatcgatggatatataatccgtgtgtacttacaaaagaganagaagtaattaatgagctagcttatactaa

SEQ ID NO: 21876 - DNA, 101 bp, rice(Oryza sativa)
  misc_feature (71): n=a or g
gtgacacaaatcccaaggtctgattgtgacacaaatcccacaattttctatcaacagccatttaggttgtnttcgtttgtactgattgggaaccttccctt

SEQ ID NO: 21877 - DNA, 101 bp, rice(Oryza sativa)
  misc_feature (71): n=t or g
ccttcttcctcctcctcctccagatccaccctccgccgccctcatttcgcagccgcgggtttggattaccntgaaatgagctttcttctcctctctgaaaa

SEQ ID NO: 21878 - DNA, 101 bp, rice(Oryza sativa)
  misc_feature (71): n=a or c
tagccaacaccggggcagtgacaagagcatgtttcagagtttgaaatgcttgctcggtgtcagaattccanaaatataactgacctttgcgcaacaagtta

SEQ ID NO: 21879 - DNA, 101 bp, rice(Oryza sativa)
  misc_feature (71): n=t or c
tcatttttctgtgaccactagatgacagtctaattccatccttgaaaaggttagtttgttgaagccacctnagagggatagattgcatgatttgggttttg

SEQ ID NO: 21880 - DNA, 101 bp, rice(Oryza sativa)
  misc_feature (71): n=a or c
taagttatacaaagtaaatataaaatggacggtgcatattgattgaggtagaatattagtactactgtttnttctttttggaatatactgcaaaacaacac

SEQ ID NO: 21881 - DNA, 101 bp, rice(Oryza sativa)
  misc_feature (71): n=a or g
gctgctagtgcagttcagtgtgttggtatggttccaactttctgcctggggatgtaagttatgatggccgntggcgatcaagtgaccggatctggtatttt

SEQ ID NO: 21882 - DNA, 101 bp, rice(Oryza sativa)
  misc_feature (71): n=a or g
atcaccgaggggcggcaagctgctgcagctgtcgacaagtacttgtcaaggaatgaacaagatgccgcagnggacataaccccctcgggtgcaggttttgt

SEQ ID NO: 21883 - DNA, 101 bp, rice(Oryza sativa)
  misc_feature (71): n=t or c
cgccacttcgtgagaatcgcaaccttcgcgaacatgtagacgaccggcagagggaacgacgaaatcggaangacactgactgtcatcggcgtcgttctccc

SEQ ID NO: 21884 - DNA, 101 bp, rice(Oryza sativa)
  misc_feature (71): n=t or g
cacatacttgccaaagaacgtaacccttaatgggacaatgatagccgacatcgtcttcaacagcagcacanggatgctggtcgcctaccttcggtttcttg

SEQ ID NO: 21885 - DNA, 101 bp, rice(Oryza sativa)
  misc_feature (71): n=a or g
tgcatgctgaaaaatttaggaggcctcagaattttagaccttaacaagttctctagagctattcgtcttcnatggttttggttcagttcaaaggaggaaaa

SEQ ID NO: 21886 - DNA, 101 bp, rice(Oryza sativa)
  misc_feature (71): n=a or g
ctttttcttaaactatagtggattagctgacccctttgtttgtgttgtcgctgtcaaattagttcgttggncataacaaggaccaaactagtagtagtaac

SEQ ID NO: 21887 - DNA, 101 bp, rice(Oryza sativa)
  misc_feature (71): n=t or g
ccgcttggccgaaactattaattcgacgaagcgactaggttaaagcaaattcggccgtaatatgtagatcnagtccccagcggagtcgccaaaaatcgtgt

SEQ ID NO: 21888 - DNA, 101 bp, rice(Oryza sativa)
  misc_feature (71): n=a or g
acaggcgacagaggtgaagatgatttgggtagacaggttgggttttgacttgcatgttcattccggggaangtacctttgctgcccggatccctttcacga

SEQ ID NO: 21889 - DNA, 101 bp, rice(Oryza sativa)
  misc_feature (71): n=t or c
ccatctatgccagaagttaagcaccattctctttcattggaagggtttactcctgttaaagatgtcgatgntacaaaaatcaagtacaagtaagcctgcaa

SEQ ID NO: 21890 - DNA, 101 bp, rice(Oryza sativa)
  misc_feature (71): n=a or g
agcgaatcccattgctattgtccaagcaccgtcattgtcatcgtcgcagccagtcgcagccgtcatcttcnccattgctgccgtcgtcgtggccggtggcg

SEQ ID NO: 21891 - DNA, 101 bp, rice(Oryza sativa)
  misc_feature (71): n=t or c
ggcttgggcgacgcgtgggacctgagcgaaccattggctgaattaaccacacatctgccctttaccaagtngacagaagggttttgccggatttggaacag

SEQ ID NO: 21892 - DNA, 101 bp, rice(Oryza sativa)
  misc_feature (71): n=a or c
aagccgcaacctgcatcgcgtcctgtgatgctttgaacttgcaatgcttgtattccatcgttttccaacgntaaggtatcagaacttgaaatgcttgtatt

SEQ ID NO: 21893 - DNA, 101 bp, rice(Oryza sativa)
  misc_feature (71): n=a or g
actgttatgatgaattggtgatattttggatgatgtctacgtttagcttgtggctatgaggtactgtactnctatcatgtttcctaataccctaatggcct

SEQ ID NO: 21894 - DNA, 101 bp, rice(Oryza sativa)
  misc_feature (71): n=t or g
ctgtgatgatatgactagcaaggtaatatggggccctagccaggaaattgtagtgtggggattagactttnatagtgggactgaatggaaggtaaccaaca

SEQ ID NO: 21895 - DNA, 101 bp, rice(Oryza sativa)
  misc_feature (71): n=a or g
ggagcagcaggcgtgcgcagcacagtagaggatgagctctcgccgccaaaaccgtagccaaagcgatagcngccggtggtcggcgacacggtccacccacg

SEQ ID NO: 21896 - DNA, 101 bp, rice(Oryza sativa)
  misc_feature (71): n=a or g
catgtatattacaggaatagcacaaattaagatagatgattatacacgcacctctcatttgtatcagatgntggcttcagagatcttagtttgttgatagt

SEQ ID NO: 21897 - DNA, 101 bp, rice(Oryza sativa)
  misc_feature (71): n=a or g
aacggacgaaactggcttacgaccagcatggctctgactatggttcttggggggtgctttgaaatgatccntgtcattggatgtcgaacctcgtaaaggga

SEQ ID NO: 21898 - DNA, 101 bp, rice(Oryza sativa)
  misc_feature (71): n=t or c
agaacgcctgcgccaccgatatcattgtgtatgggtagcccaacggaatgaagtggacgtatttcgacagnagattgacgatggtgaggatgactgatttg

SEQ ID NO: 21899 - DNA, 101 bp, rice(Oryza sativa)
  misc_feature (71): n=t or c
cctgtgagaggaagaagaagataaggagaagtggggctgacaagtgagccaccattttttatttttatctntgtcatttacacgtgggatccatatctgtt

SEQ ID NO: 21900 - DNA, 101 bp, rice(Oryza sativa)
  misc_feature (71): n=a or g
agacgaagaggatgaagtcggaggtaggaccgaagtttccgttgtagttgaggaagacaccattggtgagncggagctcagaagcggggttatgagacggt

SEQ ID NO: 21901 - DNA, 101 bp, rice(Oryza sativa)
  misc_feature (71): n=t or c
ggcaaggaggcagttcactgcgttggacaagatagaggtggctcgtcttcagaatgtcactagaatatttngagtttctcacatcaggtctgtcatttgcc

SEQ ID NO: 21902 - DNA, 101 bp, rice(Oryza sativa)
  misc_feature (71): n=a or g
gcccgttcaaaagcaatgtaaaaaggcgatactgttagtgttgattcttctcatacaattacattcaattnacatatcataattattattaaagagttctt

SEQ ID NO: 21903 - DNA, 101 bp, rice(Oryza sativa)
  misc_feature (71): n=a or g
gagattaatcccacgtcacggactcccatgaattccaaagagagcaactgcgtttaacagatttggcggcngcggaggcggagagaccagccaagtcacct

SEQ ID NO: 21904 - DNA, 101 bp, rice(Oryza sativa)
  misc_feature (71): n=a or g
atcaatgcatgtgcatgtgttccacaaactgttcgtttctttgccaacgcctccaaatccaaggctccaantctccaactaccgagccgtgtgccagcgag

SEQ ID NO: 21905 - DNA, 101 bp, rice(Oryza sativa)
  misc_feature (71): n=a or c
tctatttcgaacttgtcgcatgtcaggtcactaatttttttcaaaggcttcaattcatttcctgcctactnaagcttcccactattacgtgtattgaactt

SEQ ID NO: 21906 - DNA, 101 bp, rice(Oryza sativa)
  misc_feature (71): n=a or g
actacacaagtacacatgagcgtacgtggtttttttgggacatgtgcacacgtgttacaagttgatcaaantggacttgttcactttgttgtcaattttga

SEQ ID NO: 21907 - DNA, 101 bp, rice(Oryza sativa)
  misc_feature (71): n=a or g
ctttcagatcaagacgggtctcatcatactgatgcaggctagctcatcctgtggaaaagccgatgaggacntagacgctcatctccagcaattcttggaac

SEQ ID NO: 21908 - DNA, 101 bp, rice(Oryza sativa)
  misc_feature (71): n=a or g
ccctccaatcaaacacaacctaaaattgcagaatccggtttctcgaggggaaactgtagcgagaaaagcanccgcagcagcaggagcgaaggcggttgagg

SEQ ID NO: 21909 - DNA, 101 bp, rice(Oryza sativa)
  misc_feature (71): n=t or g
gaaccctccgccggccatgtccatctgctgctgctggtggtagtacatggacgggttcccaacaaactgcnggggatgggcgccgctgttgatctgaagcg

SEQ ID NO: 21910 - DNA, 101 bp, rice(Oryza sativa)
  misc_feature (71): n=t or g
tgggccgggccacgggcctcgggccgtatggccatttatattcggaacccatgaaaggcgaactcccctanggaaaagggaaaaaagaaaaaaaaacctat

SEQ ID NO: 21911 - DNA, 101 bp, rice(Oryza sativa)
  misc_feature (71): n=a or g
tgggtcggtttgtgatgtcctcttctccctttcgttcttgggacttgggagacgttttgtttggtgggaanttttgccagagggttattctctttttagat

SEQ ID NO: 21912 - DNA, 101 bp, rice(Oryza sativa)
  misc_feature (71): n=t or c
tttatattttgccattataagtgtctcaaacgcatcgtacgatgcatgcccatgtgaatgcacaggctacntttttttttttaccgggaaaactactagga

SEQ ID NO: 21913 - DNA, 101 bp, rice(Oryza sativa)
  misc_feature (71): n=t or c
gttcagaaatcagggttgggcagttgctcctctgctctgctcgagccttgcttgcagcgagccttcctacngactgccgcactgccatcgccctacacctc

SEQ ID NO: 21914 - DNA, 101 bp, rice(Oryza sativa)
  misc_feature (71): n=t or g
taaggtggaaatggacaccatgccatatggcttttgtagtgaacaactagattagatctctactgttgctnatgcttattgatatttgtagtgaaatgact

SEQ ID NO: 21915 - DNA, 101 bp, rice(Oryza sativa)
  misc_feature (71): n=t or g
cccaaaatggaaagtagagtccaacagaaattccattcctgtgcgaaatcgaaggctaagagtactatgtngatgtaatgagatggctaggattgaggagc

SEQ ID NO: 21916 - DNA, 101 bp, rice(Oryza sativa)
  misc_feature (71): n=t or g
cctagatcatgccctcaccactatcttctccaaagcaacaacagggatgaggagtgagaggaggcacaacnccatggcgaattaaaggacgataccatggc

SEQ ID NO: 21917 - DNA, 101 bp, rice(Oryza sativa)
  misc_feature (71): n=a or g
tggaaggtgcgcacaacgagtaaaagtaaacagctgtgctcttcatctctctttggggttgtattttggangagaaaaacacaacgaattaattcagaaga

SEQ ID NO: 21918 - DNA, 101 bp, rice(Oryza sativa)
  misc_feature (71): n=a or g
agtgcccatgtcaccaaagagaaatgcaatagtttcattggcttcgttgtcacgtgaaatgaagctgtacntatcgctccatcctgaagagttgctaccaa

SEQ ID NO: 21919 - DNA, 101 bp, rice(Oryza sativa)
  misc_feature (71): n=a or c
caactgcacaaatctcctaaagccaaccatttttgctgaatcccggattgttggatcaattaggctcttcnatccgtaatactcttggtcatactgatcta

SEQ ID NO: 21920 - DNA, 101 bp, rice(Oryza sativa)
  misc_feature (71): n=t or c
caatctttttttccctaatagctaaagtttgaacgttcaagcgatccaatcaaacattcacatctggaaantattttggtgctacaggtttgctgagaaca

SEQ ID NO: 21921 - DNA, 101 bp, rice(Oryza sativa)
  misc_feature (71): n=a or c
gcgcataccactgtgttgagggacggataaatagaggttcaggctgaaggctagcccttgcctcttcaatntttgtacatgctttgtcatacaagttttgg

SEQ ID NO: 21922 - DNA, 101 bp, rice(Oryza sativa)
  misc_feature (71): n=a or c
gctccccaagattacccacttcgacctagggaataattggctgaccaacccggattatcgcaagttctcgncgatgcccaccgtcaagttcctgtcgctct

SEQ ID NO: 21923 - DNA, 101 bp, rice(Oryza sativa)
  misc_feature (71): n=a or g
cgatatcgtcttcccggtctacaccatgatgccggtctcgattggcccagcaactaccaggagcgagaacngcgtggttacgaccctggatggatccatgt

SEQ ID NO: 21924 - DNA, 101 bp, rice(Oryza sativa)
  misc_feature (71): n=a or g
ccatcaccaaaacccagagacttctctcctcttgctcctcctcgacgccatggcccccagatcggacagcnccaccggcggcgcggccgccgcccaggccc

SEQ ID NO: 21925 - DNA, 101 bp, rice(Oryza sativa)
  misc_feature (71): n=t or c
cttctcgatgcacggcatcacgtgccccgtccaaggttttcttggggtcttccatccctgccagagccatnttacatggaacgcacatatgaactcctcca

SEQ ID NO: 21926 - DNA, 101 bp, rice(Oryza sativa)
  misc_feature (71): n=a or c
atgaaggagaggcttgcttatggagtttactctattctgagagtgagagccccgagtggcagcttgagtanaaggcacctcttgcggacatatggggcgac

SEQ ID NO: 21927 - DNA, 101 bp, rice(Oryza sativa)
  misc_feature (71): n=t or c
cttctttcatcgccggtcataaacatcgatcacctcctgaaacaccttggatctccaaagaagaagaaganaccaccacctgctgctgctgctagcgcgtc

SEQ ID NO: 21928 - DNA, 101 bp, rice(Oryza sativa)
  misc_feature (71): n=a or g
atagtgtgttcccataatcaaatagatcatcatcttacatactttattgactggttgaagtgtcatctgancataaacttcatcagtttcagaatctgcct

SEQ ID NO: 21929 - DNA, 101 bp, rice(Oryza sativa)
  misc_feature (71): n=t or g
tttgggaacaatgctcttctgattctgattgttgtcccaacctggcccagtatcaatgtccatcatgtttncagcctgaatcgctggtgcaaatgcgtcga

SEQ ID NO: 21930 - DNA, 101 bp, rice(Oryza sativa)
  misc_feature (71): n=t or c
gctagatgcacctcagttcattcgtcagcttcatctctgatgacaacttcactgggccgccatactgtcgnggcactccggtctatccaactttcaggcat

SEQ ID NO: 21931 - DNA, 101 bp, rice(Oryza sativa)
  misc_feature (71): n=t or c
tcctccccctcctcttcatcgtactggtcatcgacagtgtcctcatcgtcggcatcagagtcagtggaggnaggggcctttcgcttctgaggggccgattt

SEQ ID NO: 21932 - DNA, 101 bp, rice(Oryza sativa)
  misc_feature (71): n=a or g
cccccatcaactatctgaaccctcaatggtttctgcagcacttccacaccattcagtttgtttccaatctnttcatcaataaaagaattggtactgcctga

SEQ ID NO: 21933 - DNA, 101 bp, rice(Oryza sativa)
  misc_feature (71): n=a or g
gtaaaagttggaagttttaaagctatttgggttcaaaacctcatacggttaatttgtgtataaaaaagatnggtagaaattaaaaccatttttccaaactg

SEQ ID NO: 21934 - DNA, 101 bp, rice(Oryza sativa)
  misc_feature (71): n=a or g
tatggtaaatttggtattaaagctgtacttaataatttgatcgaagtaatagatttcaaatttaggcactnttcttttctccaacaaaagttgaattaaat

SEQ ID NO: 21935 - DNA, 101 bp, rice(Oryza sativa)
  misc_feature (71): n=t or c
aattgatataagttaaaaaaaaggaacatatgaaatcttaaaaaggaatttgaataggcgtctaatggggngattcaaggcaaccttaaatacattggagc

SEQ ID NO: 21936 - DNA, 101 bp, rice(Oryza sativa)
  misc_feature (71): n=a or c
cacagacctattttttcgtcttgaagcttggaagattagtggcgctaaagacttcggcgttcgaccatcantcaagtgagagtgccagaagctcgccttct

SEQ ID NO: 21937 - DNA, 101 bp, rice(Oryza sativa)
  misc_feature (71): n=a or g
tatgttttggcaagagtataatatgtgcttggttaatccttcccaaatctgcttcttcattgtggaagctnttcatcatccgcataacatccgatcctatt

SEQ ID NO: 21938 - DNA, 101 bp, rice(Oryza sativa)
  misc_feature (71): n=a or g
ctactccggagctggtgtagtggatgtcgtctttttgacttgccacacctttttggtcttaggtgtgggtngcggctttctgggcgccggctttacaggct

SEQ ID NO: 21939 - DNA, 101 bp, rice(Oryza sativa)
  misc_feature (71): n=a or c
ccacagattgcaaacacatcacaatgaactatcggctgcctgtaatgtatcagccagtcttgtgacccttncagccacgtacccgcgaaacctctcccgaa

SEQ ID NO: 21940 - DNA, 101 bp, rice(Oryza sativa)
  misc_feature (71): n=t or g
cggcgtaatttcagcaagaagcaatggtcttcagaacgactaggaaatgaattagccttttttgcaaattntcatgttgtcatgcacattataattcatat

SEQ ID NO: 21941 - DNA, 101 bp, rice(Oryza sativa)
  misc_feature (71): n=a or g
gcatctgcgatgggttagtacttccccatcgtcacttgtgatcagttctagtcttggaaattgggactctnacagagctggccgattcacagctttcttgg

SEQ ID NO: 21942 - DNA, 101 bp, rice(Oryza sativa)
  misc_feature (71): n=a or g
acaataaaaggtgcatcaaagtctggcattgcaagaactggggcagtgactaatgcatgcttcaatgcctnaaaagccttttcagtctcatcagtccacat

SEQ ID NO: 21943 - DNA, 101 bp, rice(Oryza sativa)
  misc_feature (71): n=a or g
gattaatttgggctttttaagaaggagactgattaatttgtttggactgaaggcaagagaaacaacagccnttggatgatagatggacagtgcacgcacct

SEQ ID NO: 21944 - DNA, 101 bp, rice(Oryza sativa)
  misc_feature (71): n=t or c
catgatgcatggcccttgtggtgaggacaacaaaaaatgcccttgtatgaaagacaacaaatgctcgaaanactatcctaaagatttccaggatgaaacat

SEQ ID NO: 21945 - DNA, 101 bp, rice(Oryza sativa)
  misc_feature (71): n=a or g
catttctcccataacagcagcatgttgggcaagttcagttagcatcagtaatcccttttgtccttctttgnctacatctaccaattttccatccatctaca

SEQ ID NO: 21946 - DNA, 101 bp, rice(Oryza sativa)
  misc_feature (71): n=a or g
aaaggtgtttcctggacaggaaggctgtcagaaggaaattctctatggccaacacataacagattagccgntacattctcagcaagcatataatctgacat

SEQ ID NO: 21947 - DNA, 101 bp, rice(Oryza sativa)
  misc_feature (71): n=a or g
atatttccagagagattaagaacttggagcttgtccattagcatgattgattctggaatagtaccagtcanttggttgtttgaaaggtccaaccaaacgag

SEQ ID NO: 21948 - DNA, 101 bp, rice(Oryza sativa)
  misc_feature (71): n=a or c
cttcaccagcttcagaaatcatagaattaagcaccaatgcattacgaaaaaacattcgcatatcatcctgntgtttacgtgccttgctatttttaccacct

SEQ ID NO: 21949 - DNA, 101 bp, rice(Oryza sativa)
  misc_feature (71): n=t or c
gaggaaaggagagaagagggaaaagagagagagaggaggttgaagtggtcacgctgacacgtgggtcccangctgactcagccaccacgtagaataagtta

SEQ ID NO: 21950 - DNA, 101 bp, rice(Oryza sativa)
  misc_feature (71): n=t or c
ctgtagcacatgttccatgggttacagaccaccattttcctcaccaccaccactcacggatgcgcaagaangttctctacattttctcttttgtgctcgaa

SEQ ID NO: 21951 - DNA, 101 bp, rice(Oryza sativa)
  misc_feature (71): n=a or g
cctcctcatgcttcaatgtctctataaactcggtgacaccgatcggatgaaggagatttataaggagtggnaatatcgttatgaaaactatgacccgaggc

SEQ ID NO: 21952 - DNA, 101 bp, rice(Oryza sativa)
  misc_feature (71): n=t or c
gccgcagaaatccgtagcgagtctgaatcaggctgctactaaggaacaaacagaaatattggagaaaagtnccaagaagttggaggatattcctatagtac

SEQ ID NO: 21953 - DNA, 101 bp, rice(Oryza sativa)
  misc_feature (71): n=t or c
tccattacaaattaaaactcgtgagagcttcagaaactacgtactgattgtccaaaaattctcagagattntatgcatgctccttctgcagtacaagtaga

SEQ ID NO: 21954 - DNA, 101 bp, rice(Oryza sativa)
  misc_feature (71): n=t or c
gtcctaagaaacttcttatctcaggtactgaggtttgtgttctccattccattaccactttaatcttttcnggatccacgacaactccttccttagttatt

SEQ ID NO: 21955 - DNA, 101 bp, rice(Oryza sativa)
  misc_feature (71): n=t or g
ggcatcaaggaattcttgcctggctttgaccagaacgtggttgcctggttggtgttgttcctcacactcanatctgtgttgctgattgaattgagtatgta

SEQ ID NO: 21956 - DNA, 101 bp, rice(Oryza sativa)
  misc_feature (71): n=t or c
cctggccacgaatggtgagcttcatgacgtataccccgtcggtgtccagattttggtcggccggcagcagngtaaccttgcgagggaggttgggcgggcga

SEQ ID NO: 21957 - DNA, 101 bp, rice(Oryza sativa)
  misc_feature (71): n=t or c
aaatttcgttgacgccatccccttttcctcaataaaatctcgggcagggtgctagtaaactaaaagtcganggcgttaaatatttaggaatagagagagta

SEQ ID NO: 21958 - DNA, 101 bp, rice(Oryza sativa)
  misc_feature (71): n=t or c
aacgtgcgtacgctcacccttatgaacacgcgcacaacctacctctatgagcatctcctaaagactgaacnggtatatcttgaaatcgacgaagtcatcac

SEQ ID NO: 21959 - DNA, 101 bp, rice(Oryza sativa)
  misc_feature (71): n=a or g
gcgttcgctacaacacgtcgtttgtcatctttatggcgaaggtcctcctcgtttttccggagacgaagctngtacccatccagcctctccaaggcggactt

SEQ ID NO: 21960 - DNA, 101 bp, rice(Oryza sativa)
  misc_feature (71): n=t or g
ccaccgtcttgccatttagggttagctgactgccaatttcaagaacataccggtcactcttgccataactnatcactttcctgcatatccagcatatatat

SEQ ID NO: 21961 - DNA, 101 bp, rice(Oryza sativa)
  misc_feature (71): n=t or c
gaaacttattattccagctactatagttatctagatcgattggtgaatcaattagggtgtgtttggttcanggtcaatgttggatgggatatggcggtcta

SEQ ID NO: 21962 - DNA, 101 bp, rice(Oryza sativa)
  misc_feature (71): n=t or c
agccaaaggcaatgcaaaagccatgatgcatatgcataaaaatggagtatagctaattaacccaccacccnctgtcatcacactcgcgcatcggcgcatgc

SEQ ID NO: 21963 - DNA, 101 bp, rice(Oryza sativa)
  misc_feature (71): n=a or c
gcattccgcaaatcatcaatcaaatcatagatcaccttgtacagacgaatttccacacttttcttcttagnatagcttttaactgatcctggagctttgac

SEQ ID NO: 21964 - DNA, 101 bp, rice(Oryza sativa)
  misc_feature (71): n=a or g
ggtggacctgaccgagactatgttcatccatttgacacccatgggcgacctcataatttgggcaatagccntggccatggttacaggcaggaggatgatct

SEQ ID NO: 21965 - DNA, 101 bp, rice(Oryza sativa)
  misc_feature (71): n=a or g
ctcaagatataccggcccagtttttcgaatgtgctcatagagatatcatagagatagagcgtgtgtgtacntttatagaggtattgtgcatgcgtcgtgaa

SEQ ID NO: 21966 - DNA, 101 bp, rice(Oryza sativa)
  misc_feature (71): n=t or c
tgggattcgaatctctgcgtgaaagctgctgtgcttagtgctctacgatttttattccatcgcttctttcntcgaagaaaacttgtcttcttcgaggaaaa

SEQ ID NO: 21967 - DNA, 101 bp, rice(Oryza sativa)
  misc_feature (71): n=t or g
ctaatatttattaatccaacactctccaaaagaagaggacatattctatagtgaactcagggtctggttancaacgccaaatacccaacattaacataaca

SEQ ID NO: 21968 - DNA, 101 bp, rice(Oryza sativa)
  misc_feature (71): n=t or c
tttcgtccacggtagctgcaagcaacaaactgctgttacaagttcccaatcctctcaaattcagacatgcntttttttttaaaaaaaattgcaggtcaggt

SEQ ID NO: 21969 - DNA, 101 bp, rice(Oryza sativa)
  misc_feature (71): n=t or c
agttcatcttttgacaacgggtagccattggagaaagtcacaaataaagttctttcatcatttggaacatnagaaggttgttgtattacctgcaaggaaat

SEQ ID NO: 21970 - DNA, 101 bp, rice(Oryza sativa)
  misc_feature (71): n=t or c
cacagatatatcctccatctcatagctcttccttttccgttgatctaagcgttggagaagtcattgttggntggagtggatggagcagaaaggactgagct

SEQ ID NO: 21971 - DNA, 101 bp, rice(Oryza sativa)
  misc_feature (71): n=t or c
ccggtgttgcatagtttgcagaactcattgtacatgaggtcttgaaaggtgaaggcacggaggagagcaantggccattgatagacgagtctggactgctg

SEQ ID NO: 21972 - DNA, 101 bp, rice(Oryza sativa)
  misc_feature (71): n=a or g
gagggcgcggtgccttgcgccatgtggggggcggcggcgagacttgggcttttttttttttatcgtcgganaggagaaatcggagagggaggggggatcga

SEQ ID NO: 21973 - DNA, 101 bp, rice(Oryza sativa)
  misc_feature (71): n=t or c
tgaccagcatgcatgctcagcgtcgttgccgtgtagatattccccatcagatcactcgctctcctcttatnccttgtcccaactccaactgcagaggaagc

SEQ ID NO: 21974 - DNA, 101 bp, rice(Oryza sativa)
  misc_feature (71): n=a or g
tttggatttgggatggaaggatgaaatatatcttcttagcaaacgagcaatatttgcaatatttgtaatantattattcttgtgccgaggaggaaatcaag

SEQ ID NO: 21975 - DNA, 101 bp, rice(Oryza sativa)
  misc_feature (71): n=t or c
ttatgaataggccaaagcagttgaatgccctctcctctgcaatggtatgacttctaaagaaaaaaagtganaatgagtcaataagtaatggagcatatatg

SEQ ID NO: 21976 - DNA, 101 bp, rice(Oryza sativa)
  misc_feature (71): n=a or c
acaaatgattaaaaaatataaaaatgattgtttaaatatagaccacggaaaaaagttagaaaccagggtcngaaagactccagaaaatttttaaagaagct

SEQ ID NO: 21977 - DNA, 101 bp, rice(Oryza sativa)
  misc_feature (71): n=a or g
catgggtggaacattgccaccaatactgaccattccagcatcaaacgtctgataatttgagctatcggggntgaacgggctcacagaattgaactgaggat

SEQ ID NO: 21978 - DNA, 101 bp, rice(Oryza sativa)
  misc_feature (71): n=t or g
ggcaccggttcttcgtgtacatagctgctctgccatcatcaatggggtgttcgccgtagagtagctttttntaacaagagaaaaaggaaagaaaaaaagag

SEQ ID NO: 21979 - DNA, 101 bp, rice(Oryza sativa)
  misc_feature (71): n=t or c
gacatcagtactcatgacatcaacttttgagtgggcaaggtttgcatatgtggtgttattgcctactgaancaaaggactcgaaggttataggagcacaat

SEQ ID NO: 21980 - DNA, 101 bp, rice(Oryza sativa)
  misc_feature (71): n=t or c
tgatcctaattccagcttgcatctaggcttgtacatgttgttggagacactggtgttgcatctgctgcatnggactctacggttgctgtatcaacatctga

SEQ ID NO: 21981 - DNA, 101 bp, rice(Oryza sativa)
  misc_feature (71): n=a or c
agatttattttttaaaaaaaatcattatagatcgactttttgcatttctacccgtgttgtgaggagaggantatctctgggtacacttcacgagtacccct

SEQ ID NO: 21982 - DNA, 101 bp, rice(Oryza sativa)
  misc_feature (71): n=t or c
ggtcatttattaaaatgcattgctctgacctaccttgatgtaaaaaggccccaaccggatcaaggtctccnggaactgaaatgagtaaaatgaaaaccaga

SEQ ID NO: 21983 - DNA, 101 bp, rice(Oryza sativa)
  misc_feature (71): n=a or g
ttcggtgcggttctttcgggttaggtttataccgaacttgattttgaccactccatcagttcatcacgctnccaacaataatcaggaatcaacaacatata

SEQ ID NO: 21984 - DNA, 101 bp, rice(Oryza sativa)
  misc_feature (71): n=a or g
agatacatcctcatttggtttagcctttagcctatcatgaagcttccctctaaggtctgtttgacttggtngtgacaatctagctcgaggccctctgtctc

SEQ ID NO: 21985 - DNA, 101 bp, rice(Oryza sativa)
  misc_feature (71): n=t or c
tccaaatcatctatattatgcatctcccttgttacctatcctaaggaagcgttcgggagaagccggcacanaaaacgaagcacgtattattgcatgactat

SEQ ID NO: 21986 - DNA, 101 bp, rice(Oryza sativa)
  misc_feature (71): n=a or g
acatttggggcctagagctataccaatgcccaatttacctgcagtaggacctgatggccaaatcaagactnaaccagctgctatcttacaaagaagaatgg

SEQ ID NO: 21987 - DNA, 101 bp, rice(Oryza sativa)
  misc_feature (71): n=t or g
gtcttatagtagacattttggaagaaccagtgcggttgttgtaccagtttgttttgtttgaacactcaggngttgtttagattcaggggtgtaaagttttg

SEQ ID NO: 21988 - DNA, 101 bp, rice(Oryza sativa)
  misc_feature (71): n=a or g
gacattgaggctttcgggaaaaggtcatcgatatagaaacccaaaggctgggctgagaacgcgggacggcntgggtgtagcccaaccaaagcgttgggctc

SEQ ID NO: 21989 - DNA, 101 bp, rice(Oryza sativa)
  misc_feature (71): n=a or g
atatttgtccttgctgctggtaccgttgttgttttacttgttcgtagaagattgagatatatggagctacnggaagattgggaggttgattttgggccaca

SEQ ID NO: 21990 - DNA, 101 bp, rice(Oryza sativa)
  misc_feature (71): n=a or c
cattgtgtcattcggcaacttacagattccagcagcaatcgcgcatgtcgagctcgcagggttgcgccttnatccaaagggctacgacggccaaggtggca

SEQ ID NO: 21991 - DNA, 101 bp, rice(Oryza sativa)
  misc_feature (71): n=t or c
aggagaggagttggaaggtagagagagacaagccatcattagccaccaaatgcaggcatgcatcatatagntgacaggacaagaatcagaggaagaagaag

SEQ ID NO: 21992 - DNA, 101 bp, rice(Oryza sativa)
  misc_feature (71): n=a or g
cgatcgagtagacctaataatctctaagttttatctgcctttgccgatctaatgtgagttatatcggcttngcttcggacgatacgttgtcggcaatccag

SEQ ID NO: 21993 - DNA, 101 bp, rice(Oryza sativa)
  misc_feature (71): n=a or g
cttttctgttgcctttgatgttaacaggacagaaaccatgacaaacctgtagacagaagccaacacccagncagatacccaatctctggtggtctgaaaca

SEQ ID NO: 21994 - DNA, 101 bp, rice(Oryza sativa)
  misc_feature (71): n=a or g
tgattaggttgaactgcttgaggtgcagcagacgaattgttcatcaaactcgaatttggatcaggctgagncgactgcagcccagaggtatcagcagtcag

SEQ ID NO: 21995 - DNA, 101 bp, rice(Oryza sativa)
  misc_feature (71): n=t or c
cctccgtgagaagtagtcggccgctgctatccttagcctcgctgctcgccggtttcttccgttgctccacngcccgcagccgcccgatgacctcctcgatg

SEQ ID NO: 21996 - DNA, 101 bp, rice(Oryza sativa)
  misc_feature (71): n=a or g
atttcagcttttactagctagtacttacctggagggtgaaggctgtcactaatattgctagaaacagaganccagtctccagcaggttgaaatcaagatcc

SEQ ID NO: 21997 - DNA, 101 bp, rice(Oryza sativa)
  misc_feature (71): n=t or c
catgacaaagaaattgaattgcttgctacagagaagctagaagagtttgatgaacaggagaacaagtcctntttgattttacaggaggaaacagaggaatt

SEQ ID NO: 21998 - DNA, 101 bp, rice(Oryza sativa)
  misc_feature (71): n=t or c
gcttgttgtttcaacagtaagtcttcgcaatcttgtcagcctaccaatctcctcaattaacctcacagagntacatgggatggagatactctccagctcct

SEQ ID NO: 21999 - DNA, 101 bp, rice(Oryza sativa)
  misc_feature (71): n=a or g
agagttttgcaccatggagtcctagactagggtggtatttatagctgggaggggaagaatcaagggtcctnaagtggtccccacttacctttttaaatgtt

SEQ ID NO: 22000 - DNA, 101 bp, rice(Oryza sativa)
  misc_feature (71): n=a or g
gttcaataattaactccatcagagagagaagctcagagctcattgcaagtacaaatgtcgatgaagaaaanaaaacatttgtatgtagtaacttgtattta

SEQ ID NO: 22001 - DNA, 101 bp, rice(Oryza sativa)
  misc_feature (71): n=t or g
agtgagtgaccatttccagctgtctcaggccacataggagagataggtgaggtagcaagtgagtgaatctntttaactgccccaggccagttaggagagat

SEQ ID NO: 22002 - DNA, 101 bp, rice(Oryza sativa)
  misc_feature (71): n=a or c
gcaccaccatttacggtgaacatactactcctacaaaagaaaactaagaagttttaggctgcttttccacncccccccctaactttcccaatttctactca

SEQ ID NO: 22003 - DNA, 101 bp, rice(Oryza sativa)
  misc_feature (71): n=t or c
tctgcacatttttttctccctctgtaagtagatggtagtgaaatgcttggcttagacttacatactgcaangtgctgtcaaaaggtttagatgtttttgta

SEQ ID NO: 22004 - DNA, 101 bp, rice(Oryza sativa)
  misc_feature (71): n=a or g
caatgttctgtgctacaatatttattgctacagtactgtgaacagtacagcacacgatctagatcgtcccntatgcatcccattggccatagtgcatacta

SEQ ID NO: 22005 - DNA, 101 bp, rice(Oryza sativa)
  misc_feature (71): n=a or g
aattcaccccctcccccaatatgtagcaatgatggtttccatcccgacagccgacccttgatcttatcctngaggggctggaagtgtaccttgcgcagttg

SEQ ID NO: 22006 - DNA, 101 bp, rice(Oryza sativa)
  misc_feature (71): n=t or c
agcttcctaggataactttgagacaccggcactggattacttcaagtctaacagtcgaggctgaacacacngaggagcttcaccttctcggagagctagct

SEQ ID NO: 22007 - DNA, 101 bp, rice(Oryza sativa)
  misc_feature (71): n=a or g
ccaaaatttatattttctttcctaaaattgtgaaatgagaaccctaatcgatcgtgccgattgtgtatctncatattgatcaatgatttaatttgagagag

SEQ ID NO: 22008 - DNA, 101 bp, rice(Oryza sativa)
  misc_feature (71): n=a or g
ctctcgtcgtccgttcatcctagtggtggatttccctcgttcttcattccgtttatgttcttcatctgctnctcttgctttgcgtgcttgcattggtggtt

SEQ ID NO: 22009 - DNA, 101 bp, rice(Oryza sativa)
  misc_feature (71): n=t or c
cagccttcccagtcgcctctgatgatctccccagacaagcttgcagatttcctgacccaggccttcgcggnggtgcagcctcctctgctcaaaactcccac

SEQ ID NO: 22010 - DNA, 101 bp, rice(Oryza sativa)
  misc_feature (71): n=a or g
gttctttgcacacatcgcattcccattgagcccgagagctcgccatctagggagcctcaaagacggtttantaatgcgatgagagaagttgtgaagaaaga

SEQ ID NO: 22011 - DNA, 101 bp, rice(Oryza sativa)
  misc_feature (71): n=t or g
tcgcacgtcactagctagctatatagtatcatgcacactactgtttcagtgcttcctagctactcttggtnattctctttcacgtacaataaatcattaat

SEQ ID NO: 22012 - DNA, 101 bp, rice(Oryza sativa)
  misc_feature (71): n=t or c
aaccgtaatgatggctccatcgtttgcatatttgcaaacgagtactccaaccatcccaaaaataggtaaanattggtttccgtgtcgatctttgactgtcc

SEQ ID NO: 22013 - DNA, 101 bp, rice(Oryza sativa)
  misc_feature (71): n=t or c
cgattttggaaccagcaatgatggctgtcagtagaagctaggaagggccatgaattatgggcatgtttagntcgcgaaatgaaaatttttgggtgttacat

SEQ ID NO: 22014 - DNA, 101 bp, rice(Oryza sativa)
  misc_feature (71): n=a or g
ctcctgcatgaataaccaggtaggtacccggcctgatatcctctccatagatgatggtggctgtatcaatntcttggggaggtggagaaggaattggaccg

SEQ ID NO: 22015 - DNA, 101 bp, rice(Oryza sativa)
  misc_feature (71): n=t or c
cgtttacaaacttttatgttgccttttgcttgctcaatacagagacgaaatgtaggccatgtttagatccnctggtaaaatttttcaccatatcacatcga

SEQ ID NO: 22016 - DNA, 101 bp, rice(Oryza sativa)
  misc_feature (71): n=t or c
gtgaagtctgcacagcgtacaaacacaggcagtaaaaaggcgagatcaataattaacagcaggactagggntgtgtttagatccgaagtttggatccaaac

SEQ ID NO: 22017 - DNA, 101 bp, rice(Oryza sativa)
  misc_feature (71): n=t or c
acgaatcggtatccccatggtttatattctcttctacaagttgccaaatcgatttctttgatagatgatanttatgtctcctgccttactaaactgagctc

SEQ ID NO: 22018 - DNA, 101 bp, rice(Oryza sativa)
  misc_feature (71): n=a or g
taatctgccaatattgatcttcttgtggtcccactcattttaggaggcagcaaagcggttggagcaaatangtgagtatgaaacaaaattactcaattttc

SEQ ID NO: 22019 - DNA, 101 bp, rice(Oryza sativa)
  misc_feature (71): n=a or g
taagacaactagtccaaagaagtactgcgtccgtccaaataacggcattgtggctccccagtccacatccnatgttcttggtaatttgatgaattgcgtca

SEQ ID NO: 22020 - DNA, 101 bp, rice(Oryza sativa)
  misc_feature (71): n=t or c
ttcctttccctctgtagttgtatctcctctcgttaatttcttattaagtcaatatcactaaggctctgttngcaaagaacaggttcccaacccaacggaag

SEQ ID NO: 22021 - DNA, 101 bp, rice(Oryza sativa)
  misc_feature (71): n=t or c
cataatagtctcactatataaaaaggagaactgctagaccacggaatccagcttaggccttgttcagcaanaggggagtcatttccccagggagattcacc

SEQ ID NO: 22022 - DNA, 101 bp, rice(Oryza sativa)
  misc_feature (71): n=t or g
atcccattttacgtgggcagcatagtactgatggccttgttttgggctaatccattcggcccatggatttnttatgaatgactttgttccgttcccataaa

SEQ ID NO: 22023 - DNA, 101 bp, rice(Oryza sativa)
  misc_feature (71): n=t or c
cgtgttgtatcggatgtagataaagatctctttttctagagacggtcacgctaaattgctcctccatgtcnatcccatcatgtgttacaccgtgagggaga

SEQ ID NO: 22024 - DNA, 101 bp, rice(Oryza sativa)
  misc_feature (71): n=t or c
agtggaggaggtgcatgcgaggatggaggaaaagctacaaaaatcgcgggggccgtggcgcggcgtggcgnggcgtggcgtggcgcagcctttgcatgcgc

SEQ ID NO: 22025 - DNA, 101 bp, rice(Oryza sativa)
  misc_feature (71): n=a or c
tgacttcggttcacgtgctgagaaacctttcatcttaagtggcacaggtgctggtcaaaatggtcactcanagatatccgataatgctggttttcatgagg

SEQ ID NO: 22026 - DNA, 101 bp, rice(Oryza sativa)
  misc_feature (71): n=t or c
tttaatgaaactaatttacggcactacaccctttgtcacataaaaccaacttagtctggatgtgacacatnataatattacgagtctggacatacacctgt

SEQ ID NO: 22027 - DNA, 101 bp, rice(Oryza sativa)
  misc_feature (71): n=t or c
tgctagacggttgtggcgttacgtcatggcgatcgactatgctacttgaaagttgtttttgatagcaacanggtttccaaaacataactttaacttcttat

SEQ ID NO: 22028 - DNA, 101 bp, rice(Oryza sativa)
  misc_feature (71): n=a or g
atcctaccagcttcttcggctcttcccataaactgcagagtactacgccgcgtcaaaacgcttagaaatangcagcagaaaaaaaaaaagaaaagaggaaa

SEQ ID NO: 22029 - DNA, 101 bp, rice(Oryza sativa)
  misc_feature (71): n=t or c
gatggaggtggagttggtgctggtaacctggtttttggtgcggtaccagggatgtctgctccagttttccnggctgctggcggaggtgtgttgccggctgg

SEQ ID NO: 22030 - DNA, 101 bp, rice(Oryza sativa)
  misc_feature (71): n=a or c
tatagcggttaggatagctagttagccgcagaaaaaataatataagccattagcattaattaagtactccntccgtttcagattataagactttctagcat

SEQ ID NO: 22031 - DNA, 101 bp, rice(Oryza sativa)
  misc_feature (71): n=a or g
atccgtgcttaccacagggtatgtcatcataaataagttggcatagctctcctgttttgtttcacattttntatttacaaaccatgttataaaaactgcag

SEQ ID NO: 22032 - DNA, 101 bp, rice(Oryza sativa)
  misc_feature (71): n=t or c
ggtgttaatttcgtgctcgaaggggtgttatttgaactcgttgccctgcgcttcatcaacaaatatcattnatgattcttttcatgatcataatttgtcat

SEQ ID NO: 22033 - DNA, 101 bp, rice(Oryza sativa)
  misc_feature (71): n=a or g
acagacagtactaccagccctgaaggcctcaccgaatgttccttcaccaagcttcacaatgctgcctggtntactatttccatgaacatcttcgttaaatg

SEQ ID NO: 22034 - DNA, 101 bp, rice(Oryza sativa)
  misc_feature (71): n=a or g
tatcctgaagaatccacctgaacagaagaagggtggtgggaaagacaagaaggcaatgaggagagctgagnaggagcgtctaaaggaaggtgaggctgctg

SEQ ID NO: 22035 - DNA, 101 bp, rice(Oryza sativa)
  misc_feature (71): n=t or g
tgatgatggccgtccagccatttctatcccgaattttgcggattcgttccaatttcgggaaaaagggaaanaggagatcgagtggatcaaaagccctcaac

SEQ ID NO: 22036 - DNA, 101 bp, rice(Oryza sativa)
  misc_feature (71): n=t or c
ttatcaacagagctggatagaagcattatggcctagatgcaaaaaaaaaataccagcctaatgcttctatncagctggacaaattgcatttcaccccttac

SEQ ID NO: 22037 - DNA, 101 bp, rice(Oryza sativa)
  misc_feature (71): n=a or g
ttgatgatgtaaccagtggcagtgccactggaactggatgattgtattggacttggactttaatatgatanttagatgaaagctgtgggctgcactctttt

SEQ ID NO: 22038 - DNA, 101 bp, rice(Oryza sativa)
  misc_feature (71): n=a or g
atccgctatctccggctatagcggcagttatagcttgagatttagaacattgctaaggccctgtttagatnggactaaaacttttaagtccctatcacatc

SEQ ID NO: 22039 - DNA, 101 bp, rice(Oryza sativa)
  misc_feature (71): n=a or g
caacaaaataaataatatatgcaatttttttgaataggatgatgatcaatagtcggcatcatgtataaaanaacagagtgagtgtaaaaggaaaaaaaaaa

SEQ ID NO: 22040 - DNA, 101 bp, rice(Oryza sativa)
  misc_feature (71): n=a or g
gcggcgccggcggcgaaggagaggagaagggtttgcgttgcgtgtgttgctgtacttgataatgggctatngtcctatgggctacatgtggatcggcccat

SEQ ID NO: 22041 - DNA, 101 bp, rice(Oryza sativa)
  misc_feature (71): n=t or c
ttgttttgtaatcacacagatcgatcaaaggcctcaaggatactgataattaagtgatatgtcatcctctntctgtctctctctctctcttcctctctctc

SEQ ID NO: 22042 - DNA, 101 bp, rice(Oryza sativa)
  misc_feature (71): n=a or g
tgccattgatcatggtcttgcatctggggattctgtaggaaagaagtatgtactgcccaccagttttactngtggcagacgttatatggtacagaattacc

SEQ ID NO: 22043 - DNA, 101 bp, rice(Oryza sativa)
  misc_feature (71): n=t or g
ggctaacaattaacaattaacattggtgtcactcgatcccgatgacttatagtaaagaccactctaaaagngctgcgataactttttgggtggaaatatat

SEQ ID NO: 22044 - DNA, 101 bp, rice(Oryza sativa)
  misc_feature (71): n=t or c
ttttcttctcttcctagtttatcaaactagggcgatgtcaaatattattcagatgcctggcttctttacanagctgttggatatagatatatagataagta

SEQ ID NO: 22045 - DNA, 101 bp, rice(Oryza sativa)
  misc_feature (71): n=t or g
tgtttccgacaacctctgaccttgagttaaccatgggtagatgcgcgaggagcttaggaatgttttctctnttggtggcaccgcaagaacggccgctgtcc

SEQ ID NO: 22046 - DNA, 101 bp, rice(Oryza sativa)
  misc_feature (71): n=t or c
acgcctgaaatttgctccatatgcacaatacagctaattttccttgcctggttatattttttacacaagcncgcactggttaatatatgaaaaatacatgg

SEQ ID NO: 22047 - DNA, 101 bp, rice(Oryza sativa)
  misc_feature (71): n=a or g
cggcggcagccgccagccagattggtttcctcatccatcatcccaattgcgccaccgagaccttaaaattnccttgttcaccatcaccgctctcgggtagt

SEQ ID NO: 22048 - DNA, 101 bp, rice(Oryza sativa)
  misc_feature (71): n=a or g
caacgagtacaactgattacagctggtaaagaaaagtcagcgctttcgtaaccgatctttttatgcgctanttagtgcaaatatcttgacgcgtgggtcaa

SEQ ID NO: 22049 - DNA, 101 bp, rice(Oryza sativa)
  misc_feature (71): n=a or g
gaatcagtcctcaagaacctcgtcgctgatgatttgcctaccaaccaggagatagcagcaattgtagtacnaaaacagcggcgcgaacgtcggaaatcacc

SEQ ID NO: 22050 - DNA, 101 bp, rice(Oryza sativa)
  misc_feature (71): n=a or g
agacgaagtctccaaggagaggagcgacagataaaccgccgctgccgtctgtcaaggcctcaagaaggctnaggcctcaagaacgggcggcacgacaatgt

SEQ ID NO: 22051 - DNA, 101 bp, rice(Oryza sativa)
  misc_feature (71): n=t or c
aagttcccacagtggttcactactgatgtccgaaggcttctgtccaggctgcttgatccaaatccaaacantaggatcaccgttgagaagctagttgagca

SEQ ID NO: 22052 - DNA, 101 bp, rice(Oryza sativa)
  misc_feature (71): n=a or g
tggccttcaccatcttgagtcagcaacgtgcttaggccgggttggttcggccttccctgccaaccgaactnccagcccacaagcctagtggccagctcctg

SEQ ID NO: 22053 - DNA, 101 bp, rice(Oryza sativa)
  misc_feature (71): n=t or c
atgccatttttagttatatatcgaccatcatttcgccttctatatatcgtgaatccagactcatcaataanagtctcagcctagaaatctttagggtagtg

SEQ ID NO: 22054 - DNA, 101 bp, rice(Oryza sativa)
  misc_feature (71): n=a or g
acttagtttagtttcttatgctaatagtgatttagtagtagttcaagctattcgatcgcttcgcaaccgtngaccgtagtctgctgcggcggctgtccgtc

SEQ ID NO: 22055 - DNA, 101 bp, rice(Oryza sativa)
  misc_feature (71): n=t or c
cagcaacgagccccagcttgctctcttgttggcatgcatatgctattgattctaatcgtgtccgtgtccgngtccgcgagtatctatggcggtagtgatag

SEQ ID NO: 22056 - DNA, 101 bp, rice(Oryza sativa)
  misc_feature (71): n=a or g
agaaatcaaaggtgttgttgagataagcgcaaagtaggcccaagtgcatacccgaacgaggaggctcttcnccgcggtgcatccttcgacgaactcattca

SEQ ID NO: 22057 - DNA, 101 bp, rice(Oryza sativa)
  misc_feature (71): n=t or c
cagacttcacggaagaatctcagccctcaaaaactcccttctattctatacaatgttcaagcaaaactctntcaactgaccatcctaaatgaaaggggcaa

SEQ ID NO: 22058 - DNA, 101 bp, rice(Oryza sativa)
  misc_feature (71): n=t or c
aatatatgaatttatagtggacatgtcacatgtgtataaggagttaaggacgcgctcatatatgcgtgtgnagtggtatgagtgtaatgcacgcacgtcct

SEQ ID NO: 22059 - DNA, 101 bp, rice(Oryza sativa)
  misc_feature (71): n=t or c
atccgagctctcgggtactctcaatccaggcacgaacacagccacctcgcctatgctcccgggtcttcttntgatcgcaccggtgtcgtttggcttggaat

SEQ ID NO: 22060 - DNA, 101 bp, rice(Oryza sativa)
  misc_feature (71): n=a or g
aatctttgcaagaattacaaaactcatgtgttccaccgctactagcgacctgttctttgagctcctaaacnggaaaaaaaaactatgttcaatccattttc

SEQ ID NO: 22061 - DNA, 101 bp, rice(Oryza sativa)
  misc_feature (71): n=a or g
ccattttctgcagcaccatgagtggcatctgcagaacatttggattcctgcatgttctcatcagttccagnagcagggtcacctagtgcatcatctgtatc

SEQ ID NO: 22062 - DNA, 101 bp, rice(Oryza sativa)
  misc_feature (71): n=a or g
tagggttcttcgtcttgtacagggtcatgtgctgggctgtgctggtcaggagggcagccaagaccacgctntgatttttcacataagtgtgtgttgtaagt

SEQ ID NO: 22063 - DNA, 101 bp, rice(Oryza sativa)
  misc_feature (71): n=t or c
ctacacggatttgttaacaaggaataagttcacttggtgacccagtgatcggaatctaattcatctaaacngcaaaaccggatatctcgaccctcaaatta

SEQ ID NO: 22064 - DNA, 101 bp, rice(Oryza sativa)
  misc_feature (71): n=t or g
aaaacaggctcgtattttatctttcgtactatttcgtaactagtttcaataattacaggtcctagacctanaaaaaatagacatattcctcaattaacaca

SEQ ID NO: 22065 - DNA, 101 bp, rice(Oryza sativa)
  misc_feature (71): n=t or g
gcttaatcaaatattcaaatcaactctagatctaggctaatctgggtgcagtaagaaaactacacagtacnacgcgtttcttgttcacacttgcagtagtg

SEQ ID NO: 22066 - DNA, 101 bp, rice(Oryza sativa)
  misc_feature (71): n=t or g
acttactgatctttaacccaagtttaactgtgtgctttaaatatctcagaatcctcttggctgctacccantattctgtagttggagcatgcaaatactga

SEQ ID NO: 22067 - DNA, 101 bp, rice(Oryza sativa)
  misc_feature (71): n=t or c
tgcacctgctgcaccgtcatcggcaccaggtcaactaattaaccctcggttgttggtaagggagcagtcanagcatagtgggcaaaatgtgaatcggctaa

SEQ ID NO: 22068 - DNA, 101 bp, rice(Oryza sativa)
  misc_feature (71): n=t or c
tgcccatcgcgcccgcttgccatccctacttccagctcttaatactgcatgttttatattgcaattgctgnatttgctatcataagcatgtcttgctgagt

SEQ ID NO: 22069 - DNA, 101 bp, rice(Oryza sativa)
  misc_feature (71): n=a or c
acgggtggctttgattcccatgaaaataatcctcaaatcacccaacaaaatcatgcacacacaactacacnagctgaaatcaatcgatctcactgcatact

SEQ ID NO: 22070 - DNA, 101 bp, rice(Oryza sativa)
  misc_feature (71): n=t or c
gcatgatagtacaagcactataatttcgtgtactgtttttcctcaacctaaattagaacatgccgtttgtnaattttactcgagtttatggtaagtgatat

SEQ ID NO: 22071 - DNA, 101 bp, rice(Oryza sativa)
  misc_feature (71): n=t or c
tatttagtaaccaaatcacacacatgaacagccaataactagctacatacagaaggctagtagccagttcncggtagccagtagcagacaccgcctacgcc

SEQ ID NO: 22072 - DNA, 101 bp, rice(Oryza sativa)
  misc_feature (71): n=t or c
agacatggcaatttctttatggcatttcatgaactgttctaaggctaagacctcatcattatctgatgatnagtgggagtccatcaccatgtcattatctg

SEQ ID NO: 22073 - DNA, 101 bp, rice(Oryza sativa)
  misc_feature (71): n=a or g
tcgtaggttagaaagctagacatgtttgttttttaaaggtgaccactctattttaaggacatggcagatgnttgcaaggaggtggcagacggtgatcaggg

SEQ ID NO: 22074 - DNA, 101 bp, rice(Oryza sativa)
  misc_feature (71): n=a or c
ttgttcttgtatgtgttcttcgattcacatgcaatgattagtatttttggtgaggttaatcgggttttggnagggttcataactagagaagacgtgatgct

SEQ ID NO: 22075 - DNA, 101 bp, rice(Oryza sativa)
  misc_feature (71): n=a or g
cggctagtgggctactgggctaggaaaatacgagctgtgtgtgagttgtgtttggactctgaggagcgagntggtatttatagttggtcagaggtatagct

SEQ ID NO: 22076 - DNA, 101 bp, rice(Oryza sativa)
  misc_feature (71): n=t or g
caccagtgcaacctcggagagtttgagtttggaattgtattcttgcaaggtttgcagcgtgaagtgcaccntcgagaggatgctcgcgtaccatctcactg

SEQ ID NO: 22077 - DNA, 101 bp, rice(Oryza sativa)
  misc_feature (71): n=t or c
actgataaacatttgacagtaatggaaatcaccatcgacaaagaatcttgcgaagaggtgctcagcacaancggatcaagaacttgctcgcgctcttcctg

SEQ ID NO: 22078 - DNA, 101 bp, rice(Oryza sativa)
  misc_feature (71): n=a or g
gcagggtgggtgctcaaaaactcgattctggataggggaagataacacggcggcggggagatgcgacgccntcacgccaccgatccgtcgatagggttagg

SEQ ID NO: 22079 - DNA, 101 bp, rice(Oryza sativa)
  misc_feature (71): n=a or g
acactgtcaagtactccatcaaagtcaaaatcatgatttaacatgtgtctgaagtactttgcagacagacntacatgctaacatgcatatgcttttagtat

SEQ ID NO: 22080 - DNA, 101 bp, rice(Oryza sativa)
  misc_feature (71): n=t or c
gctagttcgattttttatggttggatactattagtttactcacctttactcgtatcgcctccttctggtangtcagttaccaacctatacaatcaacaaca

SEQ ID NO: 22081 - DNA, 101 bp, rice(Oryza sativa)
  misc_feature (71): n=t or g
tagcctggtgcttacccgtcagacaggcgggcgggcgaaccgtgttttttttggcgggctgccaggccatncgaaccctatcaaggtcgtcatcatcggtg

SEQ ID NO: 22082 - DNA, 101 bp, rice(Oryza sativa)
  misc_feature (71): n=a or g
tggcctttgtctcttcgatggagcttcttttgccctaatctcatcaggatcaaggactctcttctctaatngctggttactagacaaaaagtgagttggca

SEQ ID NO: 22083 - DNA, 101 bp, rice(Oryza sativa)
  misc_feature (71): n=a or g
tggatgttgttggatcggaataagcatatatatccggttggaacatagattaagtaattattctatggaanctagtccgcgcatatacgcgggcatgtgcg

SEQ ID NO: 22084 - DNA, 101 bp, rice(Oryza sativa)
  misc_feature (71): n=t or c
attcattataacataaaaacttaaaatgtgcaacatatttggattccaactgaaacattctcttttcgcangtgaaacatcaaatttgaacagttgaaaca

SEQ ID NO: 22085 - DNA, 101 bp, rice(Oryza sativa)
  misc_feature (71): n=t or c
gccgtcagcctatccaatatgattggaacaatgttggttgggtccacttcagctgatggatttttggctcntgttttatttacaggaggtttgactcctgt

SEQ ID NO: 22086 - DNA, 101 bp, rice(Oryza sativa)
  misc_feature (71): n=t or c
gcataccatgggtcagagtctgtgactttcaacaacatgtcatctcgcagataatcatttatcgatagctnctgcatgttagtgatttgcatacgcgacaa

SEQ ID NO: 22087 - DNA, 101 bp, rice(Oryza sativa)
  misc_feature (71): n=t or c
aaacttggcgtctagatccatggctagttttggaccgtaatccctcacatgctctccgaatttagccaacnagattgagggagccgaaacttttgtggatt

SEQ ID NO: 22088 - DNA, 101 bp, rice(Oryza sativa)
  misc_feature (71): n=a or g
gcaataacgtcctcaagtagcaaacactaggcagagcagaggcggcatcaccgcctcttcattggggccgnaagccgcggaagaagacgcggacaacggcg

SEQ ID NO: 22089 - DNA, 101 bp, rice(Oryza sativa)
  misc_feature (71): n=t or g
tgtttgactcaaaatgtggctcttcactcaagtgattcctcctcagggtttatagaacccataaaaatcgntctggatttttcaaaccgggccgaaaatat

SEQ ID NO: 22090 - DNA, 101 bp, rice(Oryza sativa)
  misc_feature (71): n=t or c
attacatgggctacagaacaagcaatgttatttgcactacttgtaaagaggcatgctttagccgcttgtgnggctgctgggggcttgagagctgctgccga

SEQ ID NO: 22091 - DNA, 101 bp, rice(Oryza sativa)
  misc_feature (71): n=t or g
gttaaggagctggagacaattgtggtggagaaagaggttgacataattgatgagagcgaggttgaagagantcctccagtccctgcaatgctggatgacga

SEQ ID NO: 22092 - DNA, 101 bp, rice(Oryza sativa)
  misc_feature (71): n=a or g
tagtcagcatacatctgtcacagccacagacaagagaagaatgtaatacatataacgaaatcaaaacctcntttttatctcttttttttttctaaaattca

SEQ ID NO: 22093 - DNA, 101 bp, rice(Oryza sativa)
  misc_feature (71): n=a or g
cttctccgataccccgtgatatcctcgagcttggatgtgcatgaacatgttgggttttggtttgattagcntccccaacagcggaagcctaaaaagggtga

SEQ ID NO: 22094 - DNA, 101 bp, rice(Oryza sativa)
  misc_feature (71): n=t or c
acgcgccctgctctactactggagtactactactccagtactggtagtacagtagtacagacacacacacngacactggccctgctgatggtagtggtagt

SEQ ID NO: 22095 - DNA, 101 bp, rice(Oryza sativa)
  misc_feature (71): n=a or g
ttccttcttccaattgttttattcatagttgattactcataaatcttgtcttttgcagaagaagaagttcnctgtgaagaagaaatcggcagcaacccaat

SEQ ID NO: 22096 - DNA, 101 bp, rice(Oryza sativa)
  misc_feature (71): n=a or g
taagtataagcataaacgaaaagacgaggccgagaattttagcgagattagagatatgtcgttagtttccntctattagagtgcgttatggagcacattcg

SEQ ID NO: 22097 - DNA, 101 bp, rice(Oryza sativa)
  misc_feature (71): n=a or g
ttatgaaggctctaatggtttattaggggatagggagggtcgatctaaagaccccccccacccccacgctntctccgcccatggccacatcgatctctccc

SEQ ID NO: 22098 - DNA, 101 bp, rice(Oryza sativa)
  misc_feature (71): n=a or g
aaatcttttttgaaggagtggtcactggaattagaggaagtcttttcgcttgatcgagatggagaattcancaagtactcaagatataagaataatctaca

SEQ ID NO: 22099 - DNA, 101 bp, rice(Oryza sativa)
  misc_feature (71): n=a or g
gccccactatttctaaactattcttttgtgtgcagctgacaggtggcccatggttttttattattttttcnagatataattgccacgcaagcgccacgtca

SEQ ID NO: 22100 - DNA, 101 bp, rice(Oryza sativa)
  misc_feature (71): n=t or g
tattggtatggaatagattctctccgaatagatactaaccaaccgtgcttttcttatagttgtgaacgaangtactagtacattatcaagggtttttttta

SEQ ID NO: 22101 - DNA, 101 bp, rice(Oryza sativa)
  misc_feature (71): n=a or g
tccctctgcgaaccttcaggctccatgaacaagaccgaagtggcagttggatgaattctaacgtcaccacncatctcgcagacatttgctctgaaattaga

SEQ ID NO: 22102 - DNA, 101 bp, rice(Oryza sativa)
  misc_feature (71): n=a or g
gatcttacttgtactaacccttgttgcgcccaagcaaatatttccccgagcactatatatgacttggattntgtaggcaaaagggagaagcaaatagatca

SEQ ID NO: 22103 - DNA, 101 bp, rice(Oryza sativa)
  misc_feature (71): n=t or g
ttcgcgataattttttagcaattccctttcccatgtattaggcctcgatttattagtcattttcaatgganaaataattaatgattatttttcatgtgtga

SEQ ID NO: 22104 - DNA, 101 bp, rice(Oryza sativa)
  misc_feature (71): n=t or c
aatagtagtacctcgagtaataatttgtacattgggattcaccatggatctaagagagtaaatttcaaacncattcctcacttgcaaaatcaggtaagaga

SEQ ID NO: 22105 - DNA, 101 bp, rice(Oryza sativa)
  misc_feature (71): n=a or g
aaagtggatcctgaaacctttgcggatttgccaacagaattggcagttgttctcccgaggaaagaaaacgncgacgaactacgcaccgttggccaccgtgc

SEQ ID NO: 22106 - DNA, 101 bp, rice(Oryza sativa)
  misc_feature (71): n=a or g
cggttgctggctggctgtcactcggctgatcctcattagttggctcgattccttttaagtttgtttacctnctagtcgggtcagagtcttttccagaagga

SEQ ID NO: 22107 - DNA, 101 bp, rice(Oryza sativa)
  misc_feature (71): n=t or c
taaaagttaattatggtactcacctcttgatggcgcttacttcttatttccaatggatataagccataccngctggctagcttacaccaaaaaacatctaa

SEQ ID NO: 22108 - DNA, 101 bp, rice(Oryza sativa)
  misc_feature (71): n=t or c
cgttcatgtaccccttcatgagcgtggtgtacaccctggagttgggcgggtaagccttgggaagcagcggnacctcgtcttgttcccacggcttgacgatg

SEQ ID NO: 22109 - DNA, 101 bp, rice(Oryza sativa)
  misc_feature (71): n=t or c
aagtgtcaatcatagaagttcatcactgtgctgtttcacttcaagaggctttggaatctggagtacattgncaccatcttttgctgatgctgaagcttgag

SEQ ID NO: 22110 - DNA, 101 bp, rice(Oryza sativa)
  misc_feature (71): n=t or c
caagttcatacataagagaatcaaacattcacatcagagaatcaacaagtttgaggaggaggaggagcccnagacggtccaccgtggcaacgtcatagagg

SEQ ID NO: 22111 - DNA, 101 bp, rice(Oryza sativa)
  misc_feature (71): n=a or g
ttagttggtgcacaaaaaattcagaggctgcacaaactcatacatgcctctatcaacacaaaaaaaaactncatccgcccaaattttcaccaccaattaac

SEQ ID NO: 22112 - DNA, 101 bp, rice(Oryza sativa)
  misc_feature (71): n=a or g
cagccagtcaggatcaagaacaagaaaacagagagaaaaattcgtcgtgagctccggctgcttccgtcgangtggcgaaaatcagcgtccgtcgttctccc

SEQ ID NO: 22113 - DNA, 101 bp, rice(Oryza sativa)
  misc_feature (71): n=t or c
cggcgtgcgggcgacaaatccggcggcggagatgctcctgggcagcgtatccatccacatgcttgcggctngaggcgcgggaggcggtggatcaggtagtg

SEQ ID NO: 22114 - DNA, 101 bp, rice(Oryza sativa)
  misc_feature (71): n=t or c
tgtggagacttggcattgatgatccatatgctccgatcaggatggtcgaacctctccattggttatcaccnaaaccgaaacacggttgacctcgctggtaa

SEQ ID NO: 22115 - DNA, 101 bp, rice(Oryza sativa)
  misc_feature (71): n=t or c
tttctggtagcctatgaaggcaccggaaaatatttgggagaataagtttgcattaggtccctctatttgtngttttcgtccctgaaccacaaaaccgggta

SEQ ID NO: 22116 - DNA, 101 bp, rice(Oryza sativa)
  misc_feature (71): n=t or c
caagaaaacgattttttttagaaagccacgttaatgacgggtgctaacaaaaacccgttaagacttcaccngtatcgagtggatttttttttaagaaaatg

SEQ ID NO: 22117 - DNA, 101 bp, rice(Oryza sativa)
  misc_feature (71): n=a or g
ctagatgggggtgaacctacgcggataagctaacttgcaaagtccctatgtaggtggttagttgtgttccntggcaccttggcacacaaaaaaggaccccg

SEQ ID NO: 22118 - DNA, 101 bp, rice(Oryza sativa)
  misc_feature (71): n=t or g
aggactcagtgggtgagtgaagttctcaaagctgaagatcatgaaccttccggtattaccattttgacaanggttccttcatggaaagccattagagctcc

SEQ ID NO: 22119 - DNA, 101 bp, rice(Oryza sativa)
  misc_feature (71): n=a or g
gcatttgttattgcggcaagagagttggggtttgagttttatcatagggcacagtcaagtatagttgttcntgaacgggatccgatcacgaatattgtaaa

SEQ ID NO: 22120 - DNA, 101 bp, rice(Oryza sativa)
  misc_feature (71): n=t or g
gacttgtgtgcaaaaacagaattagtcaaacggattagttcttaactcaatgcagaggctctattcagaanagatggatatgggcagtgtgccagtgtgga

SEQ ID NO: 22121 - DNA, 101 bp, rice(Oryza sativa)
  misc_feature (71): n=t or c
tcggaagcgcctgcaagtctccttcgcttctcgtatttcatacttcgtttgtcatgctcacgtctcaccanttcctctttgctcggtgtagttttgccgtt

SEQ ID NO: 22122 - DNA, 101 bp, rice(Oryza sativa)
  misc_feature (71): n=t or c
ctgcctccgaatgacgccacaaattgtcgtcattcatggatacttgcaaggacatcgtcgctgcccgtctncccgccgcgggaactcggccggtgacagat

SEQ ID NO: 22123 - DNA, 101 bp, rice(Oryza sativa)
  misc_feature (71): n=a or c
gagaccagactgttaattaccttttgaagaaagcacacggttctatggtatccagtgttgagcacctctangttgaattgcttcgggatggtgtccacact

SEQ ID NO: 22124 - DNA, 101 bp, rice(Oryza sativa)
  misc_feature (71): n=a or g
cctcaatcatctaaggaggaaatttaaatggtccaatgaaatttggtttgtcactgtcatagatgacatcnaaaatttattggtacagattacaacactcg

SEQ ID NO: 22125 - DNA, 101 bp, rice(Oryza sativa)
  misc_feature (71): n=t or c
cactatatatcaagcttgtattttgagatgtgcagaacgttatatagatcagatgtgaattgttatcccgnttataataaattaattaggtttgcctaaaa

SEQ ID NO: 22126 - DNA, 101 bp, rice(Oryza sativa)
  misc_feature (71): n=a or g
gggtttgtgtgaggagaccaatgacatcatcccaagaaagaacctgacgatcactgctggagtgtgggganacgatgttagcaattactctgcgaaagaag

SEQ ID NO: 22127 - DNA, 101 bp, rice(Oryza sativa)
  misc_feature (71): n=a or g
gctattggtctgtggcccatggcattgttgcagggagattcgatgacaacatgaggcaactgggcgaggcngacagttggcctaaggcggcgactacgtgg

SEQ ID NO: 22128 - DNA, 101 bp, rice(Oryza sativa)
  misc_feature (71): n=t or c
gtctgaaaaaaatacaaacaatcagttaaaactcgaatcatgcgcgtacaaattactccgtatttaggccntgtttagttcccaagtttttttttccaaaa

SEQ ID NO: 22129 - DNA, 101 bp, rice(Oryza sativa)
  misc_feature (71): n=t or c
aattttttagaaataaatcgggtgcccgatttgtagtcgcttcccggtggttccaagcaattatcttcacnttttgctcacgggaccgccctagccatccc

SEQ ID NO: 22130 - DNA, 101 bp, rice(Oryza sativa)
  misc_feature (71): n=t or c
ttgtcactttgccaatttagcaattaaccactacaacaatattgaggagaacattgtaatagcccttttcnttgtttgctttccatgacatcatgagtctc

SEQ ID NO: 22131 - DNA, 101 bp, rice(Oryza sativa)
  misc_feature (71): n=a or c
taccatcaagttttatttgtaaccaatcgtgccttaagagaacatgagccacagccaagaacaacagatgntggaacagaatcagaagtgtgcaattccat

SEQ ID NO: 22132 - DNA, 101 bp, rice(Oryza sativa)
  misc_feature (71): n=t or c
agctttgctagcgctcgcttgagcatcgaattgtgcacccatgagaacgtattgaaccgcttcaggcaacngctacgcgaaccatacccctccttgggctc

SEQ ID NO: 22133 - DNA, 101 bp, rice(Oryza sativa)
  misc_feature (71): n=t or c
aatgacatgtttacagtgaagtcgaagctcctatgtaacttgggtggcaagttcgcaatggtaacacatgncttgtgtagtcgaggctgttgtgtcacttc

SEQ ID NO: 22134 - DNA, 101 bp, rice(Oryza sativa)
  misc_feature (71): n=a or g
ctgctaagtagaatattattgaagcgaagttgaaagttatgatcttttataagaaacttttgagatttgcntatataatttaaataaattgagttcaaagt

SEQ ID NO: 22135 - DNA, 101 bp, rice(Oryza sativa)
  misc_feature (71): n=a or c
atatggctgggtgggctatcagctgcttgtggtgtagttgtgcgtcgtggtcgcctataaagggtgtgttncttcgtctcaaaataagtttaatattgacc

SEQ ID NO: 22136 - DNA, 101 bp, rice(Oryza sativa)
  misc_feature (71): n=a or g
aggagaggcttctggttgggaggttttgcagttctcttaccctcttctgttcatgaatcatgtgcaatggntgttggagctgtagaagcatggtgatgatt

SEQ ID NO: 22137 - DNA, 101 bp, rice(Oryza sativa)
  misc_feature (71): n=a or g
gcaagcagcaacagcaaagtgatttgattcctcctcctacccaaacagatctgaggctgctgccaaattantccccttcctcgcgtggcatgtgcacatcc

SEQ ID NO: 22138 - DNA, 101 bp, rice(Oryza sativa)
  misc_feature (71): n=a or g
gttgcttgggtggctttcccagcctagccatgcccgtgcaaaaacagacccccaactatgccgaggggaanaggggaaaagctcgattcaagcttcgcatc

SEQ ID NO: 22139 - DNA, 101 bp, rice(Oryza sativa)
  misc_feature (71): n=t or c
atcctggagacctggaccatggcgcttgggcaccattgtgcaggaggaagacaggaggtacacggaagttngcagagaagcagggggtagggtaactattc

SEQ ID NO: 22140 - DNA, 101 bp, rice(Oryza sativa)
  misc_feature (71): n=t or c
aagctgctgcccatcattagccatttaccagaggagtgtcatcaacattgaatgcttccagtcttcttggntgtatgggagcattggtccttgaatggacc

SEQ ID NO: 22141 - DNA, 101 bp, rice(Oryza sativa)
  misc_feature (71): n=a or g
cgcaacgaattctgctagcaggccaggtagcggactcatcaagcttatcagccaacacgctaataattaantggaaaaaatcttcctgttataaccaccgc

SEQ ID NO: 22142 - DNA, 101 bp, rice(Oryza sativa)
  misc_feature (71): n=t or g
atgatgtgaagtaggaaactttcccttcctcccagatcatagaaaaaaaatatttctacttcacaggattntatacatgaaggagcacaaagaaatgtttc

SEQ ID NO: 22143 - DNA, 101 bp, rice(Oryza sativa)
  misc_feature (71): n=t or c
taaaattgccatccctacaatagatactgtggcgagaatgaggaggcccagcacagggctaggtaccatcngggaggggtgctggcatggattccgatagg

SEQ ID NO: 22144 - DNA, 101 bp, rice(Oryza sativa)
  misc_feature (71): n=t or c
ccatactctgattgagatgttaagccactagggaaaaaggcacaatgaatcccaaacacattgtctaattncatacatttcaatgacttagaatcccattc

SEQ ID NO: 22145 - DNA, 101 bp, rice(Oryza sativa)
  misc_feature (71): n=a or c
tattcaaccttatatctcacccttctccagagattactttcccttatgtttctactttgaaattttgaaanttcttatcttgtctttaggatcgaaacctt

SEQ ID NO: 22146 - DNA, 101 bp, rice(Oryza sativa)
  misc_feature (71): n=t or c
ccggtggtcttcgcggccagctcgttctcagcggaaatgtcagtctgcttggcccttttggcagcccgagntgcccctgccgcctcgtactcgtttgaagg

SEQ ID NO: 22147 - DNA, 101 bp, rice(Oryza sativa)
  misc_feature (71): n=t or c
gacacccttaatcttctacactctcacgctctaattacatcagaaatctagattactggattgcaaatcancgatggcgttcgcactgcacagcaacgccg

SEQ ID NO: 22148 - DNA, 101 bp, rice(Oryza sativa)
  misc_feature (71): n=t or c
cacattaggatcatttggagtgtaaagagggagcaggaatttgaagattatgaaggtcatcaaggttgagnaaagaacgaagacggaagccccaaatctca

SEQ ID NO: 22149 - DNA, 101 bp, rice(Oryza sativa)
  misc_feature (71): n=a or g
aaatgcaatccttctggaggaaaaggagaagaaggaaaaggagatgaggaatcaaatcatccttgatgccnaagaattcaagaaggcatttgttgagaagc

SEQ ID NO: 22150 - DNA, 101 bp, rice(Oryza sativa)
  misc_feature (71): n=a or g
tactttgagaaatttggagtagattgtggcaacatccagaagccaaaattgtcggtaaaattgctgaagtnaaatgtcggctctgaagtgaagacgaaaat

SEQ ID NO: 22151 - DNA, 101 bp, rice(Oryza sativa)
  misc_feature (71): n=a or g
aaaaatacagaatctctcacatttgcaagaattggaggtgtacaaagttagcagtatttcgcgcatcgacnccttacaagggatgacacaactccgaggta

SEQ ID NO: 22152 - DNA, 101 bp, rice(Oryza sativa)
  misc_feature (71): n=t or c
taaaaagaaaaatagaagacaatgtattgtgtacttcagatacctatgagatatcacctgatatacctggnaggtttattgtcccatagaagtcccctaaa

SEQ ID NO: 22153 - DNA, 101 bp, rice(Oryza sativa)
  misc_feature (71): n=t or c
cgtcaccttattttcgcttgtgaaaatgcaatcggaaaatccttggttagtactccctccgcggctccgcnccataatataagggattttgagtttttgct

SEQ ID NO: 22154 - DNA, 101 bp, rice(Oryza sativa)
  misc_feature (71): n=t or c
atgtgggcgtccatcaagctgagtgttggatgagctaactggagcgtatccgttgtcgggcaaccatcatncagcttgggcaggaggcaggcgttccgagt

SEQ ID NO: 22155 - DNA, 101 bp, rice(Oryza sativa)
  misc_feature (71): n=a or g
ctattgcacagggagagaaatttattgctggcctttaaagttctacatagggggagaaacaatttcaggcntcgagatcatcgcgaggacacagagaagcc

SEQ ID NO: 22156 - DNA, 101 bp, rice(Oryza sativa)
  misc_feature (71): n=t or c
tgcggtgctgttttatgaaaaaacggaaacagtgccgcaaactgaaattgacacggttcgtcatgcaaaangaaaccgcgggctaagaggggagtgaattg

SEQ ID NO: 22157 - DNA, 101 bp, rice(Oryza sativa)
  misc_feature (71): n=t or c
atgcaatggttaattcttcatcttgccgatggacccaacatggacatcgaaaacttgttatctcttgctanattttccatgtcgcccatgtccccatgagc

SEQ ID NO: 22158 - DNA, 101 bp, rice(Oryza sativa)
  misc_feature (71): n=t or c
actattccattccacatgtcctcccaaagagtgactgaattaccattaacaactgtacattgtgcccctgntctgtaaatatcaatcaagcttatgatatc

SEQ ID NO: 22159 - DNA, 101 bp, rice(Oryza sativa)
  misc_feature (71): n=a or g
aggataaatgcacttggaaatcgtccccctgtcattgacaaaagcaacagccaagaagaaatatgtctgcnaaacttatacagaaggaaaatactaattat

SEQ ID NO: 22160 - DNA, 101 bp, rice(Oryza sativa)
  misc_feature (71): n=a or g
aaagcaattttttcagcttctaattgcggtccgtaaaccactgtaattgaccattgttgagcttcttctcncatagttatggttgcagagacagagaaacg

SEQ ID NO: 22161 - DNA, 101 bp, rice(Oryza sativa)
  misc_feature (71): n=t or g
atcacgagtaccttgcagcgctatttcggagtccttgcacttccatcatgggtattaaacgtgacatgtangtcttgaatccttggatgcctttggacagc

SEQ ID NO: 22162 - DNA, 101 bp, rice(Oryza sativa)
  misc_feature (71): n=t or c
attttcaacatggtacagtagatgagatagatggggaacatgatccattcatggagttgaaagcaaggttnatggacttcaagcacaggaattgtgtgtaa

SEQ ID NO: 22163 - DNA, 101 bp, rice(Oryza sativa)
  misc_feature (71): n=a or g
caaaaccgaccgaagacattgtggcccatgaatgcctagttgccaacatggcccctcacaacacagggatnccgagtcaaaacctgcgtcgtcgatcgagt

SEQ ID NO: 22164 - DNA, 101 bp, rice(Oryza sativa)
  misc_feature (71): n=a or c
ttttggggatgcagtcgtgattgttgtaaagtaaccacgagcccgtttcgtcgtctgattgatattcaggntagatggtggttgtacatttgtgtactggt

SEQ ID NO: 22165 - DNA, 101 bp, rice(Oryza sativa)
  misc_feature (71): n=a or g
aagtagttacaacatacacacaaacctggtcttataaaatctgaaagaccaaaatctgtagccttgagggntgagtcctctttggttgatttgaagaggaa

SEQ ID NO: 22166 - DNA, 101 bp, rice(Oryza sativa)
  misc_feature (71): n=a or g
cagggtttctaaccactcgaagccgaacgccattggtgtcaatgccaagcttccagtggcgtcggatgctncgccgccggcgatgtacttggtcccgtcat

SEQ ID NO: 22167 - DNA, 101 bp, rice(Oryza sativa)
  misc_feature (71): n=a or c
tttgtgaagcgcctaccggaagattggaagttgtcagacgagtggttcatgcccactttgaagattggaanactctgatctgatttaatggtttgcatcaa

SEQ ID NO: 22168 - DNA, 101 bp, rice(Oryza sativa)
  misc_feature (71): n=a or c
atacctttagtatatgcagccgcccatttcttccttaagttgtacatcctcccgagccattggttatcttntgccactttgcgtttcagcttgaactccac

SEQ ID NO: 22169 - DNA, 101 bp, rice(Oryza sativa)
  misc_feature (71): n=a or c
atcagatatggagaacacgaacatttccatttcaacaccaccagtgaagaacaagaattctgtttatgagnccttactttcggagtcacccatttcttccc

SEQ ID NO: 22170 - DNA, 101 bp, rice(Oryza sativa)
  misc_feature (71): n=a or g
ccttgtgccaaaaaatgagctgtgtacgtatacacttactgagcactcaattgccacctgcaggcagcggnaactttttaataagtacgctattttgactg

SEQ ID NO: 22171 - DNA, 101 bp, rice(Oryza sativa)
  misc_feature (71): n=a or g
cctcaactgggtttgtgctaaggcaacatcttcagcaattcattgtgcaatcaccatcgtcaatcgtgtcntccaactccaaatcttgctgtgggcagaga

SEQ ID NO: 22172 - DNA, 101 bp, rice(Oryza sativa)
  misc_feature (71): n=t or c
cttttatcttgttggagtgctccacagcaactggatgtcgaaatatttggcactgagcaatgcgattcatngcatcaaaaaacaatgcgattctgaataag

SEQ ID NO: 22173 - DNA, 101 bp, rice(Oryza sativa)
  misc_feature (71): n=t or c
cttttttaatatgccgagagttagacggattgaatgtagtaggcatactaattgcacacttggtcttttcngtttttagtatggcgggaatttcatgatta

SEQ ID NO: 22174 - DNA, 101 bp, rice(Oryza sativa)
  misc_feature (71): n=t or c
agagttgagaattgaaatttgaagctctaccaaacggggtccatgtatgtatacttccacagacaatcacnggtggagaaagcctttttacttccagttgg

SEQ ID NO: 22175 - DNA, 101 bp, rice(Oryza sativa)
  misc_feature (71): n=t or g
atcggcatttaagctaagtggcaaacaggatggttgaggccgtgcatgagggaacttacgtttacgatacnagtagcctggctgagtgcctttttcagcag

SEQ ID NO: 22176 - DNA, 101 bp, rice(Oryza sativa)
  misc_feature (71): n=a or c
tcgttcttcgttaaataaacccataatttcaccaccaaacacatccatgtgcattggaaacttcatggctnaaggcgtgaagcatcttcggaatcttcacc

SEQ ID NO: 22177 - DNA, 101 bp, rice(Oryza sativa)
  misc_feature (71): n=t or c
gggcccggctgttgcaggcaacttctgctgctactggagctcctggagcggaagcattgaagaaggcacangacgagtagttggggactatggaggcacga

SEQ ID NO: 22178 - DNA, 101 bp, rice(Oryza sativa)
  misc_feature (71): n=t or c
agccaccagtgatattctataggttgtttcagcagtggtgaattccagcttatgatgagaggcaagaatanattttcagccacagatgtgcacacttctga

SEQ ID NO: 22179 - DNA, 101 bp, rice(Oryza sativa)
  misc_feature (71): n=a or g
caaaggttttaaatctccggctatagcaaccactatgtccaaagatatatactcactcactccgtttcagnttataagacgttttacttcggtcaaaatca

SEQ ID NO: 22180 - DNA, 101 bp, rice(Oryza sativa)
  misc_feature (71): n=t or c
ctaggataagtaactgaataggacgtccatattgaacttgatactgagacctctgaagtagccgacggaangcaccaaggcaaccataaagtttcttattg

SEQ ID NO: 22181 - DNA, 101 bp, rice(Oryza sativa)
  misc_feature (71): n=t or c
agagtgcggcgaaatgcccatcaccttgtcagattgcaggcacggtgggtagtaggtcatccttaagcctngaggctgctcttcaaatatgcctaaaagag

SEQ ID NO: 22182 - DNA, 101 bp, rice(Oryza sativa)
  misc_feature (71): n=a or g
gacaacacacaaagggcccgtttcgtagagcttttaacttctattaactctaggagttggggtttggagcngagttgtggagcagcctaaacttagttcca

SEQ ID NO: 22183 - DNA, 101 bp, rice(Oryza sativa)
  misc_feature (71): n=a or g
aggatgaaaattgtagggtgataaataaaaatctaccaacatttataaaaacattattagtgcatggacancatagtgatatcgttcgattttactatata

SEQ ID NO: 22184 - DNA, 101 bp, rice(Oryza sativa)
  misc_feature (71): n=t or c
tgtcgtgtgggtttgagggaccaaaaaccgctaccagtgctagttttttccctaaccagcactagtaaganggtatatttgatactcccttcgtttcatat

SEQ ID NO: 22185 - DNA, 101 bp, rice(Oryza sativa)
  misc_feature (71): n=a or g
ataaatttgaaataaattaaggtaagaaaccgagaaagtataacagaagtcaatgatcgcccctcctcccncacgatcacgtgtggcctttatccgcacaa

SEQ ID NO: 22186 - DNA, 101 bp, rice(Oryza sativa)
  misc_feature (71): n=a or g
ttggaagtaaaagaagaatcccaaaaggttgaagcatacaattcgaccattgcaatctacacataccattncaagctctaagccgccacctagagcaacgc

SEQ ID NO: 22187 - DNA, 101 bp, rice(Oryza sativa)
  misc_feature (71): n=a or g
ctatattggaacaacaaagttagaggagagcaacatcaacatccaattttagttaagagaatattacaagngcaaaataaattattttatcatctcaaaag

SEQ ID NO: 22188 - DNA, 101 bp, rice(Oryza sativa)
  misc_feature (71): n=t or c
tgtgagttgcccaagacgaatcgctttgctcacaatggctggagctcggttgtctctcgcgttcctgtgcnttgtggtggtggtggtggcctccgcgctcg

SEQ ID NO: 22189 - DNA, 101 bp, rice(Oryza sativa)
  misc_feature (71): n=t or g
tttgcgcctcccactgtggaaaccgattcgcatgatcgcatcgcccggaaatcgcacggatgcccgtaccntgctacgccgccatggaagtggaactcgca

SEQ ID NO: 22190 - DNA, 101 bp, rice(Oryza sativa)
  misc_feature (71): n=a or g
tcctctacctcttcaatcgacgtactgcccacctcacaacttggtgtgctttcaagaaaagcattatcatnagaaattttgtgagattcctcttctttctg

SEQ ID NO: 22191 - DNA, 101 bp, rice(Oryza sativa)
  misc_feature (71): n=t or c
aaatgtcactaagcagcagcaacagcaagagaatgttaaaaaaaaagttcatatataagcaaagggctaancatatagtgcaaaattagcccatttgaaag

SEQ ID NO: 22192 - DNA, 101 bp, rice(Oryza sativa)
  misc_feature (71): n=t or c
tgtgcccgttggagttttaagttatattgatcaagatgtgctgctggagagataacatcagctaggtcttnagaaataagagcttggatagcattgaattt

SEQ ID NO: 22193 - DNA, 101 bp, rice(Oryza sativa)
  misc_feature (71): n=t or c
ttgaaatttatgattttctagggggcgattttcatgttggtaggaagtttctacagggtaggtagtttggngctagggacatgtcgacatgaggaccaatt

SEQ ID NO: 22194 - DNA, 101 bp, rice(Oryza sativa)
  misc_feature (71): n=a or g
taatgctttgattgcttcagacatagaactggaatgattgttttcaacatcagaccactcttctaggtacnatatctgaccacatcaaaaaataacaatta

SEQ ID NO: 22195 - DNA, 101 bp, rice(Oryza sativa)
  misc_feature (71): n=a or g
tacaacgccgcggtactgacgacttttgtggaccgatggagaccagaagctcacactttccacctttctancggggagctgatggtgacacttgaggacaa

SEQ ID NO: 22196 - DNA, 101 bp, rice(Oryza sativa)
  misc_feature (71): n=t or c
aggaactcggcaacccgtggtagtcttgcgatgcatcaggagggcatagctatgcttaggcctagttatgntgtattgttaaacgggttatgctacatagt

SEQ ID NO: 22197 - DNA, 101 bp, rice(Oryza sativa)
  misc_feature (71): n=a or c
aacacataaagaggcagatgagctgagagaaatgagactcaacgtgcggcactggaaagagaaggaaatcnacagtagggagaggagactccaaggacgct

SEQ ID NO: 22198 - DNA, 101 bp, rice(Oryza sativa)
  misc_feature (71): n=a or g
cagaaagttctcccagcagaacgagtatgcgtgtcgttgagtttcattgtagtgatgttcaagtactacgntccatctgaaatcaacaacataggaagaaa

SEQ ID NO: 22199 - DNA, 101 bp, rice(Oryza sativa)
  misc_feature (71): n=a or g
gaaagaacttacatgagcgacttgaacctggcgttgggtgagcatgttgttgttgggcgcgaactggaagncaccggcggtcttctgggcttgcaccggcg

SEQ ID NO: 22200 - DNA, 101 bp, rice(Oryza sativa)
  misc_feature (71): n=a or g
ccagactagttttttgttcaactcataattagaaaaccatttcagtacactggaaactcagtaacttctcncattgtcatctaactcttccattgtcatgt

SEQ ID NO: 22201 - DNA, 101 bp, rice(Oryza sativa)
  misc_feature (71): n=t or c
gatgcgtaccacgacgacgagcctctgcgctaccacaccgtggacaacatcttcggtgatcagcccgtccntggactggcgacgcacgacttcgaggccga

SEQ ID NO: 22202 - DNA, 101 bp, rice(Oryza sativa)
  misc_feature (71): n=t or g
gcttttaacgtaccttgagatctactgtaaagcttaagccctgcaggtatccccaaccaagagaaaggagntaatcttctaactgttcacaagatgtaatt

SEQ ID NO: 22203 - DNA, 101 bp, rice(Oryza sativa)
  misc_feature (71): n=t or c
ttgacaacaaatatcaaggcatgaaggttgctgtggcttttgttgtgcgaggacaaactgccctttatgcnttgtactgtgtcatgatattgtcccctata

SEQ ID NO: 22204 - DNA, 101 bp, rice(Oryza sativa)
  misc_feature (71): n=t or c
ggccctaactgaagatttgttactccgttttctttttaccttttggtgttgccgtctcccagaatgacaancttgtcagctgggaggccgctggctccagg

SEQ ID NO: 22205 - DNA, 101 bp, rice(Oryza sativa)
  misc_feature (71): n=t or c
ggagaagactcaaagtgaccgtgacaaggacaagggaaaagaaaaggaacgtatggaggagcatgaacgangccctgggggtgaacgggagagggagcgcc

SEQ ID NO: 22206 - DNA, 101 bp, rice(Oryza sativa)
  misc_feature (71): n=a or g
tctcatgtccatgatctgctgcacggtagtaagacagtgtcttgtactgttatgaaggaaaaggggctttngattagcttgatgctattgcagtgtaaaat

SEQ ID NO: 22207 - DNA, 101 bp, rice(Oryza sativa)
  misc_feature (71): n=a or g
ttcattttcaatgatattatcagctccttaggtcttcttgaaatccctcttaaaggcaggaggtacacttngagtaacatgcaacaaaaccctctccttga

SEQ ID NO: 22208 - DNA, 101 bp, rice(Oryza sativa)
  misc_feature (71): n=t or c
tcttcactggcggcggcatgcaactccttggccttcgtcaacgcgcaacgcttggtccctcagtctctgcnagcagtggcacacgactcctcggcctccat

SEQ ID NO: 22209 - DNA, 101 bp, rice(Oryza sativa)
  misc_feature (71): n=t or c
gaggattcatgtaccactacagatgttgaagtaagcatggagagcaagacactactaaaaaacaatttttncgtgcggcaagaaagggttttcgcgtgtgg

SEQ ID NO: 22210 - DNA, 101 bp, rice(Oryza sativa)
  misc_feature (71): n=a or g
tgattgttgagggccttggacgccttgtgaagctcagcatagaccctgtcgtagctgcacatcacccctcncatgtgaccaaaggtggtgtcgacctctcc

SEQ ID NO: 22211 - DNA, 101 bp, rice(Oryza sativa)
  misc_feature (71): n=t or g
tggacccaagactgaggtatactgcaaatccgcagttctgaaatctgtagagctaacttttctgtgggaanaaaagaaaagaaggtctttggagctaattc

SEQ ID NO: 22212 - DNA, 101 bp, rice(Oryza sativa)
  misc_feature (71): n=t or c
ccaaagtcaaaggcagcactactcaattgctgattctatcctctactcactgctggactttcatcctgagntgtggggtcttcctccttttgaagatcgta

SEQ ID NO: 22213 - DNA, 101 bp, rice(Oryza sativa)
  misc_feature (71): n=t or c
attctagatttaatatctacgatatcagatatgacactccataggtatatcatatcagatacttaggtacnatgttgacattagaatgataccagagccat

SEQ ID NO: 22214 - DNA, 101 bp, rice(Oryza sativa)
  misc_feature (71): n=t or c
gtggtattacgcgagttgggatgtacccccttcatctcaatatgtcgcaacctcctctatattcgtagttntaggattgatctaatctgatcctagggtgc

SEQ ID NO: 22215 - DNA, 101 bp, rice(Oryza sativa)
  misc_feature (71): n=a or g
aaataatcgttggactgtagccactcccagtattaatcacacaatgatcagatgtggtgttgctagatagntatcgcaagtaactgaatctttgaggaatt

SEQ ID NO: 22216 - DNA, 101 bp, rice(Oryza sativa)
  misc_feature (71): n=a or g
aacccacgcgcaattgcatcatctctcccaaaataagaggcatggtggtggccgagcggtgggtgccacangcggacatcctggtgcaccgcacggtgggc

SEQ ID NO: 22217 - DNA, 101 bp, rice(Oryza sativa)
  misc_feature (71): n=a or c
ctgttcaaatgtgaataaatgtggtagaaacaagaagattatattacctgccagcaccaaatgagatggcncatgatggtgtcctctctttcaattcacca

SEQ ID NO: 22218 - DNA, 101 bp, rice(Oryza sativa)
  misc_feature (71): n=t or c
tttattaattaataattttgtagctaatcataatcaaatgaaggctcgatgaggtggatccgcatcaatgncagatactactgcttcaaatgcacatgaaa

SEQ ID NO: 22219 - DNA, 101 bp, rice(Oryza sativa)
  misc_feature (71): n=t or c
agaagtggaggcaaaagaggagaagggagttacggaggcatgcaccaaatcaatggtttgcatccaatcgncaggttctttcgccaccacattattcatat

SEQ ID NO: 22220 - DNA, 101 bp, rice(Oryza sativa)
  misc_feature (71): n=t or c
cataattttactgacacccacgcacacgtattgtgatcctctgcattgatacgaaggctagtttagttccnaactttttcttcaaacttctaacttttcca

SEQ ID NO: 22221 - DNA, 101 bp, rice(Oryza sativa)
  misc_feature (71): n=t or g
agggcatatatatgttgcagagaaaatcgttttttctagtagtggatctttcccccagaaaagaggaaaangtttcaaatgtaattatagtacaattaata

SEQ ID NO: 22222 - DNA, 101 bp, rice(Oryza sativa)
  misc_feature (71): n=t or c
gtctgttcatcaaagattgggcctagtgaatcaaggtcgcggtcagaaggatgaggtagttaggacaaatnaatggtgtccttctggtattttcacaaaga

SEQ ID NO: 22223 - DNA, 101 bp, rice(Oryza sativa)
  misc_feature (71): n=a or g
gaagctggaccaggcgccgtggtcgaggctccccgagtcgttcagagacaaaggggcactcgtggagttgnagttgcgggaccaaagggtggtgctgttgc

SEQ ID NO: 22224 - DNA, 101 bp, rice(Oryza sativa)
  misc_feature (71): n=t or c
ttgggcgccaaatcccggtcttcgcactccaaatcctgaccagcctaatgcactctagatcctgaccagcntgaataacctccttgcactctagatcctga

SEQ ID NO: 22225 - DNA, 101 bp, rice(Oryza sativa)
  misc_feature (71): n=t or g
aaagccatttaccgaaattactaagctcatctctgtgtgcatctggaagcgaagggttaagtaacctcatntttattttcaaactaagcacaacaacatgt

SEQ ID NO: 22226 - DNA, 101 bp, rice(Oryza sativa)
  misc_feature (71): n=t or c
ctgggagtagctgctagctagtactcatcgtgatcttccagtattattattcccagttgcttgatctgcgnagagtgcaagtgaggaaagaatgagcccga

SEQ ID NO: 22227 - DNA, 101 bp, rice(Oryza sativa)
  misc_feature (71): n=t or c
caacaataacatgaggacagtcttacgttgttcatcctccatgatgggaaagtgtatgatgcaccaagaantgtgaagaagtaatgcgtccaaaagtaatt

SEQ ID NO: 22228 - DNA, 101 bp, rice(Oryza sativa)
  misc_feature (71): n=a or g
gtgcctccataccgaggccgccaagaacgggttcgtccaaaactcgcccgttcatctctacggcgcgtgtngcctgttcgagagcgtgcacaaggtgttcg

SEQ ID NO: 22229 - DNA, 101 bp, rice(Oryza sativa)
  misc_feature (71): n=t or c
taataggacaaacaacatgacgtgtgtttgcgtctttcatgattaaagataaattgtgggtgcgtactacncatctctcatgcgacgaaaacgaagtgtgc

SEQ ID NO: 22230 - DNA, 101 bp, rice(Oryza sativa)
  misc_feature (71): n=a or g
tcaataaataataatctttgatcaatgccggccactctttggagcgtccaaacttagagcctgtttagatnggactaaagttacttttaagtccctatcac

SEQ ID NO: 22231 - DNA, 101 bp, rice(Oryza sativa)
  misc_feature (71): n=a or c
acagttcaaacagggtgacgtcctcgatatccaaagcagtgagccagctgcatgcgacgatgcgacggcgncggcgccggtcatttacgccttgagggaat

SEQ ID NO: 22232 - DNA, 101 bp, rice(Oryza sativa)
  misc_feature (71): n=t or c
gtgactgttgaactaatccagcgcgacgacactctacaggtttgctgtaaatctggagagtaatttatcancattgaaaaaaaaatcataagatactatat

SEQ ID NO: 22233 - DNA, 101 bp, rice(Oryza sativa)
  misc_feature (71): n=t or c
ccgcgagcagtaactaattaaaagttactgtctgttctgatgccaggaccaccgtacctcgtctatgagangtactatgactgtaattcatactgtttcaa

SEQ ID NO: 22234 - DNA, 101 bp, rice(Oryza sativa)
  misc_feature (71): n=t or c
ttgcccaaaaagcacgcatctggaagtgagaaaagaaaaaagaagagaaggatagaggacttgatacaatngcaaaaaggagctattaataaattttttaa

SEQ ID NO: 22235 - DNA, 101 bp, rice(Oryza sativa)
  misc_feature (71): n=t or c
ttgctgctccagtttacccttctcgccaagcagccgggtatttttgtgctccaactcccacactctgtccncaagtgtggagacttggtgtgatagggtcc

SEQ ID NO: 22236 - DNA, 101 bp, rice(Oryza sativa)
  misc_feature (71): n=t or c
tggtgaaaggaagattgccgaacaacctaaaaagtggcatactatattagctaagtctttatggtcttatnggatggcatgtcatggatctatacaagttc

SEQ ID NO: 22237 - DNA, 101 bp, rice(Oryza sativa)
  misc_feature (71): n=t or c
ccttgtcaagaataggtgagttgtattatctgccatgtgtaccctatgatattgcaaaacaaaagtaagcntcatataattcaaatgaaagttgctaaata

SEQ ID NO: 22238 - DNA, 101 bp, rice(Oryza sativa)
  misc_feature (71): n=t or c
tttggtttgcaaaatgaatttgcggatgagttacataccccattttggctttcccaccagctttcgtcagngacaatggctgaagtaagggggtcccggcc

SEQ ID NO: 22239 - DNA, 101 bp, rice(Oryza sativa)
  misc_feature (71): n=a or g
gcggagctaatcactctctccagaccgtctgatcagggtacaacggctcagatcgaaatgccaaaccacanacatgatgctaagtaaatattatggagtat

SEQ ID NO: 22240 - DNA, 101 bp, rice(Oryza sativa)
  misc_feature (71): n=a or c
accaccaatagacttccttcttcgtgtccacgggcatttgtctggggccattagtgcttgtacaattatcntgtcactgacaaggtctctatcatcatttt

SEQ ID NO: 22241 - DNA, 101 bp, rice(Oryza sativa)
  misc_feature (71): n=t or c
ttgttatccttgcacattaaaatttcggaggatcaaccgtcgtgtgtccaaacttcctaggcagttttatnccacttcgattctccaaccaggatgaaata

SEQ ID NO: 22242 - DNA, 101 bp, rice(Oryza sativa)
  misc_feature (71): n=t or c
atgtctgggaccaaaaacataacactggaacacatttctctgagtctgcttctttttacggtctactcgcnttttcctcgtggtggtaaatgccgaatcaa

SEQ ID NO: 22243 - DNA, 101 bp, rice(Oryza sativa)
  misc_feature (71): n=a or g
tgtgcaggcgtgagcttttgttcgttttcttgggatactttccttaatggggaatcaaactctcccatttnatacagggtgtatttagttcacatcaaaat

SEQ ID NO: 22244 - DNA, 101 bp, rice(Oryza sativa)
  misc_feature (71): n=t or g
ctatgccttttttgttagctaactgaaaatagtggcatctgatacaatagattctttgtcaactggagcantctaccaaccatcaaatagtcattcgaaaa

SEQ ID NO: 22245 - DNA, 101 bp, rice(Oryza sativa)
  misc_feature (71): n=t or c
tggtgaggcccaggaaggacgtcaggaagatcatgtagccttgatcgccgtacttggcagtgaagtagaangcggggatgaacaagaaccgagccaggatc

SEQ ID NO: 22246 - DNA, 101 bp, rice(Oryza sativa)
  misc_feature (71): n=t or c
cgcgaacacagccaaagccaagccgcgtagccgcttgattaacagtgcagtgcaggcaaggggtaaaaatngagaaaattgacatttagccattctcaggg

SEQ ID NO: 22247 - DNA, 101 bp, rice(Oryza sativa)
  misc_feature (71): n=a or g
agctacgagtgatctggtgcaaagaaaactggttcaggtgccaagagcctaatttgcgaaggaacgacacnaggtcggattcttctcgtaagcttctctgg

SEQ ID NO: 22248 - DNA, 101 bp, rice(Oryza sativa)
  misc_feature (71): n=t or g
taggatgataggggtgtggtagggttattgctcaaggagattttgtttgtagatgcaagtagccccctaanttgaaggttcatcatcattcagggtggcat

SEQ ID NO: 22249 - DNA, 101 bp, rice(Oryza sativa)
  misc_feature (71): n=a or g
aaatttggtcaacatactaggtggttaccgttaccacacggctacagcaactccgattaccatgctaactncgagttaatcaacaagaaagaaaaccttag

SEQ ID NO: 22250 - DNA, 101 bp, rice(Oryza sativa)
  misc_feature (71): n=t or c
tcgagaagtaaggcaggacataaacgaggaatgcacaccctaaaacgaagtttccagttaacagatgattnccaagttatggtcaaaacaaaaacaaatag

SEQ ID NO: 22251 - DNA, 101 bp, rice(Oryza sativa)
  misc_feature (71): n=t or c
agctgagtacttttcagcgaaggacacaaccaggacagtcggatgcatgtacgtatttagctagctagtcngtgtttagatctaaagtttggattcaaact

SEQ ID NO: 22252 - DNA, 101 bp, rice(Oryza sativa)
  misc_feature (71): n=a or g
gtaataaatgatttggataagcacataaataaacgaacaatggattttttttgcggggaaacgaacaatgnattatttatccaccgacacatatgtacaaa

SEQ ID NO: 22253 - DNA, 101 bp, rice(Oryza sativa)
  misc_feature (71): n=a or g
ttaagtgcacaaatgggcaaagcggagcagaaccagtggcataacctttttcagacgaagtgtgtcgtcancaagcgttcctgccgcacaatcatcaatgg

SEQ ID NO: 22254 - DNA, 101 bp, rice(Oryza sativa)
  misc_feature (71): n=t or g
agagataatccaataacaccagcaccagaatacaggtcaacaactgttgacccacgtggtacatatttgtncaacgtatgcagtaacgcattaaaagactg

SEQ ID NO: 22255 - DNA, 101 bp, rice(Oryza sativa)
  misc_feature (71): n=t or g
aagcactaatttacttagttataaaccatgtttgtgattacacatgcagatccagttgctcaatggaaaanaaagttgttgtcacagataggcaagttata

SEQ ID NO: 22256 - DNA, 101 bp, rice(Oryza sativa)
  misc_feature (71): n=t or g
cctcagcaagcaaacgttctcgtgacacactgattctagcccaatgaaaaccacgtctacactcttgtacncatattaattttgggtttgtttttcattat

SEQ ID NO: 22257 - DNA, 101 bp, rice(Oryza sativa)
  misc_feature (71): n=t or g
atatgctattagaaaattagagatagtactctgtgcgtggtgggaggagggatgaaaaaatgacgagttcnattttaaggtagtagagatatgtacaaagc

SEQ ID NO: 22258 - DNA, 101 bp, rice(Oryza sativa)
  misc_feature (71): n=a or g
tgcatgcaacaacggctaatcaaattagttaccattgccattacgtgttgataattcatcgcgtccctatntactccttccgtttctaaatattttaggag

SEQ ID NO: 22259 - DNA, 101 bp, rice(Oryza sativa)
  misc_feature (71): n=t or g
agagtgacatagttatatatctctaagattggagcggaaccccatctcgagcaagtttaagtacccagaancgaaaggacctgtagcctagtggttagaag

SEQ ID NO: 22260 - DNA, 101 bp, rice(Oryza sativa)
  misc_feature (71): n=a or c
ttgtattcggacacacattcggagttgtgctcttcgtagcttcctcatcttatactttattaattagatantgctagtatataactatatatgtctgcatg

SEQ ID NO: 22261 - DNA, 101 bp, rice(Oryza sativa)
  misc_feature (71): n=a or g
aatctagagtacattatacatcacagatataacaattggaactaacatcgataaataggcaggaaattatngggtagattggtgagggccacgcctgcgaa

SEQ ID NO: 22262 - DNA, 101 bp, rice(Oryza sativa)
  misc_feature (71): n=a or g
gggtcttcttcactgacaaataagcaaaaggactcattagtcctttttatttccgttgccatttcaagggnaaaaaaaagaatactaagtactcacttcat

SEQ ID NO: 22263 - DNA, 101 bp, rice(Oryza sativa)
  misc_feature (71): n=t or c
agggtgaactatctgaagaatctgctaaagtgtgcaaaggataggatggtcagtcctgacacattgcctgntgactctcatgatgacagattcaggacctt

SEQ ID NO: 22264 - DNA, 101 bp, rice(Oryza sativa)
  misc_feature (71): n=t or c
ttgaccgggccatgtaagttgatgaggcattggatccgaggcccgaagactggcaaatctgaaccatttgntgacctgccaggctatcctgataatgtgag

SEQ ID NO: 22265 - DNA, 101 bp, rice(Oryza sativa)
  misc_feature (71): n=t or c
aagttcggcaacagcggtggcaacggaaagagggagagactgacaagagagaggtaggggaaagagaaganaggggagagaggtgaagaagatggaactga

SEQ ID NO: 22266 - DNA, 101 bp, rice(Oryza sativa)
  misc_feature (71): n=t or c
tttcatacaagctagctgcaccgatacactgatttaacttgagtcttcactccaggtccgtctctgaggcntcctcctctggcagctcaaaggcatcaacc

SEQ ID NO: 22267 - DNA, 101 bp, rice(Oryza sativa)
  misc_feature (71): n=t or c
attattggggtgcgttgtttgataaggttcgaaacaagcatattctacaacggggagcccatgcgaattanggggccatcaacgaattcaacatctgcaga

SEQ ID NO: 22268 - DNA, 101 bp, rice(Oryza sativa)
  misc_feature (71): n=a or g
gatatgtttcttagcaaggtgtactaagtagtctagtggtaagttacccgcttgttatattggaggttatngtttgaattctccttactatctttttttct

SEQ ID NO: 22269 - DNA, 101 bp, rice(Oryza sativa)
  misc_feature (71): n=a or c
ggtcaaatgacaacaaaatcatgccacagctcaaatcaatcccaaaattgaaatggtattcgactgagatncaaaccttcttggctgctggagtagatgga

SEQ ID NO: 22270 - DNA, 101 bp, rice(Oryza sativa)
  misc_feature (71): n=a or g
ggaataatggaggaataatgcgtagttggctgaaggagataaagaggagagagggtgaggtggatgaaatnggacccactgacatgtgggttccactaatt

SEQ ID NO: 22271 - DNA, 101 bp, rice(Oryza sativa)
  misc_feature (71): n=t or g
cttgcattcaacaatgattcggttagatagaactgggatcttacgcattcacatgtgtgaaaatttttttntagcaaatttgttctcttcatgcacaaatc

SEQ ID NO: 22272 - DNA, 101 bp, rice(Oryza sativa)
  misc_feature (71): n=t or c
tcatcatgtaaaatttctagtatcaagataccttgtttgctgttccatgtttgtgaacatgttttagggcntgtttggggagtttaagattctaagaagca

SEQ ID NO: 22273 - DNA, 101 bp, rice(Oryza sativa)
  misc_feature (71): n=t or c
gaaactaagggtggtaccattgcatgtgtaggctatcaacaagctgccattagggagaagggagagggggnggaggcaggtggcccttcgccggactggat

SEQ ID NO: 22274 - DNA, 101 bp, rice(Oryza sativa)
  misc_feature (71): n=t or c
ctcagcctctcggcgctgcatgccgtcgaggttctcctccccttcttctttttcttcctttctccgtcttncccctccttctccctgcccagcacatcctc

SEQ ID NO: 22275 - DNA, 101 bp, rice(Oryza sativa)
  misc_feature (71): n=a or g
cgaggacatggacgatgtcaagaggttggacgacatggagcaagacctgctcctgcgcattgaggacggcntggtcgccgccgccgccggcgacgaggcct

SEQ ID NO: 22276 - DNA, 101 bp, rice(Oryza sativa)
  misc_feature (71): n=t or c
taactccgattatggtaattttctcgaaatcgaggaagttgaataggcaactctaacattgttagaactcngaggtgaagatccaagcaaaaacaacgtaa

SEQ ID NO: 22277 - DNA, 101 bp, rice(Oryza sativa)
  misc_feature (71): n=t or c
ggcgctcccgtgggtggttagtggcgatttcaatgagatattgtttagttgcgagaaggtaggaggttccnagaggagtgagtctctgatgcacaactttc

SEQ ID NO: 22278 - DNA, 101 bp, rice(Oryza sativa)
  misc_feature (71): n=t or c
atggtcaacggcctctgtcagatcgatctagcattagtaaggcctgtttacttccgaaaataaaatttttnatgaaatcatatcgaatgtttaaacacatg

SEQ ID NO: 22279 - DNA, 101 bp, rice(Oryza sativa)
  misc_feature (71): n=t or g
aggggacaaggtggacatggcatctctgccctcctcgtctaaaagctcttttgccagattaggttcatccncatctgtgacacctacaaggctaccgacaa

SEQ ID NO: 22280 - DNA, 101 bp, rice(Oryza sativa)
  misc_feature (71): n=a or g
atgtgctctgaactttacatcgcagcatatgacgggcaaacagatgaggtcgtcaggctcttaggagaaancagtggcgttgccgtcgagtcaccgactat

SEQ ID NO: 22281 - DNA, 101 bp, rice(Oryza sativa)
  misc_feature (71): n=a or g
aaagttttgaccgaaacttgtcctaaacattgacaatttatgaccgaagagagcataaagcttggtagtcnatcctctgttcttgttcagccgtgttcgca

SEQ ID NO: 22282 - DNA, 101 bp, rice(Oryza sativa)
  misc_feature (71): n=a or g
gtcacagttgtaaaccattttcattattaaaaagagtccaaatcacccctttgaactattgagtgagtacnaattaccctcatggacccgaaaactagata

SEQ ID NO: 22283 - DNA, 101 bp, rice(Oryza sativa)
  misc_feature (71): n=a or g
cttttggccattggatggagagatcagcctcagaaaaggagaaaatgacagtcaacgacaaggtgaggagnttataattgagcggtggttctcacgttgaa

SEQ ID NO: 22284 - DNA, 101 bp, rice(Oryza sativa)
  misc_feature (71): n=a or c
gtgaactcgttcctgctccgcgcaaacaggaacggcgtatcgcggaggtcgtcctgcgaggaggtgctttngtattcggtggtattgtacgaagtatagca

SEQ ID NO: 22285 - DNA, 101 bp, rice(Oryza sativa)
  misc_feature (71): n=t or g
cttgcagtctgtcatgccggcacggtcgagaatgtcgaggcagtactgacgttgactgagcagcagtccgnagggctgccgagttacgctgacgccaagaa

SEQ ID NO: 22286 - DNA, 101 bp, rice(Oryza sativa)
  misc_feature (71): n=t or g
caacatctccccctccttgccttcaccgtcacatctgagtcacatccatccaacgccaccgtcgcctgcantggatctccctcctcgcaagcttctgcctc

SEQ ID NO: 22287 - DNA, 101 bp, rice(Oryza sativa)
  misc_feature (71): n=t or c
ttacacaaaatgtttggtccaacacacaagctagctgacgaattgagtgcatgcttgtggctaggaataanctgaacagagaatcacatataaacagagtt

SEQ ID NO: 22288 - DNA, 101 bp, rice(Oryza sativa)
  misc_feature (71): n=t or c
ggtcgaaactgatcgctaatgaccgtcaacacctgactgccccccgccgtctcattgctgccatcctcganggccggctctctgacctctgctccagctgg

SEQ ID NO: 22289 - DNA, 101 bp, rice(Oryza sativa)
  misc_feature (71): n=a or g
tatactactccataatccatattcgcacattttgtactagtaagcagtaaggcgattcaggtgaatgagangtttattttactctgatgatgctgcatgat

SEQ ID NO: 22290 - DNA, 101 bp, rice(Oryza sativa)
  misc_feature (71): n=t or c
ggttgcggaggacgccgaagatgagcagccgcgtcttcatggcgctcgtcttggccctcaccgccgtcganttcgccttcaccaccgccacgatcgtcgac

SEQ ID NO: 22291 - DNA, 101 bp, rice(Oryza sativa)
  misc_feature (71): n=t or c
gcattttttacacctctttttcctctaatcgttgccttctctttggcagtctttaggcttgctaccaccancttccaagcaacccttgatccttagtttcc

SEQ ID NO: 22292 - DNA, 101 bp, rice(Oryza sativa)
  misc_feature (71): n=a or g
cgagatctcggtttcgtccaccacgcatatatgagcactaaacgaactctaactagatgacaccccgcgcnttgatgtgggaatataagagtaatgtaaag

SEQ ID NO: 22293 - DNA, 101 bp, rice(Oryza sativa)
  misc_feature (71): n=t or c
aattgatcggtatttttcaggggaactaacaattgattggtgttgaaatgggagcccaataattgactggnttttcctatggacaccatcaaaggacatgt

SEQ ID NO: 22294 - DNA, 101 bp, rice(Oryza sativa)
  misc_feature (71): n=t or c
ctagcaaccaatagagcatcacctctatgtatccatggaccacctttcaagacaaactcataatctccttnagcactgaaagttatgatgaacatattatc

SEQ ID NO: 22295 - DNA, 101 bp, rice(Oryza sativa)
  misc_feature (71): n=t or c
tgctactgaaatcgaggactaggccatgtgccacagttgattatctgtgacatgttgaatggagcttccgngcatttattttcttttccgttgtgctattt

SEQ ID NO: 22296 - DNA, 101 bp, rice(Oryza sativa)
  misc_feature (71): n=a or c
aaccaaccatatttctctccaggcttgctttttgcgatcacatctctaagatgctccatcatcttatttgnactctcagattcacactcctgtacagtaca

SEQ ID NO: 22297 - DNA, 101 bp, rice(Oryza sativa)
  misc_feature (71): n=a or c
ttttaatcattcatccaagattatagctatactataatattgtgtttctcttacctggcacggagaactgnacttttatcattctttgcaaattcaataat

SEQ ID NO: 22298 - DNA, 101 bp, rice(Oryza sativa)
  misc_feature (71): n=t or c
atctcatgggctattactactactactacaacagaacaacacaattccctcccgcaacaacggagaaaacnaacgggggaacggataaaatcgcgggggaa

SEQ ID NO: 22299 - DNA, 101 bp, rice(Oryza sativa)
  misc_feature (71): n=t or c
gggggaaagtataacagcttgttagagaggtacaagcagcaggtggctaagtgtgccgaggagtgtgcgcngaggtacgatggcttgaagaagaagtacgc

SEQ ID NO: 22300 - DNA, 101 bp, rice(Oryza sativa)
  misc_feature (71): n=a or g
tgtatatcttggtcttctttctgtattcgtgcaggtatacctttccttgtactctgtatttttgggtaacnaggataccccttatccgtaatcctgacagt

SEQ ID NO: 22301 - DNA, 101 bp, rice(Oryza sativa)
  misc_feature (71): n=a or c
catgttctctccaccttcattcattctagattcatctcatgtctcttcacaagttgcatttagtaccaacntatattcaaatcatcatacaccctccgaat

SEQ ID NO: 22302 - DNA, 101 bp, rice(Oryza sativa)
  misc_feature (71): n=t or c
aaatgaatagtagcgacagcttacatggccagggtccaaaatcaaaagggtaaatcgatcttgattcccangttgaccattttgcttttggatcccaacta

SEQ ID NO: 22303 - DNA, 101 bp, rice(Oryza sativa)
  misc_feature (71): n=t or c
gtcggcagcgaagctcgaaaacttgctttgggagggtggggcagcggattcaagctcttcatgggaagganggttgagagtgcaaccaggtcaaagagcgt

SEQ ID NO: 22304 - DNA, 101 bp, rice(Oryza sativa)
  misc_feature (71): n=a or g
gctgtctccatctgcatcgccgtcctcctcgtgcccacctccatcagttgcggtggctcaactatttgcgnccggggatcaagagggtaaatgtctctggc

SEQ ID NO: 22305 - DNA, 101 bp, rice(Oryza sativa)
  misc_feature (71): n=a or g
tgatggatgtagacggaatgtctccttgatgatagcatggaagaaggtgagatgtgatagatccgactctnagaggagcctatcacgacccacaacaacat

SEQ ID NO: 22306 - DNA, 101 bp, rice(Oryza sativa)
  misc_feature (71): n=a or g
ttaccagtgcctttcagctcatgggccacggccagcaattgttccaactgccacttttggggcccattccnttgggtgcgtgcccaaggtgatccggacat

SEQ ID NO: 22307 - DNA, 101 bp, rice(Oryza sativa)
  misc_feature (71): n=t or c
gagagatgcagtgactcacttgtagaaaacaatgatgaccgcaccgatgagccaacaatggctgccactcnacctgatagtaatcaaggattatattccca

SEQ ID NO: 22308 - DNA, 101 bp, rice(Oryza sativa)
  misc_feature (71): n=a or g
tcattctacctggcatgctaattgtttcttttctcatgcttataggaataaggggctgattttttacaggnagacaacaccttcgtggcgtgttaagcgaa

SEQ ID NO: 22309 - DNA, 101 bp, rice(Oryza sativa)
  misc_feature (71): n=t or c
caggaccgatttagattaatttggggtaaaatgtgaataaaacggaaggtttccaaaacaaaacaatgaanggattctaattcatgaaggacggacgattt

SEQ ID NO: 22310 - DNA, 101 bp, rice(Oryza sativa)
  misc_feature (71): n=a or g
gggttggatgtaacaaaaccaacataaagtgttccctcaagcacagtgagaagctcagtagcacgaggatncacatgtggtgggttgacacccattggcgc

SEQ ID NO: 22311 - DNA, 101 bp, rice(Oryza sativa)
  misc_feature (71): n=t or c
ggaatctgcaatttgtcaggaagacatcagtgttcataccgaatcttgccctggaaagtcgcttccagttncagaagatatatctgcacctaaatctcctg

SEQ ID NO: 22312 - DNA, 101 bp, rice(Oryza sativa)
  misc_feature (71): n=a or g
ggagcgatggagatggagatggagttgttggtggggatgtggaacttgtcggcgacccacgacatctccgncgcgcgctgccgcgtccttggccacgcacc

SEQ ID NO: 22313 - DNA, 101 bp, rice(Oryza sativa)
  misc_feature (71): n=t or c
agtatgccgtcaaggtagaacatttggaagaaaatataaaaggtgctcaagacctgttcgccgagggcttntcttagtttattgattagggttattctagc

SEQ ID NO: 22314 - DNA, 101 bp, rice(Oryza sativa)
  misc_feature (71): n=t or g
aattctgaaactattcttgctacgtgatctgatgatctggttgttgaagttgcagccaatatttctgcctngctagtggcgatcgatcggtgcaaatatat

SEQ ID NO: 22315 - DNA, 101 bp, rice(Oryza sativa)
  misc_feature (71): n=a or g
aggatgcatcgagtgcgtgagtggaaggacaaagatagaactagtggcggatttactgcctggcttgtgcnggctgttttcccgggctgcgcaagtgcaaa

SEQ ID NO: 22316 - DNA, 101 bp, rice(Oryza sativa)
  misc_feature (71): n=t or c
gttagataatttccatcagtaggccagaaaatgctcaatgtatatcacatctattgtttaaccataagaancaaggtagcaaactgatttatgaaagataa

SEQ ID NO: 22317 - DNA, 101 bp, rice(Oryza sativa)
  misc_feature (71): n=t or c
cactgttagttaggtcatgcatccatcatgcaagtatatttgcaacagaggttttggtgtaaccatagttnaaaaaaataaaattgatattctagtgctac

SEQ ID NO: 22318 - DNA, 101 bp, rice(Oryza sativa)
  misc_feature (71): n=a or g
ggaacaaccagacaagatttcgtcttggaccgctaaacccgtcttaaccccttctcttcagtacttcatcnatgccatcgatgacctccgagtacgaggtt

SEQ ID NO: 22319 - DNA, 101 bp, rice(Oryza sativa)
  misc_feature (71): n=a or c
gaggtgcttgcatgtaatttcgaatcggcctcgtttggtatgtgtattcagcacacaaatactaacggtantacatcggttacttatggtccatcggtctt

SEQ ID NO: 22320 - DNA, 101 bp, rice(Oryza sativa)
  misc_feature (71): n=a or g
agcggttggcgaatgctaatggacgaggccaaagagtcaaagaggccatcgatgcccataaggcggaggcnccctgtggtcctggaggcgccgttgacaca

SEQ ID NO: 22321 - DNA, 101 bp, rice(Oryza sativa)
  misc_feature (71): n=t or c
gggagacgaaggaagtttctggcagaaggattttctagagatcatgttgattgttggctaacatgtttctnaaggtatgatgaagaagctttcgaaggttg

SEQ ID NO: 22322 - DNA, 101 bp, rice(Oryza sativa)
  misc_feature (71): n=a or g
cttctcgctttcttgatcttcctctccccttcggccttctgcaagctacatcagcgctggagcagtggcancggcgatgggtggcgagtggagtggtggcg

SEQ ID NO: 22323 - DNA, 101 bp, rice(Oryza sativa)
  misc_feature (71): n=t or c
agtttattgtcttgttgggttttatttttatataagttttagaagccttgtcaaaggctgccactatactnctgtacggttcagccgctgccctaggattt

SEQ ID NO: 22324 - DNA, 101 bp, rice(Oryza sativa)
  misc_feature (71): n=a or g
tagatatgtagttaaggtccatcctatggatgaacacggtatgacagcaagttaggtcacttaccaaacgnggagccatgatggaaccgtgctaagccttg

SEQ ID NO: 22325 - DNA, 101 bp, rice(Oryza sativa)
  misc_feature (71): n=a or g
ctaagatgcaaagtgctgcaggtgttaggtctataggaagaaagcatatacggggtttttgagctagcacnttaggtagtgcatgcattggcgtgctgttc

SEQ ID NO: 22326 - DNA, 101 bp, rice(Oryza sativa)
  misc_feature (71): n=a or g
ttggagtccatgtcgtctcgtacctttgagtggaatgatgcctctgtcgatgagttccttgcattggaggnacgccatgagcccgcaagcggacgtcgtcc

SEQ ID NO: 22327 - DNA, 101 bp, rice(Oryza sativa)
  misc_feature (71): n=t or c
gcaggcagagagccggacgcgtgatgcaacgacgcatgtgaaacggatcccggagactgatgccccgatcntggagactcctgcgacatggatcccaggtc

SEQ ID NO: 22328 - DNA, 101 bp, rice(Oryza sativa)
  misc_feature (71): n=t or g
ttgctccctcctggtacttgtcatatgagtcacttgcttccaccattgatcaccaaggcctctggctgtgntggctcagcaatgtccttcaccacctccac

SEQ ID NO: 22329 - DNA, 101 bp, rice(Oryza sativa)
  misc_feature (71): n=t or c
cgcctcagcccccatgaactccggcgacgactctacccaaccaacaaccaaagcaatcaatcaaccaatcntttgagctcaaaaaaacgttgcaaaatcgt

SEQ ID NO: 22330 - DNA, 101 bp, rice(Oryza sativa)
  misc_feature (71): n=a or g
accagaatctcatgattggcaaaatacagctgagcaggatgaccccatacctcaaaactcccttcctaccngtccatccggagcaacggcacagcgggtgc

SEQ ID NO: 22331 - DNA, 101 bp, rice(Oryza sativa)
  misc_feature (71): n=a or g
gaaatccatgaggatgaaactgctactaaaagcaaccggcagtttgtttgcaaggaggagggctgtaacanggttttcaagtatgcttcaaagatgaagaa

SEQ ID NO: 22332 - DNA, 101 bp, rice(Oryza sativa)
  misc_feature (71): n=a or g
gtcatccggacttgacactccgccactgatcctgtgccctctattcttatgttttcgaaatgaacccttanttattagcttgatttagctaattagcttcc

SEQ ID NO: 22333 - DNA, 101 bp, rice(Oryza sativa)
  misc_feature (71): n=a or g
aactggaagttggcagatccaagcgatatgccaccgctccaaccttgtcaagcacctgaaatggtccatanaatcgaaacgaaagtttacgattagccctg

SEQ ID NO: 22334 - DNA, 101 bp, rice(Oryza sativa)
  misc_feature (71): n=a or g
ttcccttctcgattttcgccgcttgcctctggtctaagcttgtcgctcaagtcctcggtttcggcaggtcnggccgaaggcccttcgtggtatacctccaa

SEQ ID NO: 22335 - DNA, 101 bp, rice(Oryza sativa)
  misc_feature (71): n=a or c
aattccaccttccacactctgaatacctgacgaatccgcttcctccatttccaggacatattcagaatccncatctcctgtacgcacgtcccctgtcatac

SEQ ID NO: 22336 - DNA, 101 bp, rice(Oryza sativa)
  misc_feature (71): n=a or g
tagtacgtgtacgtgcgtcatagtactttttcactttccttttgattttgctagtcagttctcatcctganacttttactccctccgtcccacaaagagag

SEQ ID NO: 22337 - DNA, 101 bp, rice(Oryza sativa)
  misc_feature (71): n=a or g
agagagtatgtgtgtcgctcaataatctgatccactaaatgtgtttcagccacctgattaagcaagaaagncaattgatttccatactttattccatagtt

SEQ ID NO: 22338 - DNA, 101 bp, rice(Oryza sativa)
  misc_feature (71): n=t or c
ggtggctcaaaatacaattcactctaaatatcaaaatcatcgatatgtgcggttcgttgatcagcagatcngctaagtttgacatttttctagttatattt

SEQ ID NO: 22339 - DNA, 101 bp, rice(Oryza sativa)
  misc_feature (71): n=t or g
tgggttgtctgggcacggtacaaagctaggaacgcgatttggggaggaaatagcggccagtgatggagctncggtgtttgcgcagcgggaggatgccccat

SEQ ID NO: 22340 - DNA, 101 bp, rice(Oryza sativa)
  misc_feature (71): n=a or g
cttgtcatctttccatggatgtgcaactgtaaactcatcagggctgcaaacaatattcttgtccttttcantgagctccttatcatttagaggacgcagac

SEQ ID NO: 22341 - DNA, 101 bp, rice(Oryza sativa)
  misc_feature (71): n=t or c
tcaacttcagtctgatatgttccatgtacatgagagggatgcttatggtttttgcaggagaaatagaagtntaaaatgttgccattgcttgtacagtttat

SEQ ID NO: 22342 - DNA, 101 bp, rice(Oryza sativa)
  misc_feature (71): n=a or g
tgcatttttttcctcagctccgagcatatatgcatacatgtacacaggatgagcaggcctctagaactccntctgcttgagtacatgtataggtaggcagt

SEQ ID NO: 22343 - DNA, 101 bp, rice(Oryza sativa)
  misc_feature (71): n=a or c
agtattagagtggtcttatttctcagtctcttggtcaacacaacatccacctgtttctatcccaaccattnttaccaacaactaatggaacgtttacctcg

SEQ ID NO: 22344 - DNA, 101 bp, rice(Oryza sativa)
  misc_feature (71): n=a or g
cattttagtatgagattagtttatttttttccctatctgtctcaaaactaaatcagcgtcgtactaaaatntgtcacatatatattcattttagtatgaga

SEQ ID NO: 22345 - DNA, 101 bp, rice(Oryza sativa)
  misc_feature (71): n=t or c
gagttagtatgttagtatgtgttttatccaacactacaaaatgagggaaccaaataggcatgctcttcatnatttttttattcaatccattctatgccatc

SEQ ID NO: 22346 - DNA, 101 bp, rice(Oryza sativa)
  misc_feature (71): n=t or c
tatctgaaccccagataaaattccaagcatcccccatccttgattgtaaattcaaactgtccagaacctcntgaagctgcaaaaatttagaataagcctca

SEQ ID NO: 22347 - DNA, 101 bp, rice(Oryza sativa)
  misc_feature (71): n=a or c
cgtcgagccatcgttgatcgctgaagctgggggaaaaggaccagggatcaccaaagcacaaatcatgaagnaaatcctaatgttagaaatttgcaagatat

SEQ ID NO: 22348 - DNA, 101 bp, rice(Oryza sativa)
  misc_feature (71): n=a or g
atttttttaaaaaaatcatattaatctatttttcaaaatttatagccatacttaggccctctttgtttagncttataagccaacttataagtcgaaaagtc

SEQ ID NO: 22349 - DNA, 101 bp, rice(Oryza sativa)
  misc_feature (71): n=t or c
ccgtcggcgaggccgacttcctgagcgagatcaccatcgtcgccagcgtgcaccactacgcgctggtaggnttgctcggatactgcctccagcccggcggc

SEQ ID NO: 22350 - DNA, 101 bp, rice(Oryza sativa)
  misc_feature (71): n=a or g
acaagtgatgatagtggtagatgtacactaagatcttcattgaaggctgttggatccaagaatgcagggcnttctgtgaaatgggcagacgagaatggaag

SEQ ID NO: 22351 - DNA, 101 bp, rice(Oryza sativa)
  misc_feature (71): n=a or g
ttggaaaaaacttttacttcggatcagtggctcacgtgtcactgtgtcagtgagagattaggaattaaacnggggaggaagccaggacgcccgcacgatgc

SEQ ID NO: 22352 - DNA, 101 bp, rice(Oryza sativa)
  misc_feature (71): n=a or g
tgcacaagctgctttggacagaattttcatactgccaaatccacattttctgcatctacatcagctaatcnatgcaactatgcgaatactgcccggtgttg

SEQ ID NO: 22353 - DNA, 101 bp, rice(Oryza sativa)
  misc_feature (71): n=a or g
cagctaccagggggccggtcagactacccatatgccaccggtcagactggccatgtacgccagtcagaccncccgtttggggccagtctgaccgcccctgg

SEQ ID NO: 22354 - DNA, 101 bp, rice(Oryza sativa)
  misc_feature (71): n=a or g
cgtttcagatgccgcacgacggcaagtggttcttgttcgcatctttttcccctttccttctctcctctcgntgaactggtgtggacacctccggccatgag

SEQ ID NO: 22355 - DNA, 101 bp, rice(Oryza sativa)
  misc_feature (71): n=a or g
gttggcgtcgtcgccgtcgttgccggagccgtgcgtgaagaggaagagcttcttgatacgccggacggtcnccgcgccggcgaaccgcaggcggtcagggt

SEQ ID NO: 22356 - DNA, 101 bp, rice(Oryza sativa)
  misc_feature (71): n=a or g
tggagtacccgtctcatggagagcgagaagaaagtacacagatgtcgatgtgcgagaagaaagcgagagcnccttcgggcgtatcgcacattccaactcta

SEQ ID NO: 22357 - DNA, 101 bp, rice(Oryza sativa)
  misc_feature (71): n=t or c
tccataccccaaactttctaaaccggataagttaccccctaacatagattggagtggtttaagatctcagnagcgtacacatggcacccgatcaacaaaaa

SEQ ID NO: 22358 - DNA, 101 bp, rice(Oryza sativa)
  misc_feature (71): n=t or c
cggaagcatacccgcacaaagtctcagacaatattggttcctcctcctgatactgtctcagcgtctcccanggctcctcagggagagcagcctcctcctgc

SEQ ID NO: 22359 - DNA, 101 bp, rice(Oryza sativa)
  misc_feature (71): n=t or c
gttcatgcaaaattgcaccaattactcgagaaatctgaaagtagctggggtggattgatcgaacatagtgnaagaggttcttgggctattataactcagga

SEQ ID NO: 22360 - DNA, 101 bp, rice(Oryza sativa)
  misc_feature (71): n=t or g
attgcatgcatatgtctacaattatccactcatttaggacggaattagtacaatttcatggtgcattgatntttttcttctgaactataattagctatttt

SEQ ID NO: 22361 - DNA, 101 bp, rice(Oryza sativa)
  misc_feature (71): n=t or g
ctcctcgatatcctgtggacctgtactctcgtatcggaaccaaaacaattatggagtgataacacgcacgngattgaattatttgcagtccgttaatgcgt

SEQ ID NO: 22362 - DNA, 101 bp, rice(Oryza sativa)
  misc_feature (71): n=t or g
atgaaatgctaaaaaacctttcaaaaaagtaatttttaaaacttccagtgaggccttactgtgaaataagnaactgcagctttgtaaccgattagactgag

SEQ ID NO: 22363 - DNA, 101 bp, rice(Oryza sativa)
  misc_feature (71): n=t or c
tctaccgcatgcaatcctggcgagtgacagcagaatattcatcccccaaaagcttacccggtttcagacgnatattgttctcaagatatacggtattgcca

SEQ ID NO: 22364 - DNA, 101 bp, rice(Oryza sativa)
  misc_feature (71): n=t or c
ccttgccttactcccctcttgcagtggaaattttttccaggtatctcattgacctgaactgaagaagaagnagaagaaaagatcttccttatccatccaag

SEQ ID NO: 22365 - DNA, 101 bp, rice(Oryza sativa)
  misc_feature (71): n=t or c
gcaacatgtaagcaaccagcagcaaaccaacagtattttatctctattgcacgtcagcaaccagcagtacncgctctttcttcttctttttcttttcgtct

SEQ ID NO: 22366 - DNA, 101 bp, rice(Oryza sativa)
  misc_feature (71): n=a or g
cagttttgttcttagatccttgagaccaatagagctgatatccaagttgtcaatgagtatcctcccacccncaggatcaacgaggcggaacaatgagctga

SEQ ID NO: 22367 - DNA, 101 bp, rice(Oryza sativa)
  misc_feature (71): n=t or c
tgctgacttgtcactagtggtcaggacaggcgtgcaaggtcagctgtgagttatcattgtatttcttagangaatatttcttcagctgttttgtaacaggt

SEQ ID NO: 22368 - DNA, 101 bp, rice(Oryza sativa)
  misc_feature (71): n=a or g
gcttaaaacaactgatatgagttgtaatgcttcacaagttgaatggcccggtgccgaaagagctccacatngagaaaataatccattgagattatgtacag

SEQ ID NO: 22369 - DNA, 101 bp, rice(Oryza sativa)
  misc_feature (71): n=t or g
aagggatcatgaccaagaagttcttgtgctaaaccagcggctcgctgaatccaaactgcccagcaatgttntacagtcacctgagcctagtgagaccggcc

SEQ ID NO: 22370 - DNA, 101 bp, rice(Oryza sativa)
  misc_feature (71): n=t or c
agcgcgagcggtgaaagtggcaagtctggcagtgaaaaggtaacggggaagcatatatagcccaacaaggngacgtttcgcctacccaccagtaataaagc

SEQ ID NO: 22371 - DNA, 101 bp, rice(Oryza sativa)
  misc_feature (71): n=t or c
aaggccgtggactcttgctaatgacatcgatggaactgacattttatatcagtatattaccaactaactcnctccgtcaaaaaaaaaaagagaaaccccga

SEQ ID NO: 22372 - DNA, 101 bp, rice(Oryza sativa)
  misc_feature (71): n=a or g
caaggcagctttccttttggacgatagctattttcccatccttgaggtaccttggtacttgacgataccgntaatctgagagaaattattatacccgtggt

SEQ ID NO: 22373 - DNA, 101 bp, rice(Oryza sativa)
  misc_feature (71): n=t or g
cactaatagcacggtcgtcgtcaatgtcacatccatcgtcgtctacaagctgcagatcatcaacaccaccntggtcactggccggagacaccaaccacgga

SEQ ID NO: 22374 - DNA, 101 bp, rice(Oryza sativa)
  misc_feature (71): n=a or c
acagaaattttgttatgtttgcaatgtcgaatctcactacgtttgcaataacaagaagaagaaggaggatntcttgcccaagtgctcaatccaatgtgtgt

SEQ ID NO: 22375 - DNA, 101 bp, rice(Oryza sativa)
  misc_feature (71): n=a or c
ctaccaccctacctagcttagaatatttaccatgcattctctctcctctcctcttctcttccctctctctntatatatactcatctccaagctgttcttgg

SEQ ID NO: 22376 - DNA, 101 bp, rice(Oryza sativa)
  misc_feature (71): n=t or c
gcaatccaggtgtatgatttgaatgtatcgtccccccatgatgaaccaatggagatctacggtatatttgnatttagagatgtacgaaacaaccaacaacg

SEQ ID NO: 22377 - DNA, 101 bp, rice(Oryza sativa)
  misc_feature (71): n=t or c
tggtcttatctcgtatctgaagattgccggaaccaagaacagatgaaaataaagctagatatctcacagtngatgatgcttcttatccatatatcctcgaa

SEQ ID NO: 22378 - DNA, 101 bp, rice(Oryza sativa)
  misc_feature (71): n=t or c
ggggagatcaggaagaagtgcagcgccatcaaccacttgtactaaatgcattgcatgcatggacacaagangaccacacagagacgatgatcaacgacgac

SEQ ID NO: 22379 - DNA, 101 bp, rice(Oryza sativa)
  misc_feature (71): n=a or g
accggacgccgctccgttcaattcacgcccagtcgaatcacaacctccctcgctccctctgaccctctccngatggtcgccggcgatggcgctggtgccca

SEQ ID NO: 22380 - DNA, 101 bp, rice(Oryza sativa)
  misc_feature (71): n=t or c
aaagccagaggacaagttgaataaagtaaaagcagtttcaagggagggaggtaggtcgatatcttatgacngcaaattttcagttaaatggttatatgacg

SEQ ID NO: 22381 - DNA, 101 bp, rice(Oryza sativa)
  misc_feature (71): n=a or g
ccctgcgttgagaatgaaccatagcatgtagagagtaccctgagccagggctagagagtagaagatcatcnttgctggcttcaggttggctttggaggagt

SEQ ID NO: 22382 - DNA, 101 bp, rice(Oryza sativa)
  misc_feature (71): n=t or c
aatgttggaaagtgacattaagaacgactatctctgcagtattgctcgtcagactatcgaacttcatatcngcgaggcactcccaccgaaggcgaagctct

SEQ ID NO: 22383 - DNA, 101 bp, rice(Oryza sativa)
  misc_feature (71): n=a or g
caaaggtttccctgatcagtggtgcgactgggttatgaaggtagttagaggtggaaaagtggccattaaantaaatgatgaggtgggtccatattttaaca

SEQ ID NO: 22384 - DNA, 101 bp, rice(Oryza sativa)
  misc_feature (71): n=a or g
aaatcacttcaactcccaggtatctcaacaggatttgtttatctatcgagagtttagcaggcatgacagcnatgaatttgtaacctttctgagcagcaaca

SEQ ID NO: 22385 - DNA, 101 bp, rice(Oryza sativa)
  misc_feature (71): n=a or c
ctactagctaacgagtaattaaggtatatatacaccatcaccatgtccatgcacgcacaaaagattgccgncggcgacgtcgccatcgatctccacccgtt

SEQ ID NO: 22386 - DNA, 101 bp, rice(Oryza sativa)
  misc_feature (71): n=a or g
atatgatgcatggaacaccgtcaagttatgtactctctctcctaaaataagttaatctactacgtgaaatnatatattctagttctataaatttaaacagt

SEQ ID NO: 22387 - DNA, 101 bp, rice(Oryza sativa)
  misc_feature (71): n=a or g
gacagcatcgggtctccggttcactgggtggcgtcacttcgtcaagcagagtgatctacagccggatcatntcagcgacaaaggcacggtcacattcgtgt

SEQ ID NO: 22388 - DNA, 101 bp, rice(Oryza sativa)
  misc_feature (71): n=t or g
tgcatctccaatgctagccgtcgaagatcaaccttgcctctatcattgttcttaggcccaccaatgggacnacgcgcggaggtcggcgagagagacggagt

SEQ ID NO: 22389 - DNA, 101 bp, rice(Oryza sativa)
  misc_feature (71): n=t or g
ctgctaggcagggaaataaagaatgggacaaaacatcataatctagtatataggagtataatagaacaacntgaacatggtaaggtggtacccatcatcac

SEQ ID NO: 22390 - DNA, 101 bp, rice(Oryza sativa)
  misc_feature (71): n=a or g
gaggccgaggctcaacaatgagggggttggggagttcttgtccttgctgggcacttcagatctgaaggcgncatggaggaagctgcagccggcaatggcat

SEQ ID NO: 22391 - DNA, 101 bp, rice(Oryza sativa)
  misc_feature (71): n=a or g
acgccagaccaaaagatttgttcaacatcaaggtgttgctatatatggtctaaagtctaagggcatgtttngaggagctttagattctgagaagcagttgt

SEQ ID NO: 22392 - DNA, 101 bp, rice(Oryza sativa)
  misc_feature (71): n=t or c
gaagaagcctgagctttggcctggtagcacagagtactacgtatttgggtgtgccgtgacgcttgaacacncatgggtcctaaacaaaaccagctgtccag

SEQ ID NO: 22393 - DNA, 101 bp, rice(Oryza sativa)
  misc_feature (71): n=a or g
gtggtttcacgtgagcatccattcgtagcgcgggaatcttatagtagtaaaccttcaatattgttcctttngaacgcagaagttttataggattttcatat

SEQ ID NO: 22394 - DNA, 101 bp, rice(Oryza sativa)
  misc_feature (71): n=t or c
aagatcatgcaaatcacaatcagcaagagcttctctgaaatctttcatttgtctctctgatcgcctgaccngagaccaatgttcagattgccacatagcct

SEQ ID NO: 22395 - DNA, 101 bp, rice(Oryza sativa)
  misc_feature (71): n=t or c
ctattaggctgttttagtgctagttttagtgctagtttccaatttttacttctagtttttaccatgcacgnttttcaaaatactaaacggtatgtctttta

SEQ ID NO: 22396 - DNA, 101 bp, rice(Oryza sativa)
  misc_feature (71): n=t or c
gatgaggaagacgatgattccgtttcttggttgtcatcgttctttggcgaggctgagttaggtttttcggngaatgagatgatttagtagcgagggaggtc

SEQ ID NO: 22397 - DNA, 101 bp, rice(Oryza sativa)
  misc_feature (71): n=a or c
gtagtttttttttaatctcattcaattttgaattcccaagttgaaaataatgggcccacttggcgctggtngtgcggctcgaggagctgttgttgttgaac

SEQ ID NO: 22398 - DNA, 101 bp, rice(Oryza sativa)
  misc_feature (71): n=a or g
cgccgccgccaccgtcggtgccactgctgccaccaccaccaccgcgctccataatgtcaagaacgcgctcnacctcgcagctgccgacattggatgacgat

SEQ ID NO: 22399 - DNA, 101 bp, rice(Oryza sativa)
  misc_feature (71): n=a or g
ttgaagatctcaacagcaaggaacgaacgcaacccagaagttccgaggggtcaatgagattcgttgtaccnggagtagggagtaggtgagaccaaacaact

SEQ ID NO: 22400 - DNA, 101 bp, rice(Oryza sativa)
  misc_feature (71): n=t or g
agaaggtgcaaagcaaccagaggtgcgccttgtctgtctggcattggtttaagtagatccacaagcaacgnaatggaccttcgagcagtagcactcgtacg

SEQ ID NO: 22401 - DNA, 101 bp, rice(Oryza sativa)
  misc_feature (71): n=a or c
ccacaaacctgatgctagagtgaagataaaatacaagggactaggttgatgggagattgagagttacttantttctaaattttcactccaacggcacgtta

SEQ ID NO: 22402 - DNA, 101 bp, rice(Oryza sativa)
  misc_feature (71): n=a or g
cccagatgtcgtcgtcgacacactcgtggccgatgcgctcgccgtgggtggacagcagagaaaggaagatngaactgggagtggtggtaggacccaccttt

SEQ ID NO: 22403 - DNA, 101 bp, rice(Oryza sativa)
  misc_feature (71): n=a or g
cctgcttgatgctcctcacctaactagtgctgcagaaacagatccaacatcacctatctccttcaacttcnacttctccaagaagtaccgcggagaagact

SEQ ID NO: 22404 - DNA, 101 bp, rice(Oryza sativa)
  misc_feature (71): n=a or g
attaatcaagctagctagccttttgccattccaagttccaaccatggccagctagtggtgcacaagggggntcaccatggtctcaccatcaccctcctctt

SEQ ID NO: 22405 - DNA, 101 bp, rice(Oryza sativa)
  misc_feature (71): n=t or c
tgctaacgatttggtattcagtaggagtaggccatgtgaacaaggcaaagatactcctactgatcatattnatatgtgtcatgcaaccttctgctctattg

SEQ ID NO: 22406 - DNA, 101 bp, rice(Oryza sativa)
  misc_feature (71): n=t or c
gtccactcgcttgcatgttactccccgtcccattttgcagtcgcggtttccgtgtctaatatttaatcgtncgtattatttaaaatttttttaaaaaaata

SEQ ID NO: 22407 - DNA, 101 bp, rice(Oryza sativa)
  misc_feature (71): n=t or c
gatccggccgggctcgccggggccggagaagaagagagaaaggtactcacgaggaggagtcgccggcgtanggccgccgtccaccagcacggtcggcggcg

SEQ ID NO: 22408 - DNA, 101 bp, rice(Oryza sativa)
  misc_feature (71): n=a or g
gtgaatcgagaaagcacaagcttcagaatcaccaaacatgtgtaagatccctatatattcagggctatacngctgcatatgaacattcgatcattataagc

SEQ ID NO: 22409 - DNA, 101 bp, rice(Oryza sativa)
  misc_feature (71): n=a or g
cctatcaatggaatcgaattcagcatccattttccttgattgagctggaacacctagagttttcctttgcnccaactctgtctcaattcgtgcctaaacag

SEQ ID NO: 22410 - DNA, 101 bp, rice(Oryza sativa)
  misc_feature (71): n=t or c
gctatgtctgcagagctggaggagaaagggtagttccagaagctgtagatgttcatgccaacgaatccctnctgtgtagcctgcaaatgtccatgcatgtt

SEQ ID NO: 22411 - DNA, 101 bp, rice(Oryza sativa)
  misc_feature (71): n=t or c
gggttccaccaagattatccaatgaaccaatattatccatttggtccagtgtactatcaaatgccttcccnaccacctgcacgatatcagaataggcgatc

SEQ ID NO: 22412 - DNA, 101 bp, rice(Oryza sativa)
  misc_feature (71): n=a or g
atcgctggcaatcatagggtcctgagccaccttcggtgatgatgtcatcgttgatgtcaactccatctcanccgtccaaaatcaatataaatcatctcctg

SEQ ID NO: 22413 - DNA, 101 bp, rice(Oryza sativa)
  misc_feature (71): n=a or g
ttatcagggccaactgccaaacggtcaggaaattgctgtgaagaagctctcaaaggagaacacggttcaangactgaaagagttcatgaatgaggttgaca

SEQ ID NO: 22414 - DNA, 101 bp, rice(Oryza sativa)
  misc_feature (71): n=a or c
tccgcatccgcatccgccgccgagccaggaagtgaagaagggcaaggagaaggtcggcgagggggagatgntggagagagcggtgtcggcgcctgttgatc

SEQ ID NO: 22415 - DNA, 101 bp, rice(Oryza sativa)
  misc_feature (71): n=t or c
actgtccacaaccctggagaaatatttctgtactaaatcttgcatgctttacagagagtgccacctcctcntgctgctggatatgatcggccacatcttgg

SEQ ID NO: 22416 - DNA, 101 bp, rice(Oryza sativa)
  misc_feature (71): n=t or c
tatgtaagggggctgctgctgctgctggctcttccttatacgcaggtcatcagcaagctgagcacacttcntttttgtctccgctagttgttgctctagct

SEQ ID NO: 22417 - DNA, 101 bp, rice(Oryza sativa)
  misc_feature (71): n=t or c
actccaccgagttcgcaaagcagtactgaatttggtcttgagtgtagcgcaccatcttagtcctctttttnttctcgttggtgggatcaatcgccgtggcc

SEQ ID NO: 22418 - DNA, 101 bp, rice(Oryza sativa)
  misc_feature (71): n=a or g
ctacttatgggcttccgttgggctacttctctgagggtcctgatagttctgttgttcctgataaagatggnaagaaagtggttggggtgaaaaaaggcttg

SEQ ID NO: 22419 - DNA, 101 bp, rice(Oryza sativa)
  misc_feature (71): n=t or c
gcaaatggatacaattagacagtcgagaacagtttgggaatactatgagaaatttgatgagttgatgaacnaattgttgtcctatgatcctgtcattagca

SEQ ID NO: 22420 - DNA, 101 bp, rice(Oryza sativa)
  misc_feature (71): n=a or g
gctcttctactgttcttctacatcacaattctgggaaccactacagcaaggtcgcccattttcagcaagcnatactagcatcaacatccaacgaggcgctc

SEQ ID NO: 22421 - DNA, 101 bp, rice(Oryza sativa)
  misc_feature (71): n=a or c
tgacttcagggttcaacattccagctggattgcaattttaaagtacatcattgtctggaattctggattgnattcatgcccgtgggagaagaaaatagaga

SEQ ID NO: 22422 - DNA, 101 bp, rice(Oryza sativa)
  misc_feature (71): n=a or c
atgtggcattaaaatcaaaaaagaatgtgcatgacttatttgccattcacaaaaataatattgtggtaccnactgacatgtagggcccacatgtcatcttc

SEQ ID NO: 22423 - DNA, 101 bp, rice(Oryza sativa)
  misc_feature (71): n=t or g
atgattggttttatgtaattcagttcagtgatgtttatctgctggctgtatgctgttagattaggattggntgttttaagtgaacttcccatgtctaatac

SEQ ID NO: 22424 - DNA, 101 bp, rice(Oryza sativa)
  misc_feature (71): n=t or g
tataccaacacaagatacgcacacgcatacaatgatatactccctccggttatttaaacatggcgttttanaggtcgacatggtgccaaaaatatgacttt

SEQ ID NO: 22425 - DNA, 101 bp, rice(Oryza sativa)
  misc_feature (71): n=t or g
aggcattgtaatgaatttatctactttggtaccattaacatttagtcttgtaatgttcaaagaatcaacancagtggatatttcaggcgattactgttcta

SEQ ID NO: 22426 - DNA, 101 bp, rice(Oryza sativa)
  misc_feature (71): n=a or c
aaatatggccaacgggatgctgctgctttgtgcttatctacttcagagattcagagcagaggaattgatanagcaagatcacatccagcaggcgggatctt

SEQ ID NO: 22427 - DNA, 101 bp, rice(Oryza sativa)
  misc_feature (71): n=t or c
tcaatgtcttggatttcaaaagcgtggaaatccatgacaacctctttgttattgtgatgaacaagaacatnttttataatcgcaaatccttcaatcaactg

SEQ ID NO: 22428 - DNA, 101 bp, rice(Oryza sativa)
  misc_feature (71): n=a or g
acaaaagctagtttttgaacgagtgtcagccaccatctttgctcttctgatagatcaacgaaacaaaactnacaccaccaaacaaatcagcaacccgaccc

SEQ ID NO: 22429 - DNA, 101 bp, rice(Oryza sativa)
  misc_feature (71): n=t or c
catttggcgagtcggcaatggccgttcaatccgtatatggcgcgatccctggatttcgaggggccattcangtcgggtaatttcgaggaaaggcagctgca

SEQ ID NO: 22430 - DNA, 101 bp, rice(Oryza sativa)
  misc_feature (71): n=a or g
tcctttttctccttttatttttcttacgctttcttctccccaatttatctcgcgcatttgggggctctttncttaagtaggaatccccccaggtcagcggt

SEQ ID NO: 22431 - DNA, 101 bp, rice(Oryza sativa)
  misc_feature (71): n=a or g
atgatttttattttgggatgaatttatcagcacgtgacatcccgacacaatgtgcatttcaatagatgatnacaggaagatacagatcacccctcgcaccg

SEQ ID NO: 22432 - DNA, 101 bp, rice(Oryza sativa)
  misc_feature (71): n=t or c
gcggcgagcacagcgtccgcgtggcttcacgcgtcggcacagccgacgacggcatcaacgttggccacagnggcaacgctgtgctcgccgttcctgtcgtt

SEQ ID NO: 22433 - DNA, 101 bp, rice(Oryza sativa)
  misc_feature (71): n=t or c
aaaaaaaattaaaaataaaaaaaattcgcagcaactgtgccttgctagcctatcgcgaactggtcaaggtnggagaccgcatgggctgttttcaattttct

SEQ ID NO: 22434 - DNA, 101 bp, rice(Oryza sativa)
  misc_feature (71): n=a or g
tgccaaatcagttcagaatgattgcctgcattggtgtgtaccaggccctatcgacgcttggaatgatctcnttatgaagatggtattgggctgatgaagcc

SEQ ID NO: 22435 - DNA, 101 bp, rice(Oryza sativa)
  misc_feature (71): n=a or g
gacagtagtagtaggcttctacccgacttggacaatgaataagtctatcatgtatccctttctgtcgaatngtctctcataacgcctcccctatctttaaa

SEQ ID NO: 22436 - DNA, 101 bp, rice(Oryza sativa)
  misc_feature (71): n=a or c
aaaacccacccctacttaatttcactccaaaaaccatctctagtcgcacatgcttattaatagaatcagcntattattgctgatgtagagttaccacgtgc

SEQ ID NO: 22437 - DNA, 101 bp, rice(Oryza sativa)
  misc_feature (71): n=t or c
cacatcactcatccactaatttccacctataattattactattcaacacaaaattcctccttactccctcngtcccataatataatgaatttcggatgaat

SEQ ID NO: 22438 - DNA, 101 bp, rice(Oryza sativa)
  misc_feature (71): n=t or c
agcggcatccatcctcacagatctggtgatggcggactgctacggtggtgatgacggcagcaacggactanggcgagcacgatgatggcagtggtggcagc

SEQ ID NO: 22439 - DNA, 101 bp, rice(Oryza sativa)
  misc_feature (71): n=a or g
gaggtggttggggcgcaaagtgtgcatttattccaacccactagtcgcctgattcctaacttgagccgttnagggcatattgaggctcgattcgccccggg

SEQ ID NO: 22440 - DNA, 101 bp, rice(Oryza sativa)
  misc_feature (71): n=a or g
ttagagatgtggtcatccgtgatcaatttgtttggcccatcagataggtgtcatagatggcggatctttcntagtgaatgcgtatgtctgtttgttgacag

SEQ ID NO: 22441 - DNA, 101 bp, rice(Oryza sativa)
  misc_feature (71): n=t or c
ctgcgaaactatgggacgtacattacatttcaatcgttctgaccaaagggatgcatcttcaacacatcggngaaggatccgctggagggagggggattctt

SEQ ID NO: 22442 - DNA, 101 bp, rice(Oryza sativa)
  misc_feature (71): n=a or c
catgctctcactagatgaggctaaagtgataggcattggttatccaaaggcaaaggtaactcaactgttgntggacgaagaaaagcagctgagggtgatct

SEQ ID NO: 22443 - DNA, 101 bp, rice(Oryza sativa)
  misc_feature (71): n=a or c
taagtcagtcaaatttgtataacttaaggcgtgacaacttaaacaagtaataggaaccaaccaaacaaccntgtagaactacaacaatttatggtatttac

SEQ ID NO: 22444 - DNA, 101 bp, rice(Oryza sativa)
  misc_feature (71): n=t or c
gccccgccggtgtgggaaggcggctcgccggagtagaggagcggatgtcttctcttcgcatcgccatcgcnatcgcttgatgtactctctcctcctcgtcc

SEQ ID NO: 22445 - DNA, 101 bp, rice(Oryza sativa)
  misc_feature (71): n=t or c
gcaggcgagcagaagcagaagaagcgagtgcccttctggatgatgctggttatgttttctgtttttggtgnggtgatggccttgcccctgatgcaactctg

SEQ ID NO: 22446 - DNA, 101 bp, rice(Oryza sativa)
  misc_feature (71): n=a or g
aaaccatgccactccgtccctctttccgtcctacccgtcgctatttccgtccatgccttcctctcacgccncataccgccaccgccaagagatgaccccgc

SEQ ID NO: 22447 - DNA, 101 bp, rice(Oryza sativa)
  misc_feature (71): n=t or c
cttccaagtatgctgttctggaatataacatggtgcatgcatgagcaagatacctttgggataggggtgcngtccacattggggtacattcccaatgatgt

SEQ ID NO: 22448 - DNA, 101 bp, rice(Oryza sativa)
  misc_feature (71): n=a or g
accaccctgggggaaattctcagctggttccttctatacgatccaattaaatggcgaaagaacatcagganaaaagataaagtactttatcactacttaaa

SEQ ID NO: 22449 - DNA, 101 bp, rice(Oryza sativa)
  misc_feature (71): n=t or c
actatttatgataacgaacaaaacagcgttgacaatgtaaaagatggcaaagggatactgccggctaatcngtctcttagtgtgtcgttgtcgctccttgg

SEQ ID NO: 22450 - DNA, 101 bp, rice(Oryza sativa)
  misc_feature (71): n=a or c
ttgttacatgtttaatgtaaaatgataatctctagtacctgagtgatgataggttcatcaacctcttcaanttctggtgtgggttctttgctaataatatt

SEQ ID NO: 22451 - DNA, 101 bp, rice(Oryza sativa)
  misc_feature (71): n=a or g
cgcatcaacggctgttaatatctggcctcggtacttcccagttaggaatgtaccatcgacacacagcaccngccacgagcactggaacgcatgaatgcatg

SEQ ID NO: 22452 - DNA, 101 bp, rice(Oryza sativa)
  misc_feature (71): n=t or g
tttcagataaatgtctggtgcgcagaccgaaattttgcctacaagttaactgatgagatgcatgatccatnggccaagaaactggttctgggatttgctcg

SEQ ID NO: 22453 - DNA, 101 bp, rice(Oryza sativa)
  misc_feature (71): n=a or g
ttgccattgagagctcgtccataaatctcgccatctaatcccttgagcagataggcattgtgaggaacacntcgatgaattcgaaaggggccttcccaatt

SEQ ID NO: 22454 - DNA, 101 bp, rice(Oryza sativa)
  misc_feature (71): n=t or c
tttaattgatggtttaaacatgttctgttttgtttgtgcttcgactgtgctcgtttcccatatattagtanaatgtgtattctgattatcttcatttctta

SEQ ID NO: 22455 - DNA, 101 bp, rice(Oryza sativa)
  misc_feature (71): n=a or c
tcgtgctatggtgccacctcaggccacccgttgctcctccttgccgtcaaatttttaaacgtacctttttnctaacaatgtaagaggcaattataggagct

SEQ ID NO: 22456 - DNA, 101 bp, rice(Oryza sativa)
  misc_feature (71): n=t or c
ggacccccgtacaaccgcgcggatggaagggattgctcatattacgacgaatccccatacttgagttcatntggtgagttgttgactatccatccatctgc

SEQ ID NO: 22457 - DNA, 101 bp, rice(Oryza sativa)
  misc_feature (71): n=t or c
tcttccataggtatgggttcaccttttcgattgagtgctggattcctacccacctataggttccccttttngattgagtgttggattccgacctccaatga

SEQ ID NO: 22458 - DNA, 101 bp, rice(Oryza sativa)
  misc_feature (71): n=t or c
taataatgttcaacctgtgttattcccgtccttttccaactcaagttcctcattttccgcatacacacttnccaaagtactaaacggtgctttctttataa

SEQ ID NO: 22459 - DNA, 101 bp, rice(Oryza sativa)
  misc_feature (71): n=a or g
aaatatttaattttacatttaaaaaatgtgatgcgctacgataagcaatgcaaaaagacacgaatattagnaatgacctaatatcaaataattagaagggg

SEQ ID NO: 22460 - DNA, 101 bp, rice(Oryza sativa)
  misc_feature (71): n=a or c
cgtttcacttgatcagctagagggggcttgagctcacttgaatcacatattgattgaagatggtcccttgnaaaagagatggcttctacgagttctgtctc

SEQ ID NO: 22461 - DNA, 101 bp, rice(Oryza sativa)
  misc_feature (71): n=a or g
cgactgatcactgacaatgtgttgctagcctatgagatgacgcactttatgcaaacaaaacgtactggccnggagggctatgctgctttgaaacttgatat

SEQ ID NO: 22462 - DNA, 101 bp, rice(Oryza sativa)
  misc_feature (71): n=t or c
atatcaattaaccgaaaagcattacagtacaagctgccaggatttccgacctagagaagcaggtcgaggcnctggagaaggacaaggccgaattagcaaag

SEQ ID NO: 22463 - DNA, 101 bp, rice(Oryza sativa)
  misc_feature (71): n=a or c
agtttggactataattcgaagatcagcccactagctaatttaacaaagtctgacatatactccctccgtcncaaaaaaaaacccaatcctaaatttgagac

SEQ ID NO: 22464 - DNA, 101 bp, rice(Oryza sativa)
  misc_feature (71): n=t or c
tatcgataaccctaccttattgaaaataattatcatggtataagcgtctttgtttcagaaatatcatcatnattaggtttccgttagcaactatccgttaa

SEQ ID NO: 22465 - DNA, 101 bp, rice(Oryza sativa)
  misc_feature (71): n=a or g
agcttctcttagaaactccagctgtcagacattccccaaagagttatttttaaccagattctgataatttnttgatgtagaatccatataatgaactagaa

SEQ ID NO: 22466 - DNA, 101 bp, rice(Oryza sativa)
  misc_feature (71): n=t or c
tgcaaatcaaatataatattaataaataaaaaaccggcgaacaggtgaactggtcgaacaggtgaaccgangaccagagcagatcgacctccggtccggtt

SEQ ID NO: 22467 - DNA, 101 bp, rice(Oryza sativa)
  misc_feature (71): n=t or c
acttgcagatcatctcaacatacttattggaatatccatgatatataataccctcaaaaaataatagccancaggaacacaataaattaacccaacctcat

SEQ ID NO: 22468 - DNA, 101 bp, rice(Oryza sativa)
  misc_feature (71): n=a or g
ccgccaaacaatataatagcaaaacaattacacaagttcatagacttatttacactagtagcatacccgtnctaacgctacggtgacaactaatattgcaa

SEQ ID NO: 22469 - DNA, 101 bp, rice(Oryza sativa)
  misc_feature (71): n=a or g
cattcacaacgcagctgacaagcggctcaacaatgactatgatgtggttgagatggagcgtgtcattgctntcgggctctggtgtgcgcatccagaccgat

SEQ ID NO: 22470 - DNA, 101 bp, rice(Oryza sativa)
  misc_feature (71): n=a or g
tagtatccgccgcaaaccaaacagtacatcccgacgtacgtgacgagaaaattagggcctgtttggtacanctccaactcctaaatataacttcaggagtt

SEQ ID NO: 22471 - DNA, 101 bp, rice(Oryza sativa)
  misc_feature (71): n=a or g
tgcaaacaatcatgtactccagccaacatcatttccagatgctagtggattggttccaaacaccagggttncttccagactagcatttgcggggaatccac

SEQ ID NO: 22472 - DNA, 101 bp, rice(Oryza sativa)
  misc_feature (71): n=t or c
tgatgctctcctcgttacattattaataattaggaaaaaaatcaactcataaaggtaaaaatctcatccangcccggtccctgtcccgggggcgacgcggg

SEQ ID NO: 22473 - DNA, 101 bp, rice(Oryza sativa)
  misc_feature (71): n=a or g
ccgttcatcatcagcaacaccaacaagtatctcgcattcatctatgactgctcgattcctgaacacgttgngcagctgcaacggccatgtggaaaccggac

SEQ ID NO: 22474 - DNA, 101 bp, rice(Oryza sativa)
  misc_feature (71): n=a or g
ttctgcaccaaactctggttgaagcttggtagatggaaagcacggtattttagaactttctgtgctttgantcgttgcctaaatcagtttgaaggcatgtt

SEQ ID NO: 22475 - DNA, 101 bp, rice(Oryza sativa)
  misc_feature (71): n=a or c
agaatatggcaaactaaaaaaatacggtgagcatgggtttttatctgcagcatatgggatttgaacccacncttagctaggagtaggaatgtgtcttacca

SEQ ID NO: 22476 - DNA, 101 bp, rice(Oryza sativa)
  misc_feature (71): n=t or c
aaagccatttgcaaaaatccccaaataaaccaaaacaaattcactggtcacaatcacaaattcatagcatnataaaaaatgaccaaaaagctgtgcgcata

SEQ ID NO: 22477 - DNA, 101 bp, rice(Oryza sativa)
  misc_feature (71): n=t or g
aaattgaattaaataataatctactgtagttagtgaagcccatgtaattagttgggccgtaacggtactgnaccacctatatatttatcgataaattttgt

SEQ ID NO: 22478 - DNA, 101 bp, rice(Oryza sativa)
  misc_feature (71): n=t or c
cgctgtcaccaatcaaaatactcctacgttcttcctcttcatcttcaaaccacgaacgcacctcttcctcnccgcgcctccaatgacatgtgcacggccaa

SEQ ID NO: 22479 - DNA, 101 bp, rice(Oryza sativa)
  misc_feature (71): n=t or c
ttttggtctgcctattttacaatgtccatgatattttagttccttcagtttaattttactgtgtttagatntaaagtttggatccaaacttcagtcatttt

SEQ ID NO: 22480 - DNA, 101 bp, rice(Oryza sativa)
  misc_feature (71): n=a or g
ccatatagatgatgacgtggcacgttatttttttctcccttattcctcaatcatttttctcttctttgtcnccgccgtcgtcgaggaagaaggctgcatcg

SEQ ID NO: 22481 - DNA, 101 bp, rice(Oryza sativa)
  misc_feature (71): n=a or g
gatgaaacggtgaagaaacagtagctaaccctggcatcttaatttggtggtactagggatgaaaacggtcngaaacgatcggaaaacagcctcaaccattt

SEQ ID NO: 22482 - DNA, 101 bp, rice(Oryza sativa)
  misc_feature (71): n=a or g
gctctggagttatccgaggcatcgtcgattctgcgtcaatggagggctcgattggttcaaattgtttccgnttccatgtaaaagtttcagaattgtgacgc

SEQ ID NO: 22483 - DNA, 101 bp, rice(Oryza sativa)
  misc_feature (71): n=a or g
aatctgaaaatttgcatgacgaatgagagcaaatgtaggggaaccaggcataaatggagagtaggtaatgnccatggaagagggcagatgaacacggggat

SEQ ID NO: 22484 - DNA, 101 bp, rice(Oryza sativa)
  misc_feature (71): n=t or c
gcatcaggagtggttatgctggctatatttgactcctttaggtctaatcttccttgttgcacacacactcngtaggcgatgccaactctatcggtcaaaag

SEQ ID NO: 22485 - DNA, 101 bp, rice(Oryza sativa)
  misc_feature (71): n=t or c
aacaaaaatagttgttaaggcgagtacgcatgccacgtattgaacttcaatcgggatgagtatgtttcacnacaagaaatagcatttgtaattttagaaca

SEQ ID NO: 22486 - DNA, 101 bp, rice(Oryza sativa)
  misc_feature (71): n=t or c
gtgcacgttataaacgtctgcgtttgtactgtgctttaaaaaaaatcattaatccgctactaatcacaccnatatttttaagtataaaatatacatataag

SEQ ID NO: 22487 - DNA, 101 bp, rice(Oryza sativa)
  misc_feature (71): n=t or c
cttcgcgaggaacaggtgggaaaaatatctcaaaactgttgaaatccatagcactttcttcagcttcatcncaagcattttgtagattgcttatctgaaag

SEQ ID NO: 22488 - DNA, 101 bp, rice(Oryza sativa)
  misc_feature (71): n=t or g
aatctgtaaaaccgcactttccaactcttgtctcggtgtcgaagcatcagctcttggccattattgaatgnaagatacgcatcatcatatagttgagttat

SEQ ID NO: 22489 - DNA, 101 bp, rice(Oryza sativa)
  misc_feature (71): n=t or c
atagagaagctaaaccaagctgcagtccaaaatcaatttttttccctgttcccagcccttatcagaattantgaaagatatgatgagcatatatggattgg

SEQ ID NO: 22490 - DNA, 101 bp, rice(Oryza sativa)
  misc_feature (71): n=a or c
ctttaattggaaagaaatcaactgaggttacacgtcaggatgacagcaatgcaatccattatatcaccccnaaaaaaaaaactcttatccaatcaatctca

SEQ ID NO: 22491 - DNA, 101 bp, rice(Oryza sativa)
  misc_feature (71): n=a or g
ctgtgcgaccagttgttttctcgattctaccttgggctactccaccttgatccccattttttcctcctcanacgcacccttcaagtgtagcaatgtagaga

SEQ ID NO: 22492 - DNA, 101 bp, rice(Oryza sativa)
  misc_feature (71): n=t or c
ggcgcagcaggccctgttatcgtgtacatcttccacaagatgttcccaaacaagaaatggataacactgantaacttaccagtgctcatcggcgcgacagc

SEQ ID NO: 22493 - DNA, 101 bp, rice(Oryza sativa)
  misc_feature (71): n=t or c
aaaatgacgtgcaagatggacgccatcatgttaaagtaaaagggttacacgtacatccacttgccgattcnaattagcctcgccttcctacttcgaggctc

SEQ ID NO: 22494 - DNA, 101 bp, rice(Oryza sativa)
  misc_feature (71): n=t or g
ctggtgggcgactccataatatgttagaattggaggggtggactccaatagtagtccaggcaatgcttaangggataagagggatagaaaagagaagagag

SEQ ID NO: 22495 - DNA, 101 bp, rice(Oryza sativa)
  misc_feature (71): n=t or g
cctcatgccactagtctatgcgatttccaaaaacagaaagaaaactctgcgacaaggaaaagagggtgacncttggataaaagatctgaccatacatacgc

SEQ ID NO: 22496 - DNA, 101 bp, rice(Oryza sativa)
  misc_feature (71): n=t or g
gacaagccaaaatctgcaattttcggtgccatgttctcatctaacaatatattttcgggctttaagtccanatggtaaataggcttttcttgtccattgtg

SEQ ID NO: 22497 - DNA, 101 bp, rice(Oryza sativa)
  misc_feature (71): n=a or g
aacatgatgaagagcctgcttggtgttagcggcaaatgtctcaccaaagttgaaagagtttccaggaaggntcccatgactaacatcagaatcagcaccag

SEQ ID NO: 22498 - DNA, 101 bp, rice(Oryza sativa)
  misc_feature (71): n=a or g
gcgcagggtgacgaatctcgccgccggccagtagctgcaggttggactcgaactcagagaagccaccagcnatgtggggcccacgtttggattcctttgag

SEQ ID NO: 22499 - DNA, 101 bp, rice(Oryza sativa)
  misc_feature (71): n=t or c
gacttgggtgattgctagggtcttcactaactttggttttggctccgtcatgtatattgtctccttgatgngacaagtctggggctggtggtttggcaacc

SEQ ID NO: 22500 - DNA, 101 bp, rice(Oryza sativa)
  misc_feature (71): n=t or c
tgatctccacttcaagcaggcgaagaagcccaagcttaccggcatcagcaacctctcttcgctccggcaantccacgccaccgtctgctgcggtaaagatg

SEQ ID NO: 22501 - DNA, 101 bp, rice(Oryza sativa)
  misc_feature (71): n=a or g
aagcattttaagaagtcaataacaacatccagatcaggagctctgtcaagagctaagatcttcacagtgcncatcacatttgacagactaacaggaaccag

SEQ ID NO: 22502 - DNA, 101 bp, rice(Oryza sativa)
  misc_feature (71): n=a or g
tgcgtcgtcggcgcccatcctttgctgcgcgcgcgtgacggcgtgcgtgaggagggaaaaaaggcagaganagaaagagaacggcgaagagaagaaaccgt

SEQ ID NO: 22503 - DNA, 101 bp, rice(Oryza sativa)
  misc_feature (71): n=a or g
gacagaaatgaggacaatgagcagttagaatcagacacaactcaaagcagtgttgacgatcgactccaacnagcagatcaacagtctgtgaaaggatcaat

SEQ ID NO: 22504 - DNA, 101 bp, rice(Oryza sativa)
  misc_feature (71): n=t or c
aataaataatttcataaatatttgtatctaaccagaggcacatcgggccttataggtaaacccagctcctnctgcaattcagctttacacttggcctaaac

SEQ ID NO: 22505 - DNA, 101 bp, rice(Oryza sativa)
  misc_feature (71): n=a or g
taccacccactgatatcaagtctggatctattagtgaaactgttgagctttctcatggtgagaagagcaangttggccctccccctggccatcgtgccaaa

SEQ ID NO: 22506 - DNA, 101 bp, rice(Oryza sativa)
  misc_feature (71): n=t or g
gagccatgcatccggcactggctgccttacttgctgtcgcctccatgattaactagtggtgctaaactgtntacctctttgttcctaattatgagaatctc

SEQ ID NO: 22507 - DNA, 101 bp, rice(Oryza sativa)
  misc_feature (71): n=t or c
aaaaatagtgggaaaaaaatatttacatgtctctgtctatgccgtttgttttcctctcttgattagagcanccacaatggtaaaataagttgctctcataa

SEQ ID NO: 22508 - DNA, 101 bp, rice(Oryza sativa)
  misc_feature (71): n=t or c
gtaccatggagtatgtcgtagaggctccctttgttagcaaattcataaaccaatattacagcatccagctnacagcagaaacccaacagttggataatgtt

SEQ ID NO: 22509 - DNA, 101 bp, rice(Oryza sativa)
  misc_feature (71): n=t or c
tgtggacgatcggaagagtacctctggtgctctcttcttcctcggctcaagcccggttgcatggcagtccnagaagtagaaagtggtcgctcttgcctcct

SEQ ID NO: 22510 - DNA, 101 bp, rice(Oryza sativa)
  misc_feature (71): n=t or c
ggggagaggaggaacaagcctaggaaggctgcttccaagaagaagaaggatggatggtttgaatcttctcngcgcttcgcttggcttggttgggtttaatt

SEQ ID NO: 22511 - DNA, 101 bp, rice(Oryza sativa)
  misc_feature (71): n=a or g
aataacctcgaaagcacatttgcacatacaaagtcgccactcattaatgttgcgatctttattgctattgncaatagcacctgatgctcatctgggttttc

SEQ ID NO: 22512 - DNA, 101 bp, rice(Oryza sativa)
  misc_feature (71): n=a or g
aatatttttattttttatttcgcatttcagatttaccgtaaattatttttctacatggactgttatcttantattaatttttttcttttgaatacaaagtt

SEQ ID NO: 22513 - DNA, 101 bp, rice(Oryza sativa)
  misc_feature (71): n=a or g
gcaaggttttggtggacaacaagtacatgcaattgggaaaatacgtttgcaaatagtttttgggaaaggcnacaatgcaaggaaggaggaaatagtgtttg

SEQ ID NO: 22514 - DNA, 101 bp, rice(Oryza sativa)
  misc_feature (71): n=a or g
aacataccgtttagccgtatgggtaacgtgtggatgaaaaacgaggaagtagaggatatgaaagtgtaganaggaacacagcctaacaatccatagaacaa

SEQ ID NO: 22515 - DNA, 101 bp, rice(Oryza sativa)
  misc_feature (71): n=a or g
ttcagcccctaatgatgattctgatgtcaccccaagaagttgtgagaagttagagtcgtctgcttcgtcgngcccgcaagaggcgaatgtggccaacaagg

SEQ ID NO: 22516 - DNA, 101 bp, rice(Oryza sativa)
  misc_feature (71): n=a or g
acatcttgatgtggagggatactgtgatgcagatcagggcaactgtcttgatgatagaaggtcaatatcangctattgtgtatttgttcgtggcaatttag

SEQ ID NO: 22517 - DNA, 101 bp, rice(Oryza sativa)
  misc_feature (71): n=a or g
ctttcactgctcctgtgtgcctcaattaattggtacctccttatcgccatcagtgatgtgaaggttgatcngccggctgggatgctgccgcttgcttcttt

SEQ ID NO: 22518 - DNA, 101 bp, rice(Oryza sativa)
  misc_feature (71): n=t or c
acccttctacatcgttcgatgtgtattacaattttgtgctccttcattcacatgtattctatttgtgtttnagcttcagctactctaccgctatcatacgt

SEQ ID NO: 22519 - DNA, 101 bp, rice(Oryza sativa)
  misc_feature (71): n=t or g
cgacagcttcggcttgaaatggccgcggcggcgggagctattccgccggtttatatccttcttctcctccnccggaggaggaggatgaggagggtggcgga

SEQ ID NO: 22520 - DNA, 101 bp, rice(Oryza sativa)
  misc_feature (71): n=a or g
ttcagacatcgtcagatccatgaggaatggatttgctgttcattttcccataatacataggtggagtaggnttgggcacatcaaggattgtctgatggggt

SEQ ID NO: 22521 - DNA, 101 bp, rice(Oryza sativa)
  misc_feature (71): n=t or c
actcgtgcatgatctccaataccatccctagtataatggggaaccacttgaagaacgcttgtctgcggcangggcggtgaaatgggtggtggcggaggctc

SEQ ID NO: 22522 - DNA, 101 bp, rice(Oryza sativa)
  misc_feature (71): n=a or g
gtcgggcaggctttaatttgtagtttgtattacatgcggtgtgtattaggcagggtttaccttaccgccgntaaccgcgcggttaccgggcttaccgcggg

SEQ ID NO: 22523 - DNA, 101 bp, rice(Oryza sativa)
  misc_feature (71): n=a or g
gtggttagcaagtaaatcaatgttatattaaaaaaatatttaccttgctacccaactaagggcctgtttanatcccctggcaagttttttcatcctgtcac

SEQ ID NO: 22524 - DNA, 101 bp, rice(Oryza sativa)
  misc_feature (71): n=a or g
attcatgagctatccacatattcaccaatatgccaggctcaaaataatagccttttgggaacaaaccacanaatgaaaaacattgctgaaggtgctctggc

SEQ ID NO: 22525 - DNA, 101 bp, rice(Oryza sativa)
  misc_feature (71): n=a or c
ccttccctctcgacgtccaatttgggacctcaccagcattctcaccgcggtacctcgttcgccgtgttccntgccggtgctgaacccccaccgcaccatct

SEQ ID NO: 22526 - DNA, 101 bp, rice(Oryza sativa)
  misc_feature (71): n=t or c
tcaagctctcataggcatgtagcatatcactagaatgcatcagctgatgctatagactcggacgtgcatgnaacttactccttgctacctacacgcagcat

SEQ ID NO: 22527 - DNA, 101 bp, rice(Oryza sativa)
  misc_feature (71): n=a or c
tcgcccctttttttgggggacaccaactcttcacccaatcgacgccaacaccaaaagcaacaaaaacaacnaaaaaaaaacccaccaaaaaccttcccaaa

SEQ ID NO: 22528 - DNA, 101 bp, rice(Oryza sativa)
  misc_feature (71): n=a or g
ccgccaatgcgttttttcccctctcctttggtgcgtcaactcgccgagaaatacagccccggcatataagnggaaaaagcgaaacggtagtatttacaaat

SEQ ID NO: 22529 - DNA, 101 bp, rice(Oryza sativa)
  misc_feature (71): n=t or c
atatttttcttcctatgttgttgatttcaaatggatcgtagttggatgtaccatgttcatcgttcgtccanagagtatagagagggggtcaatgaatttgt

SEQ ID NO: 22530 - DNA, 101 bp, rice(Oryza sativa)
  misc_feature (71): n=a or g
ccgacacatttgctagcgcgaacaaccttggtgcattctgaaccgaggaagattgcaagcagagatggcancatagtatccctcaaatattagtgctgcaa

SEQ ID NO: 22531 - DNA, 101 bp, rice(Oryza sativa)
  misc_feature (71): n=a or g
ggtcaaagtcaaacactatcggcctctcattcccagcagcaccttgggtcaacgaggatgcgacatcggtngcagcctgagccgacgaggagggaacgtcg

SEQ ID NO: 22532 - DNA, 101 bp, rice(Oryza sativa)
  misc_feature (71): n=a or g
caactctttaaaccttaattaacaaagtcatcacaagcttgagaaacatttttttcaacattaaggaaccntaagttcataaccatatattcagggaatgg

SEQ ID NO: 22533 - DNA, 101 bp, rice(Oryza sativa)
  misc_feature (71): n=t or c
ctttgacgcattagtatctgccttattatgtaacgcacagtccaatttggcaaaatagcatgcataactanttttaaggattaaataattataatcattct

SEQ ID NO: 22534 - DNA, 101 bp, rice(Oryza sativa)
  misc_feature (71): n=t or g
gatttgtaattatgacactacaaacattaacaatgcatacgagggagagaggagagagaaagtaaagtagngggaagtaaagtagtgggaaaggataggaa

SEQ ID NO: 22535 - DNA, 101 bp, rice(Oryza sativa)
  misc_feature (71): n=t or c
atagcatcattctttggtcgaatgacattcttcacgcagtcaattggtagtatatgctcatggttgcctgnagatgcctcgatttgttcctggctcctcct

SEQ ID NO: 22536 - DNA, 101 bp, rice(Oryza sativa)
  misc_feature (71): n=t or c
ttttcttacacgagatatcgctttattatgattcgtacaatatcatacttttgatgcaagttgactccgcngccgccacgactcgatcgagcaggcactcg

SEQ ID NO: 22537 - DNA, 101 bp, rice(Oryza sativa)
  misc_feature (71): n=a or c
cgtgcttgggtgtgcgccaactcacacaatcgtgaaatcatacttggcacagatattgctgaggcaatcancaccacagaatcctatcactttcttgctaa

SEQ ID NO: 22538 - DNA, 101 bp, rice(Oryza sativa)
  misc_feature (71): n=t or c
ataggattcgtgtgtcgaaattaaatagggcctggaatccttaaagattggtgcatcacctatcatattantccctccattctaaattgatctacatattt

SEQ ID NO: 22539 - DNA, 101 bp, rice(Oryza sativa)
  misc_feature (71): n=t or c
tttgcccatttaaaccaaccgttttgttaaccattttggttggcatgcaagcacatgtaaatagtgcaacnaattaggaaatcgcctcgttgtgcccgttc

SEQ ID NO: 22540 - DNA, 101 bp, rice(Oryza sativa)
  misc_feature (71): n=a or g
gaaggggaggccggcggtggctagagcacatgggagaacgaagggagagcatgtggagggctggttgcccntttcctcgtcgttcgccgcgaggcgctggc

SEQ ID NO: 22541 - DNA, 101 bp, rice(Oryza sativa)
  misc_feature (71): n=t or g
ttcaaaaatttacaatagtagttgcccaccaccctctgatctgggagggagcgattttaatgacgtggcanacggccgtcgcctcacaagtaacggccaac

SEQ ID NO: 22542 - DNA, 101 bp, rice(Oryza sativa)
  misc_feature (71): n=a or c
gaagagatgccaaacagtattgcagaaatgaaacgaacagccaaattaaccacacactcaccgaatctggncggtttcttgatgaagtcgatcaccggctt

SEQ ID NO: 22543 - DNA, 101 bp, rice(Oryza sativa)
  misc_feature (71): n=t or g
ggtcgggagttattgcctattggggagaacggctgggaatatatgtgattgtgatatgatttgtttttttnagagcattgctagcaatcctgaggctagcc

SEQ ID NO: 22544 - DNA, 101 bp, rice(Oryza sativa)
  misc_feature (71): n=t or c
tcaactacaaaaagaaacccgtcctgatcaatatagcaaaggtcaccagttttcagccatccttcagaatnaaaggtggttgcattggcctcgttgtcacc

SEQ ID NO: 22545 - DNA, 101 bp, rice(Oryza sativa)
  misc_feature (71): n=a or c
tgttatgcacttcctgtgctgctctgctctataaatcacacctgcaaacatggagcttgcaaaagaatganaataacttctctgtactatgcctgtttctt

SEQ ID NO: 22546 - DNA, 101 bp, rice(Oryza sativa)
  misc_feature (71): n=t or c
tctctcaactcgccatttagattatctatagtattcttggcgcagaatttcgaaccccccatggtgtcctngaagtaacaattgaggttcttcacctccaa

SEQ ID NO: 22547 - DNA, 101 bp, rice(Oryza sativa)
  misc_feature (71): n=t or g
acaatggttgcctttggagcttccgattttggcgtgagatcatggaccatgtaggcagccgaggcccaaanctatgtaaaatcaaaggtgtttttgattat

SEQ ID NO: 22548 - DNA, 101 bp, rice(Oryza sativa)
  misc_feature (71): n=t or c
agaggggttttggtcctagctggtgtacatgtggcattaatctgattatgtggcaatctagtcaataatantattaaaaatataaaaaaataattattcac

SEQ ID NO: 22549 - DNA, 101 bp, rice(Oryza sativa)
  misc_feature (71): n=a or g
ctgtgttcggttgtctgccacctttgcaaactcttactggttgtctggtgacttgtttagctggcttgtgnctttaggaagggaaagtgtgtgaaattgca

SEQ ID NO: 22550 - DNA, 101 bp, rice(Oryza sativa)
  misc_feature (71): n=a or g
cacgcagccaccaacaccatctggcggtagtcaatgcccaagagaaaatgtaattgcacttaatgtgtgcncacaacttgatttgtccacgctgctcaaca

SEQ ID NO: 22551 - DNA, 101 bp, rice(Oryza sativa)
  misc_feature (71): n=a or g
gatgttacacaatgtcagggaatcagtgatctacttttactgtagagagacagctcaattcttcagcagcnactacagtcaatgtctcaagcattagactt

SEQ ID NO: 22552 - DNA, 101 bp, rice(Oryza sativa)
  misc_feature (71): n=a or g
gtatttttattataggcttatttggtcgtttcttcgtgtgcgtacgttagatagcgttgaagatcccaccngactcacaggaactgaagtgggcctagaag

SEQ ID NO: 22553 - DNA, 101 bp, rice(Oryza sativa)
  misc_feature (71): n=a or g
tgacagataccttgctggctggcaagctcgccttctatcatatgcggagagattagtgctggtgaatgctntcctggacatcatacctgtatacgccatgt

SEQ ID NO: 22554 - DNA, 101 bp, rice(Oryza sativa)
  misc_feature (71): n=a or g
tgaatttgctactatctctagaatagtgttcaagttctttgttgattctccagctgagccagccagagccntacgggtggttgatgacagttgcatagcac

SEQ ID NO: 22555 - DNA, 101 bp, rice(Oryza sativa)
  misc_feature (71): n=a or g
aaatctcagtctaattgcaaggattctcgatcgagagattccatatttggtagagcattcggatcacgagncaccgtgcaccattttcttgacaagtgtgg

SEQ ID NO: 22556 - DNA, 101 bp, rice(Oryza sativa)
  misc_feature (71): n=a or g
tctgtctgcagggtgataaacaaagtggtagtaatgatagtggatcaacatctgcgggtcaatctccacgncttaaatcttttgccagtagatcttttgtg

SEQ ID NO: 22557 - DNA, 101 bp, rice(Oryza sativa)
  misc_feature (71): n=t or c
cacgggttgccagaggctctcatttcagatcgtgatagaatttttactagcacactttggacgacactatncaaattggctggcactcaactgcgaatgag

SEQ ID NO: 22558 - DNA, 101 bp, rice(Oryza sativa)
  misc_feature (71): n=a or g
aacttcttcaaaagataggtatggatgttgatttccgcaagtttggaatgctgtaggatgggagaactgtnctgtggtagatgagcctggttctcatttgc

SEQ ID NO: 22559 - DNA, 101 bp, rice(Oryza sativa)
  misc_feature (71): n=a or g
atctctctcaagacattttcttaagcaacgaggcttctctcttcaaatttcaatttctttccccccgaacnctctgccaccaccatctctagcggcttacc

SEQ ID NO: 22560 - DNA, 101 bp, rice(Oryza sativa)
  misc_feature (71): n=a or g
gctgaagacatgatacgctgagattatggagctaaaaccaagagcaacgaaagctaagaatgccatggagnctgaagcattgataagtttggcaaattgat

SEQ ID NO: 22561 - DNA, 101 bp, rice(Oryza sativa)
  misc_feature (71): n=a or g
tccggacgaatcttcccctcgctttgagttgaaagcagtagagcatcttgaactggccgccttctcccctntttgaggtttgtgtttaattcctgaaaaaa

SEQ ID NO: 22562 - DNA, 101 bp, rice(Oryza sativa)
  misc_feature (71): n=a or c
aaaattcctatgaatgaacaacactatagagttttcggaggaaagttaataaaagctttaacgttttgaanatttttcttcaagtttatctgcctcattca

SEQ ID NO: 22563 - DNA, 101 bp, rice(Oryza sativa)
  misc_feature (71): n=t or c
gtccattattatgcccatgagagttacatgatgaaaaaaacatactccctccataaaaaaagccaaacccnaaaccctaaattttcgtgtccaacatttga

SEQ ID NO: 22564 - DNA, 101 bp, rice(Oryza sativa)
  misc_feature (71): n=t or c
tggaccttgctctttgcagatgttaggttgccctcgatgtgtggcaagctcagttcaattgctagtggctncagggtatcatcatcacgtaagaacaacag

SEQ ID NO: 22565 - DNA, 101 bp, rice(Oryza sativa)
  misc_feature (71): n=t or g
gtgtgcgcacggaatatcctgtgatggcgttgactgtgcttctgagtcatctgttccagagtcttcacttnaaattgtgttggcagtagcagttgttgcgc

SEQ ID NO: 22566 - DNA, 101 bp, rice(Oryza sativa)
  misc_feature (71): n=a or g
agcacaagaagattcaaggcgcaggtcgagggcctttttcagagcagagctgatgaagaagaagaagtttngattggcccaaagtttaaaattttgttgaa

SEQ ID NO: 22567 - DNA, 101 bp, rice(Oryza sativa)
  misc_feature (71): n=t or c
ggatgcaaacttttgtgtgattggggtattcttcccatccgatagccaaaatcagagcccaaactttgtgntgtgtcatcaaacccgaacaaatcattgat

SEQ ID NO: 22568 - DNA, 101 bp, rice(Oryza sativa)
  misc_feature (71): n=t or c
aaccaaaacatataccagaggcaaatcagctttaagtttgacaaaatcttgtcgcgctttggagaggcatnaaccactcaacgaaaatataacttagcgaa

SEQ ID NO: 22569 - DNA, 101 bp, rice(Oryza sativa)
  misc_feature (71): n=t or c
caagaggcagaagtttgaggtggctatgttgagcagcataaactgattgtgggcctgtgacaacaagcacnctaattaccgaaacattgtccaagtgtcca

SEQ ID NO: 22570 - DNA, 101 bp, rice(Oryza sativa)
  misc_feature (71): n=t or c
agttcaggatgagagattacctgaagaagacttcatagaagatccggacatagcaaattcaaaggggaggncaagacaaagatataaaacaattagagagc

SEQ ID NO: 22571 - DNA, 101 bp, rice(Oryza sativa)
  misc_feature (71): n=t or c
ttctcgaactcaccggccttaaaacacccaccgaggagtgcattgtaacaaacgacatcaggctgaactcnactcctcggcatttcgtcgagcaggtcgag

SEQ ID NO: 22572 - DNA, 101 bp, rice(Oryza sativa)
  misc_feature (71): n=t or c
cgtaccccagtctgttactgctaataagacaacaccacctccaactgctgtggacattttcaagcttaccngctcagaccttggtcgactgcgttcgcagc

SEQ ID NO: 22573 - DNA, 101 bp, rice(Oryza sativa)
  misc_feature (71): n=t or g
aaaataaaatagctatgttatcaagccggtgaacttcatcgtatgccaaggttttaaagcgcatatggatncaacagaactcttgacaattagttgggata

SEQ ID NO: 22574 - DNA, 101 bp, rice(Oryza sativa)
  misc_feature (71): n=a or g
catggtccacttttcatcagaccactcatacagcctcaaatgtccatcgtactctaatcttatgtactggntggacttcgcttctggcagtgcaataatgg

SEQ ID NO: 22575 - DNA, 101 bp, rice(Oryza sativa)
  misc_feature (71): n=t or c
cgtaatcatggaccagagtactacgtattcgaaagacattaatctcgatcgtacagtttcaagttctagcnaatattaccatgtttgtgagattagacacc

SEQ ID NO: 22576 - DNA, 101 bp, rice(Oryza sativa)
  misc_feature (71): n=t or c
tgatgtgcttgattaagctttggataggatcggtttctttctgatggctgtctgccattttcaggtgcggnaccagagcagaaagaggctggccgagcagc

SEQ ID NO: 22577 - DNA, 101 bp, rice(Oryza sativa)
  misc_feature (71): n=t or c
ttgatcaaaaaatgaaaccattcctttacttccagatattccaaggagcataaagaaacttctccatgaanagctcccctgataatccaacttagccctta

SEQ ID NO: 22578 - DNA, 101 bp, rice(Oryza sativa)
  misc_feature (71): n=t or c
tagcagacactttttcatcttctcttttttgcctttcccaacccatccccctttcccaaccatccctaccngatcccctctcctctctcctcctcgcgacc

SEQ ID NO: 22579 - DNA, 101 bp, rice(Oryza sativa)
  misc_feature (71): n=t or g
cgccttcccacgcgctgggatcacgtttagggtttttgaatggggtaccaggtgccccgggggcgcgtgangcttcggcgttcactacggccggcttcctc

SEQ ID NO: 22580 - DNA, 101 bp, rice(Oryza sativa)
  misc_feature (71): n=a or c
gattgcagcatcatcaaactctcagcagatactgcaatctgcactttccaagtttgctgctgaggaagccnaaaattcatccgaaactcaccaggataaga

SEQ ID NO: 22581 - DNA, 101 bp, rice(Oryza sativa)
  misc_feature (71): n=a or c
ctggcatcatccaaggcgccaagaatgcggccatggttgacctcggtgttaacgaaggtcaccttgacgcnatgctcgacgaggcagtgggcgagctccat

SEQ ID NO: 22582 - DNA, 101 bp, rice(Oryza sativa)
  misc_feature (71): n=a or g
tacaataatctgatgagatgtgggattactggtttctttggtttcttggtgagtttcagctaccgagttgntagttatcacccttgtgaaaagacttttag

SEQ ID NO: 22583 - DNA, 101 bp, rice(Oryza sativa)
  misc_feature (71): n=t or c
ttttattggtttagacttttagtggctttagagcattaaatttaatggtgaagaagtcacactcctacttnaaataagtcaaaaataggttgttcaactca

SEQ ID NO: 22584 - DNA, 101 bp, rice(Oryza sativa)
  misc_feature (71): n=a or g
tgtaagcagtggtatgctgttcactacaccggaaggtgaaagatcccttgaggagagtagagttaacaatnacagcaactctaactgggtaagttaatggc

SEQ ID NO: 22585 - DNA, 101 bp, rice(Oryza sativa)
  misc_feature (71): n=a or g
gtttagaaatgatgtacaaaaacaaatatgccaacgaaagaaaggatgtaagacgccaagaaaataagaantaattatcatttaagttaatggaaagatag

SEQ ID NO: 22586 - DNA, 101 bp, rice(Oryza sativa)
  misc_feature (71): n=t or c
aatagattggcatgatctttgatggaaaattagttgtggttggttacctggaagaagatgtcagtgggcangcgcagcgccttgacggtccagtaggcgac

SEQ ID NO: 22587 - DNA, 101 bp, rice(Oryza sativa)
  misc_feature (71): n=t or c
ccaaccttggccaacacttgatagggtccaaaatagcgaaaagatagcttatgatttgccctccgtgaaanagatgattgcacataaggttgtaatttgag

SEQ ID NO: 22588 - DNA, 101 bp, rice(Oryza sativa)
  misc_feature (71): n=t or c
acgaagtgggcttgggttgtacactttgtacacaggtaaggtattattgggcttttgggctgtctcaactntgttcgctaatcatcacaatcacaagtgaa

SEQ ID NO: 22589 - DNA, 101 bp, rice(Oryza sativa)
  misc_feature (71): n=t or c
agtgaaaatgatgcccggctttgattgggtctatgctgggcaactagattgaaaggaactaataagaaacnaaagttggcgtaaaaggcgccattagagct

SEQ ID NO: 22590 - DNA, 101 bp, rice(Oryza sativa)
  misc_feature (71): n=t or g
acttctgagagaatttctgtggagttatctgggaaaacaatggcccgtgttctacctttggcatttccacnaagcggggaaacaaaacctaatatattaac

SEQ ID NO: 22591 - DNA, 101 bp, rice(Oryza sativa)
  misc_feature (71): n=t or c
agtcgtaaggtaaggtgcctaacattttatcgaacgcttgcaagtcgagcagtacaccgggacttcgtcanaggcagccggcacgtcgagtcagggtccac

SEQ ID NO: 22592 - DNA, 101 bp, rice(Oryza sativa)
  misc_feature (71): n=t or g
aacaatccaaagaacctgaattgcacgagaagctcctctaggtatgtaaaagcaatgttcaaggacccaangttgtattccactacctacagaacccacaa

SEQ ID NO: 22593 - DNA, 101 bp, rice(Oryza sativa)
  misc_feature (71): n=t or c
tggagcaaaatcctgctggaaccttggggaaaagtaatggtaagttacaagaggaggaggctccccacagnttagtagagaaattaatatacatggttatc

SEQ ID NO: 22594 - DNA, 101 bp, rice(Oryza sativa)
  misc_feature (71): n=t or c
acttttttatgcacataaggatttgtatttctattaaggcccagttcgggaggtagagccgcacgaaaaanggtgttgcccatttaacacatgattaatta

SEQ ID NO: 22595 - DNA, 101 bp, rice(Oryza sativa)
  misc_feature (71): n=t or c
accttaaagatgagctagagtaagtaatcagtggaggagtattcactaatcagctagcacgggtgcaacangctctcgtgaccacccccccatcccctctc

SEQ ID NO: 22596 - DNA, 101 bp, rice(Oryza sativa)
  misc_feature (71): n=t or c
tggagcttttgcagtctgctgatatcaccttgttgtatctgttctaagagcaagttaatagagccgccggntgccagttgcaaaataatacacctcagcaa

SEQ ID NO: 22597 - DNA, 101 bp, rice(Oryza sativa)
  misc_feature (71): n=a or g
ggaagctttcgccacatgcccttctctatccaattgaccctccaagtccaccatcggccccaacatcatcnatggttctactgagctcccgccaccttcac

SEQ ID NO: 22598 - DNA, 101 bp, rice(Oryza sativa)
  misc_feature (71): n=a or g
gcaaatggtgcatcttgcctaatcatagtaaaaatagaaaaactggcatgattgttggtgtcaccccactngatcagaagataagtaaaatagaaatgact

SEQ ID NO: 22599 - DNA, 101 bp, rice(Oryza sativa)
  misc_feature (71): n=t or c
ttttcacgttttataaccgtcatacctgtcctatgaatagagttcttcacttcacttctcacacgcactcnaagcttgagctgaattataagatgatctat

SEQ ID NO: 22600 - DNA, 101 bp, rice(Oryza sativa)
  misc_feature (71): n=t or c
ctgacatttacctatcctcacactagaagatgtgacagtttcgttgcccttatttatcaaaagaaaggttntttaaaaaattctatgattatcaaccttca

SEQ ID NO: 22601 - DNA, 101 bp, rice(Oryza sativa)
  misc_feature (71): n=a or c
atccatccaccttcttattattaggttgtaggctgccatttttctaccagccatttacaagattgccaacnagattcgctctgctctcgtagccactttac

SEQ ID NO: 22602 - DNA, 101 bp, rice(Oryza sativa)
  misc_feature (71): n=t or c
cctacggatgctactggtctagccaagcatttggtgattgtatgcagaaaggcagcagacgcattcctgangacagctggtacacgattttattgttctcc

SEQ ID NO: 22603 - DNA, 101 bp, rice(Oryza sativa)
  misc_feature (71): n=t or c
ctattcgtggtgaaataccatttgataatttgtaaatatcaaacgtcctggcctagttgtgtccaaattgntgaccttggttcatgcactggcgagtttgt

SEQ ID NO: 22604 - DNA, 101 bp, rice(Oryza sativa)
  misc_feature (71): n=a or c
gaaatggagctatgaagaaactagacgtgttcaaccggcagctcattcagtctagttggaaaaatagctcntgtttaatgtcaggaatcaggatatgtggt

SEQ ID NO: 22605 - DNA, 101 bp, rice(Oryza sativa)
  misc_feature (71): n=t or c
tattttccgtgctcaaaatattgaacttacaagcagatcaaaatcatgatcgcaggagtatctccaacagngatagccgttcaatcaccctacattgctca

SEQ ID NO: 22606 - DNA, 101 bp, rice(Oryza sativa)
  misc_feature (71): n=t or c
gaaactctagctgcagaaaaaaaaacaaaacaaaatgtgtcctaccaacaccatcccttgagggcaatggngcatacagtacattttaaacttattcactt

SEQ ID NO: 22607 - DNA, 101 bp, rice(Oryza sativa)
  misc_feature (71): n=t or c
gggcacaaatttgctgtttcttccagagttcttgctgtatacgtgcatgatggcatcatcatgttttgctnaccagttcaacccaagcgaggaagcagagc

SEQ ID NO: 22608 - DNA, 101 bp, rice(Oryza sativa)
  misc_feature (71): n=t or c
ttgccaataagaatcatgaacgataattcaatttttgaaactattctcgaaacaccataaggtttctaccntagttttgaagtccaatattgattttgccc

SEQ ID NO: 22609 - DNA, 101 bp, rice(Oryza sativa)
  misc_feature (71): n=a or g
ttatacttaaatgggtcagaggagtactgaccaacttgacacgggataaaaaaatgctttgccatagtatnaaaaaaattacaatgatcttgcagacatac

SEQ ID NO: 22610 - DNA, 101 bp, rice(Oryza sativa)
  misc_feature (71): n=a or g
cgcccgacattatgggatccaaaatcttggaaatatgctattcctggctgtcggtgagccagcgcacttcngtgatgacctaaatttggagaaatcaggag

SEQ ID NO: 22611 - DNA, 101 bp, rice(Oryza sativa)
  misc_feature (71): n=t or g
cgcgatcacgaagctctgcagatgttggacatttcattcttcagatttatacagcagcagttaagcagatnatgacattgttcgattttgttaaatttcat

SEQ ID NO: 22612 - DNA, 101 bp, rice(Oryza sativa)
  misc_feature (71): n=a or g
cttctatgcataggatatgttgccatattttagtatacactttcagcccagcaagctccaggtgcttgtantcatcgtgcaaccacaactcacatagattt

SEQ ID NO: 22613 - DNA, 101 bp, rice(Oryza sativa)
  misc_feature (71): n=t or c
atgcatcttatcctgtccattttgccattgcactcccgtggctgtgaagatgtcaaatatatataatgttntagtagaagaatcaaatgctactagcacta

SEQ ID NO: 22614 - DNA, 101 bp, rice(Oryza sativa)
  misc_feature (71): n=t or c
tttagctcatatataataatccactcattcacattttccaatcccatcccttataagttataacccattgncaaagagggcctaaatagatttctttagcc

SEQ ID NO: 22615 - DNA, 101 bp, rice(Oryza sativa)
  misc_feature (71): n=a or g
acaggttctgcatttgctccagtgaccctaatattgtggtcatgtcttcttcgtgcataatgtccggaatnatggcgtgggttacgctttggttgtggaca

SEQ ID NO: 22616 - DNA, 101 bp, rice(Oryza sativa)
  misc_feature (71): n=t or c
gcggtcgccgaggccggcgcggaggcagaggcgaacactgtagtaggcttggatgccgaggtcttggaganggtggcggaggcaaaggccttggagacaat

SEQ ID NO: 22617 - DNA, 101 bp, rice(Oryza sativa)
  misc_feature (71): n=t or c
agatgaaagaatcacaaatcacagatccctcaacaatttcatagaaacaatcactgttgccactgcgtcgnaggatccatcgcaagacccgccgcagacgc

SEQ ID NO: 22618 - DNA, 101 bp, rice(Oryza sativa)
  misc_feature (71): n=a or g
ggatgagttggaggatattgggatgcaaattgtggacaggtgtgatggtttaccgctcgcgattaagatgnttgggggcctcttacttagtaagagcagaa

SEQ ID NO: 22619 - DNA, 101 bp, rice(Oryza sativa)
  misc_feature (71): n=a or g
gtgacgaagaaatgtttcggatgatagtgagtgacttgcacatcccgccgatggatccggcaagcacagcngaggtcatcggcaaagaccccctcctccac

SEQ ID NO: 22620 - DNA, 101 bp, rice(Oryza sativa)
  misc_feature (71): n=t or c
ttagcagtagatcactggagatcctatttgcagcatggggagtttgtcattctcattgatcatcatagccngatgcatttatcagatcaaagactgcacac

SEQ ID NO: 22621 - DNA, 101 bp, rice(Oryza sativa)
  misc_feature (71): n=a or g
agcaatgatagtgtttttagtacaacaaatttacgatactcaactttacttgtttttaataggatgacttngacgagtctacaggtcgggctcccgatcga

SEQ ID NO: 22622 - DNA, 101 bp, rice(Oryza sativa)
  misc_feature (71): n=t or c
cgcactgtgcatgcatgcatggcgtatgtcagatgcaagtatttttctactttctatctcttttccttttntaaaaaatgtgtccaatatataattctaga

SEQ ID NO: 22623 - DNA, 101 bp, rice(Oryza sativa)
  misc_feature (71): n=t or c
ttgcatgcaggcggattaaggaagaaatggttaattgctcctcttttcatagtttcagatatcctctctcnggctcagttaatttttgatacacgtttgac

SEQ ID NO: 22624 - DNA, 101 bp, rice(Oryza sativa)
  misc_feature (71): n=a or g
aaccaacatcaatcacagacatcacacaacaaacattgaaataaagatcaaagaaatcacagacatcaccnctgctcaccgtcagcgtctaccagatccgc

SEQ ID NO: 22625 - DNA, 101 bp, rice(Oryza sativa)
  misc_feature (71): n=t or c
tctacgtgctatgggatttgacaacacaacaaggatctaccttgctcctagcaagctctttgctggggatngcctcatgatcacgaagccattcgaggcca

SEQ ID NO: 22626 - DNA, 101 bp, rice(Oryza sativa)
  misc_feature (71): n=t or c
caattcttcagccgtattacggagtagttatatgttgctagctgcaacgtataacactcctatcctaagcnactttacatatcattattgcatcctggaac

SEQ ID NO: 22627 - DNA, 101 bp, rice(Oryza sativa)
  misc_feature (71): n=a or g
ttaattgataatatgtggggtttttttaattgagtggatatattgcaggtcggggagtgtttgggatggcnctgcctggttgtccagagacgttccagtca

SEQ ID NO: 22628 - DNA, 101 bp, rice(Oryza sativa)
  misc_feature (71): n=a or c
cagtagccgacaaagctgatagggaaattcgtggagaaaatggaggcaaattgctttcaatgattcagtgncagtaaagcgaaggtcagctggctctgtgt

SEQ ID NO: 22629 - DNA, 101 bp, rice(Oryza sativa)
  misc_feature (71): n=a or g
aatcagttgtttctgtttgttaatgcaggctaagatgttttactacaattcttcagctttgcttgagcccncgacacgatcatcattgtcgaaagcaattg

SEQ ID NO: 22630 - DNA, 101 bp, rice(Oryza sativa)
  misc_feature (71): n=t or c
tgtaagtagcatgtaaccgtgatttcccttcaaaaacttgagttggcttagtggtttggacgctgccctangtaaaatggtgggggatttacaattataac

SEQ ID NO: 22631 - DNA, 101 bp, rice(Oryza sativa)
  misc_feature (71): n=a or g
cccaaggtatcgaccaccggcaccgcgagttccttaaggccgccaccgcttgcgcgcctcgacaagctctngggcaagcccgacgtcttccgctaccgccg

SEQ ID NO: 22632 - DNA, 101 bp, rice(Oryza sativa)
  misc_feature (71): n=a or g
attgcaaatcgaccgtacaaaagcaccaacatcctagttgcgagtcattcccaaatcgaaaggactcgaanttgtccaccaagaccaacaactaaatcgca

SEQ ID NO: 22633 - DNA, 101 bp, rice(Oryza sativa)
  misc_feature (71): n=t or c
ccactctaagattgtgtttggctcttcttttcccaacctttattttcttatttttcatgtacatattttcnggattgctaaatggtgtgttttgtaaaatg

SEQ ID NO: 22634 - DNA, 101 bp, rice(Oryza sativa)
  misc_feature (71): n=t or c
ttgcttggaaccaacatctatactcctttaagctagctacgtcgaaaggacaatcctcttgaacgattgtngcttcaatcccatcatattgttgcacatat

SEQ ID NO: 22635 - DNA, 101 bp, rice(Oryza sativa)
  misc_feature (71): n=t or c
aacaagcagcaacattggcactgattatacctctagtgaatcagttgtttttttcctcggcgttagtctcntctagtgaatctgcaacaaatgtgttgttg

SEQ ID NO: 22636 - DNA, 101 bp, rice(Oryza sativa)
  misc_feature (71): n=a or g
aaaacatcatgtgcatgttcaaaaacataccttgctggtatatcacagccaaaatcaaattggccagtttnttaaaaaaaatcaatcaggccaaagaaaaa

SEQ ID NO: 22637 - DNA, 101 bp, rice(Oryza sativa)
  misc_feature (71): n=a or g
ctcgttggccgtgatcctattttttaaagcccctcccatttttgcacgtagacgtcttaagtccttgtctntaaaaactgatattttacaggcaagatata

SEQ ID NO: 22638 - DNA, 101 bp, rice(Oryza sativa)
  misc_feature (71): n=t or c
gaataaagagaagtggggtcttgaggaggaagtcggagataagccttcccctctagtagaattgtggatcngctgatcttggcccaatctaaataggtggc

SEQ ID NO: 22639 - DNA, 101 bp, rice(Oryza sativa)
  misc_feature (71): n=t or c
cctgtgtcgatcgccgtcctgatcttcccgtccgtcaacgagatgagcttgccaatgtcgtcaatgtaggngtcggcgcctcgcgggaacatggtgccgcc

SEQ ID NO: 22640 - DNA, 101 bp, rice(Oryza sativa)
  misc_feature (71): n=t or c
caaactaatgctactgcacatcaacgaaatcacattagggacagcgatcaagtgctactgcacgcactttngctaaactaaggtccaacaggatcgaagtt

SEQ ID NO: 22641 - DNA, 101 bp, rice(Oryza sativa)
  misc_feature (71): n=a or g
ttggccctcggccccctgcgaatccgtaaatcagagagcatgccgcaaaaaaaaggatgtaccaaatatcntgtctcggtgtcgctatcattttggatctc

SEQ ID NO: 22642 - DNA, 101 bp, rice(Oryza sativa)
  misc_feature (71): n=t or c
aagcttccattgcaagtgacagtgagtgagccttgttcccaaattgtgtcttgtgtggatgaagctaaaanagtggttccactgagtatggttttacccac

SEQ ID NO: 22643 - DNA, 101 bp, rice(Oryza sativa)
  misc_feature (71): n=t or c
cttagttttcaaccaacttgtagccaactttatgtcttggccccttttcagaatgcaagaatgataaaaanacaaaagagagggttgcagaacatataaaa

SEQ ID NO: 22644 - DNA, 101 bp, rice(Oryza sativa)
  misc_feature (71): n=t or c
tgcctttagaaacgcatgtcccagtactaatgtctcaacttgagaacacttctagaagtctagctgtccantctctgtgtgcgcctgcggttcgaggcttt

SEQ ID NO: 22645 - DNA, 101 bp, rice(Oryza sativa)
  misc_feature (71): n=a or g
catgacataccgacagtcatactgcctttttaacggggaaagctgagatgattatactaagcttttcttangcactgtttgattcagcttagcattattat

SEQ ID NO: 22646 - DNA, 101 bp, rice(Oryza sativa)
  misc_feature (71): n=a or c
gcatagtatgaggttaactgtcagccaagaacatgctagcatatcatcgtgtgataaatgatgtactgaanttgttatcttgtggctacagattcaattga

SEQ ID NO: 22647 - DNA, 101 bp, rice(Oryza sativa)
  misc_feature (71): n=a or g
atatatttttggacggaggagtaagagaagatattaacttattaaggcctgcagtgataaggaaagttatnctttttatttcattccattgcattctgtag

SEQ ID NO: 22648 - DNA, 101 bp, rice(Oryza sativa)
  misc_feature (71): n=a or g
ttccctgtttggtaaagtgattaaagctcagcttgatgataatgtgaggggaagattgctggttaaagctntgtactcttctacccttcaagttcctagaa

SEQ ID NO: 22649 - DNA, 101 bp, rice(Oryza sativa)
  misc_feature (71): n=a or g
taaacaagtcttatatggaaagaacgaaatgctagcatatccgagcaaaaatcaaagtcggagcaggtttncaacgcgatcagggaagagattctgatgac

SEQ ID NO: 22650 - DNA, 101 bp, rice(Oryza sativa)
  misc_feature (71): n=a or c
caggcgacactgctttttcccttcgatgcattgtcatagctccttctccactgccacctcctcctgtttangcgacccgtcaccaagaccagggcagcaag

SEQ ID NO: 22651 - DNA, 101 bp, rice(Oryza sativa)
  misc_feature (71): n=t or c
tgtagcctaccatttcaagcccattgcacgtgagagttctgaccacttaattgtttgatttctatcctcanacgacgcctccaactgaaagtaaaagttta

SEQ ID NO: 22652 - DNA, 101 bp, rice(Oryza sativa)
  misc_feature (71): n=a or g
agagaagagagattctaggacaacaggtagccacttcgtttctccagggggagtgaaagatgacaagaatnttgttctggccttgcgtgacagatggggga

SEQ ID NO: 22653 - DNA, 101 bp, rice(Oryza sativa)
  misc_feature (71): n=t or c
ctttctggcctgaggctcaggacttcctagcagtttcataggctgaacagatagttctgttagaaacttcngggctaagggcccaaaaattctgactttcc

SEQ ID NO: 22654 - DNA, 101 bp, rice(Oryza sativa)
  misc_feature (71): n=t or c
cccccgccatatccccaggttccttgagtcgttcgagacgtgcacccataacctggttctaaaattattcnttgtatcatggtatatcttttgagcgagtg

SEQ ID NO: 22655 - DNA, 101 bp, rice(Oryza sativa)
  misc_feature (71): n=a or g
ggcccattgtttgggccctgatcgagctgttttaacgggctaattagcaataggaaaaagtgcaccgaagntccctcaacttatagtcgggataaaaaaca

SEQ ID NO: 22656 - DNA, 101 bp, rice(Oryza sativa)
  misc_feature (71): n=t or c
ttgggcattcctattcacacaagaaagctgcgcaaaattgatcttcaaccgctggtagataaagtgggttnaagaatccctggatggaaagggcgcttctt

SEQ ID NO: 22657 - DNA, 101 bp, rice(Oryza sativa)
  misc_feature (71): n=t or c
tatgctatattcttggcagttcttggtctcgtcttgtttgcgcatttgattggaaatgtgcaggtactttnatggtgtaaactccatttacaaattgttaa

SEQ ID NO: 22658 - DNA, 101 bp, rice(Oryza sativa)
  misc_feature (71): n=t or c
acatgcatgagagccagggactgttgctagctacgtacgaatcacatgcaacgcatagcaaccactctgcntatcgtatgctttttaatatataaatgctg

SEQ ID NO: 22659 - DNA, 101 bp, rice(Oryza sativa)
  misc_feature (71): n=a or g
agggattatatacggtgcatccatctttatgaggaggagtttataggggaggaggtgaggacaagtgctanagattatatacgatgcattcatctttagtt

SEQ ID NO: 22660 - DNA, 101 bp, rice(Oryza sativa)
  misc_feature (71): n=t or c
ggtaaaaccacaacttcaaaataaaaactctaggtcccatcaagactacaatgcagtatcatctacgcatnaattatagaactaaaatgattagtagtact

SEQ ID NO: 22661 - DNA, 101 bp, rice(Oryza sativa)
  misc_feature (71): n=t or g
tcgccatatcttctaaaactgttgttgtactatgaacagtgccggctgagtcttgcagctttgtgattctnttcttctttgcacgccaaaccactttacta

SEQ ID NO: 22662 - DNA, 101 bp, rice(Oryza sativa)
  misc_feature (71): n=t or g
gtcttttggaagggtttgaaccaaattttcttcatctactcctctggtctccaaccacctatagcgttcanatctccttactcgctctcttatttgaggag

SEQ ID NO: 22663 - DNA, 101 bp, rice(Oryza sativa)
  misc_feature (71): n=a or g
caagtggtatcagagcatccggttacgaaccagggtgttgcactgatgggtgacgacaagaagttgatcgncggcacctccaaagaaggcgttgtgataca

SEQ ID NO: 22664 - DNA, 101 bp, rice(Oryza sativa)
  misc_feature (71): n=t or c
ctacatgatcgtggttgacgcgacatagtataagtagctcctgtccaaattccattctcctgctttcatcnatccctttgcatctttttattgcaacagga

SEQ ID NO: 22665 - DNA, 101 bp, rice(Oryza sativa)
  misc_feature (71): n=t or c
acatgacagatgagaaccttttccctgacgcacagacatatgctgaagtcataagaggattcttgagatanggttccccatcagacgcaatgaacatttat

SEQ ID NO: 22666 - DNA, 101 bp, rice(Oryza sativa)
  misc_feature (71): n=a or g
tgtggtggtggcagtactcatcggtgtgtaggctgacgaagagtctccagtttcagaatttgtactttcancattgttgctgctaacacctccaacaccgg

SEQ ID NO: 22667 - DNA, 101 bp, rice(Oryza sativa)
  misc_feature (71): n=t or g
tgcaaccctgtacatatcgcagacagcccacctgaagagttcaactaggaatttgtgaagacaaaccgaancgtgagtagtcaagtggatgtgtatttctt

SEQ ID NO: 22668 - DNA, 101 bp, rice(Oryza sativa)
  misc_feature (71): n=a or g
tgggagccttctgggtggtataggatatggagttttcattccactaatggcaactttcgaggctgtgggtnagggtgtcgcggacaagctcacccattgtt

SEQ ID NO: 22669 - DNA, 101 bp, rice(Oryza sativa)
  misc_feature (71): n=a or c
atttagagaagattttgatttcatgagaagctgcacaatgtagaaacttcccagacataccctaggaatcncttccagcctggcagccttcctatccagtt

SEQ ID NO: 22670 - DNA, 101 bp, rice(Oryza sativa)
  misc_feature (71): n=a or g
ggaggacttcaagaagaatggattgccggagactcagccagtctaccctttcctgaggaaggaggaagatnaagacaatgccctctacttcacgctgtcca

SEQ ID NO: 22671 - DNA, 101 bp, rice(Oryza sativa)
  misc_feature (71): n=a or g
cttcataccacatgccaagcagtcagcagtttaccgtgccaattcaacttggaaacataatccctatcctncaaacttactagttcatcctcctgatggta

SEQ ID NO: 22672 - DNA, 101 bp, rice(Oryza sativa)
  misc_feature (71): n=a or g
agtagttttgggagcaatggcatgcccaaatcttcctttcaaatcaatagatcacaatggtggatcttcgngagatcaagttggtgccctcttttctgcta

SEQ ID NO: 22673 - DNA, 101 bp, rice(Oryza sativa)
  misc_feature (71): n=t or c
gaaaaagttctaaaatattgaagacgcttaactgccaatctgccacatccacgttcacttgtacatcaaanttcgctaagaatggtgcgtatgaagcattg

SEQ ID NO: 22674 - DNA, 101 bp, rice(Oryza sativa)
  misc_feature (71): n=t or g
aaacatcccaaactacttactggaacacccaaaaacaccacactgaagtgcaacatttgcaaatgaactantgaaatactagaaaatacttattgaaacac

SEQ ID NO: 22675 - DNA, 101 bp, rice(Oryza sativa)
  misc_feature (71): n=t or c
gtcccacgttgattcagttgccacgcctgataaaaccggtgtcaactagagtcaatactatataaggaccnaaagttagccggttttataaattgggggat

SEQ ID NO: 22676 - DNA, 101 bp, rice(Oryza sativa)
  misc_feature (71): n=t or g
ctagcaagccaccccaaattcgattcgattcgataagattaagaaggctagcccgatccaagaagagaagnaagaagcgatgtcgtcgtctcggaacccta

SEQ ID NO: 22677 - DNA, 101 bp, rice(Oryza sativa)
  misc_feature (71): n=a or g
acttcaacaagttgccctttagcttttcttttgtctacatattttgctgttccagttccaatcttcaggcnatctctgaagtgagacggcagaagagcaaa

SEQ ID NO: 22678 - DNA, 101 bp, rice(Oryza sativa)
  misc_feature (71): n=a or g
gggcagtgtgctgctgggaatggcaatgagagtagtaacgaaagggttttgcaactagaaggagagctaanagatatgaaggagcggttactcaacatgag

SEQ ID NO: 22679 - DNA, 101 bp, rice(Oryza sativa)
  misc_feature (71): n=t or g
ctgttttctgtataggtcgaaggctttcacgtatgatgaagtagtggaaaaggtggctcaaaaacttggtnttgatgacccaactaaaattcggcttacat

SEQ ID NO: 22680 - DNA, 101 bp, rice(Oryza sativa)
  misc_feature (71): n=t or c
ggctcctagagactggaggttctcctgtgcagatagacgaagttactcttttttttcgctaggtcggccangaagaaatgccccgaccttaagattgagag

SEQ ID NO: 22681 - DNA, 101 bp, rice(Oryza sativa)
  misc_feature (71): n=t or c
taggattgattggaagggacttcgttgatgggtatactgcatctttccggaatggtgtgggtttcaataanggaaatggtctgtctggtgagcaagggttt

SEQ ID NO: 22682 - DNA, 101 bp, rice(Oryza sativa)
  misc_feature (71): n=a or g
gtaatccaggtatatcatttcctatgacaagcgtagctagccttaatgaatatatacatgactcatttttntaagtttttaatagctatagctctcaaaat

SEQ ID NO: 22683 - DNA, 101 bp, rice(Oryza sativa)
  misc_feature (71): n=t or c
atgttcataccatcgcaaacagagagcaagcttaatgggtattttgaaccttgagttttcagtgcatcctncgacaatatcaacgttattataccagacat

SEQ ID NO: 22684 - DNA, 101 bp, rice(Oryza sativa)
  misc_feature (71): n=t or c
cccagggtttgtctttttttttttacggagggagtagttgctaatgttgaatgtggcgcataaattatttntaactattatataatgataaatggaagttg

SEQ ID NO: 22685 - DNA, 101 bp, rice(Oryza sativa)
  misc_feature (71): n=t or c
aaacaaaataactggggcgttcaacttcaaccacctcaaaatcaatggcttgtccctgtcatgtctccttnggaaggccttgtctataagccttattctgg

SEQ ID NO: 22686 - DNA, 101 bp, rice(Oryza sativa)
  misc_feature (71): n=t or c
taagtctgtgagtaatggatggacattaacaaaaggatgttgtgtacaaataaacactgtgaatggttccntatgtggtataagatgcttaagcattagat

SEQ ID NO: 22687 - DNA, 101 bp, rice(Oryza sativa)
  misc_feature (71): n=a or g
tctacagagcttctctcgaccggacgattcttggagtcagccaatatgggatcatgatcagacggagatcnaagagcctaccttgcatcacctcctgacgg

SEQ ID NO: 22688 - DNA, 101 bp, rice(Oryza sativa)
  misc_feature (71): n=t or c
agtgacgccaacaaacacaaacctatgcaattattcagcaatgagttccctccgttccaaaaaaaaaaganaaaccctaggttttcgtgccaacgtttgac

SEQ ID NO: 22689 - DNA, 101 bp, rice(Oryza sativa)
  misc_feature (71): n=t or c
atctggctgatactgatggtcggatctttagtagtgttggctctgttttgtattgcaatccaatatgcttntcgaatttgaaatttaattttcaagaataa

SEQ ID NO: 22690 - DNA, 101 bp, rice(Oryza sativa)
  misc_feature (71): n=a or g
gtttagaagaatattaagtaaacaaacatgaggcttcatctgaatgcagaaagtggttacctgcaattctncttcagtcgacgatagcacagacctctgta

SEQ ID NO: 22691 - DNA, 101 bp, rice(Oryza sativa)
  misc_feature (71): n=t or c
tccacaccaccggaggtttcacttcccactgcaaagcctgcaaatggtcctgatcctgttatacgtctgancgtgatgccggagctgggtcgcccaaaggc

SEQ ID NO: 22692 - DNA, 101 bp, rice(Oryza sativa)
  misc_feature (71): n=t or c
gctctcttcactaacctcctcttcggaggaggagggaggcttcccgtatcttgagtaagatagtaaatcangacttaacttcatcgtcctacgaaaaagaa

SEQ ID NO: 22693 - DNA, 101 bp, rice(Oryza sativa)
  misc_feature (71): n=t or c
cttgatgatggcatccagtgctgattagttagtgtaagttattactgacgtgagcggcgacgaagtaggcnatgaggttgagggcgatgccccaccagatg

SEQ ID NO: 22694 - DNA, 101 bp, rice(Oryza sativa)
  misc_feature (71): n=t or c
ccttgcaggtgattctggagtttggtcacattgaaccccttaactctcttgtggcacgctaagcagcggcngtcatcttttccaagcctctccccaagctc

SEQ ID NO: 22695 - DNA, 101 bp, rice(Oryza sativa)
  misc_feature (71): n=a or g
gtatacatatacgtatcgtcatctgcggcaacgacgactttctggggatggaattttgtccctcaacctcntttatccaaagctactatttttttttattt

SEQ ID NO: 22696 - DNA, 101 bp, rice(Oryza sativa)
  misc_feature (71): n=t or c
atatctgctgcattaaattgtggaaataatactgcaacagattatgttgaggccctgacaacattacatgncttttccgattgtagccaaaataaacctta

SEQ ID NO: 22697 - DNA, 101 bp, rice(Oryza sativa)
  misc_feature (71): n=t or c
tgtttgtttcggggcggtgctgtagttgtacagggtttataatgtcgagatgaccttccgttttggattanggcggaataacatttttttacgaaatccgg

SEQ ID NO: 22698 - DNA, 101 bp, rice(Oryza sativa)
  misc_feature (71): n=t or c
tataggggttgtttggttgatggtcgtggtttgctacaccaaacgttagatgcgctacaattttttaggtnggtgtttggttgagtgtcacagttaagtca

SEQ ID NO: 22699 - DNA, 101 bp, rice(Oryza sativa)
  misc_feature (71): n=t or c
ttcaagtacattcttgttggcttattgattattgattatcgtgagcacgtttctcaagttagcatatactncctccgtcctataatataataatctaggac

SEQ ID NO: 22700 - DNA, 101 bp, rice(Oryza sativa)
  misc_feature (71): n=t or c
aaatatgttgttccaaggtggagttcagatatgccatcagaaatccaacccaatgcctccattttaggcgntgcaatcacccggatggtcgctggaccatt

SEQ ID NO: 22701 - DNA, 101 bp, rice(Oryza sativa)
  misc_feature (71): n=t or c
gtcatgtacgcccaggcgtagtgaatgaaaggccaagcggcccaagcccatggcgtccatatctggtgaanggtggtacgtcatcatcttcgctgcatccg

SEQ ID NO: 22702 - DNA, 101 bp, rice(Oryza sativa)
  misc_feature (71): n=t or c
caatcacattcaaggccaccggctcaaggcgagatggagaagccgcccagcgcctccatcggcctatttcnctctctgttgtgcgggtaacatcctgaaaa

SEQ ID NO: 22703 - DNA, 101 bp, rice(Oryza sativa)
  misc_feature (71): n=a or g
aatcttatagtagctagcttgggcgttgaatggaagcaccctattatagggggtgatgctctaagcctctnatagtcacctttttaagcaagttgattaaa

SEQ ID NO: 22704 - DNA, 101 bp, rice(Oryza sativa)
  misc_feature (71): n=t or c
atgaggtatgcagggagaggtacggtggtcacgtattatatatgattggccgaatagaaccaagaggaaancatcgtatttatatgcgactgacgagagcc

SEQ ID NO: 22705 - DNA, 101 bp, rice(Oryza sativa)
  misc_feature (71): n=t or c
gttctctccgggagtttttgaggagtgacagaaatgtcggcattcttccaggggagttccagaggagtacngaagatgtcggcactctcttcaattttgta

SEQ ID NO: 22706 - DNA, 101 bp, rice(Oryza sativa)
  misc_feature (71): n=a or g
tcatgcatgacaaaaaccctcgtggagaactgccacacacgcgtgcttaatattcgatcaagtatacggcnttaaaaaaaaatatctgatcacacacacgt

SEQ ID NO: 22707 - DNA, 101 bp, rice(Oryza sativa)
  misc_feature (71): n=t or c
agatagagtcatgcgtgcaaccaacaactccacctccacaccggtaatcattttattatctaaacaaaatntggtatacggctctctctgcatataaactg

SEQ ID NO: 22708 - DNA, 101 bp, rice(Oryza sativa)
  misc_feature (71): n=a or g
atgcatgctatccttgattcttggttcaaaaataacagatgcagctgttgcatctattgttcgctcttacncaagcttggatttgcttgatttaagcgggt

SEQ ID NO: 22709 - DNA, 101 bp, rice(Oryza sativa)
  misc_feature (71): n=t or c
atgcagccatgcaggaagcacaacttaattatcttgtgcaactccagatttttctcggagaccggggccgngagtctcgcggccggagagacaaggctcgt

SEQ ID NO: 22710 - DNA, 101 bp, rice(Oryza sativa)
  misc_feature (71): n=t or c
tcttctttctgctaaagacttaaccatcacccattttacttaacctgcttcttggccgagttcttccgttncggcctggcctcctgcagcatggacagcac

SEQ ID NO: 22711 - DNA, 101 bp, rice(Oryza sativa)
  misc_feature (71): n=t or c
tcagctgagctcgggtgagctctttctacctccaagatttcctcctcctacctccactccactcgcctcanctcagctcacctcagcgtcgtcttcttcct

SEQ ID NO: 22712 - DNA, 101 bp, rice(Oryza sativa)
  misc_feature (71): n=t or c
attttgtattgggttgtttttgtgacttgtccttgttcatcatgcaggtgggcttgcacaattgaaggaanggacggttcagatctctggtgaaacggaga

SEQ ID NO: 22713 - DNA, 101 bp, rice(Oryza sativa)
  misc_feature (71): n=t or c
tgagctgagctgatgattcaacggtccaactgaattgttccacacgttggtcatcaggacagggttcagangtgcagccaacacggcagcatgtcttgccc

SEQ ID NO: 22714 - DNA, 101 bp, rice(Oryza sativa)
  misc_feature (71): n=a or g
agtgatcgcgtgtgtgagggttttgccacaacaagtggtatcagagcctgagtttaacatgtcttccgacngcgacagtggccgctacactcctccggggc

SEQ ID NO: 22715 - DNA, 101 bp, rice(Oryza sativa)
  misc_feature (71): n=a or c
tgatctgtggaagcttgtagatgctctttcaactctctttcttcacgttctagttcacggatttccacatncctcccgctttgggttgagctactcacact

SEQ ID NO: 22716 - DNA, 101 bp, rice(Oryza sativa)
  misc_feature (71): n=a or g
tagtcgaggatcattgcaacggactccttctgctaaagtccggcgtggctaaccctgctacccgacagtgngtgccttctcctcctgccccacctcagccc

SEQ ID NO: 22717 - DNA, 101 bp, rice(Oryza sativa)
  misc_feature (71): n=a or g
tatatttaagaagctcaagatgaacattgagaggtcaagtcagtgcaatgtattttggaatggaaaggatngatttgaggtgaaagaaaaggagagaagga

SEQ ID NO: 22718 - DNA, 101 bp, rice(Oryza sativa)
  misc_feature (71): n=a or g
gcgtaagggaatatatcgtatacatacgagtttcctatgcacacttcatacacatcaactagcaaatcacnaaaaaatctaaaaaaaaatagacatttact

SEQ ID NO: 22719 - DNA, 101 bp, rice(Oryza sativa)
  misc_feature (71): n=a or c
ggggctacttatttgcttttggttaggttacatgaaagatttacagttgtacatctatcctccctctgtcncattttaagtgcagctatgatttttcacgt

SEQ ID NO: 22720 - DNA, 101 bp, rice(Oryza sativa)
  misc_feature (71): n=t or c
ttgaaaagtagttgtactactcactgtaaatatactatagcgccatatgtgatcatgtatagtggtacaangaatttttactgagattatttcacgcatgc

SEQ ID NO: 22721 - DNA, 101 bp, rice(Oryza sativa)
  misc_feature (71): n=t or c
gttgtgcctttgaaatttatatctccttttgagctgtaaaaaccgaatgaaaaaaaatacggcaagaattntatagaaatggtaactgtttatccatttcg

SEQ ID NO: 22722 - DNA, 101 bp, rice(Oryza sativa)
  misc_feature (71): n=t or g
gacaaaaaaagaggttacattgctccatcaaaccatttgtcacatccatgttaagtgaggatggcatatcnaagtgtccattccatatgcattgcggcatg

SEQ ID NO: 22723 - DNA, 101 bp, rice(Oryza sativa)
  misc_feature (71): n=t or c
aattgtgtgcctattcctgtgaaagagagcttggacgagcccagtgcaaagatcaatgttctactgcaagnatatatttctaggctggaactggagggtct

SEQ ID NO: 22724 - DNA, 101 bp, rice(Oryza sativa)
  misc_feature (71): n=a or c
atccatgcaatagtggatgctaaatcaaaaggttctgtcaggttttccaaggtcccgtggtccggttctgntgtacaaagaccagaatgtgacgctatgaa

SEQ ID NO: 22725 - DNA, 101 bp, rice(Oryza sativa)
  misc_feature (71): n=t or g
actttggagggttgtggcacgggacttgaaggctggaggaagtcaattcgttggcttgcatatttttggtnctactcatgccgtgctggtgctgctaaaaa

SEQ ID NO: 22726 - DNA, 101 bp, rice(Oryza sativa)
  misc_feature (71): n=a or g
cgacctcttgatcgtggaccaccattctggcacagacaggaggagactcgttatgattctgttgatcacanttacagaaaaagacctcaatatggtgaccc

SEQ ID NO: 22727 - DNA, 101 bp, rice(Oryza sativa)
  misc_feature (71): n=a or g
gagttcttggcaagcttccccatatatacccgaccaccaccgggcaacggttgatcgatatagccagtgangagaagggttatagaggctgatcgaccatc

SEQ ID NO: 22728 - DNA, 101 bp, rice(Oryza sativa)
  misc_feature (71): n=t or c
agtgtgcaacgatcaacaaattataggtaagtagaggatgcaactaatccaccgcaacaatagttgactanagatagattgtgactatgagtaatagcatt

SEQ ID NO: 22729 - DNA, 101 bp, rice(Oryza sativa)
  misc_feature (71): n=a or g
gcacacttcaggttccatgaagattgaaaaatgagcagctggtatagcttgcacggttgcttggtgaatcntaaagcgctcgcagtatcaatttttgtata

SEQ ID NO: 22730 - DNA, 101 bp, rice(Oryza sativa)
  misc_feature (71): n=a or g
cccatggaccatggtggagcggatgctgcgtaggtgcaggaaggatagccccacagttgcgtcactgcatngggtgcggaggaggaaactgaggcgtctga

SEQ ID NO: 22731 - DNA, 101 bp, rice(Oryza sativa)
  misc_feature (71): n=t or c
tctgtagctgtgctataaacaatatcaggagcaatcagcggtgttgatcctccacctttcatataattgancttccccccattaacctctctagtcacaga

SEQ ID NO: 22732 - DNA, 101 bp, rice(Oryza sativa)
  misc_feature (71): n=t or c
aatattgattctcgagattggggtagatgtctacatttagcagactttgttgccatgcttggatatgactntgatggaaagttgaaaacttattggttatt

SEQ ID NO: 22733 - DNA, 101 bp, rice(Oryza sativa)
  misc_feature (71): n=t or c
atgcagctctccataagaatccaaattctcattgttctcatgagggatggaagtcaaggctttgtacactncaagaaaagccttttctagatgctccaaag

SEQ ID NO: 22734 - DNA, 101 bp, rice(Oryza sativa)
  misc_feature (71): n=a or g
tggagtcgacgataagactgacgaaaattacaatcagtttgaggagcaacctccgttcgcggtgacggtcnactcgagcaccctcctatcaaaggaggaca

SEQ ID NO: 22735 - DNA, 101 bp, rice(Oryza sativa)
  misc_feature (71): n=a or c
agaattccgttgtataccacatacacaactgtaacttccattactaggtagagcacatgggccccgggtancagctaaccaaacaggcccacggcccctta

SEQ ID NO: 22736 - DNA, 101 bp, rice(Oryza sativa)
  misc_feature (71): n=t or c
gcaaaagaaagacgcaatatgatttacccaagatccaagcagtcttcaggatgacatatatcaaattttgnaaaattataatggcatgttctaattttccc

SEQ ID NO: 22737 - DNA, 101 bp, rice(Oryza sativa)
  misc_feature (71): n=t or g
atagcacaaatgctgaaacaagggattatacaggccagcacaagtccatttgcttcaccagtacttttagnaaaaaagaaggatgggacatggaggttttg

SEQ ID NO: 22738 - DNA, 101 bp, rice(Oryza sativa)
  misc_feature (71): n=a or c
tctgcccaaaataacctcttcaagcatcctgcttcgtcggtctcatactcataatagaaatccatatcatntttctgacgagcttgcatgtacttaataac

SEQ ID NO: 22739 - DNA, 101 bp, rice(Oryza sativa)
  misc_feature (71): n=a or g
caatgtggaaattagccatggaagcagttctggtgacaaaatgattgctgagttgaccgaggaggaattgncattgcaaggtgtgcccgcagatgagactc

SEQ ID NO: 22740 - DNA, 101 bp, rice(Oryza sativa)
  misc_feature (71): n=a or g
ctgttgtttatggtttacccaagcggtacttcgaagcagttagctactgctgcttttgattactgatcttntctatgcaagcatactgccaggagagtgct

SEQ ID NO: 22741 - DNA, 101 bp, rice(Oryza sativa)
  misc_feature (71): n=a or g
gtcaaagaaatccaacaccgcaatctcgtatacatgcaagccatcgagatggcaccgccgaacatttcgancagcatcttatatttttacacaaagaaaaa

SEQ ID NO: 22742 - DNA, 101 bp, rice(Oryza sativa)
  misc_feature (71): n=t or c
cctggcttggggattgatttggctgtagaattttgccttctatttgcatggccagttgaccgcaattccangtttctgttaccttgagtattgttttcaga

SEQ ID NO: 22743 - DNA, 101 bp, rice(Oryza sativa)
  misc_feature (71): n=t or c
tcagaaagcacccttccatcatcagactttagctgcataattaaatttctgcgatatctttcagttgccgnagcatgaaagaattttgtattttcaccacc

SEQ ID NO: 22744 - DNA, 101 bp, rice(Oryza sativa)
  misc_feature (71): n=a or g
gaagaagagcaagtggcatctttggtaggagccggattcgacttcgacggcttcaagcggggctggatttngcggcggcggcggcttcgaggggaggggct

SEQ ID NO: 22745 - DNA, 101 bp, rice(Oryza sativa)
  misc_feature (71): n=t or c
ggtcctgatcctcgacggattgagatcttctacattgcaccgtgtcactgacatgtagatccgatgatttncggtctcatatgtttagtgataaaggcgtg

SEQ ID NO: 22746 - DNA, 101 bp, rice(Oryza sativa)
  misc_feature (71): n=a or g
ttcccctagttcattatccgaacgcccattatcagccgtaggacagttccaacttgccacagacagcgatnaggtaaccccacagacagcgatgaggtaac

SEQ ID NO: 22747 - DNA, 101 bp, rice(Oryza sativa)
  misc_feature (71): n=a or g
aatgataaattactctgtgaacgtactaaggatgtgttcacttgcaaagtttttttttaacgactcgcacnagacagtgcgaagttctattaatagagcag

SEQ ID NO: 22748 - DNA, 101 bp, rice(Oryza sativa)
  misc_feature (71): n=a or c
tatttcttgtctatacatgattaattacaataatttgaagagttcctagcgcaagcatgcaacttgacaanttgtacaagcatgctgactatgcatgcaag

SEQ ID NO: 22749 - DNA, 101 bp, rice(Oryza sativa)
  misc_feature (71): n=a or g
ataatttccttttcaaacattttttgttattattatggataggttgttcctagaagggctagagaagtatnggcgtggcgattagcgcaacatctcacgct

SEQ ID NO: 22750 - DNA, 101 bp, rice(Oryza sativa)
  misc_feature (71): n=a or g
cgtcgcccacaaatgaagttgtcaccgcatactcacccaactccaagaagatggctagacccaagtcggcnacgtcctccacctcgatttgtccccttctc

SEQ ID NO: 22751 - DNA, 101 bp, rice(Oryza sativa)
  misc_feature (71): n=t or c
gtaccgctccagttccagttccagttccagttccagctctccctcgccctctctcgcttctgcttcatcgncttccttcgcggatgccacggggagttgcg

SEQ ID NO: 22752 - DNA, 101 bp, rice(Oryza sativa)
  misc_feature (71): n=t or c
tgtatgtgcggttaatttggttatggaaagcatcattcagcaacaccaaataatttgatatgcacagacgncggcgcctaaatatacacaatctgataaaa

SEQ ID NO: 22753 - DNA, 101 bp, rice(Oryza sativa)
  misc_feature (71): n=t or g
tcttcattacccattagcaaaaatactttaaaaatattaccgaggatcaagaaatagcctttgtcgctcgngtttgatggtgtcactaactccgcagctga

SEQ ID NO: 22754 - DNA, 101 bp, rice(Oryza sativa)
  misc_feature (71): n=t or c
catgccttattctaaattgggattcaaatattttgggctctatctagtggagatacgattggagcagcaanttataaattggcactgctggaagggagtat

SEQ ID NO: 22755 - DNA, 101 bp, rice(Oryza sativa)
  misc_feature (71): n=a or g
catttggcgaagaacattggttgtattaacacatgctcagctctcaccacctgatggacttgactataacnatttctttacaaaaagatctgagtcacttt

SEQ ID NO: 22756 - DNA, 101 bp, rice(Oryza sativa)
  misc_feature (71): n=t or c
ctggcaataccctccgagcagcgcgcaccgtgaaacttcattcctaacttgcatcctgtcaaacaccttgngagcctccaccatcaacccacacttggcgt

SEQ ID NO: 22757 - DNA, 101 bp, rice(Oryza sativa)
  misc_feature (71): n=a or g
ggtgttagaaggctcgtgtatgtaagcacgtataatgtggtttttggaggagagccgattgtcaatgggancgaggcgctgccttatttccctgttgaaga

SEQ ID NO: 22758 - DNA, 101 bp, rice(Oryza sativa)
  misc_feature (71): n=a or g
ttatcaagaaacttaaagcaccctaccccacttcaatgaccaagatattcaagggcttaacatttgagcgngacatgtcattttactacctttgtcaaaag

SEQ ID NO: 22759 - DNA, 101 bp, rice(Oryza sativa)
  misc_feature (71): n=a or g
gaatgtattgctaggtagtattatatcaaagagaatcagtacagttggctgttttggcaaatgctgacgcnatgtaccagtatatctgatatattatagca

SEQ ID NO: 22760 - DNA, 101 bp, rice(Oryza sativa)
  misc_feature (71): n=a or g
attaaacagatatcaaaatatcaatgacggcttgcattgaaaaccagagtatgaagctagtacttattaantttgccttatagctcataagccgcaacaaa

SEQ ID NO: 22761 - DNA, 101 bp, rice(Oryza sativa)
  misc_feature (71): n=t or c
gaatcctagctatctgttaccagaaaacacataattagtgtgatgcctgtgattgtgtattacataatatnttgtaattgtctttttttctaaattctgtg

SEQ ID NO: 22762 - DNA, 101 bp, rice(Oryza sativa)
  misc_feature (71): n=a or c
gggcgtccttatctacgcagtattttatctcgatgcccgccccgtgcgctaaaagaaaaaaaatggctctnagctcggctcagtttgttttatagggtgtc

SEQ ID NO: 22763 - DNA, 101 bp, rice(Oryza sativa)
  misc_feature (71): n=a or g
ataatattatcaagtgtgcataagagagatggcacataccttcagattgctaacaattgattgagcatcangaacagaaggctgaaggttatattctgtca

SEQ ID NO: 22764 - DNA, 101 bp, rice(Oryza sativa)
  misc_feature (71): n=t or c
ttacagaagttgttgtgtacctgtcttgagcagaataagttggaaccttcctgttgacatcatcaaattcnattaatccaggccaattcaaggattcactc

SEQ ID NO: 22765 - DNA, 101 bp, rice(Oryza sativa)
  misc_feature (71): n=a or c
tattcatcgttcagttggaggctggacgataacatgtttgtgcagtttagctgaaatgatttccttgcagngcacccttcttctaggccaaatggatatgg

SEQ ID NO: 22766 - DNA, 101 bp, rice(Oryza sativa)
  misc_feature (71): n=t or c
ctcatatttagatttagtggtgaactccgtgaaaatcatttgctgtgttcggtgaagctcataccaaaatntacgacgcaataacaaacctctcatttgtg

SEQ ID NO: 22767 - DNA, 101 bp, rice(Oryza sativa)
  misc_feature (71): n=t or c
acgagaggccgatgcacacgataggaccaaaaaagttgaataggagtagaatattgaacatcggaaggacngggcttgctagtattgcagtaaatgcgtga

SEQ ID NO: 22768 - DNA, 101 bp, rice(Oryza sativa)
  misc_feature (71): n=t or c
gacatcaccatcttcatcggcgactggtacaacaagaaccacacggtaatcaaatcaacacgaaatcaacngcaatatgaaacattttggacaggtttttg

SEQ ID NO: 22769 - DNA, 101 bp, rice(Oryza sativa)
  misc_feature (71): n=a or g
agagttatgtgtacattgtaaaacaatcatgctgggaacagaagcaccaaatgcaagtcccatgtacattntaaacaatcatcaagtttgtgaataaaagc

SEQ ID NO: 22770 - DNA, 101 bp, rice(Oryza sativa)
  misc_feature (71): n=t or c
acacttttcagggctcaagttgactgccaaatattcttcctcgagacatacacttgttcggccatcgctanttgttccagcccccatccctctttgtcgtc

SEQ ID NO: 22771 - DNA, 101 bp, rice(Oryza sativa)
  misc_feature (71): n=a or c
gtcgttggtcgtcgtcacgggaggtatcgccatgcgctggggatgtcaaaatgcagagagttcgcgtcttngaagacggccatgagctcggcttctcccag

SEQ ID NO: 22772 - DNA, 101 bp, rice(Oryza sativa)
  misc_feature (71): n=t or c
gacagtgaaaagaaataaagaagctttattcgatgacataaaaatgatgacccctgctgcctgtcctcctntgcaatcatctttattttttttgttgtcca

SEQ ID NO: 22773 - DNA, 101 bp, rice(Oryza sativa)
  misc_feature (71): n=t or c
agttgcaaagtcatccaggcctatgatatcatgtttgttacccaatcaaacatccaatatgttttcatttncccctcactgtgcaagtcctagtttctagc

SEQ ID NO: 22774 - DNA, 101 bp, rice(Oryza sativa)
  misc_feature (71): n=t or c
ggtttagctcttgtattcgatcatacagttttgatgtgatttctttccatagcattatcattacacttatngacggcatgattttgaaaattgttttgaag

SEQ ID NO: 22775 - DNA, 101 bp, rice(Oryza sativa)
  misc_feature (71): n=a or g
ttaacaagcagatgatggttgaattcaagatgagttatcttggccctttaagtttttatctggggattcangtgattcagaagggggtgccatcagtctga

SEQ ID NO: 22776 - DNA, 101 bp, rice(Oryza sativa)
  misc_feature (71): n=t or c
atcgagcacctccgcacaaccctgatgattcgaagcacttgtaaagagcatgtttcacaccggtttagctncagctgaaacccaaccaaatagttttagct

SEQ ID NO: 22777 - DNA, 101 bp, rice(Oryza sativa)
  misc_feature (71): n=t or c
cctaaaaccacttttaaaatcgccgagggaatcattttgcacggtgttaacagttgagggagttggtatanctggttttgtggttgagagatgcgaatcag

SEQ ID NO: 22778 - DNA, 101 bp, rice(Oryza sativa)
  misc_feature (71): n=t or c
acactttgttatggttaaattagtgagttagtgtgtctgagtgatcccttccttttcatgcaagatgtcanttgctcgcaccctattccatctcttgattt

SEQ ID NO: 22779 - DNA, 101 bp, rice(Oryza sativa)
  misc_feature (71): n=t or c
taacagcatcatttagcatctgactgtatggaataccaagattggagtcgaagttggcgagcacatcaganagcgtagattcaccaaagaggagatatcca

SEQ ID NO: 22780 - DNA, 101 bp, rice(Oryza sativa)
  misc_feature (71): n=t or g
agtaggagtataatggagaggttctttccggtaatagaagttgtgaaagacaatagtacgcagtcatatcnttgataaatatatgaattactcccttcgta

SEQ ID NO: 22781 - DNA, 101 bp, rice(Oryza sativa)
  misc_feature (71): n=t or g
acttcaccgagtgcttcattaggagagttgtgttctgtactctcaggttaactatgcccagtcctcctttntcctttggggcctgcaaaccatatcccagg

SEQ ID NO: 22782 - DNA, 101 bp, rice(Oryza sativa)
  misc_feature (71): n=t or c
accctatcttcttggctttcgtcgatccttcgattccgtgcgttctgtttggttgcggttgctgtgcctgnttgcggatgaatttgcgatttttttttttt

SEQ ID NO: 22783 - DNA, 101 bp, rice(Oryza sativa)
  misc_feature (71): n=t or c
gaagtgatcgaaaaaatcgcttgctcaactgcaatatagggtgctgggtagcaattcctgtgtgcgcgtgnatagggacaattcaatacttttctcaagaa

SEQ ID NO: 22784 - DNA, 101 bp, rice(Oryza sativa)
  misc_feature (71): n=t or c
tgagaactctatagcagtctagcctcgtgacttcgtgagacgacgtcacagttcatccttggcaggaaggntagctgtccgacctagatggaagggcacgt

SEQ ID NO: 22785 - DNA, 101 bp, rice(Oryza sativa)
  misc_feature (71): n=t or g
atttgacttatttttcccccttctaactgcattgcaggatatggagtcagggaaagctgcgaagccgaagnaactcggtagtaaaatgtaggtctaaaaag

SEQ ID NO: 22786 - DNA, 101 bp, rice(Oryza sativa)
  misc_feature (71): n=t or c
cataagtcatagtaacacatagctgatgtttgagatagatttagaataaaatcagcgcagagaaagttatnagagtataattaattaagttttaattgttc

SEQ ID NO: 22787 - DNA, 101 bp, rice(Oryza sativa)
  misc_feature (71): n=t or g
atccaacgaagagaaatagcataacgtctacagatttctcttcagaagatgttgatttgttgctgcattcntttgacagtggaggcccacacaaaccagca

SEQ ID NO: 22788 - DNA, 101 bp, rice(Oryza sativa)
  misc_feature (71): n=a or c
aattaactaacaagcacctatatatacacctcctatcatacctcctccccaaatcaaccaagttccatttnatttcttgcatctccaattatactcttgct

SEQ ID NO: 22789 - DNA, 101 bp, rice(Oryza sativa)
  misc_feature (71): n=a or g
aataattcaaactttcaattgacggcggttaacttacacgttcaagacagatgtagcgagactgctcagcncctcgcggcgggccatctcatccgtgacga

SEQ ID NO: 22790 - DNA, 101 bp, rice(Oryza sativa)
  misc_feature (71): n=t or g
aactgtaggaaacagtacaacttagatcccatggcagtatatacccccattttctcctattttcgctaacnaggaaggtagcccgcgcatacgcgcgggca

SEQ ID NO: 22791 - DNA, 101 bp, rice(Oryza sativa)
  misc_feature (71): n=t or c
aaaaaggagcaggagatgcagaggaaaagagagaactgaaattcagaaccaagagaaattgacagtggatngactaacctggctgacatggctgcacacgt

SEQ ID NO: 22792 - DNA, 101 bp, rice(Oryza sativa)
  misc_feature (71): n=a or c
gtgtatgacgaacaaggcaaccttatagaagagaagccaattgactcctcggaggcggcaatgagaaaganaatatcaattgcacgcaacaaatttgaaga

SEQ ID NO: 22793 - DNA, 101 bp, rice(Oryza sativa)
  misc_feature (71): n=t or c
ggatcaatccatcctttgaatacatacccaaacccaccttctccaagaatactatctggcctaaagttaanagtggcagatttcaactcttggaaagtaaa

SEQ ID NO: 22794 - DNA, 101 bp, rice(Oryza sativa)
  misc_feature (71): n=a or g
tagaggatttgtgggaagagagccgggcgagatgaaaatgagatgaccaaaataaaggcagagacgaggtnacagtggcacaaggcaaagcgagctaggca

SEQ ID NO: 22795 - DNA, 101 bp, rice(Oryza sativa)
  misc_feature (71): n=t or c
ttaggtggctaacagctaacaaacagctaataattcaaagaaaaaaattagctaacaacttataatccagnttatagtaatctggctcaataatctaggtt

SEQ ID NO: 22796 - DNA, 101 bp, rice(Oryza sativa)
  misc_feature (71): n=a or g
ggcggcagcgatcgcagcacgaggacctgcacgacggtggctgcggcttgtggaccgtgcatcagctgctncctctctctggcctgtgcacggggaagcgg

SEQ ID NO: 22797 - DNA, 101 bp, rice(Oryza sativa)
  misc_feature (71): n=t or c
caacttatgagtgggtggtgcaatttaatcgcgcaacttgagaagctatagaccgattccttcttactgtnttatcagacggccaaaatataatttgattt

SEQ ID NO: 22798 - DNA, 101 bp, rice(Oryza sativa)
  misc_feature (71): n=t or c
gaggtatcaccttttgtttgcattctctcacttaatcgacctcgtctagatgagccctccccaacttctgngctgcttgctgcacaatcttcagaccaatc

SEQ ID NO: 22799 - DNA, 101 bp, rice(Oryza sativa)
  misc_feature (71): n=t or g
tctgaagaaatgtggtgtcggatggttgggaagtagagcggttgcatctgcaatggcagcttccaacaccntcacctcttgaaccctagctccctcgcaat

SEQ ID NO: 22800 - DNA, 101 bp, rice(Oryza sativa)
  misc_feature (71): n=a or c
acaaaaacacttctattttctccccagcacatccatcctccctctcacttactaatgctgacgacgtggcntgctgcccggccacacgtattggcaccgac

SEQ ID NO: 22801 - DNA, 101 bp, rice(Oryza sativa)
  misc_feature (71): n=a or g
tggctaggtttcataaattaggagtgtttgaaatgtacaattggatggattatggatattttgttttgagntattatacttttagaagtgtggcataaata

SEQ ID NO: 22802 - DNA, 101 bp, rice(Oryza sativa)
  misc_feature (71): n=t or c
tcaagcaccctgtcatactatgaactacagagcattcataaccccttaaagaagaatcaaaccgatggcgncctaacttcaaattcaacaattatccaaag

SEQ ID NO: 22803 - DNA, 101 bp, rice(Oryza sativa)
  misc_feature (71): n=a or g
aggtagattgtagagtataattagtaggacaaccagtagctctagcacctgataactactgatagcaaacnttcctctagtgcctccttttccatataaat

SEQ ID NO: 22804 - DNA, 101 bp, rice(Oryza sativa)
  misc_feature (71): n=t or c
tcactccgtcgaaaaaaaacttaacctaagaggggaatctcgacaaaggaggttgtccaaattctttatcnaggatggtcccatcctcttcaaggttaagt

SEQ ID NO: 22805 - DNA, 101 bp, rice(Oryza sativa)
  misc_feature (71): n=a or g
ccatgtcattacaattcttttgaaatatgagacgacattttctacactctaaacgtagttggtctcaaatntaggccactgcattttttttatatcatcca

SEQ ID NO: 22806 - DNA, 101 bp, rice(Oryza sativa)
  misc_feature (71): n=t or c
gtggaacatttgcacaccgctggtttgttacaacctttgccgattccgtgcaaagtctggcggacatctcnacggatttcgtggaaggatttcccaagttt

SEQ ID NO: 22807 - DNA, 101 bp, rice(Oryza sativa)
  misc_feature (71): n=t or c
ataccaagctttcaagaacatttggatgtgtccatcatctcctcgggctcttcaatgctatctgttgtgtnatttgttagtgccggtgatttagcaacaaa

SEQ ID NO: 22808 - DNA, 101 bp, rice(Oryza sativa)
  misc_feature (71): n=t or c
tcgtccaccaacagcaggaaatacttgttcccccatggtgtcgccggcgtgattggaccgcacaagtcgcngtgcaccagctccaacagctgtcgtgcacg

SEQ ID NO: 22809 - DNA, 101 bp, rice(Oryza sativa)
  misc_feature (71): n=a or g
aaacggtatgatattgatatgatgcctcctcaccacaagatcgcagagatatatatcatcatcatctattnaattgtatatttcatcatgcatgtattttt

SEQ ID NO: 22810 - DNA, 101 bp, rice(Oryza sativa)
  misc_feature (71): n=a or g
tgttcttccggttggccgtcgcggactctttcagcttcggtatcacaatccatatcacgaactgcagcacncgcacgcacgccaagaaacaccaccgttca

SEQ ID NO: 22811 - DNA, 101 bp, rice(Oryza sativa)
  misc_feature (71): n=a or g
gacaactacaaactcaactaacaacgaaaaaaatggaaaaaaaaatgttctagcagctcaatgaggagcanatgaaaaccaaaatctaaatgcctacacga

SEQ ID NO: 22812 - DNA, 101 bp, rice(Oryza sativa)
  misc_feature (71): n=t or c
tattcttctggacctgattattagtataatgagttctcagcttcttatgctgtgatcttggcgtatgtggnatcgtggattggttgttcggtttaaatgtg

SEQ ID NO: 22813 - DNA, 101 bp, rice(Oryza sativa)
  misc_feature (71): n=a or g
ttttttcatgacaaaatgctggcacatcattgctcattttcatgcagaagctacagacttgcaggttctcnataattcttacatcactctggtgccaaaga

SEQ ID NO: 22814 - DNA, 101 bp, rice(Oryza sativa)
  misc_feature (71): n=a or c
aggaaatactccatgagttagcaataacaaaacaaactgataacgaggaaaacctatcagtaatcggtttnaaaaaaaaaactaacagtaagaaacaattg

SEQ ID NO: 22815 - DNA, 101 bp, rice(Oryza sativa)
  misc_feature (71): n=a or g
tttcttttttttttgcggggagtggatttgatctgatcgagaggggtttatgtaaatcttatacgtttggngcatttgcaaacttgtccattgtttttctt

SEQ ID NO: 22816 - DNA, 101 bp, rice(Oryza sativa)
  misc_feature (71): n=a or g
gtcgaggaggtagtggcgctcattggggaggcgagcgttcgatctagcgttacctcgaaatggccttatcntaggtggtcctcctgaaggcctcgcctata

SEQ ID NO: 22817 - DNA, 101 bp, rice(Oryza sativa)
  misc_feature (71): n=t or c
atttcttcttggtaactgagatcagaaggattttcctcactttttaggcatactccctcgtactcgtaaangaagtcgtttttgacaacgacacagtcttc

SEQ ID NO: 22818 - DNA, 101 bp, rice(Oryza sativa)
  misc_feature (71): n=t or c
aaagggaattatgttggtgttaatcgatgtctactagtttagaggcagttgccaaaaccatagcgatccanccgccgttttccctttccaactcacttagg

SEQ ID NO: 22819 - DNA, 101 bp, rice(Oryza sativa)
  misc_feature (71): n=a or c
taaatgttcactcccgaggatatttgattggtttggagagagccatcccacttctcatgacctgagcctgnatttggatggtgaaacttgcaattactgcc

SEQ ID NO: 22820 - DNA, 101 bp, rice(Oryza sativa)
  misc_feature (71): n=a or g
ttttagaatttccaaatgccatcgaagcacgaatgaagtggcacatgagttgggccagctaggtaggggtngataaaaagctcaaaactcgtggctcgaat

SEQ ID NO: 22821 - DNA, 101 bp, rice(Oryza sativa)
  misc_feature (71): n=t or c
cgaagaacaacaccagggggctgctgttgagtcccttgcggctcaagagcgaaccctgggcagaggtaaangacagtttcctcactctccaattcctttcg

SEQ ID NO: 22822 - DNA, 101 bp, rice(Oryza sativa)
  misc_feature (71): n=t or c
gttaatcgggctaatggaaaataattgtactgtaaatttccgtggtataaaatagaaactagttgggtggnccgcacaattgcgcggctagcacccaaaca

SEQ ID NO: 22823 - DNA, 101 bp, rice(Oryza sativa)
  misc_feature (71): n=t or g
ctgaaagctcccatcagattatgtgttctagctaaataagtttattctttgatgtgatctgtatggcccgngatttgttgcacatcttaaagtttattatt

SEQ ID NO: 22824 - DNA, 101 bp, rice(Oryza sativa)
  misc_feature (71): n=a or g
gcaatgttttcagttattggggcttctttctcaaaaatgaagtgggacagggctaaagaaatgctcacganaagcaccacggaccagatggggaaacgact

SEQ ID NO: 22825 - DNA, 101 bp, rice(Oryza sativa)
  misc_feature (71): n=a or g
ttgtttcaagcagtaaacgatccgttgcattcatgatctgtctcaacccaaaccatatcctgatacgcccntcagctgtgttgtgatgcttttcgtataga

SEQ ID NO: 22826 - DNA, 101 bp, rice(Oryza sativa)
  misc_feature (71): n=t or c
cgaaactagggcatttcatatctctttcttaatgtacgatcgggacatatctccagggaggtagctcttgnggctatttcaagtggtgtgatgaacaacag

SEQ ID NO: 22827 - DNA, 101 bp, rice(Oryza sativa)
  misc_feature (71): n=a or g
ctcctctgcattgaataattacgctaactgacgacaataatacacaataacactactgttatgtaaaatcntgaagagatcacaatctggagggaagcagg

SEQ ID NO: 22828 - DNA, 101 bp, rice(Oryza sativa)
  misc_feature (71): n=a or g
aaaagactctagcgattgggaaaacactattcaagtggtaaagttctatttgagtgaacttgtgctactcnagcagcttgtcccgcttgaggccttgttcg

SEQ ID NO: 22829 - DNA, 101 bp, rice(Oryza sativa)
  misc_feature (71): n=a or c
cgatttgatgttggctcgattgcgttgttctgattcacgacagtatcagttggatggcccagattttgaantcgaaggtagatacgcatggttggattcat

SEQ ID NO: 22830 - DNA, 101 bp, rice(Oryza sativa)
  misc_feature (71): n=a or g
cagctgccacaaaactaaggcccaattatctagtcaacttctttgggaaaaaatccactttgacaccctcnttatacctcggatctgatttgtatccctta

SEQ ID NO: 22831 - DNA, 101 bp, rice(Oryza sativa)
  misc_feature (71): n=t or c
cttttcccctctactctaagccactcacaaacatgaagtcatgtcatctcttctttgctaatcgctaccanggaccttgctcccacctctcttcggcctgt

SEQ ID NO: 22832 - DNA, 101 bp, rice(Oryza sativa)
  misc_feature (71): n=a or c
aaattcctaacacacgtctttgttttcggccttctatatctctgtgctctgtagcagcttaggcctggttnagttaactaaaacttttaccaaaaaacatt

SEQ ID NO: 22833 - DNA, 101 bp, rice(Oryza sativa)
  misc_feature (71): n=a or c
cgtctcctcctccggtcaagccgaaggcgtaatcctataatccgctttccacataatgtcacggtctccantctttccgttttccaggaccggaagcgggt

SEQ ID NO: 22834 - DNA, 101 bp, rice(Oryza sativa)
  misc_feature (71): n=a or g
gcatccttggtaggtataaagatggaattcattggattatctgacatccctttacccacatgttcgttgcnaaggactacagaaatgttatgctttttaag

SEQ ID NO: 22835 - DNA, 101 bp, rice(Oryza sativa)
  misc_feature (71): n=a or c
gagtgacaattattttcaatgtaatatcatcaccatttgcatgagtggatctggctcgataaatttggtgnaaattttaatccattgtgtagtgttgcatg

SEQ ID NO: 22836 - DNA, 101 bp, rice(Oryza sativa)
  misc_feature (71): n=t or c
cacaaggagagtctgggcggcactagcggagtgggtgacgtgcgagcaacaaaatcctagccaatggcggnaaacttcaacggtgctagattggtgggagg

SEQ ID NO: 22837 - DNA, 101 bp, rice(Oryza sativa)
  misc_feature (71): n=t or c
ctggagcgtgaccatgggccgccctcgtggcaccgtttttcggagctcctcaacatgcgctacggcccccnactccgttcagcaccgctgggcgagctcgc

SEQ ID NO: 22838 - DNA, 101 bp, rice(Oryza sativa)
  misc_feature (71): n=a or g
tgtattaattgttccaagatatgttttttcaaatgagtctgctactgcagttgctgttcgccaatgtttcnttgaggtgcttcgcttttgctctgatcttc

SEQ ID NO: 22839 - DNA, 101 bp, rice(Oryza sativa)
  misc_feature (71): n=t or c
ctggcccacaggcaagaaatcactgctcaaaatattcatagttactccatagaatttagggcattagaatnttcattaaaatagactttgtttggtagtat

SEQ ID NO: 22840 - DNA, 101 bp, rice(Oryza sativa)
  misc_feature (71): n=t or c
ttgcacaaacgtacgggggtggttgtccattagttttctgggtaactagcgccaaagtactacctccgttntacgttttaggttataatatgttttagttt

SEQ ID NO: 22841 - DNA, 101 bp, rice(Oryza sativa)
  misc_feature (71): n=t or c
cgcctgtggaaatgtatttcgcaggcggtcagttgtcttcatttttactggcctttactgaggcggcttangccaccatcagcgaaaaccttttttctatt

SEQ ID NO: 22842 - DNA, 101 bp, rice(Oryza sativa)
  misc_feature (71): n=a or g
cgatgaggaagaattgatccagtatatcatcactggactcggagaaggctacagtgaggtcatctcagctntctgcgcaagggtagagcccatctctgtaa

SEQ ID NO: 22843 - DNA, 101 bp, rice(Oryza sativa)
  misc_feature (71): n=a or c
tgcgcagcagttcggtgagggacagggtcaccttctacttccactatttgaacctgctccttcgagcctcntgcttcacgggatcaacttctctgcccgat

SEQ ID NO: 22844 - DNA, 101 bp, rice(Oryza sativa)
  misc_feature (71): n=a or g
aaatccctaacacttcgcttcttgttagcaaagtgcttcatctgatgttgagtcctatggagatgttgttntatcaattgttgcatgagtttccttttcct

SEQ ID NO: 22845 - DNA, 101 bp, rice(Oryza sativa)
  misc_feature (71): n=a or g
aatgaatatatattgttcaacagtttaaaaatgagtagtacttatttaacggagtactatgagcctgtttnccacagctccagctccaattacatctctcc

SEQ ID NO: 22846 - DNA, 101 bp, rice(Oryza sativa)
  misc_feature (71): n=a or g
tcttcgttcttgcagccttggtggaatgccgccattacctcggtgtccttgacataagggattgtgttccnccgttctttgaagcggtggatgtagtcggt

SEQ ID NO: 22847 - DNA, 101 bp, rice(Oryza sativa)
  misc_feature (71): n=a or c
ccagtaaaccgcaacgtttagttctcgttgtttcgcacatcatttcatttttacctgtcgttgaggatatnaacactatatcgatctaacatgtgccttga

SEQ ID NO: 22848 - DNA, 101 bp, rice(Oryza sativa)
  misc_feature (71): n=a or c
tgtacattgagcagacacagggaaatcttgtgtacgtaggtcgtaagctccctaactttgctacactgttntctaaccctatgaaatcagtatataactac

SEQ ID NO: 22849 - DNA, 101 bp, rice(Oryza sativa)
  misc_feature (71): n=a or g
ttttgaaatttatggagttcatcctcgcaattgggttcgggtggctggattgaattttactgggaacgctncattttggttacagtccataaggtccacgt

SEQ ID NO: 22850 - DNA, 101 bp, rice(Oryza sativa)
  misc_feature (71): n=a or g
tttcctttttacgagggaaagtgaattttcagtacttttcgctatggctggaacaaatgttttttaaaacnacccggaaaaatgccaattccttaggcgaa

SEQ ID NO: 22851 - DNA, 101 bp, rice(Oryza sativa)
  misc_feature (71): n=t or c
tctatacaaccttttctgatgttacccagaatgcatcatctctgtcttggcagatttggttggttaacaancacacttgcttccgtgtgtgcttgcttggc

SEQ ID NO: 22852 - DNA, 101 bp, rice(Oryza sativa)
  misc_feature (71): n=t or g
tagtcccggttcgaatagaaaaatagactaaacatcatttttagctctggttaaaaagccaacgaaacttnttgatctttagtcttagttggtgttaacaa

SEQ ID NO: 22853 - DNA, 101 bp, rice(Oryza sativa)
  misc_feature (71): n=a or c
atgattcgactggctgcatgtggccattgtacttgttagctctgagaaataaaagtgcagtcttgactctngacgaatataagcaatttaacttgtgtact

SEQ ID NO: 22854 - DNA, 101 bp, rice(Oryza sativa)
  misc_feature (71): n=t or c
ctgtcctatcagctttctactgtgaatgaagaaaaggtgcagacagaagtaagagaaggattatttagacnatcatctcctcttcaattgatagaagattt

SEQ ID NO: 22855 - DNA, 101 bp, rice(Oryza sativa)
  misc_feature (71): n=a or c
tctagaaatctttggaacttcagagagagacactctagttaatttagtttcttggttcgcgatgcaggaanggatcgaacacgcggggatacttcgtgtgg

SEQ ID NO: 22856 - DNA, 101 bp, rice(Oryza sativa)
  misc_feature (71): n=t or g
tggtggaagtctccttctgcagtcgattctccgactatctcaatacctgacagaatgcgcagggtcttcantgtttttttgccgccggactcctttgcttc

SEQ ID NO: 22857 - DNA, 101 bp, rice(Oryza sativa)
  misc_feature (71): n=a or g
acctaccaatgttactaatgaagatgaagatgccagcaatatccctgaggacaaaagcagcaaagccagtnagcaacctcctcctctacctcctcgtcgtc

SEQ ID NO: 22858 - DNA, 101 bp, rice(Oryza sativa)
  misc_feature (71): n=a or g
gtcgacgacggcgagcacgagcgatcatctgcttcatcatcagcgtttgctcgcggcggcggacaggtacncgctggacgggctgaagctgatgtgcgccc

SEQ ID NO: 22859 - DNA, 101 bp, rice(Oryza sativa)
  misc_feature (71): n=t or c
gtgacgatcataccaagattatacattctgccttcgctctccataacttcaggattgacagctccgacacncatttccttacacaaaacccattgtacaat

SEQ ID NO: 22860 - DNA, 101 bp, rice(Oryza sativa)
  misc_feature (71): n=a or g
agccaacttatcagctctgactttaaaagcagactgagattcaggagacataactgaaacaggcttgggantagaagggcctagagagaactgtctaggaa

SEQ ID NO: 22861 - DNA, 101 bp, rice(Oryza sativa)
  misc_feature (71): n=t or g
aggccgcccggcgatgctccttacatgtgtggtgacagtagccagatgatggccggtgatagcaagcaggnacagcgctggccgctgcagccttcacttcg

SEQ ID NO: 22862 - DNA, 101 bp, rice(Oryza sativa)
  misc_feature (71): n=a or c
cagctggtgctcggagtagacgagatgccggcttgctgcgaatataacataatagttcataatattagacncaccaatttaagtgaaaatcaagtgatatg

SEQ ID NO: 22863 - DNA, 101 bp, rice(Oryza sativa)
  misc_feature (71): n=a or c
acacacaggttcagtcagatttttttttgctgggcaccacacataagccaaggatgatttgccatgacagnaacggcgaggatctcaagcgccctctttcg

SEQ ID NO: 22864 - DNA, 101 bp, rice(Oryza sativa)
  misc_feature (71): n=a or g
ctcgattctcaagggccagaagggagatgtgctgcaacctgatccttaggcatcaatttggtgtttgtgtntttccaatttagcgccaggctgaggagagg

SEQ ID NO: 22865 - DNA, 101 bp, rice(Oryza sativa)
  misc_feature (71): n=a or g
tgtgtcagctgcatagaacttgcaatcctcaggtagctctggagaaacaaaagaaatagctgttttcttcnattcctgcctacttttgttttctgatggaa

SEQ ID NO: 22866 - DNA, 101 bp, rice(Oryza sativa)
  misc_feature (71): n=t or c
aaggttgaaacctaaaaaatataagtactaatcgcattctccaaatgaagccccatgggactagaacactntgatgcagagagtccttcactcaccgatag

SEQ ID NO: 22867 - DNA, 101 bp, rice(Oryza sativa)
  misc_feature (71): n=t or c
tcataggttcacaatccaagggcccagatcttatccccaatccctatgcaaaccctccatattccattcgncgtctcacatctcattatctcatagcccat

SEQ ID NO: 22868 - DNA, 101 bp, rice(Oryza sativa)
  misc_feature (71): n=a or g
acaattctactccctgaattggtccaaaattctaaatttcttcctggtgaattgttgcagggctccaaagntgcggcaagagctgcaggctgaggtggata

SEQ ID NO: 22869 - DNA, 101 bp, rice(Oryza sativa)
  misc_feature (71): n=t or c
gcatttgttgggtagcaatttgcctcgtgttgtgtcgttggtaaacgcattacgacccagaagttctcaantgtcagtatctcaccaacccttgcaaccgt

SEQ ID NO: 22870 - DNA, 101 bp, rice(Oryza sativa)
  misc_feature (71): n=t or c
attctgcgttaggaaggctaatgaagacgtgaagtagaagctgtagcagacaccctctatcaatatggcgnacgctcaagaaattcagctccaaatcagag

SEQ ID NO: 22871 - DNA, 101 bp, rice(Oryza sativa)
  misc_feature (71): n=t or g
aggtgagatctcttagttcctccaacttgtcgataaaagagactgcaaggttgcaattagaaatcagagtngtcagttttgaaatggtcttgctccacttc

SEQ ID NO: 22872 - DNA, 101 bp, rice(Oryza sativa)
  misc_feature (71): n=t or g
aaagaaaccaaagtgaaggcaatgctctttggtcgtacaatggagagagatttcttcaaagagactaaggnggtgtttgaatcttctgaagatgaacacaa

SEQ ID NO: 22873 - DNA, 101 bp, rice(Oryza sativa)
  misc_feature (71): n=a or c
tctcctgtgccgccagccttctccttgaaggaaggaagaaccaactcagcaatctccctcctcgccgtggntataaagccagccagcacccctccctcttc

SEQ ID NO: 22874 - DNA, 101 bp, rice(Oryza sativa)
  misc_feature (71): n=a or g
ccggccaagatatatcgaaatgcacaaccacctttagccaccggagcgcgggacgacgacgaccatgaccnccgccgccgccgccgccagtccgccgagcc

SEQ ID NO: 22875 - DNA, 101 bp, rice(Oryza sativa)
  misc_feature (71): n=t or c
atacagaatttaggcatgtcattctatataatagtgaccggaagcggatcctctgacttcgaccacaaagncacggccgtgcagtccgcgttgtatccacc

SEQ ID NO: 22876 - DNA, 101 bp, rice(Oryza sativa)
  misc_feature (71): n=a or g
acccaccccaccgtctctctccatttggactccgattccacgccgacgtcgccgcctgatcgtctccggcnccggcgatcccaaccgccgcaaccaccgcc

SEQ ID NO: 22877 - DNA, 101 bp, rice(Oryza sativa)
  misc_feature (71): n=a or g
tggcacaaattgaacgacaattttttttctgcggtgcatgacaaagacgtaaaaattggccaactaaaggnaaaaaaaagtaaaaaaaggaacagcggaaa

SEQ ID NO: 22878 - DNA, 101 bp, rice(Oryza sativa)
  misc_feature (71): n=t or c
gagtgcttcctccgtcttgccagctttgccaagtccatcaatcaccgtactataactaatcaagtcaggantgcatccattcactagcatctgcttaagaa

SEQ ID NO: 22879 - DNA, 101 bp, rice(Oryza sativa)
  misc_feature (71): n=a or g
gtaaaaacaatgcaataaggattttctgttacaatgtactccctgtatcccacaaaaaaaatcaaatcctnggaaattttttttttttttggggggggggg

SEQ ID NO: 22880 - DNA, 101 bp, rice(Oryza sativa)
  misc_feature (71): n=a or g
cgccgagaggtcgggcaccttgcatagcgcttgaaggagtatgttataggagtacacgctaggtacaaccnaggggttggagactgggatctccttgaacg

SEQ ID NO: 22881 - DNA, 101 bp, rice(Oryza sativa)
  misc_feature (71): n=a or g
gatttcaacatctacattcaaagggatcagtaaatgacaaatcttggacatgctcaatacatgcagcatcntggaaacatccctttgtggtaaatatgaaa

SEQ ID NO: 22882 - DNA, 101 bp, rice(Oryza sativa)
  misc_feature (71): n=a or g
aatacgcataacgtaaagtgaataagtcttgcttcccttatctctcgctctgattgaatcgtcgtcctcanttacaaaaccgagtatagcacttcacccac

SEQ ID NO: 22883 - DNA, 101 bp, rice(Oryza sativa)
  misc_feature (71): n=t or g
aactttccaacaaaaataagctgccacagcattagacaaactaactgcctaacttatcgcatattcccatncttgtgtccaacgtttggatgaagcaagcc

SEQ ID NO: 22884 - DNA, 101 bp, rice(Oryza sativa)
  misc_feature (71): n=t or c
tatccatttagcttacttctggccttgagcttctcagtactgttccagcttctaccactttccttcatacnaatgtctttactttggtaaagattgtcttt

SEQ ID NO: 22885 - DNA, 101 bp, rice(Oryza sativa)
  misc_feature (71): n=t or g
ccggccagctgcttcgccgtcagcttgaaccgcacgcccttcagtccgaggagcctcttgagcacgatgtncagcaccgccgccaggtacacccccgtggc

SEQ ID NO: 22886 - DNA, 101 bp, rice(Oryza sativa)
  misc_feature (71): n=t or c
tgtgagtatgtgaccacaccgagagataagttatagccatattggctgtactaataaatcaaagcaaaagntaaaatttgaattttcaaattttattttga

SEQ ID NO: 22887 - DNA, 101 bp, rice(Oryza sativa)
  misc_feature (71): n=t or c
tttcttagtttctctcttgattatttcgatcatgacctagaccgaatttgctgcttgacaatttttccatngttatttggttttaccttttagtgatcgaa

SEQ ID NO: 22888 - DNA, 101 bp, rice(Oryza sativa)
  misc_feature (71): n=a or c
cacaagaacaatatcgctttttaattaactctgaagtcaaggaactctaagatgaggtatgtatgatatanacatgctgtaacctatatatgtataacaaa

SEQ ID NO: 22889 - DNA, 101 bp, rice(Oryza sativa)
  misc_feature (71): n=a or c
tcggtgcagtctgaacctgtactactggttgatagtccagtttgtatcaatcgtttcgaatatcttggatnatgagtaattaattttccggtttaaaagaa

SEQ ID NO: 22890 - DNA, 101 bp, rice(Oryza sativa)
  misc_feature (71): n=t or g
cagattaaggaaaacaaattgttgtcccagattaagcctccataaaaaactaattaagcctctgtttctgntgtttctcctaaaccgtttatcggaatcga

SEQ ID NO: 22891 - DNA, 101 bp, rice(Oryza sativa)
  misc_feature (71): n=a or g
cgccacagaagtgacgagcttttaaatgttttgctctccactggagagtcgccttggtcatgtgggcaatnattttgcttggcagcgcaagtttttttgag

SEQ ID NO: 22892 - DNA, 101 bp, rice(Oryza sativa)
  misc_feature (71): n=t or c
aaattaatgagaataaaacagagacttgccattgacgatgaaatcctaaagccgttgttgccaagctcgangccggaggaggaagtcaacgtcaatggtgc

SEQ ID NO: 22893 - DNA, 101 bp, rice(Oryza sativa)
  misc_feature (71): n=t or c
cgggtgcttatgattggcagcgattttgcaggagattttacccgagggtttcgattccgagcttgggatgnacggtcagggagggaacttcaatccgcagt

SEQ ID NO: 22894 - DNA, 101 bp, rice(Oryza sativa)
  misc_feature (71): n=a or g
gacgaccgttgccccctgtccttgtgaggtaaattgctggaagacgatacgttggcattagcggaagaatngctactgttcctggctgctggcacgtcatg

SEQ ID NO: 22895 - DNA, 101 bp, rice(Oryza sativa)
  misc_feature (71): n=a or g
tgataactaaacatctgcacattttaggtgcattgggcatagcaagcgtgctgcttcacccgaaaacattnggcggatgtgcggtcttcagtggcttcctt

SEQ ID NO: 22896 - DNA, 101 bp, rice(Oryza sativa)
  misc_feature (71): n=a or g
ggctattaccttggagcgagttgtcatcaggattttgctcccatttgtcgacatggggaaagcgtcaaccnattcatgccatgtttcttctctccagacgt

SEQ ID NO: 22897 - DNA, 101 bp, rice(Oryza sativa)
  misc_feature (71): n=t or c
gagttctccagaatatatatttttccacctactctccccacatgttggacatctgttcatattatcatacnctccacgaaataacacacaatcattgacac

SEQ ID NO: 22898 - DNA, 101 bp, rice(Oryza sativa)
  misc_feature (71): n=a or c
cttgttaattcttcttcttcttcctaactactccaagctagctcagaatcagatccatccatggcctcctncggctccaagtccaagaccaacaatggctt

SEQ ID NO: 22899 - DNA, 101 bp, rice(Oryza sativa)
  misc_feature (71): n=a or g
agtatgcaggaggtggctgccaagctgcacgcaattagggattccatatctcagaggttactgaatcaacntcaacactgttagttgttctgttttgtctg

SEQ ID NO: 22900 - DNA, 101 bp, rice(Oryza sativa)
  misc_feature (71): n=t or c
taagtaaatctcgtatacatatatgaagtaattagttatttggcaattagatgttgctgtaacccatttcnattatctaaaaaaaaaagatgttgctagct

SEQ ID NO: 22901 - DNA, 101 bp, rice(Oryza sativa)
  misc_feature (71): n=a or g
tctgctctgctcctctctctctagtttctctctctagccccgacacattgtaataagggcacccgcaatgnttatctataggctctctacaagagatccat

SEQ ID NO: 22902 - DNA, 101 bp, rice(Oryza sativa)
  misc_feature (71): n=a or g
ctcgttgcaccacacaggtaactatcgtaggctggccatttctcttgatgaagtccttgtgtttcaggatnctttttaactatgctaatgttcacacccac

SEQ ID NO: 22903 - DNA, 101 bp, rice(Oryza sativa)
  misc_feature (71): n=t or c
tttatagttggaatcatctcagattccgatatagcagtagttgatttcacaaccccttcaccctgaagtanaggttcctccccatgtgtcgaactcggttg

SEQ ID NO: 22904 - DNA, 101 bp, rice(Oryza sativa)
  misc_feature (71): n=t or c
caccttaataacttttaaaagattgagaaagtaatcagatttgtgtagccatcggattggaatgggtagcnagcccaagtacccccacccatattaatatc

SEQ ID NO: 22905 - DNA, 101 bp, rice(Oryza sativa)
  misc_feature (71): n=a or c
ccaaacttctccctaatttcaggaactaaacacagcgtatgttcggatgacaatctttgggggcagttgangtccgtggcagtggcagtgatgaccatgac

SEQ ID NO: 22906 - DNA, 101 bp, rice(Oryza sativa)
  misc_feature (71): n=a or g
tgctgatgatgaaaaagccaatacaagaagatgtatgtcctttggagaagcaaccattgtatattctgganagaaccaatcagttgatggcttcaaaggct

SEQ ID NO: 22907 - DNA, 101 bp, rice(Oryza sativa)
  misc_feature (71): n=t or c
aggtagattcctatctacggattgttggggagccaaagcttccttcttcgtttctgcaggtgattttaatntcctgttttcttcttatatcatactccgta

SEQ ID NO: 22908 - DNA, 101 bp, rice(Oryza sativa)
  misc_feature (71): n=a or g
aggtcaaggtgcaccatctaatcaagttggaggcatgattgaagtctcacgtatcactcagaaagaaacangtgatgactcatggttcacaacagatgtta

SEQ ID NO: 22909 - DNA, 101 bp, rice(Oryza sativa)
  misc_feature (71): n=t or g
gactgcagttcacaggtgtaccaaggattgattagaaacataataatgttcagatgccaatgcagagtacngtatgttagcagaaggtacaataccatatc

SEQ ID NO: 22910 - DNA, 101 bp, rice(Oryza sativa)
  misc_feature (71): n=a or c
gctctgatgaaccgatggggaaactgaaggccaaaggctggttaattagctactatcttgcaataccccgngagagagagacagagagagagagagaggga

SEQ ID NO: 22911 - DNA, 101 bp, rice(Oryza sativa)
  misc_feature (71): n=t or c
ggtttattttgaagcggggaaagaagctagcattctagcaaaggagtagacgagtagctcggttcattggncgtcgtaccatgggaaggtcgctgaagcac

SEQ ID NO: 22912 - DNA, 101 bp, rice(Oryza sativa)
  misc_feature (71): n=t or g
tcccctcagatgaatgtgccgcagctccaatcacactgcttggcatagacccataattcctaacgagttgnaagtttgtcatagctgccccagttgctgaa

SEQ ID NO: 22913 - DNA, 101 bp, rice(Oryza sativa)
  misc_feature (71): n=t or c
ttttgacggctaccctgggccgaatgatgggccagccatgttcgattttattgggcttgacttcagatttncagcaaaaaactatactaatacatactcct

SEQ ID NO: 22914 - DNA, 101 bp, rice(Oryza sativa)
  misc_feature (71): n=t or c
tagatattttaccggaattagttcccttgctgtgtgttaacagataaaaaaattggccgctccaaacatanggggataaataaaatagcttgtatttacga

SEQ ID NO: 22915 - DNA, 101 bp, rice(Oryza sativa)
  misc_feature (71): n=a or g
ttagagagaattttttgagcgcatggtataaaaccacatcaaatacatgtggttgaaccgtaggtgtttcnatatattgttgtcaaagcgactggtactat

SEQ ID NO: 22916 - DNA, 101 bp, rice(Oryza sativa)
  misc_feature (71): n=t or c
cacgcttttggcacgcctagtgggacaacctttggtagttcttcatcatggttgataaaaaacatgatatngatgatgaaaacatcatcccggtgatgcta

SEQ ID NO: 22917 - DNA, 101 bp, rice(Oryza sativa)
  misc_feature (71): n=t or c
attgatttttacatatggtggcttagagacccgcctaaaaatctagttttacatgtgggtgtgaaaccacnagggaaaattgtctattttgacatgccttg

SEQ ID NO: 22918 - DNA, 101 bp, rice(Oryza sativa)
  misc_feature (71): n=a or g
catcatgatattgtagcggataatagcctgtattttgtttaggttacaggtgaatctagggttccgctgcngaaaccaatctgctatcaatattttaactg

SEQ ID NO: 22919 - DNA, 101 bp, rice(Oryza sativa)
  misc_feature (71): n=a or g
gcacgacggggcagagaatatgcaaccttgggttaggattgatagggttgtgcaaatcttaaagcagatcnaatagtctagaaaatgcaaaatatagggaa

SEQ ID NO: 22920 - DNA, 101 bp, rice(Oryza sativa)
  misc_feature (71): n=t or c
aaataggcctcatcaacataagagcggggagtagtaatataagatacttgcatattaatcaaagccccaantctacatgctagacgggtaaccaaagatgt

SEQ ID NO: 22921 - DNA, 101 bp, rice(Oryza sativa)
  misc_feature (71): n=t or c
ttacgtgcgtacccgtgtgttttcacacggatataccggtgcgacggtctaattctgctgctttggatatnttgttattagtgattattacaccatcgtca

SEQ ID NO: 22922 - DNA, 101 bp, rice(Oryza sativa)
  misc_feature (71): n=t or g
tctctaatttgactggacagggtgatttaatggaatggactgatgagcatactaccattgtttgtcaattntttgcccaacaagtggtgaaaggaaatagg

SEQ ID NO: 22923 - DNA, 101 bp, rice(Oryza sativa)
  misc_feature (71): n=t or g
gacaatgatgaagagaagaaagaaacatatttcgctactggtataatttttgcttcgggaaagagatcatnctgcgttttaacaacaatagatgatgctag

SEQ ID NO: 22924 - DNA, 101 bp, rice(Oryza sativa)
  misc_feature (71): n=t or c
ttggatggtgctggtgtcttgtcttcgatggttttctccttgattggctgttgcacatgcacctgcacctnactgattattgtccctgcaagttctccttc

SEQ ID NO: 22925 - DNA, 101 bp, rice(Oryza sativa)
  misc_feature (71): n=a or g
tggtcatcaaaggctagcgggtgctacagattgaaggccggcaggacattcacaaatcggcggctgtgccngtccggcgccgggggtgatgacgactcgaa

SEQ ID NO: 22926 - DNA, 101 bp, rice(Oryza sativa)
  misc_feature (71): n=t or c
agcagaagcaggagccgcagcagaaatgaggagagatccagtccttttggcaatgcaggcaaagaaaagantgctgccatctcgagcaacctagcaaagct

SEQ ID NO: 22927 - DNA, 101 bp, rice(Oryza sativa)
  misc_feature (71): n=t or c
agtacttactagcgtttgtacgggattcttcatcagataattaattaacgacatacaacgagatgattggnatcaacagtagctcgctgcaaacgtgggag

SEQ ID NO: 22928 - DNA, 101 bp, rice(Oryza sativa)
  misc_feature (71): n=t or g
aattgactggggcattggatcctctgcatctgtgtgaaatgtccctaagtttccgtgtctaaagtttaacngtccgtcttatatgaatttttttataatta

SEQ ID NO: 22929 - DNA, 101 bp, rice(Oryza sativa)
  misc_feature (71): n=t or c
cactattttgtggaatgtaggcagtggttatgaccgattcgataaaaaagagggggtagtgtgcatttttngttggggattccctggaataaaacgtcgtg

SEQ ID NO: 22930 - DNA, 101 bp, rice(Oryza sativa)
  misc_feature (71): n=t or c
cctgacatagcaggatatgtaagacaaggcatttgggcacaggaaacaactaaaacatacagatagcaaangattgtcctcgttcatgtcaccatcagtgt

SEQ ID NO: 22931 - DNA, 101 bp, rice(Oryza sativa)
  misc_feature (71): n=a or g
tgagggccatgttctatccgtggtaaattggccccatgcattctcctagcattacctttgccatgccgtcnctctcctcaagcgcctcaacggcgtgctcc

SEQ ID NO: 22932 - DNA, 101 bp, rice(Oryza sativa)
  misc_feature (71): n=a or g
tatggagatggctaggctgccataggcttaaaaaccgcatgcgaaaacctaacaaccgccagggaaaatanatatcaaatcataattttgagagagcttct

SEQ ID NO: 22933 - DNA, 101 bp, rice(Oryza sativa)
  misc_feature (71): n=a or g
aacaatacactcgcaaccgccaaaacaaaattaatgaatcataaatgtcaacggcgtatcaggatatgccnaaagcacaaataaataacttggcacagaga

SEQ ID NO: 22934 - DNA, 101 bp, rice(Oryza sativa)
  misc_feature (71): n=t or c
gtggttgcatcaacagagaggaatcggtccagaatctagcggaatactggtagtaggcaaatcaattaacnagatctcgcggagagggtccggctcccccg

SEQ ID NO: 22935 - DNA, 101 bp, rice(Oryza sativa)
  misc_feature (71): n=a or g
ggcactgcctggaggatggcttcacttatgtcaacactcaacatgtgcaatcgatcgatttagtatccaanatgattatgtctagctgataattagcatgc

SEQ ID NO: 22936 - DNA, 101 bp, rice(Oryza sativa)
  misc_feature (71): n=a or c
ctatgccactacagttgatcaagctcatcggtaatctatgtgaaggtaccgttcactcttgatgggccaantggagttcttcaacaccttgagcacttgat

SEQ ID NO: 22937 - DNA, 101 bp, rice(Oryza sativa)
  misc_feature (71): n=t or c
taaccatccacgcgtgcatgatatatcgatcgatctctactcttgtgtactcctcgcagatatgacgaaanccgacgacgatctcaaatgcttctacgtgc

SEQ ID NO: 22938 - DNA, 101 bp, rice(Oryza sativa)
  misc_feature (71): n=a or g
tttgggacgcggcatgtccattcttgataaatcttaggttcttggatggtctccctaccccgattcggctnttttagctgttaatccgtgctagcttcgtg

SEQ ID NO: 22939 - DNA, 101 bp, rice(Oryza sativa)
  misc_feature (71): n=t or g
tgctaaatttaacgaatcaacagccaacattgtccctgttctctcagttgaagcaacagaacaaaccgganaagttcaatacagcaggagacagtgaatcg

SEQ ID NO: 22940 - DNA, 101 bp, rice(Oryza sativa)
  misc_feature (71): n=t or c
acggtgagggtgacaggcaagctcatgactctatcggggaagaagctaacctcgtcgccgtcgtccatgtngtagtccgccggcgtctcatagccggtcac

SEQ ID NO: 22941 - DNA, 101 bp, rice(Oryza sativa)
  misc_feature (71): n=t or c
cttggtggcgtctgctgaatcggctgttgctgtgccggatcgacaactagtggatttggtaaaaacatagncgccacctggtcctgagttagccgattgac

SEQ ID NO: 22942 - DNA, 101 bp, rice(Oryza sativa)
  misc_feature (71): n=a or g
cctccccacttaaaaagttcaatttcctcttctttttgtgcaggacatgttcgtggcgagcagcgagacgncggcgacgtcgctgcagtggaccatgtcgg

SEQ ID NO: 22943 - DNA, 101 bp, rice(Oryza sativa)
  misc_feature (71): n=t or c
ctaaaaatagttataaaaataaaaaccagaagctgagaaaccaacatctctaaattctcataagctgttantcataattttaaagcttccctagatagggt

SEQ ID NO: 22944 - DNA, 101 bp, rice(Oryza sativa)
  misc_feature (71): n=a or g
cccactccagatcggatttccatggctcggcctcaaattggccaggggagtcaatgccactagcttacccngacaacatctccaacaacggcggcaaacta

SEQ ID NO: 22945 - DNA, 101 bp, rice(Oryza sativa)
  misc_feature (71): n=a or g
aaagtaggcatccaaaggctccaagcagtacaattgagtttgggagagtatgagtcttgagaaacaatctngaagaagaaaaaaacttgtttctagcttct

SEQ ID NO: 22946 - DNA, 101 bp, rice(Oryza sativa)
  misc_feature (71): n=a or g
gaagagtggtttaagatgctgaagtccatgatgactagttctgataacggaacttcggtaatggaaagtcngtattaccatggacagacctaccagtttac

SEQ ID NO: 22947 - DNA, 101 bp, rice(Oryza sativa)
  misc_feature (71): n=a or g
aggatctatcccatcatgtctttacctttacagacgactgaggccatgtttaggatgtgtttagttctacnttaaaattaaaagtttgaaaaaactggggc

SEQ ID NO: 22948 - DNA, 101 bp, rice(Oryza sativa)
  misc_feature (71): n=t or c
agggatgaagccgcgatagcacccactgctttcactggagaaacagtagtaatagtacactttctgtcganaggatcaggtgtgcgtgtgactgctcctgc

SEQ ID NO: 22949 - DNA, 101 bp, rice(Oryza sativa)
  misc_feature (71): n=t or g
tgtctaagattttccataattatattcggatcacatccaataaacaaatatccttatgggcttaaagcacntagcgaacatgcacactcctgaacaaagac

SEQ ID NO: 22950 - DNA, 101 bp, rice(Oryza sativa)
  misc_feature (71): n=a or c
cgaaaccatcatctaaaccgctttggtaccttattttctttggttttaggagttaatggatacatcatatntgatattgcagtttgaggatgaatttccga

SEQ ID NO: 22951 - DNA, 101 bp, rice(Oryza sativa)
  misc_feature (71): n=a or g
acatttgttgtcgatacttcaaacacaaagatgttgctagatatgcatggtgataccatcagggagaaggnaatattggtaatatcccatgctaatgtgtg

SEQ ID NO: 22952 - DNA, 101 bp, rice(Oryza sativa)
  misc_feature (71): n=a or c
atatcctgcatagagacatcaaaccaggcaatgtactcttggatgaaaatttcaacgccaagctcgccgantttggcctatcgaggatggcaaaccaagac

SEQ ID NO: 22953 - DNA, 101 bp, rice(Oryza sativa)
  misc_feature (71): n=t or c
tcctggggaagtgttgggtctgttggcactcttatcctagcttgtacctctacagacgtttgccttaatangagtaagtgttttgttatttcttgatgata

SEQ ID NO: 22954 - DNA, 101 bp, rice(Oryza sativa)
  misc_feature (71): n=t or c
gcaaacattacccatcttctaccaaacaaaatgattggatcattccatcctataaacaaaacaggaatctnggttcttaaaccaaacacacattaaggtcc

SEQ ID NO: 22955 - DNA, 101 bp, rice(Oryza sativa)
  misc_feature (71): n=a or c
aagctagattcttttgtataattactcgagcagattagctaggccaaatcaaatacgtatgtacatatggngtatcatattcgtgtgtggtactagccttc

SEQ ID NO: 22956 - DNA, 101 bp, rice(Oryza sativa)
  misc_feature (71): n=t or c
ttacgcatattgagtaatcggccagtagatattctgacaaagcaaagtaatttagtaatgaacatactccngctagtatttaaaatggcttgctcgaagtt

SEQ ID NO: 22957 - DNA, 101 bp, rice(Oryza sativa)
  misc_feature (71): n=t or g
agccacacggagcctaatgcaggcacgagcattctggtaaacatctatcttgtactcatccttgaatttcnctgcaaagtgcttaaacaggacttcatcga

SEQ ID NO: 22958 - DNA, 101 bp, rice(Oryza sativa)
  misc_feature (71): n=t or c
tggtggcccgtggcgttgaggaccaccgagtcgttgcccgtcgaccaggtggcgatcggcttgctcgtgtngcagttcttgtagtccgacttgctcaccgc

SEQ ID NO: 22959 - DNA, 101 bp, rice(Oryza sativa)
  misc_feature (71): n=t or c
aggccaccggcgacggcatggggcatggcagcgaacaatgaagttctggcggatctggagaccacgaccanctgaacaacgccgcacatatcctcccggcc

SEQ ID NO: 22960 - DNA, 101 bp, rice(Oryza sativa)
  misc_feature (71): n=t or c
cacatcaaatcacattagaacatataaattcgattagaaaaaaaattaacccagtaagatagacacgtggnatttaacgtggcgcttacgtggcaatggta

SEQ ID NO: 22961 - DNA, 101 bp, rice(Oryza sativa)
  misc_feature (71): n=t or c
gacttatattgaaaagctaaaaaattgatttgtgatgattgcttgggtggggtttcaattgctcttagggnctgtttggatgagtttgagattctaagaag

SEQ ID NO: 22962 - DNA, 101 bp, rice(Oryza sativa)
  misc_feature (71): n=a or g
gcatgcacgcgccccgccatagttagcatcaatcggcggatcaaggactggttttctagctggttttaacnaaaaaccggacggtccatccaatttctgcc

SEQ ID NO: 22963 - DNA, 101 bp, rice(Oryza sativa)
  misc_feature (71): n=t or c
taaatcgaagtggttaacggcttcccttttcagttctggaagctggtagcgttcttcgcaactccaactancactcctgcgctatttggtggtggcctgtt

SEQ ID NO: 22964 - DNA, 101 bp, rice(Oryza sativa)
  misc_feature (71): n=a or g
gaagaatgaatttacaatgacaatcactaactagaggttcactacaagttcggaggccttatccatttaangcatctctacccaatgcaaggccaggcatg

SEQ ID NO: 22965 - DNA, 101 bp, rice(Oryza sativa)
  misc_feature (71): n=t or c
ttatcattatcatttagcaaacatggataactacagtcaaaacgacacatagggcagaatgatacggaaantacagttttaatgctcggtttagatatgaa

SEQ ID NO: 22966 - DNA, 101 bp, rice(Oryza sativa)
  misc_feature (71): n=t or c
ttctgaatgatttccgagagttttgtagccctgcagaaaactgtatgtccttcctgtccgggtgcttctcntgtaggaaaactgtatgtccttcatgtccg

SEQ ID NO: 22967 - DNA, 101 bp, rice(Oryza sativa)
  misc_feature (71): n=t or c
gctgcaggcaaggatgtgtcagatgtttctgaggatgaagcttttgaggacccatttgctgcatatgaggntgctagggatgtggctgccggtgagggtcc

SEQ ID NO: 22968 - DNA, 101 bp, rice(Oryza sativa)
  misc_feature (71): n=a or g
tgaaggaaagctcaaaagaaacttcacactaccctcatcaaataagagatgcagatgaaagtgcttgaatnatgagtgatgcaaaaagaaagactaaatga

SEQ ID NO: 22969 - DNA, 101 bp, rice(Oryza sativa)
  misc_feature (71): n=a or g
attaccaccgacatctataccccttttccatctctacggtctaaaaacacaaaaaaatcggcaccggcctnggcccgaggcacgtcggcggcccgccatgc

SEQ ID NO: 22970 - DNA, 101 bp, rice(Oryza sativa)
  misc_feature (71): n=a or g
tttcccctttctctgttggcgtgctactattaatgtaaagaaagttctggttgggtgagcgatggcaatgnttttggccttttggtgcgggtaagtaagtt

SEQ ID NO: 22971 - DNA, 101 bp, rice(Oryza sativa)
  misc_feature (71): n=a or c
agggaagtacaccgatgttacaacaattaacttggtcaaagctcttgttcttacaacctggaaattaatcntcttcactgcagtttgtgccttactccgta

SEQ ID NO: 22972 - DNA, 101 bp, rice(Oryza sativa)
  misc_feature (71): n=t or g
tctctgcttgaaaccaaaatagaaatcaattttgaaattgcattctagccgggtccacaagtcagtgaaangatatttgcagagaggccctcggaagttgg

SEQ ID NO: 22973 - DNA, 101 bp, rice(Oryza sativa)
  misc_feature (71): n=t or c
gagaagcaaattcaagaataagatcaatcaaacacaatgggtcagaaattgcagatcacaatggaaaggcnttgctgctgcactccttctaccaacatttc

SEQ ID NO: 22974 - DNA, 101 bp, rice(Oryza sativa)
  misc_feature (71): n=a or c
tttccaaagcttcagaggatatcgacagtccaacagagcagttaccttcaaactttcatgtaatccgcaanaaagtgatttaccatctttgttgaatgtca

SEQ ID NO: 22975 - DNA, 101 bp, rice(Oryza sativa)
  misc_feature (71): n=a or c
atgatctatatatgttgataccatgaactgatcgagctgatccgggtcgtcatcacgctgtggctcgtgcnggcgacgagggtggccgtcggcttcgtcca

SEQ ID NO: 22976 - DNA, 101 bp, rice(Oryza sativa)
  misc_feature (71): n=t or c
cagaaactgcagagatttattagtatggggaagtctgtgtcgatgcctgttaaccgggacgaggatgcagnggctgcgttcaagcactctgtgagcttgcc

SEQ ID NO: 22977 - DNA, 101 bp, rice(Oryza sativa)
  misc_feature (71): n=a or c
atatgtagaaggaagtgaaacctgttcacttccacggaatgaattagacaggcttccatcaatagtaacanttccagctcccattttttcctgctggcctg

SEQ ID NO: 22978 - DNA, 101 bp, rice(Oryza sativa)
  misc_feature (71): n=t or c
atcaactttacgatcccattgtattcaaggaactcgtaccttgataaatctcaatttacagtttgttctcntgctaataaaaccaaggcaaaatttgctac

SEQ ID NO: 22979 - DNA, 101 bp, rice(Oryza sativa)
  misc_feature (71): n=a or g
tcctcaggtaagctctccagctgcgttccacctctgatcaccaaccccttggtgtgacagagacccttgantggctcaagatgcagtatgtctggcagatc

SEQ ID NO: 22980 - DNA, 101 bp, rice(Oryza sativa)
  misc_feature (71): n=a or g
atctgcgaggaaagattgtgcaagtacattggcataggcacggtgatggacatcctcgcgctggctgatcnacaccactgcaaggggctgaagaaggcgtg

SEQ ID NO: 22981 - DNA, 101 bp, rice(Oryza sativa)
  misc_feature (71): n=a or g
ctgtgttagagccgtaaccgagcccctaattgcaagccattttggagagggcatattaagtgcactgttcncagactatgctcaccgtgttgccagccacc

SEQ ID NO: 22982 - DNA, 101 bp, rice(Oryza sativa)
  misc_feature (71): n=a or g
tatcgcatcttcttgattatctttattaaaacaataggcttttaggaggttcccgtttgatgtgctgatgnctgttgtatttttattttaaatctgtgata

SEQ ID NO: 22983 - DNA, 101 bp, rice(Oryza sativa)
  misc_feature (71): n=a or g
tccaataaaattggttaatttgcaagtctttaatccacaaggttgaccatatcgattgaatttcaatctgntcttctcattgggatcaaggtccttccata

SEQ ID NO: 22984 - DNA, 101 bp, rice(Oryza sativa)
  misc_feature (71): n=t or c
gagaagggaacattttacgtgtgcttttcatgagaagccgaagagatgggaacattttgcgtgtccttttnatgcaattttgttcgcctaacacttcactt

SEQ ID NO: 22985 - DNA, 101 bp, rice(Oryza sativa)
  misc_feature (71): n=t or c
gccggaccgaacatgcgaggatagagatgcttgtccaattttatttcaagtccatgtattatcggctggancagtgaagcccatttaggagcttgagtcca

SEQ ID NO: 22986 - DNA, 101 bp, rice(Oryza sativa)
  misc_feature (71): n=t or c
tcattgaatggcagcttcgcggagccataccttctcccaacaatgtcagcaaagcctgaaaaaataagaancaagaaggtggatatacttagcagaagcat

SEQ ID NO: 22987 - DNA, 101 bp, rice(Oryza sativa)
  misc_feature (71): n=a or c
gttgagaatagccgaatgacatggcaattcggagtagtagttagtctctctcacatttgcaatgctaggcnggcgttgcggcgatcgccggatgcagaggg

SEQ ID NO: 22988 - DNA, 101 bp, rice(Oryza sativa)
  misc_feature (71): n=a or g
tagaattttggtggatgagttaattgttcagagcaaaacaaaaggtagggagctgaggcagtcttagcctngactcatcatcctggaaaagtttatgttcc

SEQ ID NO: 22989 - DNA, 101 bp, rice(Oryza sativa)
  misc_feature (71): n=t or c
cggatttccgtctgatacttgtcttccatattaattttcatttctgagaaaagcaatatgtattcatttcngtatctggtactaaataaaaattattcgtt

SEQ ID NO: 22990 - DNA, 101 bp, rice(Oryza sativa)
  misc_feature (71): n=t or c
cagaatcaagaaacattttgacaccgtgatctgggttgctgtatctatgagctttgatgcaaaaacattgnttgataaaataattcagtctgttacattat

SEQ ID NO: 22991 - DNA, 101 bp, rice(Oryza sativa)
  misc_feature (71): n=a or g
tcgaattttgtagcttacaattgtttcggctcatcgtacaccagagaggatgtaccattatgcattatctnctaaagaaagaggcttagaggtcataattg

SEQ ID NO: 22992 - DNA, 101 bp, rice(Oryza sativa)
  misc_feature (71): n=a or g
gcaccaagctacaaaggcagagcatcaagtgcaagaagatgcaaaggtggcacacaacacctcatttactnctcgctctttgtccagtgggggtagaccga

SEQ ID NO: 22993 - DNA, 101 bp, rice(Oryza sativa)
  misc_feature (71): n=a or g
tttgtgttcagcgcgaacagggtcaaatttggaggtaaatttgcttctcatatgggccaacatcctattgngccgtgatgcttccgggcccatatctggcc

SEQ ID NO: 22994 - DNA, 101 bp, rice(Oryza sativa)
  misc_feature (71): n=t or c
tagtgttcagtgcaagaggtttggttcagaacaaaccgcgacgttgaagatgttgtcgacaagagtagcanttgcagcggtataatttctatggagtggct

SEQ ID NO: 22995 - DNA, 101 bp, rice(Oryza sativa)
  misc_feature (71): n=t or c
actaaccacttcatgcccctttcccccacatgatgcatcaggttgaaaaaacacagaacatgcagctctgncacctggagttctgccttggccaaaagcag

SEQ ID NO: 22996 - DNA, 101 bp, rice(Oryza sativa)
  misc_feature (71): n=t or c
gtcctccattagtggatgtccttctctttgtgcagtttccttcatctcagagaggtatgtgctgatccttngctgtgcacttgtgtaagcctcttgagaat

SEQ ID NO: 22997 - DNA, 101 bp, rice(Oryza sativa)
  misc_feature (71): n=t or g
cagattatgtcttggtcccttatgtagccttacgataaagcttgaagttgtttttcggtagcaccgttgtntgttccatctggttctaattgtaaaaacag

SEQ ID NO: 22998 - DNA, 101 bp, rice(Oryza sativa)
  misc_feature (71): n=a or g
cgagtcgtcgctgctcccactcatccgccaaccggttgcccccgaatcccgacgaaccttcgctgctcccnggtgcgtaatttctcctccccctcgcctcc

SEQ ID NO: 22999 - DNA, 101 bp, rice(Oryza sativa)
  misc_feature (71): n=a or c
ctttgagaatcatgtttgtcttgatgagatcatctgtattcttgcctagcttcctgaatatagcgtatggnatcaaattcacagcagccccaccatcaacc

SEQ ID NO: 23000 - DNA, 101 bp, rice(Oryza sativa)
  misc_feature (71): n=t or g
ggccgacaagttgaaaagcaacaccagtattacgagatcatagccaaaccgagacccggcatctatcgttnccacccacttcccaaggtcaatatacccca

SEQ ID NO: 23001 - DNA, 101 bp, rice(Oryza sativa)
  misc_feature (71): n=t or c
caaactttgctcacgcgaaaatattggaacgagggcgacacacacttctctgaaatcagcgacgtaaaatnagtgatatttttcaacgactcacccaatct

SEQ ID NO: 23002 - DNA, 101 bp, rice(Oryza sativa)
  misc_feature (71): n=t or g
tgcacctccctccagcctcaaactccatggaggaaagttatgcttatgcagactctccaggcagcaacaanttgacatgacaagtctcctcctctcaatgg

SEQ ID NO: 23003 - DNA, 101 bp, rice(Oryza sativa)
  misc_feature (71): n=t or g
ctccctctggcaattgaagaacactgctgccacaggaggtccaagattatacagtgcggaaaaatctcttntattgaaatttggtctccatcctggtgcat

SEQ ID NO: 23004 - DNA, 101 bp, rice(Oryza sativa)
  misc_feature (71): n=a or g
agagatcagggtgatttggttctatttggttgggattggatctgattattgtgaaatcgatcggtcaaacnctgtcttatgctttgaaagtctattaatgt

SEQ ID NO: 23005 - DNA, 101 bp, rice(Oryza sativa)
  misc_feature (71): n=t or g
atcatcgatgttaatttgttcaattcctgcagcaagacatacgtacgcttcattatttgaagatggttggntgttatctaaacggggccatgtattggctt

SEQ ID NO: 23006 - DNA, 101 bp, rice(Oryza sativa)
  misc_feature (71): n=t or c
cggccgcgggcgagcggagatgccccggacccaacaagataggggggagccaaaatggcgctgctctcacnaccctccccgcctcctccgctcccgccact

SEQ ID NO: 23007 - DNA, 101 bp, rice(Oryza sativa)
  misc_feature (71): n=a or c
ttgaaggaaaggatttcctgattcagagctacaaggagcagaagctagagctctgtgggaagatcagaganttgcaagaaaagctctctgcacaagttccc

SEQ ID NO: 23008 - DNA, 101 bp, rice(Oryza sativa)
  misc_feature (71): n=a or g
tcctcttcaccctcttcccgtccctcattcacatcttgctcttcttcctcacttgctcatattcctctccnctcgactcctcatgctcgcactcgggctct

SEQ ID NO: 23009 - DNA, 101 bp, rice(Oryza sativa)
  misc_feature (71): n=a or g
cacggtcttacaagaaaacaaaagccaaaaaacacacccatgctgacctctctacggagctactccctccntccaaaaaaaagacaaaccctggatttcgt

SEQ ID NO: 23010 - DNA, 101 bp, rice(Oryza sativa)
  misc_feature (71): n=t or c
caaaggcgtggctagagttgagttcagtctagggattggttttgagccgtcctggctataccttcctttantggtctagcggtgaccgatcacgtttagtg

SEQ ID NO: 23011 - DNA, 101 bp, rice(Oryza sativa)
  misc_feature (71): n=t or c
ggagcggtggtggggaggagatggggtttttccgcactgtgctgggtttcttcgggtttggggtgggagtnaccatggggcttgtgattgggtactacctc

SEQ ID NO: 23012 - DNA, 101 bp, rice(Oryza sativa)
  misc_feature (71): n=t or c
cacataatagttacatagctgttacattgacagctactgttaatccatacacagttgatggttcatacttnagagtgttcaataaatattcatatatatat

SEQ ID NO: 23013 - DNA, 101 bp, rice(Oryza sativa)
  misc_feature (71): n=t or g
tgagccacaggcggcggtgaagtcgaccaagcgcgcggggattatcggagttgccttcgaggcgtactatnccaagatttcgcagatgccgcctgcatcga

SEQ ID NO: 23014 - DNA, 101 bp, rice(Oryza sativa)
  misc_feature (71): n=a or g
tggcgcgtcatcgtggtccgcgtcaagatcatcctccacgtcaggcggaggagagacaaattccaccggcnacacttctgccacaggcggtgttgtcggag

SEQ ID NO: 23015 - DNA, 101 bp, rice(Oryza sativa)
  misc_feature (71): n=a or g
ccaacaatataattctgctccattctaagccacacaaggtttgtgagactccctgtctctggtggtatggnaccagatatctcatttgcgtgcagccacaa

SEQ ID NO: 23016 - DNA, 101 bp, rice(Oryza sativa)
  misc_feature (71): n=a or c
tggaagagatttgatcgatcttacagaggagatgaaagacaagttcagaggtcagcctcttctgctatggnatcatcatatggtgttgacacaaattggta

SEQ ID NO: 23017 - DNA, 101 bp, rice(Oryza sativa)
  misc_feature (71): n=a or g
gttttcacctacctgtactctgtttttcaacaatagaactcccaccgtcctacagatttaggtggaatgtnacatatcctaatactatgaatctggacatg

SEQ ID NO: 23018 - DNA, 101 bp, rice(Oryza sativa)
  misc_feature (71): n=a or g
aatttaccaggtatatgtaggatattatgcttttttataacaacaagcacattgttcaaagaatccaagcnaacaaaaagaaaaaaataactatatgaaca

SEQ ID NO: 23019 - DNA, 101 bp, rice(Oryza sativa)
  misc_feature (71): n=t or g
ctacgcactcatgggccaggactagacgcatttgcaagtggaaaaagttcaacttgactccctcaacatangtgaaactaatttgtattcctcaatttctc

SEQ ID NO: 23020 - DNA, 101 bp, rice(Oryza sativa)
  misc_feature (71): n=t or c
gtgtacattctaactcatattcacaaacaacctacacttccagggaggcattaccagaggtaacattttcnggagggcttcttccgaaccttcaatctgaa

SEQ ID NO: 23021 - DNA, 101 bp, rice(Oryza sativa)
  misc_feature (71): n=a or g
aatctaaatcatttagaattttatctcttcgtttttttgacccaaaagtgacgtggtcgcatggaagtagnctgaaggactttatatggttcccaatcaac

SEQ ID NO: 23022 - DNA, 101 bp, rice(Oryza sativa)
  misc_feature (71): n=a or g
agcaaccaccagaagagtttagactagaaatagttgatggcctccccttggagcaatcctcatcatcacanttatggcttatatcaaacaagtattcatcg

SEQ ID NO: 23023 - DNA, 101 bp, rice(Oryza sativa)
  misc_feature (71): n=t or c
atacaacttagaaatgagagtttaagagagagggagtaacctgacgagctgttaagaaatagaatggtacnggttgatgggacatctaaaaactataaaaa

SEQ ID NO: 23024 - DNA, 101 bp, rice(Oryza sativa)
  misc_feature (71): n=a or g
gaagatgccatcaacattccatccaaccaataactaccggatttatcttcctggttccttgtcacaggtgnttcttcatgcagctcctggttacgcaccac

SEQ ID NO: 23025 - DNA, 101 bp, rice(Oryza sativa)
  misc_feature (71): n=a or g
aaatcggatgaccgatatgtagtttcttcccaattccgcttgcactactacctgacgctgatctcctcccntgcaagtatgcaacagcaatcagttccacc

SEQ ID NO: 23026 - DNA, 101 bp, rice(Oryza sativa)
  misc_feature (71): n=t or c
tgttgccgttgccatcggaaatttgcggcctcaatccagcgggggtggaccaaaaacttcttgttactaanagcccagcgagccttctccgttcctagatc

SEQ ID NO: 23027 - DNA, 101 bp, rice(Oryza sativa)
  misc_feature (71): n=a or g
agcaaaggctggctatgtctacatggagttctggtccatcaggaaatctaattcctatcttctcgtcctcnatctcagcaccatgaagctggagatgtttc

SEQ ID NO: 23028 - DNA, 101 bp, rice(Oryza sativa)
  misc_feature (71): n=t or c
aacatactggctcacattggcggacattgttgccattttcttatgctattgtatctggtgctattggatcntgttctgtcttatttgcaaaatcattgtaa

SEQ ID NO: 23029 - DNA, 101 bp, rice(Oryza sativa)
  misc_feature (71): n=a or c
gaagacgaaccataggagtatgtttcatgtttatggtccgtataatgcactaaccattaagtgtaagatantaatgattttgtcttctagttatctggtct

SEQ ID NO: 23030 - DNA, 101 bp, rice(Oryza sativa)
  misc_feature (71): n=a or c
accccattcagacccattacaacaacagctccagcagctgcaatctcaaatgatggagatccaacaacaanttcaacgccgaaataatggtggatcagggc

SEQ ID NO: 23031 - DNA, 101 bp, rice(Oryza sativa)
  misc_feature (71): n=a or g
tgcgtggcgtggaagggagactagtagtaatttgattcgattaatagcaagaggaagatgaggaagtacangtagtgcgcggttggctctctctccctctc

SEQ ID NO: 23032 - DNA, 101 bp, rice(Oryza sativa)
  misc_feature (71): n=a or g
gcgtgatctcaaaaggagttagttctcgaaaagatctcgcaaatattggctatttcttcacaatctgcatngggattggcatgtgttactttgcggattaa

SEQ ID NO: 23033 - DNA, 101 bp, rice(Oryza sativa)
  misc_feature (71): n=t or c
tatgccatcaaagtctccctacggcgatgaaacatttgataacaatgtagtgaaccaagatggttttgatngcttgaactcgctagagataaataatcctt

SEQ ID NO: 23034 - DNA, 101 bp, rice(Oryza sativa)
  misc_feature (71): n=a or g
caaggaacacgtcaacaacaagaacaattcctacatctatttaactataatgttcatccgatccaaatccncatgttctcggtacacatatgaacaagaga

SEQ ID NO: 23035 - DNA, 101 bp, rice(Oryza sativa)
  misc_feature (71): n=t or c
aggctcacataggcccaactaattttgtatcactacaactaattgacatccatatgtttagtggccccccnatgctatatcagttattcaaaaacgttcat

SEQ ID NO: 23036 - DNA, 101 bp, rice(Oryza sativa)
  misc_feature (71): n=a or g
ggatttgtttgtccctgttgttgattggagtgctctatctgttgttccggtggactctaaggatgtggcanaggcaatatcaaacaaggctcaatgtggtg

SEQ ID NO: 23037 - DNA, 101 bp, rice(Oryza sativa)
  misc_feature (71): n=t or c
cccccattgctacataagttagtgattcattggtagatctgcttgtgcttgaatgtgcaagaatgcttggnagatctgattgatgttgaatgtgcaagagt

SEQ ID NO: 23038 - DNA, 101 bp, rice(Oryza sativa)
  misc_feature (71): n=t or c
gacccttacatggaccgagatatgataactgggcggggatcaaaagatgaacttcctgaattttctccaangtatgtaacattctcaacacttgcacttgt

SEQ ID NO: 23039 - DNA, 101 bp, rice(Oryza sativa)
  misc_feature (71): n=t or c
ccgcaccttcggcaaacccttcaccgctacgaacttttcgtttttactttgccaattgccaaagggggccngaatacacaatttttggtgaacaccctgct

SEQ ID NO: 23040 - DNA, 101 bp, rice(Oryza sativa)
  misc_feature (71): n=a or g
cagtgtgtgggggcgtcgtcggtcgtctctttctgctcggtgacggttgagggtgtcacgtaggtcaacangctgccattgtcgaggggagcaaggccgtt

SEQ ID NO: 23041 - DNA, 101 bp, rice(Oryza sativa)
  misc_feature (71): n=t or g
atcatggctactacagctcaaaaaaagtgtcatgtgcaaatcgggaggatggagacttactgcgccagcantccatttgattgaatgaagttcttttcgct

SEQ ID NO: 23042 - DNA, 101 bp, rice(Oryza sativa)
  misc_feature (71): n=t or c
aaacctgatactatttgttttgccagcgatgaaagcagtgtcgcttgctcgccaattccaatgcgaatttngcttctcctcctatgcggacacgccgccac

SEQ ID NO: 23043 - DNA, 101 bp, rice(Oryza sativa)
  misc_feature (71): n=a or g
atgttcacatggaagatagggacccaaaacgccaaaagaatggttctgatgggtcgctaaggatggaaatnggaggcttagcgccagctaagctgccctca

SEQ ID NO: 23044 - DNA, 101 bp, rice(Oryza sativa)
  misc_feature (71): n=a or g
gactttgcatgctactacctgctcaagaaactgctgtgaacctacaccataggcacttaaagcaccataanctgcaaacgcattggacctcattttcgtat

SEQ ID NO: 23045 - DNA, 101 bp, rice(Oryza sativa)
  misc_feature (71): n=t or c
tgacagagcatacttgggcaggtacctggagatcagttcctatgctttgcttggtgacggctcgaacatcngcatctctgtaaaaggtgtcggcacctatt

SEQ ID NO: 23046 - DNA, 101 bp, rice(Oryza sativa)
  misc_feature (71): n=a or g
gtgaagcatttatacagctggcatacacgtgtaccaaaaccaccataaaaacagcttaaggggttaaagtntctggttttaatagttggagtatgtattat

SEQ ID NO: 23047 - DNA, 101 bp, rice(Oryza sativa)
  misc_feature (71): n=a or g
ctctgcatgcccatgaggtgcatcatcgaaaccaaatactaacaacggtctccttatctgcactccaggtnttttgacatcaactaaaatcatcgattgct

SEQ ID NO: 23048 - DNA, 101 bp, rice(Oryza sativa)
  misc_feature (71): n=a or g
caactcacgctttcgcatagagtgatgatgtctaacctttgcgcaattgctcttgcagacttcaaagcacnaagtatctattttaatgcagaaaggaagct

SEQ ID NO: 23049 - DNA, 101 bp, rice(Oryza sativa)
  misc_feature (71): n=t or c
aatacacgttccctccacccatctctttccatacaaccactccctggctccctgcttctactgaaacctanaggctactagctagtgctctcactctcact

SEQ ID NO: 23050 - DNA, 101 bp, rice(Oryza sativa)
  misc_feature (71): n=a or g
cggagagaacaagaggagtgcttacaccgagaggaagaggaacataaacggaaggaggaagaagatcgcanactacaagaattggccgaggtcaggcgcat

SEQ ID NO: 23051 - DNA, 101 bp, rice(Oryza sativa)
  misc_feature (71): n=a or g
tattgtttttatgattagaatgaaacaacaccatcttaataggatgggcgcacatcccatccgctcggccncctcctctttgagagcatccctctatgatg

SEQ ID NO: 23052 - DNA, 101 bp, rice(Oryza sativa)
  misc_feature (71): n=a or g
ctggccttgagtgttcgctatctcaagggttttggtatggacaggataatctgctttggttcttcatttcngccatttacagctaacactgaaatgtctct

SEQ ID NO: 23053 - DNA, 101 bp, rice(Oryza sativa)
  misc_feature (71): n=t or c
ataactatgcccgaacgagtctgcttgaatgaatgcaagtattgattcttcaaattgttcatcatctgctngtactctagcatctattctggtgtcagctt

SEQ ID NO: 23054 - DNA, 101 bp, rice(Oryza sativa)
  misc_feature (71): n=t or c
tgactgacaacctacataccataaaactattgcaggtacctcctatagtaacatttctgctaaccaggctntgttaaaactctgaaactcaggtatgcctt

SEQ ID NO: 23055 - DNA, 101 bp, rice(Oryza sativa)
  misc_feature (71): n=a or g
aagaagagataatcttttttaaagtggtgttactctcttctaaaactagtaaggtggtactaaaatttacntataaccctttcgtattatagatatcttga

SEQ ID NO: 23056 - DNA, 101 bp, rice(Oryza sativa)
  misc_feature (71): n=t or c
tcttcatctcttctatcaataccatgagacatgagcaaaatcatggtactccagtaagaagataggttccnagttgcttctggtgtagtacagttaaccaa

SEQ ID NO: 23057 - DNA, 101 bp, rice(Oryza sativa)
  misc_feature (71): n=a or g
attttcatctagtgttttatttcttgttttagggatgttgctgatggcacaaaggataccgagccagatanctggctcatatcactgttcaaggaacttga

SEQ ID NO: 23058 - DNA, 101 bp, rice(Oryza sativa)
  misc_feature (71): n=t or c
gatttgagggaggtaagatcaccaacatacaaggacgcagagcttctacacccacataacccaatattatncagatgtggccagtcaccgcagaagaagtc

SEQ ID NO: 23059 - DNA, 101 bp, rice(Oryza sativa)
  misc_feature (71): n=t or c
ttttgtaaaaagaaccaatagaatagttgtagatatcgaaataccggtagttatttttgatgtcgttgacnattcgtgtacagaggactaatctagacttt

SEQ ID NO: 23060 - DNA, 101 bp, rice(Oryza sativa)
  misc_feature (71): n=t or c
aacacacaacgattctatagtgtgaattgcgtagcaatttctcagtggctttttgcctatcaagataagtngttatgtccagcccacgataaattaacacg

SEQ ID NO: 23061 - DNA, 101 bp, rice(Oryza sativa)
  misc_feature (71): n=a or g
ggtgaacagcttgttgtcacgggagttcacaaaaaactcctgtgaaaatcgagttagaaaaagggctggcnatcagaaactatgaaggctaccacggtggg

SEQ ID NO: 23062 - DNA, 101 bp, rice(Oryza sativa)
  misc_feature (71): n=t or c
ttatgtggctatattttaaaccttgacaatgacatgtgaatattgttggtgcatctctattaagtcactangtgttatttcactactggaatacatcaatc

SEQ ID NO: 23063 - DNA, 101 bp, rice(Oryza sativa)
  misc_feature (71): n=a or g
tgtgtcttgcacagcctcttcaccggcgtctcttgaaccttcaataatccatacacaaaaagcagtaccantacattaattacacgtacagaaaacggtgc

SEQ ID NO: 23064 - DNA, 101 bp, rice(Oryza sativa)
  misc_feature (71): n=t or g
aactaagcttctgtctattatatcaattccctatgtacatggattgacaacagcgacatggtatggttgantttttacagtgagacttactccggtctatc

SEQ ID NO: 23065 - DNA, 101 bp, rice(Oryza sativa)
  misc_feature (71): n=a or g
accaaacgacgacaaggctggtggctagatgtgccatatgatgtgactcatccatagatgacgacggttgncaacgaagaaaaccagaacaacgaaaatgt

SEQ ID NO: 23066 - DNA, 101 bp, rice(Oryza sativa)
  misc_feature (71): n=t or g
atccgagccgattccttgatctccgttcctcttcatgttttaccaatcctacaaataatagcacacattantaagaatttataaattgcatattcagttat

SEQ ID NO: 23067 - DNA, 101 bp, rice(Oryza sativa)
  misc_feature (71): n=a or c
aacacgcgtgcttgcagttcctgcgattgcgtaatcatcctaagatctccagaaacatgtagagttcacanattttagtgattcattcagtcatcgtgtgg

SEQ ID NO: 23068 - DNA, 101 bp, rice(Oryza sativa)
  misc_feature (71): n=t or c
cagcaaaataaccctacttggcgtgccttgcaaccaaaaggaaatgtcaagagtgagtgacaatgaaaagnctataatataatttgccataatataaagta

SEQ ID NO: 23069 - DNA, 101 bp, rice(Oryza sativa)
  misc_feature (71): n=a or g
gcacaaaaggctttgcttgacgcaaaaaaatgtgtaaaactgcggcctaagtggatgaaaggtcactaccnggaaggagctgctttgatgttgctaaaggt

SEQ ID NO: 23070 - DNA, 101 bp, rice(Oryza sativa)
  misc_feature (71): n=a or g
taaaatagcagtgctgcaaaacgaaaaaaattctctgtcatcagagctacagcagctagaagcttcttttnagaatcttggtaatgacttggaacaggaac

SEQ ID NO: 23071 - DNA, 101 bp, rice(Oryza sativa)
  misc_feature (71): n=a or g
tcttctcgatctcctccttgctcagcctgcccttgtcgttggtgatggtgatcttgttcttctgcccggtngtcttgtcctcggcagagacgttgaggatg

SEQ ID NO: 23072 - DNA, 101 bp, rice(Oryza sativa)
  misc_feature (71): n=a or c
aacaacaaaaaatggtgaggccatatggccccacatgtcatcccaccactccctcctctctatatgtggcnagtgcagaggggcggcagcgggcggagggg

SEQ ID NO: 23073 - DNA, 101 bp, rice(Oryza sativa)
  misc_feature (71): n=t or c
caaaacataatatgaaattaccaatataccatcttcctcttcaatccttcttcccatctcaggccgcgtgnaggcgccggccattgaggagaacacaacta

SEQ ID NO: 23074 - DNA, 101 bp, rice(Oryza sativa)
  misc_feature (71): n=a or g
ggctattggtacctttctttggttgtagcaccaacaccaagatgatgtataaagttttacatgtataaatntaactgggtatataccaaatactttttttc

SEQ ID NO: 23075 - DNA, 101 bp, rice(Oryza sativa)
  misc_feature (71): n=a or c
ctctcagtgaagaatctcagtcttcatctgggattcaacaaacggtgttctgtggacttggagacaatgantttgggtgtgtttggttaggcttttcaacc

SEQ ID NO: 23076 - DNA, 101 bp, rice(Oryza sativa)
  misc_feature (71): n=a or g
cagggagattcggatggtccagcatgaggaggatcgcatccaggtcctccccggcttcatcacggagcttngtcacaggcgttccgctccgcgaggtacat

SEQ ID NO: 23077 - DNA, 101 bp, rice(Oryza sativa)
  misc_feature (71): n=t or c
gatggtgggagtccccttaacagtgagacgaggtgcactctctcttgcactttctcagatggcttccgatnaggggcttggaccacttctttttctcccaa

SEQ ID NO: 23078 - DNA, 101 bp, rice(Oryza sativa)
  misc_feature (71): n=t or c
tccattagccatgcaattctgaaactccataagccttttctctacatcagcaagaagcagccttcgctgangccgtgcagtcctacctcttccctcagcac

SEQ ID NO: 23079 - DNA, 101 bp, rice(Oryza sativa)
  misc_feature (71): n=a or g
ctgtcacagtggagtttgactccaccttcttctccttaagttttctgtcaaggaccttcttcgccttaccngcattcccataatgcaacaatgtcagcgca

SEQ ID NO: 23080 - DNA, 101 bp, rice(Oryza sativa)
  misc_feature (71): n=t or c
acaaattctcccatgctgttgaaagagaataagcgatctaatgaagctgctatgcctataaaggatgattngagagctatcttttttgattacttgacttg

SEQ ID NO: 23081 - DNA, 101 bp, rice(Oryza sativa)
  misc_feature (71): n=a or g
ttaccggtcatacttgatcccggtttcccttaaaactcccaaaaaagagagacaaacacacttgaaagtanaaagatttatgcgcacggcggactgggcgg

SEQ ID NO: 23082 - DNA, 101 bp, rice(Oryza sativa)
  misc_feature (71): n=a or g
aaataaatatagtcacaaatatttattggaacatcaaacaaacccattagaatgtgcttgcaaaaacatcnaagacattacttatttaattaaaaaattag

SEQ ID NO: 23083 - DNA, 101 bp, rice(Oryza sativa)
  misc_feature (71): n=a or g
atcgataatatagaccatcagcgtttggaaaatgaggaattgctaaagagagagcgtgctgatcttcaacnaaatttgcagctccatcggcatgaattgga

SEQ ID NO: 23084 - DNA, 101 bp, rice(Oryza sativa)
  misc_feature (71): n=a or g
caccatgttcaattggtcgctagtgtacatctgtacttgatcagcaacttgttccaaacgaccttgaatgntgacaaacaacttctcagaatcaagattag

SEQ ID NO: 23085 - DNA, 101 bp, rice(Oryza sativa)
  misc_feature (71): n=t or c
gcatgatgtgtctgtgattcacaagttttcaaaggttttacacatcttgtcctggcactctgagggaatancttgtactggtcagaaacatcacttccaac

SEQ ID NO: 23086 - DNA, 101 bp, rice(Oryza sativa)
  misc_feature (71): n=a or g
aagcggaagcctagttttcgcttaaaaaatgtgtaaaattctaggcccaaaacctattaggccgaaaagantcagcttgaatgggccaaaacattagttga

SEQ ID NO: 23087 - DNA, 101 bp, rice(Oryza sativa)
  misc_feature (71): n=t or c
gcttgtccatcttattattggtgtcttcctattacttcctccatcccaaactgaatgttttaagatttctnagcacctctatttatttgattcagttgcta

SEQ ID NO: 23088 - DNA, 101 bp, rice(Oryza sativa)
  misc_feature (71): n=a or g
tttagtacaagtattttaccaaaggccaactaagatatcagtgaatatcgctagctcactgccagtgactntctgcttgtaagtgtttcgtcatgcgagga

SEQ ID NO: 23089 - DNA, 101 bp, rice(Oryza sativa)
  misc_feature (71): n=a or c
cggcaattgcatcttggcattttgggaacgagtcgtagtgtcattgtgtgttttctctcgctgtagtgaanaaaccagataacttaatcactgtgcgggga

SEQ ID NO: 23090 - DNA, 101 bp, rice(Oryza sativa)
  misc_feature (71): n=t or g
tcagagctaacaattctatgatttgcaggcactagtggaattgcatgcccattctcagggttctacaagtncaacaattaaggtcacttctgggcaagctt

SEQ ID NO: 23091 - DNA, 101 bp, rice(Oryza sativa)
  misc_feature (71): n=a or g
acgcggctaggcgaccaagcacaagcagcaaattaacaagcgtttcaacaagctggagatcacgagtccgnagcagatggacggccacgtcgctgtggcgc

SEQ ID NO: 23092 - DNA, 101 bp, rice(Oryza sativa)
  misc_feature (71): n=a or g
gcgagacaaattttttaagcctaattaatccatataattagcacatgtggattaatccatataatccactntagcatcacataggctaatcatggattaat

SEQ ID NO: 23093 - DNA, 101 bp, rice(Oryza sativa)
  misc_feature (71): n=a or g
ccccatcccatgagtctaagtggcatcaaccaaattgaaaagaaagcggcaacgtgaccaacacgattggnaaagtgataatgatcacattagaggggaga

SEQ ID NO: 23094 - DNA, 101 bp, rice(Oryza sativa)
  misc_feature (71): n=a or g
ctgccaaacaaccgtaagcttctccacaccacaacgcatcatactgctttcatctcccctaccgatggccntcgcgtcgtgctgctccttgcccattggct

SEQ ID NO: 23095 - DNA, 101 bp, rice(Oryza sativa)
  misc_feature (71): n=t or c
tattagctttaagtcgggacatgtcggccaatgacttaggtcatgtcttggtcggataggaggtgcgttgnctgcctccaaggttgtcagtatcggaatac

SEQ ID NO: 23096 - DNA, 101 bp, rice(Oryza sativa)
  misc_feature (71): n=t or c
atcctggctgacttcattgcggaatggaccccggtggacgaatcgattccatctaataccctcttcttccncggagaagaagaggatccaaacgccgacat

SEQ ID NO: 23097 - DNA, 101 bp, rice(Oryza sativa)
  misc_feature (71): n=a or g
ttaatgtctcagatatagaacaatgtacttttagtgaactcgccaatccatgcccccgtttgtctttatcnccctttttcctctctgcgatccaacatgcc

SEQ ID NO: 23098 - DNA, 101 bp, rice(Oryza sativa)
  misc_feature (71): n=a or g
aaagtcagtgagaaggagccgacaccaatctgcaacatacttttgtcttgaaagaacatacagaccatttntatatttttcatcctttacttgacaatagc

SEQ ID NO: 23099 - DNA, 101 bp, rice(Oryza sativa)
  misc_feature (71): n=a or g
gaaggatgccagtgtagaaccagaaagacgttctgctgaggaagatgaacaatcagaagattcctttggtnacatcttcgaggattcagatagacggagga

SEQ ID NO: 23100 - DNA, 101 bp, rice(Oryza sativa)
  misc_feature (71): n=a or g
gatgctgcaaacatggataatacaccaccaatggtagaagtgaagccaaaatacaggtaaccagttcatgnatcctttaacactgtgcttcttttcccaat

SEQ ID NO: 23101 - DNA, 101 bp, rice(Oryza sativa)
  misc_feature (71): n=t or c
catggtcaccaggtactggacggctggcgtgcccagtttcaccggtattaagaaggcaaagtcgttcagcnttgaatctttagtcacactgattgacgtct

SEQ ID NO: 23102 - DNA, 101 bp, rice(Oryza sativa)
  misc_feature (71): n=t or c
gattgaccaatgcaccagccaccttccaagctttgatgaatcaggtgttagccccttatctcagaaaattngtgcttgtgttttttgatgatattctcata

SEQ ID NO: 23103 - DNA, 101 bp, rice(Oryza sativa)
  misc_feature (71): n=t or g
tcctgctctgaggaaaggctttccaagcttacgcgacgcgaacttctgtcattctgtgagagccccttcgncccacatcattagctctacaagactacaac

SEQ ID NO: 23104 - DNA, 101 bp, rice(Oryza sativa)
  misc_feature (71): n=t or g
tcttaacacttgatctccatcgatcgatgatcatgtcgttggcaaccatacatccgttcttcagagatttncatgatcagggcgggctcttatttgattca

SEQ ID NO: 23105 - DNA, 101 bp, rice(Oryza sativa)
  misc_feature (71): n=a or g
agcgagatgatacgagaatgagtacaagaatgagtagagaagggagggagcggtcggcgcataaatggttngaaaagaccggcggtgcggtgaaggccgcg

SEQ ID NO: 23106 - DNA, 101 bp, rice(Oryza sativa)
  misc_feature (71): n=t or c
ctgttcatggctccccgcattttttggctccatgttcgtaccccatttcatattaaaactcatagaacagnccactgcgatggatgaggaccagatgacga

SEQ ID NO: 23107 - DNA, 101 bp, rice(Oryza sativa)
  misc_feature (71): n=a or g
cgagagatactgcgttaaccgtgatttcaccggttggattgcacaggtaaaactactgctttttatattantatggatatagaaattcgcactaatccaaa

SEQ ID NO: 23108 - DNA, 101 bp, rice(Oryza sativa)
  misc_feature (71): n=t or c
gaatacgtcgataaagctaaactgaagcggcgtgttggttatggtgttatggatgtggtttgactttgtgnggagtatgtaaaagcgacctctgctcaatg

SEQ ID NO: 23109 - DNA, 101 bp, rice(Oryza sativa)
  misc_feature (71): n=a or g
aacggaacttgccatgccatgtcctgaatttttcagcatattgtttgtaccatgtgtcaggtaactcttcntatcgattatgtctttgagataacatagtg

SEQ ID NO: 23110 - DNA, 101 bp, rice(Oryza sativa)
  misc_feature (71): n=a or g
ttgggttgaccagatcaataagggaaactgcgtgaatggactcatgcagaagactgggatgagggagattntcgctgcttatcatgcagcaaccaacctgc

SEQ ID NO: 23111 - DNA, 101 bp, rice(Oryza sativa)
  misc_feature (71): n=t or c
actttttactttacttggccacacctccaccaacatgtgaggtccttaagtgatccgcatacaaaaatatntcctcttttttttctctcgtcaccacttca

SEQ ID NO: 23112 - DNA, 101 bp, rice(Oryza sativa)
  misc_feature (71): n=a or c
ctattcatagtgtaagaacgacgaaatgatagcacctaccttcttcttccataggcatctcgattaatatntctgtttttctattgaggcggtggtggttg

SEQ ID NO: 23113 - DNA, 101 bp, rice(Oryza sativa)
  misc_feature (71): n=t or c
agggcagagagtattgccaggcgattctggctatagttgtttccaaccatattacatctcggagcacacgnatactttgaatgatagacggcatgaacgta

SEQ ID NO: 23114 - DNA, 101 bp, rice(Oryza sativa)
  misc_feature (71): n=a or g
aagcatatgttgtcttagctcatcaatatgttatgacatattctaagaacatgtatgaatctatcacaggntcccatagagtgcaccctagtcgttagggt

SEQ ID NO: 23115 - DNA, 101 bp, rice(Oryza sativa)
  misc_feature (71): n=t or g
gaatgagctacctcccagtacaagtgatggagcttcatatagcgatggataataaaatactcccttcgtcncataaaaaactaacttaacactagatataa

SEQ ID NO: 23116 - DNA, 101 bp, rice(Oryza sativa)
  misc_feature (71): n=a or c
attcaggccacctcgcggcttgccctaaattaattatctcctagattcctaattagtctcaccggttgccnttagaacatgtaaaatggtcattaacagcg

SEQ ID NO: 23117 - DNA, 101 bp, rice(Oryza sativa)
  misc_feature (71): n=t or g
tacagagcaatcatgaatgtattatgatccataccgcgagataatcgcttcgcctttgacatgattttgtnctgaaagtgaaagagacagaaatagagtta

SEQ ID NO: 23118 - DNA, 101 bp, rice(Oryza sativa)
  misc_feature (71): n=t or g
accgagcctccagccgttgagatgtcatgagccgccaaagttcaattacgaatacaactctaccacggacncctcctctcaacctgctaattttttcggta

SEQ ID NO: 23119 - DNA, 101 bp, rice(Oryza sativa)
  misc_feature (71): n=a or g
caaaacaaaagcttcgctgctttccgcacccaacaggtcaacagtaacagattcacctcgaagacgaagcngtcgaggaggtagcggacgacgaggaagaa

SEQ ID NO: 23120 - DNA, 101 bp, rice(Oryza sativa)
  misc_feature (71): n=t or c
gcacatatgtggactacttctttatttaccacgaacacgtttcccacgttgttaaatactacctcggtttnaggttacaagactttttaacattgtccata

SEQ ID NO: 23121 - DNA, 101 bp, rice(Oryza sativa)
  misc_feature (71): n=a or c
gcaataactactagtgacgagcttgaggtggctattgcagctatgatgacgagcttctcacaaagtagtgnctatgacaatgatgagcaatggcggcagtc

SEQ ID NO: 23122 - DNA, 101 bp, rice(Oryza sativa)
  misc_feature (71): n=a or g
tttcccggctataaagattcgtttttttttctctcgatctcctcgcacccctctcaactcgcccaaattcnccggcgtttcgtggaggtggcggcctggtt

SEQ ID NO: 23123 - DNA, 101 bp, rice(Oryza sativa)
  misc_feature (71): n=t or c
gatgtttacaggcagttctacagggaatgtgttatctccgggacaattgatttcgtgtggggcgaggcganggccgtcttccagatgtgccacctcctggt

SEQ ID NO: 23124 - DNA, 101 bp, rice(Oryza sativa)
  misc_feature (71): n=t or c
ttaaatctcgtgagaaggattattacctggatctgcatgagaagattgttgacagtagcaccaccatcaangcgcagcaggaactccccttctgcactctt

SEQ ID NO: 23125 - DNA, 101 bp, rice(Oryza sativa)
  misc_feature (71): n=a or c
gtggtgcttctctaggtactccattgcataaggtcttgcctcccatatgtgcttcaaatgcccttgaaacntatcctcagtgtagcatctagcagttgggt

SEQ ID NO: 23126 - DNA, 101 bp, rice(Oryza sativa)
  misc_feature (71): n=t or c
gtagatattacggactcgcgaccctcattaataacagagagaaatatggttacttaaaagttcagccccancctcatcgaggagctagtatggacccaccg

SEQ ID NO: 23127 - DNA, 101 bp, rice(Oryza sativa)
  misc_feature (71): n=t or c
ttctattcccattttactgagatccaattcagcacaggttattagtggtgacatctttcttttccgttttnctttccaccaatgtggtgtagttcctcctc

SEQ ID NO: 23128 - DNA, 101 bp, rice(Oryza sativa)
  misc_feature (71): n=a or g
atattgttgacatggcagatgatctttaccatccattgagagaacttccaccacaacacgagggagttaanttttaatataaaatgtctaaaatggaaaga

SEQ ID NO: 23129 - DNA, 101 bp, rice(Oryza sativa)
  misc_feature (71): n=t or c
gccgccgcgcgcacaatttctttctaaaaaaaagtttgaatgcacttttctttctcaaaatctcgttttcnaaaataaaactatttcttcatatgtttcat

SEQ ID NO: 23130 - DNA, 101 bp, rice(Oryza sativa)
  misc_feature (71): n=t or c
tgcttatcatgcagcatcacagatggaccagatgacgtttctggatggcagtgttgtttatggacctcatnttccatatggatactccaccgaaagaagcg

SEQ ID NO: 23131 - DNA, 101 bp, rice(Oryza sativa)
  misc_feature (71): n=t or c
ttgcaaagttgcaaacgttgtcattgctgcagaaaaagccaaacctcaccaaatcttaaaaagagttctangtagaatttgtgcgtaaaatacacttttta

SEQ ID NO: 23132 - DNA, 101 bp, rice(Oryza sativa)
  misc_feature (71): n=a or g
atttatttttctatcatgacatccagctaaacggagagacaagcattatgcggtatctgtactggcaaganctcttttctcaccatccagtgccaagtcaa

SEQ ID NO: 23133 - DNA, 101 bp, rice(Oryza sativa)
  misc_feature (71): n=a or g
tttacataatgttggttttcttttatagcgtgtgtgctgtgcttattgatttttggaatgggtttaactcntgtgatttttcattcatggaatttaatcgc

SEQ ID NO: 23134 - DNA, 101 bp, rice(Oryza sativa)
  misc_feature (71): n=t or c
tccaccatcaaagacatatgaacaatgtggccacagatcctcaaaatctttgacgttgacactactaggangcccgcttaagttggcgcttgtaagtgcaa

SEQ ID NO: 23135 - DNA, 101 bp, rice(Oryza sativa)
  misc_feature (71): n=t or c
aaaaaaggtaggcggtgtcagacccctcctttacctttaatcccggttggactaaagagctatttctagtnccggttgttaaacaaccaggaaaaaaaaga

SEQ ID NO: 23136 - DNA, 101 bp, rice(Oryza sativa)
  misc_feature (71): n=a or g
ttgttgagttctttccatcctagtataatcctagctttaactgtcaattgttgtatgtcgagatttctgcnacatactttactaaaattaatttaattatt

SEQ ID NO: 23137 - DNA, 101 bp, rice(Oryza sativa)
  misc_feature (71): n=t or c
gaacaccaatgcaaattttggaccatctcagcactagcagtaacatcgttcagacaatacaaattcgagcntgagatccaggaggcgacatacatacactg

SEQ ID NO: 23138 - DNA, 101 bp, rice(Oryza sativa)
  misc_feature (71): n=a or c
tctggggccggcgggggcgtacgagacgcggaagctaccgaccggttttttccgtatatagagaaaaaatnaaaaaagtaatcacatcaagagaaacaaca

SEQ ID NO: 23139 - DNA, 101 bp, rice(Oryza sativa)
  misc_feature (71): n=a or c
gagagcacaaccggctgcaccatgcatctttctttccttgaagggtatccgctatgtgactacgaccgtgntgttcctatgctctagagtaggttgtaggc

SEQ ID NO: 23140 - DNA, 101 bp, rice(Oryza sativa)
  misc_feature (71): n=a or c
gatttagactttttgtaagctgcctcacatcagcatggcaaagaaagttaagcttctgttgaacatggganatcatgttaaaccactttgagtgagagtct

SEQ ID NO: 23141 - DNA, 101 bp, rice(Oryza sativa)
  misc_feature (71): n=t or c
ggttcctcctcaaggttgcatacttgcatcgtacttggagcatagcgtcgatgcttagcgaaagttaatcncccctgtcttttcccgctctctgtcctcca

SEQ ID NO: 23142 - DNA, 101 bp, rice(Oryza sativa)
  misc_feature (71): n=t or c
tgatgcaataaagcagcgtggtaacatcgttgctattttctctcaatgctctttgtggttttactccttcngtttttaataaataacgtcgttatgtgttt

SEQ ID NO: 23143 - DNA, 101 bp, rice(Oryza sativa)
  misc_feature (71): n=a or g
gaaattaacaaacacaactagtgattgtatcgacaacaaaccttttggacccgtctagggtatcgcagatnttatggtacagccgttgtgttctccgcgac

SEQ ID NO: 23144 - DNA, 101 bp, rice(Oryza sativa)
  misc_feature (71): n=a or g
catacctgaatacatatgcacgatgattacagtgcaggcatgtgtggcgcattcatagtcaaatgttgtancaaacggttatttcgtgggttcaacgatat

SEQ ID NO: 23145 - DNA, 101 bp, rice(Oryza sativa)
  misc_feature (71): n=t or c
ttccttatttcaattacatggcagacagacgcacacgtacatacaccatacactagtacacacacaacacnacacttacacacccacgaatatgcctccta

SEQ ID NO: 23146 - DNA, 101 bp, rice(Oryza sativa)
  misc_feature (71): n=t or g
attgattttaattatgcagattttctgtacaattggcactggacattctttctgtatccaattggcactgnacattctttctgtatccagattcattgaag

SEQ ID NO: 23147 - DNA, 101 bp, rice(Oryza sativa)
  misc_feature (71): n=t or g
aaaagcgtaaaacggagggcggataaacttaactaatcaagcaaccaagtaagcagcgccgcgccccttcnagatcccggcgttttggtccgtagctcgct

SEQ ID NO: 23148 - DNA, 101 bp, rice(Oryza sativa)
  misc_feature (71): n=a or c
cgttgaacctcagcaacgaggtgggcacggggccgtcgagatggttgttggacagattcaagaactggagngccgggaggccgaggtccgggacgcggccg

SEQ ID NO: 23149 - DNA, 101 bp, rice(Oryza sativa)
  misc_feature (71): n=a or g
gtgacatgagtagtaccctaatgccttgacctcaaattcactgcctagtggttgcagtgaatttcagattnggttatttgcggggttaagttcctaattta

SEQ ID NO: 23150 - DNA, 101 bp, rice(Oryza sativa)
  misc_feature (71): n=a or c
tctacccattgggctattgtctattagctgatattatgttgcattgttatagggccaaaaaaagggggtcncgtgcggttgcctatttggcacatggccat

SEQ ID NO: 23151 - DNA, 101 bp, rice(Oryza sativa)
  misc_feature (71): n=a or c
ttaggattaggcttcacaaaggaatacgataggccatgctctaagcatcatccaaacaactcctacatatngaagcttaaacacagaagaaaaccatcttt

SEQ ID NO: 23152 - DNA, 101 bp, rice(Oryza sativa)
  misc_feature (71): n=a or g
aactaattttataaatgaaccctgcacaaaaactatataaaaaatggacttcgaggacagaaccagggccnaaggcactgagttccaatggctcaacgcca

SEQ ID NO: 23153 - DNA, 101 bp, rice(Oryza sativa)
  misc_feature (71): n=a or g
acaataggaaagcaggagttcgtgctaaagcctgtacaagcaacactagggccaaattcaactggtggccncgggggttcgcccctacccgatgtgatcca

SEQ ID NO: 23154 - DNA, 101 bp, rice(Oryza sativa)
  misc_feature (71): n=t or c
agcgttggatctaatatccatcgatatcgtcgtcttttcattcaagcagttgcaaagaaaacttgtcacgnccggaaattcactagtaatttccgaactta

SEQ ID NO: 23155 - DNA, 101 bp, rice(Oryza sativa)
  misc_feature (71): n=t or c
ggaaggaaaagatatctaagattgccgcactgcgagatgaactcagtactatttacagtgttgtatcagcntcagaatctggtgtgttttcttctcatggt

SEQ ID NO: 23156 - DNA, 101 bp, rice(Oryza sativa)
  misc_feature (71): n=t or c
tgagctcccaccatttcatccattacctgaatggaaccaagaaagattacccgaacgctgttgcagcatangttgatgtgcgggatgtagcgcgtgcacat

SEQ ID NO: 23157 - DNA, 101 bp, rice(Oryza sativa)
  misc_feature (71): n=t or c
tatctcatccatccattttccaaatcaagggtacatatcaaagtgctacaacaccattgctataggtatgnacagtattatttttttctgtgcgaacagtg

SEQ ID NO: 23158 - DNA, 101 bp, rice(Oryza sativa)
  misc_feature (71): n=t or c
acatgccatttgcaccacctgtgcactgtctgtggatggggatataccttccttattgcagctgccatagngggagcttgatctgcataacaaaaagcacc

SEQ ID NO: 23159 - DNA, 101 bp, rice(Oryza sativa)
  misc_feature (71): n=t or c
tggagtgatcaagactcaaagagtcactaacaaaatattctgccattctataacatggttccctctcaagnttgctgcttgctgttgttgcttccccatat

SEQ ID NO: 23160 - DNA, 101 bp, rice(Oryza sativa)
  misc_feature (71): n=a or c
ggagcaacggcagggtgtttgatagcggggctatgcttgttgaagtcctccagtatggtttgctggtctgntttcttcaatccctgtgataaagcaagaac

SEQ ID NO: 23161 - DNA, 101 bp, rice(Oryza sativa)
  misc_feature (71): n=a or g
gatcaattctgctaatagtatgatattactagtagagagtgtcgtagcgttgctcttagtggaaggtttcnttcatgagcttaactacggtgctctctact

SEQ ID NO: 23162 - DNA, 101 bp, rice(Oryza sativa)
  misc_feature (71): n=t or c
ttctgtcaaagagtttcacgatcataagatcgggatggaaacacatttatcccgagtttgatgttgatganaccggtttgcggcacatctgtaagaagttt

SEQ ID NO: 23163 - DNA, 101 bp, rice(Oryza sativa)
  misc_feature (71): n=a or g
ggacatttaactattagagattttgacgtttaacaaattgccaattatagtctaacatgcggactctcatntgtctatgatacataatttagtggtaaatt

SEQ ID NO: 23164 - DNA, 101 bp, rice(Oryza sativa)
  misc_feature (71): n=a or g
agcacatggtgtgtgtgcatgatggcagtgcatgtgatggactgccaacagctaattcatggcatacatancataagcaattgctacatgattttgtttca

SEQ ID NO: 23165 - DNA, 101 bp, rice(Oryza sativa)
  misc_feature (71): n=t or c
tgaggctgtcgagagaatatcactgaatgagagtttgttcccacttggtgccaatgacgatggcttctgtngtaacaattctttcctaataaaggtcctgg

SEQ ID NO: 23166 - DNA, 101 bp, rice(Oryza sativa)
  misc_feature (71): n=a or g
taaaccgccttgtccgcattcaactcgctgaatccccccaccggcatagttttccccttttctttttctcnctttgtttcaaggcttttgccttgactcga

SEQ ID NO: 23167 - DNA, 101 bp, rice(Oryza sativa)
  misc_feature (71): n=a or g
atatgtagttccagaaaatgtatcgacaagtatatacgtaatcctgaccgtggatacgtatatattcactncatgcttatgttcaacttctcgcatatatg

SEQ ID NO: 23168 - DNA, 101 bp, rice(Oryza sativa)
  misc_feature (71): n=t or c
ccggctcgcttatacttggcttctttttaaaattttgtagatattagggagctcatatcattggatgatgncatggaggaacttgggatgggaccaaatgg

SEQ ID NO: 23169 - DNA, 101 bp, rice(Oryza sativa)
  misc_feature (71): n=a or g
acccttcaaagacctcttctccagtagtggatgagtcttactcatctcttaaacttgtatgctaattatgncagtattgagaaagctctttcttaaaggag

SEQ ID NO: 23170 - DNA, 101 bp, rice(Oryza sativa)
  misc_feature (71): n=t or c
ggattgaatagctgccgaattgctctgagaccaatatgatggacttcaatggcatatactccctccgtttnataatataagactttctagcattgctcata

SEQ ID NO: 23171 - DNA, 101 bp, rice(Oryza sativa)
  misc_feature (71): n=t or c
ttgaaagaacccacaagccatgtccatcggggtctcgattccagaccagcttagttttcctttggttctgnaaaaaaccatccgatttaaatgatttttct

SEQ ID NO: 23172 - DNA, 101 bp, rice(Oryza sativa)
  misc_feature (71): n=a or g
cattacaagggaggcaatcccacttcgcccggattccacgttttcgaggttatctcgtggctctagccccncctaggcgtgggggccacactcgttgaatc

SEQ ID NO: 23173 - DNA, 101 bp, rice(Oryza sativa)
  misc_feature (71): n=t or c
aactgagcggttttcatcggttctgtgtcaaacttgtgtcactgctctcgacgagatactgttgtttcttntgcagggaaaggaataagttcaccaaaggt

SEQ ID NO: 23174 - DNA, 101 bp, rice(Oryza sativa)
  misc_feature (71): n=a or g
tggtgaccctactgttgtaatttattccatttgcacaacgatccaaccaatactgggaggtaggtctggtnattcttagctccgttcggtagtacaagttc

SEQ ID NO: 23175 - DNA, 101 bp, rice(Oryza sativa)
  misc_feature (71): n=t or c
ggggaatttacatggatgcttttatgataggaacatttacaaggctaactgtagacaatttagtgtcgganatcagggatgtttctaggtatatatttatt

SEQ ID NO: 23176 - DNA, 101 bp, rice(Oryza sativa)
  misc_feature (71): n=t or c
agaggagtgaagacacatctttacttgaaattacggaggagaaacaaggagcataaaaaattcatgctaangactttcaggatattcactggattcacatg

SEQ ID NO: 23177 - DNA, 101 bp, rice(Oryza sativa)
  misc_feature (71): n=a or g
tacgaacgtcctaacgggtgattgatcgctgggcagaatcggtccccctcccccacatgatttccttgttnacatcattactttcctgttttagtaaattt

SEQ ID NO: 23178 - DNA, 101 bp, rice(Oryza sativa)
  misc_feature (71): n=t or c
cagtcggttacagtaatctctcgacatctaacgcgacaatcaacattaccatgatagcgacaaccaagacngactagatcgccattgtcaccaggacgaca

SEQ ID NO: 23179 - DNA, 101 bp, rice(Oryza sativa)
  misc_feature (71): n=t or g
cagcgtcatgtaaacaaggagaaaggatatcacttagattcctttcaacattctttagatgttcctccttntcctcaattgccttcatattgttcttaatt

SEQ ID NO: 23180 - DNA, 101 bp, rice(Oryza sativa)
  misc_feature (71): n=a or g
tgtacagcattcatgatgtagccaactgcatgtatatatccaggtgaatagacaacagatcaggtttgccntcaatccttaagagagatgacactgtgtct

SEQ ID NO: 23181 - DNA, 101 bp, rice(Oryza sativa)
  misc_feature (71): n=t or c
tccgcggttgaggtcaccaaaacgccctaggagatcgccaatttcacccagaagtcgttctgcaaaccgtnggccctctccacaacgaaggaggtaccgag

SEQ ID NO: 23182 - DNA, 101 bp, rice(Oryza sativa)
  misc_feature (71): n=t or g
acctcaacccctgggcaaggccgatcttgatcctcgtcgagaattttctcccttccgtggcccaaatatcnctcagtaagagccgatcgaggcatggggcg

SEQ ID NO: 23183 - DNA, 101 bp, rice(Oryza sativa)
  misc_feature (71): n=t or c
gcgcggttgacagccctaagcccctaacaatttggagtaacttccctttaggttcaactagaaaaaaatgncattgcgttgcaacgggtaaatgttatttt

SEQ ID NO: 23184 - DNA, 101 bp, rice(Oryza sativa)
  misc_feature (71): n=t or g
tgattcatatgacgatgattctgatgatgatatggttgatgataccagtggtgactttgattctaaggcanctgagaaaaattttgagactcgaaaaaggc

SEQ ID NO: 23185 - DNA, 101 bp, rice(Oryza sativa)
  misc_feature (71): n=a or g
tcatcaatatgtctctctaatgcatccaaattccatcgagaacttctagtaagggcgtaattcattatagntgattgaatcatttactggggaaacatatg

SEQ ID NO: 23186 - DNA, 101 bp, rice(Oryza sativa)
  misc_feature (71): n=t or g
ctgctctactatacactggaaatggcctgtgctagtctagggattcaattgtctcatggatgtacaatctngagaaacaagaaatcagccacaaagattga

SEQ ID NO: 23187 - DNA, 101 bp, rice(Oryza sativa)
  misc_feature (71): n=a or g
attatttcatttatagccctatttcggaaccaatggtagcgacccgtacgccattggattagatttcaacngtgtagattaacagagattattttcactaa

SEQ ID NO: 23188 - DNA, 101 bp, rice(Oryza sativa)
  misc_feature (71): n=t or c
gctaacaaaattatcttgagtttgtcaggatgttctaaatgtactacgcgatgagcaccgtatggaaaaancgaggacggttttccatgaagaaggggagg

SEQ ID NO: 23189 - DNA, 101 bp, rice(Oryza sativa)
  misc_feature (71): n=t or c
cttggcttcctcgaaccaattaagaggtttcactcacacgtgaggccacggtatttttctatctttttccntaatataataccacctcaacctaccatgtc

SEQ ID NO: 23190 - DNA, 101 bp, rice(Oryza sativa)
  misc_feature (71): n=a or c
gagatccgactcgtcgccgtcgttgccgtcattaaaccggctttccatctttcgcctcgacacccccaccnccaccaccaccactcctcttccgtttcctc

SEQ ID NO: 23191 - DNA, 101 bp, rice(Oryza sativa)
  misc_feature (71): n=a or g
ttcatgggtgactgcggttgaggaggtgttcattggttggagagggggtgatgacagcgtgatatgtgatngagtattgtactgtttaattcactccacag

SEQ ID NO: 23192 - DNA, 101 bp, rice(Oryza sativa)
  misc_feature (71): n=t or c
gcaaattttgtttatgtactctatatatactagactaaattaaaccagtggataagggggcagtccaatgntgcactgggtttcaaggtagagaattttac

SEQ ID NO: 23193 - DNA, 101 bp, rice(Oryza sativa)
  misc_feature (71): n=t or c
atatgcggaatttgagtttttttttctatgatagtcctagagatggcagtggtgccccattcaccgtttcnccacggtgaattcacccattaggggacggg

SEQ ID NO: 23194 - DNA, 101 bp, rice(Oryza sativa)
  misc_feature (71): n=t or c
gctcgacgggatccaccataaggaagtgatctggataagaaaggaaaatcaaagttccactcgagcactanaaggactactcggatcgtatccatattagt

SEQ ID NO: 23195 - DNA, 101 bp, rice(Oryza sativa)
  misc_feature (71): n=t or c
tctcaaccatataaggccatcaccaatgcgtgtctttgggttgttccctcgccgacagacgtctgcttttncatccgcgccggctccccacgatggagcgc

SEQ ID NO: 23196 - DNA, 101 bp, rice(Oryza sativa)
  misc_feature (71): n=a or g
ggccttgcatttaccgccaccactagatttagccgggggtcaactcttgtcatcaatggagaagaccgttntcaccacgtccgcaactattctcctgccat

SEQ ID NO: 23197 - DNA, 101 bp, rice(Oryza sativa)
  misc_feature (71): n=a or g
aaacgggcgtgcaacaaatcaaaccatacccgttacagcaaaaaagcccataaaacaagcgccacatttangcccaaaaatgtggcgaatcctggacaaca

SEQ ID NO: 23198 - DNA, 101 bp, rice(Oryza sativa)
  misc_feature (71): n=t or c
tgagttttgtataggccattgtatttaattctactctattcaataaaattaacatcgacttatgctggttnataaaaaaaatggcattgatacgtgaatta

SEQ ID NO: 23199 - DNA, 101 bp, rice(Oryza sativa)
  misc_feature (71): n=a or c
acgtcgcctagccgagtggagtactccatgtctcataaaaacgaatctgttgtacgatgaatccggacgtntagatttatagtattaagatgtgtcacatt

SEQ ID NO: 23200 - DNA, 101 bp, rice(Oryza sativa)
  misc_feature (71): n=a or g
atctctaaggctatttttgaaaataaggttcaacccaataacgtattgtaaaatagttgataaagtcaccngtatattatagaaagagataatgtcgatga

SEQ ID NO: 23201 - DNA, 101 bp, rice(Oryza sativa)
  misc_feature (71): n=t or c
gcggaaattacaccaggtgggtgattcaagtacaggctataatggaggaccaaagaatcagggaggtgatngagcagatgtcttcttcttcgcatcgaata

SEQ ID NO: 23202 - DNA, 101 bp, rice(Oryza sativa)
  misc_feature (71): n=t or c
tgggagctaaccgtggtgggcaccatctcgtattcaccaaacctcctgcccctcacgaagaaggcacctcnaagccgctgctgcaagaacagcagcagcgc

SEQ ID NO: 23203 - DNA, 101 bp, rice(Oryza sativa)
  misc_feature (71): n=t or c
tggggggcaagctttgaatttgcctatgctgttaaacatcatgtgactaataatcaggctaaatatgaggnagttttaaaagggttacaattgcttcagga

SEQ ID NO: 23204 - DNA, 101 bp, rice(Oryza sativa)
  misc_feature (71): n=a or g
ggttaaaggttgcgagaatacgtgaccctataagctagtattaagataaaggatatcgccgttcacaagancatctcagttatgtacaaacaggataaaaa

SEQ ID NO: 23205 - DNA, 101 bp, rice(Oryza sativa)
  misc_feature (71): n=a or g
cgtcgttcgtcttacagaagagtggcagaaccgaggagacatatctaggtggccttacacgtacgcttgcntgagctcgcgatgggttggagaagcgtgcc

SEQ ID NO: 23206 - DNA, 101 bp, rice(Oryza sativa)
  misc_feature (71): n=t or g
gtctgatcacaaacttgtcaagctattaggtgaaactgatttgagctgtgaacaaacataaatcatgaagnaagtaatgtttcaactactgctcatatttt

SEQ ID NO: 23207 - DNA, 101 bp, rice(Oryza sativa)
  misc_feature (71): n=a or g
ccaggttaattcgggcagtccggcaattttgcctggtatcaccaattgtccatgcgaacagaaaaagttcngtacttgggcttctctatatactatatact

SEQ ID NO: 23208 - DNA, 101 bp, rice(Oryza sativa)
  misc_feature (71): n=a or g
tacccggatctttagcgtgccatggcatataacgtgcagtaatccttttatgcagagtctcgaatggttgnccaattatgcttcctgatttgaacaaaccc

SEQ ID NO: 23209 - DNA, 101 bp, rice(Oryza sativa)
  misc_feature (71): n=a or c
aaaccttgagagctgaagtgggaatgccatatgctgatatgtcatatgcccaggcccagccctgtttaaanaaggaaaaaggaaaatgagaaaggaaggta

SEQ ID NO: 23210 - DNA, 101 bp, rice(Oryza sativa)
  misc_feature (71): n=a or g
aggtagctcttatttatattatgatttcgttggttgaattgtgtcaggtgttgccggatatgtgcaatttnttccttttgcaagagttccagttcttcagt

SEQ ID NO: 23211 - DNA, 101 bp, rice(Oryza sativa)
  misc_feature (71): n=t or c
agccccagaagagatctaaaacaacggccattgtcctggctaagaatggtgtaagctttcagcatatcgtngccgccagccatgtcctgtatgctgtatcc

SEQ ID NO: 23212 - DNA, 101 bp, rice(Oryza sativa)
  misc_feature (71): n=t or c
aagcagtgcttgtaagcaccctgacataccctgacccactcctctcccacaatcgtcatgttcacgtgcantagcacggatagtgacctgacatctgcaac

SEQ ID NO: 23213 - DNA, 101 bp, rice(Oryza sativa)
  misc_feature (71): n=t or c
ttcttcatgttcaacttcagcggcaaccgcaacgagatcagcatcatcaagttcgtcttaggaagctcatncatttccatcaacccggaccagttcggtgt

SEQ ID NO: 23214 - DNA, 101 bp, rice(Oryza sativa)
  misc_feature (71): n=a or g
gctagtcatggccaaaggcaggatattctctgccttgttaatggtgtttctagttttggctccccactgcnaggcgttctatttgccaggcagttacatgc

SEQ ID NO: 23215 - DNA, 101 bp, rice(Oryza sativa)
  misc_feature (71): n=a or g
tcataaagctctttttattcaagctgcttctaatttcttctcctcgtctttacaagctgagcttgcagcantcatgacagccatcttgatttgtcaaaagt

SEQ ID NO: 23216 - DNA, 101 bp, rice(Oryza sativa)
  misc_feature (71): n=a or g
aaggcattaatttcttctttgcaaaaaaaaaaagcataaggtccaataagatggggggcatgtttggggancttctaacagctgcagtttctactagaatc

SEQ ID NO: 23217 - DNA, 101 bp, rice(Oryza sativa)
  misc_feature (71): n=t or c
ttatgcttttggatttttgctcacatttaatggccttttatttctgcacattttattagaataacatttcngtagaacataaggctatatttttttcttga

SEQ ID NO: 23218 - DNA, 101 bp, rice(Oryza sativa)
  misc_feature (71): n=a or g
ggcggaattggtagcagagaaaggcaatcgggtcggagtagcaagagcttgcttaatctttaaccacactntgtgattgataataacaaaactagtgtaca

SEQ ID NO: 23219 - DNA, 101 bp, rice(Oryza sativa)
  misc_feature (71): n=a or g
tgagagtagtagtacaatgtcagagttagattgatggtcgtagccttactcctgaagagatggttttccangcttcctttgggcatgaactcgtaaaccag

SEQ ID NO: 23220 - DNA, 101 bp, rice(Oryza sativa)
  misc_feature (71): n=a or g
gtggatggaatggattggaaagagatcgcctttttctgtgcggtttgtagttctgtcactggattatagcntatgtgagtgacacgactataaactatatg

SEQ ID NO: 23221 - DNA, 101 bp, rice(Oryza sativa)
  misc_feature (71): n=a or g
gcaacacaaatggaacataaaattggttgcaaagtcagaaataagttgaaaagagtcgctgataagctgtntcaactgtcagcacagttgagacagatggg

SEQ ID NO: 23222 - DNA, 101 bp, rice(Oryza sativa)
  misc_feature (71): n=a or c
aaaaacctcaaaaatgaaaaggttaaagtgccggatcgagtctcgctatttctcaatggaataagttcacntgctgtccctcaactttacaccgagtttgt

SEQ ID NO: 23223 - DNA, 101 bp, rice(Oryza sativa)
  misc_feature (71): n=t or c
acattagttacatcaagaatcggagttgtcctgttacaaggtggtgcctacaactaaaagagcctagtatncgtgcaggatggcgcagcgagggtggtgat

SEQ ID NO: 23224 - DNA, 101 bp, rice(Oryza sativa)
  misc_feature (71): n=t or c
gatgtgttatatttggctaaacccagggcgtttagtttgagaatatgtggaattagatgatccttgaaaanaatattttctctatgtcaggattagctcca

SEQ ID NO: 23225 - DNA, 101 bp, rice(Oryza sativa)
  misc_feature (71): n=a or g
tttggtcaaactatcttcatccgtgtgacagaaaaatgttacatttggtttatctataagaaattgctaantcacatttggtagaagtttaacttagagca

SEQ ID NO: 23226 - DNA, 101 bp, rice(Oryza sativa)
  misc_feature (71): n=a or g
gatgggatggaatggtccaatccagagtttggtttggagaatagaattagattttctttttagaaaatggnataaacccggcctctacatccaactggatt

SEQ ID NO: 23227 - DNA, 101 bp, rice(Oryza sativa)
  misc_feature (71): n=t or c
tcacaagttctcctagactttaactttcttaactgctctgccactgtcaaagcacttttgcccatgccccnacatatggcctcctctgcatcatcaatgtg

SEQ ID NO: 23228 - DNA, 101 bp, rice(Oryza sativa)
  misc_feature (71): n=a or c
ttgaaaaatagctaaaatgtaatgtcacacacaatacaagagctggctattgattgagccgctataagttnaaaaaaaatacaaacttttaatgtaactgt

SEQ ID NO: 23229 - DNA, 101 bp, rice(Oryza sativa)
  misc_feature (71): n=t or c
cgcagacaattgacattaagcatttatgacatatcttcatgatagagatgaagtccaagaccaagacgggnacaagctcggcgaaaagccattgcttcagc

SEQ ID NO: 23230 - DNA, 101 bp, rice(Oryza sativa)
  misc_feature (71): n=t or c
gccaggtgaaattaccaaattgccctcgccattttgacccttctataatctgttgattcatctaccacagntcatagcatcaaatctgagggtgctctttg

SEQ ID NO: 23231 - DNA, 101 bp, rice(Oryza sativa)
  misc_feature (71): n=a or g
atcctggtggttggccacgtcatcggctccattaactgaaacagagtactctccaatggaatgtgtcccancatcaacaccactaaaaccactgcaatgtc

SEQ ID NO: 23232 - DNA, 101 bp, rice(Oryza sativa)
  misc_feature (71): n=a or g
ttagctttttgcaagtgcagtactccccagattaatcacaatgcgaggccatcctcctaattgcacggcangctcggggaagaagggcaaatgagtctttt

SEQ ID NO: 23233 - DNA, 101 bp, rice(Oryza sativa)
  misc_feature (71): n=t or c
tagcctcagtatcttgtgatgcggcagttggcaatgctgtctatatgcttccctctttctataaccatgantgtggtatgtcttttgaccttgcgctgttg

SEQ ID NO: 23234 - DNA, 101 bp, rice(Oryza sativa)
  misc_feature (71): n=t or g
tatcaaatatctgatgtgacagagatttttagttcccagatctaaacaccctcttaaagtttagttcgtgnatcaaacacctccttaataagatagctaga

SEQ ID NO: 23235 - DNA, 101 bp, rice(Oryza sativa)
  misc_feature (71): n=t or c
tacttcagctacccagcaaggcctgagcaactgatatttgatggattttcattgcatgtttctagtggcangacaatggctatagttggggagagtggaag

SEQ ID NO: 23236 - DNA, 101 bp, rice(Oryza sativa)
  misc_feature (71): n=t or c
gctgtccgtcttgcaacttgttgctgaagtagtccaggactaatgaacttcgagttgttgttttgtagtgnagacactctatttcttccataccttccaga

SEQ ID NO: 23237 - DNA, 101 bp, rice(Oryza sativa)
  misc_feature (71): n=t or c
tacattgtagtaaaggccagtgtcagggtactattagccaaagaatgcgtgctaagagtaatacttcatcngtttcacaatataagactttctagcattgc

SEQ ID NO: 23238 - DNA, 101 bp, rice(Oryza sativa)
  misc_feature (71): n=t or c
atgcaacggcggaaaaggactatcctagtgggtgtttagcttcagtccacaggagtactcaactagggtanaacgcttgatattttaactccgtcttcatc

SEQ ID NO: 23239 - DNA, 101 bp, rice(Oryza sativa)
  misc_feature (71): n=t or c
acaagcagccttgcccggattcttgttcttttgaataaagtgaaagtactcgaaagcgaggagggcattanctgtaatcaacctccccggaacaaaagcac

SEQ ID NO: 23240 - DNA, 101 bp, rice(Oryza sativa)
  misc_feature (71): n=a or g
attcttaatttctttggactgatctcgccgaggtgattggaatggaggccagtgatcatttataacaggantcggcatgcgtgccggtggagatggaggtg

SEQ ID NO: 23241 - DNA, 101 bp, rice(Oryza sativa)
  misc_feature (71): n=a or g
aacatgtttaccgtcgaattccttcggtctttttcggtccgaatcggagtgctattccacacgtgaaatgncgcatcttggctttataagctaaatcatcc

SEQ ID NO: 23242 - DNA, 101 bp, rice(Oryza sativa)
  misc_feature (71): n=t or g
atgataaacaatgatatgcaattgcaagtgggcagataaaggaacaaatacccttggcttcaaaccaaaantttccacgtgagaaataattccatcgatac

SEQ ID NO: 23243 - DNA, 101 bp, rice(Oryza sativa)
  misc_feature (71): n=a or g
tcctaaagttttccatctactcataggcctaaaatggagctcgtttgcgcatagtgttggcatcgggcctngtctagtgcgggttggacaggtacagcgta

SEQ ID NO: 23244 - DNA, 101 bp, rice(Oryza sativa)
  misc_feature (71): n=a or g
ctctagcacaagaaaaatgttagctaatatacatagggcctgcactgattttaaaaatgtagtaattgcgntctagtaaagttcacaaatactgaaatctt

SEQ ID NO: 23245 - DNA, 101 bp, rice(Oryza sativa)
  misc_feature (71): n=t or c
gggagtcaccagctttagttttgaggacagacatgggttttttcttcaaatatttatccctcagcatatcntgccaccacccatccccattttccaagttc

SEQ ID NO: 23246 - DNA, 101 bp, rice(Oryza sativa)
  misc_feature (71): n=a or c
tgcctcgtcggtagcccgtggaagagcttcccgtttgccggcatggtctccatagtctccatggtctccgncatcggcacgctcatcgtcgacactgtcgc

SEQ ID NO: 23247 - DNA, 101 bp, rice(Oryza sativa)
  misc_feature (71): n=a or g
cattatactgaaccagctgcgcaatacgggcaagggtgctacaaaagatggtctcggcaaggaagacacancaaactttgggcttatgggcggcggcgctg

SEQ ID NO: 23248 - DNA, 101 bp, rice(Oryza sativa)
  misc_feature (71): n=a or g
agtcttgtgcaacaattcttttgtttgctgcaaattggtttactgtttttgtatgtgttgggatttgtgancattgattaagctcaccagtgctttaatca

SEQ ID NO: 23249 - DNA, 101 bp, rice(Oryza sativa)
  misc_feature (71): n=a or g
ctcattagcagctactccctccgacctaaaatagtaacgctttgactattctatgaaaaacaataaaaaanatcaatcatataaaattgatgttattaaat

SEQ ID NO: 23250 - DNA, 101 bp, rice(Oryza sativa)
  misc_feature (71): n=a or g
cagagtcatagtactagagcacttaataataatactaagcacaaacccctaacaatgggaatctcacttangcaggtaaattatataccataaagaagtct

SEQ ID NO: 23251 - DNA, 101 bp, rice(Oryza sativa)
  misc_feature (71): n=t or c
cattcaccgattgattcttttaacgacaagcaattctcattgcattcaatagttaaaaactaactcaactnccattcctagaacaactaggttcaacaaac

SEQ ID NO: 23252 - DNA, 101 bp, rice(Oryza sativa)
  misc_feature (71): n=t or c
gtggggaatcacctagttttctatataaaaaaaaaagacaccggctactcctaaaagaaaatatcttcatnccaaaatataacaatataaagctgattgtc

SEQ ID NO: 23253 - DNA, 101 bp, rice(Oryza sativa)
  misc_feature (71): n=a or c
atatctcaattgaggaaggagtctcagcgacctcacatgacctcacatgtcaacttttttaaaatctaaanggaggttatatgatccaaatctcccaagaa

SEQ ID NO: 23254 - DNA, 101 bp, rice(Oryza sativa)
  misc_feature (71): n=t or c
ggtcacaggcatgcgaagcgaggcagcagcaccaccactgtgattcctagcctagcgctaacactcgctangccaaaactcggcgcaaagaagcaaaagtt

SEQ ID NO: 23255 - DNA, 101 bp, rice(Oryza sativa)
  misc_feature (71): n=a or g
gccccgtctattgacaacgtgcctgctggcccagctgtcaacatcggagacaccgatttcgaccttaagancaggctgctaactatagcataggcaagccc

SEQ ID NO: 23256 - DNA, 101 bp, rice(Oryza sativa)
  misc_feature (71): n=a or g
gatggcccacttgtttcgaaacgtactccataattgtaaaaggaaatacaggaatattccctctgtactcntaaaatcgttttgcacagcgacgtggtctc

SEQ ID NO: 23257 - DNA, 101 bp, rice(Oryza sativa)
  misc_feature (71): n=t or c
gggtatcatcatacatggaggagaattatcgtgttcctggtaggtaccaatcgaaatcctctgcagtatgntcactgacatatagggcccatatatcaatg

SEQ ID NO: 23258 - DNA, 101 bp, rice(Oryza sativa)
  misc_feature (71): n=a or g
aaatgagaatctaaatgtacttcccggtactgagactaattcctgaactaatgaggtatacatttatgagnccagctccaagaagaaaaatgaagtaaaag

SEQ ID NO: 23259 - DNA, 101 bp, rice(Oryza sativa)
  misc_feature (71): n=a or g
cactatattcttcctctctcccctcctctcttcccaatcccctccaaggtgacgagtggcatgaaggacancacgacgagctgcagccggtgggaaacgaa

SEQ ID NO: 23260 - DNA, 101 bp, rice(Oryza sativa)
  misc_feature (71): n=a or g
ggcatggagcactttatgtacattgccagggagattttgtcatgatgtacgagttcaacatacttttaacntgcttatattgctttctgatctttctttat

SEQ ID NO: 23261 - DNA, 101 bp, rice(Oryza sativa)
  misc_feature (71): n=t or c
tcctgcattttttaggaatcggatggtatgtggggtgatcctacgttattaagggatcgaccgggtgcggnccacatgttagtgagagagaggggtggatt

SEQ ID NO: 23262 - DNA, 101 bp, rice(Oryza sativa)
  misc_feature (71): n=a or g
cccttctcaagcggcggcgacagcaacgacatgggaggcggcggcgacgacgatgtagagatactgctctnctcccctgaccaccacggcacagtcgcccg

SEQ ID NO: 23263 - DNA, 101 bp, rice(Oryza sativa)
  misc_feature (71): n=a or c
gataccaatctgatggtaggaaaaattgttgtttaaaatggtgggaactctcggtccataaaaccaaactngtactattatatacacatccaactacaact

SEQ ID NO: 23264 - DNA, 101 bp, rice(Oryza sativa)
  misc_feature (71): n=a or g
atcatgatattattagtaatggctaagtagatcgacccaaccataaaagtgcagagacaatgataaaactntagtgggcttagcatagcacgagactatca

SEQ ID NO: 23265 - DNA, 101 bp, rice(Oryza sativa)
  misc_feature (71): n=t or c
tccgcttgccgcgccacagtgcgccgccgccgatgaggccccatcgtcaatcgctcgtagaccatagcagngccaaccctcgattcagttggccctcgcct

SEQ ID NO: 23266 - DNA, 101 bp, rice(Oryza sativa)
  misc_feature (71): n=a or g
tcaggctcccaaaaccgcaccaatggtggtgcgcgtacgtgtactgctaattaagtaacttcgtgtttccntcaaggtttactaaatcttttggagtgggg

SEQ ID NO: 23267 - DNA, 101 bp, rice(Oryza sativa)
  misc_feature (71): n=t or c
tctccacggtattcttcttctttcacaacattataaacagttgggggtatgcttccttctgtatagattgnttccaaagaaatcctgaaagaaatggatat

SEQ ID NO: 23268 - DNA, 101 bp, rice(Oryza sativa)
  misc_feature (71): n=a or g
tggcaagattaacataaaaaggtggcatgcaagtttgcatgcttgccattaagaaaaactgaaacagacantcaccactttccaatcctcaaaatagatta

SEQ ID NO: 23269 - DNA, 101 bp, rice(Oryza sativa)
  misc_feature (71): n=t or c
ccccccctgttctccgcctcacataatctagcttgtgtgacatcactactagagaaatcattattaacganagaaaatatggtcgttgaaagtccaaatgt

SEQ ID NO: 23270 - DNA, 101 bp, rice(Oryza sativa)
  misc_feature (71): n=t or c
ggttcaatccgggccagatttgtagagattcaagccctagttccagatgatctggcgaataccatctctcnagctgtgtaccttgagcaacatcagttcaa

SEQ ID NO: 23271 - DNA, 101 bp, rice(Oryza sativa)
  misc_feature (71): n=a or g
gaagacccacatgtcagagacgcgtctcaacaagagccgtcactatgtcaactccagtgatgcgttttgtngagacacatctgtgatatgcctcccctggg

SEQ ID NO: 23272 - DNA, 101 bp, rice(Oryza sativa)
  misc_feature (71): n=a or g
aaactgatgttgatactgctgcacctttctattcgtttgttaaacgtttatcgggctcttcaagctcatcngatgtggactttgacaagtttctatctagt

SEQ ID NO: 23273 - DNA, 101 bp, rice(Oryza sativa)
  misc_feature (71): n=t or c
ttctttccaaagaaacaaagaagtaatgatacacgcccttctctagcatgactcatacgcagcctcaaccntgacatggtggccccaggctgatgctgccc

SEQ ID NO: 23274 - DNA, 101 bp, rice(Oryza sativa)
  misc_feature (71): n=a or c
aaacccacctaaatccatgttagttcccacaagttcactcagttaaacagaagctcagatcgacatgcagnctactcacaggtggatgaatactccctctg

SEQ ID NO: 23275 - DNA, 101 bp, rice(Oryza sativa)
  misc_feature (71): n=t or c
agggtgtaataatacaatgtactgtttatatcagctaattactaactaccattgtaatacgatgaagcagntgattgggcgttgttttctttgtaggagtt

SEQ ID NO: 23276 - DNA, 101 bp, rice(Oryza sativa)
  misc_feature (71): n=t or c
tttttggctcgtcgacctcattagacatttagactggacagatactcgattactgagttgcacgcatgacncactaaatgtttctaccaaattactcttct

SEQ ID NO: 23277 - DNA, 101 bp, rice(Oryza sativa)
  misc_feature (71): n=t or c
acttcagtcaaaggctagtcaaaggtcccctatgtcggtcaaatctcggtcaaacccgcagtgacttcccncaccaccccctctcttcttagctctcatcc

SEQ ID NO: 23278 - DNA, 101 bp, rice(Oryza sativa)
  misc_feature (71): n=t or c
gttatgcaagacaatgagaatagaagaagcgaaagaagtttttgatcaaaggggatggattctaatagctngagtggacgtccacctgtttattgcatgtc

SEQ ID NO: 23279 - DNA, 101 bp, rice(Oryza sativa)
  misc_feature (71): n=a or g
gatctacgacttcatcggcctcctcaggaagcactacggcatcgacgactagctacgctattgtgtgtacnccttaatttggttgttattattactgctat

SEQ ID NO: 23280 - DNA, 101 bp, rice(Oryza sativa)
  misc_feature (71): n=t or g
gagcacaggaaattcattttaagacataattgtagtaccagtaattatcaaagaaatgtaccattgtccanggcggaaggcgtaggtcatgcagacaacgt

SEQ ID NO: 23281 - DNA, 101 bp, rice(Oryza sativa)
  misc_feature (71): n=t or c
cgtaatctaatgattaaaagcgtaaaaggagccaggtcggcatcctatttgccttagctccacatttaatnggtcgcatgcttttgtagactccacttgat

SEQ ID NO: 23282 - DNA, 101 bp, rice(Oryza sativa)
  misc_feature (71): n=t or c
tttttttcatatttcagaccaaaataagaagatgaaaactcttcattttaacctataaactccatttatcnttttcttttctataagttcgattttgagtg

SEQ ID NO: 23283 - DNA, 101 bp, rice(Oryza sativa)
  misc_feature (71): n=a or g
cctttttctctacaatgatatcgagatctactatgatataccgatcattggttggaggtattcaattcacntaaaaaaaactcatgttttactagctaatt

SEQ ID NO: 23284 - DNA, 101 bp, rice(Oryza sativa)
  misc_feature (71): n=t or c
gcggacgcgttgtgcttgccgttgctggcggagatgttcgccacagtggatatgtccatgtgtagcgtcgngcgcttcttcctccgcgagtccgccgccgc

SEQ ID NO: 23285 - DNA, 101 bp, rice(Oryza sativa)
  misc_feature (71): n=t or c
taaatggttagattctttatggtggaactagctcactcaaattcgacacatagactttgacacatttactnacatttacgactaattattcttttaatggt

SEQ ID NO: 23286 - DNA, 101 bp, rice(Oryza sativa)
  misc_feature (71): n=t or g
tcattacgccgccaatagcgaacataacataggtctcgaggccatactaacctgcatgttcatgtagaatngaagaatgtgtaagtttcaatctgatagat

SEQ ID NO: 23287 - DNA, 101 bp, rice(Oryza sativa)
  misc_feature (71): n=t or c
taaccagggaatattaccatagtacatcagccgatagaaccagcaatagtgcagaatatacacgaaagtantttgatggagtcgctgatggtgaagcattg

SEQ ID NO: 23288 - DNA, 101 bp, rice(Oryza sativa)
  misc_feature (71): n=t or c
tgtgtggctgtgccacacaattccgcaagaaggccctcgctcttacccataatcacgaaaatactctatcnatcctagtattttcttattcccaagatata

SEQ ID NO: 23289 - DNA, 101 bp, rice(Oryza sativa)
  misc_feature (71): n=a or g
agcttgaaatgatctcatacagagaggttttaatttggctgccagttcatactgtggaaaactgaaacatnatctgaattgtgatgttctgagttgacagc

SEQ ID NO: 23290 - DNA, 101 bp, rice(Oryza sativa)
  misc_feature (71): n=t or c
caactacaaatcggccaattgaattgacaaggctcagaggattaattaattaatgcggcttgcttctgctnctgctcctgctcctgctccagttgcacatg

SEQ ID NO: 23291 - DNA, 101 bp, rice(Oryza sativa)
  misc_feature (71): n=a or g
tcactgttatatattaaatccgttagatatgaagtacgtacctacatgttattagtcattcaaaatcaaanggcagatttgtttcagaaaaagggtacgga

SEQ ID NO: 23292 - DNA, 101 bp, rice(Oryza sativa)
  misc_feature (71): n=t or c
tgcacgtatataggaatgggaagaggcgaacaccatgtaggagtcgaacgttccaaagtgagataaacttnaacttttataatggtagagaaaatatgtgg

SEQ ID NO: 23293 - DNA, 101 bp, rice(Oryza sativa)
  misc_feature (71): n=a or c
tttccgtttttttagtagagtcacgttcatgtttctacctgactaagggcatgtctgagaaacagagaatntgatagtttggatattaatttagagtatta

SEQ ID NO: 23294 - DNA, 101 bp, rice(Oryza sativa)
  misc_feature (71): n=t or c
gtccgtcgggtcgattttcgctaaaaagagagagagagccgctaatgctatgtgtgcacaccgatccttanaagtagttcctctattttgtattacaggtc

SEQ ID NO: 23295 - DNA, 101 bp, rice(Oryza sativa)
  misc_feature (71): n=a or g
tggatttcacaaaccgaagcagcgtgaaactgcaatgccataataatataagcaaatctaaccataattcngagacaactactaaataaataagttatata

SEQ ID NO: 23296 - DNA, 101 bp, rice(Oryza sativa)
  misc_feature (71): n=t or c
atattaccgtcggtacgaaaatccaatttgtgaacgaccaatgactgagcttgatcagtacttgcaagagncacgtctatctggtggtgagcgtgatgttc

SEQ ID NO: 23297 - DNA, 101 bp, rice(Oryza sativa)
  misc_feature (71): n=t or g
atagcttctgaagaatctccatggccatgggggttgttttttccctcgctctctttagcatcatcaccctncccaagatcaacaaaagaaaaatagttaat

SEQ ID NO: 23298 - DNA, 101 bp, rice(Oryza sativa)
  misc_feature (71): n=a or c
gccactgaagccatctccttcgacgacgagcgccgcaccgagctcttcctcaaggaccagatccccaaganggtcgcgttcggggggtacgtcgccgtcgc

SEQ ID NO: 23299 - DNA, 101 bp, rice(Oryza sativa)
  misc_feature (71): n=t or c
tgcatctctaattgaacgaccttggcgccagcccattttcatcaataacttcactcctgctcaaattattngaaactgtcaattcatttcaaatggtacat

SEQ ID NO: 23300 - DNA, 101 bp, rice(Oryza sativa)
  misc_feature (71): n=t or c
gggccggcgcgggcgagccacttgacgatgtgtggcaggaagatcttgaagccgccgtaggcgttgaaganggcgacgaacacgaggttgtggaggagctc

SEQ ID NO: 23301 - DNA, 101 bp, rice(Oryza sativa)
  misc_feature (71): n=a or c
ctaaactttacgctgaactaaacacaacctatgttgttcttctttagcttcgacctcaactattgttgatnttctcttttcctgttttctcctaacatatt

SEQ ID NO: 23302 - DNA, 101 bp, rice(Oryza sativa)
  misc_feature (71): n=t or c
gctaatttaatatttatcttcatcagactcaaacaatgtcatatttcacgtggtaggaaactatcccctcngtctcataaaaaaccaacataatactagat

SEQ ID NO: 23303 - DNA, 101 bp, rice(Oryza sativa)
  misc_feature (71): n=a or c
aaaaaattagtatgtaatgtgaacttccgaaataggattatgccactgcgagggatcgatgaaccgcaccntgggaattgacctaccgacttggcaggtgt

SEQ ID NO: 23304 - DNA, 101 bp, rice(Oryza sativa)
  misc_feature (71): n=t or c
gggaattactaatccggtgtgccaggagcccgggacatggagtactaatgtatgtcgtcggtgtagaccgngtcccgatccccaagggaaaacgagtgcaa

SEQ ID NO: 23305 - DNA, 101 bp, rice(Oryza sativa)
  misc_feature (71): n=t or g
ccctgaaatgctcaaattaaaatggcattttgtctgggagtccttaatgaattgtactgtggaccaacaancattgtttgtccgtgatttattttctaaaa

SEQ ID NO: 23306 - DNA, 101 bp, rice(Oryza sativa)
  misc_feature (71): n=a or g
aaggttctatcttttgtagagaatattcttgctacatctcttcgttttgtgagaagctatgaggattgagnatggctctctcatcatgctgcatctttctc

SEQ ID NO: 23307 - DNA, 101 bp, rice(Oryza sativa)
  misc_feature (71): n=t or c
cgtgctcgccgccggcgggtggtgagtgcacaagggcggaaaacgacgggggaggaggacagcggtgtcgngagcccacgtgtgggcagcgtcggaggcgg

SEQ ID NO: 23308 - DNA, 101 bp, rice(Oryza sativa)
  misc_feature (71): n=a or c
tacatgctaactacaaatgattcatgaacctacatatctatcatagtctctagttaggccctgaacctagnaaataattagattgaacaaatatttcgaac

SEQ ID NO: 23309 - DNA, 101 bp, rice(Oryza sativa)
  misc_feature (71): n=a or c
gaacaacgaagggcaatgcaccaaccggagtggaagaggaagatgccatcggcttgttttagatgtatctntgaggagaaggctatgataccatgtggaaa

SEQ ID NO: 23310 - DNA, 101 bp, rice(Oryza sativa)
  misc_feature (71): n=t or c
acatgtaatcaaatcagacaataccatatcaccaaagtaataagttgagtcagaattctttggtgagaagngaagcaacacttggtcatctattcttatgt

SEQ ID NO: 23311 - DNA, 101 bp, rice(Oryza sativa)
  misc_feature (71): n=t or c
attaatcgcaaagttccttcacgtcaattttgtcataattgctagctctgctttggaagatatatagggtnttctgttctgttctttgtagaaattaattg

SEQ ID NO: 23312 - DNA, 101 bp, rice(Oryza sativa)
  misc_feature (71): n=a or g
gaaacgagctgctgccatcaaaagggaaaacacataactttaatctcatcgcatcaggcagaaacaagccntgaattgctcaaagcccttgcgcaataatc

SEQ ID NO: 23313 - DNA, 101 bp, rice(Oryza sativa)
  misc_feature (71): n=a or g
ccccactcttttgcatctttatgctcccctttcctttgtctaatcgattgatgagaagtatttgggtgaancaattagtacacaatagcagctcacctgat

SEQ ID NO: 23314 - DNA, 101 bp, rice(Oryza sativa)
  misc_feature (71): n=a or c
tttgttcttgctttgatcttgccccttgctcttgttgttggacttgttatcttcttgatagaacttggtgnaagctacggttgatcccttctcaagcttct

SEQ ID NO: 23315 - DNA, 101 bp, rice(Oryza sativa)
  misc_feature (71): n=a or c
aagacgccggcgtcgttctacattgtaagatcgatctgtcagctcggttcaccatttctgacaagaaaaancaactgccacaagaagacgagaaattcagt

SEQ ID NO: 23316 - DNA, 101 bp, rice(Oryza sativa)
  misc_feature (71): n=t or c
caccatggcacaagatcatgtaagcaatacctcacatcagtggcatgttggtacatcaatttgtgagtgancagacgcttgaaactgagctgaatttcgta

SEQ ID NO: 23317 - DNA, 101 bp, rice(Oryza sativa)
  misc_feature (71): n=t or c
cattgacctagtctaaccgagtgagttggcgtgtgggcccatatgtcatcctcttctttccatcatcaccncttcctctccagcgggtaggcgatggcgtc

SEQ ID NO: 23318 - DNA, 101 bp, rice(Oryza sativa)
  misc_feature (71): n=a or g
ctttgaaggtatggctgcggtattcatgtgtcttggcctcaccaacaacacctgctcacatcaacaagtcngtatgaagctaccattgtaaccagttcggt

SEQ ID NO: 23319 - DNA, 101 bp, rice(Oryza sativa)
  misc_feature (71): n=a or g
acattctttacagtccaaaagcgcctaagctgatagaaaagatgcgcaattcattctatatttcaataccngaactatattcggggtctgttctaaagtgc

SEQ ID NO: 23320 - DNA, 101 bp, rice(Oryza sativa)
  misc_feature (71): n=a or g
ctgggtacacgtgctgcaagcatagagtaccctgtccgtaccaaccaaattccacgagagatccctgagcncaagttcccgtcatggctgcttgttttggg

SEQ ID NO: 23321 - DNA, 101 bp, rice(Oryza sativa)
  misc_feature (71): n=t or c
agatcgaaagttcatgattggtgtaggaagctgaatcgttcctatctttaacgttgctgccgcttccttcncgttattgtcggcacccgcccatggggtgg

SEQ ID NO: 23322 - DNA, 101 bp, rice(Oryza sativa)
  misc_feature (71): n=a or g
ggcccagcgcatatcctagtttgtggacatcatgggccgtggcccaaccgctgtataaacataacaaaaangggaagccaccattctagggttgcctccca

SEQ ID NO: 23323 - DNA, 101 bp, rice(Oryza sativa)
  misc_feature (71): n=a or g
attacaagttgagggaccttcggtgtactttttccccaggttaaagccaacctttttgccctccgaagctngagttgcaggcccacgctaccgggctcggc

SEQ ID NO: 23324 - DNA, 101 bp, rice(Oryza sativa)
  misc_feature (71): n=t or c
gctatcccaggatccttctaatcaggagatttaggcttctaatgctcccagaaatgtttttttttcaatanatggctcaaagagataacactagtttgtat

SEQ ID NO: 23325 - DNA, 101 bp, rice(Oryza sativa)
  misc_feature (71): n=a or g
ggataataattcaaggtttattttcaataacaacaagcataatagaaattcaagcgacttgtcacttactnctggaggtggattgaaggcattgaacggca

SEQ ID NO: 23326 - DNA, 101 bp, rice(Oryza sativa)
  misc_feature (71): n=a or c
gatgaaaagttgtcatttgaatgtgtaccagtaccaaatcagtcctctaaacattagcatatactccctcnttcccaaaatataacaatttatccaccaat

SEQ ID NO: 23327 - DNA, 101 bp, rice(Oryza sativa)
  misc_feature (71): n=t or c
atgtcaggctctctaacatctgcttccactgttgtaggctgtgcagaaccatcattagtagcagcttgtcnagaaccatcattgtgggaagggttctcagg

SEQ ID NO: 23328 - DNA, 101 bp, rice(Oryza sativa)
  misc_feature (71): n=a or g
ttaagggcccaagtgatcgatggaggttaattagctagctcttgactttgcaggagatatatgggaaatgnccggcttaacgtttgaggagatttggggaa

SEQ ID NO: 23329 - DNA, 101 bp, rice(Oryza sativa)
  misc_feature (71): n=a or g
ccagattgatgcctaagtcaacaaaatccacggcatgttgaagacatgccgccgttgcttgcccgaggccnaggcagctgcacagcgggatcgtcgccacc

SEQ ID NO: 23330 - DNA, 101 bp, rice(Oryza sativa)
  misc_feature (71): n=t or c
aaaacacacatattgctatttgagttcccatcaaataatctgcttatgtggctacgcagtgtgctgatctnatttccttttagatttgggaacacaatatt

SEQ ID NO: 23331 - DNA, 101 bp, rice(Oryza sativa)
  misc_feature (71): n=t or c
gtggttgacgggcgtatgacatagatgactagtgtggctattccaatggttgtgtcttctatttcatatcngatggcttagagcctatgtagtgcactctt

SEQ ID NO: 23332 - DNA, 101 bp, rice(Oryza sativa)
  misc_feature (71): n=t or g
acctggtgcttctcccccttttccgtctctgcagctcacatccgctcaaattcttcacgatccgtaagtgngtatgagttcttgcggatcagaagctaaat

SEQ ID NO: 23333 - DNA, 101 bp, rice(Oryza sativa)
  misc_feature (71): n=a or g
atatactccctccagttctatattttttgtcgttttgaacgtaatgacatttaccaaggagtaattaatangacgtctatttatggttctaccgatattaa

SEQ ID NO: 23334 - DNA, 101 bp, rice(Oryza sativa)
  misc_feature (71): n=a or c
gtagtactagaggctggtgtatgggtcctaatgtcatatgctcggaaagaagagagtacatgaaaagactnttgaagtgagtaataataagttaagtctgc

SEQ ID NO: 23335 - DNA, 101 bp, rice(Oryza sativa)
  misc_feature (71): n=a or g
atttgatcgccattttctgaagatgatgttgtcactgtcaaccaccaaggcagacaccaaccatgaaatgncatatagcctagtggttacagtgacctaag

SEQ ID NO: 23336 - DNA, 101 bp, rice(Oryza sativa)
  misc_feature (71): n=t or c
gtatatctctcatcttgtgctatccaactctttccctctctggcataggcgtgtctggccgattacgttgntttcgcgaaaaaaagagtagaataggctaa

SEQ ID NO: 23337 - DNA, 101 bp, rice(Oryza sativa)
  misc_feature (71): n=a or g
ctactacttatcagatacaggccggccttgatacatacactacaaaaacttttgtaccttctgcctctctntactcttaaaattaatctcaaaccctgttt

SEQ ID NO: 23338 - DNA, 101 bp, rice(Oryza sativa)
  misc_feature (71): n=a or g
gcagctaagttcgggtgagccacacacacaatcaccgcagcaagcgacccaaccaagcgcggctctgaccncaggaggagcaagtcaaggggtggtggttt

SEQ ID NO: 23339 - DNA, 101 bp, rice(Oryza sativa)
  misc_feature (71): n=a or g
gacgacaaatgtttcttctttgccttataaagctctttcgtttgtaacacagtggaaaaaactagctccgncaaagctaaggggggaggtggagactgtac

SEQ ID NO: 23340 - DNA, 101 bp, rice(Oryza sativa)
  misc_feature (71): n=a or g
acacatgtcactggatcagaagaatggcgtcaaacctggccactcatggaagggttcggctagggttaacnccgggggttactatcggtaatataggctag

SEQ ID NO: 23341 - DNA, 101 bp, rice(Oryza sativa)
  misc_feature (71): n=t or g
agatgagacatttcctagtcctatagctcgtccatatttatggtactaagaattatctcatctgattttanattcttatattttaggatggagggagtagt

SEQ ID NO: 23342 - DNA, 101 bp, rice(Oryza sativa)
  misc_feature (71): n=t or c
atttccggtatctgctgtccagggacctggcatttcctcacctgaactgactaatcttactgctctctgcncaaataggctgtgaaatgagctgaagtata

SEQ ID NO: 23343 - DNA, 101 bp, rice(Oryza sativa)
  misc_feature (71): n=t or c
tgcattggtctgtcgatgggtggagtagcaagatctcatacttataggtgcatggaaagttgcggacttgnggttatctacgagatttgtgttctccagtg

SEQ ID NO: 23344 - DNA, 101 bp, rice(Oryza sativa)
  misc_feature (71): n=t or c
tagtgcaaggcattgaactagtcagaagacgtatgaacaaaattgaattaaaacattctcatgattagtanatatatacaagctgtaactacatctttgat

SEQ ID NO: 23345 - DNA, 101 bp, rice(Oryza sativa)
  misc_feature (71): n=t or c
tgaaatggcgccttttaaaatcagtaattgacataccacatggctgaatcttttggcgcatcacggtgtcnggcttgagtggaacagaaaacagtagctga

SEQ ID NO: 23346 - DNA, 101 bp, rice(Oryza sativa)
  misc_feature (71): n=t or g
tagtgaagctatatagctagcacatatatcttcggtgagacggtgaacagatactagctatagggaatatnctgttttatatatacttgatactatgtata

SEQ ID NO: 23347 - DNA, 101 bp, rice(Oryza sativa)
  misc_feature (71): n=t or c
ggcatctcgggttcctccgccttatcagtcactacttcggaggaggaggtctcggtggtctcggaggtttntgcaccccccccctccccgccccggttttg

SEQ ID NO: 23348 - DNA, 101 bp, rice(Oryza sativa)
  misc_feature (71): n=a or g
tttgtgttcatgctttcaagtgacttttgaggtgagacggcattgagacacgtgcggagcatttgagacangtgtgaagggcaacaacgtgccaacgtgag

SEQ ID NO: 23349 - DNA, 101 bp, rice(Oryza sativa)
  misc_feature (71): n=t or c
tatatatatatatcagatcgaacggttaaaagacaacgggcctgttcattcatttcgataccattttcaancataccattttttaccaaaattataaaaaa

SEQ ID NO: 23350 - DNA, 101 bp, rice(Oryza sativa)
  misc_feature (71): n=a or g
attcggtccatatttttgcccgatattatccgaacttatatccgtattcgacgctatccgtgtctgacccnattccgattatacaatgtgggttaggatat

SEQ ID NO: 23351 - DNA, 101 bp, rice(Oryza sativa)
  misc_feature (71): n=a or c
gtgcatgttgagagattgttgatctcagagcatgcaaagttataaagtgaagtagcacgtcagtccactgntctttcaaattcaatcttcggatgaccctt

SEQ ID NO: 23352 - DNA, 101 bp, rice(Oryza sativa)
  misc_feature (71): n=t or c
atgcactagtttgggttttctttttcctttgggtgtgtgctattctcttgtatccctggtgggcgggtgtnggagtctttctctaacaccgtacacctttt

SEQ ID NO: 23353 - DNA, 101 bp, rice(Oryza sativa)
  misc_feature (71): n=a or g
catgggcgggagcggaacccgaggaaaagggacccctctaggaatgatgagacgaatagaggcggtgcatntgatattcccttgaactataaaaggaggac

SEQ ID NO: 23354 - DNA, 101 bp, rice(Oryza sativa)
  misc_feature (71): n=t or g
tgggaagttggcgattgaatggtgtggaggaaattagggcatagttatatactccttcccttaatgggtcngctgggccttgaaataggctatcccggggc

SEQ ID NO: 23355 - DNA, 101 bp, rice(Oryza sativa)
  misc_feature (71): n=t or c
agcttgttctgttaatagtgcagctaattaagcccatgtcctcgtgtctcgatcgatggggtttttcctcngtcataaacagggcaagttcatactatttt

SEQ ID NO: 23356 - DNA, 101 bp, rice(Oryza sativa)
  misc_feature (71): n=t or c
ctgtttgaatgtgatgaaaatgagaactaagtgatggcacgtaaaacgagaaaaccatttacacgcttaantgagttttagttattgatataaacttgaaa

SEQ ID NO: 23357 - DNA, 101 bp, rice(Oryza sativa)
  misc_feature (71): n=a or g
tttttctggtttagctcgagcttgcaaacaagcataaccgagtcggccttttagcttgttaaaataacgcncgagccagctcgatatccacctccgtgtgt

SEQ ID NO: 23358 - DNA, 101 bp, rice(Oryza sativa)
  misc_feature (71): n=t or c
ctcgagttccaacttcgagtgctcgagatggaggtgatgtgatggggattttttacggggaggttggtggngtgagactgtgggtgggcccccggttttct

SEQ ID NO: 23359 - DNA, 101 bp, rice(Oryza sativa)
  misc_feature (71): n=a or g
aaaaagaggagaggattcgttggttaaatggaggtggaggtctctttcgctccatgggaaaaattaattgnaagcagggcccgaatcaagcaaatcgtgcc

SEQ ID NO: 23360 - DNA, 101 bp, rice(Oryza sativa)
  misc_feature (71): n=t or c
atgaaaaacaggataattctgaaaccaacacagtatcgcgcgagcgcgtcaacaaaaacaggaacagaaangtatcgtaccagtgctcaccgccccgcctg

SEQ ID NO: 23361 - DNA, 101 bp, rice(Oryza sativa)
  misc_feature (71): n=t or c
atcttagaagatagggctgctaaaatggtaccataacgccttttattttcccacccgtgtgagcacgaatntttacgcaatcaaacggtccaaaaatcgaa

SEQ ID NO: 23362 - DNA, 101 bp, rice(Oryza sativa)
  misc_feature (71): n=t or c
aatcaagcatataattggataaatttaaaatacacgtaaaaattgcacaatagagttactccctccattcnaaattgatctacatatattttttgaggtta

SEQ ID NO: 23363 - DNA, 101 bp, rice(Oryza sativa)
  misc_feature (71): n=a or g
gagattgggtcgagctctactgttggactcccaacggaagcagcgttttccgagtacctcgagatcgcggntactgggagctcatccatgaagtcctgcgt

SEQ ID NO: 23364 - DNA, 101 bp, rice(Oryza sativa)
  misc_feature (71): n=a or g
tcggctatcacggcatagatcgaggtaggaaaatgcacactgcacttttgcaaaagaggccctaattatcnaaggacgtatggcgaaaaaaaactatcaac

SEQ ID NO: 23365 - DNA, 101 bp, rice(Oryza sativa)
  misc_feature (71): n=a or g
aacaaaaatttacaagtaagtttcaactataggggatcaaaagtcatactggaagctccttccaatttgcnatgcatgttgagatataaaaatcacaaatc

SEQ ID NO: 23366 - DNA, 101 bp, rice(Oryza sativa)
  misc_feature (71): n=t or c
cgaaggagctgagcttttgtggattgaaggcacatcataataagggaacgacgacgatgatttcgcgtaanagacaccgggagtaactatgttaatggcag

SEQ ID NO: 23367 - DNA, 101 bp, rice(Oryza sativa)
  misc_feature (71): n=a or g
aagaagaagcaaaaaatatttcgaaggagaagactaatttgtctggacctaacttccaagatggctgcatntttgttgggagggtactcgctttatttttg

SEQ ID NO: 23368 - DNA, 101 bp, rice(Oryza sativa)
  misc_feature (71): n=a or c
cctcaactccacggcatcttctttcttctctcttcttcacaagattgagagggaggggggaggtggccganaggagtgtgtgagcgcggggcagcggcagg

SEQ ID NO: 23369 - DNA, 101 bp, rice(Oryza sativa)
  misc_feature (71): n=a or c
gccacgtccactcgatgaaaaggttcatctttcgctttttcgtgttcagctggagatgtcagagcctcatngtttggcctaaacagccaaagaataagtca

SEQ ID NO: 23370 - DNA, 101 bp, rice(Oryza sativa)
  misc_feature (71): n=t or c
taatttagcttgattaagggggtatttggaagagaggggctaacataagtccttcagaggacttatgtccncctaattcttacactcatcagtggatatga

SEQ ID NO: 23371 - DNA, 101 bp, rice(Oryza sativa)
  misc_feature (71): n=a or g
gagccaacaggggagctgcatctcatgtctgctccattgaaatcaattgatggtttaattttgtttgatcnaccaaaatgcagtgtccgggcagaggatat

SEQ ID NO: 23372 - DNA, 101 bp, rice(Oryza sativa)
  misc_feature (71): n=a or g
caagtagggagataaaacattttgggtagtaaaataggatcccatctcgctcatgacgattagtccttttncttagtcatatagcccattgccccacatgt

SEQ ID NO: 23373 - DNA, 101 bp, rice(Oryza sativa)
  misc_feature (71): n=a or g
gatatttctgaaatcgagatctctcgatatcatggaaccaatcttgctaataaaacaggtaatgcttatcnttacgagcacagtaaaagcatgtacaatag

SEQ ID NO: 23374 - DNA, 101 bp, rice(Oryza sativa)
  misc_feature (71): n=t or g
cttaaaataaaacaacctaagataatatggtatataacctaatataacaatctagatagaaaaatgttcanatttgttaaactagattatatttaggttgt

SEQ ID NO: 23375 - DNA, 101 bp, rice(Oryza sativa)
  misc_feature (71): n=a or g
cacttggcgcggcccatttttccgctagcgcgaaatagaaggagtatttccgtatttagggcctgttttanaacctccaaaatagcaaaagttttacagtt

SEQ ID NO: 23376 - DNA, 101 bp, rice(Oryza sativa)
  misc_feature (71): n=a or g
aatatcaataccaggctgacgggtccctgtatcaggataaagagaaatacatattttcgcttttgacaaanctaggcaggaagattatacatggtgagaag

SEQ ID NO: 23377 - DNA, 101 bp, rice(Oryza sativa)
  misc_feature (71): n=a or g
aatcagagataattgatcttctgttcagtgattggagtgtgacagatacatttgcacttgagttactctangttagcaatactggtatccagtgggtaagc

SEQ ID NO: 23378 - DNA, 101 bp, rice(Oryza sativa)
  misc_feature (71): n=t or c
aggctgtcaatccaactgtctttccagaccagagtagtatctgctgaaccaataatcaccattgtgaaggncctgaataaagggattaacttgaacatgtc

SEQ ID NO: 23379 - DNA, 101 bp, rice(Oryza sativa)
  misc_feature (71): n=t or c
tggccagtccttgggagttctgttcatcctagtcccccacatagctatgctttttggagttcaaggcaggntatatgcatgtggcattcatgtgacaggtg

SEQ ID NO: 23380 - DNA, 101 bp, rice(Oryza sativa)
  misc_feature (71): n=a or c
gctctcttgcttgctcttgttgggaactcgcgaaagcttcggttcttttgagaagaagagaggaggcagcnactctcgcggtgtctcgcgcctcgcctcgc

SEQ ID NO: 23381 - DNA, 101 bp, rice(Oryza sativa)
  misc_feature (71): n=t or c
gcactgagtatgaaaagaaacacgaggtatagacaatcaagccaccgaccagcagtcaggctggtagatancctggctaatctaatctggtaggatgatat

SEQ ID NO: 23382 - DNA, 101 bp, rice(Oryza sativa)
  misc_feature (71): n=a or g
atagtccgggggacaagtatgtgaaggcttgatagactatagattgggtgcttgcggggcctgaatacctngctcgagggataaagtgtgtaaagatctga

SEQ ID NO: 23383 - DNA, 101 bp, rice(Oryza sativa)
  misc_feature (71): n=a or c
ggttttggtttgatgagttaagtggacttcttctttgttgggcttgggccttaggaagcattcattgggcngcttgtggttctgatctgcacacgaggtct

SEQ ID NO: 23384 - DNA, 101 bp, rice(Oryza sativa)
  misc_feature (71): n=t or c
ttcgatctgttggatcatggtattctaaaaccctacctttagaagggagcctgcttttcatcagagaccanggaagttggaacgaaataagtacattcatg

SEQ ID NO: 23385 - DNA, 101 bp, rice(Oryza sativa)
  misc_feature (71): n=t or g
tggtttcgtgtagctcgaatgatgcgccctgttcgctgtggtgcggcggttcttgataattgatactatgntttgattttttttccccttggtttggtgag

SEQ ID NO: 23386 - DNA, 101 bp, rice(Oryza sativa)
  misc_feature (71): n=a or g
tttgaactcgtactgccgcgaaatgcacagtggatttcggccttttcggtcaatttaccgatcggcgttcngtacggggaaacgtacagcgagggatcggt

SEQ ID NO: 23387 - DNA, 101 bp, rice(Oryza sativa)
  misc_feature (71): n=t or c
tgatatctgttcaatgacagtttggtgtgctcgatttagattagaggttttcgcgatctataacattcttngtttatgtgctaaacatccgtgggttgaga

SEQ ID NO: 23388 - DNA, 101 bp, rice(Oryza sativa)
  misc_feature (71): n=t or c
gcagtaatttgattatttcgcacgaattttctgtttatacgagcaaacaatacactgaacaggaagagtanaataacaatactagttgtgttgtgatttct

SEQ ID NO: 23389 - DNA, 101 bp, rice(Oryza sativa)
  misc_feature (71): n=t or c
ggcctacctaattcgatgttcttttcctgaggaaggtaccaagctagtctagcttcgatctgagagtcgangagtaccatattacattcctacatgcttta

SEQ ID NO: 23390 - DNA, 101 bp, rice(Oryza sativa)
  misc_feature (71): n=t or g
gctgaacgagggtcgtgacgtcatcctcgacggtaccctctcctgggagccgttcgtccagcagaccatcnccatggcgcgcgacgtccaccgccgccgct

SEQ ID NO: 23391 - DNA, 101 bp, rice(Oryza sativa)
  misc_feature (71): n=a or g
agattcatcacatcatgtttcaaaccctcaaaaggacatagaaatgtgatatttccctctgcatcattgcnttatcttcttatcaaggacgcatggtccaa

SEQ ID NO: 23392 - DNA, 101 bp, rice(Oryza sativa)
  misc_feature (71): n=t or c
tagtgggttgtactagtgatccaacgattcgttggcataataagcctggcctaaggtcatgcctgtaactngcctggcatctgtttggttgctaccctgag

SEQ ID NO: 23393 - DNA, 101 bp, rice(Oryza sativa)
  misc_feature (71): n=t or c
atcggaatgaccaatagcagatggctagctagctcttttttcacaagaatccgttgctacttgtaattcanatttggcttcgattctctctaaaatgaagt

SEQ ID NO: 23394 - DNA, 101 bp, rice(Oryza sativa)
  misc_feature (71): n=t or c
aagtcgtttcaattaggctttagaaattactccgggctccaccactgcacatgactaaataactcaccatnaccgatgacaattcatgacttttgaatttt

SEQ ID NO: 23395 - DNA, 101 bp, rice(Oryza sativa)
  misc_feature (71): n=t or c
agacaaagaaaacgcacgaatttcacacttacctttaccaccgccgagagcctggtgcacggacttgtccnccccaagaagcctaaaccccctcggcctcg

SEQ ID NO: 23396 - DNA, 101 bp, rice(Oryza sativa)
  misc_feature (71): n=t or c
aagaaactgtctattaatgaccaacaaatcatttcattattctggtcccttccaagttccgactagggtgntaggctgctggcaaacatcaattcttaagt

SEQ ID NO: 23397 - DNA, 101 bp, rice(Oryza sativa)
  misc_feature (71): n=a or g
tgccaagattgctgtttattgtgtgcacatggtgcactgtaggctacagaaccttttactgatgaaagggnaaaaaaaaactttctgatctcatttacaag

SEQ ID NO: 23398 - DNA, 101 bp, rice(Oryza sativa)
  misc_feature (71): n=t or c
tcgcaaatataccctttagatgtatgacatatgggtctccactatacccgggaaaaaggacccccgctctnataatttcagttcattttctcacttgtgca

SEQ ID NO: 23399 - DNA, 101 bp, rice(Oryza sativa)
  misc_feature (71): n=a or g
aacccctctttttgatgggtgaaggcccatcgtgcaacaaactggccggttcggtatgtcttagtttgacnatttatacagttaaacgcccggttgataac

SEQ ID NO: 23400 - DNA, 101 bp, rice(Oryza sativa)
  misc_feature (71): n=a or g
gagttaagtagtcggtgtgatatagatggttaggggtaggatgagaaagtaagatcatcttttattttggnacatttaacttcttaccatttttaagatgt

SEQ ID NO: 23401 - DNA, 101 bp, rice(Oryza sativa)
  misc_feature (71): n=a or g
tgtcttcaggatgaccatcatcgttgctgccgctcactttctcaacggaaggttatgtgtctccaacgcancaacccaatcagttagcatggatatccgct

SEQ ID NO: 23402 - DNA, 101 bp, rice(Oryza sativa)
  misc_feature (71): n=t or c
ttaaggaaagaaaagaattttgggactcaattcggcaggaaaatcaatgccatatgcaaaacactgatgcnctaatagaagatttgaagttcccggctgac

SEQ ID NO: 23403 - DNA, 101 bp, rice(Oryza sativa)
  misc_feature (71): n=a or g
tctctcacttagtcatccctctctctcactcgttcatagtggcgaatgcggcgcacacgaaggtaggtcantggtgtggcatacgtcgacgacagcctcag

SEQ ID NO: 23404 - DNA, 101 bp, rice(Oryza sativa)
  misc_feature (71): n=a or g
tgccgatgcggatgaagagtggattgtttcaaatatcggaaatggtaaggagttggtgtggatttgattcngaaacatgttaaaattaatgaatgttacgt

SEQ ID NO: 23405 - DNA, 101 bp, rice(Oryza sativa)
  misc_feature (71): n=t or c
cgctggtggcggtgaggcagcggaacggcgtgacggcgacgagctcgctcaagatcatgctgcacgacgcngacgcctacgtcgccgagatcgacggcaag

SEQ ID NO: 23406 - DNA, 101 bp, rice(Oryza sativa)
  misc_feature (71): n=t or c
cggttgttaatgagggagcatccacagcctactgggcagattgcgaattggacgactcaagatcaagttgntgccatgtttctgccacctccacctattat

SEQ ID NO: 23407 - DNA, 101 bp, rice(Oryza sativa)
  misc_feature (71): n=t or c
ttcttttcttttcgtggctacagaattctttctggagtatatacaccttatatcatgacgtaaacgaatgnatagagatcaatgttttaaatagcgggcta

SEQ ID NO: 23408 - DNA, 101 bp, rice(Oryza sativa)
  misc_feature (71): n=t or c
tcaaagtgtgtgcttatatcttactcatgcagtctcatgtgcatgtgcccttcccttcatgacgattttgnaaaacctcttgattggtagtctgagtcttg

SEQ ID NO: 23409 - DNA, 101 bp, rice(Oryza sativa)
  misc_feature (71): n=a or g
ctcttgtggacccaatgtactgggccgtactctaatctgggccgcgcattttaatccagtaaaggaaaaangaaaaagtccacttagactcccttaattgt

SEQ ID NO: 23410 - DNA, 101 bp, rice(Oryza sativa)
  misc_feature (71): n=a or g
tttctcaaaatcatttcttatatatctaggacgattaaactagggaggccggtgatcaaccttttcttcanttctgagaaactcttctcacattcttctat

SEQ ID NO: 23411 - DNA, 101 bp, rice(Oryza sativa)
  misc_feature (71): n=t or c
gatggagaagacctcatcagaagacatacctccggcgaccgctcacctcgagaagaacgagatcctacacngccacgccgtgaagatggcaatcttcgcga

SEQ ID NO: 23412 - DNA, 101 bp, rice(Oryza sativa)
  misc_feature (71): n=a or g
ttcagaaaaaaaagagctgcatttttttttatggctgatgtagcgatcggccgcatcaaaatctgaggctnaaagccaccgggatatgctgcgtccacgga

SEQ ID NO: 23413 - DNA, 101 bp, rice(Oryza sativa)
  misc_feature (71): n=t or g
ctgcccaggatcatcaatacacgttgaggcttcttcgtgtgtgaaagcatggctaactcgtctggtcaaangcaaaattgctgctatcctaaaacaaatag

SEQ ID NO: 23414 - DNA, 101 bp, rice(Oryza sativa)
  misc_feature (71): n=a or g
cttaccgtcactagctataggacaagtggctaagctaacctaagcacgacaataattaactagatttttcncaatttggagcttttaaaatactttttttt

SEQ ID NO: 23415 - DNA, 101 bp, rice(Oryza sativa)
  misc_feature (71): n=t or c
tcaaattttctagtaatacttaataaattagacgttaatgagccattcgattatggggagaggttcccaanccctcctcatatgcttatggtatttgccag

SEQ ID NO: 23416 - DNA, 101 bp, rice(Oryza sativa)
  misc_feature (71): n=a or g
atgatagtgttaactaaggggcgaattgtccttttttttgccccacctcatttgatcatgttatatcaacncttttttttattaagagcattttgaaatgt

SEQ ID NO: 23417 - DNA, 101 bp, rice(Oryza sativa)
  misc_feature (71): n=t or c
gttcattttcacgtatagaaagtggttttgcattgtagcagtgtttggcacactaaaaaagcattttcgtngatgttgggtctttttttcacaggcgggta

SEQ ID NO: 23418 - DNA, 101 bp, rice(Oryza sativa)
  misc_feature (71): n=t or c
caaggtaatgggaacatgcaataacttttctgaccatggggtggtttgttgttgattactacctctgtttnaggttataagatgttttaactttggtcaaa

SEQ ID NO: 23419 - DNA, 101 bp, rice(Oryza sativa)
  misc_feature (71): n=a or g
tctgttagtatcagaaccataaacttgcagatgcaagcatagatatcatgccaaccacatgactatctcantattagccagttgaaccagttgaaatttgt

SEQ ID NO: 23420 - DNA, 101 bp, rice(Oryza sativa)
  misc_feature (71): n=a or c
ctctataattgaataatgcaagcagattgaattattagcatgatcgctttactaacctgaagaaatgtggnaccggtcctttcactatagtacaatccata

SEQ ID NO: 23421 - DNA, 101 bp, rice(Oryza sativa)
  misc_feature (71): n=t or c
gacttcgccctaatatttcgcccctgtcgcgcatccacacacacatatattctttgacgtaatacacacanacatacatacatatatatatatatatatat

SEQ ID NO: 23422 - DNA, 101 bp, rice(Oryza sativa)
  misc_feature (71): n=t or c
tgaaaaacgactcctgagacggtttcgtccgatatggcatcgttgaccctgttaaacggctgagtccgcangtgggccccatatggcagtgtgatgtagaa

SEQ ID NO: 23423 - DNA, 101 bp, rice(Oryza sativa)
  misc_feature (71): n=t or c
tccgtttttatccctacttacagtatgtaactcaaacctggtgttcagtacaagagtccataatatgctcnatggaaacgctgaaaattccatctaagatt

SEQ ID NO: 23424 - DNA, 101 bp, rice(Oryza sativa)
  misc_feature (71): n=t or g
ctgaaaaggagaaccaaaccaggaggtgtaatcttctctaatgttaatatgtgggaacttcaagagaaaangatctacaagaataatttactgcaaactgt

SEQ ID NO: 23425 - DNA, 101 bp, rice(Oryza sativa)
  misc_feature (71): n=t or c
tattatcctttcctaattctctcttcagatacaatgattcaacgatagaaccttgaaactcaaccgtcacngatggatacgcttgccggagaagacgttgc

SEQ ID NO: 23426 - DNA, 101 bp, rice(Oryza sativa)
  misc_feature (71): n=a or g
aaagaatcgtactatgcagctattcatttttgttgaacagaccacaaggaactcagcccttctgacactcnaggcatggccatctactcaagaacagtgct

SEQ ID NO: 23427 - DNA, 101 bp, rice(Oryza sativa)
  misc_feature (71): n=t or c
acgaggcacgggaggaggtgatgggacactgggatcatccttccgacaccgacgatgatgacgacgaagantggaagcttttcattagcgcaattaggagg

SEQ ID NO: 23428 - DNA, 101 bp, rice(Oryza sativa)
  misc_feature (71): n=t or g
agttggcaaaactgagttggattcaattagtgcgtgcattaggcgactatcaccgagcaaacaggaaaaanatcaggctgtctaagctgatctactactat

SEQ ID NO: 23429 - DNA, 101 bp, rice(Oryza sativa)
  misc_feature (71): n=t or c
gctttgtatgatcttttaaagtgcaatgtgccaagtgacgacagcttatagtagcagattagcaagaggtnagtttgctggtacttttggaaagatcttac

SEQ ID NO: 23430 - DNA, 101 bp, rice(Oryza sativa)
  misc_feature (71): n=t or g
atccccctgtctcaacccattatgtgttgtaaaatagagccctatctgatcattcactctaatagccactntcccccctttaaccactttcaagatccaat

SEQ ID NO: 23431 - DNA, 101 bp, rice(Oryza sativa)
  misc_feature (71): n=t or c
tattggccctccatgatatacaaagctctctgacttcgatgagcttctatagacttgatgagtccatgagncaattaaaatttattctattaaattttgct

SEQ ID NO: 23432 - DNA, 101 bp, rice(Oryza sativa)
  misc_feature (71): n=a or g
gtcctctctatctctgttcatttactatgatttcgacaggctcaagaacacacttagtgtaatttacatanttttgcctttatcttctagttgttgaaatt

SEQ ID NO: 23433 - DNA, 101 bp, rice(Oryza sativa)
  misc_feature (71): n=a or g
aaatgaagatgtcaagaaaatccttgaagacatatgtcatcggctagggtcatcactggacagtctggtgnccgattgtggttcaatccaggcacgatttg

SEQ ID NO: 23434 - DNA, 101 bp, rice(Oryza sativa)
  misc_feature (71): n=t or c
gcacacaaccaaactaaagtttctaggagacgtcctatgaaacaacagattggatagaataccacagcacnagagaatagtgaaggagctcaccaggtaga

SEQ ID NO: 23435 - DNA, 101 bp, rice(Oryza sativa)
  misc_feature (71): n=t or c
tgttgaaggtcctaatcagttggttttttgtccctggttttggatattaggagggtctcttagtatctttntttttgtggaacaactttcagtgtctgtaa

SEQ ID NO: 23436 - DNA, 101 bp, rice(Oryza sativa)
  misc_feature (71): n=t or c
ccatgacgatcatcgcattactcgttatcatcatcagccaggtcgaactgcttgagcagcgcgccgcagangggcagtgggatgtccttgaggtagccgag

SEQ ID NO: 23437 - DNA, 101 bp, rice(Oryza sativa)
  misc_feature (71): n=a or g
ctttatgtttgggtggtattcaagatgtgttacatttatgatagaagacgaagcacaaaccacgaagtgtnaaaggaaggtattagaagattgcaatggcc

SEQ ID NO: 23438 - DNA, 101 bp, rice(Oryza sativa)
  misc_feature (71): n=t or c
gacccgatgattctctcctggctgaagttgttggtcgccttcaagatgtccacgaacgtcaatctcttcgncgcctcaccggcggcctccgacatgaacag

SEQ ID NO: 23439 - DNA, 101 bp, rice(Oryza sativa)
  misc_feature (71): n=t or c
gttgattgacctttgtacacctggtgattttaccatagccaaatctatgcctaaccacacacactactcgncctttatttgaccaagtttaattactccta

SEQ ID NO: 23440 - DNA, 101 bp, rice(Oryza sativa)
  misc_feature (71): n=t or c
agtacaaaggcctatgaccttggtggttgtgtaaaatggacttataaattattcctgtttctatagtttanagagaaagtagctgcagacaccaagtctac

SEQ ID NO: 23441 - DNA, 101 bp, rice(Oryza sativa)
  misc_feature (71): n=a or c
tgaggtactcgaaggttgtttgggatgcatatgcgatttagtatttgccatttcttgctgatgattgatgntgaacatttctaatagaacgagttagacca

SEQ ID NO: 23442 - DNA, 101 bp, rice(Oryza sativa)
  misc_feature (71): n=t or c
tgagatatgctgtgggggatggaaaggatgcggccatgcaggatgtgggagcgatctgatacgttggaacnggtttttaaaagctgaaaccttatatatta

SEQ ID NO: 23443 - DNA, 101 bp, rice(Oryza sativa)
  misc_feature (71): n=t or c
agaaaggcgagtggaacggcggcggctggccagggagaacgaaatttcccaactaatcttcaccattttcngtgcacatgcttttcaaactaatctttatt

SEQ ID NO: 23444 - DNA, 101 bp, rice(Oryza sativa)
  misc_feature (71): n=a or g
tgctgtgccagcatccattttcagatccttcataccaattgcgggatctttggaccgagctttcggtgcantcgctgtggttttcttcagcggcttgtcgg

SEQ ID NO: 23445 - DNA, 101 bp, rice(Oryza sativa)
  misc_feature (71): n=t or c
ggctagatttgatggggggatcaacaacgatttggctagatttgatgggggatcggctccggtatgaaggnacatgactgtcttttgaaggttgaagacga

SEQ ID NO: 23446 - DNA, 101 bp, rice(Oryza sativa)
  misc_feature (71): n=a or g
ggcacagcttcccaccgcaatcttggaaaaatcttgagcgatcgagttgcgggcggtggagatggtggccnacaagtgggcgctggagaaggctcaggcac

SEQ ID NO: 23447 - DNA, 101 bp, rice(Oryza sativa)
  misc_feature (71): n=t or c
tgcgacactgcacggtctcacgctgtgatagtgcgagaccgtccatgtggtcattttcacgtcacggttangcgggatcaatagtatatttctattgaaca

SEQ ID NO: 23448 - DNA, 101 bp, rice(Oryza sativa)
  misc_feature (71): n=t or c
cacgaaaaaattataactatatatgacctattttcaccgtgtatgtatctttaatataaatttaaacactnacattagcttaaacttgatactctatccat

SEQ ID NO: 23449 - DNA, 101 bp, rice(Oryza sativa)
  misc_feature (71): n=a or g
gtgaacatgaagcaacggcctaacttgttctttaatcagctggatgccaaataaagagctataagaggggnaaaatgatctgtacatacaatatttgacta

SEQ ID NO: 23450 - DNA, 101 bp, rice(Oryza sativa)
  misc_feature (71): n=t or c
gagacgtgagtaggcaggcttcgtctccaacaatggcaggcaactggtagtgtcaaaacaaagatttcggnaatacttaaaaggggtggctatcaagctaa

SEQ ID NO: 23451 - DNA, 101 bp, rice(Oryza sativa)
  misc_feature (71): n=a or g
cacagcaaggcgatttggcacttctccaacgagctccccctttgcaacaacgcttgtcatgcaactaggcnatgcatcgaggtggacatgtctcttcttcg

SEQ ID NO: 23452 - DNA, 101 bp, rice(Oryza sativa)
  misc_feature (71): n=a or g
ggcggagtccggcgactggttggtgaggttgaagtcgccgatcttggcgtcgtggccgtcgaagacgagcncgttgctggagcggatgtcgcggtggacga

SEQ ID NO: 23453 - DNA, 101 bp, rice(Oryza sativa)
  misc_feature (71): n=t or c
gctgtcatcgcggtccgtgcctcgtcgctgcgccccttgaatcgttgttgctgtccatcgttcctccctgngcccacgccaacggccgcccccgacgacat

SEQ ID NO: 23454 - DNA, 101 bp, rice(Oryza sativa)
  misc_feature (71): n=a or g
ctgaacgtcaaggtgaggacgctcaccggcaaggagatcgacatcgacatcgagatgacggacacggtggncaggatcaaggagcgcgtcgaggagaggga

SEQ ID NO: 23455 - DNA, 101 bp, rice(Oryza sativa)
  misc_feature (71): n=t or c
tgaaaatgtgcctatgctttatagcaacccttgcatggaatctgaaagttccaatcttatgcctttttagnactttgttttaatgtttttcacttgtgcga

SEQ ID NO: 23456 - DNA, 101 bp, rice(Oryza sativa)
  misc_feature (71): n=t or c
ctttaaaaaaacatcaaacattctgttagagaatgatgtggcatataactgttggttactcctttcccgcnctcccagagggtttttttttataggaggag

SEQ ID NO: 23457 - DNA, 101 bp, rice(Oryza sativa)
  misc_feature (71): n=t or g
tatatacaattagagaaaaggcagtaaatacccgtgtaaaaaaaaggagagataccattcttaagaaatantatatacttctacaagataaagaagcatat

SEQ ID NO: 23458 - DNA, 101 bp, rice(Oryza sativa)
  misc_feature (71): n=a or g
gaagaaggagagagaaattgcatgtaaatatgcaggagggtagcttataggcttgcagattccctgtgatngttttgtttgcacggactgcattcgatttt

SEQ ID NO: 23459 - DNA, 101 bp, rice(Oryza sativa)
  misc_feature (71): n=a or g
tcatgaaagcgtccttttttttctcacacatttaataaaataaaccgtggaggtgggcagataaataactnttatgaagtaatcaaaatagattatgttag

SEQ ID NO: 23460 - DNA, 101 bp, rice(Oryza sativa)
  misc_feature (71): n=a or g
catcaaagaattgtctgtttgaactttgcataaagagcgctgataagaatcccttgaaactcgaagaactntacattttacagggaacaatcatacataat

SEQ ID NO: 23461 - DNA, 101 bp, rice(Oryza sativa)
  misc_feature (71): n=t or c
gagtttcaactatgacatagatgatcacaacgcatgaccaatacaaagtttaataccttgtgtctccaagntgtccatgtaagctccatctttggcgaaat

SEQ ID NO: 23462 - DNA, 101 bp, rice(Oryza sativa)
  misc_feature (71): n=a or c
atgaacaattcgtctctgcactgactctgctaaccttgtcttcaatgcagaaaatggtcatgtccttgtcntgcgacagggctgtatgggatgctgttatg

SEQ ID NO: 23463 - DNA, 101 bp, rice(Oryza sativa)
  misc_feature (71): n=a or g
ccccgtcggcgctcaactcctctctcatcggccaacacccttctccctaccacgcatcgctcttctccccntcggtcgccgccttggaaaaatatggggaa

SEQ ID NO: 23464 - DNA, 101 bp, rice(Oryza sativa)
  misc_feature (71): n=a or c
ggtcagaccggccagatgtcccggtcagaccaccattgttgacagtcgtgatgtcaccttcggtcttctcngcttgtatagttttcgccgcatctccagta

SEQ ID NO: 23465 - DNA, 101 bp, rice(Oryza sativa)
  misc_feature (71): n=a or g
atgcagcacctgtatgaaagtcagtaccatcccattaaagacaggttttgttgttcatatgtcaagggctngtaaggttttgcacgttgtatcgaattaaa

SEQ ID NO: 23466 - DNA, 101 bp, rice(Oryza sativa)
  misc_feature (71): n=a or g
ttctggtttcacggttgtcgtggaagatgccctgtcgtgggccaactaccatggtctccatgatgacatcnaggacgtcggtggcgatggagcagtacatg

SEQ ID NO: 23467 - DNA, 101 bp, rice(Oryza sativa)
  misc_feature (71): n=t or c
tgacaagttggaaaactcatatattagtaactttcactacttgactaaatttggtgctactcccccgtccnatgatataaaggattttaggcggatgtgac

SEQ ID NO: 23468 - DNA, 101 bp, rice(Oryza sativa)
  misc_feature (71): n=t or g
gctcgtgcttattgcatgtccccgcgaaaagaagaacaaaagaggagtggaaactgaaacgtacgtcctangaagaagctgagcgccgtcgtcgtcagctg

SEQ ID NO: 23469 - DNA, 101 bp, rice(Oryza sativa)
  misc_feature (71): n=t or c
gataactttccatccctcctagaataattaatgtagaaaaatacccatgtagaaaataaatacccatactnactccgtccaaaaataactcagcctaggtg

SEQ ID NO: 23470 - DNA, 101 bp, rice(Oryza sativa)
  misc_feature (71): n=a or g
caaataagttgccagatgccatcactgattacaagggagtgacaaggtcgcatatacctgtagtaaatgcnccggaaagagtagaggtaacccagaaggtt

SEQ ID NO: 23471 - DNA, 101 bp, rice(Oryza sativa)
  misc_feature (71): n=t or c
aaagaaagaaatttcccccgtgaatcaaaaaacatgcttctcttcaaaaactcttttcttctccccctttngacaatgatttcatcaagcataggaattat

SEQ ID NO: 23472 - DNA, 101 bp, rice(Oryza sativa)
  misc_feature (71): n=t or c
gaattaatttctggctggatacttagctgagcaaaaagatgatgggcctgcctctcacatactccctccgnttcacagtataagtcattctagcattttcc

SEQ ID NO: 23473 - DNA, 101 bp, rice(Oryza sativa)
  misc_feature (71): n=t or g
agggtgagttggagttgcttgttgaccgatctgctggagactggccgtttgtgcaggctgagaagctgatncttcttggcctgcagtgtgcagagcttagc

SEQ ID NO: 23474 - DNA, 101 bp, rice(Oryza sativa)
  misc_feature (71): n=t or c
gggtgatcaatccactgggtaagcaagcaagttgccgtgtgtacggcgtcttcccatttcacattatttcnacttttttttttctttctggccccttcatt

SEQ ID NO: 23475 - DNA, 101 bp, rice(Oryza sativa)
  misc_feature (71): n=a or g
cagccctacattgctttggtagttcactcgaaactggggcgttgtcccatgttactgatctactccctccntcctaaaaaagataaactatgggttttcgt

SEQ ID NO: 23476 - DNA, 101 bp, rice(Oryza sativa)
  misc_feature (71): n=t or g
gaagctcgatggaggaataaatagcaataatacgcaaccttctaatgagcggggtttcaaatgtcaaaacntgtcaacaaaagtttggcatataatgttta

SEQ ID NO: 23477 - DNA, 101 bp, rice(Oryza sativa)
  misc_feature (71): n=t or c
tttaagctggtaccaagcatatgcaaaaccgtttgggtcacctaataccaatctccaacggtttcgttganaaatgttcatttggtactgcccaaaaccgg

SEQ ID NO: 23478 - DNA, 101 bp, rice(Oryza sativa)
  misc_feature (71): n=a or g
atcaaccgatggaaagcttatctagaagaaaccgagttcaagaaagaatcgtcaagaccacgacatggtancttaatttatctattaattatacatggttt

SEQ ID NO: 23479 - DNA, 101 bp, rice(Oryza sativa)
  misc_feature (71): n=a or g
gcataaatgaacagactgtaataatggatgaagatagcttaattcaaggcatcaccaaaactgctaaaccnttgatgattccacaatgttcccttttctta

SEQ ID NO: 23480 - DNA, 101 bp, rice(Oryza sativa)
  misc_feature (71): n=t or g
tatttaaatctataaaatcaacacatacgcggatctggttatttttcttccttacaggtacaatatttganacccatgtagggtatttgacttctctaata

SEQ ID NO: 23481 - DNA, 101 bp, rice(Oryza sativa)
  misc_feature (71): n=t or c
ctagccgcccctctccctctccctcaagttctcttttcctccccaaccggccccctcttcctttggccganaggtgggacccgcagccccacctgccagct

SEQ ID NO: 23482 - DNA, 101 bp, rice(Oryza sativa)
  misc_feature (71): n=a or g
cttaaaaagaaggtggaaaattatatcagagaatgtcctatgtgtcaagtcaccaagtctgaaaacattcncatacctggcttgctaaacccattagaaat

SEQ ID NO: 23483 - DNA, 101 bp, rice(Oryza sativa)
  misc_feature (71): n=t or c
agccacaccctaccaggatagaagtacatactgtcatttccaccttttgttgggttcactgcacttctttnatcagggaagaacaaggcatgcactgctga

SEQ ID NO: 23484 - DNA, 101 bp, rice(Oryza sativa)
  misc_feature (71): n=a or g
agtttcaatgggtacaaagttttgatcccgggttccactgaattggaaattaatggaggatacggagaggntgggatgggtgggtttagaaaactggaaga

SEQ ID NO: 23485 - DNA, 101 bp, rice(Oryza sativa)
  misc_feature (71): n=a or g
cccgtaatgtactgatgtcgctgttcagtattcgaacccatcaaaaccgttattcatccattctttcgagnaagcatccactgttaacatcaatcacatgt

SEQ ID NO: 23486 - DNA, 101 bp, rice(Oryza sativa)
  misc_feature (71): n=a or g
gttgaaactacacaccacttaccgctacactatcaaatgcatctcctactcttatcgtatcaatgtgcttngtagagccaaaacattggataggcatgtac

SEQ ID NO: 23487 - DNA, 101 bp, rice(Oryza sativa)
  misc_feature (71): n=a or g
aggtgatgctacctctccaaaggacatacacctacgagtgctgggattttcatcattggcatagattgctngaaaggatgacactgacagagcagctatat

SEQ ID NO: 23488 - DNA, 101 bp, rice(Oryza sativa)
  misc_feature (71): n=a or g
ctccaatttcaacctgtgattattcatggagttgatagactgccaccaaaatcatcttgatgaccaattcnaatgcaagcgccaacttcgacctgtgcttg

SEQ ID NO: 23489 - DNA, 101 bp, rice(Oryza sativa)
  misc_feature (71): n=a or c
catcgttgcggcggtcgagcgttccaggagcactaagatgcgcaggttccatgtgggttttaatttttaanttttttttcttttaatgtcatatcaacgtc

SEQ ID NO: 23490 - DNA, 101 bp, rice(Oryza sativa)
  misc_feature (71): n=t or c
agcagcatcttcccaccgggcacgagttcctgatgtcgcagcttgaggaagaggacatgtccttctggaantgatcctggtacaactccaccatctattgt

SEQ ID NO: 23491 - DNA, 101 bp, rice(Oryza sativa)
  misc_feature (71): n=a or g
atgatatgcatatactacatctgcatattgtgtttcattcacctctaggactgatcatcacacatttactngtttccagtgaaaacatgttaacatatgta

SEQ ID NO: 23492 - DNA, 101 bp, rice(Oryza sativa)
  misc_feature (71): n=t or g
cgctcactcctggagaaaaccagtaaaacaaaattttcatctcccacgtcctgttctaccgggcacactcntcctgcgtcttcttcatgtgtctcgtcttc

SEQ ID NO: 23493 - DNA, 101 bp, rice(Oryza sativa)
  misc_feature (71): n=a or g
ttccatttgcaactttctcgacgagccatactactgctggaacttctgaatttctgacagttcagaacttntatgtacgtatattaactaatcactcaatg

SEQ ID NO: 23494 - DNA, 101 bp, rice(Oryza sativa)
  misc_feature (71): n=t or c
acacccttgtagtcttcttagccagtggcaataagcccaagacccaacggcgggctgacggctcacaattnccatcctgccgccggcggctaccgcgggcg

SEQ ID NO: 23495 - DNA, 101 bp, rice(Oryza sativa)
  misc_feature (71): n=t or c
ggcaacggtgggaggtcggtgatgaggtggctctggtggtcagccatagtggaggaaaagagaagggaggngagggagccagccatccgcgagaaggcatc

SEQ ID NO: 23496 - DNA, 101 bp, rice(Oryza sativa)
  misc_feature (71): n=t or c
tataacccgtcccttaactcccaaaaccgatacaaatcgactctctgaactgtttcggaggtggttttatnccacgtggtatttttattccgtcgatgtgt

SEQ ID NO: 23497 - DNA, 101 bp, rice(Oryza sativa)
  misc_feature (71): n=t or c
tatgacatttcctaatactacggatctggatagaataggacatttttcagtattacgaataatgtcccatncaattttaggttcttatattttggaaggga

SEQ ID NO: 23498 - DNA, 101 bp, rice(Oryza sativa)
  misc_feature (71): n=a or g
tagaattctaaaagttcacttgtacttagcttgctactatgtactccttccgtattccgtattttaatgtntgacgctccgtagttacaatcgggctagtg

SEQ ID NO: 23499 - DNA, 101 bp, rice(Oryza sativa)
  misc_feature (71): n=t or c
tattattctagttagccgtactacaaacgtagagggtattattgtaaaaaataggtctagatagatataanaattatttaattgtgacaatatttttattc

SEQ ID NO: 23500 - DNA, 101 bp, rice(Oryza sativa)
  misc_feature (71): n=a or g
gtccaacgggagtatttattaattaatcgatgtctcctaccctcatgggagaggtttgctattgaaaaccntcaatgttaacgcgggcctcgaattcaata

SEQ ID NO: 23501 - DNA, 101 bp, rice(Oryza sativa)
  misc_feature (71): n=t or c
aatttgaaccctgaaggaagtatggtaggagttgggattcacacgagtggattaatcgagatctttggcanaaacatttaaatgcacccaaataacacaaa

SEQ ID NO: 23502 - DNA, 101 bp, rice(Oryza sativa)
  misc_feature (71): n=t or g
ctgacatccttctcaggatcttagatccagcaactgagattcatcccatgatccaccccatctctcttgantgccccatgtctcaccaccgtgaaaagaca

SEQ ID NO: 23503 - DNA, 101 bp, rice(Oryza sativa)
  misc_feature (71): n=t or g
tcgtagatgaacagacatcctgaggcataaatagcagaaaaccacaagtcgggctagctttttgcttggantcttttatttccctgtcgccgtagtcccct

SEQ ID NO: 23504 - DNA, 101 bp, rice(Oryza sativa)
  misc_feature (71): n=t or g
ggttgggacgttgtttggaacggcgtccacatcctgaacttttttcttaaacggctaccaagattcttcangtgaggattacattatatttggagagtgtc

SEQ ID NO: 23505 - DNA, 101 bp, rice(Oryza sativa)
  misc_feature (71): n=t or c
ttgatcatcctgcctcggttttcactacacctacgaatacaatattggttagcaacgcatctactaacggnaagtgctacgataaatgtgaccaccatctt

SEQ ID NO: 23506 - DNA, 101 bp, rice(Oryza sativa)
  misc_feature (71): n=a or g
cacaacgggatcccaagttctctgatatacaatcctcatattgttggaaactatgcctgccttccttctcnagttctcttatgtaactagaatctgaagtc

SEQ ID NO: 23507 - DNA, 101 bp, rice(Oryza sativa)
  misc_feature (71): n=t or c
atgtaaccacagccaccaacgtccagagactgtaatttttgtgcatgagccagctcgctcagaccagcatnagtcacattatgacaaaaccggagtgtgag

SEQ ID NO: 23508 - DNA, 101 bp, rice(Oryza sativa)
  misc_feature (71): n=a or g
ttgtgtcaagaattttgttaccttgatatcccctttctttattaactccacagtgccaacatctattactnctgaccgaccagtatttgccttaagaagca

SEQ ID NO: 23509 - DNA, 101 bp, rice(Oryza sativa)
  misc_feature (71): n=t or c
ttttagactagaaaaatacacctgcgttgcactggttagtaccaggatgagtaatgtttgatctcaacaanttatccaagcaactaagcctgatcataagc

SEQ ID NO: 23510 - DNA, 101 bp, rice(Oryza sativa)
  misc_feature (71): n=a or g
tccgggtccccaagacgaggcatatccttgattccttgtatgaaagtatatatgtacctgatagcacacangttttcaggggaaataacaacactttgtaa

SEQ ID NO: 23511 - DNA, 101 bp, rice(Oryza sativa)
  misc_feature (71): n=t or c
ctcctataaattccgatgataataccatctcctgatcagttcaattttgtcataatcggctgcttcttcgnttcaattctgtgttggtagcaggcgacgct

SEQ ID NO: 23512 - DNA, 101 bp, rice(Oryza sativa)
  misc_feature (71): n=t or c
gaactctctgcatttatgcaagaagaaactttggaacctttagcattgtctgctcctactactgatgaagnggtaattttatgctataattttctcaagtg

SEQ ID NO: 23513 - DNA, 101 bp, rice(Oryza sativa)
  misc_feature (71): n=a or g
aacatatacagttgcaatatcaatttgacaataaaggttacacagtgactgttgtaagggaacacttaccngccaagatttcaaattgcaaaaaattccat

SEQ ID NO: 23514 - DNA, 101 bp, rice(Oryza sativa)
  misc_feature (71): n=t or c
tcagtctgtgccaatattgtctcaaaatcctttgtattcactattctgagtgacaaggcaattacaccganaaacaaattcttcgagcaccctaacgggag

SEQ ID NO: 23515 - DNA, 101 bp, rice(Oryza sativa)
  misc_feature (71): n=t or c
gggacaagggcagcttgccagcttctgtcgctcgagtttccatttgctttgtgttgccactctgtatactntcaatatgtaaatgatattacgtacagtat

SEQ ID NO: 23516 - DNA, 101 bp, rice(Oryza sativa)
  misc_feature (71): n=t or g
acctggttgaaaaatatccagattgatgctcatcagaactggcttttcctaggggactttaatttctacanatctatttacagaaataaagtgggagctga

SEQ ID NO: 23517 - DNA, 101 bp, rice(Oryza sativa)
  misc_feature (71): n=t or c
tcgaaccattttttacggcaccattttttacgcaacgtaaactcgaagacggtggtcactcccgcagggangaagaagacagcgttcgggagcgtgaactt

SEQ ID NO: 23518 - DNA, 101 bp, rice(Oryza sativa)
  misc_feature (71): n=a or g
tagtggggattgggatggtgcaatgtctatgcacaaatgcagcacaaatgatcatactccctccaggcacngatgcaccaatgtccatttactcccatgca

SEQ ID NO: 23519 - DNA, 101 bp, rice(Oryza sativa)
  misc_feature (71): n=a or g
cccagcccaactttgctgctgctgcggctaagcaccgaactactacacccctaaataagaatcttattgtnccgaaccaaaacagaaggttagggcaccta

SEQ ID NO: 23520 - DNA, 101 bp, rice(Oryza sativa)
  misc_feature (71): n=t or c
gggagcatatacgtaacgaggggagattggatgaatctgatccgtccatccattgggtggttcgtaccctnttggactgagccggccgtgatgctgcaaga

SEQ ID NO: 23521 - DNA, 101 bp, rice(Oryza sativa)
  misc_feature (71): n=a or g
accacctcacccaaccctgcttttctccttataggcggcggaagagggaggagaaaagcactgtgcctttnccaaaatgccctttgaatagaatctcagcc

SEQ ID NO: 23522 - DNA, 101 bp, rice(Oryza sativa)
  misc_feature (71): n=a or g
aagcccatgtcctagtaaagaacaaaggaacctcaggtctcactgaagaccctaatgcctcgcctacaaanagcatgctggaggagaccactcacatgcaa

SEQ ID NO: 23523 - DNA, 101 bp, rice(Oryza sativa)
  misc_feature (71): n=a or c
gagataaatatgaaatacattttccttgctaataccttcctatgaaagccccttttcacaaaaaaaaaaanctccatatgaaagctcaaaaagcattacta

SEQ ID NO: 23524 - DNA, 101 bp, rice(Oryza sativa)
  misc_feature (71): n=a or g
tcctgcatacagccaaatctgtgttggatggatttacatgcactactattgaaagcctaatgggtgtttcntggtcgaaagcttgttgcatgatcaagcaa

SEQ ID NO: 23525 - DNA, 101 bp, rice(Oryza sativa)
  misc_feature (71): n=a or g
aattgatacagccaaacaggaatgaatgccatagcaactgggcaaaagcacatctctcatttgtattggtnttggaacagctctcggacgttgatgggaga

SEQ ID NO: 23526 - DNA, 101 bp, rice(Oryza sativa)
  misc_feature (71): n=t or g
tcataatggggtttttcattaacctacttagtgaggcgtggacatgtgtaatggagaaaacctttgagaanattttctcaataggggtctgcctctccaat

SEQ ID NO: 23527 - DNA, 101 bp, rice(Oryza sativa)
  misc_feature (71): n=a or g
ttttgcctttacttcatcatatctcctttttagggtatcataattctcattttccggtcttggctcaaccngaggatcattatggagggcataatcaatat

SEQ ID NO: 23528 - DNA, 101 bp, rice(Oryza sativa)
  misc_feature (71): n=a or g
tactatacatggtactgtagactgtacaatttgttgcgagatccacctcaacctacaggctacagctacangaaccacctggagcttcaaatatttaacat

SEQ ID NO: 23529 - DNA, 101 bp, rice(Oryza sativa)
  misc_feature (71): n=a or c
ttgttggttgatatcacatggatggcagcataagtgagttagacaaagattgtattaccttttgatgaacngctcagttcaaagttggagtcttgaagctc

SEQ ID NO: 23530 - DNA, 101 bp, rice(Oryza sativa)
  misc_feature (71): n=a or g
agctcccctgaaactagtatcaacagaagactgaagtggatccgtttgacgttttaccatcagatccgaantctatctattatattattaaaggaatagaa

SEQ ID NO: 23531 - DNA, 101 bp, rice(Oryza sativa)
  misc_feature (71): n=a or g
gtgaaaaaaatttaatgacaatatacgtttcacatgtataaccatgacaataataatgttggtatcgatcnttgtaactaagacatcataagaaaaattgg

SEQ ID NO: 23532 - DNA, 101 bp, rice(Oryza sativa)
  misc_feature (71): n=t or c
aatacagtggaccttggttgatcagggggagcattcgttaagtaggcccaaacacgtcttgtcttcgtctncgtctccggggaaggaggctcgccagtcac

SEQ ID NO: 23533 - DNA, 101 bp, rice(Oryza sativa)
  misc_feature (71): n=t or c
ttcacaagatagatagacactgtgatggccattgctgaggtgtgcaagaattttgtagatataataacctnatttcttgtatctaacatttcatcgttcgt

SEQ ID NO: 23534 - DNA, 101 bp, rice(Oryza sativa)
  misc_feature (71): n=a or g
aataagtctagattatgtcctgaaagtttacgtaggtaacctggcctaattcagaattgggaagaaacacnaagagtctgggtatagatgtcatcatgctc

SEQ ID NO: 23535 - DNA, 101 bp, rice(Oryza sativa)
  misc_feature (71): n=a or g
gacgtagccaacttgcggaagctaggacgccaacaaaagatgaaagaatatagatctagcgggcgggcttncaccaaatgcttggaaagttttggcaaggg

SEQ ID NO: 23536 - DNA, 101 bp, rice(Oryza sativa)
  misc_feature (71): n=t or c
acgttgcgacattgtctcttggatgcagcctaacgagctcttgtcgacgatgggcttagagcaagttcaanagtatagctcactactagctataaatcatc

SEQ ID NO: 23537 - DNA, 101 bp, rice(Oryza sativa)
  misc_feature (71): n=t or c
ctcaggagcacctgaatgatagctggtaaaagcacgcaaagagaatagtgcatatgatccgtgctactacnatcttgctagttgctgcgccatttatatat

SEQ ID NO: 23538 - DNA, 101 bp, rice(Oryza sativa)
  misc_feature (71): n=a or g
gtcaatcttgcctgctgataaggcaactgccactaccaagcgatcgatcgatggacatattattattattnctcaacaaagtagagggattaatccgcttg

SEQ ID NO: 23539 - DNA, 101 bp, rice(Oryza sativa)
  misc_feature (71): n=a or g
cccatccatggcggctcagcaagtacctccaattggagccaggcagttgaatgccatggcgcaacctcgcncacaagctgcgattttgcccttcgccacac

SEQ ID NO: 23540 - DNA, 101 bp, rice(Oryza sativa)
  misc_feature (71): n=t or c
atagatccctctggaaaagaccccacgtcaactgacacggagaccggtccttcagaagaaactggaccgantgccgaagaccgcctgggtaataatcaacc

SEQ ID NO: 23541 - DNA, 101 bp, rice(Oryza sativa)
  misc_feature (71): n=t or c
atggattataaagcccccaactagagcatctgttgtttattgtatgcggtccacaacgttataaaagatantaaaaatgaataaatttatcctatgacaaa

SEQ ID NO: 23542 - DNA, 101 bp, rice(Oryza sativa)
  misc_feature (71): n=a or g
ttccctggcctctacgagacatagccgatgcatacggatcaacctacgaatccgtttatacgtaaaattancgagcaacctataaattgactcacaaatta

SEQ ID NO: 23543 - DNA, 101 bp, rice(Oryza sativa)
  misc_feature (71): n=t or c
agatagtgctagatctcacttgatagcccccgcagcaacatattgggtttgtctaggttcatcttcgatgncgttatctggcggcgtgtatttgtgtctat

SEQ ID NO: 23544 - DNA, 101 bp, rice(Oryza sativa)
  misc_feature (71): n=a or g
atctgaagcttaaaatttagaggagcttgaaattccaagaaccaggtgattcgtagctggtagcttattanaatctgaagcttctgattctagaagaactt

SEQ ID NO: 23545 - DNA, 101 bp, rice(Oryza sativa)
  misc_feature (71): n=a or g
taccccatgtggcagccgatgaagcctgtggctcccatgacgaggacggagatccctcacccgttggcccncctgacgtgcgcaaaggctcgcacattttt

SEQ ID NO: 23546 - DNA, 101 bp, rice(Oryza sativa)
  misc_feature (71): n=a or g
gatataaagcgaaccatatatgccaagttattagagaaatcaaatcctggcatgatggagggtgtgacaangtcagtcgctaatgaaatgggggtgccgtt

SEQ ID NO: 23547 - DNA, 101 bp, rice(Oryza sativa)
  misc_feature (71): n=t or c
aaacattttctcgaagtgatgaacattgaatttttttttctccaagatacaaacatctgaaacattttgtnaaagggcctgtttagatccatttgaaatgg

SEQ ID NO: 23548 - DNA, 101 bp, rice(Oryza sativa)
  misc_feature (71): n=t or g
cctgtacagtgatggatccagcggtgttgtcgagtccaaacgacgaagagtatttgatattgattgataanttcttttcaaagtgtgtgttactgacagaa

SEQ ID NO: 23549 - DNA, 101 bp, rice(Oryza sativa)
  misc_feature (71): n=t or c
gtaccaggcgatacttgtgatatcagcctctgataccggtgggttcgaatgattcctgtgaggtattaggngatacctgtgaggtactaagcaatacttgc

SEQ ID NO: 23550 - DNA, 101 bp, rice(Oryza sativa)
  misc_feature (71): n=t or c
ggcccaaataaggtgattgtggccactccagaacagatattggacatgaggttggatctatttgaaagtanacttgctaagctttccatgaagttcttgca

SEQ ID NO: 23551 - DNA, 101 bp, rice(Oryza sativa)
  misc_feature (71): n=t or c
ggcaaaatttaccacataaagaacttccctccggagaatgatgaagtttctgctcgtcttgttacacgctntgatgatacatttgagaaggttatgttgtt

SEQ ID NO: 23552 - DNA, 101 bp, rice(Oryza sativa)
  misc_feature (71): n=a or c
gtgcctacttaattattgactagcctcctcgcaaaaaaaaattattgacttgccaaaatgtagttgttatntagtagaaacaaatatattgtatttggcta

SEQ ID NO: 23553 - DNA, 101 bp, rice(Oryza sativa)
  misc_feature (71): n=t or c
tctgataaataatatataagcatgggtttaataaacgatctgatcatctagtgtctcaagtaaatccatcncaaaatggatcagaacaaggtaaaaataaa

SEQ ID NO: 23554 - DNA, 101 bp, rice(Oryza sativa)
  misc_feature (71): n=a or g
cgaacagttagcagtcacacgaagcgcttcccgaaaactttattagcgcgttgttctggtgcggaacatcntaagctagcgaaggttccgaagaactactc

SEQ ID NO: 23555 - DNA, 101 bp, rice(Oryza sativa)
  misc_feature (71): n=a or g
acatcgaaattcaatctttttacacgttcgcagaaaaacaatttcctcttacatattagaaactatcacangcacgcttcctaaacttataaacggtgtga

SEQ ID NO: 23556 - DNA, 101 bp, rice(Oryza sativa)
  misc_feature (71): n=a or c
catttaaactgtaagttgttcgtggcagtggcaatttctgtgaatgtcccaaccggttcttgcgttagttnaacttttctttttgttatccaaggaatacc

SEQ ID NO: 23557 - DNA, 101 bp, rice(Oryza sativa)
  misc_feature (71): n=t or c
tactttgcttcaaatgttaattctgaaagaaattgagatagtgtcaactaatactctagacacgatttgtnatcacatgttttttacttgaagtatcatct

SEQ ID NO: 23558 - DNA, 101 bp, rice(Oryza sativa)
  misc_feature (71): n=a or g
tgcgtttcaagcctgcctacaatccatacaccgagccgagcatggaaattttcaggtgacagctttgattnctggcttcatgattcttctagttcatgaat

SEQ ID NO: 23559 - DNA, 101 bp, rice(Oryza sativa)
  misc_feature (71): n=a or g
tagctgaagccagacatctgttgcagcaatcatccaagttgccataatcttgaagctcgcctctacctgtncagtgttagaaaatgtattttttttttaaa

SEQ ID NO: 23560 - DNA, 101 bp, rice(Oryza sativa)
  misc_feature (71): n=t or g
tggttactacggtaaccatcgcatgtgaaaccctaaaacgtggatgccttcttcaatgcataaaaaacttnttcttaacataatctttctactacctccgt

SEQ ID NO: 23561 - DNA, 101 bp, rice(Oryza sativa)
  misc_feature (71): n=a or g
tttcttgataatattagtaatttcattcacgaattgaactatgataaccaatggtgatcccaggacaaaanttatcggggatccaatacatattaattatc

SEQ ID NO: 23562 - DNA, 101 bp, rice(Oryza sativa)
  misc_feature (71): n=t or g
tgttgcaaatatgaaagcctacttcttatatagtgtgctaatgatggttgtgggtagttggaaatgtcagnaacacccccctcttaatcgtcattgaggac

SEQ ID NO: 23563 - DNA, 101 bp, rice(Oryza sativa)
  misc_feature (71): n=t or c
agcatgatcccgagcgcgaacacgttacccttctgagtcaccacggccactccaatgcgatgtacgccagngccgagccaccgatagagcctcgccctcgc

SEQ ID NO: 23564 - DNA, 101 bp, rice(Oryza sativa)
  misc_feature (71): n=a or g
agagattaaattgacctattaggacgtttgtgcccataaatcgagcctctctatgtatatataattgtagnaaatattttaattttgctcttagtatataa

SEQ ID NO: 23565 - DNA, 101 bp, rice(Oryza sativa)
  misc_feature (71): n=t or c
gccgagctggatgagtcggcctgtctttttggcaaagtcgcaagtgtactgtactacaagtctacaacaangggagacgttggtagtacttcatcatactc

SEQ ID NO: 23566 - DNA, 101 bp, rice(Oryza sativa)
  misc_feature (71): n=t or c
tatgcagctatatatgctaccaccggcaccggcgttcgatctctaacggcctgcaataaatgtagtccccncgatcgatccagagctgagctcaagtttgc

SEQ ID NO: 23567 - DNA, 101 bp, rice(Oryza sativa)
  misc_feature (71): n=a or g
gtacatggtcaccactgtactgacgccctccaccagatagcctcaccgacctctctttcgtcggccctccncgccatcgaccggggcggcctccctgccat

SEQ ID NO: 23568 - DNA, 101 bp, rice(Oryza sativa)
  misc_feature (71): n=a or g
ttattgttaaaggcaaaatttgacaagtcaagaccaagtcaaaggagaagttgacgccatgattgtagttncgtcagttggaaagtgtataagatgagttt

SEQ ID NO: 23569 - DNA, 101 bp, rice(Oryza sativa)
  misc_feature (71): n=t or c
tataaataaagctatatgggctaagattccaatgcacatgcgacaagagaccaaaaccgcagaaaaatccntcctttctactctcatcttaaaatataaga

SEQ ID NO: 23570 - DNA, 101 bp, rice(Oryza sativa)
  misc_feature (71): n=a or c
aattaatataggcgtggatctttaataaattgtgatcatatatatgcgctggcaaaacaggctatctttcncctgcatatatataatcacaatatatattg

SEQ ID NO: 23571 - DNA, 101 bp, rice(Oryza sativa)
  misc_feature (71): n=a or g
aaactagaaagccggcggtcaaacaaagccaaaaatcacatggcacacactaaatgacacgaatattaagnaagaatctaatattaaataattagaatgga

SEQ ID NO: 23572 - DNA, 101 bp, rice(Oryza sativa)
  misc_feature (71): n=t or c
catgagcgtaagctgttgacaaaggatagggacggttttagaacaggtacaataagactgacttagcaggnggtagattgatctacattagcctaatccta

SEQ ID NO: 23573 - DNA, 101 bp, rice(Oryza sativa)
  misc_feature (71): n=t or g
gaactcatcgttcgcgaagtgaaccagaacagaacacttttaggtgaaccgtgctaaaattttctttcaanaaaaatcacacaaaactacaaaattactag

SEQ ID NO: 23574 - DNA, 101 bp, rice(Oryza sativa)
  misc_feature (71): n=t or c
ggagtatatcataaaactaatatattacatccattcatgccaatttgctaatgccaatttgccggtgctanattgcttgggctctactacatataaaatag

SEQ ID NO: 23575 - DNA, 101 bp, rice(Oryza sativa)
  misc_feature (71): n=a or g
ttagctgtcaatactattttatgtatggtacactgcactcatggttttgttttggttcttgccaactggtnactactcatagctggatggaatttggtcgt

SEQ ID NO: 23576 - DNA, 101 bp, rice(Oryza sativa)
  misc_feature (71): n=a or g
cttcgtaagtgaaataaaaagggcatatttatgccaaaatatgtcattttgtacatccaaacagtcttcanaatatattccgagcactggttctactataa

SEQ ID NO: 23577 - DNA, 101 bp, rice(Oryza sativa)
  misc_feature (71): n=t or c
cccaaaaaaaaattggggcttcaggtccgctctgatgagatccgccgctatcctcctttgtttattttttnattattatttcagtattttttttacctaat

SEQ ID NO: 23578 - DNA, 101 bp, rice(Oryza sativa)
  misc_feature (71): n=t or c
ttgcacgcacctacccttttcctgttattgttcctcccattcttagcgtttgtgtgaggtcgatttcatancactatggggctaaacgagaagccattggt

SEQ ID NO: 23579 - DNA, 101 bp, rice(Oryza sativa)
  misc_feature (71): n=t or c
aaactaattgaagtaggagtatatgtaggctgccaaaagttactcataagtcataaccaaagcgctacttnatctatttcaaaatataacaactttcaaca

SEQ ID NO: 23580 - DNA, 101 bp, rice(Oryza sativa)
  misc_feature (71): n=a or g
ctcttgtcatccctggaccagagcatccagggaaaacattaagtgttctaatgcaacctttagttgatgancttctgaagttatgggagggggtagaaacc

SEQ ID NO: 23581 - DNA, 101 bp, rice(Oryza sativa)
  misc_feature (71): n=t or c
cctcaaccccaagtagagccaacacaaatccatcactgattattgcatcactgtcaggtcacgaatccaangatggccatagaattgggcaaaaccatggc

SEQ ID NO: 23582 - DNA, 101 bp, rice(Oryza sativa)
  misc_feature (71): n=t or c
gtttatatatatgatatgtttcgcttggcaagatgggaactctgagaagaatataataataggcgtcaacngattttgtattataaaaaaattctgcagta

SEQ ID NO: 23583 - DNA, 101 bp, rice(Oryza sativa)
  misc_feature (71): n=a or g
tcaacataataccggattttcagagctattagaaccccaagtctgggatgataagcatttggtaggcgagntgcaaagcctagctgtctcaatgcggcggg

SEQ ID NO: 23584 - DNA, 101 bp, rice(Oryza sativa)
  misc_feature (71): n=t or c
agtctgtgaatgccttatctcctcatgataccggggccttatctcgtcgttcgtggtgggcccgtcagctnggctcaattaggaggtgcgggtttttaata

SEQ ID NO: 23585 - DNA, 101 bp, rice(Oryza sativa)
  misc_feature (71): n=t or c
gccttagaggctaacaagtgggacccaccttaacttactatcttcttccctagtcattcatgtagctcggngaggctggaagattctcgagagcaagacgg

SEQ ID NO: 23586 - DNA, 101 bp, rice(Oryza sativa)
  misc_feature (71): n=a or c
aaccagcttattgttcatatgaggtgagaaagctgacaatagagccaaaaagaagatgggagttttatacncgcgtgaaggaaaggacatcagcgtattgt

SEQ ID NO: 23587 - DNA, 101 bp, rice(Oryza sativa)
  misc_feature (71): n=a or g
cataaaccgccattaaaaatatattgaggggtgaggggctaagtaccaccagcgaaaatagattttcactngcggccgagttaacttaaaatcgctcccaa

SEQ ID NO: 23588 - DNA, 101 bp, rice(Oryza sativa)
  misc_feature (71): n=t or c
cacaacgaagaataaattgtcattccgaacggacaccaatgtacatccataatattcccaacttacagaangatatattccccccttattataactatatg

SEQ ID NO: 23589 - DNA, 101 bp, rice(Oryza sativa)
  misc_feature (71): n=a or c
gatcgaccgatcgatcgggcaatcttagaaatgcgctagagtgtctataccctctcggtctcaaaataaancaacctcgtagtagtatgatgtttatttta

SEQ ID NO: 23590 - DNA, 101 bp, rice(Oryza sativa)
  misc_feature (71): n=t or g
ggtcgggcggtgcggtggtgcatcgtcgcggtccgcggtggaccgtcttgtcagaagtggagatttcaganatatctgaagaaaagttcagaagttcagag

SEQ ID NO: 23591 - DNA, 101 bp, rice(Oryza sativa)
  misc_feature (71): n=a or g
gcgggagcgggctggagctcggcgacgtagaagctgatggagtagcagaggaggccgacgttgcctggatngaggatggcgaacgggtggtcggggtcagg

SEQ ID NO: 23592 - DNA, 101 bp, rice(Oryza sativa)
  misc_feature (71): n=a or g
ccccactagattaatatatgtatatgaggggatgggtcacatctccacctaaattattttttttagacggngggagtagtaacttatagagtttgaatttt

SEQ ID NO: 23593 - DNA, 101 bp, rice(Oryza sativa)
  misc_feature (71): n=t or c
ctcgtgcttctatcaaaactttaatctattttagcaacatggggcaaaggtcgataagccatttctactcncgtgtttctatcaaagctttaatatatttt

SEQ ID NO: 23594 - DNA, 101 bp, rice(Oryza sativa)
  misc_feature (71): n=t or c
ggcggcgtcctacatcaccggccaagtgatatgcgttgatgggggaagcatcctttcttgaattgtatgtntgcaaaataaattaggacatatatgacata

SEQ ID NO: 23595 - DNA, 101 bp, rice(Oryza sativa)
  misc_feature (71): n=a or g
accaggctactgatttgcagtattttcctgacatcaatagagagaaaggagaaattagcaagtaaggactnagctgaccgtaggcgtccgacgtttttcat

SEQ ID NO: 23596 - DNA, 101 bp, rice(Oryza sativa)
  misc_feature (71): n=a or g
ctaactggtttcaggttttatccggtcgtcctttggtgaataaagaggaaaataatgctaatgatgttgcnttcactgatgctgttggttttcaggagaag

SEQ ID NO: 23597 - DNA, 101 bp, rice(Oryza sativa)
  misc_feature (71): n=a or g
ctagtatggaacatgtaatccatgacgggccacatgccttatctctatctctatcgggtggatctcatcantggtgggttaacatccgaccgtggtaaagt

SEQ ID NO: 23598 - DNA, 101 bp, rice(Oryza sativa)
  misc_feature (71): n=t or c
gtcgctcgcgtatatcatcttcggtcaacacaacatatctctgttcataagaaaatgaacacagaagaggnccatttgagattttgagttagttctgacac

SEQ ID NO: 23599 - DNA, 101 bp, rice(Oryza sativa)
  misc_feature (71): n=t or g
atggagtagaagtacctaccaatggcttcttctctagtgacaagtggcgccaattaatcgcactagtacanaaccttccatccgtgacggcctctaacatg

SEQ ID NO: 23600 - DNA, 101 bp, rice(Oryza sativa)
  misc_feature (71): n=a or g
ggaccaccgtgaggattgaacccaataaaattgatctatttatgcatcttgtatcactaccggttggttgnacgaaccgatagtgatacgctcgtgtcact

SEQ ID NO: 23601 - DNA, 101 bp, rice(Oryza sativa)
  misc_feature (71): n=t or c
cctatgaaacgaatgcataaacagtgccaaatccaaaggaattgccaatcctacgaaaatcctgtgtaatncctccgttccgaacaagcccttagctccac

SEQ ID NO: 23602 - DNA, 101 bp, rice(Oryza sativa)
  misc_feature (71): n=t or c
tgaaccatcaaagtaaacagctagcaggatgatgtgtatatatgatgatgatgacatatgaggagtttggnagcaatgccgtgtcaacatgtagttatctt

SEQ ID NO: 23603 - DNA, 101 bp, rice(Oryza sativa)
  misc_feature (71): n=a or g
tcaacccggagggagtaacaattgtaaatgccctaatggctcatttgtaaaaggaaggaataagttcatcngaggtcccaacgaatccgattttctgtcct

SEQ ID NO: 23604 - DNA, 101 bp, rice(Oryza sativa)
  misc_feature (71): n=t or c
atattttaaagactcgcacataatgcggtctttgatctaaatgtagtccgtctgctctcttgctctcttcntgttctcccatctcttttttttatcttccg

SEQ ID NO: 23605 - DNA, 101 bp, rice(Oryza sativa)
  misc_feature (71): n=t or c
gccgtgtttcttttatcccatcttttttttctcaacttccaacgtacgtaatactaccttcgtcccaaaanataataatatagaatcaaacgagatatatt

SEQ ID NO: 23606 - DNA, 101 bp, rice(Oryza sativa)
  misc_feature (71): n=t or c
gccattgtcaggtctgaagtctgttctgtggctttcatgtagtgtcactcttgatatcttaccaacagtangggtacttaactgttgagcaattgaaccac

SEQ ID NO: 23607 - DNA, 101 bp, rice(Oryza sativa)
  misc_feature (71): n=t or c
atcgtacaggacgccccggtagatgggacagtaagacgctttgaaagaaaacctcagctcaggcttgctcnttttttaagttactcttttttttttcacag

SEQ ID NO: 23608 - DNA, 101 bp, rice(Oryza sativa)
  misc_feature (71): n=t or c
atacagatagaatacatcttgcaagcacggcagtaaatccatcatccatcgatcgacgccatacgtaaatngtctccaactctaagtcgatcgatcgatcg

SEQ ID NO: 23609 - DNA, 101 bp, rice(Oryza sativa)
  misc_feature (71): n=t or c
gggaaggccgacgggagtggagttggaggaggcgcagtggtggagttggctggctgttgggagaagctggnagccggcaggtggaggaggcggtcaatccg

SEQ ID NO: 23610 - DNA, 101 bp, rice(Oryza sativa)
  misc_feature (71): n=a or g
cgggggatccagggcgtgcgtgctgctgctctgctttgctccccgctgagctactgctctgctcagcttcncggccagctccggccgccgtcagccgcctg

SEQ ID NO: 23611 - DNA, 101 bp, rice(Oryza sativa)
  misc_feature (71): n=t or c
cgaaaattatcagcaacatcaatgctatacggaagatagaaagcagcaagaagcataccaatgctatactncctccagtttcattttaattgatattttag

SEQ ID NO: 23612 - DNA, 101 bp, rice(Oryza sativa)
  misc_feature (71): n=t or c
gggccatggcaatcgtcgcgaagacatgcctgaattcaaagccatcaaggcggccttctgctcggtacgtnctgagagccctggagaacccgctaaagatt

SEQ ID NO: 23613 - DNA, 101 bp, rice(Oryza sativa)
  misc_feature (71): n=a or g
agggtttccatcggcgccctttatatagagccaggatcgctgatggctgaatggtaagacaacactttatnatctgggtgcctgccatctatttacaaagg

SEQ ID NO: 23614 - DNA, 101 bp, rice(Oryza sativa)
  misc_feature (71): n=a or g
gtggattcatcatttcagaagccctagatgccatgtaagaacaagacatttataccatacaacccacagcngaggccacacctaggtatcctataatacta

SEQ ID NO: 23615 - DNA, 101 bp, rice(Oryza sativa)
  misc_feature (71): n=a or g
aaaccaagctattccaaatcatcgttaggttatattcacaagctagctgcttctcagaatatcttggaacngattaaaaaaaagagagatttgaagcgaga

SEQ ID NO: 23616 - DNA, 101 bp, rice(Oryza sativa)
  misc_feature (71): n=a or g
gcctagcgtttcatggaaatcatcattaattacgcgttgattatgtttacggatgaaacccgacgtgttcngaacagttgatcatcttttgtcactagttt

SEQ ID NO: 23617 - DNA, 101 bp, rice(Oryza sativa)
  misc_feature (71): n=t or c
ttcttggccttcttcttgggagccagagccgatggatcgattgccggtgctttggtcttactcttcctgcngacatcggctggatctctcatctgcccttg

SEQ ID NO: 23618 - DNA, 101 bp, rice(Oryza sativa)
  misc_feature (71): n=t or c
ccatatgctgataaatcattggcgatcaatcacaagacttcgaattggactttgcgatcactttcgaagcnaatctgggtcccaagtgcgcaagattttgt

SEQ ID NO: 23619 - DNA, 101 bp, rice(Oryza sativa)
  misc_feature (71): n=a or g
gctgtgttggcagatctagtgggcaacagtggcggcgttgacgatttcggattatattttccaattcatgnagttagagctttgaatcactcttggccatt

SEQ ID NO: 23620 - DNA, 101 bp, rice(Oryza sativa)
  misc_feature (71): n=a or g
gatatttaagtcatgcttgacatagcttcagattttattatacataagaaacacaacggggtgtcagacgntccaagaacatatgcgatattccgtgcaga

SEQ ID NO: 23621 - DNA, 101 bp, rice(Oryza sativa)
  misc_feature (71): n=t or c
cccatccggcggcctcgagcttgagctcctcttcctcttctctcctccgatggctggcggcctcacctctncccccatccggcggtcctctcctcggtgga

SEQ ID NO: 23622 - DNA, 101 bp, rice(Oryza sativa)
  misc_feature (71): n=a or g
tcgtagggagatttgggtttggtgtatttggagttacgaccctctagcgtgatgtgttatttgtgtgcctncgcgcgcaagcgtgtgtgtatatatgtata

SEQ ID NO: 23623 - DNA, 101 bp, rice(Oryza sativa)
  misc_feature (71): n=t or c
agtagacgcattaggcagacatgcgcaatcgtagccgtttgatcaccaaatctaacgtcccagattgcctngatcatcccctcccttgcactctatgatat

SEQ ID NO: 23624 - DNA, 101 bp, rice(Oryza sativa)
  misc_feature (71): n=a or g
attatttataattaatctaatagtctattgatacaatagttaccgggaaagtgtatttatcccttgagggnatatcccattgtttcttgcttgccatctac

SEQ ID NO: 23625 - DNA, 101 bp, rice(Oryza sativa)
  misc_feature (71): n=a or g
tgataggccctcattgtatacacacatgaaaatgatagaaagataaggcgaaaatgcctccatttggacanaaaagctaaaatctcaaatatcagataagt

SEQ ID NO: 23626 - DNA, 101 bp, rice(Oryza sativa)
  misc_feature (71): n=a or g
gagggtttgtcccagaacttgcactgtttcacctccaaatcctctgagcgaagttggtgcttgggatagcnccaatgtcggcagacccatcttggcgtatg

SEQ ID NO: 23627 - DNA, 101 bp, rice(Oryza sativa)
  misc_feature (71): n=t or c
cgccataacatggtgatataatgtctttacaccaaaagctgttgtggtaactacaagagaaaagaagactncaattggttgaggaatacccctatgccacg

SEQ ID NO: 23628 - DNA, 101 bp, rice(Oryza sativa)
  misc_feature (71): n=a or c
tggcggcatataacctgatagttgcacgatgatgtctactactccagtccaacatgctgattaacctggcnatcgtctgcgttgaagtggtgagtttctcc

SEQ ID NO: 23629 - DNA, 101 bp, rice(Oryza sativa)
  misc_feature (71): n=t or c
gtttgaaaatttcgtgcattttgcagttttcatcccaagtcccaatctgaaaccctaccctacatgttggngaaaaagtttaatcaatggtaaaataatca

SEQ ID NO: 23630 - DNA, 101 bp, rice(Oryza sativa)
  misc_feature (71): n=a or g
cccgaaccatatatctatgaagttcacttttcatcctttgactggagcgaaaagtctgaattacacccctnaattttaggtgagtacgaattaccccctta

SEQ ID NO: 23631 - DNA, 101 bp, rice(Oryza sativa)
  misc_feature (71): n=a or g
catttgttgaaatatatggccggaagtgtttgtatctgctgactaatacttgttctgatcgagcatttctnacatagttgcatgccttggagagtttttat

SEQ ID NO: 23632 - DNA, 101 bp, rice(Oryza sativa)
  misc_feature (71): n=a or g
gttcaagctttattcaccaatatggtttgaactaggagacatgctaggaattgaagttagcatgcttcatntcttattgttctgttggcaatagtatgaaa

SEQ ID NO: 23633 - DNA, 101 bp, rice(Oryza sativa)
  misc_feature (71): n=a or g
gacccatttaaattgcgaacggaccttacctggtcacggtggcgaaaatcattctctatttttatgtgcgntaccttaagaaaaccacacgcaaaaatcaa

SEQ ID NO: 23634 - DNA, 101 bp, rice(Oryza sativa)
  misc_feature (71): n=a or g
agaagtttagaaagtatgattgtgtgtttcttagtagattgggttatttggttggttcgatctctgaagcntcaagaccgacctgaacaatgatagaccaa

SEQ ID NO: 23635 - DNA, 101 bp, rice(Oryza sativa)
  misc_feature (71): n=a or c
atggattacggaagaattagagtaaccacttagccaacaatggtaaagcataagtatccttaacatatctnatacttccaagggttactgcaaaagcattt

SEQ ID NO: 23636 - DNA, 101 bp, rice(Oryza sativa)
  misc_feature (71): n=a or g
cacacagcgaatcacagttttgctttgcaccgagtaaaattaagaccggaagtgaattacatgaggcgacnccatcaccaatccctctgtaatttgcttcc

SEQ ID NO: 23637 - DNA, 101 bp, rice(Oryza sativa)
  misc_feature (71): n=t or g
actagaccgtccatgagcgactgaaatttgagcttgcacctaactcattcctcacaaaaatcaaagcaaanaagcaaaaggcatgcaggccagacatggag

SEQ ID NO: 23638 - DNA, 101 bp, rice(Oryza sativa)
  misc_feature (71): n=a or g
gctccatataacgctgcatggtcgaccgtccgatcagaagtagatcaagtaaatctcggttggggtctccncgaactgtttcgttttatttctctctgttt

SEQ ID NO: 23639 - DNA, 101 bp, rice(Oryza sativa)
  misc_feature (71): n=t or c
aattcagtcctcccgaaagtgtatttttagatccaaatccaccttattttgtgtacgagtgaattgcactntgggccatgttttattaccaaagtttcact

SEQ ID NO: 23640 - DNA, 101 bp, rice(Oryza sativa)
  misc_feature (71): n=t or c
tgagctgtgcggtgttgtactacgtattagtataaatcatttttgggtactactccctccgtccaaagctnatttataatttgttgtactccaaccgtccg

SEQ ID NO: 23641 - DNA, 101 bp, rice(Oryza sativa)
  misc_feature (71): n=t or c
ctgaagcaaactgctgaataggaagtactacagctctttgcactgttgcacagtactgctggtactaaggncttgtttggtaggactccaaactccaactc

SEQ ID NO: 23642 - DNA, 101 bp, rice(Oryza sativa)
  misc_feature (71): n=t or c
tgtgattaattagtgtacaacatgttataccataggtactaggtaccaccgtaccaggtatcacaagtatnaagtatcaggtgtcacatgtattaggtacc

SEQ ID NO: 23643 - DNA, 101 bp, rice(Oryza sativa)
  misc_feature (71): n=t or c
acgcgagagataccccctgccgtaactcggccaaccgggcactctgcggatcccaaatcctcacgtttttncgatgggcgtaaatgatcacagtaggttta

SEQ ID NO: 23644 - DNA, 101 bp, rice(Oryza sativa)
  misc_feature (71): n=a or c
gatcccaattttctacatcaatgtttgaacccaacaaattaacatagttgtccatgtattcacatcatagnaacataaataaaatgaacataaaagcacag

SEQ ID NO: 23645 - DNA, 101 bp, rice(Oryza sativa)
  misc_feature (71): n=a or g
gagctggcgacgaggtacttcagcttactgtgcccaacccagaacaaagcgcgtcaatcatgagggaggcntctcgcgacgcggtcggcaggagggactgg

SEQ ID NO: 23646 - DNA, 101 bp, rice(Oryza sativa)
  misc_feature (71): n=a or g
taagggataagtccattttacatcccctagctcttttttttttgtctagaatccaccccttgactcttaanccagacactcaacaccctcaactatcaaaa

SEQ ID NO: 23647 - DNA, 101 bp, rice(Oryza sativa)
  misc_feature (71): n=t or c
aacccaaaatgccactacaaaatcatctcatttacaaccaaattctgtgccattctgtccatatatacccntgttccaccttcttcgatccaccgcagcag

SEQ ID NO: 23648 - DNA, 101 bp, rice(Oryza sativa)
  misc_feature (71): n=t or c
ctgtttggccattggcctcattttctgagaccaaaccagccttaaacttgcattcagaccagaccaaattntcaggtctagtgtgaacgtgaattatcagc

SEQ ID NO: 23649 - DNA, 101 bp, rice(Oryza sativa)
  misc_feature (71): n=t or c
ccaaagtatcagctactcagaaattctgacaaataatgatagctgtttgttactgtcccttccgtttatanccatttcatatttcatattgtaagtcgctt

SEQ ID NO: 23650 - DNA, 101 bp, rice(Oryza sativa)
  misc_feature (71): n=t or c
aaagaaagctctcagaatacttgcttttcaggtcacccttcattgaaaataaggggttcacaatctctganggtttcccagaattaatactagaaaaattt

SEQ ID NO: 23651 - DNA, 101 bp, rice(Oryza sativa)
  misc_feature (71): n=a or c
cggcggcgagcgcggtgagccccttgaagaagtccggcgggatgcgggtgaagccgttgttgtggacgagnaggtactgcagcgacgagagccccgcgagc

SEQ ID NO: 23652 - DNA, 101 bp, rice(Oryza sativa)
  misc_feature (71): n=t or c
cataacaagcttcctgactattccaaccttcaagtttttggttgcctttgttatcccaatcttagtgccangacatctcacaagctctcccctcgttcagc

SEQ ID NO: 23653 - DNA, 101 bp, rice(Oryza sativa)
  misc_feature (71): n=t or c
gcagctacttttcctcgtaaatatcttaaccattttaccctgcactcgggtatgagcttgtaccatttttntcaatgtgcatttttttttcatttcatttc

SEQ ID NO: 23654 - DNA, 101 bp, rice(Oryza sativa)
  misc_feature (71): n=a or c
agtatagcagctagtagtacgactctcaagcctactcggttagtcatatgataaactccctccgtttaacnaatataagtcattctaccatttctcatatt

SEQ ID NO: 23655 - DNA, 101 bp, rice(Oryza sativa)
  misc_feature (71): n=a or g
agcgaacttaccgcaacagtgcgtgaagctgatcaacacgaacccgttaacgacgaccaaattcgcgtcancagaaccgtccccgacccaccactctgccg

SEQ ID NO: 23656 - DNA, 101 bp, rice(Oryza sativa)
  misc_feature (71): n=t or c
aaactttacaaccaagaaactaaacacacccctacgatactcattgagtcattgttagtgtgtgtgaaacntttaagcagtagtagtactgcttatcgttg

SEQ ID NO: 23657 - DNA, 101 bp, rice(Oryza sativa)
  misc_feature (71): n=a or g
tcttccgcctctctctctctctcaacctcaacctcaacagaagtaggtaggatgtaacgataacctccacnagatacggaaggaatgtcgcaacgccctcc

SEQ ID NO: 23658 - DNA, 101 bp, rice(Oryza sativa)
  misc_feature (71): n=t or c
agaacatgactaagcatcatctgacatctccgttcctgtgacatgttagcaatcaatactaccagtgccanggattgaatcatcagcaacccaatagacaa

SEQ ID NO: 23659 - DNA, 101 bp, rice(Oryza sativa)
  misc_feature (71): n=t or g
cgcatcgattcctttctccaagttgagttctgatgtttctgttgcctttgagttcgtttatgacggtttgntttatggtaaaaattcaaggatggagatca

SEQ ID NO: 23660 - DNA, 101 bp, rice(Oryza sativa)
  misc_feature (71): n=a or g
aaaaaaaaagacctctattgggagcgaggagagagcagagagggtgaatgagatttctcagactttgtatnaggttagagaatcattctcctagatatacg

SEQ ID NO: 23661 - DNA, 101 bp, rice(Oryza sativa)
  misc_feature (71): n=t or c
gtacgccaactatcggtacctaatgggcgagaggccccggttggatgaggcgatggcttggtatgaagtgnggaaagggcttttcacgccggaactgctcg

SEQ ID NO: 23662 - DNA, 101 bp, rice(Oryza sativa)
  misc_feature (71): n=t or c
gcacacgctaagacttttggtttttttgtcccctttttttaatccgacctgttcactgcgctcctgggtgnttttagttttttttgttcaatctttttgtc

SEQ ID NO: 23663 - DNA, 101 bp, rice(Oryza sativa)
  misc_feature (71): n=t or c
gctttggatggtgcatgaatcggagttcagagcctcctttcgtaacacaagaatttcgggggaatttaggncttgtttagttcccataacataaacttttt

SEQ ID NO: 23664 - DNA, 101 bp, rice(Oryza sativa)
  misc_feature (71): n=a or g
tttggcgatgacaatgatgcgttttaacatgtcaaaccatatcccctgacttagtgaagtaccgactactntgcaatagtctctatgagtttcataatcca

SEQ ID NO: 23665 - DNA, 101 bp, rice(Oryza sativa)
  misc_feature (71): n=t or c
cccataaattatgtgtaacacaacatcgctcgaggagagaaagaattgagtgactgacaaccaggacccangggtcagacggctagttcatcgtggatcag

SEQ ID NO: 23666 - DNA, 101 bp, rice(Oryza sativa)
  misc_feature (71): n=t or c
tcatcacatggttggcaacctgtcacaggtatggtaataagaggatagaatcatcagctcaacggccattncccccttccttccgcgtggttcaccaacaa

SEQ ID NO: 23667 - DNA, 101 bp, rice(Oryza sativa)
  misc_feature (71): n=a or g
acgtgcacgtccggacataccgtgtcgtgcacacagtggaaactagtatttggaatacgtgtactatgctnatatgttagtattattctgtgcgatggctt

SEQ ID NO: 23668 - DNA, 101 bp, rice(Oryza sativa)
  misc_feature (71): n=a or g
gtcaaggcaacaacaaatgctcctgccagctggcagtcagcaatgaaatgatttaagggaactccaaacanacataaccctatccacttaagcataacaat

SEQ ID NO: 23669 - DNA, 101 bp, rice(Oryza sativa)
  misc_feature (71): n=a or g
gtgtttttttttaaatattatatttgttttgtcctactactactactactctcttggagagagagaggganagagtggggcccactccctcccattccaag

SEQ ID NO: 23670 - DNA, 101 bp, rice(Oryza sativa)
  misc_feature (71): n=a or g
tcaatcacccatggctcgccaaacttccatccatgaatgcaatgcgaaacttgtggcaacgaggctttggncttgcctgagaggacgggctgcacgctgtt

SEQ ID NO: 23671 - DNA, 101 bp, rice(Oryza sativa)
  misc_feature (71): n=a or g
tacaagggacaggtacgagaacgtatgcaatgctttgttggtcaccgccacaccggttaattagcaggaancaagaacgtctaagcagggaagtagagtgc

SEQ ID NO: 23672 - DNA, 101 bp, rice(Oryza sativa)
  misc_feature (71): n=t or g
cttgtcaagtggcttttgaggttttgctaaaaagatactgagcttccgagagatgacacgattgatcaganatagaagaacgatgcggagagtgagacttg

SEQ ID NO: 23673 - DNA, 101 bp, rice(Oryza sativa)
  misc_feature (71): n=t or g
gttccccatattttatgatagggattgtttgcttcatctcaccctgttgtttcgtgggtatgcatcactantttatttatttggaaattgtgaattttcca

SEQ ID NO: 23674 - DNA, 101 bp, rice(Oryza sativa)
  misc_feature (71): n=a or g
ggggagggcagatccaccgtcaaagcgtagagaaagggaggggggagaaagaggggtgagcagcagggaangggcaaatctcgttgggctacctgttcagc

SEQ ID NO: 23675 - DNA, 101 bp, rice(Oryza sativa)
  misc_feature (71): n=t or c
atactggtggggataacccatcggcaagatcacatctgggatatctgatcaaactaccggcattagttggngcattggtgcgctatgcatttgtgcgtgca

SEQ ID NO: 23676 - DNA, 101 bp, rice(Oryza sativa)
  misc_feature (71): n=a or c
agacatgatggagatagttaacctctctcgcatggttgaaattaattgcaccagttatatcgtgggcaccntgaaataccatcatatttgaagacaggata

SEQ ID NO: 23677 - DNA, 101 bp, rice(Oryza sativa)
  misc_feature (71): n=t or g
agatgcaatctcgtcgtggctatcctgctctgataccatgtaaatctggcagaagcatcttacctctctcnaggccgcgttgcatgttaatataggcaaga

SEQ ID NO: 23678 - DNA, 101 bp, rice(Oryza sativa)
  misc_feature (71): n=a or g
agatttgtaagaaaatactggtttgggataaaagtgcaaaagtataccatctggttatcgcgaacaaacantagcggtctcgcaggatggtgggcaaacac

SEQ ID NO: 23679 - DNA, 101 bp, rice(Oryza sativa)
  misc_feature (71): n=t or c
caaagaagatggtggaagcattcgaaaagatggtgaaacagaggattttagatctctaggattcgctctcnataatgttttcttcgttccaaattatttgt

SEQ ID NO: 23680 - DNA, 101 bp, rice(Oryza sativa)
  misc_feature (71): n=a or g
ctcgccgtctctcccgttcatgtcgttggctgacggactgagtcatccaaatgaggattgatgatgagtcnattcattcccctgccttgcgaaattgctcc

SEQ ID NO: 23681 - DNA, 101 bp, rice(Oryza sativa)
  misc_feature (71): n=t or c
attcgatagatataaaaaaaaaaaactaatctagtacgggatgtgtcacagtttagctaggactacgaatntaagcaaactctattcagattcgtagtatt

SEQ ID NO: 23682 - DNA, 101 bp, rice(Oryza sativa)
  misc_feature (71): n=t or c
ggcggtgtctccggcgtgtagtccggtgatggtggtggagagatgacgcggcgaagatgacgggtccagcngtgatgagggctgaaggccgtcaccacgtc

SEQ ID NO: 23683 - DNA, 101 bp, rice(Oryza sativa)
  misc_feature (71): n=t or g
gaccagtggtactaaataagataatcaatgccacttactgtagctataaaggagaaggtatgtaactgagngcacccacaatagttatctataggctcttt

SEQ ID NO: 23684 - DNA, 101 bp, rice(Oryza sativa)
  misc_feature (71): n=t or c
ttctcgtccttcgtgtatgaaggcatagttaagttgtctgcacttcagcccctgaagattttttatcttanaaatagaccctcatctgtttccttctttag

SEQ ID NO: 23685 - DNA, 101 bp, rice(Oryza sativa)
  misc_feature (71): n=a or c
gagcttttcctctcaccatacataatattctttctgtccttcataatattcatggtctacttactacagtntgcctgacacaaccaacatatctcatgtag

SEQ ID NO: 23686 - DNA, 101 bp, rice(Oryza sativa)
  misc_feature (71): n=t or g
attttaattcctattacctacttttttatagatgtccttaattggtcaaatggtaagctctgagtctctgncattgacttacaagtcatcgagtcaacggc

SEQ ID NO: 23687 - DNA, 101 bp, rice(Oryza sativa)
  misc_feature (71): n=t or c
gaattatatttccagtagtgtcgctaataaataccatcagttatgtacttgtccacgtccaaagtttggtncacctttaataatttgaggatttttgttta

SEQ ID NO: 23688 - DNA, 101 bp, rice(Oryza sativa)
  misc_feature (71): n=t or g
tttcatctccgacaagggcaactcgcctaggcatgacataaggtacgcggtagaattcacctctactctgngcatctcgccatcgctgttcccaggaatca

SEQ ID NO: 23689 - DNA, 101 bp, rice(Oryza sativa)
  misc_feature (71): n=t or c
agcttccgtaaaaactgcatcagatgagattaacataagatgacagagccgtggatgtcggtctccaagtnggactcgggacggagtttttttttttttaa

SEQ ID NO: 23690 - DNA, 101 bp, rice(Oryza sativa)
  misc_feature (71): n=a or c
aacagatccaacctcactgccaaattccttctcagtcatgcgcaattgatggaacaaggtgctacgtcacntgtaatgggcctatgggcttgtaacttcgt

SEQ ID NO: 23691 - DNA, 101 bp, rice(Oryza sativa)
  misc_feature (71): n=a or c
tggtccggcccaggttcagatagctggcccagttgtaccatgtgcactaacgcatggtcatgtgtgccttncgaggtttttcatcataatttatttattta

SEQ ID NO: 23692 - DNA, 101 bp, rice(Oryza sativa)
  misc_feature (71): n=a or c
ggggggggggaaatccaactgactggcctgcgggagaggtaggagggagggaagtggtaggaactcaccgncgacgacgacggcggcggcggcggaagcgt

SEQ ID NO: 23693 - DNA, 101 bp, rice(Oryza sativa)
  misc_feature (71): n=t or c
aaacacccttacagagatctctgaacaatggccactcttgtccaaccatattacaaccatagacacaaaantatttaatttctaacagatttatttcacta

SEQ ID NO: 23694 - DNA, 101 bp, rice(Oryza sativa)
  misc_feature (71): n=a or g
gatgaggagcggaagggacgagcagggaattgagggaagcatcatgcccttcataggaagcagaaacatcntgcttgaagatgaagcagtagccaacatgg

SEQ ID NO: 23695 - DNA, 101 bp, rice(Oryza sativa)
  misc_feature (71): n=t or c
gaccgcctcggccatcggcctcgagggtgcggctgggaataattttgcgagaaaatccgtattatcagttnttcgggaaaaactcccgattcgggttgttg

SEQ ID NO: 23696 - DNA, 101 bp, rice(Oryza sativa)
  misc_feature (71): n=t or c
tatgtgacccagcaatcatcttttccttctctgccctactactacgcagcttaatttgtcatttcggatantattcgaaaatttccagattcaagatgcat

SEQ ID NO: 23697 - DNA, 101 bp, rice(Oryza sativa)
  misc_feature (71): n=a or g
aagaaagtgaagcagttgatgtgatatgatttgatgcgacatgcatagtctatagagatgcaatgcaagcnatgggcatttgccagcgtctgaagatctca

SEQ ID NO: 23698 - DNA, 101 bp, rice(Oryza sativa)
  misc_feature (71): n=a or g
gccgaaaccacccttcgaaccatcttgagaattgagatcagatcttatttacactgatcttgggagttganacatgtcatatactcatatatgatattacg

SEQ ID NO: 23699 - DNA, 101 bp, rice(Oryza sativa)
  misc_feature (71): n=t or c
gcaaaataatactgaaagactggaggtggaggttaccttctgttgtttttatgtaatgaaatatgtgacanagaagatctcaagaaaagtttctatgtacg

SEQ ID NO: 23700 - DNA, 101 bp, rice(Oryza sativa)
  misc_feature (71): n=t or c
gccgcttcgaaatccaaaatgaggctttagttccgtttcccaggcgaatctctgtggtggcattgaacatntgtctatctacctcatagcatggaattggc

SEQ ID NO: 23701 - DNA, 101 bp, rice(Oryza sativa)
  misc_feature (71): n=t or c
atcaagatgctcaggaacctatccaaacaaccaacgttgccagtgagctcaaagttccaaaggtcaataanttagtgtcctaattttaagcttatgcaatg

SEQ ID NO: 23702 - DNA, 101 bp, rice(Oryza sativa)
  misc_feature (71): n=a or g
actgatgcactaagtcgcaagacctattgcaatgcagctcaaatattgctagaccaagatcgtctgtgcanagaattggagaagttaaggctgaccgtggt

SEQ ID NO: 23703 - DNA, 101 bp, rice(Oryza sativa)
  misc_feature (71): n=a or c
aaaatgtcattggtcctgactactgagcaagattctattgacaagtgaagcaacataccccctccgtcccnaaaaaaatccaatcctagctacgattaggt

SEQ ID NO: 23704 - DNA, 101 bp, rice(Oryza sativa)
  misc_feature (71): n=a or g
aaaatttgaaccaacgattaatattcatgaaatttcaggccaaagattaatgctaagatgtttttgggccnaagggtaaaattcaacacttttggggccca

SEQ ID NO: 23705 - DNA, 101 bp, rice(Oryza sativa)
  misc_feature (71): n=a or g
taggggttacatcgctccggaatgggtttctggtgttcccataactgaaaaggttgatgtgtacagttacngagtggtgcttctggagttagtcatggggc

SEQ ID NO: 23706 - DNA, 101 bp, rice(Oryza sativa)
  misc_feature (71): n=t or g
ttaggaagcgacccgccgacttggctgtcaaccacgccgaagaattggtggctgttagctgacgcaaatgnggggtcggaaacgtgtcgcgatctgcaatg

SEQ ID NO: 23707 - DNA, 101 bp, rice(Oryza sativa)
  misc_feature (71): n=t or c
agaaactttactataagaaaagatgcataacagatggatgatgcttggagggtagaatactaatttttttnagtccattgctaaaaaagatttagaataaa

SEQ ID NO: 23708 - DNA, 101 bp, rice(Oryza sativa)
  misc_feature (71): n=a or g
accttttcaacaagttcatgctccaacgaggagtaagatttgttatgattgtttgcattcgtggggctagngcttcgacgctctgatcttgtcaatgtaaa

SEQ ID NO: 23709 - DNA, 101 bp, rice(Oryza sativa)
  misc_feature (71): n=a or g
taccactagtgtgtacttcaggagaattcctccttcccgatatgatttcaaatagcaccataccaaagctntaaacatcaacttttggagtaatagcaact

SEQ ID NO: 23710 - DNA, 101 bp, rice(Oryza sativa)
  misc_feature (71): n=a or c
ataggaggacaacaatcatcaaacatgtggttaagaagagcaacaacggatacaaggtggagtgaacaacngtaaaaacaaacaaggagcaaattacatga

SEQ ID NO: 23711 - DNA, 101 bp, rice(Oryza sativa)
  misc_feature (71): n=a or c
catatcgtcgtcgtttttcgtaccccagatctgtgacagatcaatcgatgcttatgcagttagagcaagtncaatagcaggctatacgctagctataaata

SEQ ID NO: 23712 - DNA, 101 bp, rice(Oryza sativa)
  misc_feature (71): n=a or g
catgtaatctactgtgttcaaattttggttctctgaaccaaaacccttgaaaagaaagcaaagcactaganccacctaattactagtgcctaactagattg

SEQ ID NO: 23713 - DNA, 101 bp, rice(Oryza sativa)
  misc_feature (71): n=a or g
ctggtagtttcaagggaataaatcggtcataattttgtcttatttggtgcttcatatatatagtgaatttnaagatgagactttacatataaatatgatac

SEQ ID NO: 23714 - DNA, 101 bp, rice(Oryza sativa)
  misc_feature (71): n=a or c
gaatgtaacaccagcaactctgaacagctgaatcggcaattggcatttcctacatctcaaaaattgacccnatcgatccaacacctatatctcttttacaa

SEQ ID NO: 23715 - DNA, 101 bp, rice(Oryza sativa)
  misc_feature (71): n=a or g
gcggagaaggagagaatgagagaaggcgcgctggcggaggagatagactgagagaaagagagaaaggatangagcgagcggaagaaacgaggcatgtggtg

SEQ ID NO: 23716 - DNA, 101 bp, rice(Oryza sativa)
  misc_feature (71): n=t or c
cgcaacggcgaccaccgtggtgagcttgagtgcgaagtgcttgacgatgacggagcggaaagctcgccgangaggcaacaagaactatagcagagagctcg

SEQ ID NO: 23717 - DNA, 101 bp, rice(Oryza sativa)
  misc_feature (71): n=t or c
tgtaattaggcctagcgctaagcttcaataaacgccaattggacccggtccaactaaagaccaattgggcncggcccaactaaaaaccaattgggccctct

SEQ ID NO: 23718 - DNA, 101 bp, rice(Oryza sativa)
  misc_feature (71): n=a or g
tctttttttattactgaatcatcctttgaactgtcatcatcaagagaaatttgcacattgagaggaacagncagtttagctcttatcttgtcaccattctc

SEQ ID NO: 23719 - DNA, 101 bp, rice(Oryza sativa)
  misc_feature (71): n=a or g
aattgtgggcttctctctcccctcaaatccctaaattcctccctctcaaatacctagcgagggtggcagcnaggcctgcttttgccacagtggactgccac

SEQ ID NO: 23720 - DNA, 101 bp, rice(Oryza sativa)
  misc_feature (71): n=a or g
cctagcgtttcatcaagcctcggaccgacccatggtgcttgtgacctatacgtctgatcgatacacgatanaactatataagaatcttcttctattaatat

SEQ ID NO: 23721 - DNA, 101 bp, rice(Oryza sativa)
  misc_feature (71): n=t or c
cttacagcatactccgattgcgtttcctttccccttgcatacggtagcatggcgttaaccctaactttttnatactaataaaatataataataaatttatg

SEQ ID NO: 23722 - DNA, 101 bp, rice(Oryza sativa)
  misc_feature (71): n=a or g
gcagttattagtcaaatattggctgtggagttcagagcatgaatagtgattgtaggcaactttcgcagttnagttcagagcataaatactgtgatttagac

SEQ ID NO: 23723 - DNA, 101 bp, rice(Oryza sativa)
  misc_feature (71): n=t or c
gacttttttgttgacatgttaaaggatttcccccactgggttgcttcaagaactgaatgcattgctgttcntccttcgcagaattactctctctctctctc

SEQ ID NO: 23724 - DNA, 101 bp, rice(Oryza sativa)
  misc_feature (71): n=t or c
ttaccaacaaaacaagtttttctcccctaaattctgctaaacagccattgtttagtatagtcgatccgtancctatctcaaattaatggagctaacaatct

SEQ ID NO: 23725 - DNA, 101 bp, rice(Oryza sativa)
  misc_feature (71): n=t or c
tgtactacaattaactataaatatgtaatagtttgtttttctctctcatttctatatgtgtttgcaggggnggatttatagtgtaacggtcggtgtcagac

SEQ ID NO: 23726 - DNA, 101 bp, rice(Oryza sativa)
  misc_feature (71): n=a or g
caaaatggcaagaaagcgcaaaagaaaggagacgatgctttcgtagtgttgagaagcaagctgaaacaacnacgacgacgacgatgacgagtcgacgacga

SEQ ID NO: 23727 - DNA, 101 bp, rice(Oryza sativa)
  misc_feature (71): n=t or g
aaaccagcaggtgggtcctgacacttactagagttcatcaaaagttagcttacttctagtttcttctctcntgtttcatataatccctggccgtgtacata

SEQ ID NO: 23728 - DNA, 101 bp, rice(Oryza sativa)
  misc_feature (71): n=t or g
taaaagctgctattatcaaaagcctgtttagttcccaacttcccatacatacaaatgcttaatgtattcanataggttcactgaatacacctgatcatgat

SEQ ID NO: 23729 - DNA, 101 bp, rice(Oryza sativa)
  misc_feature (71): n=a or g
ggtaaggatagaggtaaaataaatgattactctctattaattgttctgtttggtaagaggtggacggaggnttttgaagatggggagtattttggaaattt

SEQ ID NO: 23730 - DNA, 101 bp, rice(Oryza sativa)
  misc_feature (71): n=t or c
cgagaaagctagaggcacttgcgcagaagcttgttgctatgggtttctcatcagatcaagcaacaatggcncttatacagaatgagggctgccttgaagag

SEQ ID NO: 23731 - DNA, 101 bp, rice(Oryza sativa)
  misc_feature (71): n=t or c
acattaacactggactttgcatttttacccctagaatatattttgtgcaaggtgccacctaattttcctanttttatatgtaatgtagtgtgccattgctt

SEQ ID NO: 23732 - DNA, 101 bp, rice(Oryza sativa)
  misc_feature (71): n=t or c
agttcctctcgcagatgcggtacacggcaaggacaaggagatcgacgacgcgcgtcagagtccgttagatnagattcgcacgaggccattgatccatcctt

SEQ ID NO: 23733 - DNA, 101 bp, rice(Oryza sativa)
  misc_feature (71): n=t or c
aagatcgcgtcggccggtggagaagcgaagcccaaacgaacgcgaggcgcctccgatgtacacgtggcgcntcctccgcccctacaggtggcaagctcaaa

SEQ ID NO: 23734 - DNA, 101 bp, rice(Oryza sativa)
  misc_feature (71): n=a or g
agagcaaaaattccctaattctgtggtcgcggcaagacagaattagggctctagatctatatactcctagngacgaataataatatgattcttgatgcttc

SEQ ID NO: 23735 - DNA, 101 bp, rice(Oryza sativa)
  misc_feature (71): n=t or c
aaagcgagtgcgtcgaatatgtctatactaaaaaaacggcgcacctattagcacgcttaactacttagccnggccgtgtatttttcttttgtgcgtgaagc

SEQ ID NO: 23736 - DNA, 101 bp, rice(Oryza sativa)
  misc_feature (71): n=t or c
ttttggtcctcagcaggtagatagtggaaaagaatattcctcagcccctctcttcgacctctccaatgtgnacacattcgtattgttctcaaccagccaat

SEQ ID NO: 23737 - DNA, 101 bp, rice(Oryza sativa)
  misc_feature (71): n=t or c
ccctctcacctcggctggccgtggctcctaccctccttcccggggttggaaatttcggatgaaattacttnaattttttcatgaattttggtaatacttgt

SEQ ID NO: 23738 - DNA, 101 bp, rice(Oryza sativa)
  misc_feature (71): n=a or g
gaggctgaaccactcgctacaataaccgcagccgaggttcagaaattcgtctggaaaaacatcgtttgtcngttcgggataccgaaagagttcatcactga

SEQ ID NO: 23739 - DNA, 101 bp, rice(Oryza sativa)
  misc_feature (71): n=a or g
gcaacacatcttgaagatgaggcctccaggggcattatagaagatatattgattaggatatgcaaggtatntttttcagttggttctgtgcttttttccca

SEQ ID NO: 23740 - DNA, 101 bp, rice(Oryza sativa)
  misc_feature (71): n=a or g
agcgagtggcgggacggaggaagcctgggccagcttccaagggtggcggcagggaacaacaacaagtgtgnaagtaggccggtggtggggtggaggcctca

SEQ ID NO: 23741 - DNA, 101 bp, rice(Oryza sativa)
  misc_feature (71): n=a or g
atttcctggtttttatgcgctgtctattgagcgcatcataagtggtagtagcttctttgaagtaaaggccnggattctttgcattattaaagggagtagat

SEQ ID NO: 23742 - DNA, 101 bp, rice(Oryza sativa)
  misc_feature (71): n=t or c
ggtgagtaagattatggatggttaggaggcaggcacagttgtagcatcttagacggcacaagctctctctnttttttttttttttgactggatgaccaaga

SEQ ID NO: 23743 - DNA, 101 bp, rice(Oryza sativa)
  misc_feature (71): n=a or g
acaccaccccattcacgagatcaaagcggtggttggtctgagggaaatgggcggtccgggcagatgtgcanacatgctctgtgtcgaaacatgaattcggc

SEQ ID NO: 23744 - DNA, 101 bp, rice(Oryza sativa)
  misc_feature (71): n=t or c
aaaggtactactgattgattaaggtacgactgataattcatagaaatagcatggaagtacatggggctgcntacggctcgggcgcccgatgatttggaaaa

SEQ ID NO: 23745 - DNA, 101 bp, rice(Oryza sativa)
  misc_feature (71): n=a or g
aatcgttacgctccaacgaaccgtctagaacgtcttcccagaaactactgcttcctccgtctcggattttnagttttatttgcaacgtttaaccatttgtc

SEQ ID NO: 23746 - DNA, 101 bp, rice(Oryza sativa)
  misc_feature (71): n=a or g
aatgcagataaacgtgtggtcattgagcccaataaataagataaagttgaattcacatgaaggtcaaaagntattctacataggttcaatcccaacaccaa

SEQ ID NO: 23747 - DNA, 101 bp, rice(Oryza sativa)
  misc_feature (71): n=a or g
tgccatgggaatcctgcgaaaggggagtaatggatgtaaacaaccatcaatgataattcaagcattgaaangacgtaaatctagtcgatcggcaccatcga

SEQ ID NO: 23748 - DNA, 101 bp, rice(Oryza sativa)
  misc_feature (71): n=t or c
aactcaaaaggagtgactttagtagcatcatgtttaaatatcccatgaacccataatgcctctgaaagcanctcatatcacttctttgagtgttcttcaat

SEQ ID NO: 23749 - DNA, 101 bp, rice(Oryza sativa)
  misc_feature (71): n=a or c
tggcactttctcacccacgtgtggccggtctttagcggtttatctgctcggtttttcaccggttctggctnaaaaccggcggttcaatcggtttttcccgg

SEQ ID NO: 23750 - DNA, 101 bp, rice(Oryza sativa)
  misc_feature (71): n=t or c
tttgagagagtggcaaatagtaaattctcctggcgtgggggtgccacaagatggcattgccacgaatacgnggcccatagagaatttgacccagaacggga

SEQ ID NO: 23751 - DNA, 101 bp, rice(Oryza sativa)
  misc_feature (71): n=t or g
ttttttttatgctgttgctcatttaaaaaaattgtgaagtttgtgctgtctattacaattacatccagccntgctattcatcttggccaaggaggccatcg

SEQ ID NO: 23752 - DNA, 101 bp, rice(Oryza sativa)
  misc_feature (71): n=a or g
tcatatttttggtttgttagcatgctatatggcctcgctatgctctcacaagattgttttgaatgtctgtnttgtgtgttgcctgtgagatatgagttcaa

SEQ ID NO: 23753 - DNA, 101 bp, rice(Oryza sativa)
  misc_feature (71): n=t or c
gatttaacatctactgctaccctgtcaaaaaaaaataaattctaaggatgtatctagacaacatgtatgtncaaatacatcctcaggattggacttttttt

SEQ ID NO: 23754 - DNA, 101 bp, rice(Oryza sativa)
  misc_feature (71): n=t or c
gtttgctctagatgacagtgctgattacgtcaaggatttgttggagcgaattgttggctgtgggaatgtgnatgcagtaaagctcaggcatccaaagaacg

SEQ ID NO: 23755 - DNA, 101 bp, rice(Oryza sativa)
  misc_feature (71): n=a or g
tgtacccgattccttggctcaaaagggagagcaagcgaaaggaagcacaaaccttaaacaccccaaaattnaaactttagtttgaacaagaggtcgaaaga

SEQ ID NO: 23756 - DNA, 101 bp, rice(Oryza sativa)
  misc_feature (71): n=t or c
cgtctctgatgagcatgagggcatcgatcatgagctaaaagaggtggtctcagctcgttccacgtgacccngcaaacgttttcagcggtttactcgcacct

SEQ ID NO: 23757 - DNA, 101 bp, rice(Oryza sativa)
  misc_feature (71): n=t or c
gtggtgcagaaattcggaaatggttctaagtatgtaattgcattgcaagacatgggctgtgttcttttggnggggttgggaacccctcccctctacacggg

SEQ ID NO: 23758 - DNA, 101 bp, rice(Oryza sativa)
  misc_feature (71): n=t or c
gcactaaaagataaccgttcaatggttgaatcacactgggcataacatagactggaaagatacagtgggcnaaagacttcacgttcacatattctagacca

SEQ ID NO: 23759 - DNA, 101 bp, rice(Oryza sativa)
  misc_feature (71): n=a or g
gtccagccacaatatcctcattaggacaaaaactcctatttgcataggttccaacattcatcctattcctnatctcattttctgtgtcaaagatatataac

SEQ ID NO: 23760 - DNA, 101 bp, rice(Oryza sativa)
  misc_feature (71): n=t or c
aaaaaaaaaaaaaaagacaaccataaacaaataccctagggcacaagggccatcgacctagcaaacaaatnttggagctttgaggctccaggcaagcaccg

SEQ ID NO: 23761 - DNA, 101 bp, rice(Oryza sativa)
  misc_feature (71): n=t or g
tgtaggccaggcaattgtcttcaatgggctcaatcacaactccttggaggcgtgtgaggaggccaagattntggtggcagagatcgaagggctatgtgtac

SEQ ID NO: 23762 - DNA, 101 bp, rice(Oryza sativa)
  misc_feature (71): n=t or g
ggaaatgaaatttttagggtgcgcaaggtcaaagaaagaagtggtgacacatatgtttatactggttcagntcctcaaggcaaggtaataccctagtccaa

SEQ ID NO: 23763 - DNA, 101 bp, rice(Oryza sativa)
  misc_feature (71): n=a or g
actctattgtggttgatgtagtctctgttccggcaccaaacaatggctattcacaaaaaggagactatatnagtacaattcgaaacatgcctatatataga

SEQ ID NO: 23764 - DNA, 101 bp, rice(Oryza sativa)
  misc_feature (71): n=a or g
ggatgccgccgaggtcgatgatgtggatgaacttgtttgtcctcgtcgtctcgaggacgaatcgttcacgncgatggcggcgaggtggagaagcgggcaca

SEQ ID NO: 23765 - DNA, 101 bp, rice(Oryza sativa)
  misc_feature (71): n=t or c
tgctgatgattgttttagtgatgtgctagaaaattgtgccttcctgttatagctaactttgtcgtgctaantttggctgctaattttggcttctaatagcg

SEQ ID NO: 23766 - DNA, 101 bp, rice(Oryza sativa)
  misc_feature (71): n=a or g
cgacacattcaaccatagtactttcacgtaatgtggatgtaaatggctgtccccaatcgacatgacatganaaacatggataaatccttttatcaaatggg

SEQ ID NO: 23767 - DNA, 101 bp, rice(Oryza sativa)
  misc_feature (71): n=a or c
tagaccggtgaaccatgtttattttagggtgaatatgatccctatagtttcgcttcgagctcagtttagtncttgaggtttcaaatcgttcaaataagtct

SEQ ID NO: 23768 - DNA, 101 bp, rice(Oryza sativa)
  misc_feature (71): n=t or c
tcatcagtgctgctcattggttttaaaaaatgacatcagtaaaacatacatgcacagtacatcgattctcnaagacaaaaatgagcttaggaatattagta

SEQ ID NO: 23769 - DNA, 101 bp, rice(Oryza sativa)
  misc_feature (71): n=a or g
ccgcgtgatgggatgagcgagccggctggtccagctggagaaggtttgtcggcatccatgcaagtaaacancgagggtgtgcgcttgccttgccaacctcg

SEQ ID NO: 23770 - DNA, 101 bp, rice(Oryza sativa)
  misc_feature (71): n=t or c
acttgtcatcgggatataaaaatgtcctcgaaccgcaaaaccagtatgcggggtccttaactatacaaaantggtcacccgaggtcctttggtggcggctg

SEQ ID NO: 23771 - DNA, 101 bp, rice(Oryza sativa)
  misc_feature (71): n=t or g
taagtatccacacatgcataattatgaacatcagaatttagaccttgtgagtgaagtcatgcaccacatcnaaggtttttctccattgtaatgattttcta

SEQ ID NO: 23772 - DNA, 101 bp, rice(Oryza sativa)
  misc_feature (71): n=a or g
agcatagctgtacaaacctacaaaacatcaattctactactgagtactcctactgagtactccctcctagnttgctatattttgagacggagggagtgctt

SEQ ID NO: 23773 - DNA, 101 bp, rice(Oryza sativa)
  misc_feature (71): n=t or c
tgtttcacgagcgatttgatttttgaggtccttggattcgtccatggcgttctctcgttagaatatactanaccaacacagaaccatgagcgaggggaata

SEQ ID NO: 23774 - DNA, 101 bp, rice(Oryza sativa)
  misc_feature (71): n=a or g
agagtggaggttaactgaagcacatgagaccaaattgttatcagactaaccctacaatggaagagtgggantggtataataagcaatggaggagtgggagt

SEQ ID NO: 23775 - DNA, 101 bp, rice(Oryza sativa)
  misc_feature (71): n=a or g
agaaaataatgaattctgggggagctcacagaaaagggaaattaatcttgaggaaattcgggctaatgttncaccggaaatccaagaaaataatattccaa

SEQ ID NO: 23776 - DNA, 101 bp, rice(Oryza sativa)
  misc_feature (71): n=t or c
ttgacttcttccaatatgaccgctgactatccattaacggttctattttttttcggaatcgttagaattgngtcgacatattttctcctccatcacagtcg

SEQ ID NO: 23777 - DNA, 101 bp, rice(Oryza sativa)
  misc_feature (71): n=a or g
tgggcgagtcacgaatttctggcgacggggcaacgagccaacgaatgcacataaacgcgttgcatgtgaanaaggaattgaaaaagaataataatctaatg

SEQ ID NO: 23778 - DNA, 101 bp, rice(Oryza sativa)
  misc_feature (71): n=t or c
attagaagagaggaaaccatcgggtggaaaccgcaaaacttgaagggcacataaaagagtgataagagtgngcatgtatcttattttcatcaaaatgtctc

SEQ ID NO: 23779 - DNA, 101 bp, rice(Oryza sativa)
  misc_feature (71): n=a or g
gcggaaggccgccctcaagcgtcccaaaaccttagagcaggtgtgcctctatgtccttcacattttcaatntagtttgtcctgatgttttgagacaatcca

SEQ ID NO: 23780 - DNA, 101 bp, rice(Oryza sativa)
  misc_feature (71): n=a or c
aaaaatctcatagctagagtactctcatcgtctttaaaatacaagggattttgtctgtgaattaggatacntagaatctgttaggaaggagagtagtaaat

SEQ ID NO: 23781 - DNA, 101 bp, rice(Oryza sativa)
  misc_feature (71): n=a or g
atgtattacaaatctttaagcatttgattgttcaattcgcagtactaactatcgctgtagcgttagtatgngcatattactagaacaaaagtgaagagggt

SEQ ID NO: 23782 - DNA, 101 bp, rice(Oryza sativa)
  misc_feature (71): n=a or g
atgtttttggccaaaaatttttgatgaaaacgaggcctaaaataaccgaactattacgtcgatcaaacttntgcattttgtcatccatcacaaaatttgtt

SEQ ID NO: 23783 - DNA, 101 bp, rice(Oryza sativa)
  misc_feature (71): n=t or c
agaaagtaagcaagctatgtgtgctcgcatcctacgtacagcacaagctggcattttgcttgaaaaatggnatagctttgttggtatttcttatgacctcc

SEQ ID NO: 23784 - DNA, 101 bp, rice(Oryza sativa)
  misc_feature (71): n=t or c
ttcatgaataagtagccttcactgtactcgaggattattgggtgcaattggattcaatcttaacaaggtcngtcgtcttacgacagcttcttttcggtgga

SEQ ID NO: 23785 - DNA, 101 bp, rice(Oryza sativa)
  misc_feature (71): n=t or g
ttttaaataatatgaacaattaaaattgaatacgagaactcatggttgtgtttaaaataggacagaggcanaggcgtactgaattttcttttgtgagtgta

SEQ ID NO: 23786 - DNA, 101 bp, rice(Oryza sativa)
  misc_feature (71): n=t or c
cctcaccgacaatccaatactcctacgaaataccgatgcgaggattatactagatcccaccgggcccacangtcagcgaccctcgtgcgaccccaaaggcg

SEQ ID NO: 23787 - DNA, 101 bp, rice(Oryza sativa)
  misc_feature (71): n=t or c
ttttaaaatattgacatggtaactgccaaagttagtagtacagcacataagagtacgggtctgtttggtancaaattattgcggtattgccctaccaattt

SEQ ID NO: 23788 - DNA, 101 bp, rice(Oryza sativa)
  misc_feature (71): n=a or g
aatagctttgaaatcatgacggctaaatactctctctctgttcctataatatagcaagttaaaactagacnaaaaattttatagtataataaatctgacca

SEQ ID NO: 23789 - DNA, 101 bp, rice(Oryza sativa)
  misc_feature (71): n=t or g
tcttttcttttgcaaaacacagcacacactcatccctaatgaatgtacacacgcacgtacactatatctanaaacactttcatgaaactggatcaatatat

SEQ ID NO: 23790 - DNA, 101 bp, rice(Oryza sativa)
  misc_feature (71): n=a or g
ttaaaatttgggtgaaaatctagattgtttggcttatgccagctgaatattttaggagaaaatgtagttgncagaaactccccaaaatagacaaaagctct

SEQ ID NO: 23791 - DNA, 101 bp, rice(Oryza sativa)
  misc_feature (71): n=t or c
caagtgggtcccactcgtccccagtcctttcactcttctatcctagtgctgatgtcatattcctccttttnagttataaaataattaaatatgatgcaata

SEQ ID NO: 23792 - DNA, 101 bp, rice(Oryza sativa)
  misc_feature (71): n=t or g
gagtggtagaagcctgcatttggatagatgattgggttgatctctctgcacagtgtatgcgtccccagttncagcctctgttttaaaaaaaaaagttgcag

SEQ ID NO: 23793 - DNA, 101 bp, rice(Oryza sativa)
  misc_feature (71): n=t or c
ggcttctccacccacggtccggcttcgtcattcggcagtcttttttcgagaaaattcatccgatagttcgnatgacgtgcctctaacaattatgatatcaa

SEQ ID NO: 23794 - DNA, 101 bp, rice(Oryza sativa)
  misc_feature (71): n=a or c
catcagtgacatgcacgactacgacccccttgaactcttccaagaatttcaattagcggtacatttggatnaatctaccttcgatgcgtaccactaaacac

SEQ ID NO: 23795 - DNA, 101 bp, rice(Oryza sativa)
  misc_feature (71): n=a or g
tgcattgaatgtgttcattgttgttgtctcaccctaattactagaaaaaagaactgcgtgcagcttgtgcnctttaaccatactatgtcagtcgtgctttt

SEQ ID NO: 23796 - DNA, 101 bp, rice(Oryza sativa)
  misc_feature (71): n=a or g
atatttgtctttgtacaacagtgttgaaagaactgtgggttgtacaccagtagtgttgaaagaagtgttgngtgatagtatgttggtgtaccatcattaca

SEQ ID NO: 23797 - DNA, 101 bp, rice(Oryza sativa)
  misc_feature (71): n=t or c
cttgttttgcaaattcccgacagctcagtggtaattatgacgtgggaccaaaccatttgaaagtagactcnataagctttccaacaagtactcatgggccc

SEQ ID NO: 23798 - DNA, 101 bp, rice(Oryza sativa)
  misc_feature (71): n=t or c
ttttaggatggagaaagtactaatttgtactctcggttcaaaatatagcaacctatgactgggtgtgactnatcctaatacaatgaatttggacatacata

SEQ ID NO: 23799 - DNA, 101 bp, rice(Oryza sativa)
  misc_feature (71): n=a or g
gcgtgtgcaacaacactgtacctcttcttcctggccgcgacatgaacgaaggtcctcccatcggagtcgcncaatccggcggaaccggggaatatggtgag

SEQ ID NO: 23800 - DNA, 101 bp, rice(Oryza sativa)
  misc_feature (71): n=a or g
ttatattttgggacggaggaagtagcttacatcccttgagaagatcagcggagacaaggaacgtcaccttntttttcctaacaacggcccaccgcctgcac

SEQ ID NO: 23801 - DNA, 101 bp, rice(Oryza sativa)
  misc_feature (71): n=t or g
atgtaagggtaattagggaacaaaaatcctttgagaagactaacaggctgtacagaaaatggacgaatgtnaattgtaatgtgttatatagtactagtact

SEQ ID NO: 23802 - DNA, 101 bp, rice(Oryza sativa)
  misc_feature (71): n=t or c
catagcttggccaacaatatacataatacgttcacatcaaacggcttcaaaaaagtagatgcaaaatgcanaagcatatgcatatactccctccatcccaa

SEQ ID NO: 23803 - DNA, 101 bp, rice(Oryza sativa)
  misc_feature (71): n=t or c
catattgagaaaaaaaagagagagaaatgtcaacaggggataaagggtgatccatttttaatagttcgatnatgttgtaaaatgagtcaaaaattacttta

SEQ ID NO: 23804 - DNA, 101 bp, rice(Oryza sativa)
  misc_feature (71): n=a or g
tagagtatttgggacacataatttcagctgttggggtagccactaaccctgataagatccaagtaatgttncaatggcctgtgcccaccaatcttattgag

SEQ ID NO: 23805 - DNA, 101 bp, rice(Oryza sativa)
  misc_feature (71): n=t or c
tgcacattgtgcaggaggtaatgtccatgaagaatcctaaagaacattcctgataccctcagcgccaatanattgtgagaataatgcactaataccaacat

SEQ ID NO: 23806 - DNA, 101 bp, rice(Oryza sativa)
  misc_feature (71): n=a or c
tttttttaaaaaaagtaaatacttgattaattataagaatttgacacgaaaagtgagttcccaacctcatnttccgaacacaacttaataagtcaaagcaa

SEQ ID NO: 23807 - DNA, 101 bp, rice(Oryza sativa)
  misc_feature (71): n=t or c
aggggacccgtcccgcgcgcgttacaccgatcgaatcaatcgcggtccgcaccagaagtggatttttatcnctcgggagatatctctttccatgtcactta

SEQ ID NO: 23808 - DNA, 101 bp, rice(Oryza sativa)
  misc_feature (71): n=a or c
gattcccgcgataattctggcctcagcgcttggtacgattcggtggatttgttgatggtcatctaacaggnggagagatcgtttcgccgggaggaggacga

SEQ ID NO: 23809 - DNA, 101 bp, rice(Oryza sativa)
  misc_feature (71): n=a or g
ttctagctgaaattgtttaatcttgtacacgttttggcccttctaaaaggcttccgtgtactaagggcctntttggcacagctccagctccagcttttttg

SEQ ID NO: 23810 - DNA, 101 bp, rice(Oryza sativa)
  misc_feature (71): n=t or c
ctgtggattggtttcacctccatttcctaatccttttgcatccctgatctctctatctctgtcgctcgcgnagccatggcggagggggattccagggatgg

SEQ ID NO: 23811 - DNA, 101 bp, rice(Oryza sativa)
  misc_feature (71): n=t or g
acagttgtagccgttaccattggttctgaagtgaacggcacaaattaacctaggacactgtagcaaaaagngcacggcacaaattaacctaggacactgta

SEQ ID NO: 23812 - DNA, 101 bp, rice(Oryza sativa)
  misc_feature (71): n=t or c
ggtagtaacttaaagaaacccttatgtatgatttgctcgcaaagtatcaatggcagcctaatcactagtcnaaatgttgctgctgggacctggggtcctag

SEQ ID NO: 23813 - DNA, 101 bp, rice(Oryza sativa)
  misc_feature (71): n=t or g
ctgtgccaaagagaccagttctatctagctaagaggcacatgcgagaaatgtaaacagcaaaagcttcctnaatttcaacatgatgataggtgctaatgga

SEQ ID NO: 23814 - DNA, 101 bp, rice(Oryza sativa)
  misc_feature (71): n=a or g
tggctgatgtggcatcagagatatccagagcagtgcaataaacatctcccaggccagtttaattgaccgtncagaaactacagtgcttagcagatcatgtc

SEQ ID NO: 23815 - DNA, 101 bp, rice(Oryza sativa)
  misc_feature (71): n=a or g
ctaagaatcatcagatatccttctcccgcagttttaattcaataattggggatttatcgactatgtacacngtacacaattgctgggcacctgcatcccaa

SEQ ID NO: 23816 - DNA, 101 bp, rice(Oryza sativa)
  misc_feature (71): n=a or g
acctaatctgtacggttgggccaaaccagtttgattcgaccaatgaaaaacccggccgcttgcgcgcgccnccgccgggaaaggcggaaatggcggggcgg

SEQ ID NO: 23817 - DNA, 101 bp, rice(Oryza sativa)
  misc_feature (71): n=t or g
atggcagcaactagacaccgtaagcactcccaactttctcttttgcgagatctcatcccattaggtttaanttcttggtagaaatgacaatgtcgagagta

SEQ ID NO: 23818 - DNA, 101 bp, rice(Oryza sativa)
  misc_feature (71): n=a or g
tctgctacatcagatgaacagtggattagatctggctaattaaggcaaaacaacggcgcctatattattangtaagatctcactgatatgtgatacattac

SEQ ID NO: 23819 - DNA, 101 bp, rice(Oryza sativa)
  misc_feature (71): n=a or c
ctgttgaacgtgaagctcatgaaaggaaatctcaccaaaaaagaatcaggaacacacgttcgaacacacanaaaaaaaaaagaatttctagcacatcgtaa

SEQ ID NO: 23820 - DNA, 101 bp, rice(Oryza sativa)
  misc_feature (71): n=t or g
tccgcccgggcaagcacatgtggttcacagctcaggaacaacacggtctgtttagctgagggtcgtgctgncacgacccgtctagccacgtgatgcttggg

SEQ ID NO: 23821 - DNA, 101 bp, rice(Oryza sativa)
  misc_feature (71): n=t or c
tgcttagccatgcttagatcaactagctcactatgaggaaagtaccatggtggctatgatcatgatctttnttcagtagttcaagacgcccggtcgctgtg

SEQ ID NO: 23822 - DNA, 101 bp, rice(Oryza sativa)
  misc_feature (71): n=t or c
atgggcatggcatatttgaggtaactttaaattctgataagcaaggggtaagaatctaaaaaatcaacctntaatgagatatgacgttttctagttcagtg

SEQ ID NO: 23823 - DNA, 101 bp, rice(Oryza sativa)
  misc_feature (71): n=a or g
aacaattcatcgaccttcctcaggccacactcatgtctcagctaaaattcgactcgggacatctgtgcctnatacgctaatatggtatacaaatcagtgca

SEQ ID NO: 23824 - DNA, 101 bp, rice(Oryza sativa)
  misc_feature (71): n=a or g
cgtccctaccagatcggcagctatttgccaagcaaatgcatgtttttccatcccagttcttagtgcacgcntccctaccagatcggcagctatttgccaag

SEQ ID NO: 23825 - DNA, 101 bp, rice(Oryza sativa)
  misc_feature (71): n=t or c
gtctattgagttctctgtatgaccatacaatatttgcttgcattgagctaagaattgtggtaatctcaagnaaattttcgtctttgtggtttatgtgttgc

SEQ ID NO: 23826 - DNA, 101 bp, rice(Oryza sativa)
  misc_feature (71): n=a or g
aggctgaagattaattagataaacagaggtggatacagcctcagcccaaaaatgtggtggaacatgagacncaattagaagagtacgagcagtctctatga

SEQ ID NO: 23827 - DNA, 101 bp, rice(Oryza sativa)
  misc_feature (71): n=a or g
cgattcgtgctccttgcttgccttcacggcaattcttacatatcacatctaccctatagttcaacaagttnttttactcattcatcgtgtgacacatccaa

SEQ ID NO: 23828 - DNA, 101 bp, rice(Oryza sativa)
  misc_feature (71): n=a or g
tgcctgctgggtaggactcgatagtcaacattatgttctctttcattcatttacagtttgccaaatgcctngtttcaaagagtgctagcattgtggtacat

SEQ ID NO: 23829 - DNA, 101 bp, rice(Oryza sativa)
  misc_feature (71): n=a or g
ctctctccccttgtcctctcctctttctctgctcatgctcctctgctcctgttgttggcgatgcttctctnctgctctctgattgggtcgacccgtctgca

SEQ ID NO: 23830 - DNA, 101 bp, rice(Oryza sativa)
  misc_feature (71): n=a or g
tcgaagattgctgaccttgaatatagggtatgcatgaggaggtggcaagaagggtggacgaacgacttgcntcacagcggagccaggagccctagccctac

SEQ ID NO: 23831 - DNA, 101 bp, rice(Oryza sativa)
  misc_feature (71): n=a or g
ctgccggtctgaccggcctatacatggcggtcaaaccggcccaaccagagaaaaaccggcagacttccaanctggtaattttccctattttatcccttggt

SEQ ID NO: 23832 - DNA, 101 bp, rice(Oryza sativa)
  misc_feature (71): n=a or c
tagataataattctagatgatcacctaagttaattctaagatttgaacaccgatgggtgatggctagagtnttggattttaaccctctgcgttttgacaac

SEQ ID NO: 23833 - DNA, 101 bp, rice(Oryza sativa)
  misc_feature (71): n=t or c
cattaagtaatttttgacagcttacaaattcaggccatggtgctttcaatcatgaacttaagacatttgcnggttggtctcttataaaaaaatatttgtcc

SEQ ID NO: 23834 - DNA, 101 bp, rice(Oryza sativa)
  misc_feature (71): n=t or c
ccactcaatcgaagcaagaactcccatgaagctggagattttgttttgggggaggggggggacaccttgangccgtggaggagggcggcgttgacccagca

SEQ ID NO: 23835 - DNA, 101 bp, rice(Oryza sativa)
  misc_feature (71): n=t or c
aatggcggttggcctcgtgcttgattggtcttttcgatctccgcgtgttctgcttggtttagtaccacctnggttgtctagcgagctgtgcaggaggggcg

SEQ ID NO: 23836 - DNA, 101 bp, rice(Oryza sativa)
  misc_feature (71): n=a or g
ttacttattttactctggtttgaatcgagtttagcttaatacatatacgtaagttttggatctaggaggtntatatatggtgaaaataaataaactacagc

SEQ ID NO: 23837 - DNA, 101 bp, rice(Oryza sativa)
  misc_feature (71): n=a or g
tgttgttcttcttttgtgttgactattagtttcatccattgagccctctccaaaggaagcttgctggtgcnggttcttcatcgccggaatcatctcctccg

SEQ ID NO: 23838 - DNA, 101 bp, rice(Oryza sativa)
  misc_feature (71): n=t or c
gaaaattactaaaccctacctaattaataaatagtattaaatcgtcacgccatggtcttcatggttcctanttgaactcgaactcttctagataagctttc

SEQ ID NO: 23839 - DNA, 101 bp, rice(Oryza sativa)
  misc_feature (71): n=a or g
tatagaggtgcgaatgtgcgactttataggctagttatagatgtaagttcaatgtgtatcgtatctgtcgngtttgtatagttttttttttaaccgagcta

SEQ ID NO: 23840 - DNA, 101 bp, rice(Oryza sativa)
  misc_feature (71): n=t or c
gcatgtgtgttcaatgtgatcgagtatgttttcagttgtgtttctgatgactcaggttttgtggggaaatngtgaaagcatgttcaaacaaatcgtagtaa

SEQ ID NO: 23841 - DNA, 101 bp, rice(Oryza sativa)
  misc_feature (71): n=a or c
tgacctgctttgtccgggcactccggcctctaccgaaggagaccgggagagttatcagcccgagcgcttcnaccgtatccccgctgaagcccctcaagggc

SEQ ID NO: 23842 - DNA, 101 bp, rice(Oryza sativa)
  misc_feature (71): n=t or g
gggtgccgcaagagaatactcagaagccgatgcctcggcggctgatttcttccccttttagacggcgagcngcgaaaccaccggtttgcgcacagggcttc

SEQ ID NO: 23843 - DNA, 101 bp, rice(Oryza sativa)
  misc_feature (71): n=a or g
tataataaataaaaacctttttcttttctatctttctcctttccccgttcccatcccatcccatatccttnccgtcaatccctcccaccacctttctctaa

SEQ ID NO: 23844 - DNA, 101 bp, rice(Oryza sativa)
  misc_feature (71): n=a or g
ggtgtcgtggaaagaacatacaacacttgcaccttttgtgttttgcaaggtttcactcaaggagagagccncgtaagcgatgctcgaagggcatggaaatc

SEQ ID NO: 23845 - DNA, 101 bp, rice(Oryza sativa)
  misc_feature (71): n=a or g
agtcaccttagttctgcaactcaaaacagtaggaaaactgcaaaagagaataaattgtgacggcttgttcnagagtttagatgatggaattgatagtgaga

SEQ ID NO: 23846 - DNA, 101 bp, rice(Oryza sativa)
  misc_feature (71): n=a or g
ctgatgattcttgatttcacacttctcttactagccgagacctcataattaagagtgatcttactttcgcngtttatggctgcaggtccatttgaaagagg

SEQ ID NO: 23847 - DNA, 101 bp, rice(Oryza sativa)
  misc_feature (71): n=t or c
cattatcccttttttctgaacttttgcttataaataattccttttctgattcaccaaatgcataggcttantagatgtatttatggtctgtgcttcaaaag

SEQ ID NO: 23848 - DNA, 101 bp, rice(Oryza sativa)
  misc_feature (71): n=t or g
tactcctagaatggaatgcacaagatgtctgaaaatttgcacgtgtgttgtggctctgaccatgtgaagcntaggctgtctatctaacgttctgaattaac

SEQ ID NO: 23849 - DNA, 101 bp, rice(Oryza sativa)
  misc_feature (71): n=t or c
cacttgtttttagtttcaaacgtttatatggggttacctttgatatccagagaatgtagagggctgcaagntcagattggacacatgcctcaccaaattca

SEQ ID NO: 23850 - DNA, 101 bp, rice(Oryza sativa)
  misc_feature (71): n=a or g
ccgcggcatacgcggtttccgatggcggtggaaattgactccgatgaacagtggtgggcctcaggtggagnagtaggcgatttgtgcggaaagaagcgatc

SEQ ID NO: 23851 - DNA, 101 bp, rice(Oryza sativa)
  misc_feature (71): n=t or c
cagcaatccttaattgaactctggacttggcaatggtccgtggttgtgatcaaaagaaccgagtttagtgnctctgggatcaatgctggctttgcattatt

SEQ ID NO: 23852 - DNA, 101 bp, rice(Oryza sativa)
  misc_feature (71): n=a or c
aacaaatctgtgaggatagagtggtgcggaatcacttcgactgcatactctggatatgtgtctcggatganttcgaggtaaacaggttaacaagagatgtt

SEQ ID NO: 23853 - DNA, 101 bp, rice(Oryza sativa)
  misc_feature (71): n=t or c
tactggaagaagagttgtcaccgatgtttgtctcaaaactgtagggttctcttgtgtacaacatgtgccanttcctttcatcgtctctttgatcagcatag

SEQ ID NO: 23854 - DNA, 101 bp, rice(Oryza sativa)
  misc_feature (71): n=t or c
cccaaccaaggtcaatgtctttcactataaatggagtaacacccaagacttcccgctccgcctccgccacngcctcgccctctgcctcgcgctctctcgcc

SEQ ID NO: 23855 - DNA, 101 bp, rice(Oryza sativa)
  misc_feature (71): n=t or c
ttccttccacttttttccttagcaggacacgcctaaactatcacctactgcatgtttctcgtcatcgctgnctcctccattgccaccagcccagcacgcca

SEQ ID NO: 23856 - DNA, 101 bp, rice(Oryza sativa)
  misc_feature (71): n=a or g
gaaacgacaaaaaagggaaaaaaaaggaaaactcgctactcccaatacggttagggatgaaaatggattgnaaatggatgaaaactagctccaccataaca

SEQ ID NO: 23857 - DNA, 101 bp, rice(Oryza sativa)
  misc_feature (71): n=t or g
cttgtagtgcaacattttgaaaactttgaccaaatccaaacatttttgttggaactgggtacctgtaacangaagatctagggggatcctagttggtttga

SEQ ID NO: 23858 - DNA, 101 bp, rice(Oryza sativa)
  misc_feature (71): n=a or c
acagaagctgccaagctccaatgatgcacaatgcctccagaaacaaggccaggcgcgttagaagaaaccanacaaggatattattaattagcatccggtga

SEQ ID NO: 23859 - DNA, 101 bp, rice(Oryza sativa)
  misc_feature (71): n=t or c
tcaacccctttactttaaatttgttgccgattggggtatatgtgagtgagaggcagagatatttctgctgnagtacgtaccaagtacaccctcatcccaaa

SEQ ID NO: 23860 - DNA, 101 bp, rice(Oryza sativa)
  misc_feature (71): n=a or g
tcaaatgatgattacctgtaagcaagcgaccacacacaagagttatgtcccactagcggtgaaacacaacnaccagaagatatatcccacatcatgattgt

SEQ ID NO: 23861 - DNA, 101 bp, rice(Oryza sativa)
  misc_feature (71): n=a or c
agcatatttgataactcatgtattgctgagtgcatctgtataataacaactctagttaaaaaactactccntccgtttcgaaatatttgacaccgttgact

SEQ ID NO: 23862 - DNA, 101 bp, rice(Oryza sativa)
  misc_feature (71): n=a or c
atataaggaacaagtagttttacgaaccgcaacaaatgtgtacattcatggacaaatgttttcccccggantgtgtgatggaattttcagtatattttgca

SEQ ID NO: 23863 - DNA, 101 bp, rice(Oryza sativa)
  misc_feature (71): n=t or c
atctttctctttctcacacacatttcgtcgaacatctagcgtgcgtgtgggatcttcttctctactccacncccgcgacatcgaacttcgtcgttcctcca

SEQ ID NO: 23864 - DNA, 101 bp, rice(Oryza sativa)
  misc_feature (71): n=t or c
tgtacaaaattgatatgatattttctttcaggtggtggaaagatgtttctggatatatgggtataaaccanattcgagaccgtgtgattgagtgctacacc

SEQ ID NO: 23865 - DNA, 101 bp, rice(Oryza sativa)
  misc_feature (71): n=t or c
gtgagaacgagtataaaattgtgttcttctttctccaccatacatgcatgcatgcaaataatgtagcccgnatagtatatatactagtatagtagtagtga

SEQ ID NO: 23866 - DNA, 101 bp, rice(Oryza sativa)
  misc_feature (71): n=a or g
taaatggaggaagtactacttatagtgtagtcacagtataactaggctgtaattacacccgagttacatcnatagtttttttgtttaaaatcgatcgatag

SEQ ID NO: 23867 - DNA, 101 bp, rice(Oryza sativa)
  misc_feature (71): n=t or c
cttgggagccttccccatccctctttcttccttgagctcggctcgccgctcgctgggcctgtgtcgtcgtngttgttcgcttctgcccgactaccgcgtgc

SEQ ID NO: 23868 - DNA, 101 bp, rice(Oryza sativa)
  misc_feature (71): n=t or g
ccaaggagaagacacattggtcccatgccttttaactcaaatgtaaagatccatagtgaccactactacantaagataaaacagtagcactattccatatc

SEQ ID NO: 23869 - DNA, 101 bp, rice(Oryza sativa)
  misc_feature (71): n=t or c
gtggctaaaacaggtaaaacgggagtatcaaggaggggcgcctgcagcgactgatgtctttctcttggatncggctagtgatggcctcctccgatggcggc

SEQ ID NO: 23870 - DNA, 101 bp, rice(Oryza sativa)
  misc_feature (71): n=t or g
cttctccaaccaccatcattgcagctacaatctcactcactcactgatcgatcgaggatggagagatcaantggacttcagtcgatgaacagtccagtctt

SEQ ID NO: 23871 - DNA, 101 bp, rice(Oryza sativa)
  misc_feature (71): n=a or g
gactggtttcgtggggaaacgagttggatggtgataggggaacttggctgggcctccggctaatgtctttnggtcgtgggctgaaaaggctgtaggccgtg

SEQ ID NO: 23872 - DNA, 101 bp, rice(Oryza sativa)
  misc_feature (71): n=t or c
tagtgaggaagcaggctttgtacatcttgagaatatcactagacatcttttcctcatctgaggataatggngctcagcaatgctccaggaggaggtccgcc

SEQ ID NO: 23873 - DNA, 101 bp, rice(Oryza sativa)
  misc_feature (71): n=t or g
catttgcagagtagcccccaggaatctcaacacttgctactcgtgcaacgcaaaggcttttaccgacgccnacacctgttgatgccctccccccaaaaagc

SEQ ID NO: 23874 - DNA, 101 bp, rice(Oryza sativa)
  misc_feature (71): n=a or c
aaattttggtagggtaacaatctaaacacataggttgaaacactattaatgctataaatttggttttgccnatgaacttgtctcttataagtatagtttgg

SEQ ID NO: 23875 - DNA, 101 bp, rice(Oryza sativa)
  misc_feature (71): n=t or c
gaagatacaaaatagtgggacctacatgttagtgggtggcactatgatccacatatcagtcggtgcgcgtngacgggggtgtgcagggtggtgctgggtac

SEQ ID NO: 23876 - DNA, 101 bp, rice(Oryza sativa)
  misc_feature (71): n=a or g
ttcggcttcagcctggtcgagagtcaacactgcaaaagtaaagggggtagctacattaaaggtcagacaangcaaaataacaaagcacaggagtgtatagc

SEQ ID NO: 23877 - DNA, 101 bp, rice(Oryza sativa)
  misc_feature (71): n=t or c
tattttacttttttaaagtatagtttaaactcggtcatattgctaaacaatattatcatggttacgaaccnatacatactagccataaacctaggttaatc

SEQ ID NO: 23878 - DNA, 101 bp, rice(Oryza sativa)
  misc_feature (71): n=a or c
tcagcccaacccatcagtacaacgagaatggccttcgcaaccacgcgcactatataacctacccacctcantcgccctctcccctctaaaccctacccgcc

SEQ ID NO: 23879 - DNA, 101 bp, rice(Oryza sativa)
  misc_feature (71): n=t or g
tctctcctccactccgctcccgtcgccgccacatcgccatggacgacgacgcctcctcctacacctactgntgccacagctgcgacagcttcgtccacccg

SEQ ID NO: 23880 - DNA, 101 bp, rice(Oryza sativa)
  misc_feature (71): n=t or c
atccaagagatttgctagctccatctgattttgaaccaccttttgtctttggagcaatagcaaaaagagantccaattctttcacatcaaattcagaatgg

SEQ ID NO: 23881 - DNA, 101 bp, rice(Oryza sativa)
  misc_feature (71): n=t or c
atataagttcaatgtaagttagacctatatatcagtcacatctgttacacatatagtactttcttcatttnataatataacgatcgggacataccgaggca

SEQ ID NO: 23882 - DNA, 101 bp, rice(Oryza sativa)
  misc_feature (71): n=a or g
cgcatctactgtccattaatctcacaaatctggcagtaatggccatgcagtctctctcaccatctcaacantactgcaactactgcacctgacggtgcatc

SEQ ID NO: 23883 - DNA, 101 bp, rice(Oryza sativa)
  misc_feature (71): n=t or g
gtaagcccgaacattaaatggaccgtaatccgtatgtagcatgcaactggcaagtatgttgggcttttagntggtctgggccgtacactagtccgacgcgt

SEQ ID NO: 23884 - DNA, 101 bp, rice(Oryza sativa)
  misc_feature (71): n=t or g
gccgtgccgcgtaattgaccagcttttatgaaataaatgaatgaaatgctctgataagtacacctaatatnttttacttcctccatttcacaacgtacttc

SEQ ID NO: 23885 - DNA, 101 bp, rice(Oryza sativa)
  misc_feature (71): n=t or c
atgtgagatgcttttcgtactttcatgatcaagattacacgcacactcgacatacacacattatgctaaanttctacactggaagctagcatctctcatcc

SEQ ID NO: 23886 - DNA, 101 bp, rice(Oryza sativa)
  misc_feature (71): n=t or c
tttatttctttggttttagcaataaaaccttcgaaaacttatttttagaatgtgaacctttttaccacgtnagtccttctgacatggcaaaagaacatgct

SEQ ID NO: 23887 - DNA, 101 bp, rice(Oryza sativa)
  misc_feature (71): n=a or g
tcccggttggaaagggttgcatcgtcgttggattctggggacgctgtggatggctcctcgatgccatcggngtctatgtcagtccccagagctaattaagc

SEQ ID NO: 23888 - DNA, 101 bp, rice(Oryza sativa)
  misc_feature (71): n=a or c
taaacagaataactatccgctcctagttacccctctccagtctccaaagcgtgtcgttttggacatatatntcatcaaacttttgaaactttgaatatcaa

SEQ ID NO: 23889 - DNA, 101 bp, rice(Oryza sativa)
  misc_feature (71): n=t or c
tagcgatcgagcacggatacagagcaattaattagactattttttccctgcccgaattccgaaaggcaacnaacttgtcttcaggctgatggcatttagca

SEQ ID NO: 23890 - DNA, 101 bp, rice(Oryza sativa)
  misc_feature (71): n=a or g
agttggcacagatttgtgctcagcaatgtgattacattgataaacaaaaaaactcaacatacaatgtaaancataaagttaatatgtgaatgtcagtactg

SEQ ID NO: 23891 - DNA, 101 bp, rice(Oryza sativa)
  misc_feature (71): n=t or c
ttcctttcaggcacggcgagcgcattggcttcagttatcttgtttcccagaaatatactggcgagaaggcnctagttaaagtcctgcgcaattcgaaagtc

SEQ ID NO: 23892 - DNA, 101 bp, rice(Oryza sativa)
  misc_feature (71): n=a or g
aattttgtgatgttcaataatttcatggaacaatgcaatttgtgatgttatggaccaaagcagttgcatcntattctatttgatgtaaatactctgttatg

SEQ ID NO: 23893 - DNA, 101 bp, rice(Oryza sativa)
  misc_feature (71): n=a or g
aaacggaagccttcgcggcaaagcaagaactacgaagcctctagatcgccggatcgatcgatccatcgcanccgtcggatcggatcggacgtgtccccctc

SEQ ID NO: 23894 - DNA, 101 bp, rice(Oryza sativa)
  misc_feature (71): n=a or g
ttcgcactcactttgattctcccatccgcgtgtttcgtgctaattccgctggtgagtacctttctagaganttgcgtgtttttctttccaagcagggtact

SEQ ID NO: 23895 - DNA, 101 bp, rice(Oryza sativa)
  misc_feature (71): n=a or g
gaatcatggtgatgaagccacgaagtaaaccgtaaccagatctgacgtggctaatgaggaagggaagcatnaaatgacaaccactatataataatgatgag

SEQ ID NO: 23896 - DNA, 101 bp, rice(Oryza sativa)
  misc_feature (71): n=a or g
caacatgtgaaacaatatagtgcaataccatgtgatgttctatgaaatatcctacatccaattttgtagtncttcccttatttatactccctccatctatt

SEQ ID NO: 23897 - DNA, 101 bp, rice(Oryza sativa)
  misc_feature (71): n=t or c
acaaatgcagctatggaaaaccatcctaggtacctttagtaacagtaacataagcagtgacaaatgctgcnaggggattagtaccacttactatcagtaac

SEQ ID NO: 23898 - DNA, 101 bp, rice(Oryza sativa)
  misc_feature (71): n=t or c
gcgatgcctggataatcttggattctttgctggtattctgttgtgcgaaatgagaaatactgcgtctctantagctgcagctactatatagcatctactgc

SEQ ID NO: 23899 - DNA, 101 bp, rice(Oryza sativa)
  misc_feature (71): n=a or g
tgatgcatgcacatgtagattaattggagcatatcttgattcaataatataggcatatccacgcaaccctnatgcacattcgctaaagtgtgtctaataat

SEQ ID NO: 23900 - DNA, 101 bp, rice(Oryza sativa)
  misc_feature (71): n=t or c
agaagaaggataacagtggaggaagaagcgaaaagaagggaaaaaatgagaaaatgaaaattttggttctntccattcttaaatataaggcgcaactatca

SEQ ID NO: 23901 - DNA, 101 bp, rice(Oryza sativa)
  misc_feature (71): n=a or g
gacgccagtggggtatacggcggcggcaggatcgggatgaagccgcggtgatgagagcaagtttaatagtntagccaactactagcttaaaatcatctata

SEQ ID NO: 23902 - DNA, 101 bp, rice(Oryza sativa)
  misc_feature (71): n=t or c
atcgtgcacccctcacctcctccccatccttttctccttttttttatgagagatttgataatttatcactnatttaagtgggttttgattatttgacatcc

SEQ ID NO: 23903 - DNA, 101 bp, rice(Oryza sativa)
  misc_feature (71): n=t or c
gggacaattgtcatgaacaatcttattcaggtaagcaaaattttccgacaacgaaaaccgctcccggcatngagaaaggggaaaattctgatctattcaga

SEQ ID NO: 23904 - DNA, 101 bp, rice(Oryza sativa)
  misc_feature (71): n=t or c
aaacaaaaaaaaaacagggctcaaagtgattcaatgaaaaagtgaaggggagtaaattggaccctttcttnttcttttttgaaagttagaaatgatgctat

SEQ ID NO: 23905 - DNA, 101 bp, rice(Oryza sativa)
  misc_feature (71): n=t or c
aaattcgtagttgataataatgtattaattaatggtcaaagtaaagtattggagaccgcgtaaaatgctantgtttttaaccgagaataacaaacattttc

SEQ ID NO: 23906 - DNA, 101 bp, rice(Oryza sativa)
  misc_feature (71): n=t or c
ccgctggtggcgcatgccgccaccactcaagacctgctggacgacctcctctctgactctttgagttcgcngacatcttcgccacgcccaccggcctgccc

SEQ ID NO: 23907 - DNA, 101 bp, rice(Oryza sativa)
  misc_feature (71): n=a or g
tgcgtccggctccggccggaagaggcagctggtgctggagtccagcgattcggaggcggatgagttctttntctcgacgcggcgcaaggaggatgatgatg

SEQ ID NO: 23908 - DNA, 101 bp, rice(Oryza sativa)
  misc_feature (71): n=t or c
atgtcccaaaacacatattctttctcagtggtagggtgtctcaccaagcacacatcttcgttctcaacganagagtgttgcaccgagctcaacattctcat

SEQ ID NO: 23909 - DNA, 101 bp, rice(Oryza sativa)
  misc_feature (71): n=a or g
tcaatatcctgaactaaattgtgtctaactaatgcagcccatcaaaagtagcatcggtttggtacctcagnccagagtactacaccaaagaaaccttatca

SEQ ID NO: 23910 - DNA, 101 bp, rice(Oryza sativa)
  misc_feature (71): n=a or g
attttagtcattcttctagaaacttccttttccaatccatccaaccaaatatgggataaaattttccttcntataaactaccaccacatcctaccaggata

SEQ ID NO: 23911 - DNA, 101 bp, rice(Oryza sativa)
  misc_feature (71): n=t or g
tgggacttggtggttaaagtggatttgcatgatattttccaataaagtaaggtctaggtaagatcattaanattggtctactcactctctccatgcttctc

SEQ ID NO: 23912 - DNA, 101 bp, rice(Oryza sativa)
  misc_feature (71): n=a or c
gaggggttgtcgggtggcgtaatgacgtgggggaaggaggtagaagaaaagaacaaaggagatatggagtnctgaagaggcggacccattattttagaaac

SEQ ID NO: 23913 - DNA, 101 bp, rice(Oryza sativa)
  misc_feature (71): n=a or g
ccttatattatgggacggagggagtactatgggttcattcaacaatcaaattataaaaaaaaaatctaacnatcctgtcgtccataggctacctccatcca

SEQ ID NO: 23914 - DNA, 101 bp, rice(Oryza sativa)
  misc_feature (71): n=a or g
aagctcccaaatgtcttgtattatccgtagtatgacttattctcccctattgcgtccaacgcctccacacnaactccactattctaacctgcgcttttctt

SEQ ID NO: 23915 - DNA, 101 bp, rice(Oryza sativa)
  misc_feature (71): n=a or g
atctcatagggcagccacaatgtggcagtaaaaagagatcataaggtcttacggtgaccatatacattgtngaggtaagctatgatatattaaatgcaaaa

SEQ ID NO: 23916 - DNA, 101 bp, rice(Oryza sativa)
  misc_feature (71): n=a or g
tctttgaacacaacagccttgctgacaactcacacccgtgctgtgcaaacgtggaagaatcagaaaacggnaattcgtttccgacacgtctacctgccggt

SEQ ID NO: 23917 - DNA, 101 bp, rice(Oryza sativa)
  misc_feature (71): n=t or c
atatgactgtattgcccttccttcactcatctaaatctggcccaaattttctcgttttttcctctttggcngacatgggcacatcgctccatcgatgggga

SEQ ID NO: 23918 - DNA, 101 bp, rice(Oryza sativa)
  misc_feature (71): n=a or g
catattatattatatatatatatatatatacacacacaggtacaatgggcatcaaaataaccaggatattnttgtgaatttggctctggtcgcacgccccg

SEQ ID NO: 23919 - DNA, 101 bp, rice(Oryza sativa)
  misc_feature (71): n=a or g
aaactttagagctgaacttttatatttcttctcttcgatagacatttgaaattagggctggttggtttgangcctaaattaggcttactaatatttggcaa

SEQ ID NO: 23920 - DNA, 101 bp, rice(Oryza sativa)
  misc_feature (71): n=t or g
ggtttaacgggttatccactcgggcatcctgcacggcactgtgttgtgttagctgcgaaagcggattatcngttttccgccttcgcgtgacgtttacgtat

SEQ ID NO: 23921 - DNA, 101 bp, rice(Oryza sativa)
  misc_feature (71): n=t or c
gaaagttcatctgaagcactaacaggcttgcaccaaacacaattgagcaaagggtcaaacatataagagantctagaatgcaagagttggatgagatggaa

SEQ ID NO: 23922 - DNA, 101 bp, rice(Oryza sativa)
  misc_feature (71): n=a or g
caactgatcccgatcacaaaatcatcacaggaacatcgcattaattcaccccagaaattgaataaaaaganaagtacactaagccgccgccgcgcaccgga

SEQ ID NO: 23923 - DNA, 101 bp, rice(Oryza sativa)
  misc_feature (71): n=a or g
ttcgcaaagtaaatttccacaaaataaaggagacaagtgacaaaagatttttttcacccgatgttcggaancttgccaacttcctacgtcaccgttgaggc

SEQ ID NO: 23924 - DNA, 101 bp, rice(Oryza sativa)
  misc_feature (71): n=a or c
tatagttggcttatagcctacaagtatacttgctcttagagcaggatctcgttgtgccgtgcaggcaccangtcgctgcccagcaccttcttgctcacaga

SEQ ID NO: 23925 - DNA, 101 bp, rice(Oryza sativa)
  misc_feature (71): n=t or c
gggaaggacccttgggatggtgtcccaactcccagaaaaagatgagacaagcttctcacggaaacagatgntggcatggctggatgtctccatggcaggac

SEQ ID NO: 23926 - DNA, 101 bp, rice(Oryza sativa)
  misc_feature (71): n=a or c
ccaggccacaatgctagtgctctcctggaagaaagaaaaaaacggccgagtcataagcatcaacagcagcnctgctccttggaccatcgccaaccaaattg

SEQ ID NO: 23927 - DNA, 101 bp, rice(Oryza sativa)
  misc_feature (71): n=a or c
gttgaatgcttgcttgttccttcgctagctctgctgtaatggagtggagcaaagttcaatctttgggtacnatattttcatttgttgggaggatagcaagg

SEQ ID NO: 23928 - DNA, 101 bp, rice(Oryza sativa)
  misc_feature (71): n=t or c
catacttgaattttaatatagaatatacctatatttgattaatgcctaatggatatataaacaactctcangcagtgttgatagtggaatcaactctctgg

SEQ ID NO: 23929 - DNA, 101 bp, rice(Oryza sativa)
  misc_feature (71): n=t or c
ttttatttgagatagtagtatggatatttatatatatgtatttttatccttcgagaatatccgcttgttgnttacataccattaaatagttattaaaaatt

SEQ ID NO: 23930 - DNA, 101 bp, rice(Oryza sativa)
  misc_feature (71): n=t or c
gcacttgtgctagtgttaactgttaagtaatactccctccatccagtggcggagctagaattttctcaaanctagggctaaattagttaaatgtatataac

SEQ ID NO: 23931 - DNA, 101 bp, rice(Oryza sativa)
  misc_feature (71): n=t or c
gtttgtactctctttcaaaacttgaacaggctgacttactacaattacatggacctgaggaggtcaagaanatgaaacagatgagggtaaggatcgcactt

SEQ ID NO: 23932 - DNA, 101 bp, rice(Oryza sativa)
  misc_feature (71): n=t or c
tgctctcccgcgtcgtaactcgagtgttttgggggatgggatcgacgagagggaagagggaggatgggacnccatgcgtcgcagcttggtttctcctgcgg

SEQ ID NO: 23933 - DNA, 101 bp, rice(Oryza sativa)
  misc_feature (71): n=t or g
atcagtgaaaaacaaaaggggttaaaatgctgctgtgctaacggtataggagtattttgaagtactaatanaatttatacgctttatatgtgagaaatgat

SEQ ID NO: 23934 - DNA, 101 bp, rice(Oryza sativa)
  misc_feature (71): n=t or c
tccacatgagtataaatactttaaccaaactctcgccagttaatatctaaaatagagtatcacaaaattangggtgtgtttagttcacgccaaaattgaaa

SEQ ID NO: 23935 - DNA, 101 bp, rice(Oryza sativa)
  misc_feature (71): n=a or g
agttaatcatcaacctgatacaagataataaaactcgctttccttgatttttcaacaacggatttgctacntttatgtcgctataaatttccgttgattac

SEQ ID NO: 23936 - DNA, 101 bp, rice(Oryza sativa)
  misc_feature (71): n=t or c
aaaatttggcgaaaattactagacaatacggttatcagcaaaacagtcaaaaaaaaaaatctttatcccanttccgatactattttcggaagatatttcct

SEQ ID NO: 23937 - DNA, 101 bp, rice(Oryza sativa)
  misc_feature (71): n=a or c
ggagctgcaggtttcaagataaaacagcaccgatatgaactgcactgtgttacctctcaatcattgtatcnttgccgcagccacagatcacgtcgaagagc

SEQ ID NO: 23938 - DNA, 101 bp, rice(Oryza sativa)
  misc_feature (71): n=t or c
tacgactactccgggtctccagcataggcagctactaccgtactaacaaaccgtatcactccctccgtccnaaaataagtgtagttttgtattatttatgt

SEQ ID NO: 23939 - DNA, 101 bp, rice(Oryza sativa)
  misc_feature (71): n=t or c
tgctcaaaaaaacatttcaagttatcttacaggagcaaacaaaacaaagtactctcaatagccatcaatgnggatttgatcaacatggattatataagtct

SEQ ID NO: 23940 - DNA, 101 bp, rice(Oryza sativa)
  misc_feature (71): n=t or g
tgccagccggccggtcaagtatcactactaatgtctagagctagtatagctagtcgccagcatgcatcttntactcccttcgtccaaaaaaaaaagacaaa

SEQ ID NO: 23941 - DNA, 101 bp, rice(Oryza sativa)
  misc_feature (71): n=t or c
cccatgaaatgaattgcatatcctgatatccacccaactgtagcagctttatgtcactggtggagaagtgntttttagtcccggttcgtaacccccctaca

SEQ ID NO: 23942 - DNA, 101 bp, rice(Oryza sativa)
  misc_feature (71): n=t or c
acaacttctccaacaacattctcttcctaaccaatcacaacctccgccatttacttttactacctacctcnactactcatccaatcacaaccctccaccac

SEQ ID NO: 23943 - DNA, 101 bp, rice(Oryza sativa)
  misc_feature (71): n=t or c
tgaataaaatgacaataaagtatacgaaaataatagtgaatacaacagcaaaaaccacaacgatacagcangaactagtaagcgtccaagctgcctccact

SEQ ID NO: 23944 - DNA, 101 bp, rice(Oryza sativa)
  misc_feature (71): n=t or c
aatcaactattttcgcaggtacgcctgcaaaaacctctttagtccgcatgaaaaaaaaagtgttttctagnagtggttcgagaaaaaataaaggtttccta

SEQ ID NO: 23945 - DNA, 101 bp, rice(Oryza sativa)
  misc_feature (71): n=a or g
cagtggagattttatatggcccgcctttttagtttttgaaaaccaattttacccaatctcttggtgaaagnaaaattttaacaccataaattctgtttagg

SEQ ID NO: 23946 - DNA, 101 bp, rice(Oryza sativa)
  misc_feature (71): n=a or g
ggtacctgctggtaccgtggtacctgctggatgggagcaatgctctaacttaaaagattttatagagtgtntctttttttaacctctttaatacttcctcc

SEQ ID NO: 23947 - DNA, 101 bp, rice(Oryza sativa)
  misc_feature (71): n=a or c
aagtctcaatcacactctagcctctgttagattatgaagacaggaagaggtgatggcgagagagtggaggnagaggtgatggcgagagagtgggggcaggg

SEQ ID NO: 23948 - DNA, 101 bp, rice(Oryza sativa)
  misc_feature (71): n=a or g
gcagtccataaagtaaaaaatgagttcgtggatttctactgatgtgattcctgttgagaattcagatttanaggtactctccataaggtaaataatgagtt

SEQ ID NO: 23949 - DNA, 101 bp, rice(Oryza sativa)
  misc_feature (71): n=a or c
ggtgagcatttcaatggttatgctcagagactggaaacttgactatcctctgcaatttaagtgggttttgntgtttcattacttcctccgtttcacaatgt

SEQ ID NO: 23950 - DNA, 101 bp, rice(Oryza sativa)
  misc_feature (71): n=t or c
tcagtgagaggagcgtagaaacctactagatctacatcttaagaatgtaaacaaaggttggcttttgaccnggccctatcctgggtcccaggctcacctct

SEQ ID NO: 23951 - DNA, 101 bp, rice(Oryza sativa)
  misc_feature (71): n=t or g
agaggcggcccgagagaaagagaggaagggagaagcaagccagggaggacggatggactttcggccagaancggcctaaagtgaaggggaaaattttaatt

SEQ ID NO: 23952 - DNA, 101 bp, rice(Oryza sativa)
  misc_feature (71): n=t or g
cccctctaaatttctactaccgctaactaggatgacagtagaaagcaacatgaacccttcgatcaaatganatcaacggttcagattattttctacaacta

SEQ ID NO: 23953 - DNA, 101 bp, rice(Oryza sativa)
  misc_feature (71): n=a or g
tttcttagtcaattttctaatttcttgaactcactttatgtgggactggacatctaaaccaggggtaaacngattattcagttcgagaaaattaagggtaa

SEQ ID NO: 23954 - DNA, 101 bp, rice(Oryza sativa)
  misc_feature (71): n=a or g
cgaaagaacaaacccatcaagcaacaccagcccaccccccaaagatcctagcacaagaaccctaatccgcncacggaacagcatgaaacgggcaccgatca

SEQ ID NO: 23955 - DNA, 101 bp, rice(Oryza sativa)
  misc_feature (71): n=a or c
aaaaatatttgttgtaaaaactggtcttaagtgaaaaaattgttcgtcgagtcggtgatccaagatataanttgggtaagaatatcaagaccaatgtacaa

SEQ ID NO: 23956 - DNA, 101 bp, rice(Oryza sativa)
  misc_feature (71): n=a or g
gtattgtatccggttcggtttccgtaatcctatcccaattctgtatctataagtcggttatagagataagnatgtaccgtccctatatgtacttgtgtccg

SEQ ID NO: 23957 - DNA, 101 bp, rice(Oryza sativa)
  misc_feature (71): n=a or g
agggagagatcacactaagcttccccttttcgggtttgcagcccagctcgtgaggcaaggtcacgctgctnctgtaggatcgtaaatgatctttcccacct

SEQ ID NO: 23958 - DNA, 101 bp, rice(Oryza sativa)
  misc_feature (71): n=a or g
tgttttgatgaatgccattactcaggttttctgattatcctttttagatagagttgtttgattaatgtctntggtcaatgccctaggccgtgtttagtttt

SEQ ID NO: 23959 - DNA, 101 bp, rice(Oryza sativa)
  misc_feature (71): n=t or c
tgccagtcacaggcactaggcaaagtactagaacgatatatacagttatacacaaagcaaggttgttaagngctgaggataaaattatatgtttatattgt

SEQ ID NO: 23960 - DNA, 101 bp, rice(Oryza sativa)
  misc_feature (71): n=t or c
cttctaggcatcccactctatttctctctctgccatgtggggcccagcccgcacagcattgccacctcctnctccaactccaggaacggctgccacgtcgc

SEQ ID NO: 23961 - DNA, 101 bp, rice(Oryza sativa)
  misc_feature (71): n=t or c
ataactgtatctgaattaatccaatcaggtggaacccagctgctgtcgtcttcaactcatggaaacagtanggaagtcctagttactggatgcagacaatt

SEQ ID NO: 23962 - DNA, 101 bp, rice(Oryza sativa)
  misc_feature (71): n=t or c
gctgtattgccgtcttgattagggccttcaccttgaaccccctgagtaccatcaccatgaactctaaacgngttgatgaagcctaggggggtgaacaggct

SEQ ID NO: 23963 - DNA, 101 bp, rice(Oryza sativa)
  misc_feature (71): n=a or g
cggacttccagccattgtatgctttaaccaagtctacatttaaatattctatgtcaatatcggccgattgnttggttcattggacatctgcttcatcatat

SEQ ID NO: 23964 - DNA, 101 bp, rice(Oryza sativa)
  misc_feature (71): n=a or g
cagtgaatgctgcttaattcaaagtttcttgggtcagagttgcagaacttctgaacttttgagtgtcaccntctccggaaaaaatctgctaggagtaatcc

SEQ ID NO: 23965 - DNA, 101 bp, rice(Oryza sativa)
  misc_feature (71): n=t or c
tccatcctgctgcgcttttatggttgtcttgtcagaacatagacatggccatagttctccgagaatttgangttaacttgtttacttccggaaaagctata

SEQ ID NO: 23966 - DNA, 101 bp, rice(Oryza sativa)
  misc_feature (71): n=a or g
ctttccacatgcatttttgttcaacccaaatgcttcactactgaaattgaggttggggtggcatctccacnaacttagaaaggaacgagacacacaggcag

SEQ ID NO: 23967 - DNA, 101 bp, rice(Oryza sativa)
  misc_feature (71): n=t or g
ttatgtactgtataactgttgctttgactggtgtccctaatctttgacgacaaatcagggctatttgattngaagaaaaaaacatataaattttgaaggat

SEQ ID NO: 23968 - DNA, 101 bp, rice(Oryza sativa)
  misc_feature (71): n=a or g
acaaccacccttccctagaggttggtaccacaccctccatattccctgtccacgcccttcctaataagctnttggagggatgcaggtcgtctgcagtacta

SEQ ID NO: 23969 - DNA, 101 bp, rice(Oryza sativa)
  misc_feature (71): n=a or g
gaaaaaaaaactttgtgattttatcagtttcattctgaatttctgacaagacatgctaacttaaaaaaagnaagtggaggtgcggggaatcgaaccccgtg

SEQ ID NO: 23970 - DNA, 101 bp, rice(Oryza sativa)
  misc_feature (71): n=t or c
aggagacaagcacaatagcactgttttttttgaacgcagagcacaatagcacttttaactctttaaactantactgcatatatttttactcctttcatctg

SEQ ID NO: 23971 - DNA, 101 bp, rice(Oryza sativa)
  misc_feature (71): n=t or c
tatgcaaatgaaattgtgaatgagacgtgttatttattagagaaaatgccagaaataccattgacaaatgnccaagtccaagaaataccattgaagagtgc

SEQ ID NO: 23972 - DNA, 101 bp, rice(Oryza sativa)
  misc_feature (71): n=t or c
tgtaacaaatggaagagactaaaaacaaactttttatggaatagaaagagtaagttatgggagcgttcggnatgccagctgcaacggctacagctgcgact

SEQ ID NO: 23973 - DNA, 101 bp, rice(Oryza sativa)
  misc_feature (71): n=a or g
cttgacccatataggccagtacaagcgctgggtaaaccaatagtgtgaaagccatctgttggcaatagcanaaaagaaggggtggtcaggatttttattta

SEQ ID NO: 23974 - DNA, 101 bp, rice(Oryza sativa)
  misc_feature (71): n=t or c
gcgttcttgattcgatcggctacgtaccagtggtcatgagagctgatctgatcatggacggcgaccagccngggtgcgccgacttgacgaaggcggcggcg

SEQ ID NO: 23975 - DNA, 101 bp, rice(Oryza sativa)
  misc_feature (71): n=t or c
ctgaaatcactagtatacacgtaagtacaacatcacagaacgtacatagacttgtatatagtacaaaattnttttttactgcaagtttgtaaccttcagtt

SEQ ID NO: 23976 - DNA, 101 bp, rice(Oryza sativa)
  misc_feature (71): n=t or c
tttatactcttggatgccactctggatctactcaaatcagagtgtcgcattactcatcctcctaaaaaaanaggactgttatattgacatgcatgactaaa

SEQ ID NO: 23977 - DNA, 101 bp, rice(Oryza sativa)
  misc_feature (71): n=a or g
catggagtactacgttgatctcgagggctgtcaccaccactacagcaacctctgacatgctgtgggatacntagcaaacactggtaattaactacctagac

SEQ ID NO: 23978 - DNA, 101 bp, rice(Oryza sativa)
  misc_feature (71): n=a or c
ggcgatagaagatgaagatgtaggtgttcatcccgtggttgaaagcagccttggatatcacaaacataccngtgtagatcagttggacgacgatggcaata

SEQ ID NO: 23979 - DNA, 101 bp, rice(Oryza sativa)
  misc_feature (71): n=t or c
gactataaagatccaaccatgggagatatggttaattcttctgaacttgttgcctgtgcaggagaatctangaaagtaagacatgatgaaagtggtattga

SEQ ID NO: 23980 - DNA, 101 bp, rice(Oryza sativa)
  misc_feature (71): n=t or g
aaataccggctttatgcaaataatctatagcctaccttggaataccttgcatcatacctcctcttggtatnacttgctaagtacagtgggaagtactcagt

SEQ ID NO: 23981 - DNA, 101 bp, rice(Oryza sativa)
  misc_feature (71): n=a or g
acgaagagggttctcgttcctgattctcaggtttcggataaaagcagaacctctgcacttctcatctacanctgaattttgtatgatggtggttctctagt

SEQ ID NO: 23982 - DNA, 101 bp, rice(Oryza sativa)
  misc_feature (71): n=a or g
cagttttgtatgccattggggatatcaaaatggtgtactagattgtaacttgttatccggagagttggtanctcgtttccggttggtgtacagtacttgtc

SEQ ID NO: 23983 - DNA, 101 bp, rice(Oryza sativa)
  misc_feature (71): n=t or c
attctcttattaaccaataacaatctcgcaccatttaacttcacctagtttcttcctcaaccaattataanattatcctatttaattccatctactttctt

SEQ ID NO: 23984 - DNA, 101 bp, rice(Oryza sativa)
  misc_feature (71): n=a or g
caacacaaatccagaaaacctgttcggatgtttgtatcaacaagtagaagagtaattctctgagaagtgcncttttgcactaaccttcttttgacctaatc

SEQ ID NO: 23985 - DNA, 101 bp, rice(Oryza sativa)
  misc_feature (71): n=t or g
catgatagtgagaccggtgtggtagtattattttgccacgctagttcgactggcatggccaaaaagattanatcttgaaaataagtttggaagggtttatt

SEQ ID NO: 23986 - DNA, 101 bp, rice(Oryza sativa)
  misc_feature (71): n=a or c
atgaacgcatcatatctggtattgcggttcagggacaaattttagaccccgacgacaaaccgagggacctnaagtgaacttactcggaagcaaaataggcc

SEQ ID NO: 23987 - DNA, 101 bp, rice(Oryza sativa)
  misc_feature (71): n=t or g
cccagtcggaaatttttttttttgaaataaggtaaaatgcattacccggctttggggagaaagccaaacancaacatacagaatcttaaacagaaaggaaa

SEQ ID NO: 23988 - DNA, 101 bp, rice(Oryza sativa)
  misc_feature (71): n=t or c
cgtgtcgataaagaggtcatcatcacagcgccgcccactcgagtcctcttcctccgccgccctctactacngtagttgccactgctgtcttcccccttctg

SEQ ID NO: 23989 - DNA, 101 bp, rice(Oryza sativa)
  misc_feature (71): n=a or g
aaattgaacaaatatattacaatgatatagatcattatatacggacacataattagctaggttttctctgnagtgattttacatttcttgaggaggtaacg

SEQ ID NO: 23990 - DNA, 101 bp, rice(Oryza sativa)
  misc_feature (71): n=t or c
attaacaccaagtagatataaattaccaaaagaataacagctttggagcaacacttcagaagaaacacaangtaaagaaattgattcttgtttttaccagg

SEQ ID NO: 23991 - DNA, 101 bp, rice(Oryza sativa)
  misc_feature (71): n=a or g
gacctatatgtccaatagatggtaagactctataaccaggctaacacttgaaagcagacatgagaaacctnttattccaataacataccgttaagtacgcc

SEQ ID NO: 23992 - DNA, 101 bp, rice(Oryza sativa)
  misc_feature (71): n=t or c
tgatttgagaaagcaaaatataggtagaaccttttttatggcccgctggtagaaatgaaactatgtagttntatgaaaggaaaaagtttatttttactctt

SEQ ID NO: 23993 - DNA, 101 bp, rice(Oryza sativa)
  misc_feature (71): n=a or g
atatcatctataatttattgaatcttacaaaataacacgcaaagcatattcaattatcgcctctcacatcntttccgtaatttttaacatatttatccatc

SEQ ID NO: 23994 - DNA, 101 bp, rice(Oryza sativa)
  misc_feature (71): n=t or c
ggggaacagatcacgagggaggtggcgcaaaagagagagcagtgatgcgtccactgtatgcttgcatgccngcatgccatgagctagccacgagacagacg

SEQ ID NO: 23995 - DNA, 101 bp, rice(Oryza sativa)
  misc_feature (71): n=t or c
atcatactattattatgttggtatttgtttggaagtaagagttaataaggagaaaaagaaagatttaagtnaaaattttaatatatatgtccaaagtgaat

SEQ ID NO: 23996 - DNA, 101 bp, rice(Oryza sativa)
  misc_feature (71): n=t or c
gggtggcccttctccggtgtgaaagtgaggtcgagggttgaggcagtgacattgacggagaattcgcggangaggtagtcgaagttgagggcgagggcggt

SEQ ID NO: 23997 - DNA, 101 bp, rice(Oryza sativa)
  misc_feature (71): n=t or c
gccatcgctttccgatcggacggctcggaacacaccaggagtcgcccagagccccagactgatccaccacnacccgcggcgtacgctccacgacacgagcc

SEQ ID NO: 23998 - DNA, 101 bp, rice(Oryza sativa)
  misc_feature (71): n=a or g
cccctctgttggcagtgagaagtccaatgtgactttattaatatcaaaacataggtagtactccctccggnttgataatacttatcgttttgacaaaggca

SEQ ID NO: 23999 - DNA, 101 bp, rice(Oryza sativa)
  misc_feature (71): n=t or c
taaatttccctgactgggaaatcatgtggataacattggttaggacctttcagaatatatgcacgccgaantgcatcttgttcattaacatcatagctcgt

SEQ ID NO: 24000 - DNA, 101 bp, rice(Oryza sativa)
  misc_feature (71): n=t or c
taaacgaccgtaaattgtccacaaaatcatgactagcaaggctttgtaatagacgccaaactctacgaaantaggttacaaagtgggtatgccaaaattgt

SEQ ID NO: 24001 - DNA, 101 bp, rice(Oryza sativa)
  misc_feature (71): n=a or g
tcgccgcctccaccacgccaacgagagaagcagagaagggaagggaaaaaatgcagagctcgagcgtgcgnccgtccatcctcgccgacccttccgtctgc

SEQ ID NO: 24002 - DNA, 101 bp, rice(Oryza sativa)
  misc_feature (71): n=t or c
atgcatttgattgttgcataggtcacagttgctaacgagaggaaaagagtagattgggaagataataaaanaagcaggccgtcccgtagaattagggggcc

SEQ ID NO: 24003 - DNA, 101 bp, rice(Oryza sativa)
  misc_feature (71): n=t or c
gaccaccaggcgccggtgcataccctgctcttgtattatatttgtgctgggctctaggcacacactgttcntcgggagctcaaaaaaaacgagctccagcc

SEQ ID NO: 24004 - DNA, 101 bp, rice(Oryza sativa)
  misc_feature (71): n=t or c
gttgattgtcgtgttagatgtcgagagattgcagtaaccgactggtcaagtactagtagtaggcgtatctngatcacgcgaagatgaatttttagatgatg

SEQ ID NO: 24005 - DNA, 101 bp, rice(Oryza sativa)
  misc_feature (71): n=t or c
ttttggataaagggagcaggactcaggtccattctaaaaagagtcacttatccaatttcgttgattctttntggatgaagggagcagtacttaggctgagt

SEQ ID NO: 24006 - DNA, 101 bp, rice(Oryza sativa)
  misc_feature (71): n=t or c
atttttgcattatgatggggattagaagaaacaccttccctgctttcctttttccgcccaaatatagctgngcaatgcttaattttttaacctaattttca

SEQ ID NO: 24007 - DNA, 101 bp, rice(Oryza sativa)
  misc_feature (71): n=t or c
gtgttggcatgtggccatggagaagtgattgggaggaagaagaaagggaggaatgagtgagagactgacangtgggtcccactatcatagacttttaacgg

SEQ ID NO: 24008 - DNA, 101 bp, rice(Oryza sativa)
  misc_feature (71): n=t or g
tggccggccacctcgtcctccccaagcgctataactcctcaccttcctcgatccttctcctcacgcacttnatctccttctcctcctctcctccctctcat

SEQ ID NO: 24009 - DNA, 101 bp, rice(Oryza sativa)
  misc_feature (71): n=a or c
agtttgccaatcctaaagagtagaaaaaccataaaaaagaatgggaaatgaatgtcaagctataagaaagnaaatttgcttttaaaataaatagaaatgaa

SEQ ID NO: 24010 - DNA, 101 bp, rice(Oryza sativa)
  misc_feature (71): n=t or c
gctgccttgccaacaacggcagcgacagcggtggcagcgtcggagctgtatgcgagctagacttggtaggnaggggcaaaatcgttttttggaagagaaca

SEQ ID NO: 24011 - DNA, 101 bp, rice(Oryza sativa)
  misc_feature (71): n=t or c
agtacgtacacaagcattaccgtgagatctgatttttcattcccgtcggacgtctaatgtgtagctctctncaagttgtaccgatatattagagatagcta

SEQ ID NO: 24012 - DNA, 101 bp, rice(Oryza sativa)
  misc_feature (71): n=t or c
ccattttgccctttctgtttggtccatcatctaaacaacatctggacttcctccaccatattgtgtagcgnatatgtttgggagctggcttgatggaattc

SEQ ID NO: 24013 - DNA, 101 bp, rice(Oryza sativa)
  misc_feature (71): n=a or c
tagctaaagtcgaacacaaactctcctttttttgcatgctgcatggtaggtatttatggaactggccacangtgttcatcagcaatgcactaaccgcgcac

SEQ ID NO: 24014 - DNA, 101 bp, rice(Oryza sativa)
  misc_feature (71): n=a or c
cttttcaagaataccagatttagtatctctaaccattaggatgtaacaagattcaagtcttcatggtctanggtcatgatctaaccttgttaatctcacat

SEQ ID NO: 24015 - DNA, 101 bp, rice(Oryza sativa)
  misc_feature (71): n=t or c
cagaatttcaaactttagttttttttgttaggataagtttacaaaatctgatattactactagaacactanaagaaacttgttaatccatgacggattctt

SEQ ID NO: 24016 - DNA, 101 bp, rice(Oryza sativa)
  misc_feature (71): n=t or c
gcgagagaggaggggaagcgtgcgagagcggaggggaagggaggctgagcgtgggacgatctggatcgttncattgcacgtggatgaatacggtgtgttga

SEQ ID NO: 24017 - DNA, 101 bp, rice(Oryza sativa)
  misc_feature (71): n=a or g
aacagctatataagccatcctgatctctctggaatgagcacaagcacagttcagaagacagagaaattacncacgcaccaccaaaatcgaaatggtactcg

SEQ ID NO: 24018 - DNA, 101 bp, rice(Oryza sativa)
  misc_feature (71): n=t or c
tatgtttgaagtacagaaactgaaaattcatatattcaaattaaccgtgtggcatatatactaaatcacanagaaatacagattcagtggtagcaaaaaag

SEQ ID NO: 24019 - DNA, 101 bp, rice(Oryza sativa)
  misc_feature (71): n=a or c
agattacaagaagccgctataaacaagcatccaactagtggtaatatgttgaagctctaggttccctagcntctagctattagctcattactggatcctag

SEQ ID NO: 24020 - DNA, 101 bp, rice(Oryza sativa)
  misc_feature (71): n=a or g
gttctggacaaggggatgtgtgtgggagtagcctttcttgtgcctctgggtagtgtgtcttcctgtgcctntctttatgatgtttggttgattttgtttca

SEQ ID NO: 24021 - DNA, 101 bp, rice(Oryza sativa)
  misc_feature (71): n=t or g
tgccatgtcacctaggtgtagaaaatcattgtccattatttaagttgataaatgaggaatgtgtttggcanaatttattaaagagaaaatatctttacaat

SEQ ID NO: 24022 - DNA, 101 bp, rice(Oryza sativa)
  misc_feature (71): n=a or g
actcatccttcgtgcgtgtacattaacctttcgagcgtagcatggatgtgtttacgcgcgagatccacacntgggtgtgtaccatgtagggcacctcgcga

SEQ ID NO: 24023 - DNA, 101 bp, rice(Oryza sativa)
  misc_feature (71): n=a or c
ccataaaaagaagaaaggataaggatgagaatcgtgtggagcacctcccctgctaacaaattttctacatngggagaataataattaggttgtattatatt

SEQ ID NO: 24024 - DNA, 101 bp, rice(Oryza sativa)
  misc_feature (71): n=a or g
atctgacacgaattctgtgacatggtgtagtgagctatatattgctatgatttcgaaatcgttgctagccntggtaataatccccgtggtattagattatt

SEQ ID NO: 24025 - DNA, 101 bp, rice(Oryza sativa)
  misc_feature (71): n=a or c
gtgatgtaggcgcgtgattatgtgtatgcatgagggtcttttccaggtaatagggaaatgttactccctcngtactcactgcacagctaaaagcgtttata

SEQ ID NO: 24026 - DNA, 101 bp, rice(Oryza sativa)
  misc_feature (71): n=t or c
ttgaatgatatgcacattgaactgttactaaaaaagcatgttctaaggggctgttctgattttttatgtgngacttcatgcattatctttaggatggtaaa

SEQ ID NO: 24027 - DNA, 101 bp, rice(Oryza sativa)
  misc_feature (71): n=a or g
tatcgatcagaaaactaacaagtatatctgttagtatgtctggaacattgatttaatatcattttgtatgncagaattcatcaaaatctaaaatttacttg

SEQ ID NO: 24028 - DNA, 101 bp, rice(Oryza sativa)
  misc_feature (71): n=a or t
caagtaccttaagttgggtgcctgcatctgcatgcagctggtagtgttgatcgatgatatgatcatggcangcatatggccgatggatggtcctaaattgt

SEQ ID NO: 24029 - DNA, 101 bp, rice(Oryza sativa)
  misc_feature (71): n=c or g
tatcttgtgttttttttttccagatctctgctaactttctgttgaacaactgtgcacgcacctacaccaanaagaaaacactcaagaagtggtttttcatt

SEQ ID NO: 24030 - DNA, 101 bp, rice(Oryza sativa)
  misc_feature (71): n=a or t
tgattgttttttatttttttacataataaaattgcatattcttttctatccctgcttcgcgtttcgcgtangcacaaaccttatttcgtgttatcagtctt

SEQ ID NO: 24031 - DNA, 101 bp, rice(Oryza sativa)
  misc_feature (71): n=a or g
ccccagcgatatcccccatctttgcgttggaatactctcacaagcttttcttgctcatctttgtcttcttncaagtactttccaacctttttaagatatgt

SEQ ID NO: 24032 - DNA, 101 bp, rice(Oryza sativa)
  misc_feature (71): n=a or g
gaccaagaccctgctatggctattgcggttggtcgtgctttcccatatactatccatcggttgtgcaggtngcacattatagacggccactcagatcatct

SEQ ID NO: 24033 - DNA, 101 bp, rice(Oryza sativa)
  misc_feature (71): n=a or c
atgacctctcaataaatatccagtttaaggttggatgcaatacgcaaatgaattggcacattggaagcaancaaacaaaccaggaggcctgatgttccttc

SEQ ID NO: 24034 - DNA, 101 bp, rice(Oryza sativa)
  misc_feature (71): n=a or c
tctgaattcgcaagaagaatgaggaacagaaggggtgtctcacccgtaccttgttcaccccaacggcgttntcctgagctttctttagaagctgggcgccg

SEQ ID NO: 24035 - DNA, 101 bp, rice(Oryza sativa)
  misc_feature (71): n=a or g
atttttttttctttttctttttggtaggagagggagagctcacttggggagcagaaatgatggctgcttcngttgctgtggcctgtggcctctatattggc

SEQ ID NO: 24036 - DNA, 101 bp, rice(Oryza sativa)
  misc_feature (71): n=a or c
gagctcaaattcagtgccaaaacactagccatggatggacaacacaattgtatacaaggtcaaatggattnatatatcaagaggattgatattgctctgca

SEQ ID NO: 24037 - DNA, 101 bp, rice(Oryza sativa)
  misc_feature (71): n=a or g
catccggattgtatcgcaccactaaccaccttttaatcttcagcatggttggtggtgccgggcttgatctnttgcttagatgaagtccgagaaagcgactt

SEQ ID NO: 24038 - DNA, 101 bp, rice(Oryza sativa)
  misc_feature (71): n=t or c
ggagatacctcttttccctaggccacacccaaacgaagatcatacactgcgtttttgctctccacaacttnaggctcgacagtgcagacccccatttcatg

SEQ ID NO: 24039 - DNA, 101 bp, rice(Oryza sativa)
  misc_feature (71): n=a or g
taccaataatttaagggcaactggatagcctctattacacgccattgcttcactcccttatcattatcttnccaaatagcataatagaggtcaaagctggt

SEQ ID NO: 24040 - DNA, 101 bp, rice(Oryza sativa)
  misc_feature (71): n=t or g
gtttgtgcatcttcctgatactgacttctggggatctgatcaacagcttgttaaccatgtatcttggcagncttgtatgaacatatgcaggagtgattgta

SEQ ID NO: 24041 - DNA, 101 bp, rice(Oryza sativa)
  misc_feature (71): n=t or g
gctaagagcacctctgatgatatcaagtctggcaaagatcctttacccgttgattcagaggtgctgactgnagtagacactgttcttgaagaagttactaa

SEQ ID NO: 24042 - DNA, 101 bp, rice(Oryza sativa)
  misc_feature (71): n=t or c
agatcaaatatgctgttgaatatgccctggcttcttcaacagcaatgcgctgattgcacagttcttctctnattatgtcaatttcttcagagccaaatctt

SEQ ID NO: 24043 - DNA, 101 bp, rice(Oryza sativa)
  misc_feature (71): n=t or c
agtgtgatagcaggagatgacacaggagatactacatttattatctttgggcatttagcgcagaggctgantggtcgttcagttgaggcactgatgctgga

SEQ ID NO: 24044 - DNA, 101 bp, rice(Oryza sativa)
  misc_feature (71): n=t or c
ttgatgaatgtacttagaagtagacggtgcgaggagaatgaagagtacaagtcattgatcaatacctatgnctttcaagacacatgattgtgaaagaacat

SEQ ID NO: 24045 - DNA, 101 bp, rice(Oryza sativa)
  misc_feature (71): n=a or g
atgctctggacaggacagcctcctcgttggcaccattggcatatgtgcaatccgcggaattgagttcttcntagcaacgacgagcggctcctgatgagctc

SEQ ID NO: 24046 - DNA, 101 bp, rice(Oryza sativa)
  misc_feature (71): n=a or g
ttccaaagtttatctggcctagcctttgagatgatatcggagaaaaaaccagatgatgaggagaacgatgngggttggatcaactgagttgatggtctgct

SEQ ID NO: 24047 - DNA, 101 bp, rice(Oryza sativa)
  misc_feature (71): n=t or g
tcatcagttcatcaccatcaatatgatcactctcatatcaccctaactagagtcgccagccggtgtgattntggttgtggacgaggcgccctcgtcgccgc

SEQ ID NO: 24048 - DNA, 101 bp, rice(Oryza sativa)
  misc_feature (71): n=t or c
gatcgcagtactgaattcaggtactattcgtgatgaactctgaaaattagtacctgatggatgcaggacanccggagatttgtgtcgtcaacctcatcgaa

SEQ ID NO: 24049 - DNA, 101 bp, rice(Oryza sativa)
  misc_feature (71): n=a or c
cattatctaaaaatattgcatgaactttcctgctcgtgtgccaaatcaggtgtccaagcctgtttttgttnatcactttcaggaaccttaaggatttgtca

SEQ ID NO: 24050 - DNA, 101 bp, rice(Oryza sativa)
  misc_feature (71): n=a or g
catggaccttgcagatgaatcaacaccgatgcctcagtggttcaccgaagaagacctctcagcttacaccnacctgtatgagaaatcaggtctcatgactg

SEQ ID NO: 24051 - DNA, 101 bp, rice(Oryza sativa)
  misc_feature (71): n=t or c
aaaatccaccagtctcctgatgaaagcagagaaaatgatgagccaaaagtgaaggttaccaaatctgatangaaggaaaaagattcccttgaatgtagctc

SEQ ID NO: 24052 - DNA, 101 bp, rice(Oryza sativa)
  misc_feature (71): n=a or g
ttattcagccaatggtcactgacttgggaaggtccttttctaatttacaagattgtccctaagggagcttncatgctacaaggactcgatggaaaagttta

SEQ ID NO: 24053 - DNA, 101 bp, rice(Oryza sativa)
  misc_feature (71): n=t or c
tgccagtattctcatcgatgaatgattttaccacacaacagcaaagctgttgccatctgccggcattatcncaggtttgcttttccgcatccttctctcct

SEQ ID NO: 24054 - DNA, 101 bp, rice(Oryza sativa)
  misc_feature (71): n=t or c
atgagtaccaaagtaaccagaattatgctgtgaagccaagacaactaggaataaggaatgatcattaccanttcagagaatcgcattcgggccagtgcttc

SEQ ID NO: 24055 - DNA, 101 bp, rice(Oryza sativa)
  misc_feature (71): n=t or c
gtcaccgacaggcgttatcttcactaactttactatcattcgccctcctcttcgccattcagatcgaagcncccatgggcaagatggccagatccacttag

SEQ ID NO: 24056 - DNA, 101 bp, rice(Oryza sativa)
  misc_feature (71): n=a or g
cttttttttttttctgggtgctgttgcggtgagccggtgaagcaagtagtagcagagtctactcaactccngcggcgcagcaggtcaagccggaataatgc

SEQ ID NO: 24057 - DNA, 101 bp, rice(Oryza sativa)
  misc_feature (71): n=a or g
gaaggatggcgacatctgccttgagaagtccagagttcatcttcctggcctgggacagagggagatcatcnatatcgcgcccgggaggaagtcaatgccgg

SEQ ID NO: 24058 - DNA, 101 bp, rice(Oryza sativa)
  misc_feature (71): n=t or c
gccggataggccagatccagactgggaggcaccagatctggtgaggaggctgtcagatttggcgtcgccgngagcccgccccgttcccgctgcctgctccg

SEQ ID NO: 24059 - DNA, 101 bp, rice(Oryza sativa)
  misc_feature (71): n=t or c
aaacgagatgataacgccgttggtgcgtttggtaagtggtaatcgtcactctggcgtctactaccagtggngacatccgagatggttcttccctgcagatg

SEQ ID NO: 24060 - DNA, 101 bp, rice(Oryza sativa)
  misc_feature (71): n=t or c
ggttgctggatgaaaaccatgtcttggttctccctgagaacttttcggacggtggcggtattgtcatcttngcccttctccctggagacattgtctaagag

SEQ ID NO: 24061 - DNA, 101 bp, rice(Oryza sativa)
  misc_feature (71): n=a or g
agaatggcgccgagtaggagagacagattaacaaggtgggagcaaatcatccctgccccaacatatgtganactgaaatcgaagaagaatctgataaccca

SEQ ID NO: 24062 - DNA, 101 bp, rice(Oryza sativa)
  misc_feature (71): n=t or c
atctgcttgaccttttccaaagtcggttaatttccactctaattttcttgtttgccgaacctaggttgcanggttcaagcgccaaaaggctgcagaaacaa

SEQ ID NO: 24063 - DNA, 101 bp, rice(Oryza sativa)
  misc_feature (71): n=t or c
tttttggaggagtcgacagctatgctgccaaagaaagacattgagttccgtatcaatttggtcctaggtanagctcccatctacaagagaccgtacaggat

SEQ ID NO: 24064 - DNA, 101 bp, rice(Oryza sativa)
  misc_feature (71): n=a or g
tgccggagcaacaacgctccattgttggccgtatcttggcatgctgcgaggaaatgggctacatgctcatnaggtgatcctatcccgttgaacttgctgaa

SEQ ID NO: 24065 - DNA, 101 bp, rice(Oryza sativa)
  misc_feature (71): n=t or c
ccccaagcacaaagaggagaggagacaaaggatcccctgcctaacgcctcttttacaataaaaggacttancaggaacaccattgagaaggactgaggagg

SEQ ID NO: 24066 - DNA, 101 bp, rice(Oryza sativa)
  misc_feature (71): n=t or c
cgcatctcctcgtcgaacgctaacatggtaaccagattaactatcccatctccatcaccatacactttttncggagccttgtcaaagttaccgtcccagta

SEQ ID NO: 24067 - DNA, 101 bp, rice(Oryza sativa)
  misc_feature (71): n=a or g
cggctcataatctagcaagcaaacgatgagaggctatacttatgcaacttcaagtgtaaatgactaatccnttaaacacacttataagctaaaatattagg

SEQ ID NO: 24068 - DNA, 101 bp, rice(Oryza sativa)
  misc_feature (71): n=t or c
gtgacgcctagggtcatgatcatcagagcaaaggagaagagcagatgaagtctaagagagaacttcttaanacaaaacgcgacgaggggcacaaacaggaa

SEQ ID NO: 24069 - DNA, 101 bp, rice(Oryza sativa)
  misc_feature (71): n=a or c
gatcacacgatcggtggtagtgaatagtgattatataggggctatagctggttcatgcaatgaccaggacnaattaagatttaagacagacaatgacactg

SEQ ID NO: 24070 - DNA, 101 bp, rice(Oryza sativa)
  misc_feature (71): n=a or g
atgaaactaagttcagcaaggaaaacattatgcttgaaaatcgaatgcaagtctgctgtacctgcactacnaacaccattctctggcattctggaacatgc

SEQ ID NO: 24071 - DNA, 101 bp, rice(Oryza sativa)
  misc_feature (71): n=a or g
ggcatgttacccacttacctacttggcacttattcgattgacttatgatacggatgcaggtcatgtgtatnaggcaatcgatgctcttcctgtaactgctc

SEQ ID NO: 24072 - DNA, 101 bp, rice(Oryza sativa)
  misc_feature (71): n=t or c
aaaaaagaacaaaaaaaaaaaacagaacgaagacagcggcatgcatcgcagcataggccggtcaagaagangatggccctgacgaggcgcctcctcatcga

SEQ ID NO: 24073 - DNA, 101 bp, rice(Oryza sativa)
  misc_feature (71): n=t or c
tcccttgttgaactgatcaaagtctctattactctggcactggcaccaacaggaatgaactctgaacagantgatggtcttgttattgcttcagccaatct

SEQ ID NO: 24074 - DNA, 101 bp, rice(Oryza sativa)
  misc_feature (71): n=a or g
cggtcgcctctgctccttccccgataagtcctcaacaacacgccgccaccaccctcaccgagggccaaatnagggggatacggtggtatatcatgttcaac

SEQ ID NO: 24075 - DNA, 101 bp, rice(Oryza sativa)
  misc_feature (71): n=t or g
aggtttgcttaagcaagcaagaagctagcaatggtgccgtgtcactcacaaccacatcccccaccatcatngcgtacggcacgacgagctcggcgaaccgg

SEQ ID NO: 24076 - DNA, 101 bp, rice(Oryza sativa)
  misc_feature (71): n=a or g
caaccgtcgctaggtatcctcgatcgccgtatatcttggctttctccactagatcctcggagttcacctcnatatacaccagcaaagtcaccttctcgagg

SEQ ID NO: 24077 - DNA, 101 bp, rice(Oryza sativa)
  misc_feature (71): n=t or c
tttgttgtaacttttcgctacagagcctggtgttgatccttttgctcaaagaagggaagataagaagaagnatgttgaaaagcaagaaaagaacagactag

SEQ ID NO: 24078 - DNA, 101 bp, rice(Oryza sativa)
  misc_feature (71): n=t or c
ccaaggatggttaactggccaccctagacagatcggatgcccgtgaattttaaacaatgtaaggttgttanggtagtggagtaattctgttattcgatgca

SEQ ID NO: 24079 - DNA, 101 bp, rice(Oryza sativa)
  misc_feature (71): n=t or c
ggcacccagtgaagaaaaggatatgccccatactacataccgtatgatgcatgggatggaggtgaccaggnaaagaagcaagactgcaaatagtaaatttt

SEQ ID NO: 24080 - DNA, 101 bp, rice(Oryza sativa)
  misc_feature (71): n=a or g
cgacgaggaaatctggctcgtcgcatcaatcatttgtcaagtttctgatagactttggcgtgaccaagtgnccggtcatgaatcttgtttattggtgacaa

SEQ ID NO: 24081 - DNA, 101 bp, rice(Oryza sativa)
  misc_feature (71): n=t or c
acgcccggccgtgtctccccgagaaacagatatggactggattatgtttctgacagttatgagagtgattngtctgaaggacactccgacggagatgatgg

SEQ ID NO: 24082 - DNA, 101 bp, rice(Oryza sativa)
  misc_feature (71): n=a or g
ctccttttcccatgtgtggagagatctttcccatttgaagccttgttcttccccctccttttccggcgacntgtggcagcttgcggcaacctcgtccctcc

SEQ ID NO: 24083 - DNA, 101 bp, rice(Oryza sativa)
  misc_feature (71): n=a or g
aacgttttttgaagggcagtggaggttgtgaggcctattctatctagtggagtaatggcgtaaaatttccnacctcgttttgtggggtggataatgaaata

SEQ ID NO: 24084 - DNA, 101 bp, rice(Oryza sativa)
  misc_feature (71): n=a or g
tgaaaaaccagtatcttatatttcgatgttcgatcatgcagtatctgctgattaaaaatcaagattgctcntggcaactgaacatacaattgatatgatta

SEQ ID NO: 24085 - DNA, 101 bp, rice(Oryza sativa)
  misc_feature (71): n=a or g
gtgcacgaaatatgtgcaaaaataacaactacaatgtcatacagcgctgttcctggatatcacggtcgtcncaccttcacacgtttggcatctgcgcatgc

SEQ ID NO: 24086 - DNA, 101 bp, rice(Oryza sativa)
  misc_feature (71): n=t or g
agctccacgtcgtcgaacggcgccgggaggttcagatcaatgaagccgttgcttttaatcatggctggaanatcgtcgcccgatgcggccgccgccgcggc

SEQ ID NO: 24087 - DNA, 101 bp, rice(Oryza sativa)
  misc_feature (71): n=a or g
atgccacagctcaaatcaatcccaaaattgaaatggtattcgactgagatccaaaccttcttggctgctgnagtagatggagaagccactggcgcgggtgt

SEQ ID NO: 24088 - DNA, 101 bp, rice(Oryza sativa)
  misc_feature (71): n=a or g
tggcattcgaatcaaagaacaccacaacaactgttatatcatcatggaagtgccgccttaccccacgatcnattttcttcagatctgaatacctcatctcc

SEQ ID NO: 24089 - DNA, 101 bp, rice(Oryza sativa)
  misc_feature (71): n=a or g
cagatccctgcccaaataaactcattacctcttctggacatgtatgtggagagaaatccatgtgatgcacngaaacaataaataagttggaccaatcaatt

SEQ ID NO: 24090 - DNA, 101 bp, rice(Oryza sativa)
  misc_feature (71): n=t or c
tacatcctcttagcaacttcattcagctgtggtgacttgggagtgcattgatgcctaatcccttgctcctngcaataatcatcaaatggccctatgtactc

SEQ ID NO: 24091 - DNA, 101 bp, rice(Oryza sativa)
  misc_feature (71): n=t or g
ctcatatacccatcggttaggaattgcttaccgttgctgaataatcttgcttagcttggagtggtcgtctnaagatttcttttgatgctcatcagttcgtt

SEQ ID NO: 24092 - DNA, 101 bp, rice(Oryza sativa)
  misc_feature (71): n=t or c
aagaactcgaatgatggcgaatgaactgttgtctacttaggccgacacatgaggttggaaatgaggaaacntgcatatcccgacggctagaacctagccag

SEQ ID NO: 24093 - DNA, 101 bp, rice(Oryza sativa)
  misc_feature (71): n=a or g
gatcagaagagcccaaacggaaaacttcggtatgctgatgcaactctgaactgcaaaggtagagtagtaantgtagattgctgaagttcgctacatgtggc

SEQ ID NO: 24094 - DNA, 101 bp, rice(Oryza sativa)
  misc_feature (71): n=a or g
aaaacggcttttgtttcataacttgggtgtctcggtacatatgggtcatgagtcagatttagatggactgnatagcaaagcaagagctggaggtcgctact

SEQ ID NO: 24095 - DNA, 101 bp, rice(Oryza sativa)
  misc_feature (71): n=t or c
agtatccggggaaccgaagcgggggttgctgcccaaaaaggtggcgcgtcttgaggagtttgcgattgttnttcttggccgttaggtgcaaatttcacttg

SEQ ID NO: 24096 - DNA, 101 bp, rice(Oryza sativa)
  misc_feature (71): n=t or c
gcagggttcatcgtgtaccaacagggacatgaaccccctaaattctttttgggggaagaactgttgttgtnagtactaaggttaagacaaagagaaaagct

SEQ ID NO: 24097 - DNA, 101 bp, rice(Oryza sativa)
  misc_feature (71): n=t or c
tgaccagccattgagggtgcatcaacttttggaactggctggtgactaaaattcgtctgctttgggcttanagaggcgggtgggaggggtaatggatggaa

SEQ ID NO: 24098 - DNA, 101 bp, rice(Oryza sativa)
  misc_feature (71): n=a or g
catcatcccaactctaccttacatcaagagttttctctgacatctcgacatatagcttcttcatctcccancctggtcaccattggattcgtctccatttt

SEQ ID NO: 24099 - DNA, 101 bp, rice(Oryza sativa)
  misc_feature (71): n=t or c
caggtggagactggacaatgaagtaatatatctgctggctgcctgtagggatatttgctgattgacttcanatatgtttaagtctctcagctttggtgctt

SEQ ID NO: 24100 - DNA, 101 bp, rice(Oryza sativa)
  misc_feature (71): n=t or c
gatgggactgcagtatcgtttggtttacaagaaaggtagtgagaacaacgccactgatgcgttgtcccgangagtggccgatgattcaacagaagtattgt

SEQ ID NO: 24101 - DNA, 101 bp, rice(Oryza sativa)
  misc_feature (71): n=t or g
aacatggtccaaccttccgtctccatcagggatgatggaaaacattgtagttccaactttgaaggctttcnctctgcgagcctatgacccaaaacaggtaa

SEQ ID NO: 24102 - DNA, 101 bp, rice(Oryza sativa)
  misc_feature (71): n=t or c
aagaatatttcattatatcagttgtttttggagagcttggccatccctgggcaataagaacttggttgctngtttctgaggagctgaaatgaagtgaagca

SEQ ID NO: 24103 - DNA, 101 bp, rice(Oryza sativa)
  misc_feature (71): n=t or c
gaccttgataaatatttcttggtctctgcaatgacatgtgtctcaccaagagcaatacgaacagcaaggtnatctgcttctctatcaagtaattcactttt

SEQ ID NO: 24104 - DNA, 101 bp, rice(Oryza sativa)
  misc_feature (71): n=t or c
gtgaatagatggacttgctctgcttgagggagcgagatttactgaaacgattcaccacggaggtttctaantatctggcacaaggagaaaacagagagaag

SEQ ID NO: 24105 - DNA, 101 bp, rice(Oryza sativa)
  misc_feature (71): n=a or g
gtacgctatcccgatacagatgaggctatgaggcttactgatgacctatcttgtgccagtgataagtcttnaacaattaagctttcttgccggcttcatct

SEQ ID NO: 24106 - DNA, 101 bp, rice(Oryza sativa)
  misc_feature (71): n=a or g
gatctcctctctctctcctccggggaaagtgagcaagaaaggcaggatcttttaaggcagcagcagtccancaagaacaagaaaagagagccgcacagctc

SEQ ID NO: 24107 - DNA, 101 bp, rice(Oryza sativa)
  misc_feature (71): n=t or c
tgcgaacctgatggtacccgaaatggagatccagcttggagaagaagtgggcgtcgcaaagttcatcaagnaattcgtcgagaaccaaaatgggaaacatg

SEQ ID NO: 24108 - DNA, 101 bp, rice(Oryza sativa)
  misc_feature (71): n=a or g
ttgaataagcaacgacaagttggagtacatgaagcccagacaaactcaccgatatttgaaaccccccaacnatgagccaaagatccaattctccaatggtt

SEQ ID NO: 24109 - DNA, 101 bp, rice(Oryza sativa)
  misc_feature (71): n=a or g
ctgctcaaagccgtcgttgccaaccagatccaccatgccaccacctgctattgcatttagcttcttcgatngtgcatttccgtattgagacggattcaccc

SEQ ID NO: 24110 - DNA, 101 bp, rice(Oryza sativa)
  misc_feature (71): n=a or g
accatgccatctaatactttcagtgaatcaacacccacccaaaccatgaaattcttcgtctcccaaacctnatttccagtcattgcactgaaaaatgctca

SEQ ID NO: 24111 - DNA, 101 bp, rice(Oryza sativa)
  misc_feature (71): n=a or g
taaacagcatagtattgtttcaactagcaaggtgtcacattacagcaagtagagtacttatcatgtgaggngctaaaatagcatgccaacaacagagcaaa

SEQ ID NO: 24112 - DNA, 101 bp, rice(Oryza sativa)
  misc_feature (71): n=t or c
ttgctttatagaatgggaatttgggggaagaatccaatccaggtaagtctaaaaaatggcatcagtgacancatataattattcaatgtttgtacattcca

SEQ ID NO: 24113 - DNA, 101 bp, rice(Oryza sativa)
  misc_feature (71): n=a or g
gagagtttgtgttgtttttaaagattacgtcagtgctgctttcaacgtgacaagtcttgtcaataaccatnttgatatttggtacaacgatcctaacatca

SEQ ID NO: 24114 - DNA, 101 bp, rice(Oryza sativa)
  misc_feature (71): n=a or c
tggcaaggctgccagagatgggccttccaccatcgttgaggagattatctttatgccgttgcagcgacganctaagtatgcagtgcagaatggtagcaacg

SEQ ID NO: 24115 - DNA, 101 bp, rice(Oryza sativa)
  misc_feature (71): n=t or c
cttatttgtgttaggtttattatgcacgcaccttcttcggacattcatccatgctcaggtcgagaagatancacctcagtatgtgctctgacgctacacga

SEQ ID NO: 24116 - DNA, 101 bp, rice(Oryza sativa)
  misc_feature (71): n=a or c
tccagaagctcaagtctgtcagattctgtcctgaaatgccaatgttacagaaactggaaatcagtgattgnaaagagttattatcagtagatgatcctttg

SEQ ID NO: 24117 - DNA, 101 bp, rice(Oryza sativa)
  misc_feature (71): n=t or c
gcaagaggctgcgtccacacaacgtttacctcttccatcgtgtaatcttcaatggggatgagttggttcancggagtcggctctgcgttgaggttgcaagt

SEQ ID NO: 24118 - DNA, 101 bp, rice(Oryza sativa)
  misc_feature (71): n=t or c
gtcgttcgttcgccacgctaatttgactgtggaagtgtcgttcttacgacacgatcacgagagctttcttncctcgctagctagcttgcattgtcgtcgtc

SEQ ID NO: 24119 - DNA, 101 bp, rice(Oryza sativa)
  misc_feature (71): n=a or g
ctcatcagtcttcagtggtttccatgttcaatcaggcgaggagggcctcctgcaattgattacatagatcntcgttgctttcttcaatctatctccaatgt

SEQ ID NO: 24120 - DNA, 101 bp, rice(Oryza sativa)
  misc_feature (71): n=a or c
cttgcactatcaggcagtctctccttgctaccaaactttgcattccactgacaatggtaagctgaccggantgaaaaaattcctgaccgagtgtgatgcca

SEQ ID NO: 24121 - DNA, 101 bp, rice(Oryza sativa)
  misc_feature (71): n=t or g
aggacaagtacactgaggtggacgaggaggagcagattcgcaactaccgtacatcttgggattcctctttntcttcccgttatggtcccttccaatgcaca

SEQ ID NO: 24122 - DNA, 101 bp, rice(Oryza sativa)
  misc_feature (71): n=a or g
aagctcccactgagcttgttgttgttcagattaaccctgtatagagactcacattttgctatcccactagnaaagcccccatcaaactggttgttaccaag

SEQ ID NO: 24123 - DNA, 101 bp, rice(Oryza sativa)
  misc_feature (71): n=a or g
cacattttagacatgttttaatttttttactgggttgttgtccagatagaagagcttgcagtcatggtgcnagaggtttgtttttcactgtgaatctcaat

SEQ ID NO: 24124 - DNA, 101 bp, rice(Oryza sativa)
  misc_feature (71): n=a or g
atatcgcatggccatcacactatcacaaacagtttgaattcaggagttcttgcagtgttcagcaaacaggntgcagtaatacactgtaacagttagttctc

SEQ ID NO: 24125 - DNA, 101 bp, rice(Oryza sativa)
  misc_feature (71): n=t or c
ttcgagaggttatcatcaatctgatttgagtgtattaaagatgaacatacagcggctgcgtaatttacttngttatgtaatctattgtgtttttggtcggt

SEQ ID NO: 24126 - DNA, 101 bp, rice(Oryza sativa)
  misc_feature (71): n=t or c
ttattttactctctgtattttccagggggcttgtccttgtctgataattcatattttccttctcaggcaangaacaattgattttaacttctgtcatccgg

SEQ ID NO: 24127 - DNA, 101 bp, rice(Oryza sativa)
  misc_feature (71): n=a or g
aatggagagggtaaatggagagactgttggagtgaacaagagtttggctcttcaaatcagttggagagttngctatatgggtatttgaagagtctaatttg

SEQ ID NO: 24128 - DNA, 101 bp, rice(Oryza sativa)
  misc_feature (71): n=t or c
aaaaacacataaatctggagtactggagtatttcccccgtcccctctgcgtcattgaaaatctcccgtccngttccgctccagcgcctgcgccgatctcca

SEQ ID NO: 24129 - DNA, 101 bp, rice(Oryza sativa)
  misc_feature (71): n=a or g
ttctgtaacaactcagttattctaaacacttactcatgctagactagtttctcggaggaggactagtcccncatttttatatcaagcaacgacatccaaca

SEQ ID NO: 24130 - DNA, 101 bp, rice(Oryza sativa)
  misc_feature (71): n=a or g
tgtaactccttgtagctgaatcttcggaattggctagaaatgatcatgtaaccttcgtcagtaatctctgntattgtctcccattttttaacaactgaaaa

SEQ ID NO: 24131 - DNA, 101 bp, rice(Oryza sativa)
  misc_feature (71): n=a or g
tgaaaggcaacgcaaatcacctcagggcttgctaggtgtctgttccccgagttaacaaacattgaccatgncttcctattatgtctgcagcaaataatatt

SEQ ID NO: 24132 - DNA, 101 bp, rice(Oryza sativa)
  misc_feature (71): n=a or c
gaggtaatgagctatatgcctacatatgttcttcagaatttcagattaggagctaacttgaaggtacctcngaccactgcttcattctctgtctgctgtcc

SEQ ID NO: 24133 - DNA, 101 bp, rice(Oryza sativa)
  misc_feature (71): n=t or c
ccgcagtgctcgtctcctctcggtctctctcttcgtctctccgtctctcgttctctcctctcgttttctcngctctctactcttctctttctcctctctcg

SEQ ID NO: 24134 - DNA, 101 bp, rice(Oryza sativa)
  misc_feature (71): n=a or c
gaaaatggtacggttataaacaataccccttatgcagaaacggcgctcagtcgataggaatttctgtgacngttttcacccgctacatccactgctcgagc

SEQ ID NO: 24135 - DNA, 101 bp, rice(Oryza sativa)
  misc_feature (71): n=t or c
gaggcgggtattgcagtacgacacgatcgatctgctgatgattcccatgacgcgatcgatcgagaagttgnccgtgtcgcggccgggggatacaacgtcgt

SEQ ID NO: 24136 - DNA, 101 bp, rice(Oryza sativa)
  misc_feature (71): n=t or c
atccttcattctgcttcacaaagtcctcctcaagcagctccttccccaccttgatatcgtgatcagtcatnggaagccggcactgctccggcacccgatac

SEQ ID NO: 24137 - DNA, 101 bp, rice(Oryza sativa)
  misc_feature (71): n=t or c
acaagaaacattacaattaagtctatcatttaagagtcagaagagcaacttgggagctaccttgagagagngtgaatcgtcacggtgcttcctcatggccg

SEQ ID NO: 24138 - DNA, 101 bp, rice(Oryza sativa)
  misc_feature (71): n=a or g
agctcgagcggctctggaccttcttgacctcgtgcttgactcggcaaaccagggatgttcttccgctgggnttgctgtggctgcaggtgaggaggtgcgtg

SEQ ID NO: 24139 - DNA, 101 bp, rice(Oryza sativa)
  misc_feature (71): n=t or g
tggctatcataagtacaaggtatttttggattagagataacaagaacaaatgtcagtttgatcggctattntttttaatgctatgagaattttcatttcag

SEQ ID NO: 24140 - DNA, 101 bp, rice(Oryza sativa)
  misc_feature (71): n=a or g
ttctttacttaaagaaaatgttttaccagtgttaaatatataggtcacatttgggtccttgaacgagtcanctttggaataaaggatcaagattttgatgt

SEQ ID NO: 24141 - DNA, 101 bp, rice(Oryza sativa)
  misc_feature (71): n=t or c
ccggttgattttactatgcattgatttaattatagttaattaaattgcagagtcccgcgcgataaaccggnacatcgcgaccaagtacaaggcggagggcg

SEQ ID NO: 24142 - DNA, 101 bp, rice(Oryza sativa)
  misc_feature (71): n=a or g
tttcgggtatttcaacgagtttgtgggcccaagacttctgtggatgaaattatcctcctctattatgtatntttcgtcttaactttggtaatttttcacct

SEQ ID NO: 24143 - DNA, 101 bp, rice(Oryza sativa)
  misc_feature (71): n=t or g
ttggtatacgtacgtgacgtttttgggtatgatccggagcttatccctgatgacggtgttcatgatgcccncgaagccgccttccgttgtgaccttggagc

SEQ ID NO: 24144 - DNA, 101 bp, rice(Oryza sativa)
  misc_feature (71): n=a or g
tgcttaagtgccagctggagacatggtttagctgacgctgtgacgcatgttgctttcgttgacaaatagantgagctctcaggatacgcgtgactaaatta

SEQ ID NO: 24145 - DNA, 101 bp, rice(Oryza sativa)
  misc_feature (71): n=a or g
cctactgaccacgacgacagaaatggctccagctcgacctttcgcgttgctgtttctcgcagtcacggtcngcttcgttctgctgacggcggccgacgact

SEQ ID NO: 24146 - DNA, 101 bp, rice(Oryza sativa)
  misc_feature (71): n=t or c
gcggtcacaccggcgttcgtagcatcaccctgtcgtacgaccggtgcatcgactccatcgccgtcgagtangaccggaacggcgtcgccgtcgccggcgag

SEQ ID NO: 24147 - DNA, 101 bp, rice(Oryza sativa)
  misc_feature (71): n=a or g
tgatcggcatgacgaagacgatgacgaaatgatcatccgacgaacatgtttgtcacctcacatgtgtgtgntcagtgatccagatccattgctagctcgat

SEQ ID NO: 24148 - DNA, 101 bp, rice(Oryza sativa)
  misc_feature (71): n=t or c
tgatcatcgatggagctgacgccgattattactccagtgtgtaatgcgttttagactcgattaatcggctngatccctagactgaaccaattaatcaacgc

SEQ ID NO: 24149 - DNA, 101 bp, rice(Oryza sativa)
  misc_feature (71): n=t or g
tgttatttgactatacaagtaattgaaattcgatcaacaacaaccataaggaaagagttgaaagttggcgngtgccatgttgcacacatatggcagttgca

SEQ ID NO: 24150 - DNA, 101 bp, rice(Oryza sativa)
  misc_feature (71): n=a or g
gaacaaagttccatagtgaacactctgaaaaagaattggaaggaaactgttgttcagtgtggtgctatccntgaagaactgattgacattgctgatatgct

SEQ ID NO: 24151 - DNA, 101 bp, rice(Oryza sativa)
  misc_feature (71): n=t or c
agacccttgcccaaatccgatgcctaatcctgatccgccactagatccagctgaagatccagcagaggatnccgtccttgatccacctgacccagcggagg

SEQ ID NO: 24152 - DNA, 101 bp, rice(Oryza sativa)
  misc_feature (71): n=a or g
tagtgtccgaacatccgatgtgacatggatccaaacaggctctaatattacctccaaaaacaatgaggagngacctcaacttaaacatgttgctaattgag

SEQ ID NO: 24153 - DNA, 101 bp, rice(Oryza sativa)
  misc_feature (71): n=a or g
ttgcatatctctagttgtgccggttctacgactaacggttcaacctcttatcgtggctgttgctccagctnagggacttcctttccgcacttcactgctga

SEQ ID NO: 24154 - DNA, 101 bp, rice(Oryza sativa)
  misc_feature (71): n=t or c
gcttggtttgtgagtgaacgactcacgaagcatctagtaaggtcatttttcgagtcaaaaattggcgaacnatggcatggacgtatcgatcagtatgactt

SEQ ID NO: 24155 - DNA, 101 bp, rice(Oryza sativa)
  misc_feature (71): n=a or g
ccacgcaatagctccaatccaatcaacaattccaagcagttcatttccttgtatatagcagattgccactntgtcgagctttgaaagacttgatcatccag

SEQ ID NO: 24156 - DNA, 101 bp, rice(Oryza sativa)
  misc_feature (71): n=t or c
cagttattggcaagttagcagtctgcctgttcattatttgggcttcatagcttcaccaacttgagatcatntgggctttatttccttgctagaatctatac

SEQ ID NO: 24157 - DNA, 101 bp, rice(Oryza sativa)
  misc_feature (71): n=t or c
gactcctcttctctcttcacaaaggcctcactcctttcttccttcacaccaaacatttgtagtaaccgatnaagtttatcatcaaatctgcgctgggattc

SEQ ID NO: 24158 - DNA, 101 bp, rice(Oryza sativa)
  misc_feature (71): n=a or g
ttggtcttccaaaatatgcaacacgggtgactcgtcggggtcaacatcgacaaatcccacgaaccgatctnaggttgtcgctgcgtcccgttcctcggcaa

SEQ ID NO: 24159 - DNA, 101 bp, rice(Oryza sativa)
  misc_feature (71): n=a or g
ggtggttcggcaacttgaacttgttgttgggcttaagcagcggtgacggaagccttatcgtactcagcttntattgcttgccgtcgcttggaatcatcttc

SEQ ID NO: 24160 - DNA, 101 bp, rice(Oryza sativa)
  misc_feature (71): n=t or c
ctacgcctcctgcgccgtcccttgtgtcttctcctatgccccttaggtgtagatctcttgtcatacttagnatccacaagtctcttgccaactaatcttcc

SEQ ID NO: 24161 - DNA, 101 bp, rice(Oryza sativa)
  misc_feature (71): n=t or c
tttcgaatactataataacaatgcttatcctttgctgctgttagacgatgagaagattgtcttcctactgnggggaactaatgttctacaaagttatgatc

SEQ ID NO: 24162 - DNA, 101 bp, rice(Oryza sativa)
  misc_feature (71): n=t or c
cctgtgtacatgacttttgctttagtaggccacattgtccggccaaaaagaaaaggcaaaatcagcagtcnattgtgcaagtatagtaatgaaacattaga

SEQ ID NO: 24163 - DNA, 101 bp, rice(Oryza sativa)
  misc_feature (71): n=t or c
atcctttacaggttactgatgttcatcattttggcatggcagttcaatgacatgataaatgtacccttcgngtcaaagccgttcgtcgcagggctcattgc

SEQ ID NO: 24164 - DNA, 101 bp, rice(Oryza sativa)
  misc_feature (71): n=a or g
ttttgaaagagtaaaattcataaaacccaacctattatggtccaggataacacaaaaccacgggaattttngcacgtgacacataacctcaagtattatga

SEQ ID NO: 24165 - DNA, 101 bp, rice(Oryza sativa)
  misc_feature (71): n=a or c
tttttcatcgatggtaagattgtaggaagttacaacggtgcgatgctgctaactgattgcatgagttccgntctcacaattcagtgtacctatactccttg

SEQ ID NO: 24166 - DNA, 101 bp, rice(Oryza sativa)
  misc_feature (71): n=a or g
cctcctctgcccaatgcccgaagcaagaggcgtgtcgacgatccactgccgagtggtcgcccaactaagcncgctaccaccgatgagcctagggccagctc

SEQ ID NO: 24167 - DNA, 101 bp, rice(Oryza sativa)
  misc_feature (71): n=t or c
ctatagatactggttttagagtttctggtatttataacaccgtcccttatttgatggtccgtagtagtacntgttggatgaacttatacattaggaaatgc

SEQ ID NO: 24168 - DNA, 101 bp, rice(Oryza sativa)
  misc_feature (71): n=a or g
taaactcgtgagaaagctaacactggaccgatcattgctaaacgtgaccaatcgtcgcttggccaacaaanaaactacagtgagattgtccaaaactcaac

SEQ ID NO: 24169 - DNA, 101 bp, rice(Oryza sativa)
  misc_feature (71): n=t or g
gttgctactcccctgcggcagagagaataaaataaagaagagacagagctactcccctgctcagctccgcntcactgccatcgccgcccccgccgctgcgg

SEQ ID NO: 24170 - DNA, 101 bp, rice(Oryza sativa)
  misc_feature (71): n=t or c
ctagagccctagacacaatgattcggatgttgtccatgctgtgtagtttactcatctttaccttcttcagnaccgcaatacttgcagcagcacaatcaaac

SEQ ID NO: 24171 - DNA, 101 bp, rice(Oryza sativa)
  misc_feature (71): n=a or g
agtcttccttctcccaccatcgtcgtaactatctcgttgttcattcgcctcctccgctcctcgtcttcggntgtgcgggctcccttcctcctgcttcttca

SEQ ID NO: 24172 - DNA, 101 bp, rice(Oryza sativa)
  misc_feature (71): n=a or g
aatttcttccgtgaggagtattatgtgcatcctgacaaaatctttgaagacatgttcggtgagaatcatcnttttacctggtcccatatatcgtgggagag

SEQ ID NO: 24173 - DNA, 101 bp, rice(Oryza sativa)
  misc_feature (71): n=a or g
gtgttataccaaaattccgcaagagccaaccattgagaccatttcttagggcaagcatgcacaaagcaccncaagaatgtttccaaacactgattgacgcg

SEQ ID NO: 24174 - DNA, 101 bp, rice(Oryza sativa)
  misc_feature (71): n=t or c
aaactctgtccctggattttattgagggcctgccaagatctgggcactataactgcattttagtggtcgtngataagttttccaagtacagtcacttcatc

SEQ ID NO: 24175 - DNA, 101 bp, rice(Oryza sativa)
  misc_feature (71): n=t or g
tatggtgattcagtgaaggcagaacaacagcttgcttccagggcctcctgtcctgttcagtttctccatgnctgtcatcatcgacgtccgcaactgcatcc

SEQ ID NO: 24176 - DNA, 101 bp, rice(Oryza sativa)
  misc_feature (71): n=a or g
cgtacccattccaactgattctccatctccagcatctgctcagaaagttccttcttctcccggacaaaacnatccttctcagcttttagctcagactacaa

SEQ ID NO: 24177 - DNA, 101 bp, rice(Oryza sativa)
  misc_feature (71): n=t or c
atggccagtttctgacatgacaaagccacatccacctgcttatgttaaaatgcccgggaggcccaaaactnagagaacaagagagccaactgagaaaccta

SEQ ID NO: 24178 - DNA, 101 bp, rice(Oryza sativa)
  misc_feature (71): n=t or c
gtctcatccacctcagttgatggtaacatcgacatccattttaagcagcaaccagtaaaactgtcattggnaaacttgatctcgcataggcatgttgcaat

SEQ ID NO: 24179 - DNA, 101 bp, rice(Oryza sativa)
  misc_feature (71): n=a or g
ccatttctggagactcacctcacctgtcaagaaagtgtctctctgcagctactgaagataacacacaatgncctgcctatgtacctttttataatgcacca

SEQ ID NO: 24180 - DNA, 101 bp, rice(Oryza sativa)
  misc_feature (71): n=a or g
tggaccaatatctatcgcatgggttccaattaggaaggcaggggttttagctccgcctccgctcgtcgccntgaccatcccaatccccactcccgtcgtct

SEQ ID NO: 24181 - DNA, 101 bp, rice(Oryza sativa)
  misc_feature (71): n=t or c
tcgttgtctcgttgatgttatcctcaagctttgtcaccaaattttctaagcgcgcttctctctacggcttnaacttgcaagtttttacatttgcatggctg

SEQ ID NO: 24182 - DNA, 101 bp, rice(Oryza sativa)
  misc_feature (71): n=t or c
ttccatgatgtgatgaatcacttggcatcatagccatgtaaactcgctctcaactatattgagaaaggacngatgaagatattacttctttatctattgaa

SEQ ID NO: 24183 - DNA, 101 bp, rice(Oryza sativa)
  misc_feature (71): n=a or g
tgtagtttaagctcgacagtgactgatttgtttgtgttggccatttgggtggcatccagattactgttgcntagcttaatcacgccctggtttgtgtaatt

SEQ ID NO: 24184 - DNA, 101 bp, rice(Oryza sativa)
  misc_feature (71): n=t or c
agacctaaaattgttgcagctatagcttctgtgcatccagatgtgacagtaacttccttctccggatcganttgcagtccgctgtccttcaggaatctttc

SEQ ID NO: 24185 - DNA, 101 bp, rice(Oryza sativa)
  misc_feature (71): n=a or c
aacatctccgccatggtacttcatagtaactaagctcttgattaaggagctcgcataagcctttgaagaantagtaaactgattctccactctctgaagat

SEQ ID NO: 24186 - DNA, 101 bp, rice(Oryza sativa)
  misc_feature (71): n=a or g
cagtcctgggctcagctagttgggctactttatggcccataaaatagttgaactactagtcgtcgcggaanggaaaaagtatacattttctccctcaacta

SEQ ID NO: 24187 - DNA, 101 bp, rice(Oryza sativa)
  misc_feature (71): n=t or g
caggtatcccgtcagaggtgtgaggatctggcgtagtgattccagtattggcatggacgtaggattatcgnagtggatcgatatcaacatttctgccacta

SEQ ID NO: 24188 - DNA, 101 bp, rice(Oryza sativa)
  misc_feature (71): n=a or g
atgccactatctttatatcaagctcattaatggaagtatctatgaggcaaaaataattttctgaatgtatnccaagtgctctagatgtggtacactctaaa

SEQ ID NO: 24189 - DNA, 101 bp, rice(Oryza sativa)
  misc_feature (71): n=t or c
tgttttaaacattgtgtcaaaagacattgcgatctgtcaaactgtgtggaggtcaaactgtctccagaacnctaaaaaaatgggcctctgtatgttaagaa

SEQ ID NO: 24190 - DNA, 101 bp, rice(Oryza sativa)
  misc_feature (71): n=a or g
tttatattattgtttaaacacggtatagacacatgtgcctatacacatatgcacactcaccactatgaatntccatacggataccgtacccatatgagtac

SEQ ID NO: 24191 - DNA, 101 bp, rice(Oryza sativa)
  misc_feature (71): n=a or g
ttggataggcacaaaactgcaaatgtgaaaatttggagtaggagagtttgtctgtgggatttggagtactngaaaaatttaaaggttagacataatcttga

SEQ ID NO: 24192 - DNA, 101 bp, rice(Oryza sativa)
  misc_feature (71): n=t or c
gattagagtgtgccagtgttgtcccagattggctgagccgagagcagagtcttgatgctcactccaaatcnattttgtccatggggaattttgtgaaaaaa

SEQ ID NO: 24193 - DNA, 101 bp, rice(Oryza sativa)
  misc_feature (71): n=t or c
taaattgtttaagcaattaagatgacatcaggaattaaacaagattagtatattctgaccccggtgacacngatgaactaattcctccccgggcgacgaga

SEQ ID NO: 24194 - DNA, 101 bp, rice(Oryza sativa)
  misc_feature (71): n=a or g
agcaaaaaaaaaattatatatcacctcttgagttaatgcattatgtactgttctaagagcacccgcaatgntaaagtaaggtgctctctataaaacatgta

SEQ ID NO: 24195 - DNA, 101 bp, rice(Oryza sativa)
  misc_feature (71): n=t or c
tcgaaggtatgggacagattcaatgcatggcccaaaagcccaggccaaacatttgaatgattggtgtcctncaggagatgtaggatttgatagaagttgat

SEQ ID NO: 24196 - DNA, 101 bp, rice(Oryza sativa)
  misc_feature (71): n=a or g
catgatagcagatgttctgtatcggtagaagaaaatgaattttcatctagttctgaagaagagtttccccntgtcgagagtataccaaaacaaatcagttc

SEQ ID NO: 24197 - DNA, 101 bp, rice(Oryza sativa)
  misc_feature (71): n=t or c
gatatgattggtgagtttggactcgtttgtctgaggaacacaagtctgcctttgttacttccatcgtctcnagatataactatcttagtatttaacgtatc

SEQ ID NO: 24198 - DNA, 101 bp, rice(Oryza sativa)
  misc_feature (71): n=a or g
aggcaacccaactcaactcaactactgctcttctgtgataccttcgcaaacgctggcgactggcaatggcnatggaaggccaacggcggcgacgcttgcgg

SEQ ID NO: 24199 - DNA, 101 bp, rice(Oryza sativa)
  misc_feature (71): n=a or g
aggtccaccgccgccgccgtgtagtcgtgaatctcttcaatatggaacaacaccgggtgcttgacgccttnctgccagtgctccggtggcgtctccgagat

SEQ ID NO: 24200 - DNA, 101 bp, rice(Oryza sativa)
  misc_feature (71): n=a or g
ctctagtgctttcttcacgttgccctctttgcaatgcccgtttatcaatatattgtacgtgaacacatccngcgcaagaccctttccacccatctcctcga

SEQ ID NO: 24201 - DNA, 101 bp, rice(Oryza sativa)
  misc_feature (71): n=t or c
tgtttaactcacagtatcgtcttgcacttattttcgctggcttaatggttctagctgtttctccctccatngtaaaataagccaacctcatactaggtatg

SEQ ID NO: 24202 - DNA, 101 bp, rice(Oryza sativa)
  misc_feature (71): n=t or c
gtaggattttcctcaagaagttcacttgaagtattcctacttccaggaaccaacgtcttctggctatctcnttttcttctattctctgtaaagtttaagtt

SEQ ID NO: 24203 - DNA, 101 bp, rice(Oryza sativa)
  misc_feature (71): n=a or g
agaaaacagcatggggatcgcagtgatattaggcgataaatcaagggcaatgatccgaacaagacaaaatnctactaccaagttcctaagaaaaccacccc

SEQ ID NO: 24204 - DNA, 101 bp, rice(Oryza sativa)
  misc_feature (71): n=t or c
tcaatggcggacggggctaatcgaatttgacatgacatgaatacatgatcggtgtttgtacctggccgtcnggggtgtagcatgcggcggtgaccatgtcg

SEQ ID NO: 24205 - DNA, 101 bp, rice(Oryza sativa)
  misc_feature (71): n=a or g
actagattgcgctccttctgtgagaccggaatactaagcccttgccacggcttttccggtgaagttctctnctgccagagccatcgtgacctcagggcgat

SEQ ID NO: 24206 - DNA, 101 bp, rice(Oryza sativa)
  misc_feature (71): n=t or c
gttataactcttcaaacatattagatatgcatcatagcaggcattgtcacctaattggtgttggacggttntaccattgtcagaaaacaacaagtcctgat

SEQ ID NO: 24207 - DNA, 101 bp, rice(Oryza sativa)
  misc_feature (71): n=t or g
tcatctgatgacaagaagaataatgtcagaggtgatgaactaactgtctgaatttggtgcttgcagggggntctaagtcagctgatcttctgcaagctttg

SEQ ID NO: 24208 - DNA, 101 bp, rice(Oryza sativa)
  misc_feature (71): n=a or g
gtgtattgtaggtaagtaccactaaagagaaggcactggaaaaaaaatatcacaagtgttatgttgtcccnataattcgttgtacctcatcaggtacatgt

SEQ ID NO: 24209 - DNA, 101 bp, rice(Oryza sativa)
  misc_feature (71): n=t or c
aatgtccttttcgtttgctgcaatcaaccttaaagggctcttttgatgctatctcttcaggcatgtccttnacaacttccacataacctctggtttgctca

SEQ ID NO: 24210 - DNA, 101 bp, rice(Oryza sativa)
  misc_feature (71): n=t or c
ctaccagccaccgtccctgcaggttaccggcgaccagccagccactagcactgcaccgcaaccggagaaanaaataaccatcaaggacgacaacgacgacg

SEQ ID NO: 24211 - DNA, 101 bp, rice(Oryza sativa)
  misc_feature (71): n=a or g
ggcaactttttgtttttttttcataaaggtgttcttttagtctacctgcgaaaagaaaggaaggtcatccncaaaaattaatcattttctatagtgtaact

SEQ ID NO: 24212 - DNA, 101 bp, rice(Oryza sativa)
  misc_feature (71): n=t or c
cccgggcttactcacgtctctcaaacatgtccttcacttgaaaactgcaacactgctgcacgtattccagntccaggaggtggcggatcaaatcctttgct

SEQ ID NO: 24213 - DNA, 101 bp, rice(Oryza sativa)
  misc_feature (71): n=a or g
agccatgacatcactgagactccgaaggaccttatctccgtccagattaagagcaaggacacaatcgaccncctcacgttcacctacaaggacacgaaagg

SEQ ID NO: 24214 - DNA, 101 bp, rice(Oryza sativa)
  misc_feature (71): n=a or g
gccggccgagaacgcatggaatagtgagtagatgctacccgcacaccttgtacagccagaaccctcctctntgctcgccgcttcccgttcgtccatagccg

SEQ ID NO: 24215 - DNA, 101 bp, rice(Oryza sativa)
  misc_feature (71): n=a or g
aactgaagcttgacgagacggcggcggctggcggatgcggatatgagcttgagcttgtcctctaccaagcnttggcggcgctccatagggaggactccccc

SEQ ID NO: 24216 - DNA, 101 bp, rice(Oryza sativa)
  misc_feature (71): n=a or g
aagctaaaaggacgttgatatgtttacattagttagtggttagtactactactggttactactcgtagttntaacgtgaaatatcttataatgtgatctga

SEQ ID NO: 24217 - DNA, 101 bp, rice(Oryza sativa)
  misc_feature (71): n=a or g
ccatatttcctgccgattcatccaggttgtgctccccctgtaggcatttatatcttctcctattgaatgtntatgataatatattcattactttgcttgct

SEQ ID NO: 24218 - DNA, 101 bp, rice(Oryza sativa)
  misc_feature (71): n=t or c
acttgagttcaaattaattcaaactgcatgcagaaatgagtcatcgtagtggagtataaatagtacaagangcaatgttaaccagacacatgagactcacc

SEQ ID NO: 24219 - DNA, 101 bp, rice(Oryza sativa)
  misc_feature (71): n=a or g
aatgatgagctggtacctggcatcaaaggatgcaggatttactcctagcattaaggcctttgaatatttgntcacaggttttgtgaagttggacaggctag

SEQ ID NO: 24220 - DNA, 101 bp, rice(Oryza sativa)
  misc_feature (71): n=t or c
gacttccgtatttttttcagaagttcgagttcccgaggaatcattcatttcgactgaatctgagggtattngtggtgttttctatccaggcaagtccatct

SEQ ID NO: 24221 - DNA, 101 bp, rice(Oryza sativa)
  misc_feature (71): n=a or c
gggctgaggaggctgctggggaaaaccctagagaagcggctggagctgagcacctccatggctgctgctcngcatcgccgcggaggtggagactggagagt

SEQ ID NO: 24222 - DNA, 101 bp, rice(Oryza sativa)
  misc_feature (71): n=t or g
tggcagagactgtggtgatcatgcaagacgagttcagagacatcctatatatacaccattgaaggagacanatctttgttgtatcaggaaagtggcaattg

SEQ ID NO: 24223 - DNA, 101 bp, rice(Oryza sativa)
  misc_feature (71): n=t or c
attgtggccgaagtcctcttgtccaaatgcaagataaaagtgagttcccagacacttgacatttgccatgntgccaaaccggacggagcttggatcgaaag

SEQ ID NO: 24224 - DNA, 101 bp, rice(Oryza sativa)
  misc_feature (71): n=t or c
cttcagtatggttgagtgaaaacattgtcgccataaaagaaaacaatgatgactccatttcttgtgggacnaccacctattttcagaattacacagtataa

SEQ ID NO: 24225 - DNA, 101 bp, rice(Oryza sativa)
  misc_feature (71): n=a or g
cgatgatcaatcatcatcgtacgtgcaacattgacaccgatgatagatcgatgaggattccattcacttgncggacaaaaacgcgtgtggtgcggtatgtg

SEQ ID NO: 24226 - DNA, 101 bp, rice(Oryza sativa)
  misc_feature (71): n=t or c
ccaaacttctaattttggcgtgaactaaacacacacccttggtttctaaaccatggccttatttagttccnaactttttcttcaaacttccaacttttccg

SEQ ID NO: 24227 - DNA, 101 bp, rice(Oryza sativa)
  misc_feature (71): n=t or g
tggcaccccccaccctctctcacacacactccctcacatgcaaacgatatgaccaagtccaaccaggccancagcagcagagcagccatggccatctaagc

SEQ ID NO: 24228 - DNA, 101 bp, rice(Oryza sativa)
  misc_feature (71): n=a or g
ttgttttaatatatggatgtcagccagtatagctatacagctagtttgccaggagctcagatggagaggcngctcctggaggcagccatggttggcagtgc

SEQ ID NO: 24229 - DNA, 101 bp, rice(Oryza sativa)
  misc_feature (71): n=t or c
gagggccaacggtgtgagttagagcaggaagtcgaggtagaaattgcagagctaagggaacataaactcanacgcttgcagaaaacaaagaatagtgttat

SEQ ID NO: 24230 - DNA, 101 bp, rice(Oryza sativa)
  misc_feature (71): n=t or c
gtgattctaacataaggaaaccttcaactgatggtaaaggacaggtgatcattgataaggcacagaatgcntgattgcctgtaggcttttgttcaatgttg

SEQ ID NO: 24231 - DNA, 101 bp, rice(Oryza sativa)
  misc_feature (71): n=a or g
gccacctcgccccatcaccctctccctccaccacactacaccccgctccactctcaggcaggcaatcagcngcgaggcaccagcccaccggccggcaatgg

SEQ ID NO: 24232 - DNA, 101 bp, rice(Oryza sativa)
  misc_feature (71): n=t or c
ggccctacaaacctcgcatctctgaactgacaaatctcattcacctctacttctgtgctggtagtctcaantgagaaagatatgcgatcatggcctttgta

SEQ ID NO: 24233 - DNA, 101 bp, rice(Oryza sativa)
  misc_feature (71): n=t or c
tatcttcaagtcaacatctattcatcacgccaatggctgcaactcctgtaaatgtgagacgatgaaaaganaaggttgttcattctcttgctgtcaaactg

SEQ ID NO: 24234 - DNA, 101 bp, rice(Oryza sativa)
  misc_feature (71): n=t or c
ggttgctaggctagttctagtaccattcttttggaggagaggaagagcaaggttgaaagtggattttaatncctcgaggaatgtcccatcgtatacctttg

SEQ ID NO: 24235 - DNA, 101 bp, rice(Oryza sativa)
  misc_feature (71): n=t or c
ccgagaactcctacgcaagatgaacgccaagcacaacatcgctacaccctaccaccctcagaccaatggcnaagcagaaatgtcgaataagcaaatcaaga

SEQ ID NO: 24236 - DNA, 101 bp, rice(Oryza sativa)
  misc_feature (71): n=a or g
cgacgcaaaggtacacataatgttagtgcgtcggtgactattgctcattttcgcatgacatctgctgcgtnctgcatagctgccctgcgcatccatcagag

SEQ ID NO: 24237 - DNA, 101 bp, rice(Oryza sativa)
  misc_feature (71): n=a or g
ttgtgcaggaatttcccaacacctttggtcagcctctggtacatttcctgaagccgaacaagatggatgcncaagccaacgatgaacatccaccaatcagg

SEQ ID NO: 24238 - DNA, 101 bp, rice(Oryza sativa)
  misc_feature (71): n=t or g
tatttaggagctatgtttaggatattactcaagttaagtctagaatcatttattgaatccctcgtaccatnataatagtatggtgcgcaagaaggaaggaa

SEQ ID NO: 24239 - DNA, 101 bp, rice(Oryza sativa)
  misc_feature (71): n=a or c
tagttaatttcacgccatgacagatcgatcgatcgatccatgttatatggtacgttgcttagatccatgtnttggtattaatcctctccttgaatcatttc

SEQ ID NO: 24240 - DNA, 101 bp, rice(Oryza sativa)
  misc_feature (71): n=t or c
gggtatcattctgtacggtattgtggatgcccttttctgatgttcgtcatgtaggacagtattctcaacantattattttcaaattccaagatgctaggtg

SEQ ID NO: 24241 - DNA, 101 bp, rice(Oryza sativa)
  misc_feature (71): n=t or c
acccattgtccctctacaggccaccctccacccacctcatgcatcaccccaaatcaacatgtcatttttgncaccacaagacaaaccaccgcaagggccga

SEQ ID NO: 24242 - DNA, 101 bp, rice(Oryza sativa)
  misc_feature (71): n=a or g
aagcggttgcaaagtaattatctaattttgcatatatactggttttagcaacgtacatggcatgcataccnaagatatatatttttaaaaaatggatataa

SEQ ID NO: 24243 - DNA, 101 bp, rice(Oryza sativa)
  misc_feature (71): n=a or c
accccacgagattcccatcggtttcattgtttcaaactccgccgtaataagtcagtggatcaaagagcagngaaggaactttgatggcctattcatctaca

SEQ ID NO: 24244 - DNA, 101 bp, rice(Oryza sativa)
  misc_feature (71): n=t or g
attgtttaacagtttgggaagcgtgcgcgtgaaaaacaagatgagaagttgagaaaggccatgtttagaanattagcccagggctaattttgagaactaat

SEQ ID NO: 24245 - DNA, 101 bp, rice(Oryza sativa)
  misc_feature (71): n=t or c
gcggaggacgctcatgagaagtaggataggatggccacgacaccccgatctggtcattgttgaagctacangaccagttgttgtcgaggtcattgccaaag

SEQ ID NO: 24246 - DNA, 101 bp, rice(Oryza sativa)
  misc_feature (71): n=a or g
ccccacgtgcacaagcgcattgggagtaagttgtgggaattcgagtttgaatatcttcaacacttcgatcngaaaggggctgcatggaaacctaaagccgg

SEQ ID NO: 24247 - DNA, 101 bp, rice(Oryza sativa)
  misc_feature (71): n=t or g
gcggaggcggaggcggtggaggtggtggcgacggatggagatgcaggagcgtgcgaatgtgcgagaagaanaggtggtatagtgttaaacgaaaatgttat

SEQ ID NO: 24248 - DNA, 101 bp, rice(Oryza sativa)
  misc_feature (71): n=a or c
gacgatgacaagcaccttcctctttagcagccttctgttgcgtcgcagcttccatgttcagaagaatgtgntcggttatcccatcacaatcacctcgcgat

SEQ ID NO: 24249 - DNA, 101 bp, rice(Oryza sativa)
  misc_feature (71): n=t or g
gcccgtttaattgttcattctttgtgtcaatttgggccggattaatcaatcggccggctacttagatgttncacgtacgtgtaacagttgtattttcttcc

SEQ ID NO: 24250 - DNA, 101 bp, rice(Oryza sativa)
  misc_feature (71): n=t or c
gcaataggaagtgttatggatgcaatgagaagggtcatgaagttgcatcatgcttccacatgaaggatgantttgtgtcatcaaggaagaagcttaatagc

SEQ ID NO: 24251 - DNA, 101 bp, rice(Oryza sativa)
  misc_feature (71): n=a or g
gtctcactcacttgtatctcgatgaggatgttggagaaggagtaggcgaaggtgatgtcactgaatgcctncaggctgtgccacaccttctgcgttgagct

SEQ ID NO: 24252 - DNA, 101 bp, rice(Oryza sativa)
  misc_feature (71): n=a or g
aagatcgttcattccccgaagtatttagcatttcaagaaaattcgagatctctttagaccttgcttcagcnatcaggtcaatattgcctaaaaatgataca

SEQ ID NO: 24253 - DNA, 101 bp, rice(Oryza sativa)
  misc_feature (71): n=t or c
ttaatgggttttggcccactctatttccagtttagagagcccaaattaggacaagccagcgtctctctctntctcgtctctccaatggcggcggcggcggc

SEQ ID NO: 24254 - DNA, 101 bp, rice(Oryza sativa)
  misc_feature (71): n=t or c
gataagagaatgagcaattgggagaaatactgccttcgacattgtttcgcaatacctgaaggattcctganacgtgaagatgtatgttcctcatattgaag

SEQ ID NO: 24255 - DNA, 101 bp, rice(Oryza sativa)
  misc_feature (71): n=t or c
gaggtccagcttggcagcgagtagttccgtttccttgacgaagcacatacctcgctgatgggtttggagtngttcctcgctccaacccatattggagacca

SEQ ID NO: 24256 - DNA, 101 bp, rice(Oryza sativa)
  misc_feature (71): n=a or c
ttagttgcattctctgcctgtatagctttttactgtagtccaccattgcgatggaagtgccggagatcgcngtcgaagtggcgccggagatcatcatcgcc

SEQ ID NO: 24257 - DNA, 101 bp, rice(Oryza sativa)
  misc_feature (71): n=t or c
cgacgcgatggagcgctgccttcaccagagagttcatcaccactggcggcatctagaagccgagcagccgnggccatgacattagaaaggggaaataagga

SEQ ID NO: 24258 - DNA, 101 bp, rice(Oryza sativa)
  misc_feature (71): n=a or c
acttgttcttccatggtacaaattcatgccagtaaattgaaaccctgtgatacactcactacaaggttttngggctaatgccacaaaattttgggcaacaa

SEQ ID NO: 24259 - DNA, 101 bp, rice(Oryza sativa)
  misc_feature (71): n=a or g
tcgtatgccgcgagagatcggtgtcgaggtgcgaccggcctgctgaaataggcaaccgggtgcttgtcttngatgagtacggtgccgaacccatgggacga

SEQ ID NO: 24260 - DNA, 101 bp, rice(Oryza sativa)
  misc_feature (71): n=a or g
gcactactggttttatctaccctgtatacctcctgttcgtggcgattttagcttgtgtaattatcttctgntgacagcaaattaatactacatccgttcca

SEQ ID NO: 24261 - DNA, 101 bp, rice(Oryza sativa)
  misc_feature (71): n=a or g
agcacggacgactcgtttggattagttccaacatatcctacgaaccgatctgatgttgtcgctgcatcctnttccttggcaacacacagagtttgaacccg

SEQ ID NO: 24262 - DNA, 101 bp, rice(Oryza sativa)
  misc_feature (71): n=t or g
agatcacctcctatcatcagtcttttctttatatcagcaacccctggatgctgctcccattcaattcagtnactcacccacagtcataatggcctgccact

SEQ ID NO: 24263 - DNA, 101 bp, rice(Oryza sativa)
  misc_feature (71): n=a or g
atcacaatactactacattgcatagtaaagaagcttttggtacacggctaatgttgttagcctgtaaagcntgtcgttggagacgtggcagtggaagccga

SEQ ID NO: 24264 - DNA, 101 bp, rice(Oryza sativa)
  misc_feature (71): n=a or g
ttactttgcttttcgcctctctttttttctcttcttttatttagttcgctcgttggaagatgccgaggctnaagcggcgaatatgatcaggggccttataa

SEQ ID NO: 24265 - DNA, 101 bp, rice(Oryza sativa)
  misc_feature (71): n=a or c
ttcctaggcaccccctaatatacactagctccgcccctggggctatatatatctatctttgtatctctctntatatatattatatatagagagaactttta

SEQ ID NO: 24266 - DNA, 101 bp, rice(Oryza sativa)
  misc_feature (71): n=t or c
gccgccaccgccttgtgctacttctagctgatggagattcaattccatccatgcacgggtgtacatgcaanggtcctgagtacatgcaatgccggcgttct

SEQ ID NO: 24267 - DNA, 101 bp, rice(Oryza sativa)
  misc_feature (71): n=a or g
tgtggggtttttgcagaagtgcatactgcatagtacgtagtactaggctactagctccgttttctattagntgatgccgttaattttttatcgtatgttta

SEQ ID NO: 24268 - DNA, 101 bp, rice(Oryza sativa)
  misc_feature (71): n=t or g
ctctttgtttcaaaatatttgtcatgctcaagcactaattaccaagaaggcaaggaggcacggagctatantaaaatttgataaaatagaaccaaatttaa

SEQ ID NO: 24269 - DNA, 101 bp, rice(Oryza sativa)
  misc_feature (71): n=t or g
tgaaacagctcctgctcaagtggttattgctgatggaggtgttttacaatgtaacaaggtagcaacaaagnttgattggtggtgccaagggcatagtttta

SEQ ID NO: 24270 - DNA, 101 bp, rice(Oryza sativa)
  misc_feature (71): n=t or g
agtgtctaattcttcttattcatggtaattgcaggctcgttccaaaactgaagctgcaagaacaaaagctncccaggaggctttcagggagcaacagggtc

SEQ ID NO: 24271 - DNA, 101 bp, rice(Oryza sativa)
  misc_feature (71): n=t or c
tcgttaaaggtgcatgtttggagatagagatacaagttgaataggtgcatgtgtgtcagagactccccgtncgatttttctcgttggttcgggcgttcgat

SEQ ID NO: 24272 - DNA, 101 bp, rice(Oryza sativa)
  misc_feature (71): n=t or g
gaagaagaggaagaaggtggtcaagtacaagatgcctaatgaagttatccaacagatgatgagataccccnacacctacccggagtgcaccgaggaggagc

SEQ ID NO: 24273 - DNA, 101 bp, rice(Oryza sativa)
  misc_feature (71): n=t or c
ttgtcatcagaaccatacctgcccaaagcaacaacagaagaaacaacagggaattttttactaactccgtnccaaaatatagctatttctagcacaatact

SEQ ID NO: 24274 - DNA, 101 bp, rice(Oryza sativa)
  misc_feature (71): n=t or c
tagttggtaatctcctttaattcgcactccatagcttagagatttcgaacctactatgtcaaaatattagnaataccaaaacctagctaagttttgataat

SEQ ID NO: 24275 - DNA, 101 bp, rice(Oryza sativa)
  misc_feature (71): n=t or c
caattaggattgctttatatatatatccgggtgaatcatagacccaaaagtgcacacgggtgaatttattnggcctcagtgcatcggcaaaactagccata

SEQ ID NO: 24276 - DNA, 101 bp, rice(Oryza sativa)
  misc_feature (71): n=a or c
caacatatttttaccgaccgactatcagacggtggttggttagatttgccgaccgaccttatttataccgnccaacatatttatccccacccacaacaatt

SEQ ID NO: 24277 - DNA, 101 bp, rice(Oryza sativa)
  misc_feature (71): n=a or g
caattcttctaagatacttattcgtcctcaaatataagataatccatgttatatttttggaacggaggganttcatatttatgctgacaataagagaaatg

SEQ ID NO: 24278 - DNA, 101 bp, rice(Oryza sativa)
  misc_feature (71): n=t or c
ttcgaacatggcctatgatagaacttcgtgatttgcttgtgaaattccctagaatctagagcttctccgangacaaatcatagcattcttgtttttttttt

SEQ ID NO: 24279 - DNA, 101 bp, rice(Oryza sativa)
  misc_feature (71): n=a or c
cagtacatcatggcttcttgcttgtgcagcttggcttaaaattgacaaaactaccggtgaaagatccgacntggtcttcattaaccaaacaaccaattatg

SEQ ID NO: 24280 - DNA, 101 bp, rice(Oryza sativa)
  misc_feature (71): n=a or g
gtgaactagacatagtaaagagaaatggaatctatcagtaatcagggcactagggatagagatacatgcangtgagtaccgctactggactgtaatggaca

SEQ ID NO: 24281 - DNA, 101 bp, rice(Oryza sativa)
  misc_feature (71): n=a or g
agacaacactgtagtctatcgtactgtcgtgtgtttcatttacaacggctgaaaaatttctcacatagccncaaactttacagacaccattagcagcttga

SEQ ID NO: 24282 - DNA, 101 bp, rice(Oryza sativa)
  misc_feature (71): n=a or g
atactatcgcaaagatcacaatggtagaaaatagcccggacatcattttaacaaacgatatttcttggggnaaaaaagagagataattttaacaagcgacc

SEQ ID NO: 24283 - DNA, 101 bp, rice(Oryza sativa)
  misc_feature (71): n=a or c
cattttgcagcattgaaatacagttgggttggtgagtctaaggagacctactatcagagaattagaccctngatgttcccagctttcgctcaaagaggcga

SEQ ID NO: 24284 - DNA, 101 bp, rice(Oryza sativa)
  misc_feature (71): n=a or c
acaagttactgtagacttatgagatgacatatataagtctacagtacacatatatcctcctccctccgttntaaaatataagatttcttttttttttactc

SEQ ID NO: 24285 - DNA, 101 bp, rice(Oryza sativa)
  misc_feature (71): n=t or g
caggagtgtacaagaaaatcgagtgagacagagaactaaagtggtggcatcgatgactagagaatgaatgncactagatcttggcaaatgacggatcatag

SEQ ID NO: 24286 - DNA, 101 bp, rice(Oryza sativa)
  misc_feature (71): n=a or g
cagttggggctccacggaggcagtcctaatgacacctccattgctgctcgagagcttgcgcatctgtggcntcagagactggctgccccgccggatgaaag

SEQ ID NO: 24287 - DNA, 101 bp, rice(Oryza sativa)
  misc_feature (71): n=t or c
gaagagcactaagcccctggacgctaaaaaagcaactcgccgtatcaacggtagatatattcccttgactngcaaatgcaacaaaggcagcatcacggcag

SEQ ID NO: 24288 - DNA, 101 bp, rice(Oryza sativa)
  misc_feature (71): n=a or g
aggccttagtattagtcaggtcttttgcgatgtcaatcatgtagctctgagcttgcagttgctgtgggaanggagtttgcttgctctgagcttctcaagaa

SEQ ID NO: 24289 - DNA, 101 bp, rice(Oryza sativa)
  misc_feature (71): n=t or c
atccacgactgatgattcgttttaagaagttaaattaatttgcttcctaatgatggtagttatttaaaatnggagtgaacctttaatgcttgaacatgtag

SEQ ID NO: 24290 - DNA, 101 bp, rice(Oryza sativa)
  misc_feature (71): n=t or g
ctggtggcgagcaatccatcatcatctattcaacgcggaattgatgtgtgcgccaatggggtatcgatccntatatatgggtaggataaaaagaaaaattg

SEQ ID NO: 24291 - DNA, 101 bp, rice(Oryza sativa)
  misc_feature (71): n=a or c
ttttgcgctttcaagtttcaaaacgggacttcactttctaccttcccgtggcccacctgaaaattagcatnccctgaataggaataagtctaccctgcctc

SEQ ID NO: 24292 - DNA, 101 bp, rice(Oryza sativa)
  misc_feature (71): n=a or c
tatacctcttgaataatacaatgcaaatatccgtgcctaaaaaaaatggaacaaaacccacggatcacatntatatataaaagatgaaattccaatcatat

SEQ ID NO: 24293 - DNA, 101 bp, rice(Oryza sativa)
  misc_feature (71): n=t or c
tttcttgatctcgttgaattccgcgctgatttccgagttcgtgggaatcgtttgtgcgcggagggggtagntgggcgaggtcttggggggtgatttttgcg

SEQ ID NO: 24294 - DNA, 101 bp, rice(Oryza sativa)
  misc_feature (71): n=t or c
attgatcaacaaaacaagctactcaacaagctagtgccccgcaccaatgtttttttagaaaaaaaaggcanattgtagattgtttaaaaatggtgtttttt

SEQ ID NO: 24295 - DNA, 101 bp, rice(Oryza sativa)
  misc_feature (71): n=a or g
tcatggttggtggaatggatagagcactggagttgtattattatttttgtgtggagcctacaacatgtgtnattacaaagaagaaaaggctaatgatccat

SEQ ID NO: 24296 - DNA, 101 bp, rice(Oryza sativa)
  misc_feature (71): n=a or g
tccaacatataacttgaccatttgtatttcactctgttcaggtgaggcaatcaagttctcgccaaccagcncagtcctatcgaagcaggcatggcaaaaaa

SEQ ID NO: 24297 - DNA, 101 bp, rice(Oryza sativa)
  misc_feature (71): n=t or c
taaccgtgcaggacacccatgatcaactagtgattaattacactgagctggaagctagccttgacctgtcngtctcgaggtcgaggctacgacgacgatat

SEQ ID NO: 24298 - DNA, 101 bp, rice(Oryza sativa)
  misc_feature (71): n=a or g
gtagtctcctaggttgaacttgccaaccagctcgtacccttccctcaccatgtcacccatgtcgctgatgncgccgccatggtggtcatggtgttcgagcc

SEQ ID NO: 24299 - DNA, 101 bp, rice(Oryza sativa)
  misc_feature (71): n=t or c
cgcgagtggataatccagtcacataaaggttattccctgggtttcttaaatcatcgtctcggctcctattnaagatcaataactgaaactcagtactatgt

SEQ ID NO: 24300 - DNA, 101 bp, rice(Oryza sativa)
  misc_feature (71): n=a or g
acaaaaagaaaatatgatccagagaactacggacttatccacatctgagataaactatacgaaactgaacnataatgttggtatatatagtgtgtcagcta

SEQ ID NO: 24301 - DNA, 101 bp, rice(Oryza sativa)
  misc_feature (71): n=t or g
ctcgtgattgggggtatcattcgcggagcggagagggtagaagtaattgaggaggggaatcggggggtttnggttggggggtgctgggatttcaaaaccct

SEQ ID NO: 24302 - DNA, 101 bp, rice(Oryza sativa)
  misc_feature (71): n=t or c
caccgaagagatatgtcattcgagagctgacgaaaggagcgatacacgtgtcattttatcttgattttatngggcatggtgggcctagaggctagtgtgtt

SEQ ID NO: 24303 - DNA, 101 bp, rice(Oryza sativa)
  misc_feature (71): n=t or c
ctcttgctgacgtgacgacggtggttctactacctcggtgacggcccgcctattctcagcgatgccatggnagtgtcaggtcctcctcatgctgccgtcag

SEQ ID NO: 24304 - DNA, 101 bp, rice(Oryza sativa)
  misc_feature (71): n=t or c
agattgacatgggcctcctgtggtggaagcaatatatggacctcacgtgctgtgttcaatcaaacctgagntttttcatccgacggttcagatgagatcta

SEQ ID NO: 24305 - DNA, 101 bp, rice(Oryza sativa)
  misc_feature (71): n=a or g
agatagagagagcgagagagacaaagagagcgagagacagacggtgaatcagagacagcgagagagagagngagagggggggggggtgcaaattaagggat

SEQ ID NO: 24306 - DNA, 101 bp, rice(Oryza sativa)
  misc_feature (71): n=t or c
actgaaataatgctcggtgacgcaggcgcagtttgagtgaattgaaatccatggcggctggctataccttnctgcactacatttgcaatgcgctgcatacg

SEQ ID NO: 24307 - DNA, 101 bp, rice(Oryza sativa)
  misc_feature (71): n=t or c
tgaactgatgcataaaaaaaaagcggcagcagtgtacagtatatgagcatttgttatttgctacttcctcnatttcacaatgtaagtcattctagcatttc

SEQ ID NO: 24308 - DNA, 101 bp, rice(Oryza sativa)
  misc_feature (71): n=a or g
tcgtgggggcgaaatcggtgcggttttgggccgttttggggtgatgagagcattggcatcgagagatagantatatagctaggataggtatatttttttta

SEQ ID NO: 24309 - DNA, 101 bp, rice(Oryza sativa)
  misc_feature (71): n=t or c
gctgttgggcctggacgccgcacccgtgccgccgcaattattcgtggatggccaatattcgggtagccgangaagtggtcatgcggcatgagtaggcgcca

SEQ ID NO: 24310 - DNA, 101 bp, rice(Oryza sativa)
  misc_feature (71): n=t or c
aggtatcacgtgatacctggtagatattagccgggatgatatcaggtatcaggcaataccttagaagaganatcgtttatcgtctggtggcattcccctta

SEQ ID NO: 24311 - DNA, 101 bp, rice(Oryza sativa)
  misc_feature (71): n=t or c
gtaataagcaactacttatatcatatagttctgctctgcactccatgatggaattatcacaatcatcaccnaatcaaccatacacgacaggagtactccct

SEQ ID NO: 24312 - DNA, 101 bp, rice(Oryza sativa)
  misc_feature (71): n=t or c
ccagggcagtttgggaaaccctgcccgttgcaactgcccccaaattacggggttgtaagttgcaacatccngtaacggcagtattttctcttttttccccc

SEQ ID NO: 24313 - DNA, 101 bp, rice(Oryza sativa)
  misc_feature (71): n=t or c
ctaaaacttttgcgtagatttagcatggctagtcgcacatgtcccacaaaaccacgtgagtttccgtcagnatgggctgcaagtgggttacgatctctttt

SEQ ID NO: 24314 - DNA, 101 bp, rice(Oryza sativa)
  misc_feature (71): n=a or g
atacgagtactcggtagtaaaattgtgctacgacgacttgctacaattcaaagttctggattctctctctnaaaaaaaaatcaaatgttctggaatattac

SEQ ID NO: 24315 - DNA, 101 bp, rice(Oryza sativa)
  misc_feature (71): n=a or g
ggatttgagtctggatagcaagttcgatctgctcctgaaaacaactggggagaatgagaagaaaagggtgnaggcagaggagagatcttgagcccacttcc

SEQ ID NO: 24316 - DNA, 101 bp, rice(Oryza sativa)
  misc_feature (71): n=a or c
gatccgatctgcaattcagcttcctatcaatcagtaataacccacaaattcaccacccttcccaaaaaaanaggaccaccagacacaagtaatcggagcac

SEQ ID NO: 24317 - DNA, 101 bp, rice(Oryza sativa)
  misc_feature (71): n=a or g
aaacacatttcgaaagggtaaaagagaagagggaaaaggagcgcactaggttagctactgactttaagatncatatatgtatgatagttgggactagatat

SEQ ID NO: 24318 - DNA, 101 bp, rice(Oryza sativa)
  misc_feature (71): n=t or c
ggagaacgcgtcggcgttgcagctcacggcgtggaccagctgcccgtccaccgtgaagaacaccttccgcntcgccggctcgaagccgcagcccaccacct

SEQ ID NO: 24319 - DNA, 101 bp, rice(Oryza sativa)
  misc_feature (71): n=t or g
taacacacaattatactggagcatatgttcactattttctgttgtgttcgattctctagcgccaaacaatnaaaacaaaagaaattgtgtcaaatgtaatc

SEQ ID NO: 24320 - DNA, 101 bp, rice(Oryza sativa)
  misc_feature (71): n=a or g
catgtgagctacgccgtcgtagaagaaggcgttgtagcttagcaccttatcgtcctcttcagattcagacnacggcaagccactattgttgtgggtgatca

SEQ ID NO: 24321 - DNA, 101 bp, rice(Oryza sativa)
  misc_feature (71): n=t or c
ttggacgaaggtaaataaatatcattgccgcaacacaagctgagttgatacaaaggcctgatgtatttcantgtttaatgaaatgtctattatcttaaaag

SEQ ID NO: 24322 - DNA, 101 bp, rice(Oryza sativa)
  misc_feature (71): n=a or g
ctagcaccactacataggcattgcaaattatccaatcctattagatacagaacttgaagggcatgtagctnccagaattcaggaaattccatgcacaatgg

SEQ ID NO: 24323 - DNA, 101 bp, rice(Oryza sativa)
  misc_feature (71): n=a or g
atttgcagatgttttgctttcttttcttgtcctcaccgaatcctactaacctcctctttgtggtaggcatntgcataagtgtcaagtgtctatatatattc

SEQ ID NO: 24324 - DNA, 101 bp, rice(Oryza sativa)
  misc_feature (71): n=t or c
tatatattttagttaaattagagtcggtcaatttgtatttgtccgtgtgcccactcaacatcactagttcntacgataaatcaccatgaaggcatgaactc

SEQ ID NO: 24325 - DNA, 101 bp, rice(Oryza sativa)
  misc_feature (71): n=t or c
cacgagttttgtcccaaaatctcggtacagtgtactcaatcgttgctcatcaccctccattgcagctaaantggctacattttttcgcataattaaaccat

SEQ ID NO: 24326 - DNA, 101 bp, rice(Oryza sativa)
  misc_feature (71): n=a or g
tttagtagatcgaactatcgaccggttatattgtgttaaacaaagtacatgcttctattagggccactcanatagacgcgtgagtgttcacaaataaaata

SEQ ID NO: 24327 - DNA, 101 bp, rice(Oryza sativa)
  misc_feature (71): n=a or g
tggccaccaccttgaggtagatgagcttgggggagtagtacaccttggagcgcgtgctggcgaggctgtcnagggagacggagtgggcgtccgagtgccag

SEQ ID NO: 24328 - DNA, 101 bp, rice(Oryza sativa)
  misc_feature (71): n=t or c
attcattcaagtaaaatatataggagatcaagtagaggtctaggttattgggatggtgttaaggctgcgtnagtttccagtagtcgttcccaactccccca

SEQ ID NO: 24329 - DNA, 101 bp, rice(Oryza sativa)
  misc_feature (71): n=a or g
taaattccactcgcattgatcaaatcatgcagttcttcatttcagaaacgtcctcatgcacctgggaagcncgttatcatacttgtcaagatcttcctcgt

SEQ ID NO: 24330 - DNA, 101 bp, rice(Oryza sativa)
  misc_feature (71): n=a or g
gaggtcgagcttgcttgggagacgtctctgcaagctcatggagggcatccaccatctcctccggattggcngagaggcgaggaggaggtgggaggtggtgg

SEQ ID NO: 24331 - DNA, 101 bp, rice(Oryza sativa)
  misc_feature (71): n=a or g
gggatttcctgcatgtctggagaagtccgactcgactagaacaaaacacttgctgaagattgtgctccctnctgtcattgtggcgtttggtgccattgttg

SEQ ID NO: 24332 - DNA, 101 bp, rice(Oryza sativa)
  misc_feature (71): n=t or c
aacattgattgcaaccgtgagaaacttgttgacaacacgcctgttactgtgaaagccgtggcagagattgntttccttgctgcgaaaccaaagaagctaat

SEQ ID NO: 24333 - DNA, 101 bp, rice(Oryza sativa)
  misc_feature (71): n=a or g
aagctgaaaccgagagttgattatagaataattattgatgagtaaccctacttgctgtgttctttttgagnggttgagaacccctcccatccgcacggaaa

SEQ ID NO: 24334 - DNA, 101 bp, rice(Oryza sativa)
  misc_feature (71): n=t or c
aaaactggatgattcacctccaaggaaaaagggaggcaaagatcagaaacaagggagctataagccatagntacaagtgattcttaacaagggaaagaaca

SEQ ID NO: 24335 - DNA, 101 bp, rice(Oryza sativa)
  misc_feature (71): n=a or c
aggagaaatgggaattagggaagagctatatccgacagaaggaaagaagaatggaaatgtatatcttcctntagcctgtttcacactaatacttgaggaga

SEQ ID NO: 24336 - DNA, 101 bp, rice(Oryza sativa)
  misc_feature (71): n=a or g
atccagttctcatggcatgtttaagggtgtgagttgagggagaagcgatcggcgggcgtaagagctcgacngcgaccatatgcatcatatggacggaggat

SEQ ID NO: 24337 - DNA, 101 bp, rice(Oryza sativa)
  misc_feature (71): n=a or g
caagctacccaagttacagtgtgttaggctccgacacatttcatgcacagagagcatgctcatcttcaagnaagatgatttcaaatgtctcaagtaccttc

SEQ ID NO: 24338 - DNA, 101 bp, rice(Oryza sativa)
  misc_feature (71): n=t or c
acctgacgttatcaggatcattgtcgcattgctgcaatatatataatcctcgttttgaagggaacctctcnttttgctttcttgcagctagcagtgccgct

SEQ ID NO: 24339 - DNA, 101 bp, rice(Oryza sativa)
  misc_feature (71): n=a or c
tggctcaaaatttactgtttttatcaacaaacttgctcaaaatttcaaaccagaaccgaccaatatgtggntttatgatattatacagcattggtagttta

SEQ ID NO: 24340 - DNA, 101 bp, rice(Oryza sativa)
  misc_feature (71): n=t or c
actccactcacggtctgatcgagttggtgatgaaagaagctgatggcgacaaaatgacttgtagagttcancgagagcaccgatacaaggcacgtatttat

SEQ ID NO: 24341 - DNA, 101 bp, rice(Oryza sativa)
  misc_feature (71): n=t or g
tttcctgacaactgttctgctggtattagtttggtgatggaaggagcttcctcagtgtaattgaagttctnatctgctgctcaagctccctgccaccccat

SEQ ID NO: 24342 - DNA, 101 bp, rice(Oryza sativa)
  misc_feature (71): n=a or g
cagaacaacatccactctgctagcataccctagagatggctatgcacctcacggcggaatgtaggtacacnaagagaatttggggattgatatcaacttga

SEQ ID NO: 24343 - DNA, 101 bp, rice(Oryza sativa)
  misc_feature (71): n=t or c
cctggtgcgatagtcgcagtagaagacgcagtatgttatgctcagatgcttcaacgatggagaccacattnccaggccaccaacgtagcaatccttcatct

SEQ ID NO: 24344 - DNA, 101 bp, rice(Oryza sativa)
  misc_feature (71): n=a or g
tttggtttgacgaagtttgtggaactagcagcttcaatgcatgaagaattggtttttcagaacttggacangtttgaaaaatcatgtgagatgtttggagc

SEQ ID NO: 24345 - DNA, 101 bp, rice(Oryza sativa)
  misc_feature (71): n=t or c
acccaccgttttcaactgctggtatatatgtaggagtattcacaagttgctaatgcctaacagtaaagtcnttgtcatcgtcggaactggccggccgcccg

SEQ ID NO: 24346 - DNA, 101 bp, rice(Oryza sativa)
  misc_feature (71): n=t or c
tactggagggtgtagatattagcgacatcatgcatgttacaagtgatgttgatgctgctacaaaggttttnagtggccaagaagaacaacatgagaaagaa

SEQ ID NO: 24347 - DNA, 101 bp, rice(Oryza sativa)
  misc_feature (71): n=a or g
gccgtacgtctcctgtagctaaccatcacttttcccttaggctctggaataaccgtgctccattgtctcanggaaaggggataccatcttgatctcaaagt

SEQ ID NO: 24348 - DNA, 101 bp, rice(Oryza sativa)
  misc_feature (71): n=a or g
aacctacaagggaacaatgaaagtcagtaaagggggagtcaatgatattttctgaagagcatgcgacatcncgagaacgagtaccccactgagaaacgcgc

SEQ ID NO: 24349 - DNA, 101 bp, rice(Oryza sativa)
  misc_feature (71): n=a or g
taagcatcaagctacaggaccagtttatcttccaggaggtgtcttcccaaattacagatatttgataactngtaaccaacagcctgctaccaacataacac

SEQ ID NO: 24350 - DNA, 101 bp, rice(Oryza sativa)
  misc_feature (71): n=t or c
gtcttatgcgctatcctttttatcattgtcgattttcagaatcgacaactccctgctagtcacgtgtctcngggtaggctgtgttcagtggtgggtgttgg

SEQ ID NO: 24351 - DNA, 101 bp, rice(Oryza sativa)
  misc_feature (71): n=t or g
gggcgaattggggatacgagggcccaatccctgatctttcggagacaaagatcgatgctttcggcagattncagagcaattcagcgccgggccatcaccaa

SEQ ID NO: 24352 - DNA, 101 bp, rice(Oryza sativa)
  misc_feature (71): n=t or c
caatatctgatacttctggcttctctgtaatgaaccacatgattggccttttcgccaggttaaccaaagcnagctagctctgcgataattaatccacagga

SEQ ID NO: 24353 - DNA, 101 bp, rice(Oryza sativa)
  misc_feature (71): n=a or g
tcttagatgtgacctgtttgatgtcatgttggagatggatcgcattctgcgtccagaaggaattgctgttntacgagactccccagatgtgattgacaagg

SEQ ID NO: 24354 - DNA, 101 bp, rice(Oryza sativa)
  misc_feature (71): n=a or c
tcttctccctagttcccacctcaggttcagctacggaactcatcttttcaatttccttgccagttctcttntttagggcctcctcttgcttagcagtctcc

SEQ ID NO: 24355 - DNA, 101 bp, rice(Oryza sativa)
  misc_feature (71): n=t or c
atatctgttctgaagttatgaaacaaagagacttacttttggatcctatactagactttcagtaatttagnagtgcagtaaagaattcgtaccatatatag

SEQ ID NO: 24356 - DNA, 101 bp, rice(Oryza sativa)
  misc_feature (71): n=a or g
gcactccgaggtgggaatggaatgatgctggcttaccttgcgaaggattctgatcttagtgttacctatantgtgactgtatttagtttctggtgttgctg

SEQ ID NO: 24357 - DNA, 101 bp, rice(Oryza sativa)
  misc_feature (71): n=t or c
tattcaggccccttgtatttctcccggactgcaagcttgtcaagttcactcgtgatgtgattggttgctcnggagtcaatgtaccaatttgtgtcaatggc

SEQ ID NO: 24358 - DNA, 101 bp, rice(Oryza sativa)
  misc_feature (71): n=a or g
caccggcagctttgggaagccaaagccaccattcgagactactacagctgcacatcgatccattcaacacnaagcaacttgaccaagcatggaaattctta

SEQ ID NO: 24359 - DNA, 101 bp, rice(Oryza sativa)
  misc_feature (71): n=a or g
ctaatttattcattaatcgtgcgagtctgctaatcggtagtgcaatgcagtgggcccactgattttttttnttggtttttgctatacatcaccagtgtgtt

SEQ ID NO: 24360 - DNA, 101 bp, rice(Oryza sativa)
  misc_feature (71): n=a or g
cttctccttctactttttttttatgtagatgccctaaagaggtagagctggggatggagggaacaaagagngggtaagccctgcacacgatgttagcccac

SEQ ID NO: 24361 - DNA, 101 bp, rice(Oryza sativa)
  misc_feature (71): n=t or c
tttacgaaaatcatattcaaccactagaagcaaatcgctgctaaatcaaccactgatttggtgaattgcangggacccacaaggtcgcgcgggttggagaa

SEQ ID NO: 24362 - DNA, 101 bp, rice(Oryza sativa)
  misc_feature (71): n=a or g
tagttgtttaactaagcttgatatgataccctgtattgttatctttggcaggaaaaaattaacaaactacncacctgtgtcgactatggcacttgcagttg

SEQ ID NO: 24363 - DNA, 101 bp, rice(Oryza sativa)
  misc_feature (71): n=t or c
aaagtatagattaagattagctttactttctcactcattcactaggaggatggtatgtcttgacacagctncttcacctatatctattggtacatcatggt

SEQ ID NO: 24364 - DNA, 101 bp, rice(Oryza sativa)
  misc_feature (71): n=t or c
cctatggacaaattttgaatccgatccatggctatgatgatagttctaggattaaaaaaaaattacacttncactcgtagcgttccaaaagtcaattcgag

SEQ ID NO: 24365 - DNA, 101 bp, rice(Oryza sativa)
  misc_feature (71): n=a or g
cggagatatttttggttccttccgttgtgctagtttctgttccgatacgtagcgtacaactcttttttgcnttttcacgtcacgtactgtagagaaaactc

SEQ ID NO: 24366 - DNA, 101 bp, rice(Oryza sativa)
  misc_feature (71): n=t or c
tccactagaagcaatatattcagatgctgatgaatcttcacaaagatagtcacttccagatggtctgatanccatggtttcagttgagcattcctttgtaa

SEQ ID NO: 24367 - DNA, 101 bp, rice(Oryza sativa)
  misc_feature (71): n=t or c
cgcataccaattatattaatggtccccgaagcattattgcatttacaggtagtatgcatctacagctgggncctgtttggaagattagcatagggctaatt

SEQ ID NO: 24368 - DNA, 101 bp, rice(Oryza sativa)
  misc_feature (71): n=a or g
tatcgggtcattagaccccggcaactatatagaagcttcgtctctgattgggatatacagttgaggaaatnaacatacatgggcatctgtttgaggttgac

SEQ ID NO: 24369 - DNA, 101 bp, rice(Oryza sativa)
  misc_feature (71): n=t or g
atcgtagtgcttgtttttgaatgcatataagctagaccttctgctgattcggcagcaatctgcaaccgttnatccaaattgagaggcagtctgttgctgcc

SEQ ID NO: 24370 - DNA, 101 bp, rice(Oryza sativa)
  misc_feature (71): n=a or g
tgatcaccaactttaacgctttccgcatgacgtatggcgtgtttgaaactttgtaccaccaatcttcttcnttggcgtaggctttccatttgtttatgcgg

SEQ ID NO: 24371 - DNA, 101 bp, rice(Oryza sativa)
  misc_feature (71): n=t or g
gaattcttatatgtacattcaaagggacgagtgtacacacttctatataagcatctacgtgtgttttgtgncttgaaaaaaaatgaaattctcaaaaagtt

SEQ ID NO: 24372 - DNA, 101 bp, rice(Oryza sativa)
  misc_feature (71): n=t or c
cttgaaaaacccaagcttaagttaatgctagccattcgatattaggtttctgatgtcaatgctattgtgancaatagtggaccaatgattgagaaaaggtt

SEQ ID NO: 24373 - DNA, 101 bp, rice(Oryza sativa)
  misc_feature (71): n=a or c
gaggatgataaactagccgaataattccaaatcagaaggtgctaatcgactgattgttcgttccttgtcgnaactcccaacttctcactgaaatctgaatc

SEQ ID NO: 24374 - DNA, 101 bp, rice(Oryza sativa)
  misc_feature (71): n=t or c
tgatgtatttattcgcatacaaggaatgtaggcagagcactagctacaggacaaaggcaccatatttttcnatcgattttaacaatttagcaacttcttaa

SEQ ID NO: 24375 - DNA, 101 bp, rice(Oryza sativa)
  misc_feature (71): n=t or c
aaaaaaattgctagtacaacaaaatcaatcaatggagtcgatctccaccttatatactccctccgtcctcnaatataagagattttgacattttgcttgca

SEQ ID NO: 24376 - DNA, 101 bp, rice(Oryza sativa)
  misc_feature (71): n=a or c
acattggtgccagcacaacagtaagcactaagccactaacgagccaatcttcagattaaggctaagctagntagctagcctgcaacctctctccaacaacc

SEQ ID NO: 24377 - DNA, 101 bp, rice(Oryza sativa)
  misc_feature (71): n=a or g
aagtaaaactcatttcaacagttttagtaacccccatcttcacaagcaggcaagactaagtaaggtctccngcgaataaggcaagactaaccaagtttctg

SEQ ID NO: 24378 - DNA, 101 bp, rice(Oryza sativa)
  misc_feature (71): n=a or g
tgtagaaaccaccaaggtaaagtgtattcttgtcggtctagaccgttaaggttatatttcttagctttccnaaagtttgatattcttcatagttttcttgg

SEQ ID NO: 24379 - DNA, 101 bp, rice(Oryza sativa)
  misc_feature (71): n=t or c
atagggtaagatactaatgaaggtacacgcaaatagacgcacgccagagtacgtattagatgttaggtaantcttcagcgtacttttttttttttttgcag

SEQ ID NO: 24380 - DNA, 101 bp, rice(Oryza sativa)
  misc_feature (71): n=a or g
ggtagatcgagtggctggtgttcaaggacctcgtcgtcgtgcagatctctttctcatcgtcgtcttcacangaagagtgtgaagaaagaagcgtcgccacc

SEQ ID NO: 24381 - DNA, 101 bp, rice(Oryza sativa)
  misc_feature (71): n=t or c
gtacagaacacatattaatttgtacatgttgttttgcatgggaagtcaaaccttctagatgccatgtgtgntcatgtcggaatcaacattattccttatta

SEQ ID NO: 24382 - DNA, 101 bp, rice(Oryza sativa)
  misc_feature (71): n=t or c
tatctaatagacggtgtgatgttagaattaacccaaacggaatttcaaacgatgcagtaggtttaattggnacaactgtgtatatgtcaaggtttaatgta

SEQ ID NO: 24383 - DNA, 101 bp, rice(Oryza sativa)
  misc_feature (71): n=a or g
gatgctggaggtattgacggggaagaaaccatatctctttaaagaagaatggaaggaggagaagagagaanaatgtgagcaagatggaaagaacacagaag

SEQ ID NO: 24384 - DNA, 101 bp, rice(Oryza sativa)
  misc_feature (71): n=t or g
agcccatcgagatgagtaatgtcttgacgttcaccattgtttgaatggatattctcgatcacctccctctncatctgcatgaatcgctgcgtctcggacag

SEQ ID NO: 24385 - DNA, 101 bp, rice(Oryza sativa)
  misc_feature (71): n=t or c
acgcacgggtatttttcctagtcaactttataagagaattccgccgtggcaactaacagattagatgtttntacatcactgacttgaaaagagaatttcgc

SEQ ID NO: 24386 - DNA, 101 bp, rice(Oryza sativa)
  misc_feature (71): n=a or c
tataactttcttgaaaagacgtgctattttctgggtttcctttgttgcaaggctagcagggagagtgctcnatatctcagtccacctgatattgaattcaa

SEQ ID NO: 24387 - DNA, 101 bp, rice(Oryza sativa)
  misc_feature (71): n=a or c
agcgaaaagtacagatatgcttcaactttcaactgcctgaggtttgcaactgctactatttcacaagtaanatttttatatcttgaacaaactgtatgtat

SEQ ID NO: 24388 - DNA, 101 bp, rice(Oryza sativa)
  misc_feature (71): n=a or g
cggacgatagcaagcgctggcagtagagtaggctagagtcatgagtctgagtcatgctggctttatatagncaaaaaatggtactacacacaaatgaaatt

SEQ ID NO: 24389 - DNA, 101 bp, rice(Oryza sativa)
  misc_feature (71): n=t or c
cggtttggatttatcccgaatcggaaaacatatagccgccggctgtaacactaaaaaaaaatcttttcccnaactctctctctctccgaaaagaggcggcg

SEQ ID NO: 24390 - DNA, 101 bp, rice(Oryza sativa)
  misc_feature (71): n=a or g
agaaagttgcaaacaataaagaaacagaagtactaacagatgcttcttgttgctaactttcgtgagtcaanaaaagcatcaggagaagaataataattaaa

SEQ ID NO: 24391 - DNA, 101 bp, rice(Oryza sativa)
  misc_feature (71): n=t or g
gaaacaagagaaaaataatcgtaggcacgtgaaaatctccatcccgcaaaagtaatactcaagtatctgangtgaaggaatttgccaggtgcagttggtgt

SEQ ID NO: 24392 - DNA, 101 bp, rice(Oryza sativa)
  misc_feature (71): n=t or c
gtttcttaatttattgaagaaaaacacaccaagtggtgcacaagttgtgatcaatggtagttcatcgcagncaatcaatgttggcgatgacaccaatgtgg

SEQ ID NO: 24393 - DNA, 101 bp, rice(Oryza sativa)
  misc_feature (71): n=t or c
caacgtacgggcatattttctagtaaatcaaaataactgttagggagggggagaggacagtacagaggtanggaggaaagtggaggaaacggagggacgag

SEQ ID NO: 24394 - DNA, 101 bp, rice(Oryza sativa)
  misc_feature (71): n=a or g
cagcaatatgcctgtcaatattagtacttgcagtaagtgtgtcctttattcaggcctgccaatcaactatnggatgaagccatgattttctattgttgaaa

SEQ ID NO: 24395 - DNA, 101 bp, rice(Oryza sativa)
  misc_feature (71): n=t or c
tactttctttttgaaactccgttagatcgtttactgagaagaggaaaaaatatctgaacgggacggcgacngagccaccatggacgcgggggcggagcccc

SEQ ID NO: 24396 - DNA, 101 bp, rice(Oryza sativa)
  misc_feature (71): n=t or c
tggttggtagctagcttctgagattatgtaaaagatgggtttcccagcttctagtttatactttctagttnattttctggattttacaactacaacttcta

SEQ ID NO: 24397 - DNA, 101 bp, rice(Oryza sativa)
  misc_feature (71): n=a or g
gggaattatttctcattggggccttttgtctaagcttagtggcgttctaatagaaaattttggtacgacanaatttggaaaaataatttacgatgataatg

SEQ ID NO: 24398 - DNA, 101 bp, rice(Oryza sativa)
  misc_feature (71): n=t or g
aaagactcctcgagctgtgactagaactggatgcaaagttcatatgggagttaccctaaatcgagtgctangaaaatatgagatacatgatttggttcttg

SEQ ID NO: 24399 - DNA, 101 bp, rice(Oryza sativa)
  misc_feature (71): n=a or g
agataaacgcccaatggaagctggtatgtacccagttattctgttgccaccaacatatagccttgtgaganaacttgacaagttgccaatggaatcaggga

SEQ ID NO: 24400 - DNA, 101 bp, rice(Oryza sativa)
  misc_feature (71): n=t or c
cggaaggtgagcctgctcatggacgacaagctgtggtggtacaacgtctttgcacccttccaccacttcanggccttcctcaacgtcgggaccaacatgag

SEQ ID NO: 24401 - DNA, 101 bp, rice(Oryza sativa)
  misc_feature (71): n=a or g
ttttttggacttttatttttgtgtgcggatgatataagcaccacatgcaaaaattggatttttcacgtacnggtgcaccacccgcatggaaaaatagtgat

SEQ ID NO: 24402 - DNA, 101 bp, rice(Oryza sativa)
  misc_feature (71): n=a or c
gcgccgccaacgtcgaggtgatcagtatcccttttttcttccatgggaggcatggccaagatcttggagcngatggcgacgaagtgcaggggcatcccacg

SEQ ID NO: 24403 - DNA, 101 bp, rice(Oryza sativa)
  misc_feature (71): n=a or c
ttttgttggacgtagacacggaaacggatatccggtctagcaataacctaaaaagaactcaattggcccancatagcagcgggtgccatgcgtagtgagct

SEQ ID NO: 24404 - DNA, 101 bp, rice(Oryza sativa)
  misc_feature (71): n=t or c
taacttggtccctctctctcagccggcccaagcaaggaaatggaagttcaggaaaaagtctgctttatctncccaagctacagtgtcgtcttcaagcttca

SEQ ID NO: 24405 - DNA, 101 bp, rice(Oryza sativa)
  misc_feature (71): n=t or g
gaaaaatctctctgctgcgtcgtcgtcttctctcctctccttaaaaatctatgtagctatgtctgtcaacncatgtacatatataagctgataaaatcatc

SEQ ID NO: 24406 - DNA, 101 bp, rice(Oryza sativa)
  misc_feature (71): n=a or g
tgaatgcataacagagccagtgaaaagaacttttatatctatgtggtccaatgtagctgcagattcctgtnatccagcatgccgaaacttgagaaggtaat

SEQ ID NO: 24407 - DNA, 101 bp, rice(Oryza sativa)
  misc_feature (71): n=t or c
acacacacggcttcgacggccggtggtaacatcatccacaatgctagcattcttgggctagcagctggganagttcggggtggcgcgccccgtgcacgagt

SEQ ID NO: 24408 - DNA, 101 bp, rice(Oryza sativa)
  misc_feature (71): n=t or c
tgtaagcttagccacctcaactctggaatcgtgtacaagtccttggggaggctcccagtaaggccattgcnatcaaggaagaggtcgttgagcagcttgca

SEQ ID NO: 24409 - DNA, 101 bp, rice(Oryza sativa)
  misc_feature (71): n=a or g
gggcctcgtacagaaaaaaaaatatttctgtagtagtgccaataagaagcctaatacgtaataggcaatgnctttgcttttactcatctttcttcagaaca

SEQ ID NO: 24410 - DNA, 101 bp, rice(Oryza sativa)
  misc_feature (71): n=t or c
tataagaagaagaaaaaagaaaaagacttacacgggatacgcgtacgtatacaggtccatggggacaccgntgggtaacgtgggaatttttttttatagat

SEQ ID NO: 24411 - DNA, 101 bp, rice(Oryza sativa)
  misc_feature (71): n=t or c
gaaggcaagggcaatttggtctcggatagcattatagcttgtagccacggggtgaaaaatggcattttaangaatctcttttgcggggtagcatttcggcg

SEQ ID NO: 24412 - DNA, 101 bp, rice(Oryza sativa)
  misc_feature (71): n=t or g
tcttccctcgcgaagcccagtctccaaacgtcagaagcttcttgggaaaatatccctgcaagcgttcactngcagaaacttcagagaggagatgatgtgaa

SEQ ID NO: 24413 - DNA, 101 bp, rice(Oryza sativa)
  misc_feature (71): n=a or g
tcatggaaccatcatcattcagccctgtaatcataatttggacgagtttagttgatgaggttttgtaggantaacacttagtatcacattagacactgttt

SEQ ID NO: 24414 - DNA, 101 bp, rice(Oryza sativa)
  misc_feature (71): n=t or c
acaaaacgcgacaacgccttttcagaacattggcctcgaatagagggatctaccatctttgatatagcatngatatcgtaaagctgggaagtggcccaccg

SEQ ID NO: 24415 - DNA, 101 bp, rice(Oryza sativa)
  misc_feature (71): n=t or c
caccaccacagcatatctgtccaaacctaaaggaactcaatgttcagcgctcagaaaacttgactttgtcnttgttgcaagagtagctgctatgcttagta

SEQ ID NO: 24416 - DNA, 101 bp, rice(Oryza sativa)
  misc_feature (71): n=t or g
atgaaacatgtgaacagagatggaaagatgtcatagaaagcgagttgtgggacttggagcaaccaaggaangaggttttgccatccttggagttgagctac

SEQ ID NO: 24417 - DNA, 101 bp, rice(Oryza sativa)
  misc_feature (71): n=a or g
acagcagcttccagattattcagtgcagtttctaattcattatcaatagctgggtttctaggtgtaccaanaattgtgcgtgagcgcttcaaagaaactga

SEQ ID NO: 24418 - DNA, 101 bp, rice(Oryza sativa)
  misc_feature (71): n=a or c
tggatgtggcgccctggccctgctcggcagatgatcattccaatcagccagcccgaacgacgtccggagcnggagctggacgccatccccgaccagcatcg

SEQ ID NO: 24419 - DNA, 101 bp, rice(Oryza sativa)
  misc_feature (71): n=t or g
cttaaatgattcttatgttcattttgtccttctgtacaattgtgcagactagttaccgtatctttttgtgnagtctttatgtatgtttatctacagatgct

SEQ ID NO: 24420 - DNA, 101 bp, rice(Oryza sativa)
  misc_feature (71): n=a or g
tttcatactattgcagaactccggatagagatgtaaaattggagtttgttttcttggaatcaagtgtgggntttttacccactactcttttaaaagtatat

SEQ ID NO: 24421 - DNA, 101 bp, rice(Oryza sativa)
  misc_feature (71): n=t or c
acaactacccactcagaccagtgcaccatcccaagttaccattgctgatggcggaaaaatattatgcaatnaagttgttgctaacctggaatggtggtgtc

SEQ ID NO: 24422 - DNA, 101 bp, rice(Oryza sativa)
  misc_feature (71): n=a or g
gcatcatgcagttgggtacgttttattataacaacataacttgcagcaacccaactagccagcccgttggnccatatatatatttgtcaaaaatacagtaa

SEQ ID NO: 24423 - DNA, 101 bp, rice(Oryza sativa)
  misc_feature (71): n=t or c
tccgactgctgcataattccagctgttcgagcggcagcagatgctgctctgcgaagcgttgttggtttttnatggggcatctgctgctgttgctgttgggg

SEQ ID NO: 24424 - DNA, 101 bp, rice(Oryza sativa)
  misc_feature (71): n=t or c
cacatgcagctatatatatgggctatggtttaagtaggtgaatatctcattggtggacctactcttgcttnaatctttctttgtggtatagcattcgagaa

SEQ ID NO: 24425 - DNA, 101 bp, rice(Oryza sativa)
  misc_feature (71): n=a or g
gatgtggagaggaggtcctgtaggcagcaaaacaaacccctttgtaaggctatggccggtttaattgagcncacaatctatttccaatacaatataaccaa

SEQ ID NO: 24426 - DNA, 101 bp, rice(Oryza sativa)
  misc_feature (71): n=t or c
aagtgataagaagatagaacagattcggagagagaaatctaatcctaacaaaccaggtgaagcagctgcgncattatagcatgctgcatgcatgcatgcag

SEQ ID NO: 24427 - DNA, 101 bp, rice(Oryza sativa)
  misc_feature (71): n=a or c
ttattcgagagatttagaatgtcaagagtagatatatcagcaaggcttggaggaatggctcctgaaagttngttcaatgagaggtcaaggaactctagatt

SEQ ID NO: 24428 - DNA, 101 bp, rice(Oryza sativa)
  misc_feature (71): n=a or g
gcagcatgtattatgtattgtttagtagttcgacaaacgtgtttacagtaaatgaaggaatatttcagccnggttgtagaatcgaactcagtctaaatcta

SEQ ID NO: 24429 - DNA, 101 bp, rice(Oryza sativa)
  misc_feature (71): n=t or g
agtgggagtggttatggacgaacttgcatcactggatatgactgtgtcatccaaaaaccttgaagacctcncaaatttctttaaagtgctgcgccagcagg

SEQ ID NO: 24430 - DNA, 101 bp, rice(Oryza sativa)
  misc_feature (71): n=a or c
caagaggtgctttgcattctgtgctttatttcctgaagcttttgaagtggatggtgatatgctgatccagntgtggatggctaatgatatggtatggtacg

SEQ ID NO: 24431 - DNA, 101 bp, rice(Oryza sativa)
  misc_feature (71): n=a or g
gctggcttgtagtacttgggcttccttttatggtttttgataagtgatagctagtgggctgctcaatttcngggccccacgggtgacccacgagtgaagat

SEQ ID NO: 24432 - DNA, 101 bp, rice(Oryza sativa)
  misc_feature (71): n=t or c
gtccctagatattactggcagtgattcattacaaaattcagatgggaactccatggacccatgacccaagntatctgaaggcatttcattgtttgaatagg

SEQ ID NO: 24433 - DNA, 101 bp, rice(Oryza sativa)
  misc_feature (71): n=t or g
tggttcgatccctgcagcgtagaatcgattttggtggatcacaaaaaggaaaaatctatgcaaggcagtgngctaggttcccatggcaacgtatacaacaa

SEQ ID NO: 24434 - DNA, 101 bp, rice(Oryza sativa)
  misc_feature (71): n=t or c
tccctttcagaaaaatctgtatgaacttggcagcagcaactactgaacctcaagtctgaacagaaaaatgnctatctacacgcatgcatatgtatgcaggt

SEQ ID NO: 24435 - DNA, 101 bp, rice(Oryza sativa)
  misc_feature (71): n=a or g
ccaataaaattggacccatacttaaggggcataaagtggacttctctcgttgggagttggtggtctagcgntttgtggtaaaaattggaaataagtctatt

SEQ ID NO: 24436 - DNA, 101 bp, rice(Oryza sativa)
  misc_feature (71): n=a or g
cgaagagcacttctcaacttcgagctattgacctattttacaatccctcagtcggtatggcttttcatagnacataccaaatcaccctatcaaactctgat

SEQ ID NO: 24437 - DNA, 101 bp, rice(Oryza sativa)
  misc_feature (71): n=t or g
actaaaatattgtaaaatgtttctaacttgctaatcaaacatttaaacctacaggcaactgctggactcanacttattggagatgaaaaggcaaaccagat

SEQ ID NO: 24438 - DNA, 101 bp, rice(Oryza sativa)
  misc_feature (71): n=t or c
ctaaaaaaaaaaggcaaaatcataatcgcatttcgaaacaagacatgaacacaattacccctttgggaacncatgtttgccatagtattatagcggcatat

SEQ ID NO: 24439 - DNA, 101 bp, rice(Oryza sativa)
  misc_feature (71): n=a or g
acaactgaaataggtgatggcttggaaaataatccccaaaatgataaaggaggctgttcttgactctctgntgtttctttcctaatcttggaactatgttt

SEQ ID NO: 24440 - DNA, 101 bp, rice(Oryza sativa)
  misc_feature (71): n=t or c
tttagttaaaagtgaaattagctgtgagaattcacgtggatgtatattcttttaagaaaatcagaagtcgnagttaggagtccgatcattttaagttagca

SEQ ID NO: 24441 - DNA, 101 bp, rice(Oryza sativa)
  misc_feature (71): n=t or c
cataaattattaagtaatgaaaatagtgggaaacatccaataattggatatgtttggagtggcattagtantactagtacaacctttacagtggaaatctc

SEQ ID NO: 24442 - DNA, 101 bp, rice(Oryza sativa)
  misc_feature (71): n=t or c
gcgagggcggacgagcgagcaagctggtcgctcgactcgtgtcatccgtcaccacgtgaccgcaatgactngagcgagcagtggcgaacctagaataaaag

SEQ ID NO: 24443 - DNA, 101 bp, rice(Oryza sativa)
  misc_feature (71): n=a or g
atgggagcttaaggcgctcactgcgtcatcccaagtcagccctctctccctattctccagcgacacgcacntgagttgcttgaagctcccagcgaccaacg

SEQ ID NO: 24444 - DNA, 101 bp, rice(Oryza sativa)
  misc_feature (71): n=a or g
gccgtacaacacgcgtgcctcccgtacgcacacgcaaccgcagtactcgttgtgtgtcttcctccccgacnagcgcaacgggctgtggaccctcgccgaca

SEQ ID NO: 24445 - DNA, 101 bp, rice(Oryza sativa)
  misc_feature (71): n=a or c
atatattactatatatttgtgtagcgacagatggcaccataatgcacgttatcatattttcaggatttttnaagtaactaccatatgcaggaacagagaac

SEQ ID NO: 24446 - DNA, 101 bp, rice(Oryza sativa)
  misc_feature (71): n=t or c
ccgcatagccgcaggcagccaaatctagtggtccctaggggaggtagataccattgtcgagcggtgcatantggctagatctaaccagcccccgagttcat

SEQ ID NO: 24447 - DNA, 101 bp, rice(Oryza sativa)
  misc_feature (71): n=a or g
atactggtcttgatcccatttgatatctccagtgtggatacaagcattgctactgctgatcacgtggatgngcctgaaactgttccacttgtgacaaggat

SEQ ID NO: 24448 - DNA, 101 bp, rice(Oryza sativa)
  misc_feature (71): n=a or g
acgtacgtaataagtacggagtactacgtatatgtacgtggtccgatacggtggcctctcgtacttgaatncgttgcctgtctgtgtcgccgtacgttttg

SEQ ID NO: 24449 - DNA, 101 bp, rice(Oryza sativa)
  misc_feature (71): n=t or g
acccaaacagatgagaacttctttgaggggaagatgagaacttactaattcgtctaaggtatgaatcattntatctgtcaaaaatagagtttgttggattt

SEQ ID NO: 24450 - DNA, 101 bp, rice(Oryza sativa)
  misc_feature (71): n=t or c
atctgataagatgtagaagtttcccattttgaagtttgctctgtgcagcttaaccatctcagaggaacacnaaaatatgggcatgactgaagagaagtctc

SEQ ID NO: 24451 - DNA, 101 bp, rice(Oryza sativa)
  misc_feature (71): n=a or g
acaacaaggttggtttgtatcatcaaataaatggagcgaaaggaaaggtgtaccatctgcacacaaaacanttaccttagttttccaatataggtgctgct

SEQ ID NO: 24452 - DNA, 101 bp, rice(Oryza sativa)
  misc_feature (71): n=a or g
tttagctgtcattctagaaaaggcaaaggaaagggggattttgaagggattagttcctgacctagttcctnggggtttgtcccacttgcaatatgcagatg

SEQ ID NO: 24453 - DNA, 101 bp, rice(Oryza sativa)
  misc_feature (71): n=a or g
aaaccaatgggtgttatcttgttcttgtagctggagccattcattagaaggatagcagatacaaaagatangtcagagccgatcggtgtggtggatccaca

SEQ ID NO: 24454 - DNA, 101 bp, rice(Oryza sativa)
  misc_feature (71): n=a or g
ttagggataaacaagttccatcattacattggatctgctgtttggagaagaccaagtggtgacctgaaaangaaggtcatttcaaccaccctaagagcaag

SEQ ID NO: 24455 - DNA, 101 bp, rice(Oryza sativa)
  misc_feature (71): n=a or g
cctttcaagggatcgaaatagtttcccctcacaatctttgcttcaagttatatcacattgagtggtacacnacccgcgaatgatgctgctgagttcctcct

SEQ ID NO: 24456 - DNA, 101 bp, rice(Oryza sativa)
  misc_feature (71): n=a or g
ctagcgagggctttgatttcggtgagaaggctaactaattacttacagtcaggggcggagccacgtgtggnggcagcttgggcttgggccccacacgtggc

SEQ ID NO: 24457 - DNA, 101 bp, rice(Oryza sativa)
  misc_feature (71): n=t or c
ccgtctagctcgctatgctctagaagatgtgcataatgacgaagaaaggtatgagaagttcttgcaaccanaaaatccatgtttgatgaaggctggggtac

SEQ ID NO: 24458 - DNA, 101 bp, rice(Oryza sativa)
  misc_feature (71): n=t or c
agcagtcacaaaagagaggaaaaaacgttaacccctgtcatgagccttatctcttcttatctcttgggaangagccaaggcatgggttggatggactgcgc

SEQ ID NO: 24459 - DNA, 101 bp, rice(Oryza sativa)
  misc_feature (71): n=t or c
tgatgccaaaaatagtttaactatagaaaatataattggtcaaaagtttctcaccagttcagatgctattngcactatagactttgttccaataagtgact

SEQ ID NO: 24460 - DNA, 101 bp, rice(Oryza sativa)
  misc_feature (71): n=a or g
ttttaccatatataatttcatttgggagagaaaaatatgcaaatagtacaaacatccctgctgatgcccgntaatcaagtacaaattacactcctgtgctg

SEQ ID NO: 24461 - DNA, 101 bp, rice(Oryza sativa)
  misc_feature (71): n=a or g
tagtgggcttaaaacccaaccaactggtcgacagaacaaggccacacgaaaaaggaataagttcactccangtccctcaaattgtcgtaaagtgtaaaatt

SEQ ID NO: 24462 - DNA, 101 bp, rice(Oryza sativa)
  misc_feature (71): n=t or c
acggccatcgctctcgtggatgagaaacttatcacagcctacccttcgcttcaaactctctgccttatctnttttgcaaacaccattagatccaatcatca

SEQ ID NO: 24463 - DNA, 101 bp, rice(Oryza sativa)
  misc_feature (71): n=t or g
atatagtatgggaattggaggcaaaagggttgggaacaatcgggattttttttatccgactggaatttttnggggggtgggggagggacgaaaaatcccct

SEQ ID NO: 24464 - DNA, 101 bp, rice(Oryza sativa)
  misc_feature (71): n=a or g
ttgctgccgctgccctcgcggtgccactctcgatcctcgtcctctcccaagaggtagcgcttcaaactgcnccctgcgtcgtcacgaccaccgctggggga

SEQ ID NO: 24465 - DNA, 101 bp, rice(Oryza sativa)
  misc_feature (71): n=a or g
aaaaccaaacctctctccctccctccccacccatgtgcattgttaaaatcccttaaatatcttagaatatnacattcttaaattagaaaaaaaacattcaa

SEQ ID NO: 24466 - DNA, 101 bp, rice(Oryza sativa)
  misc_feature (71): n=a or c
ttgttacagcagcaaagatgccatctttttcaccctaaattgacagtgcagcaaagttctcaactgtactnctgtctagcaaaaatattcttctggtacca

SEQ ID NO: 24467 - DNA, 101 bp, rice(Oryza sativa)
  misc_feature (71): n=t or c
gccgaaaacggaaagtaacacataaatgtggcagcaaagtacctggagcctgaggatgtccttgtaagaanccttgacagtctcaaactcgatgtttttct

SEQ ID NO: 24468 - DNA, 101 bp, rice(Oryza sativa)
  misc_feature (71): n=a or g
ctacgtacctgtgccattgcccgttactgcatgctctacaatggtttgtgagaatcagagtggattatatntgtatttgcacaaccgaatatttcaataat

SEQ ID NO: 24469 - DNA, 101 bp, rice(Oryza sativa)
  misc_feature (71): n=a or c
gcagcactaccaagtgagatcagtaaactccaatgtctgcatactcttcgttgtagtagaaagtttgtttntgacaactttagtctagaccacccaatgaa

SEQ ID NO: 24470 - DNA, 101 bp, rice(Oryza sativa)
  misc_feature (71): n=t or c
aaattgtatgctaagaaaacatgggccttgctcatctacaggcataagaacttctgatcctatagcttgcnatacattgaaatcaacatccataccagttt

SEQ ID NO: 24471 - DNA, 101 bp, rice(Oryza sativa)
  misc_feature (71): n=t or c
tggtggggcggtccaagtcgtcatccggactttcggaggcacctttggaacgtgaacacgtacggcggcgnagtagcggatgacggtggcgtcattggcgc

SEQ ID NO: 24472 - DNA, 101 bp, rice(Oryza sativa)
  misc_feature (71): n=a or g
ggagagctcaggaagatgggaaattgatatagggatgcatggggagggttattataggtctcggaggtgcngcatgaggctaaaagaggcggaaatcgccg

SEQ ID NO: 24473 - DNA, 101 bp, rice(Oryza sativa)
  misc_feature (71): n=t or c
gccactcagccccagttttgcatcactaaagacaaggttggggcggtatctccatgaacgtagaaatgtgngagacacgcatgcagtacgagcggcatctt

SEQ ID NO: 24474 - DNA, 101 bp, rice(Oryza sativa)
  misc_feature (71): n=t or g
taatctgaggaagtcagatggattgatgtctcatggctgtgaattttcagtgtctctggcgatttgctgtntttcgtgttcttatcagaatacatgagctt

SEQ ID NO: 24475 - DNA, 101 bp, rice(Oryza sativa)
  misc_feature (71): n=t or c
cggtgagttgttttcacagcttgttacttttgagcagcgattggaacttcgacagggtggcattcagtcgnccaccaactctgcttctcgcggcggcaatg

SEQ ID NO: 24476 - DNA, 101 bp, rice(Oryza sativa)
  misc_feature (71): n=a or g
cttcattacattaaatgcacatatttatggatgaaaaatatcgagcggtcgatctcaagtaacatacaacntagtaggacgcaagtgtaagtggagtacac

SEQ ID NO: 24477 - DNA, 101 bp, rice(Oryza sativa)
  misc_feature (71): n=t or g
tttctttcttggctttggaaatggaagaaatggagatgaaaatggagggaaggaagcaaaggaggaggttnaagaggatgaagtccaagagaacgcgttgg

SEQ ID NO: 24478 - DNA, 101 bp, rice(Oryza sativa)
  misc_feature (71): n=t or c
gacctgggttgactaggatcaataccaaatcgatatctggatttcgcgccgccacggcaagagcaatgcangctccaacggattctccgactagatagact

SEQ ID NO: 24479 - DNA, 101 bp, rice(Oryza sativa)
  misc_feature (71): n=t or c
tcgtataacaagagccatttattccttgtgtgatacatcacgggactcatcaaccaatatagcaaagtacncatctccaagatcttctatgatagctttaa

SEQ ID NO: 24480 - DNA, 101 bp, rice(Oryza sativa)
  misc_feature (71): n=a or g
agctgcagctactagaagctctcccaaacaggccctttgtatgggataagcctattttaccctcctgcttnagtcacaatcctcaacagtaaaatcgggta

SEQ ID NO: 24481 - DNA, 101 bp, rice(Oryza sativa)
  misc_feature (71): n=t or c
aatataaatataaatatagtatccgatcatttttatttctacctatataaaaatatttttctttctactcnctccgtttcacagtataaaactttctagca

SEQ ID NO: 24482 - DNA, 101 bp, rice(Oryza sativa)
  misc_feature (71): n=a or g
ctgtactgttgatgcaatcgacgcttgtttattttttctttctttcagctacttggcgccggagtatgctnctactggcaaagtaaacgacagatcagacg

SEQ ID NO: 24483 - DNA, 101 bp, rice(Oryza sativa)
  misc_feature (71): n=a or c
caaatttgcagttgtccaccagcagattctttaaccttgatgttgggacattgatacggagaccaccagcncagtaacccggacaatatctgatactaaag

SEQ ID NO: 24484 - DNA, 101 bp, rice(Oryza sativa)
  misc_feature (71): n=a or c
atgacagaaggttcttcaatcccagaaacttcaccagctcagtggcagatactaactttgttcatcagcanacccagattagacacatctcaaaaagaaga

SEQ ID NO: 24485 - DNA, 101 bp, rice(Oryza sativa)
  misc_feature (71): n=a or c
ccacaatcaatgtcgccacggattccgaggacggtacgtgcacatatatgtactctttcagtgacggatcnttaaattttcgagcaaacttaataataata

SEQ ID NO: 24486 - DNA, 101 bp, rice(Oryza sativa)
  misc_feature (71): n=t or c
tatttattattatcgacaaacaagtgcagaggccacacgtgttgattctttcgttattgaagaaaaacccngcggtcatccgcacaaatcgctccaaattc

SEQ ID NO: 24487 - DNA, 101 bp, rice(Oryza sativa)
  misc_feature (71): n=t or c
taaagaatggaaagtgtttgaagcttacatagttaaagcagcaacaaccggcgaaggatgagccaaatgangagtccgatcaataagtttgtaaatctgtc

SEQ ID NO: 24488 - DNA, 101 bp, rice(Oryza sativa)
  misc_feature (71): n=a or g
ctcccaggtatctcgccaaaacatcgtctattgctctcagtttagtttcttgaaaacaagcgatactacangccgtgtccaccattagttcgtgtagcacc

SEQ ID NO: 24489 - DNA, 101 bp, rice(Oryza sativa)
  misc_feature (71): n=t or g
cgtctacaacgccggcgtcgacccttcctccgacgacaaccagtcccgcttcttcttctccgtcctccacnccgcctcccgcacccccgtctggacagcca

SEQ ID NO: 24490 - DNA, 101 bp, rice(Oryza sativa)
  misc_feature (71): n=a or c
tattaactggcaactggcaagcaggtagtagtactattcaatgacaacgatgctgtcgcgtgtaaatccangtggcatggtaattttccatgaaatggtag

SEQ ID NO: 24491 - DNA, 101 bp, rice(Oryza sativa)
  misc_feature (71): n=t or c
gcattgttagcgttggagaagtagttcattgggttgttgttctggatcggcacagaagcatcagagttganattgaggggagattgcatgtcaggaatggc

SEQ ID NO: 24492 - DNA, 101 bp, rice(Oryza sativa)
  misc_feature (71): n=a or g
tatggctgtacatgtatggtcaggattactgaacaagaatggggcagccatatccattaagctaggcttgntatgtttgatgttgagtttatacaccagtg

SEQ ID NO: 24493 - DNA, 101 bp, rice(Oryza sativa)
  misc_feature (71): n=t or g
ggtagtgcaaaactgcgctctccaaaagagcatgacttgacgagcctcattcgcattctacagttgcattnaactattgtatgaaggaagaacacggtacc

SEQ ID NO: 24494 - DNA, 101 bp, rice(Oryza sativa)
  misc_feature (71): n=a or g
tgcatttgaggagtcaacattataggtggcatcgcacacagaaatttgataaagttgttcctgtccaacgncgagaccaacctctttattatcatgcataa

SEQ ID NO: 24495 - DNA, 101 bp, rice(Oryza sativa)
  misc_feature (71): n=a or g
atgtcaacggcccattgctggaaaaatcgtcctccgaataaaatgatgtttagaagttcccttctaacctncagcctgaagcaatagtactccctctctgt

SEQ ID NO: 24496 - DNA, 101 bp, rice(Oryza sativa)
  misc_feature (71): n=t or c
ttttgacaggtctctgaagatgaagttattgtgtctgattgtggactccaagacctgtcgatcacaccttntcttgatgctctaaaattacataaaacaat

SEQ ID NO: 24497 - DNA, 101 bp, rice(Oryza sativa)
  misc_feature (71): n=a or g
gttctatgttggaggtatgtcataagggccttcggccgacctgccgaaaccatccaaaatagcaaacatcngctaaatcccagacgtgtgccattggcgaa

SEQ ID NO: 24498 - DNA, 101 bp, rice(Oryza sativa)
  misc_feature (71): n=a or c
atgaacacttttgccgatgtcataaaatctgtcgacaagaagtttcactgtaatactgagagtaatgctcncaatcatccgccatgttacttcacaactgg

SEQ ID NO: 24499 - DNA, 101 bp, rice(Oryza sativa)
  misc_feature (71): n=a or g
taacatatgctctctgctcccagaggatgaacctctattttgcctccataccgagatagagtagagattcntagaaccccagctcagtagaaggcagcccc

SEQ ID NO: 24500 - DNA, 101 bp, rice(Oryza sativa)
  misc_feature (71): n=t or c
gatgtgttgtatgttcaattactgatggagcttgacttctgtgttgattgcttaggtggcacactttgggnttgccaagctggcgaagaacgatgtcacca

SEQ ID NO: 24501 - DNA, 101 bp, rice(Oryza sativa)
  misc_feature (71): n=a or g
tacccaaatttgcttcagtgtcctctatctggatgcaggctaatcgccttctatcaggagagcatagacantagagaactgcgtgtagcactgcatattgg

SEQ ID NO: 24502 - DNA, 101 bp, rice(Oryza sativa)
  misc_feature (71): n=a or g
tgtgatgctatgcctgttttttttttattctcgatgcgaaactatgtcttctctctcttttcgccgatccnaaaatattaaaataataaagacggtgtcca

SEQ ID NO: 24503 - DNA, 101 bp, rice(Oryza sativa)
  misc_feature (71): n=a or c
gatgttgttcacctcaaatatcgtcttatttctcgtgtgtgtgtatataggattgaaatttggaagtggtngagccaagagggagaggtgtggtacaacta

SEQ ID NO: 24504 - DNA, 101 bp, rice(Oryza sativa)
  misc_feature (71): n=a or g
ccattcgtgtttcgacaaaattagcaagcaaatgagatacgcgtgaattgatgcgatctttacctctaccngatgcttgttgttgaaatcaattatgtccg

SEQ ID NO: 24505 - DNA, 101 bp, rice(Oryza sativa)
  misc_feature (71): n=t or c
attcaggttgcaagtaaatgcaggcactactagaaaacgcattatcgccggcagtggaaatcggttttcgnaggcagggccgacctctgcttgtaagcaaa

SEQ ID NO: 24506 - DNA, 101 bp, rice(Oryza sativa)
  misc_feature (71): n=a or g
gggataattgaagatgagggctcatttcaaatcaacaaggcgatggcccacgatactttccttgccacagntggagtgttggcgagtccaaacacaatagc

SEQ ID NO: 24507 - DNA, 101 bp, rice(Oryza sativa)
  misc_feature (71): n=a or c
cattcggagtctggcatgtaagatgggaaatccagctagtccacataaaacgatggcagctgcagatccancgagcgagaacccagtgagtgtttttacca

SEQ ID NO: 24508 - DNA, 101 bp, rice(Oryza sativa)
  misc_feature (71): n=t or c
acaaaacagctttctaaaactgcatagagagtcacgttatactgtttcaatagttgagagtttaagatatncggtactacgatttagggatatgaattaga

SEQ ID NO: 24509 - DNA, 101 bp, rice(Oryza sativa)
  misc_feature (71): n=t or c
tctagcaagatacagtgtgtctcctacaaggagacattgggttggcgttaagacagtactcaggtacctcnagggtacgcaagatctcggcctcttctttc

SEQ ID NO: 24510 - DNA, 101 bp, rice(Oryza sativa)
  misc_feature (71): n=t or g
ctatctcgaattcattgtcacctccctgatggacacaacttcaacaatactgacgccttgaggaaacatgnggtcgccatgtcccaagttaccaacaacgg

SEQ ID NO: 24511 - DNA, 101 bp, rice(Oryza sativa)
  misc_feature (71): n=a or g
agttttcgggcttccctgccttgctctccccgccggggttgaaagtgagtttttgctttcgctcttagccntatacttcctttatggaaatgtgcttcagg

SEQ ID NO: 24512 - DNA, 101 bp, rice(Oryza sativa)
  misc_feature (71): n=t or c
agcatggaggggcgcgttccaggtggtagggtataccttatcagaccctggcttgttgttgagcttgctgnttctactgtcgctgctgctcctcttccgct

SEQ ID NO: 24513 - DNA, 101 bp, rice(Oryza sativa)
  misc_feature (71): n=a or c
gctccgggagagagaggtagaaagggaacagataagattggatatcgtttcacttctcccgttcctacggnattccgttggctagtttttctgttataact

SEQ ID NO: 24514 - DNA, 101 bp, rice(Oryza sativa)
  misc_feature (71): n=a or c
aaatgtactgttgaactataagagtttcagtgtagctgcacacctgttacaggacaagaagtaccagcagngtcagctgtagaggtgctggcatatccact

SEQ ID NO: 24515 - DNA, 101 bp, rice(Oryza sativa)
  misc_feature (71): n=a or g
cttgctggcacaccgtagtcgccagagacggagaagattgaggagcccccatagtccttgtcttttgccantgacaagctggtagattatttgtaaaggaa

SEQ ID NO: 24516 - DNA, 101 bp, rice(Oryza sativa)
  misc_feature (71): n=a or g
gatcgagtcgagtcgaaccaaccaaaagagagaagaagaagcaagccccccaaaatccctagcaatggagnaggagttagatggggagagtacatgtgctg

SEQ ID NO: 24517 - DNA, 101 bp, rice(Oryza sativa)
  misc_feature (71): n=t or c
cgtttctcagccgttggatgaggaaaatgcatcactgtcagattgaagacagcccaaccatcatctcacanacagatagcacatgaggcccatgtaataac

SEQ ID NO: 24518 - DNA, 101 bp, rice(Oryza sativa)
  misc_feature (71): n=t or c
ccgaacccaactcattttcttcgtcgatgtacaagcctaatctatgtatcccaaatcaaaacaaaaactgngagaactgtaattaagcgtgtcctctcttc

SEQ ID NO: 24519 - DNA, 101 bp, rice(Oryza sativa)
  misc_feature (71): n=a or g
gtggcgtcacttcgtcaagcagagtgatctacagccggatcatgtcagcgacaaaggcacggtcacattcntgtgtgggttcatggttgtgcgcaacgacg

SEQ ID NO: 24520 - DNA, 101 bp, rice(Oryza sativa)
  misc_feature (71): n=a or c
ttgatccttggattcatcaaggtctccgaactcagttatttcttcccgccaccaattaaaggtttgccacnatttttctgttaatgtcctaaattgcgttg

SEQ ID NO: 24521 - DNA, 101 bp, rice(Oryza sativa)
  misc_feature (71): n=a or c
gtagcttcttagttaaatgccatggttgttgctgcattttactcctgttttttatggttttgcaggtcagntttgtaaatggatttgagacactaaaaggt

SEQ ID NO: 24522 - DNA, 101 bp, rice(Oryza sativa)
  misc_feature (71): n=t or c
acaggtccgtgtgctccatgttccgtctacgcatcagttccccgatttcatgaccaagggcttgcctgtgnagttatttacagattttcgatccagccttt

SEQ ID NO: 24523 - DNA, 101 bp, rice(Oryza sativa)
  misc_feature (71): n=t or c
aaacaatagtatattcaggctgactaacagacctccaagatcgccacaccttatggcttgttgccgatgtngggaacggcctcttccaagaaccatggctc

SEQ ID NO: 24524 - DNA, 101 bp, rice(Oryza sativa)
  misc_feature (71): n=a or c
tcaaataatcttctgtaaggttaaaaggagtataccttgctggttaggcattgtgccaccaattttgatgngtttgttcttctcaaattcatctgttactg

SEQ ID NO: 24525 - DNA, 101 bp, rice(Oryza sativa)
  misc_feature (71): n=a or g
aaacaaacgcatgcatatgtatgccgttacctagaattaacagttatgcagatatatattcaccaactacngatggagatttacaaacagacttcaatagt

SEQ ID NO: 24526 - DNA, 101 bp, rice(Oryza sativa)
  misc_feature (71): n=t or c
cacggcagagaaaggtgactcagatatccctctcattgtcactcctagtgaatataaccatgaggaaactngtaaactgatagctaagatgataattgttc

SEQ ID NO: 24527 - DNA, 101 bp, rice(Oryza sativa)
  misc_feature (71): n=t or g
tgctcttcaccctagatagattccagagcacacataagtgcatcatcagttggaaacataattgttagacntggaccaagtaaggttctgctaattatttt

SEQ ID NO: 24528 - DNA, 101 bp, rice(Oryza sativa)
  misc_feature (71): n=t or c
ttagggaatatgggcaaacgatgagcacagtgctgttcttccacagccggaaccaccgtcccttccccttncccgtggcaccggtgcccatggcgatggct

SEQ ID NO: 24529 - DNA, 101 bp, rice(Oryza sativa)
  misc_feature (71): n=a or g
tataaaagttgcacctcaactttccggagggagtgtaagccaactatagcttatgccaagacgagataaanaaaatgagaagtgctagctcttatgcaaaa

SEQ ID NO: 24530 - DNA, 101 bp, rice(Oryza sativa)
  misc_feature (71): n=t or c
aaatggtttcattggctagcgcttgctgaattctggtataatactgcttatcactcggctttggacatatngccgtttaaggtactctatggtcatcctcc

SEQ ID NO: 24531 - DNA, 101 bp, rice(Oryza sativa)
  misc_feature (71): n=a or g
agcactgatgatcggtctctctgttctagatgctttcggtgaacaaggaagaccttctcaaggagaggaanctgctgtgcccccagatgcaactctttatg

SEQ ID NO: 24532 - DNA, 101 bp, rice(Oryza sativa)
  misc_feature (71): n=t or c
aagtgaacttgaccatttacttccttggtaccaatttcaactcgactgccaggacacctcaactctatctnagccttaaagttatacaaggaatcaaagct

SEQ ID NO: 24533 - DNA, 101 bp, rice(Oryza sativa)
  misc_feature (71): n=a or g
actctatgagacacccatctcccaatagggggggtactcgtagctaggtttttcaaaatctcaagcaaccnggtgaaagtactctaacgcacaacgcggtg

SEQ ID NO: 24534 - DNA, 101 bp, rice(Oryza sativa)
  misc_feature (71): n=t or c
gccgggtaatgacctggttgccgccttgccggcagcccggctagggtctgtttgaggggagctttagattntgagaagcagctgctgggtagccagcttct

SEQ ID NO: 24535 - DNA, 101 bp, rice(Oryza sativa)
  misc_feature (71): n=a or c
gggagagagaggatgacatgtggacctcatgtgtcagtggctttttttttaattccatgtgccacgtaagngccatgttaatgccacatggggcgaagacc

SEQ ID NO: 24536 - DNA, 101 bp, rice(Oryza sativa)
  misc_feature (71): n=a or g
ttctgcagcatggggtttaaacctgacagacaagattgattctctacttttgacggacacccatttctccngctcatttaagaacactgtgggaggatggt

SEQ ID NO: 24537 - DNA, 101 bp, rice(Oryza sativa)
  misc_feature (71): n=t or c
aaggggagaaacggaggaggagatcggccgacggtagatggtggctagtcatggcaaggagagagaaattnggccgacggcgacgagcaccaggtcggcac

SEQ ID NO: 24538 - DNA, 101 bp, rice(Oryza sativa)
  misc_feature (71): n=a or c
tggggtggatcgacgaccattgggctgtcgaagcatagcagagacccaggcagagatgtactccctccgtnccaaaaaaagacaaaccctggtttccgtgc

SEQ ID NO: 24539 - DNA, 101 bp, rice(Oryza sativa)
  misc_feature (71): n=t or c
tggcgggggagcagcgaggagtgagatctgtgggggaaacggtggtggagcttcagtttcgggcaaaatcngttacactgcactgtaacacgcgtacgttt

SEQ ID NO: 24540 - DNA, 101 bp, rice(Oryza sativa)
  misc_feature (71): n=a or c
acttgggtcatgtatgccgtttaagtggaattgtcgtgagcatagttgattcaaacttacatgatcaatgnaaaaggttttgtaacttattttagagagat

SEQ ID NO: 24541 - DNA, 101 bp, rice(Oryza sativa)
  misc_feature (71): n=t or c
tacacaaggatacgaatatccgcaatgttcactactgttaaggctgtgtttaaaaattctgattattttcnctttggcaggccatcaaggtcttagagtga

SEQ ID NO: 24542 - DNA, 101 bp, rice(Oryza sativa)
  misc_feature (71): n=t or c
attagttgattgattggatatgaaataatttggggacagtcgtgtgaaattggtgaagagcgcagctagtngctgtcgaaattttccttgttgatcggcat

SEQ ID NO: 24543 - DNA, 101 bp, rice(Oryza sativa)
  misc_feature (71): n=t or c
tatatttattgtggcatgaatattttattcgtatgacctaaatctgcggagaatacaaatagagggcgttngatgttttacttgaaaaatctttttgaccg

SEQ ID NO: 24544 - DNA, 101 bp, rice(Oryza sativa)
  misc_feature (71): n=t or c
tttaaccatgaacataaaactaaacagaggaacctgcactgtaaacataacaagaggttgaaacatggagnagcgttcagtcatggtggatgacactttta

SEQ ID NO: 24545 - DNA, 101 bp, rice(Oryza sativa)
  misc_feature (71): n=t or c
gctaatgaataattatttttccggagtattgtactttgaagcatgggaccaataatgatgtattgataatntgccccggttagctcattccaacagggcag

SEQ ID NO: 24546 - DNA, 101 bp, rice(Oryza sativa)
  misc_feature (71): n=a or g
cttctcccttctaaaatgtacatgatagagcatgcaccatatgtttaaaaatctattgctaccttcatctnaaaaaatataagatgcaacctctgtctaat

SEQ ID NO: 24547 - DNA, 101 bp, rice(Oryza sativa)
  misc_feature (71): n=t or c
gcctctcccatcatcaccatccacatccttcgcgtcctcttgagtcttgatatataccttgccttctctgnccgccgatctgccttgcctcatggttcgtc

SEQ ID NO: 24548 - DNA, 101 bp, rice(Oryza sativa)
  misc_feature (71): n=a or g
ctattttaaccaaactattatttcacgtatatctgattataagttgtctccctccgattttattttaattnacgttttagacaatgacacggtctacaaaa

SEQ ID NO: 24549 - DNA, 101 bp, rice(Oryza sativa)
  misc_feature (71): n=a or c
gatcgattcgattgtctcggaggaagagaggaaatcgatcggtttgcgctataacgaatgcagcaagcggngcacgcaccgtccgccgcctgattttatcg

SEQ ID NO: 24550 - DNA, 101 bp, rice(Oryza sativa)
  misc_feature (71): n=a or g
cgcacagaaacgttctgatttcttaacatttttgtactgcccgttctgatctctggacatctctacatccnttcggccttttacttttattaggaagttag

SEQ ID NO: 24551 - DNA, 101 bp, rice(Oryza sativa)
  misc_feature (71): n=a or g
agggttatatcagagagttagagaagctttttattggagatggtacttactgctatgtactagatggttgntgtgtgcattttctaccattttccccagaa

SEQ ID NO: 24552 - DNA, 101 bp, rice(Oryza sativa)
  misc_feature (71): n=t or c
taagttttagagcttcatggatgctggcatccccagtttgtcttgtgtcgttttggtttttcttttccttnttgtttaagactctgtatgttgctgtttgg

SEQ ID NO: 24553 - DNA, 101 bp, rice(Oryza sativa)
  misc_feature (71): n=a or c
tactgtacgcacctcttatcttgcagatgtgtccttatactggaaatcaggctatgcaacttccaattgtnaggtggctgctgcaggcgaacctgtgagag

SEQ ID NO: 24554 - DNA, 101 bp, rice(Oryza sativa)
  misc_feature (71): n=a or g
acacccaccatcacctccacacccaaaagaggaatgcatttccccgccattgatggaggaaaatgtgccanttaagccaccacctcccaagaagaggcagc

SEQ ID NO: 24555 - DNA, 101 bp, rice(Oryza sativa)
  misc_feature (71): n=a or g
cttgcagacggttggtgttcacgtcgaagctttgcaacgctgtcatgttgccaatctcaggtgggatcgtnccggtgaggttgttgaagaacaacgccaac

SEQ ID NO: 24556 - DNA, 101 bp, rice(Oryza sativa)
  misc_feature (71): n=a or c
gaatcccctcctcgtcacgaaccggaaggcgccatcctgatagatgacatcctgtatctcatctctgagtntgactgttgagtcgggcgccattgttcctt

SEQ ID NO: 24557 - DNA, 101 bp, rice(Oryza sativa)
  misc_feature (71): n=t or g
aggtgcagtacaatctttatcatgcagttctcttgcaatcccccttgtttcaaagtcccagataacacagntaccatttgcacatccagctgaaaaaaaaa

SEQ ID NO: 24558 - DNA, 101 bp, rice(Oryza sativa)
  misc_feature (71): n=t or c
ggggagtttagttcccaactccccatatgcgaacacaacctacatatccaaataagacattaggccccttnttagttcccacacaaaaaaaattataccct

SEQ ID NO: 24559 - DNA, 101 bp, rice(Oryza sativa)
  misc_feature (71): n=a or g
agagcataccagctgcaacagaacgcgtgttcctagccactaaagcttcattggcaccctcaacttcatcnacaaccatgacggctccggcaccttccacc

SEQ ID NO: 24560 - DNA, 101 bp, rice(Oryza sativa)
  misc_feature (71): n=t or c
acatttctctcctccgaacttctgcacatgagaagaaacaatgggtaggttcattcactattctaagtggnaggaagtaaagactgtcaacaattatgctt

SEQ ID NO: 24561 - DNA, 101 bp, rice(Oryza sativa)
  misc_feature (71): n=a or g
ccggccggcacgggtgattgttgcaaatgcttacacgcagtgtattgtagaacttactccgtttcataatntaagtcattctatcatttatatatatatat

SEQ ID NO: 24562 - DNA, 101 bp, rice(Oryza sativa)
  misc_feature (71): n=t or c
acatatgacaacctttgttttctcgccttctccttcaaccttttgttgctctttttatcatctacttcagntccattagcaatttcttgacctttattatc

SEQ ID NO: 24563 - DNA, 101 bp, rice(Oryza sativa)
  misc_feature (71): n=t or c
tggaatggtctggaaaggaggcttttgtgtcctcatctgaggaacctttcacagttgatggaaaagaagcnggtattctgaaaagctatggacctttgagt

SEQ ID NO: 24564 - DNA, 101 bp, rice(Oryza sativa)
  misc_feature (71): n=a or g
tggcttccacactactgggtactttattgtctgagccatccctttcactgccatatgaaccttattcaaancctgcacattagcatcttggtgagaaacta

SEQ ID NO: 24565 - DNA, 101 bp, rice(Oryza sativa)
  misc_feature (71): n=t or c
accagagcagtcgatcaattctagggccatcggatcatgagagtcgccacacgagggccatttatcctttngagagttctatctatggcacaaaattttta

SEQ ID NO: 24566 - DNA, 101 bp, rice(Oryza sativa)
  misc_feature (71): n=a or c
tgcacggggagaaaacccctaggaaaaaaccccatacagggattttccctgtaccaagtgaatcccccccnaaatctctagggaagcactttccgctaagg

SEQ ID NO: 24567 - DNA, 101 bp, rice(Oryza sativa)
  misc_feature (71): n=t or c
gttcgcaccaaaatctgaaaaccttgttttgggcaagtgtaagaactctgcataatcgtgggcccctttgncgatctgatgcagctgaagaactaatggcc

SEQ ID NO: 24568 - DNA, 101 bp, rice(Oryza sativa)
  misc_feature (71): n=t or c
aataacctcagcaacaccttcatcctcctgaccaacattattttccttggtttcctctggagccaattctngagacacaacagaactagcaccgccatcaa

SEQ ID NO: 24569 - DNA, 101 bp, rice(Oryza sativa)
  misc_feature (71): n=a or g
ccccaaatcagaaagagtcggctgtgtaagatgtccgggttgcagtctgataataggagaagatgtccctnttaaagattggcacaactattggttagttt

SEQ ID NO: 24570 - DNA, 101 bp, rice(Oryza sativa)
  misc_feature (71): n=a or g
gtaggctcgccaagggaagcttcgtgaaaatgaagcaaggaagtacttccagcagcttattgatgccatcnattattgccatagcaaaggagtatatcata

SEQ ID NO: 24571 - DNA, 101 bp, rice(Oryza sativa)
  misc_feature (71): n=t or c
ggtcgcttctgcataggaagttttaattgcatgcaacttaatagctatttctctagtgttcattcgttctnttgggatcagacgagtgcaagaaagagcca

SEQ ID NO: 24572 - DNA, 101 bp, rice(Oryza sativa)
  misc_feature (71): n=a or g
aacccggtgtccgatgagtggttcgacaaggctgacaaactcctcaaggacatcgagatgttcgtcacacnacctgtgcacctccccgtggaccccgacgc

SEQ ID NO: 24573 - DNA, 101 bp, rice(Oryza sativa)
  misc_feature (71): n=t or c
ttcggtatcccgaactgacaaacgatgtttttccagacgaatttctgaacctcggctgcggttattgtagngagtggttcagcctcgatccatcgcaagaa

SEQ ID NO: 24574 - DNA, 101 bp, rice(Oryza sativa)
  misc_feature (71): n=a or g
aaacttaaaaaaacgtctgttgcacttgccagattagaatcaggatgttgacagaatttaatctgtagtgngttttctgaaccaatattgtgctgcagcaa

SEQ ID NO: 24575 - DNA, 101 bp, rice(Oryza sativa)
  misc_feature (71): n=a or c
tacatgctctcaagttgaatgtataagctggttccagttccaaactcctcatccatataactatatagtcnatggttactaattacaaagcagcatatatg

SEQ ID NO: 24576 - DNA, 101 bp, rice(Oryza sativa)
  misc_feature (71): n=a or g
ggaagggggagagaatatcctataagtcgagggtgtcacatctaatggcatagacttcgcttttggataanttggtcaccatgcctgtcgcgaggccaaaa

SEQ ID NO: 24577 - DNA, 101 bp, rice(Oryza sativa)
  misc_feature (71): n=a or g
gtcagctggtagacctagaagcagaaggattaagggggtggaagaaggtggagtagggaaaagaaagtacngatgcaagaggtgtggtcaatttggccaca

SEQ ID NO: 24578 - DNA, 101 bp, rice(Oryza sativa)
  misc_feature (71): n=t or g
atgatgaagaagaagctggtagaagctcatctcatagtaaacgtgcaactagaagcgcacgcactaaaganattagaatggctactcttgttgatcctcat

SEQ ID NO: 24579 - DNA, 101 bp, rice(Oryza sativa)
  misc_feature (71): n=t or g
gttatacaaggagggactttgcttctgttgctctgctccctttcatacttcctcatgttcatatagcgagngcgtaagtgcagtattcaaccataatcata

SEQ ID NO: 24580 - DNA, 101 bp, rice(Oryza sativa)
  misc_feature (71): n=a or c
attgtagctatcactaggcactagtgagcttatccagtagtaagatgacacgtgggacttgtgttggtcgnatatgttatactgcatggtgtaggatgagg

SEQ ID NO: 24581 - DNA, 101 bp, rice(Oryza sativa)
  misc_feature (71): n=a or g
ctggaggccacagatggagtcagtcggcgaacttcaccaacaactggatcttgtcaacaagttgaaccaancttcttcaacgacgtcttcccctcgagttc

SEQ ID NO: 24582 - DNA, 101 bp, rice(Oryza sativa)
  misc_feature (71): n=a or g
attccttgtcagcctggtagggatactctgtcctgtgggatatgtgtcttattagtgttttctcctatgtngaattgttttctttttacaaagaaactcaa

SEQ ID NO: 24583 - DNA, 101 bp, rice(Oryza sativa)
  misc_feature (71): n=a or g
agttctcttgggagtcttcacaatactcgatgttcttgtggtaaaagttgttttactactaacctcctcgnccaaactaacatcgatagataaatctttga

SEQ ID NO: 24584 - DNA, 101 bp, rice(Oryza sativa)
  misc_feature (71): n=a or g
taaatttaataaaaccccatctattatggtccatgttacacaaaaccattaagattttggcgtgtgccacntaaccccatgtattatggttttcaagtttc

SEQ ID NO: 24585 - DNA, 101 bp, rice(Oryza sativa)
  misc_feature (71): n=a or g
ccggcagattctccggcaactagctaagctagcgactacgaaattaggagaaaactttgccgtgtgaaacntactccctccatccctaaatatttaacgcc

SEQ ID NO: 24586 - DNA, 101 bp, rice(Oryza sativa)
  misc_feature (71): n=t or c
ctgaaagacaaaaaccaggaattatctgtaccaaacacatagatgtctgctgctgttcttgaaagcaaccntttactcaggttcaacatcttgtcacagaa

SEQ ID NO: 24587 - DNA, 101 bp, rice(Oryza sativa)
  misc_feature (71): n=a or g
tgtgggtgcgtgttctcggcgatggagttgctgaggagcatcagctactgcattcctctgcctcagatggngtcgctagggatgttggcggagtatgcagc

SEQ ID NO: 24588 - DNA, 101 bp, rice(Oryza sativa)
  misc_feature (71): n=t or c
cgggcggcgaggcgaggcgagagctgcgtgaggaagaagcggaggcgaacaaaaaaaaaagaaaaaaattncttccctttttttttcccctcttggctgga

SEQ ID NO: 24589 - DNA, 101 bp, rice(Oryza sativa)
  misc_feature (71): n=a or g
taagcacccaaaagtattccatttccatctttccagctaaaagtgaggtataacactgatatactgtgccncacacgcacgagtaggagcatcgtcacagt

SEQ ID NO: 24590 - DNA, 101 bp, rice(Oryza sativa)
  misc_feature (71): n=t or c
ccttccaggatgatctgcagccgcaagaggtaattaattgatttggcaaacatcgtctttgatctccagcngtcttgtttctctccggtgaacccaaacgg

SEQ ID NO: 24591 - DNA, 101 bp, rice(Oryza sativa)
  misc_feature (71): n=t or c
aacccatctatgaattgagtaaaaaaaacatggaatcccaagaggaatgatgagcgtgaaactggtgcatnaactcattaaacctctccgcataactaagc

SEQ ID NO: 24592 - DNA, 101 bp, rice(Oryza sativa)
  misc_feature (71): n=a or c
agtaacgtaccaaaacccaagagatgacctgtcccgatgttactacaactgcaagtgcttcgtaggtcctnatcaatttccatgcaaaccctgggtcagcc

SEQ ID NO: 24593 - DNA, 101 bp, rice(Oryza sativa)
  misc_feature (71): n=t or c
gaaatatccagagaacttctctgcatcaagagtggcggaagtgactattaacttgagatcagttctacgcntaattagcttcttgagtaaggcaaagagaa

SEQ ID NO: 24594 - DNA, 101 bp, rice(Oryza sativa)
  misc_feature (71): n=t or c
aggtgagatccgagaggcgtttcacggcaaggctaccgtaggggagggtgacatccaggtgagcaacctcncctaccttaggctttttatcaaggagaccc

SEQ ID NO: 24595 - DNA, 101 bp, rice(Oryza sativa)
  misc_feature (71): n=a or c
tccctttctttgggtttggactgtgataggaacattgtggtttagcactgcaagaggctgtgtaagttttnttattgttatggtattatgctcatcaccaa

SEQ ID NO: 24596 - DNA, 101 bp, rice(Oryza sativa)
  misc_feature (71): n=a or g
gttatagtttactcttggttagtctcaactgatagtgcagttttcttgcatgagtgcaggagaggtcactncaggaggagaacaaggctctgcagaaggaa

SEQ ID NO: 24597 - DNA, 101 bp, rice(Oryza sativa)
  misc_feature (71): n=a or c
taattctggtttgctcaataccaaattatgtgtgattacggatatgcgtgaccgaaaaatactagcggctntcaaatataggtagtctcttatgcacgcgc

SEQ ID NO: 24598 - DNA, 101 bp, rice(Oryza sativa)
  misc_feature (71): n=a or g
tacttgagaattgaacatccttgtaagtaggtgcgttctagtagtaaggacttaacaatttagtattttantttagcaacttggttaagtatgtgttgttt

SEQ ID NO: 24599 - DNA, 101 bp, rice(Oryza sativa)
  misc_feature (71): n=t or c
tattttttttataaaagaaatagggtataacgcaggtgctcacatgagtacacacctacctctatgaacangtatgtgcatgctctatctctatgagcatc

SEQ ID NO: 24600 - DNA, 101 bp, rice(Oryza sativa)
  misc_feature (71): n=t or c
aaattgggaagagaggagaaaaaagaaatgagagaaatggtttctatgtcaggcaagccagatgcgggacntatgttatatagtcgaacgataatgcgaaa

SEQ ID NO: 24601 - DNA, 101 bp, rice(Oryza sativa)
  misc_feature (71): n=a or g
tttaagtttcaaacagtagtgatgagagacacgggtttgtgcttatgatgtgtgtgcgtgtgtattttctntgtaaaaaaaatcatactaaaggacattca

SEQ ID NO: 24602 - DNA, 101 bp, rice(Oryza sativa)
  misc_feature (71): n=t or g
tattgtagtgtcgaaatgatccaagtgcagatgatgatttgtggaatttagctactggatgcaagcctagngtcttgtcatacaattcttatgatattaat

SEQ ID NO: 24603 - DNA, 101 bp, rice(Oryza sativa)
  misc_feature (71): n=a or g
gaagtagaattgcgtgctaagatcgaagcactaggactagaagttaccaaggtaccagagcagacacctangcagcttgatgaggtaactgcaacaacctc

SEQ ID NO: 24604 - DNA, 101 bp, rice(Oryza sativa)
  misc_feature (71): n=a or g
tcccattttttcttccaaatgtgccaataggctatgaagaaaacataaaagaacccttttcgcttgaaccnaagtattgctaaatccactattttaaaaaa

SEQ ID NO: 24605 - DNA, 101 bp, rice(Oryza sativa)
  misc_feature (71): n=a or g
tttggaggtttggagtcgttcatggccgcacatattatatatattgtttgacgcaacacaaaacattccancaattgtactcaagaattcatcaccgcctt

SEQ ID NO: 24606 - DNA, 101 bp, rice(Oryza sativa)
  misc_feature (71): n=t or c
taggtggccttgccgaacccttcctcaggaaaatgtccactacccatgggtgtggtaatttgaggcgaatncacctccccaccccattccacactgtcggc

SEQ ID NO: 24607 - DNA, 101 bp, rice(Oryza sativa)
  misc_feature (71): n=t or g
taataagacgtggcatataaacagtacaaagctacgttctttcttctttctggacggaggtagtggtaagngtattctaaacccaatgactaggataatgt

SEQ ID NO: 24608 - DNA, 101 bp, rice(Oryza sativa)
  misc_feature (71): n=t or c
gaaagctctgatctagacatttggattgagctgtgtgtcacctccttattgaaggtgtcatatcaaggttntagatgaaaatctacccctatttttgggtg

SEQ ID NO: 24609 - DNA, 101 bp, rice(Oryza sativa)
  misc_feature (71): n=a or g
acagaaattctgaaattattttttgagatgctaacttggtagttatttttggaagtaaagtaaggcctttnatgccattttccaccttaccaaactttgat

SEQ ID NO: 24610 - DNA, 101 bp, rice(Oryza sativa)
  misc_feature (71): n=a or g
cggctgggaacgaggatggatggacatggaagcatcaccttcctccgtcgcaacctcgaggtcgataactnggaacgaggaaaggttgacgtggaagaggt

SEQ ID NO: 24611 - DNA, 101 bp, rice(Oryza sativa)
  misc_feature (71): n=t or c
atttttatcagacacgtcgttgctgtttgacactggcacaaacgtttcaatggatggactgaggaaagcancatttgattcagagaaattctcttcctcat

SEQ ID NO: 24612 - DNA, 101 bp, rice(Oryza sativa)
  misc_feature (71): n=t or g
caaattcctgatttaaaatttctagaatgcattttcacatctccgaaatgtgcctcagttctgctcctgtnttcatccctattgatggaacttgctgcatt

SEQ ID NO: 24613 - DNA, 101 bp, rice(Oryza sativa)
  misc_feature (71): n=a or c
gcctttcctttactatcgggactaaacttaccaatcccggtaccagcaccagaatcatcgttccccaaatncagcttccctttgcctttaacatcatacct

SEQ ID NO: 24614 - DNA, 101 bp, rice(Oryza sativa)
  misc_feature (71): n=t or g
actccatatggatgaacaaaaaaaaatgcatgattgatatggttgggatggtgtggtgatgatggatggangtggatcgatgcaggtggacaggaggtaca

SEQ ID NO: 24615 - DNA, 101 bp, rice(Oryza sativa)
  misc_feature (71): n=a or c
atatagtacgtgtagcattgctcttaagtaccttccaacaggagtgcagacgagaaactgtagattgcagngagcaggctgcaatctcctgttatatgggg

SEQ ID NO: 24616 - DNA, 101 bp, rice(Oryza sativa)
  misc_feature (71): n=t or g
gtcatagtgaaaaacagttgatgcctgtcggtacttaactataaaatggttcaccaacaatttgaccttgnctttcgatactgagcctccaccatcaggtc

SEQ ID NO: 24617 - DNA, 101 bp, rice(Oryza sativa)
  misc_feature (71): n=t or c
gctaaccagcatgaagggaatggaatagtgctacgctgctgctaccgatgagaatcatgagatgagacganggtttaatagatagtgacatgacggtgggg

SEQ ID NO: 24618 - DNA, 101 bp, rice(Oryza sativa)
  misc_feature (71): n=a or g
gaagaaggccaagttaagtggtaccggtaatgttacatctgacagtccagtgctagcaacaactatttcancgacagaacttagtgaagggggtgaggtcg

SEQ ID NO: 24619 - DNA, 101 bp, rice(Oryza sativa)
  misc_feature (71): n=t or c
cgggtgtgatagggggcctctcctctctctccaactatttttttagtgaaagtgacatttcaagaacaagntcacttcttttgtgctagtgtaccttctac

SEQ ID NO: 24620 - DNA, 101 bp, rice(Oryza sativa)
  misc_feature (71): n=a or g
gcggtatgaaggacatggagtgtggggtttcccgataaagtgcaatttttcatttagcgggaaggaacttncatctggttcatccgatggttgtatctatt

SEQ ID NO: 24621 - DNA, 101 bp, rice(Oryza sativa)
  misc_feature (71): n=a or g
ctagtaagagcgaatcaaccaaccaaccaaacccttggacagttggactgtttgtttaacattgtgcgggnagcgagcgacgacagcgacgtccttctcac

SEQ ID NO: 24622 - DNA, 101 bp, rice(Oryza sativa)
  misc_feature (71): n=a or g
tcgagcaatttgcattgccaactgataagcacttcttaccgaaaaacgaccaagccgatcaggaaaccaancaacaaaatcctcctcttggcgggaggata

SEQ ID NO: 24623 - DNA, 101 bp, rice(Oryza sativa)
  misc_feature (71): n=a or g
agctaataacgcgtatgcgtataacgtgacgaatcgaaatagctctagcaatcgatcatacaagtctcacncaagatgtgtgtgtgcgcgcgtgtgtggga

SEQ ID NO: 24624 - DNA, 101 bp, rice(Oryza sativa)
  misc_feature (71): n=a or g
cggagtaaaatagagatgcctggtgactggctatttgtagatacacttccaattgcaaggcaattgattgnttctgatggtacgttcttttgtcaagtgtt

SEQ ID NO: 24625 - DNA, 101 bp, rice(Oryza sativa)
  misc_feature (71): n=a or g
atggtggtatgctacagggaagatctagttgtgagcaagggcagacctaaccatgagttaagatttcgtcncctgagttgttccatgttgttttggccagt

SEQ ID NO: 24626 - DNA, 101 bp, rice(Oryza sativa)
  misc_feature (71): n=t or c
agattcactgagatcaacagcttggatggcgattgcatcttcattagcccatgtagtagcatgtcatttcntgcatgtcagtatgatggaattgaagatga

SEQ ID NO: 24627 - DNA, 101 bp, rice(Oryza sativa)
  misc_feature (71): n=a or c
tttagtatatataaatcaacattgacaagtaaaagagaaaagctatcatatatttacactataacaccaanaaatatatatatatcagcacaaaagggcaa

SEQ ID NO: 24628 - DNA, 101 bp, rice(Oryza sativa)
  misc_feature (71): n=t or c
gtgttggggcctggcttgttgtgggctgtggactgggtgtgtgtgtgtgcttttgacgtgccgtgctgggntggcggtcgcgtcgagtgcgtgtgccttgt

SEQ ID NO: 24629 - DNA, 101 bp, rice(Oryza sativa)
  misc_feature (71): n=a or g
aatgtcttccacttctaaatctttatctggccctaaaatttccctaacttctggatgattcctcatgaagntagtaaaatcttttccacggaaatactcaa

SEQ ID NO: 24630 - DNA, 101 bp, rice(Oryza sativa)
  misc_feature (71): n=t or c
cgaacgagttcttcgtcgcctttcagaccgtgtagcagcagtagatggccatggtttttgtttcgtgatgnttgttgaggacttttgttcatgatttgtgt

SEQ ID NO: 24631 - DNA, 101 bp, rice(Oryza sativa)
  misc_feature (71): n=t or c
caagcgcctcacactcactccagcacaacggaactcgttgcgtacctcggtgttgtagtactcaataaagncggcttcagatctgtctcggtgagtcacct

SEQ ID NO: 24632 - DNA, 101 bp, rice(Oryza sativa)
  misc_feature (71): n=t or g
gcgggaaaatgacttataaatacctgatgcttctcagagcagtagcgtgctttcttgcagctactacagantttatcacctttccatgtaccgcaccaatg

SEQ ID NO: 24633 - DNA, 101 bp, rice(Oryza sativa)
  misc_feature (71): n=a or g
agcaactcttcctcattcatatctagcatttcagtagtttcttcaataataccaaatggcttctcagcttntataataaatttagctccttcaagtttttc

SEQ ID NO: 24634 - DNA, 101 bp, rice(Oryza sativa)
  misc_feature (71): n=t or c
ctgcaaacaataaaggatctattttcttcgagtgccatgctaggcagtcctcatcccctctttaagaaatnctgattttgaaaattcttgatgcatcaact

SEQ ID NO: 24635 - DNA, 101 bp, rice(Oryza sativa)
  misc_feature (71): n=a or g
gttgaaacttgaatgtgataatcatgtaatcatgcaggggggacaaaaagggaaaatcgggattgctattnttagcaattggatgattccctatgaagatt

SEQ ID NO: 24636 - DNA, 101 bp, rice(Oryza sativa)
  misc_feature (71): n=t or c
agaacctaaacaagtaaccgcaccagtgtatgacacgaaaaaaacacaacacgtttccatcttactgccanaacattgaactatatagaacttgtggtagc

SEQ ID NO: 24637 - DNA, 101 bp, rice(Oryza sativa)
  misc_feature (71): n=t or c
ttttgggacggaggaagtatcatttaggactaggcttcgttcgtttctgcataggaattgagattttaacnggcacggaaaccagagcaaacaattaacac

SEQ ID NO: 24638 - DNA, 101 bp, rice(Oryza sativa)
  misc_feature (71): n=t or c
tcctttagtaacttccatacttgggcaacaccatcccatttgccagatgacgcatatatgtttgaaaggancactaggtttgccgtgttttgtggctcaag

SEQ ID NO: 24639 - DNA, 101 bp, rice(Oryza sativa)
  misc_feature (71): n=a or g
tgatcgaacaaagccgttttgcttctctaaccaggaataccaggtctgatgtccttttcagcgagtagttntacaactgagatataatccttctcaatggc

SEQ ID NO: 24640 - DNA, 101 bp, rice(Oryza sativa)
  misc_feature (71): n=a or g
caacaaaattgaaaatgatatgcaactactcttcagaatatatgacatcctggacatcgaagctgcaactnatatgcaacaacgcatgcatcttaataaat

SEQ ID NO: 24641 - DNA, 101 bp, rice(Oryza sativa)
  misc_feature (71): n=a or g
attaaggatctaattatacttccatatcaattaagggtagtagaaaagtggaaagacataatagtccatcncaaaatggagtggagggataatattgtaac

SEQ ID NO: 24642 - DNA, 101 bp, rice(Oryza sativa)
  misc_feature (71): n=t or c
gaatacgtgccattctgtttatcaatagctcggtcacaaatatgtgttgtttttctgatgaaaataataanagaacacatgtaattaatctacaaacatct

SEQ ID NO: 24643 - DNA, 101 bp, rice(Oryza sativa)
  misc_feature (71): n=t or c
cccggttttgtttttgttgctgtgagtggaagattccggaggagagaagtgaggcagtgtccaaaagacanctttcaatcctaaccattcatttctcattt

SEQ ID NO: 24644 - DNA, 101 bp, rice(Oryza sativa)
  misc_feature (71): n=a or g
gtgcaacgacgaagtgtgatcaactccctaacctgacttgcgcagcagttcactcccagcaccgttacgancacgaggaagactcgcccactaggcccaga

SEQ ID NO: 24645 - DNA, 101 bp, rice(Oryza sativa)
  misc_feature (71): n=a or g
acagaaagaaggcagtgtgctgcattttcatcggtagcaactggatcttcttggttgaggctcaactcttntaccagctgaggatcaacaatctgcagcaa

SEQ ID NO: 24646 - DNA, 101 bp, rice(Oryza sativa)
  misc_feature (71): n=t or c
gtgcgaggcatcttcgtcagctacgtcgactacgatcgcacgcacctgttcgcccacccgtccataacgcnggcgtgcccggccatcgacggcgtcctcga

SEQ ID NO: 24647 - DNA, 101 bp, rice(Oryza sativa)
  misc_feature (71): n=t or c
ggtgagacaagagaaattatctctcctccaccatcgctggaaaaggaaatgtaaagtttgatgctgtgtgngggagagtggtaatcgagttcttgatttgt

SEQ ID NO: 24648 - DNA, 101 bp, rice(Oryza sativa)
  misc_feature (71): n=a or g
accctgctatcacaaatttgtataggagcattgctataatatatacgaacgaccacatcacatgacacctnataaaacatgacaaattatcttactatgtt

SEQ ID NO: 24649 - DNA, 101 bp, rice(Oryza sativa)
  misc_feature (71): n=a or g
caaaaatggtagagaattattccattaatttgttgtggtcatagagaaataaaaaaaatattcggtaatcngtacaatatagaatataactttgagtattc

SEQ ID NO: 24650 - DNA, 101 bp, rice(Oryza sativa)
  misc_feature (71): n=t or g
gatatgcagaccgaatcgtggagcggtactggtgtcctatacgaacgacgagcgagcacacaacaataaangtagccccttgaaaacacgtttaatacagg

SEQ ID NO: 24651 - DNA, 101 bp, rice(Oryza sativa)
  misc_feature (71): n=a or g
tacgagtttgatacaaaagaaagaaaaaacaaaagctggggttgccagcttttaacatattaaattgttgncataatcatatttacatcacaactaaattg

SEQ ID NO: 24652 - DNA, 101 bp, rice(Oryza sativa)
  misc_feature (71): n=t or c
tcatggacctttgattcctcaagctggatcccaagtacggcaaggttgttgacaagcccactcagccgganggagaattcctccacggactccccttcctt

SEQ ID NO: 24653 - DNA, 101 bp, rice(Oryza sativa)
  misc_feature (71): n=a or g
caatggcttgtttggtaataatacgggtgaagtttgaagcttcagggcaaaggcgcaggcattggatcttnctgaagccattccgaacaactgagggcaag

SEQ ID NO: 24654 - DNA, 101 bp, rice(Oryza sativa)
  misc_feature (71): n=t or c
tctgagccatgtcccctcaaaaagagaactatttgttgaaccgcctgagtcatctgcatttgatggtgaanttgaagatgcaccagtcaaatatgtggtgg

SEQ ID NO: 24655 - DNA, 101 bp, rice(Oryza sativa)
  misc_feature (71): n=t or c
aattagcactgatttaggtatgtaatggatcctgacagtttgaaaatctgctgacaggttggtctttgcanagcactggtattcacatttccagtcatgat

SEQ ID NO: 24656 - DNA, 101 bp, rice(Oryza sativa)
  misc_feature (71): n=a or g
gtactacgcggacacaggggtgaaacgttaaatcactgcaccctactcacggcagcagaacagtgtcgtgnagcggcgcaatcagactgtggtggcagcag

SEQ ID NO: 24657 - DNA, 101 bp, rice(Oryza sativa)
  misc_feature (71): n=t or c
cgcaacatgatagcatcaaacttcttgtacgaaagtttcatgccacggtttattacctcatctagaagagnggtcgcatcttccgttcttccagaatcaaa

SEQ ID NO: 24658 - DNA, 101 bp, rice(Oryza sativa)
  misc_feature (71): n=t or c
atatttgatggaaaagattttgtccctgatcatcatgtttttgaccttacaattagaacattctgtagggntggctattgtcactatagaactttttataa

SEQ ID NO: 24659 - DNA, 101 bp, rice(Oryza sativa)
  misc_feature (71): n=a or g
gacagagagattttcatccatcgatcgatcgccatgccgcctcaggagttgcatggcgatgatcatggccnccaccaccaccaccagacacccgctggcag

SEQ ID NO: 24660 - DNA, 101 bp, rice(Oryza sativa)
  misc_feature (71): n=a or g
gactagcactttggcccgtcactgatgggccatcagaggtgagcggatatttatgtcctggggtacatacnttattcctactattttcatgaaattttcaa

SEQ ID NO: 24661 - DNA, 101 bp, rice(Oryza sativa)
  misc_feature (71): n=t or c
ctacctttccttttttttggtgcaagggcaatggaaatttgttttccgatatgtaggtggtgtttgtatcnagggacttaactttagtccatatatttaaa

SEQ ID NO: 24662 - DNA, 101 bp, rice(Oryza sativa)
  misc_feature (71): n=t or g
tggagatttcactttgcagtattgcgctgctcagcttgtacagagattggatgatgcagaacatatgtatngactcctgacagatgtcagcacccgaatat

SEQ ID NO: 24663 - DNA, 101 bp, rice(Oryza sativa)
  misc_feature (71): n=t or g
tgtacatagagcaaggaggctagctagatcttcaaggatctggataattgctgtctgggcagcatcagttncagtgttcttattggtgatctccatgtttt

SEQ ID NO: 24664 - DNA, 101 bp, rice(Oryza sativa)
  misc_feature (71): n=t or c
actttggacatggtgtgttagaactcaaaaagactcaaactctagcgaagagcaagctggctaacactctngatggcagagcagtcggtcggtgatcatct

SEQ ID NO: 24665 - DNA, 101 bp, rice(Oryza sativa)
  misc_feature (71): n=a or g
agaatccattatatgccattgagtttgtcatagatctgaatttaccatcgactttgtcatgttatacaatnagccatcgacttttgcttaacttttacaaa

SEQ ID NO: 24666 - DNA, 101 bp, rice(Oryza sativa)
  misc_feature (71): n=a or g
gattccaaggtgcgctgccgtcgatcatcagcctcctttgcaactcactcgcgatcttgttgctcacgctntagttgttctcgctcttgtcgttatcgttc

SEQ ID NO: 24667 - DNA, 101 bp, rice(Oryza sativa)
  misc_feature (71): n=t or c
aaggttgagctagttgagttgggttgttttactcaacaaccgttggatttgaacgctataccaaaatcaantgatgatttcgtttttttcaattaactgca

SEQ ID NO: 24668 - DNA, 101 bp, rice(Oryza sativa)
  misc_feature (71): n=t or c
ttggcattcttgtcatagagatcgtgacaggccggagaaggaatagcgggccatatttgtctgagcagaangatgaagatatattgagcatagtgagcatc

SEQ ID NO: 24669 - DNA, 101 bp, rice(Oryza sativa)
  misc_feature (71): n=t or c
ataatatgttaattctttaggctgtgttagggagtccaagttcccaacctctactatattgttttccatgngcgctcttcccgaacttctaaatggtatat

SEQ ID NO: 24670 - DNA, 101 bp, rice(Oryza sativa)
  misc_feature (71): n=t or g
atggcacacggcggctagggttcttggatttgaatttggggggaaaaatgcttgggagctaggattgctanatgtgaaattttttttgtgcatgttcttct

SEQ ID NO: 24671 - DNA, 101 bp, rice(Oryza sativa)
  misc_feature (71): n=t or c
gtgatgattctctaattacctgaactactacgagcagctggctttgtctcttaatttcctgtgactagggnttactttcttctgcgatgtgcctgttcctt

SEQ ID NO: 24672 - DNA, 101 bp, rice(Oryza sativa)
  misc_feature (71): n=t or c
atttaaccttaatgtttgctaaacaatttagaaatccttgtttttatagggagaggatacacattaccctngtacctgtaacattgcgcgctcatttctcc

SEQ ID NO: 24673 - DNA, 101 bp, rice(Oryza sativa)
  misc_feature (71): n=a or c
aactttttattgttactctacctggaatggagaagaacaaacgcaccaaaagagcaagaaaagcagtccantgaccatagtcactcctacatttgttgatc

SEQ ID NO: 24674 - DNA, 101 bp, rice(Oryza sativa)
  misc_feature (71): n=a or g
ccagtggaatctcccttgggatgaaaaagctacccctgtcatatagaagggttttttttcccggcgagccntgccatgattcctcgcaattctttttaata

SEQ ID NO: 24675 - DNA, 101 bp, rice(Oryza sativa)
  misc_feature (71): n=a or g
tttgtgtcttctgtgaccaagtggaagagacaatcgaccacattctgattgggtgccctgagtccctccanctatggtggaccgtcctttcaatcctcggc

SEQ ID NO: 24676 - DNA, 101 bp, rice(Oryza sativa)
  misc_feature (71): n=a or g
cgctgcaggggtttcccggcaaaaaaaaaggcaggcgagagaggagagaagaggagcaggtggaagtggcnggcgctctctctcctcctcctcccaaaaag

SEQ ID NO: 24677 - DNA, 101 bp, rice(Oryza sativa)
  misc_feature (71): n=a or g
aacaggggatattattaaagctggatatgccatcaatccagatgagctagcattgatcacaagcaagcatnattcaaaagctttaaagatgcatggtgggg

SEQ ID NO: 24678 - DNA, 101 bp, rice(Oryza sativa)
  misc_feature (71): n=t or c
ctttaagaaatctgggatcttatatcagttgggcaatggcatcttatcaaaatattctggatatgggttcngatacatgataccgctgtcttttggcttga

SEQ ID NO: 24679 - DNA, 101 bp, rice(Oryza sativa)
  misc_feature (71): n=t or c
tggtaaatgctctattgtatgcttaccttttttcgaggtgccaactttggaggatcaaggattaccaagtnccagacctcatttcttgagatagcaccttt

SEQ ID NO: 24680 - DNA, 101 bp, rice(Oryza sativa)
  misc_feature (71): n=a or g
aatggagaaagatagatagaaagtacaaaaagcattttgcgcaggagattaggaatataaggtatgggctnagcacggacgggatgaatccattcggtgac

SEQ ID NO: 24681 - DNA, 101 bp, rice(Oryza sativa)
  misc_feature (71): n=t or c
atcgacacatgtagcggttatctcggacacccaaacatgcttatatcgttggaaatttgatcatatttagnatattttaatccaaaatattaagacaataa

SEQ ID NO: 24682 - DNA, 101 bp, rice(Oryza sativa)
  misc_feature (71): n=a or g
ccagcaagcgtcctttggaaagggtgatatttggaggattttctatgtgaatggagaacgattttgagggnaaaaaaatggactatgatctttcgacggat

SEQ ID NO: 24683 - DNA, 101 bp, rice(Oryza sativa)
  misc_feature (71): n=t or g
atcttattcttatgcagagcgaacagtgcaatgattaattcaggtacattcccacatgttgcattcataancccaccagctataataaaataaattccata

SEQ ID NO: 24684 - DNA, 101 bp, rice(Oryza sativa)
  misc_feature (71): n=t or c
gcctttcaaatctttttacatatggacctctttttagtccacctacgaaaatcgttttataatagtgaatnaaactatcacaaaactacatatttaaaccg

SEQ ID NO: 24685 - DNA, 101 bp, rice(Oryza sativa)
  misc_feature (71): n=t or c
agagcatgcaaatcctttggcaatggtgtctattgtctttgggagggaatttactgaatctcagcttgaanaaggcttcactcagcaatttaagtggaatt

SEQ ID NO: 24686 - DNA, 101 bp, rice(Oryza sativa)
  misc_feature (71): n=t or c
gccaaaacggcgcgcacatacatcaatgacatgttcggggatctccttcggtatacacggatgcatactgnagttagctcttcactaaatattggtccacc

SEQ ID NO: 24687 - DNA, 101 bp, rice(Oryza sativa)
  misc_feature (71): n=t or g
atgaaatctagccgctaaattactagcgccagctgttgaatttgtattccccctcactatctaaattgaantatatttacatgtttataaagttatatatg

SEQ ID NO: 24688 - DNA, 101 bp, rice(Oryza sativa)
  misc_feature (71): n=t or c
tttgggggggtgttctctttgttctgcacgtgtttggggtttgtgaaagagtgtgatcttgaattgcaggngtgcattgagaagaagtatggagggattgc

SEQ ID NO: 24689 - DNA, 101 bp, rice(Oryza sativa)
  misc_feature (71): n=a or c
atctagctagataaaaagctggagtgtttggcggccatcattaaatttagggtgtaagcaaaatgagcgtngcttttaattgcttatcttctctatgttca

SEQ ID NO: 24690 - DNA, 101 bp, rice(Oryza sativa)
  misc_feature (71): n=a or g
aggccaagatgaagaccatgaacaatcttctgacttaggttctgctcatccttttgctgctcttgctgctntagaccaaggacatatgagtggtggttcgc

SEQ ID NO: 24691 - DNA, 101 bp, rice(Oryza sativa)
  misc_feature (71): n=a or g
catcaggggaagaagtatagagtcattgatgaggccttggcgtttgtaggcgaagttggtgacaagagtcnattcatctcaccggaagatgttcgtgcaac

SEQ ID NO: 24692 - DNA, 101 bp, rice(Oryza sativa)
  misc_feature (71): n=a or g
cttcccgttagcctcggcaaatttgtcggatcttttccactggttggccttggccttcagctcgcgaatgncggcggcgctgaaatggaggactcgctcgc

SEQ ID NO: 24693 - DNA, 101 bp, rice(Oryza sativa)
  misc_feature (71): n=t or c
ctgtggcatgcagtaatgtaagctttggccggtgttgatccagtttggcaagattttttttaagggagtanctaaaaactgccccaagttttttaatgaaa

SEQ ID NO: 24694 - DNA, 101 bp, rice(Oryza sativa)
  misc_feature (71): n=a or c
tggccatatatttttacccatgttacagcttgggtcaggttttagctgagtttttcaccttggaccacttnatattaccatttgtttcaacctggaccata

SEQ ID NO: 24695 - DNA, 101 bp, rice(Oryza sativa)
  misc_feature (71): n=t or c
tctttctgaaattaatcctcatcaatcaaggtgctccgttgcttcgtgtccaacaaaattttaaaggttgnatgtgttgaaccaatataaattaaacttga

SEQ ID NO: 24696 - DNA, 101 bp, rice(Oryza sativa)
  misc_feature (71): n=t or c
ggaggtggggccatgagcaatcatgcatcgttgacccactgttggacgactttgtcgttgagagtaaaggnagatgatacggttccaacagtaagggtctc

SEQ ID NO: 24697 - DNA, 101 bp, rice(Oryza sativa)
  misc_feature (71): n=a or g
ataaaccaacccagctaatgaaccatagatagtaccatgtaagttgaaactacccagggtgaaaggaaccnaactagccagtccaattgcacaaatcaaca

SEQ ID NO: 24698 - DNA, 101 bp, rice(Oryza sativa)
  misc_feature (71): n=a or g
ctggaccgtcggagggcggaagtggagaatcttaggaggataatcctcgcagatactgaggggcagccatngaggaggaggtggaattgcctctccccacg

SEQ ID NO: 24699 - DNA, 101 bp, rice(Oryza sativa)
  misc_feature (71): n=t or c
agtatggaagatgtatacggcatacaaccaaccttaaaacactatacctgcatggttgacatcatgggaanggctggcttactggaggagtcactagaact

SEQ ID NO: 24700 - DNA, 101 bp, rice(Oryza sativa)
  misc_feature (71): n=a or g
gacgaagcccgatcaacttgccaccagttggtctggatgtactaactagatggcgctcattactgagctgnagcacaccgtgatctcccgcgcgaacctct

SEQ ID NO: 24701 - DNA, 101 bp, rice(Oryza sativa)
  misc_feature (71): n=t or c
tcctcctgcaccaccttgagatcattgtacagcacgtcgtccttgacgttgtacccgacttgtttcttctnggcctcctgcaggtactcgcgttcgaagag

SEQ ID NO: 24702 - DNA, 101 bp, rice(Oryza sativa)
  misc_feature (71): n=a or c
agctttcttgaccgtctcttgcgcgttcattggcatgcctaacacctgaatttcagatcgaggtcgagagnatgaggtttttagttatagccttttttgct

SEQ ID NO: 24703 - DNA, 101 bp, rice(Oryza sativa)
  misc_feature (71): n=t or g
ctttaatttcttctctcttgctgcttcaccggcgttgacctcacaacggcagcaactgagggctagggaancgcccactgcgcgacggccgagcaccagca

SEQ ID NO: 24704 - DNA, 101 bp, rice(Oryza sativa)
  misc_feature (71): n=t or c
aattaatacatgaattactactacctccgtacttttaaaaaatattatgtttcttaatagatactccctcngtcccaaactccctgtccagattgtagaac

SEQ ID NO: 24705 - DNA, 101 bp, rice(Oryza sativa)
  misc_feature (71): n=a or g
agcacatgcacacagatgcaccaaatggatccatatgattttacaatgttaaaaaaatcctccctccgttnacgccgttggtttttttaaacatgtttgac

SEQ ID NO: 24706 - DNA, 101 bp, rice(Oryza sativa)
  misc_feature (71): n=a or g
acagttttgtggaagataatatgtacaataatcgtgggttagatcttgttctaataaaactaggtgggcgncccgcgcatttgcactgctagcatcaattt

SEQ ID NO: 24707 - DNA, 101 bp, rice(Oryza sativa)
  misc_feature (71): n=t or c
atagtttttttctcaaaaaattgacttttggtcaaaatgggccttttgaaaacctttctaccacttggatnactttgttcacattctaagggttgtagtgc

SEQ ID NO: 24708 - DNA, 101 bp, rice(Oryza sativa)
  misc_feature (71): n=t or c
gcatgagcatcatcttcagcagaaataagcatttgtactatgtacttcatggttggccttttgtttttatnttcttccaagcatgaaacggccaattgcat

SEQ ID NO: 24709 - DNA, 101 bp, rice(Oryza sativa)
  misc_feature (71): n=t or c
gcggtggaagaggacgagggagtcggcagctgcaacaaatgaggacaaggacggtggcaccaacaatagangagggcagcggcagcgcggtggaggacacg

SEQ ID NO: 24710 - DNA, 101 bp, rice(Oryza sativa)
  misc_feature (71): n=t or g
cactccgacatcatcgaagcttggtgccataggctagggttcagttgttcgtatgctatccactcttgtancgcccgttccgtcgtggcgcctagcgggaa

SEQ ID NO: 24711 - DNA, 101 bp, rice(Oryza sativa)
  misc_feature (71): n=a or g
agattgggaataaaattcgctccccagaagtaaggtacgatatatccggagttggaaaccagatctattgnaagataggatagagaatctgttggagacga

SEQ ID NO: 24712 - DNA, 101 bp, rice(Oryza sativa)
  misc_feature (71): n=a or g
aagtcatctcacacatgtcaacagttcctggaattaaaatggattcaagggctaaacgtcggaagcgggangaagaggatgatgatatgattcttttcctt

SEQ ID NO: 24713 - DNA, 101 bp, rice(Oryza sativa)
  misc_feature (71): n=t or c
tcggcctccagcttcctggttttctcagcggattcttttaccttgctctctagctcagaattaaacgaatncttgagtcggttgatttccgcgttgaggag

SEQ ID NO: 24714 - DNA, 101 bp, rice(Oryza sativa)
  misc_feature (71): n=a or g
agagagatcgagatcagcgtgagagagagagagagaatgagcagtacgagtggatctgcatgggatcacancaacaatggaggcggcgggtcgccggagtt

SEQ ID NO: 24715 - DNA, 101 bp, rice(Oryza sativa)
  misc_feature (71): n=a or c
caaccatctgggccttcttcacagtttcataaagattttgcatatttccgaaaattcctgcctaaaagtangtacaaaaatgagaactacaagatgtttac

SEQ ID NO: 24716 - DNA, 101 bp, rice(Oryza sativa)
  misc_feature (71): n=a or g
ggtgattgatgtttgaccatcaagcaggtggtgcttttcgcaacttcacctgaccttttttttttgtccanttgctgagtgaaaacatatgtgatgtctca

SEQ ID NO: 24717 - DNA, 101 bp, rice(Oryza sativa)
  misc_feature (71): n=a or g
gctaaaataacttacattgtgaaacaacggagggagtaaataacttgaaagttacataaactagcatggtngcccgcacagattgcgcggctagcatcatt

SEQ ID NO: 24718 - DNA, 101 bp, rice(Oryza sativa)
  misc_feature (71): n=a or g
tcggtggcggcggcggtctaagaggagggaagaaaccctagaaatggttagggatctctacatgggccttnggctttagttgggcccaaaaatatggcttg

SEQ ID NO: 24719 - DNA, 101 bp, rice(Oryza sativa)
  misc_feature (71): n=a or g
aagtatggcttgcctaaggttagatgtggtaaatttagttgcaaaccaaacaaccccttaatacctaactnatctaggatatgatccctccttatattgat

SEQ ID NO: 24720 - DNA, 101 bp, rice(Oryza sativa)
  misc_feature (71): n=a or g
ggaaaatggtttctacgagtgggacatgcttttggcatagagcctatcttttgtttgtgctacggtcgcgncattgtcgatgcgacgatcgacgcacaaaa

SEQ ID NO: 24721 - DNA, 101 bp, rice(Oryza sativa)
  misc_feature (71): n=a or c
ttggttcggacttcgagaacatgggctacctgtggctggctctcgggcatttctttcttgtcgctccttangcggcgctcagactgaggaggtttatcaag

SEQ ID NO: 24722 - DNA, 101 bp, rice(Oryza sativa)
  misc_feature (71): n=a or g
aagagcgagaaatcaggaaactcatgacttgagcagaactgctctgctcaaggccttaacaaaataataangcaacttaatggtaaaaagaggatcaatct

SEQ ID NO: 24723 - DNA, 101 bp, rice(Oryza sativa)
  misc_feature (71): n=t or g
gagagtcatatgcatctctgctcgcttgtgacctatactacgatccgtgtgactctgtgcgatatggaganggggggaggaggaaacggcgatcgagagaa

SEQ ID NO: 24724 - DNA, 101 bp, rice(Oryza sativa)
  misc_feature (71): n=a or g
ggcataacacttgagcacacggctaatgaagagccagctaatcaaggacccagtgagaaatcttttcctcncttatatgagtggagattaaacatgaaaag

SEQ ID NO: 24725 - DNA, 101 bp, rice(Oryza sativa)
  misc_feature (71): n=t or c
cattgtgggtagttgagtactggatgctaactgaagcattaaatttcccccagtttcaagggaaaaaaaantatacagaagagatacaggtatatatatcc

SEQ ID NO: 24726 - DNA, 101 bp, rice(Oryza sativa)
  misc_feature (71): n=t or c
cgcagtataactttagtggtttctcaatactgtcaacctttaaaccgggtatgaactttagccagttcacntgccccgttgcctcatagcatgctataaac

SEQ ID NO: 24727 - DNA, 101 bp, rice(Oryza sativa)
  misc_feature (71): n=t or c
gtccagatttttagttaggatttgatttttttttacggagagtacttctttaggcagacaaatcattttgnattgggagttgtacctgtcactagtgctgg

SEQ ID NO: 24728 - DNA, 101 bp, rice(Oryza sativa)
  misc_feature (71): n=a or g
taaaaatacattaaaaagggaaaaaagcaatagaaggatgatgatgagggaggcgccgtccaacaccaccngttcgccagccacccaccgacgacagcgtg

SEQ ID NO: 24729 - DNA, 101 bp, rice(Oryza sativa)
  misc_feature (71): n=t or c
caaaaagcgacaccatataatgtgccatcgcttgacaaaggaggcataattggaaagtgagcgatgtagcnggagagacattttcatagtagtgtgactat

SEQ ID NO: 24730 - DNA, 101 bp, rice(Oryza sativa)
  misc_feature (71): n=t or c
ggctcaacaagtgggcggcggagttatcttccttcgacctgcatttcgtcgctcgcactgccatcaagtcncaagtcctagctaacttcgtggccgaatgg

SEQ ID NO: 24731 - DNA, 101 bp, rice(Oryza sativa)
  misc_feature (71): n=a or c
tgaacacctcccagacttggtatttgtagtggttgatcagcatcataccctgaccaatgttcacatatttnatcccttccttcagatggaagtggtgcacc

SEQ ID NO: 24732 - DNA, 101 bp, rice(Oryza sativa)
  misc_feature (71): n=t or c
caaggagctaaggaaccaaataaatttaacataaacaatacttacaaagcccatgcgttgagaagagagangtcgagggcgtcccgctggacctccttttc

SEQ ID NO: 24733 - DNA, 101 bp, rice(Oryza sativa)
  misc_feature (71): n=t or c
agtgtcatgccctgcgcatggcccggcatcgcaacttgattaggatactcaccacatgttctagcctgganttcagagctttggttcttccctacatgccc

SEQ ID NO: 24734 - DNA, 101 bp, rice(Oryza sativa)
  misc_feature (71): n=t or c
gaccactagccattactgtgcatttaatgcatgggcaacaactagctggtcagaccggcatcagctctggnggctctggatcaccaagccaaggccaatat

SEQ ID NO: 24735 - DNA, 101 bp, rice(Oryza sativa)
  misc_feature (71): n=t or c
aacaatttccttctgtattaaatatttgttagctgctgctacgtataattaaggaggccagacctgcatcnaactgcgtagtagtgtctgcatcgtcgatg

SEQ ID NO: 24736 - DNA, 101 bp, rice(Oryza sativa)
  misc_feature (71): n=t or g
cataaagatatgttcaatggaatgaactgttaaggcagtggaaagagtaacagactagccagctaggaacnaatgaaccattttttaggaggaaacatgca

SEQ ID NO: 24737 - DNA, 101 bp, rice(Oryza sativa)
  misc_feature (71): n=a or c
ttaattggctagtccttagttttgttgatatgtatattcatgtggctagcagatgatggtgttagttcagntcttattggcgtggattattacaagcgttc

SEQ ID NO: 24738 - DNA, 101 bp, rice(Oryza sativa)
  misc_feature (71): n=a or g
aactatatcatgattcatgaatcaatcatctcaacatatatgtatatatcattctcaggacgaagctgaancagacggaggtggactgcgagcatctgaag

SEQ ID NO: 24739 - DNA, 101 bp, rice(Oryza sativa)
  misc_feature (71): n=a or g
tgcagacatccaaaggcaattagcatagcctcactatcaagggacagcaattcactttctcactcataacnggtcagcaactgggggatagaagtagatat

SEQ ID NO: 24740 - DNA, 101 bp, rice(Oryza sativa)
  misc_feature (71): n=t or c
catttctctccggtgactgctacttatgtgggaaaaaggagggggactcgcaataaacattttgccacagncctaagaataggaatatgtgcatttttctt

SEQ ID NO: 24741 - DNA, 101 bp, rice(Oryza sativa)
  misc_feature (71): n=t or c
agtgctgtagtgttcagttcaatttcatcgcgatgccgagtgccgacatatttctccactcggattagtgntcagcttaaaacaatagaaggacgactgga

SEQ ID NO: 24742 - DNA, 101 bp, rice(Oryza sativa)
  misc_feature (71): n=t or c
ttgctcctagtcctaccaatattgctacactcacccccgcccgcccgctctcacaaaaaattaaacctaanacatcattaatacactaaattattcactac

SEQ ID NO: 24743 - DNA, 101 bp, rice(Oryza sativa)
  misc_feature (71): n=a or g
aagatatcaaacatggaaatacttagttaacaatagtcaaaactcggaaacttgcataacaaagaacctcngacgttatggcgcattaaggccatggaaac

SEQ ID NO: 24744 - DNA, 101 bp, rice(Oryza sativa)
  misc_feature (71): n=a or c
tgcatcgatgtgcatgcatgcatgtagcatgcgcgcgaacgtacgatcgacgagctctctgccgctgtgantatagctttaggttggttgattcgctgtgg

SEQ ID NO: 24745 - DNA, 101 bp, rice(Oryza sativa)
  misc_feature (71): n=a or g
taactaccctaatattatataaagcgttaagatgcacatgttctttgaacattcagcttacacacacggantataaatacagcacgcatatgttttatgag

SEQ ID NO: 24746 - DNA, 101 bp, rice(Oryza sativa)
  misc_feature (71): n=t or c
gtccatcaaaatcaaccaaataacgctcaatcccattgattcgacgggtacaaactcaccatccacctggnccagaacccgcccttcggctgcggctccgg

SEQ ID NO: 24747 - DNA, 101 bp, rice(Oryza sativa)
  misc_feature (71): n=t or c
gaatgtttcactgaagaagactctgagaatgctcgacagaaacaaagttttaatcacactgatatggtgtnttctggtcttggaaatagcaatagagccta

SEQ ID NO: 24748 - DNA, 101 bp, rice(Oryza sativa)
  misc_feature (71): n=t or c
caatcgttcatcctttctttcctctgatcctctctactgtcccctttcaacctgtcatcgccgcgtccacngcagcgtcgcaccccgccgttgcgctacgg

SEQ ID NO: 24749 - DNA, 101 bp, rice(Oryza sativa)
  misc_feature (71): n=a or g
tggcctgaaatcattaactgtttctggagaagtttttttttggcacaatggtgatgtaagaattattcagnatctgtaaatctgtagattcaacatgaaaa

SEQ ID NO: 24750 - DNA, 101 bp, rice(Oryza sativa)
  misc_feature (71): n=t or c
atcttatggaaacgatcaatgatcacatcattagtaattgtgtccaacatatcattttctacaaagcaaangaggctatggcttagatacttgtctcccat

SEQ ID NO: 24751 - DNA, 101 bp, rice(Oryza sativa)
  misc_feature (71): n=t or g
gacgaatgattaaacattaaaaaatttaaagcgactggtaatatgggacgaaggcagtactgatacgaacntacgtgcggcattgtgttaaatctataaga

SEQ ID NO: 24752 - DNA, 101 bp, rice(Oryza sativa)
  misc_feature (71): n=t or c
ggatcgctgtcatgagctgggaaactgttttaacaaaacagctcgagtggatatatatacccatttattanatgtcatctaaattgttatgaaaaaataga

SEQ ID NO: 24753 - DNA, 101 bp, rice(Oryza sativa)
  misc_feature (71): n=t or g
gccggtggtggacatggcctggccggagtcgatcgttctctgttcgttcactgaatgtacctgggaaaatnggcagattgttttcacgcctgaagtgaacg

SEQ ID NO: 24754 - DNA, 101 bp, rice(Oryza sativa)
  misc_feature (71): n=t or c
gactggccaaatttagccattgaggagccagtttggccagccatatggcttagctatccatttagtaaaantgttggagtttgtttttgtctataattatt

SEQ ID NO: 24755 - DNA, 101 bp, rice(Oryza sativa)
  misc_feature (71): n=a or g
catccatggaacaacacaatgaaaacataacaaatttaaactgacagtttaccgagatgacgatgcgaccngtggtgccgaaagctgcgtggccaatgtcc

SEQ ID NO: 24756 - DNA, 101 bp, rice(Oryza sativa)
  misc_feature (71): n=t or c
tactgccagtaccaaactgcaagcaataagccgtactagttccaatcaaaatcgcacctttgcaagttacncttcacatacagaaccaagaacatttccat

SEQ ID NO: 24757 - DNA, 101 bp, rice(Oryza sativa)
  misc_feature (71): n=t or c
catatgataggaatacatgtgtaaaatagagtgttgaaaagaacggatgtttcagtgtagtgcagaaaaanacgggaaatgaaaatttgcaaataaattga

SEQ ID NO: 24758 - DNA, 101 bp, rice(Oryza sativa)
  misc_feature (71): n=t or c
aaacatcttgcttctaatttgaaattaatttgtcagacctgtttttaacaagctaatacatatgcccgcgnatcgcgcgggctaccttcctagttggcaaa

SEQ ID NO: 24759 - DNA, 101 bp, rice(Oryza sativa)
  misc_feature (71): n=a or g
agaactgaggaaattaccagattggttgtcaatacatgcaccagtgcttcagacattcaatatagtcggcntatcagaattgcttgatagattacttccca

SEQ ID NO: 24760 - DNA, 101 bp, rice(Oryza sativa)
  misc_feature (71): n=t or c
taaaattaagtttcaaaattcaaattttgggctttaggttatcagagcaaccgatgggactctcatatttnaaagtgtttttaattgttgtagccattgac

SEQ ID NO: 24761 - DNA, 101 bp, rice(Oryza sativa)
  misc_feature (71): n=a or c
tgcagtgtgttatcagttggtgttttcttcttctctgaactgaaaattttacgcacttgagggagaggagnattaagctgcgagtcttgttcctcggtgac

SEQ ID NO: 24762 - DNA, 101 bp, rice(Oryza sativa)
  misc_feature (71): n=a or g
tgcttcacaaaggagcaagagaaggcccttcacattctcacctccattgaggacctagaattttattgctncgaaaaactgcagtccctccctgctgagct

SEQ ID NO: 24763 - DNA, 101 bp, rice(Oryza sativa)
  misc_feature (71): n=a or g
gagattgatttatttaactgcccactgaaatggaggttcataaaatccgagttggcaaaagtaatcgtatnaaaaaaaattactgtgaaagtagatcagtc

SEQ ID NO: 24764 - DNA, 101 bp, rice(Oryza sativa)
  misc_feature (71): n=t or c
gcgacgcgggcaggagatagcagcagcaccggccggcgtgtgttggtgtgttggtgagggcaggtgacagngtggcggctcagggtgacgacggcaactgc

SEQ ID NO: 24765 - DNA, 101 bp, rice(Oryza sativa)
  misc_feature (71): n=a or c
ggaccccggacctcgtgtgactgatgaacgatatatgtgtgtgtatactgtgtactccattgtgtaatgtnctgtgtactccattgtgtaatgtctcatca

SEQ ID NO: 24766 - DNA, 101 bp, rice(Oryza sativa)
  misc_feature (71): n=a or c
catctataaatagacaagcacaatgtaaacccacttcatcattctcacaactcaaacattacagcaaaagnataagaactagaaacccaccacaatgaaga

SEQ ID NO: 24767 - DNA, 101 bp, rice(Oryza sativa)
  misc_feature (71): n=t or g
ttagagcagtgatgacatatatacagcttctgataatctggacttaaccacactcatcattcaaagtcccntaactacataagttgagcaagttggatttc

SEQ ID NO: 24768 - DNA, 101 bp, rice(Oryza sativa)
  misc_feature (71): n=a or g
cacaacatggagagggatatcaatgagaaagtaagaagttcggcgatgctgttacctggttgggaaaagancttgaagaagctgacgtttccttgcttagt

SEQ ID NO: 24769 - DNA, 101 bp, rice(Oryza sativa)
  misc_feature (71): n=a or g
acagggcgacatgaccattgaggagtttcataatgccttcacctcattgtctagacaattggattctatgntgccaaaggctggaggtgggtgcagacagt

SEQ ID NO: 24770 - DNA, 101 bp, rice(Oryza sativa)
  misc_feature (71): n=a or g
taattatatatgtatacttttacagttttggagggatacacgatattataaacatgagtactatgacatcntcagggaacccttaaaaaaggtatgtctta

SEQ ID NO: 24771 - DNA, 101 bp, rice(Oryza sativa)
  misc_feature (71): n=t or c
ggttcaggatgttcagctgcacatcaggaacaatacatggtactgggcattgtcgacatcatgtagcactngaacgatgagtgacgagccgtggtggatga

SEQ ID NO: 24772 - DNA, 101 bp, rice(Oryza sativa)
  misc_feature (71): n=a or g
tgtaagtggcaacccaccatggctcacagtgcgagcaaggccaaaatcacctagccgagcattgaactctncatcaagcataacatttgatgacttgacat

SEQ ID NO: 24773 - DNA, 101 bp, rice(Oryza sativa)
  misc_feature (71): n=t or c
attgaatgatttagatccagtggatatgctgcttcgcttttggttgaagtttctcatatatgcagccaacngatataacagagagtgccatgccaagaagc

SEQ ID NO: 24774 - DNA, 101 bp, rice(Oryza sativa)
  misc_feature (71): n=t or c
gatcagtcgaatttgtgctcgctgatcttcttaaactaatttggcgcatgtctctcgatcaggttctcacnagatagcaaggagagcatagctgagacgct

SEQ ID NO: 24775 - DNA, 101 bp, rice(Oryza sativa)
  misc_feature (71): n=a or c
tagcaaaagatcatatataatcgtgggtctcatcttatgatctgcgtgcattttatacattgagaatgccnttaagcaatttgctgttgtcttgctggccc

SEQ ID NO: 24776 - DNA, 101 bp, rice(Oryza sativa)
  misc_feature (71): n=a or g
cgtgtacctttttctgacctcaaatccttttggacctccatagtagtgccaataaatccaaccctcatctnggctgtcgaattccatgccaacatgaggta

SEQ ID NO: 24777 - DNA, 101 bp, rice(Oryza sativa)
  misc_feature (71): n=t or c
gtgctccactcacattgaggaatttcatgtcgacaggacaaaacacccccattagccacttgaacagatanagtggactgaagctgctgcaatccagtttg

SEQ ID NO: 24778 - DNA, 101 bp, rice(Oryza sativa)
  misc_feature (71): n=a or g
gcatagctagcaaaggactgaggctagccaaaaaaacagaataaattttctttcgggggaaatactcatcngtgacgggctttaacttaagaccaatggga

SEQ ID NO: 24779 - DNA, 101 bp, rice(Oryza sativa)
  misc_feature (71): n=t or c
atgtccggatgggaaatttcatgttctactctgaaattttccctctttttagatcaagtgggtttacccgnaaacccgtttataggcaaaaatagtgcgta

SEQ ID NO: 24780 - DNA, 101 bp, rice(Oryza sativa)
  misc_feature (71): n=a or g
caatcaaccaccaatcaaaatcgtattactcgcttcttaagattgaccaagaaaagaaaaaacacaacctncatcggattcggattgcgccgtggggagag

SEQ ID NO: 24781 - DNA, 101 bp, rice(Oryza sativa)
  misc_feature (71): n=a or g
gcgccaatgccgcttgcttctagctcctcaaagctatgcagcttgctgatcctgtgcctagccttctcgcngccgtggaccggagcacggcgggcatcttc

SEQ ID NO: 24782 - DNA, 101 bp, rice(Oryza sativa)
  misc_feature (71): n=a or g
tctcccttgtgccacatctctgcctttctctctctgcgccacatcaccattgccgctctcgtcgtcgcctngagagcactcccagccatgcctcctagagc

SEQ ID NO: 24783 - DNA, 101 bp, rice(Oryza sativa)
  misc_feature (71): n=t or c
ggtataatcttgtatagatgttggttgaaatgatgctctcctgctacatagtggatcattgggattttttngtacttttatcatattattttcattttcaa

SEQ ID NO: 24784 - DNA, 101 bp, rice(Oryza sativa)
  misc_feature (71): n=t or c
gtcatgtgttcgtttgatcaagtatttacagatagaaattagtggtagtcaaactagaatgcacgaagcgngtttagaagtggggcgagtagagataatca

SEQ ID NO: 24785 - DNA, 101 bp, rice(Oryza sativa)
  misc_feature (71): n=a or g
ttactgcataccttaattatgtcatcgtaatacttagtaaattttcacgctgcattcattcttctgaagtncaggtattgacctgtaaatctattactaga

SEQ ID NO: 24786 - DNA, 101 bp, rice(Oryza sativa)
  misc_feature (71): n=t or c
cctgtttgatgttaccaactggaactaaatatcaaaaaattctgttgggcttttgaaccgggactaaacanattctttagtctcggttcctattcgaatcg

SEQ ID NO: 24787 - DNA, 101 bp, rice(Oryza sativa)
  misc_feature (71): n=a or g
tggccattgcaacagaaagaccaatcagggtaacaggagagttaacaatggaaaaccagcgagcctgatcntctgtcattgacaggtaggcatcccagcga

SEQ ID NO: 24788 - DNA, 101 bp, rice(Oryza sativa)
  misc_feature (71): n=a or g
gggagcaatgagaggttggaaattataattagcaggcggcgagaagaagatgtgacattggatgacgggcnatcatcacaagctgcatggattcggcagta

SEQ ID NO: 24789 - DNA, 101 bp, rice(Oryza sativa)
  misc_feature (71): n=a or g
caacgaagctaccttacgcatcctgataggaacaagttcatcgcgggacatagacttctgccagaacacanagaggacgattgtgaaatagaatacgacta

SEQ ID NO: 24790 - DNA, 101 bp, rice(Oryza sativa)
  misc_feature (71): n=t or c
ctctacctccacacctcactcttgctcctcctcctcttcgttgacgcctctatctctacccaccacatctnactccatgtcaatgtgtccatcgctaggtt

SEQ ID NO: 24791 - DNA, 101 bp, rice(Oryza sativa)
  misc_feature (71): n=a or c
cggaggaagtaatgtggaacagagagaatagtatatactgcatcgcgttgttgtgggtaagatgtcaccangtacaacttcacaggaagcatatgattagc

SEQ ID NO: 24792 - DNA, 101 bp, rice(Oryza sativa)
  misc_feature (71): n=a or c
tcagtatggagtcggtaaaccttagcaccataggccatagctgattggcctcatgtgttgaacaccattgnttcattgagggtcctagatctttccaattg

SEQ ID NO: 24793 - DNA, 101 bp, rice(Oryza sativa)
  misc_feature (71): n=a or g
gggtagcttccctcttgctcatggacatcgaagaaagccctcagctcgcactgcacatgtacaagaataancacaaatggtgtcaatatgtcaaatattca

SEQ ID NO: 24794 - DNA, 101 bp, rice(Oryza sativa)
  misc_feature (71): n=t or c
ggtgtctcttcctacgacaatggatggctcatgggcagtaacatgaccgggacatattacgactaatttgngagactaatcttttaaacctaattgctcta

SEQ ID NO: 24795 - DNA, 101 bp, rice(Oryza sativa)
  misc_feature (71): n=t or c
taacatcaaaagaggaggagctggaccttgaggctgccactgcaagcacaaggcttctcgaggttcttgangctatcctcctcctggcatatacggcactc

SEQ ID NO: 24796 - DNA, 101 bp, rice(Oryza sativa)
  misc_feature (71): n=a or g
tgatgaaaattgttctgcagatggatggagcaaacagatgtgtttcaattggcagggctgcactttggatntgtgtcgtcagtactgctcgcacaggggct

SEQ ID NO: 24797 - DNA, 101 bp, rice(Oryza sativa)
  misc_feature (71): n=a or g
aaacaaacccgaccttgaactcgaaacaggcgcacatcccacacctacccatttgaccgtaccccaaaacnaccgagaaattagcgggagagatcgacaag

SEQ ID NO: 24798 - DNA, 101 bp, rice(Oryza sativa)
  misc_feature (71): n=a or g
aacagaaatatgtttggaataggtaacgtatcgatacgcacataccttccattggttatatggtcattaancacagctttcataacacctgcataagaaac

SEQ ID NO: 24799 - DNA, 101 bp, rice(Oryza sativa)
  misc_feature (71): n=t or g
tggtggtggtatatcaaggtctaagagactgagaccgacctatagtgtattttgattcacacattggaganattttttactgtccttgaccctatgcggta

SEQ ID NO: 24800 - DNA, 101 bp, rice(Oryza sativa)
  misc_feature (71): n=a or g
ggctttgatcaagaaattgactatcccatggatcaagatcatggggatgaaaggcgtagagactacgaccntgcagcagaaatgcataatgttgattcgga

SEQ ID NO: 24801 - DNA, 101 bp, rice(Oryza sativa)
  misc_feature (71): n=a or g
ttgaaaatagtggttttaacaaagtgagctagataaaattattgggttgtgatgtccctgaatgtatctanggcctgtttggggagcttctaactgctgca

SEQ ID NO: 24802 - DNA, 101 bp, rice(Oryza sativa)
  misc_feature (71): n=t or c
caatggcaatggagtgagcttgctgctgcacctgcattcacaccaccaaatgcagaaaagataatctcctntctctctctattaaacccacacacacacac

SEQ ID NO: 24803 - DNA, 101 bp, rice(Oryza sativa)
  misc_feature (71): n=a or c
tttgttgaagtaaaattcaatgatccttttttgcaggctgtgtgcttgcctttatagcatttgaggacagnagcataaggtctcgggctgaaagatttctg

SEQ ID NO: 24804 - DNA, 101 bp, rice(Oryza sativa)
  misc_feature (71): n=t or g
agcttgctctaacaggggcttccttcttgtagctcgggttcattaacccaaaaatcttgcccacgtttgcnactgtcatgtcagagcatggccaggacatc

SEQ ID NO: 24805 - DNA, 101 bp, rice(Oryza sativa)
  misc_feature (71): n=a or g
cggaaactcgatcgagacggattaattggctacaggcctgtttataattttatatcccaccctatgtcacntcaaacgttttaacacatatgaatatatta

SEQ ID NO: 24806 - DNA, 101 bp, rice(Oryza sativa)
  misc_feature (71): n=t or c
tttctcctcttctctctcttcctcgtctatctaacttttcttgtcgtcatctaggtgggccggccggcgangggcgacacggcgacgctgggcggggagaa

SEQ ID NO: 24807 - DNA, 101 bp, rice(Oryza sativa)
  misc_feature (71): n=a or c
tgatatcatctgaaactgaccctgaatgattttccagacaaatctcaatccgggctctctgagcagtggcnatgtccccatgagcctgggagaaacctttc

SEQ ID NO: 24808 - DNA, 101 bp, rice(Oryza sativa)
  misc_feature (71): n=t or c
ccaattgtatcgcgtcgttactgtggcaactggtggatatcactcctgcgatatatggaaaccgctaatcngatcagatctctctcacttgctttccatct

SEQ ID NO: 24809 - DNA, 101 bp, rice(Oryza sativa)
  misc_feature (71): n=a or g
atagtgaagacctcgaaacccattgcagcgatccccatgggattatattcacgggaacgataaaaagatcntgcaaccttatatttgccagtcgaagcatc

SEQ ID NO: 24810 - DNA, 101 bp, rice(Oryza sativa)
  misc_feature (71): n=a or c
taaacctccgaagctcactaagagataaaccctcatttcccttgaatatccatttgcaatggatggtcttnttctgttttggcaagcgcacaagctcccat

SEQ ID NO: 24811 - DNA, 101 bp, rice(Oryza sativa)
  misc_feature (71): n=a or c
agcttatgaaattatgtatgggatttggatttgtaaggcagtttaactacccggagctttttatttatttntagttatcttaatcataataatcgttacat

SEQ ID NO: 24812 - DNA, 101 bp, rice(Oryza sativa)
  misc_feature (71): n=t or c
gtcgctggcactactggcgacaccagataagtaggccaactcagggcctaccttattgttgctgttgagangagaagttgcgaacatggtgttagcgccca

SEQ ID NO: 24813 - DNA, 101 bp, rice(Oryza sativa)
  misc_feature (71): n=t or c
atctccttttcttttttttttcttttggcctttgtaagcagaaatttgtggtaatgaccgggaccatgtantgtaaggagtagtacaatatctcatgagag

SEQ ID NO: 24814 - DNA, 101 bp, rice(Oryza sativa)
  misc_feature (71): n=a or g
gcaaatcttgattgtgaaaatgaaatagagaatttgttccctactaaagagaattttaggctacctaatcnagggcagttgatgagaagtttcttgatcag

SEQ ID NO: 24815 - DNA, 101 bp, rice(Oryza sativa)
  misc_feature (71): n=a or g
cccgtaatttcaggtcatttctctgcttgggcgagtggtttcgagatggcggtgataccacgccgttcgcnatggcgcatggcatagatgtatggggcgct

SEQ ID NO: 24816 - DNA, 101 bp, rice(Oryza sativa)
  misc_feature (71): n=t or c
gagagactacggacaagtggagcagaactggagaagacgccggggtttttttttttcctacctttttcttntcagctgctttgcttaagtgtgttaaatta

SEQ ID NO: 24817 - DNA, 101 bp, rice(Oryza sativa)
  misc_feature (71): n=t or c
acaccggggcagggtcggttggagccaaactgggttcctggtaagcaagaaagagaagcttgcagaattancgatcgaggtggttggagtttgatttgtga

SEQ ID NO: 24818 - DNA, 101 bp, rice(Oryza sativa)
  misc_feature (71): n=a or g
attgtgaccacttccacttccagtgcgggtgttcaccatcaaaagaaaagcacgggcaaaaggaaagaacnacagagagataccattagaacaaagaactt

SEQ ID NO: 24819 - DNA, 101 bp, rice(Oryza sativa)
  misc_feature (71): n=a or g
aaatcttttagcaaactcgtgcacatacatcccatcttttaacaagccaatctgcgcacacgcggaaagcnccgcaacaatagtcacctcattgggttcct

SEQ ID NO: 24820 - DNA, 101 bp, rice(Oryza sativa)
  misc_feature (71): n=t or c
aaaattgcaaaaatgtacctcaatatcatcctgagttaagatcccctataaaatatttgttgcagatactncctcctcttttctcgaatacgcaaaaggat

SEQ ID NO: 24821 - DNA, 101 bp, rice(Oryza sativa)
  misc_feature (71): n=t or c
ccatactttcagacatgttcactaacagagcaacagattatccaacaaccaaaatattacatcttccatcnatttttttcatcacttcatcataataccaa

SEQ ID NO: 24822 - DNA, 101 bp, rice(Oryza sativa)
  misc_feature (71): n=a or c
gatgctcgtgaaacttacttatcttgggctgaattgttgatactgacagtttgataacctgatagttcacnaagctggctagaagaggatggagttgttcc

SEQ ID NO: 24823 - DNA, 101 bp, rice(Oryza sativa)
  misc_feature (71): n=t or c
ggacagaaactaaatatttgacttcatatgcaagtgcccaactgatgatgttcttaactctgacggcgagngttgtggttttcactttcgttcttgtgtcg

SEQ ID NO: 24824 - DNA, 101 bp, rice(Oryza sativa)
  misc_feature (71): n=a or g
gacattatagacttatatatagaggcaagctatcgctggagctagcaataggaactcgtatgtgacttacnttcaagttgctcttgttgttggtagatcca

SEQ ID NO: 24825 - DNA, 101 bp, rice(Oryza sativa)
  misc_feature (71): n=t or c
aaaaatttcttgagaaaattcctttctcgcatttgttacaaggtgtcgaaaagggttagcttgtctctttnattactatgaatagtaatgggccccgtggg

SEQ ID NO: 24826 - DNA, 101 bp, rice(Oryza sativa)
  misc_feature (71): n=a or g
atcggctgccctagagccacaccagaaacaggctgctgcgtgccggtcaccaactctctatatggtggaantccaccttcaggaagaaaaaccggcccatt

SEQ ID NO: 24827 - DNA, 101 bp, rice(Oryza sativa)
  misc_feature (71): n=t or g
aaatttgataagtgtcaacctgcagattggtgggttgacactagagcaactgttcatgtgtgttttgatcnatctttgttctccacttttcaggaacagca

SEQ ID NO: 24828 - DNA, 101 bp, rice(Oryza sativa)
  misc_feature (71): n=a or g
cgccattggcttggattcttgagggcttttgaagaggagatcgataggaggatgatggcgagaggactcanctcggggtggtatcctccgttgggcacgac

SEQ ID NO: 24829 - DNA, 101 bp, rice(Oryza sativa)
  misc_feature (71): n=t or c
gtgagttagcaaaatatcacaaaatatcaattgactaatgtgtgaagggaatacgtctccacgagctgtgngagctagccacggggctcgaggccagcgcc

SEQ ID NO: 24830 - DNA, 101 bp, rice(Oryza sativa)
  misc_feature (71): n=a or g
gcatctccgtcgacgggacacgcctcgctattcccaacgacacgttcgcgttcaacccaaacaccggccangacgcgcggcgtcgccttccagatcggcgc

SEQ ID NO: 24831 - DNA, 101 bp, rice(Oryza sativa)
  misc_feature (71): n=a or g
agggaggaggtgaggtgaggtgaggtgggctataaatatagttggggaggggagggaagacccgggattangcgaggagagggaaggaaggagggagggaa

SEQ ID NO: 24832 - DNA, 101 bp, rice(Oryza sativa)
  misc_feature (71): n=a or c
cagtcattcttcaggtaataagtacctgttgtgtttgccccggtgcttcgggattgagcatattttgaaangatgaggatccattgggtgttctcaattgg

SEQ ID NO: 24833 - DNA, 101 bp, rice(Oryza sativa)
  misc_feature (71): n=a or g
tccttcgtcctaaacttagaattggatgaaacatcctagttctatcaatcttgagccatacgctagctacngagaggatgtgttttatgtccatttttata

SEQ ID NO: 24834 - DNA, 101 bp, rice(Oryza sativa)
  misc_feature (71): n=a or g
attattttatcttttctgttgaagaaacactaacattagaacataacaacgtgggagataactcataaganactaatataaacaaataactcggagaaaag

SEQ ID NO: 24835 - DNA, 101 bp, rice(Oryza sativa)
  misc_feature (71): n=a or g
tgcagttgttctttttgcacagttcatgttgacagatctagatctgagtttgagatacgtagtatttccantctgaagaataagtcaaagacctatgtgta

SEQ ID NO: 24836 - DNA, 101 bp, rice(Oryza sativa)
  misc_feature (71): n=a or g
gttacagtggaggatagtgcagcaatagcgggaggtccggttttaattagctcgtttgctgataggtttgntgttttgcagtttaaatagctcggtgttgt

SEQ ID NO: 24837 - DNA, 101 bp, rice(Oryza sativa)
  misc_feature (71): n=a or g
ctgatttgtcaagatttggccgtaacttatcaagatttgtcaacataaccgattcgtacgtgggtcacacnggccatgggcccatggctatcacagattca

SEQ ID NO: 24838 - DNA, 101 bp, rice(Oryza sativa)
  misc_feature (71): n=a or g
tcctaactgttcaacatactactgtacaaatgtacaatacattgactgccacttacttgagctccaatggncacgccgtttcgttcatctggaaaagacat

SEQ ID NO: 24839 - DNA, 101 bp, rice(Oryza sativa)
  misc_feature (71): n=a or g
tgggttagctttgttatcttaagttgcgttcaatatgcacttttgaagatagatttttagcgtgtggcccnccatgtggaggaggacagcggcgtggccca

SEQ ID NO: 24840 - DNA, 101 bp, rice(Oryza sativa)
  misc_feature (71): n=a or g
gagctaactccagttatacaataaatcaaacaaactatgactctatgagtcccgtcggttagcctaataanccaaaataaaagtcaatttgaatcctcaaa

SEQ ID NO: 24841 - DNA, 101 bp, rice(Oryza sativa)
  misc_feature (71): n=a or g
acatccaaagcagtgatgccatcatcagttgctgccctagatccatgttgcgatggtcaccacactcactnccgtcctagaaccatgctcaggttcagctc

SEQ ID NO: 24842 - DNA, 101 bp, rice(Oryza sativa)
  misc_feature (71): n=a or g
tgattgctgaagcactgattgttatatgtcattttaaaggattgttttgttggatattgattttggaatgncattgtattttcctctgcaggtatgaggat

SEQ ID NO: 24843 - DNA, 101 bp, rice(Oryza sativa)
  misc_feature (71): n=t or c
cccgcaccctggtgatactcaacaccgcgctcaaaggatgtcgccttctccacatctccttgttgtggttngacagcggcggtagcagcgatgacaacgac

SEQ ID NO: 24844 - DNA, 101 bp, rice(Oryza sativa)
  misc_feature (71): n=a or g
cagtgccgcggtgagcttggcctcctcaatcttcatcaacaacgacagcaggaaggatggtgtatgcagcntggatgcttcatggtgtgcaggtaagcaaa

SEQ ID NO: 24845 - DNA, 101 bp, rice(Oryza sativa)
  misc_feature (71): n=a or g
ccaactaccgtgacggtggcaagcattcgtcgacacccccctacctcgatggacctcaacaatggtggttntcgatgaggcaagaagatgacaaccgctgg

SEQ ID NO: 24846 - DNA, 101 bp, rice(Oryza sativa)
  misc_feature (71): n=a or g
agaaggagaggttgtgtcactgacatgggatcgaccaaattttatttgtttttaaagaccaaaacgccctnacatatgggtttcacactgattcagccacc

SEQ ID NO: 24847 - DNA, 101 bp, rice(Oryza sativa)
  misc_feature (71): n=t or g
tcgttagaacgaaaccagtgcacgtgcttaaaatcaacatcagcataggctcattatattcctcgaagtcnagaaaattaatcaaaccaatgttcatggag

SEQ ID NO: 24848 - DNA, 101 bp, rice(Oryza sativa)
  misc_feature (71): n=t or c
cattgagctatatgaccttcggcagatctggtgcccgccaccaagctatagccctcgccaccctcttagangccccgaagcggttgccatctccttcccga

SEQ ID NO: 24849 - DNA, 101 bp, rice(Oryza sativa)
  misc_feature (71): n=a or g
tccctttataaacacacaacaaacatacgcgctcacaacgcgtgcacacatatcatccttacaaacgtgcncacgtataccctacatttatcagcaccttc

SEQ ID NO: 24850 - DNA, 101 bp, rice(Oryza sativa)
  misc_feature (71): n=a or g
gtggttcggggaggacgagaaaaacgtccgagcattgttcagtttggctgctaaggttgctcctacaatcntttttgtggatgaggtggacagtatgttag

SEQ ID NO: 24851 - DNA, 101 bp, rice(Oryza sativa)
  misc_feature (71): n=t or c
cacgtggtgcgaaagatgtagacggcgcgatgagcaggactacaggaatttggatgattgccagaaacacnttttgctgcttatgatgggtgattttcaac

SEQ ID NO: 24852 - DNA, 101 bp, rice(Oryza sativa)
  misc_feature (71): n=t or c
tgcaacacacaccatggatttggagagctgcagctacgtgctgccattgctgacgtgctgcctcttcttgntctactccataacctgctatgccttggcgg

SEQ ID NO: 24853 - DNA, 101 bp, rice(Oryza sativa)
  misc_feature (71): n=a or g
attggggtcacatgaaacctgaatgggtgtagatatgggtagaacatagctctttttgcttgttgattgcncgctgtatgcactagttggtgtctaatccg

SEQ ID NO: 24854 - DNA, 101 bp, rice(Oryza sativa)
  misc_feature (71): n=a or c
tgccaagaataccgttagcttcttcttcatggtacgtgattgactcctgcttcttcgcttttctttgggtnggggtatcaagggtgattttatatatggaa

SEQ ID NO: 24855 - DNA, 101 bp, rice(Oryza sativa)
  misc_feature (71): n=a or g
tcgagttggttatgtgttccattacgtgtgcgggtggattcatgcagtatgcgcgggaaaaacctatgacntattgagaaatataactataattaaaatat

SEQ ID NO: 24856 - DNA, 101 bp, rice(Oryza sativa)
  misc_feature (71): n=a or g
gactattgcattctaaccatcacagttatggaaaacatgagcaagttgccaagttggtgggggtatgtgtntgcgtctttgttgttgatacatacgctgta

SEQ ID NO: 24857 - DNA, 101 bp, rice(Oryza sativa)
  misc_feature (71): n=a or g
gtgcttggcgctgtcgcagtgatcacgacgagcagtggagcacctgggtggattccggataatctgaatgngggccatctggactatttcttctggatgat

SEQ ID NO: 24858 - DNA, 101 bp, rice(Oryza sativa)
  misc_feature (71): n=a or g
actacgcatgttagctcctaaactcctatacaaaattctagacccgtcgatttacaggagagaccatcatnccactgccttgaataaccgtgccgaggtac

SEQ ID NO: 24859 - DNA, 101 bp, rice(Oryza sativa)
  misc_feature (71): n=a or c
ttcagagaagagcttccatctgatttcttaaactctctgacagtggtaggtggagaattttccatcacttnttcctgcaacaaggcaacagcaagggcaga

SEQ ID NO: 24860 - DNA, 101 bp, rice(Oryza sativa)
  misc_feature (71): n=a or c
ctgacaattcgtcagctagcaagggcagcttccctgcctgcctgctagaggcaatttgttgtaggtgatgnacaagtactaggaatcttttcccccttcct

SEQ ID NO: 24861 - DNA, 101 bp, rice(Oryza sativa)
  misc_feature (71): n=a or g
ttgattaatgaaccatttgagctagtacttccatggatattagatgtatatcttgtatggactaacccctncaggggaaagttttcaaattgacgggtgag

SEQ ID NO: 24862 - DNA, 101 bp, rice(Oryza sativa)
  misc_feature (71): n=t or g
gttggatgaaaatggtgatggatcaactagcaagggaacgtctacacctaagggagcctctatttcttttnattacaacaaacttaccattccctctcata

SEQ ID NO: 24863 - DNA, 101 bp, rice(Oryza sativa)
  misc_feature (71): n=t or c
tcgccggatcctgcggcggggaacagcggtggcgacggatctaacgacgacaagaaagacggcgaagcggnggcggggagtagcgacaacgactgcggtgg

SEQ ID NO: 24864 - DNA, 101 bp, rice(Oryza sativa)
  misc_feature (71): n=t or c
ccacatcgatccggtaatgacagtcaaatatatctccttcactcttaaaaataaaacacgggctataacanattctactactataaatttgaataatgggt

SEQ ID NO: 24865 - DNA, 101 bp, rice(Oryza sativa)
  misc_feature (71): n=t or c
cattctccaacctcacaacacttgtgaagtttatcatagagacgaacttcattgatggcaaagatttgagntggatgggtaacctcacatcattgacacac

SEQ ID NO: 24866 - DNA, 101 bp, rice(Oryza sativa)
  misc_feature (71): n=t or c
tcagaggttcgttgctcacaaccacacatgcgtgcaatttgggcagtagtgggctagtggcgtacgtaagntgccaatttgggcccggccttttcgcggtg

SEQ ID NO: 24867 - DNA, 101 bp, rice(Oryza sativa)
  misc_feature (71): n=t or c
taatgtgatgatcaatttgggaaggagagagtgataggtggggcttaagaactagtgtttcatctataccngttgctttcaggtcattactgatccattac

SEQ ID NO: 24868 - DNA, 101 bp, rice(Oryza sativa)
  misc_feature (71): n=t or g
ggaagtagatgattagcaagaggaaggaaaaaaccattgctttgagaacagtgctagctaaagagagaaangatgatagtagacagagtactcacttgtag

SEQ ID NO: 24869 - DNA, 101 bp, rice(Oryza sativa)
  misc_feature (71): n=t or c
gaatactgagcatatcctgtacggggagttcagatatgggtgttatggcctaccaaagtgaatcttatcanatttttttaatcattaacgtgtggtatcca

SEQ ID NO: 24870 - DNA, 101 bp, rice(Oryza sativa)
  misc_feature (71): n=a or c
ctgaatcgcaagaaccgaggtgcaaatgtctctgcttctgtcaccgatacgagaaaattgtgattttgctntcgcaaaagagtggtttcgctggaatgcta

SEQ ID NO: 24871 - DNA, 101 bp, rice(Oryza sativa)
  misc_feature (71): n=a or g
aatcctttttttttttgtctgaatatagtgcccagtttcatcattcatctttatcgccacgcttcctcccnacactatttgctctatccatttacaccatc

SEQ ID NO: 24872 - DNA, 101 bp, rice(Oryza sativa)
  misc_feature (71): n=a or g
taggaactttatagtcaataatctggttaagtattttgtcaggggggctgaaggtgagttgagagggttcntggaaatggagggcaggggtctgtctgagc

SEQ ID NO: 24873 - DNA, 101 bp, rice(Oryza sativa)
  misc_feature (71): n=t or c
gatctgcttaactccagtgcagctccaaagctcgccttcggatgttgttagcatgccagttgattttatcntgtaatcaacaagaaatagaagcaaagaaa

SEQ ID NO: 24874 - DNA, 101 bp, rice(Oryza sativa)
  misc_feature (71): n=t or c
tctgttcgttttacccatgcttgatacctaagcatggcatgttcggcgggataattgagaggtgtgttcantaatttccaactagtggaaaaatcggtgaa

SEQ ID NO: 24875 - DNA, 101 bp, rice(Oryza sativa)
  misc_feature (71): n=t or c
ataccgtcgattggtgaccatggtggtagccttgtgtcggcagtgatctcatctcgaattgcgacgagagnggggtcagtagcttgagcttgccgaagacg

SEQ ID NO: 24876 - DNA, 101 bp, rice(Oryza sativa)
  misc_feature (71): n=t or c
acgcgatcgccaccatggacggatcaagcttaataggagatcatcaccatcacagcagcagcatcctcttnggcggcgcatcagtgccacctctcctagac

SEQ ID NO: 24877 - DNA, 101 bp, rice(Oryza sativa)
  misc_feature (71): n=t or c
cctctcgacacagatcctgtagaacctgtccctgtgctgcgtgatcttggcgacgatggcttcgtggagcncgcagcagcagttgtggaggacgcagctga

SEQ ID NO: 24878 - DNA, 101 bp, rice(Oryza sativa)
  misc_feature (71): n=a or g
actgtgctctgaagcaaacccctgttctttttcaggactgaattgtgctcacaagacatcaactgcagatnaaatagaggttctctgaattctgttggtca

SEQ ID NO: 24879 - DNA, 101 bp, rice(Oryza sativa)
  misc_feature (71): n=a or c
tgatgaattgagccccaaaaaaatcttgctcatggatcgagaagcctatcattgatccccgatcctcctcnggcattggacccagacgatccacactcact

SEQ ID NO: 24880 - DNA, 101 bp, rice(Oryza sativa)
  misc_feature (71): n=t or c
tcggccgcgacatatttttggtctaataccattaatgcattcattcttggacatgggccgatgaccccaantctcttagatgtaaaaatgctcacatgctt

SEQ ID NO: 24881 - DNA, 101 bp, rice(Oryza sativa)
  misc_feature (71): n=a or g
gtatatgattggatatttttagtactacaaatatagagaggtctctcatgtttttagatttatagtattanaaaatatcttatctagtacaagttagttgt

SEQ ID NO: 24882 - DNA, 101 bp, rice(Oryza sativa)
  misc_feature (71): n=t or c
acatgattatgctttgaagggctttagaaaaaaaatgctgggcttaagtacaacatgctggatcactaatnatccctcttctcaaattgatcaaatagtac

SEQ ID NO: 24883 - DNA, 101 bp, rice(Oryza sativa)
  misc_feature (71): n=a or c
gtatggcaattaattatagcacactgtggatgcgcaacgaaacacaaagcaggatataatggaggatctanagatataaccaggttatctctactgcaccg

SEQ ID NO: 24884 - DNA, 101 bp, rice(Oryza sativa)
  misc_feature (71): n=a or g
tcagacctgatacctaggtatcggatgtgatatccacgagtatcagactaggtacgtaggtatcgaacatngtacctataggtatcaaacatgatattgta

SEQ ID NO: 24885 - DNA, 101 bp, rice(Oryza sativa)
  misc_feature (71): n=t or c
cttttcgcctcttccgtggtttataaggcggttttgactaacataacttccaatcactttggtcccgttcntttctccaacaagattaaaaaactttatta

SEQ ID NO: 24886 - DNA, 101 bp, rice(Oryza sativa)
  misc_feature (71): n=t or c
atgcgtggtcgagatgcacttgtcgtgcctgttagatcatcagacaattctatgtcttgcccttagatttnagcagtcttgtgttgtgcgcggcaggcatt

SEQ ID NO: 24887 - DNA, 101 bp, rice(Oryza sativa)
  misc_feature (71): n=a or g
tttactggagttcctgtgttacaagatctatgttgtttgctctatgatggattggaatttggaacctcagnttcttctaaaagaattacgagtatatttta

SEQ ID NO: 24888 - DNA, 101 bp, rice(Oryza sativa)
  misc_feature (71): n=a or g
atttattaacatccgggaaatgtttggacaagattttatattagaacaactatctgatcacatacgcaatncgaaacattggtagaatgcacaaatacaaa

SEQ ID NO: 24889 - DNA, 101 bp, rice(Oryza sativa)
  misc_feature (71): n=a or c
tgccactcacctagtcacacatacaaggtcaatcaatcctcggcacacccagacagacagccagctcgatngccacggcggttaagtacagttgccgaaag

SEQ ID NO: 24890 - DNA, 101 bp, rice(Oryza sativa)
  misc_feature (71): n=a or c
atctatctacctgtggagacgagaggagaggaaatctatggcgtctcctcctccttcgccctccgcatcangcgcagtcgcagtcgagagatcaccgaggt

SEQ ID NO: 24891 - DNA, 101 bp, rice(Oryza sativa)
  misc_feature (71): n=a or g
actgcactgctactctgaaagatgccaccagttggaataggtccttcaaagtagttgttcgacagatcaanttggttcaaaaaagagaagttcacaagaaa

SEQ ID NO: 24892 - DNA, 101 bp, rice(Oryza sativa)
  misc_feature (71): n=a or g
gtcagttttcgtatgtcgaatgtgagtactccagtagagagtgcattgcacattcgtactcgactgtcagngcatgcacagtcgacataccaacccaccag

SEQ ID NO: 24893 - DNA, 101 bp, rice(Oryza sativa)
  misc_feature (71): n=a or c
ttattctctgtcggagtttgggtgtcgctgttatagggaagatgaatggatcatcgagaagcttgcggtcntcgctgctagacggtaagccccagctctca

SEQ ID NO: 24894 - DNA, 101 bp, rice(Oryza sativa)
  misc_feature (71): n=a or g
ccttcccacctggtttcttttttgtcacacgggtcagactatgctcatccgcgctccggtcatactcgtcngaaacccaaccagccggtggagctcgcaag

SEQ ID NO: 24895 - DNA, 101 bp, rice(Oryza sativa)
  misc_feature (71): n=a or g
aaactgaaacaacgtatttaaagagttattttaataatcaattaaggctatgttcgttgtgggcggttggnaacaaatattacagagccgtctattagcgt

SEQ ID NO: 24896 - DNA, 101 bp, rice(Oryza sativa)
  misc_feature (71): n=a or g
tgaagggttctccgttggctgccaaaactattgggcgtcttttgaggactaatttgcatgcttcacactgnaataacatattgcagagtgaactatggaag

SEQ ID NO: 24897 - DNA, 101 bp, rice(Oryza sativa)
  misc_feature (71): n=t or c
gaggacatcagatgcgaatggtcttggttagattcttttctaccacctattacatttgatgctagtcagtngtctgaatggaatcgattattgttgtatgt

SEQ ID NO: 24898 - DNA, 101 bp, rice(Oryza sativa)
  misc_feature (71): n=t or c
tcttgtaaaagcttaaagtgttggatcctccgtcgatctgaaagatcgatatgcatccactcaaaaattcnttttcttttcgcttttggagatacatgatt

SEQ ID NO: 24899 - DNA, 101 bp, rice(Oryza sativa)
  misc_feature (71): n=t or g
tacttagttaggcaaacattcaagagtagcgaggagaaggatgacattcttgtccccagtggcggacccangcctcgggccacccaagccgtggcctcagg

SEQ ID NO: 24900 - DNA, 101 bp, rice(Oryza sativa)
  misc_feature (71): n=a or c
agcagtatatcactttcgcgcgtttatgtgcgtgtgcaacaggtgtggaggtcctcaagttgcactcttgngggaaaaagaaagataggaaattggttatg

SEQ ID NO: 24901 - DNA, 101 bp, rice(Oryza sativa)
  misc_feature (71): n=a or g
ttttttatatcttaacgtgtgagttaagtttgaacctaaaattgtatggtgttgtgtagatatgttgtatnggtattgtcaaatttttctagaatttttta

SEQ ID NO: 24902 - DNA, 101 bp, rice(Oryza sativa)
  misc_feature (71): n=a or g
cgaggtggcgatgatgctgctagtggtggatgcatgatttattggttatgtattcactcaacaattgtagntgtcatgtgactagggtttggtgggcttgg

SEQ ID NO: 24903 - DNA, 101 bp, rice(Oryza sativa)
  misc_feature (71): n=a or g
ctcaaagttccaattgctttctcctgcactagcatcactctcaaggaccactagtgaacaacatttactancccattttgtggcgaacagaggcttcagtc

SEQ ID NO: 24904 - DNA, 101 bp, rice(Oryza sativa)
  misc_feature (71): n=t or c
acattcatcacgcccttcggtgttttcttctacactagaatgcctttcgggttgattagcgtaggcaacangtatcagcgcgagatccaaggagctctcgg

SEQ ID NO: 24905 - DNA, 101 bp, rice(Oryza sativa)
  misc_feature (71): n=a or g
tgcaatgtgcataccttatccgctgcttgcttttcgctattcaattgtgctacagagctttttggcttgcnagtcacgatgttaagcacgagatcatccaa

SEQ ID NO: 24906 - DNA, 101 bp, rice(Oryza sativa)
  misc_feature (71): n=a or g
atcctatatatatgatctagagaatatttcactagtagtagagaaagcctaatcacactacggccggtgcntaattgcgaatcatgcatgatcgatcgtct

SEQ ID NO: 24907 - DNA, 101 bp, rice(Oryza sativa)
  misc_feature (71): n=t or c
agacggagagagtaagcactagaactccctccattgcaacctaatattcgatgatatttttctacgtgtanagatttattgtagtagaaaaaagtctcatc

SEQ ID NO: 24908 - DNA, 101 bp, rice(Oryza sativa)
  misc_feature (71): n=t or c
tatgcagaggaaatgcaagttaataaagaggcacctctggggtgcctcaagccaatttctcagtataaccngcaagagcagagaagcaacgggtttcctga

SEQ ID NO: 24909 - DNA, 101 bp, rice(Oryza sativa)
  misc_feature (71): n=a or g
tataaaaggcgctccacccctcgttagctcaccagctctcccccaagagctgcttacctaacatacttttncaactccaccattgtccattgccaaaggcc

SEQ ID NO: 24910 - DNA, 101 bp, rice(Oryza sativa)
  misc_feature (71): n=a or g
agagacggagcgaatactatctaaaataactttcccctcccgtctctctcggtgcctcctctgagaggtgnctttcagtgcgacgtagagttttcccctcc

SEQ ID NO: 24911 - DNA, 101 bp, rice(Oryza sativa)
  misc_feature (71): n=a or g
ttcatcgaggaaagctatcgatggcctcgtggccaaaagcgtgtgaggtgtgtgtgagagaggggagaggntgggtgggtggggacgacctggagctgatc

SEQ ID NO: 24912 - DNA, 101 bp, rice(Oryza sativa)
  misc_feature (71): n=t or c
cgcagggccctgagacaagcttccgcgatggcttggcagagtggcctgattggagggtgcaaatcgagganaggtgtggtcggggagctcttgacaatgcg

SEQ ID NO: 24913 - DNA, 101 bp, rice(Oryza sativa)
  misc_feature (71): n=a or g
tgcaccctgtaccacagctgataaggataatattaaggctgcaagctcgggaggttgctaagttcttcacntcaggaatgacgaatgttgcttcagtgtag

SEQ ID NO: 24914 - DNA, 101 bp, rice(Oryza sativa)
  misc_feature (71): n=a or g
ttctttagggggaagactgtaaggtgataagttgggagggcagaaagggtggatttgatcaaaaccgttcnacctgtcttattcagcaattttcctttcca

SEQ ID NO: 24915 - DNA, 101 bp, rice(Oryza sativa)
  misc_feature (71): n=t or c
aagcttgtaggagtagcagtagtagtcctatataaaaccgggagagggaggccgatggtgatggccccacngttttaaccttgattcatctcctagtttcc

SEQ ID NO: 24916 - DNA, 101 bp, rice(Oryza sativa)
  misc_feature (71): n=t or g
ctccaacaggggcgctgtgtcccctttgttgtgatggcggcgctgatgacaagcagcgtcatctcccgtcngttgcgacggcggctcttcagcaggggtgt

SEQ ID NO: 24917 - DNA, 101 bp, rice(Oryza sativa)
  misc_feature (71): n=t or c
tcattttctggtgctgaggtggaagctagaaaaagcaagcaaaaatcaaagcacaagaagaaacacctgcnagagtctttgtctgattcaaaagttgaagt

SEQ ID NO: 24918 - DNA, 101 bp, rice(Oryza sativa)
  misc_feature (71): n=a or g
gtaatactctagtctagttagtgtagattggatctgtaggtttgcgcagcacagcgttggaattgctcgtnggcacatatgcagagcgtgatcacccctta

SEQ ID NO: 24919 - DNA, 101 bp, rice(Oryza sativa)
  misc_feature (71): n=t or c
ggatccggcgtcacctcaagctctgtttccaaccgtctccatgttgcagcaggtctcttccccgcaaggcnatctgacttcgccatctcgttgaccccaac

SEQ ID NO: 24920 - DNA, 101 bp, rice(Oryza sativa)
  misc_feature (71): n=t or c
cttctattaaacgccaacgtactcctcatcacgcctccaaacccgccgctttgattgtacttgtgctttgntgttaaagagctcgccggcgtgagtggtgg

SEQ ID NO: 24921 - DNA, 101 bp, rice(Oryza sativa)
  misc_feature (71): n=a or g
tggtgtcttaagaaatggtttagttgctgttggtgggtgtttgtctgcatgttttcagaaagaggtgcttntgtcagcatcatttctgtttctttgtctga

SEQ ID NO: 24922 - DNA, 101 bp, rice(Oryza sativa)
  misc_feature (71): n=a or g
tacccggtatagcgcagtcatttctatacacaccgtgctggatggaactatttgaaaataacaattagctnctagctagtagttactttatcaaagttagc

SEQ ID NO: 24923 - DNA, 101 bp, rice(Oryza sativa)
  misc_feature (71): n=t or c
cgtcagcgagagtatgccggatgagacggcatagttgtcgttggttaggctcttgaaggcgtacaagacgntgccattgccgcagaggacgatggtcatga

SEQ ID NO: 24924 - DNA, 101 bp, rice(Oryza sativa)
  misc_feature (71): n=t or g
tggtcagggggccgccggaatgggccacgtcactgttcactcctggtcccattccataagtttaagggtgngtttagttcaggtaaaaattgaaagtttga

SEQ ID NO: 24925 - DNA, 101 bp, rice(Oryza sativa)
  misc_feature (71): n=a or g
ctaaatatttgttgcaaatttggcctagtgccaaattgtggtggtcaacaataatattccgttttctcaantcgaatcccaatagatcaagttgacattat

SEQ ID NO: 24926 - DNA, 101 bp, rice(Oryza sativa)
  misc_feature (71): n=a or g
aaatagagcctatcttattgaatgaattgcactcgggttgtgaatttgtgatccgttcatcgtaggggggnaaatgaatgtcaactagaggtgaacacgcg

SEQ ID NO: 24927 - DNA, 101 bp, rice(Oryza sativa)
  misc_feature (71): n=t or c
atgatagattctagaaaaagaaaacaggtcccatatcgatcaagcgggctgatttaatactccctccttcncaaaatgtttccgttgacttttttaaatat

SEQ ID NO: 24928 - DNA, 101 bp, rice(Oryza sativa)
  misc_feature (71): n=t or c
aatgtgcgtactcctacgtaactcactaacatatatacagttgtccaatataaacagtactccctccgtcncaaaataagtgtagttttacgctattcacg

SEQ ID NO: 24929 - DNA, 101 bp, rice(Oryza sativa)
  misc_feature (71): n=a or g
ccgtacgcttcgccttgccctcaatgatatgggggagagggtacaaggagtccctagagaagatgcctccntctttgacttctcggagtggactcagcagg

SEQ ID NO: 24930 - DNA, 101 bp, rice(Oryza sativa)
  misc_feature (71): n=t or c
gcgccggccccgaagctgatcttgtaggggagcaggatgccgatggagatgcggatgacggagaggatgangccgagggggaggaagaggaagaaagcgag

SEQ ID NO: 24931 - DNA, 101 bp, rice(Oryza sativa)
  misc_feature (71): n=t or c
ttgcattggcatggccatcagcctgggaaacctgactggtctgagacaagccgtttcgtggccttctccanggtacctacataatgctctcacacaacaca

SEQ ID NO: 24932 - DNA, 101 bp, rice(Oryza sativa)
  misc_feature (71): n=a or g
agttttgaacttcccagataatttgggatttgtgctgccccttgtacttacttctatcatctttcttcccncatcgtctattccctaaagaatgtacttct

SEQ ID NO: 24933 - DNA, 101 bp, rice(Oryza sativa)
  misc_feature (71): n=t or c
ttctttaagaaatccacttggtgagtcacaagcaaaactgtcttcttcttgagtatacctttcagacattnctgcagaaaaaaaggtaaccattagagtac

SEQ ID NO: 24934 - DNA, 101 bp, rice(Oryza sativa)
  misc_feature (71): n=a or c
tcagagctttccttcttctggacatcgccaaaggaataaggaatttcctttttgtccatgcatggtcaacngttggtaattgttacaaatggaacaagaag

SEQ ID NO: 24935 - DNA, 101 bp, rice(Oryza sativa)
  misc_feature (71): n=t or c
cagtgtcgaggaaatccatgctattaccgcgcagcaagaggaaacctaaagaaacgttatacaacaacatncaagatgggatcctcccctggagtgaacat

SEQ ID NO: 24936 - DNA, 101 bp, rice(Oryza sativa)
  misc_feature (71): n=a or g
tatcctgtgtttcaaaggggccctaagtgtactgtcagtgtatgatcaagtcatcgtcaattttactccangggatcgatcgagtagtcgtagctcgaaga

SEQ ID NO: 24937 - DNA, 101 bp, rice(Oryza sativa)
  misc_feature (71): n=a or g
acagccttacctggtgctggtgaggtgagcagagctatcccaattccaattccaattcacaattcccaaantggaggagaagatggtggcgccatcgcccg

SEQ ID NO: 24938 - DNA, 101 bp, rice(Oryza sativa)
  misc_feature (71): n=t or c
tacattgcgtacgaacttcatctcgtctggtgaaaccatgagacaaacttattttgtttgttgtgctttcngtggaaattaggttgcagtttatgtagtat

SEQ ID NO: 24939 - DNA, 101 bp, rice(Oryza sativa)
  misc_feature (71): n=a or g
gaagatccacgacctgttcttcccgccggaaacatccccgatcaagtctaccgccgagattgtgctcgacnacctgtagaagtctctccgaccccttctaa

SEQ ID NO: 24940 - DNA, 101 bp, rice(Oryza sativa)
  misc_feature (71): n=t or g
attcccatcagggtaggggggagaccagacgggtatgccaactttatcatcatgataaaatgcaccatcantataagagtctctcagcggaactttgattc

SEQ ID NO: 24941 - DNA, 101 bp, rice(Oryza sativa)
  misc_feature (71): n=t or c
cagatccaatcgaaagggtggctaattaagcttgcgaaattgaagtgtgatgtgatgtgggtttgatgganggattagagtagctaggaaatgaaatgaac

SEQ ID NO: 24942 - DNA, 101 bp, rice(Oryza sativa)
  misc_feature (71): n=a or c
atgtaaatgctctctgctcgcgtacacggttttcttctcgcgcacacggaattcttctcgaggtgtaaacnccgtttggtaactttggggtatcaatcaaa

SEQ ID NO: 24943 - DNA, 101 bp, rice(Oryza sativa)
  misc_feature (71): n=a or c
ttctgatcatcagcatcaggtcatcactgggaacaagaggatgttccccatggatgagcactttgagcagnagcagaagaagccgaagaagaaaacccgaa

SEQ ID NO: 24944 - DNA, 101 bp, rice(Oryza sativa)
  misc_feature (71): n=a or g
tgaagtcgaccaaccgttgaagtagagaagaagcaaaccaaaccaactcccggcgccgcctctccgcccgngctggatctagccgcctgccgccgccgtct

SEQ ID NO: 24945 - DNA, 101 bp, rice(Oryza sativa)
  misc_feature (71): n=a or g
acatagctcctgagatgatctctcggggttttggtgccatatcaagcaagtccgatgtttacagcttcggnatgctactattggagatggccggaggaaga

SEQ ID NO: 24946 - DNA, 101 bp, rice(Oryza sativa)
  misc_feature (71): n=a or g
cgaggaagtagatggtgtcctcctggagcatggggaactgcgccacatcgacggacctggagcagctgcgnccgaggaagagcgcgcggccggtcagctcg

SEQ ID NO: 24947 - DNA, 101 bp, rice(Oryza sativa)
  misc_feature (71): n=t or g
ttttcattcaaatatatgtctagcccattcatccagtgaacaaaatcatctctttgggggccagaagatgncccataaacattaaccagattaaaggtatc

SEQ ID NO: 24948 - DNA, 101 bp, rice(Oryza sativa)
  misc_feature (71): n=a or g
tgctgtaccccaaccagggttcccttttaccattttcggtgcgacaccgtggtaacccgaaaactgcatgntaaccacgagacataactgattttaaaaac

SEQ ID NO: 24949 - DNA, 101 bp, rice(Oryza sativa)
  misc_feature (71): n=a or g
ccatttcaaatgatctgctagtgatttttcaaattcattagcaaccagtacatgaatttacgtagagaganaaaaaatgattctatgctaagatgagcata

SEQ ID NO: 24950 - DNA, 101 bp, rice(Oryza sativa)
  misc_feature (71): n=t or c
tcttcctccatcctccctcttttatcttccccgcgtgcagatgagactaacggagatttttgatggaaaangcgacggagtggcatgattccaattttcca

SEQ ID NO: 24951 - DNA, 101 bp, rice(Oryza sativa)
  misc_feature (71): n=t or c
ccccaaataaccgtgttgggatccattggcattgttcttatcatgctatatgcttcctgcagtcgcccaangcggccaagaagatcaatcatgcaaccata

SEQ ID NO: 24952 - DNA, 101 bp, rice(Oryza sativa)
  misc_feature (71): n=a or g
agatggatagaggtcactgctgatacacaagtatcagctcttctggatgcagtgaaatatggtctcaagantgaagttcatgacacaaaacttggtccaaa

SEQ ID NO: 24953 - DNA, 101 bp, rice(Oryza sativa)
  misc_feature (71): n=t or c
cacaatcgatctagaagcaaagcaagtatgttacgaagaaatcaacgtagatatacattattttataggangagactaccgatcgggcgccccatccaagc

SEQ ID NO: 24954 - DNA, 101 bp, rice(Oryza sativa)
  misc_feature (71): n=a or g
gccaatcgcaggcgcccatcctagtgctaagcaacggctaacgcgggatttttggagcaggcactagaacngataccctcatcttaatcgggcggtaagtc

SEQ ID NO: 24955 - DNA, 101 bp, rice(Oryza sativa)
  misc_feature (71): n=t or c
aaaaatacgatctgaaaagaaaattgtccttgctgttgcttcctcaggtgttgcttcactgcttctgcctngaggacgcactgctccttcaagatttaaaa

SEQ ID NO: 24956 - DNA, 101 bp, rice(Oryza sativa)
  misc_feature (71): n=a or g
acatcatcataagaaccagaatccaacatgactcttgaatcttcgaacaagatccacccttttacttactnactaacaatacccttttctctgcaaattaa

SEQ ID NO: 24957 - DNA, 101 bp, rice(Oryza sativa)
  misc_feature (71): n=a or g
atataatgttgtagagttgaacatataagtatatgtgtttgcaattccatgttctcacctcatctccctcntttttcacgcacacgctttttaaactatta

SEQ ID NO: 24958 - DNA, 101 bp, rice(Oryza sativa)
  misc_feature (71): n=a or g
ttcatcttcaaactgaactggcacatcttaacctacagcaaggaactggtgattcatggagtttcatttgnagtagcagttgttatactcctaaaaggttc

SEQ ID NO: 24959 - DNA, 101 bp, rice(Oryza sativa)
  misc_feature (71): n=t or c
tctaatacagtgatatcaacgactctgaatttctacctcttgttatacgttggcgagtccgatcaactgtntaaaacagtcgggcgttaaccggctccgct

SEQ ID NO: 24960 - DNA, 101 bp, rice(Oryza sativa)
  misc_feature (71): n=t or c
gcgttcgagtggcggcttccggacggcatgtcgcctgatgacatggacatgactgagaagtttgccactgntaacgtgcttgctacccctttgaaggctgt

SEQ ID NO: 24961 - DNA, 101 bp, rice(Oryza sativa)
  misc_feature (71): n=t or c
gccgacctccttgcatctccggccaacgcgcgtcgtcacagattgatcacgcctaggtgagtctcgacgtngtccccgaactagctgctcacccgctgtcc

SEQ ID NO: 24962 - DNA, 101 bp, rice(Oryza sativa)
  misc_feature (71): n=t or c
agccttgctgtgatacagctaacagtgtgacgagaggcaaccggcaattttccatgtaattctgcaatctngctttggtttgcccatagagccacaaaatc

SEQ ID NO: 24963 - DNA, 101 bp, rice(Oryza sativa)
  misc_feature (71): n=a or g
atcatgtgcttagactttgtgatggtagtatactaaattcctgctttaaccacgatccactctccgaggcntatgccgagcacgagcagtgaccttgacgt

SEQ ID NO: 24964 - DNA, 101 bp, rice(Oryza sativa)
  misc_feature (71): n=t or c
acgctccaaatacacttcaatgattggttgaagagaaacatctagcagttctgccttgtccatgctgccantcccacacatgctctgatcttgatgtttgc

SEQ ID NO: 24965 - DNA, 101 bp, rice(Oryza sativa)
  misc_feature (71): n=t or g
cgaaatgtatatatacatttggatttgtattgaacggcattcgattttctattaatttttagggtacaganatttgtactcgcgaaagaaaaaatatatac

SEQ ID NO: 24966 - DNA, 101 bp, rice(Oryza sativa)
  misc_feature (71): n=t or c
tcaaggaggcttccaatgcctggatatctgcaagggttgctggtggcagttgttctgcgacgggcagcagncgtgctcgctctacatgggcttgccccgcc

SEQ ID NO: 24967 - DNA, 101 bp, rice(Oryza sativa)
  misc_feature (71): n=t or c
gttttaaaaccacaaaccgatctgcttagctaaacacaatcacaaagctcgcaagatcaagatcgtgccancactacaacgtcgacgtcactggcagctca

SEQ ID NO: 24968 - DNA, 101 bp, rice(Oryza sativa)
  misc_feature (71): n=t or c
gcaaagccaaacaaccatgtcatatttggtcatgtcgctccatggcaacgtattaagtaagccgtgtaatnaggaattgattttcccaacttcatggctag

SEQ ID NO: 24969 - DNA, 101 bp, rice(Oryza sativa)
  misc_feature (71): n=a or g
cataagcactactaaaaaaggatttttcctgtacgaggagctatttagattgtagacggactgtttttgcnttcgcacggataaattggcgtcccattttc

SEQ ID NO: 24970 - DNA, 101 bp, rice(Oryza sativa)
  misc_feature (71): n=a or g
caaacggggttcgccagtcgtatgggtctttgcctaatttcacctggtcaattgtcatgacctccaagctntccatgggcacacttggtgcatataggact

SEQ ID NO: 24971 - DNA, 101 bp, rice(Oryza sativa)
  misc_feature (71): n=t or c
aataaatactaaaatatattctaaatattgttcgcattcaaccttgccctttcttttggcaatttcatggngatccttgttagagtggtcattctttgtca

SEQ ID NO: 24972 - DNA, 101 bp, rice(Oryza sativa)
  misc_feature (71): n=a or g
gccaggaacctatggggggccatgtgtgaggcgggtaatatatctctaaatgggggtaatctgtgcaatgncccgggttggatttttgatcaactggaaat

SEQ ID NO: 24973 - DNA, 101 bp, rice(Oryza sativa)
  misc_feature (71): n=a or g
acccgcggccatgggcaatcttcttcttcttcttccccacccggccaaggccaaattgaggcctcccaccncggcggcgaagcgcggtacactcttcttct

SEQ ID NO: 24974 - DNA, 101 bp, rice(Oryza sativa)
  misc_feature (71): n=a or c
tgttgaccttccaaacctgaaggagcttgagctgaaagggaataataatgatcggaagcttgttgcatgtnttgccggtgctcctcacctttccaggttaa

SEQ ID NO: 24975 - DNA, 101 bp, rice(Oryza sativa)
  misc_feature (71): n=a or g
ttttcttttactgactataattttatataggtggcatgtctgatgaagagcgggtccatatatcacgtagncatcaaatcagctgaaaccaccatttaaac

SEQ ID NO: 24976 - DNA, 101 bp, rice(Oryza sativa)
  misc_feature (71): n=a or g
cttaccgcaacttcatcggtcatacccttagaactaagactcttggtcttatggacgatcttgctcaatcngccatacatgttgcttgggctttcaccatc

SEQ ID NO: 24977 - DNA, 101 bp, rice(Oryza sativa)
  misc_feature (71): n=t or c
tcataactagggatcttctccaacatcctccacttcattttcaaaactccaatgacctttcaatgacattnctaagagatgagtgtgcatagttgaagttc

SEQ ID NO: 24978 - DNA, 101 bp, rice(Oryza sativa)
  misc_feature (71): n=a or g
cattatgtgcgtgctgtatatgtgcattagtgcatatgaaggtaaataaatggagtgctctgaagggaacnaattaaaagaggtttcagtgaacgtaaagc

SEQ ID NO: 24979 - DNA, 101 bp, rice(Oryza sativa)
  misc_feature (71): n=a or g
ttgccttcgaaattcctcgcatttggtttcccttgttgatttgggggaacggcggcggcggcgagagagcngctgcggcggcgacggcggcggcgaagaag

SEQ ID NO: 24980 - DNA, 101 bp, rice(Oryza sativa)
  misc_feature (71): n=t or g
cttgtcatcctcttgcacactcatcatgccctccaattcagagctcacaacgacagtgacccgggttcttntgtcgggttccagttgtcggtgagcaaaca

SEQ ID NO: 24981 - DNA, 101 bp, rice(Oryza sativa)
  misc_feature (71): n=t or c
tggtaaagctccaaaggagccgtctgctgatgtgtcagctaatattgcttgatttatcatttcattcgtcnaaacagtagctcgataaccctccactggaa

SEQ ID NO: 24982 - DNA, 101 bp, rice(Oryza sativa)
  misc_feature (71): n=a or g
tgatctatgaacaagcatggttcattgcagaagcactatgttccttcaggccttcttcttctttgcagcancaacatcctttgaaccctcttttgccttct

SEQ ID NO: 24983 - DNA, 101 bp, rice(Oryza sativa)
  misc_feature (71): n=a or g
tagctccaaccataggcggctttctagggtgcaatccaagcaacttgatgaattttatcgtgtaaatcacncagttgattccgtaagcatgtttctttttt

SEQ ID NO: 24984 - DNA, 101 bp, rice(Oryza sativa)
  misc_feature (71): n=t or g
tccagatgcatgacattgtgagggagctggccatttccatatcagaggacgagaccttctgcatgacacanagtaaatcgcaccccggtgaacccgaatac

SEQ ID NO: 24985 - DNA, 101 bp, rice(Oryza sativa)
  misc_feature (71): n=a or c
cgtccactatgcatcgtgacctatgtcacctcttgctcgattaaatttgtcactaactcttctccctctangcatcagaactactcggagatcatctcaat

SEQ ID NO: 24986 - DNA, 101 bp, rice(Oryza sativa)
  misc_feature (71): n=t or c
aaaatgcgatcctagcggggcttcagctccattccaaaggtaaaactcaactgggggtctgagccttggtnttctaacttcgtcttcagctcagaagcact

SEQ ID NO: 24987 - DNA, 101 bp, rice(Oryza sativa)
  misc_feature (71): n=t or c
ttgactagagttggtacaaaattacctctgcgtagtagacaatggatgcgagagctgctgccattttcttnctactcatacttgtctatcaagaaaatcca

SEQ ID NO: 24988 - DNA, 101 bp, rice(Oryza sativa)
  misc_feature (71): n=t or c
atgagcagccctaaccattttggtagtgtctccagccgtttacagccatccaaccgcagctctatcagagnggctagtttcttcatgctttcaggtagata

SEQ ID NO: 24989 - DNA, 101 bp, rice(Oryza sativa)
  misc_feature (71): n=a or g
taataggagtttcatggtaactgtgtctaaaaattttctcgagatccatctattctgggctggtaagggcnggggaatctatgggccaatgatctcagcat

SEQ ID NO: 24990 - DNA, 101 bp, rice(Oryza sativa)
  misc_feature (71): n=t or c
atggtcactggttagcactggtgcaactcgcgccctcaattaattattaattactccctcctgttccgcancgcaaattgtaattattaattacttaattt

SEQ ID NO: 24991 - DNA, 101 bp, rice(Oryza sativa)
  misc_feature (71): n=t or g
ccagttgatctcaaaggacacagccgtcatgtagttgaaccagcgtttccaatcgtccacactggtaatcnacccagatgggaggtcgagcacatatgcgc

SEQ ID NO: 24992 - DNA, 101 bp, rice(Oryza sativa)
  misc_feature (71): n=t or c
ttctcgccggagtcaatttctcaagagatttgctacaaaagatgccgcagtttgggatggaaaaccacaantccaacctgttggggaacttggcatcctgc

SEQ ID NO: 24993 - DNA, 101 bp, rice(Oryza sativa)
  misc_feature (71): n=a or g
cattagcgatggtctcagcaactcggctccatagctgctccagttgctatggggagagaaggggaaaaatnaatgaccgggagtgggggagtgggaataag

SEQ ID NO: 24994 - DNA, 101 bp, rice(Oryza sativa)
  misc_feature (71): n=t or c
cggcagtgataagtctttcaagtgcccgatcactggatcatccaccaactctgtgatatgaactgaactcnaaacatgcaggttatcttcaaactgaggag

SEQ ID NO: 24995 - DNA, 101 bp, rice(Oryza sativa)
  misc_feature (71): n=a or c
tcttgacaacttcttgtcaacctttacactcctgcgtgttcttattttttctgacgttgattttgatgagntaccgagttcaattggaaatcttaagcact

SEQ ID NO: 24996 - DNA, 101 bp, rice(Oryza sativa)
  misc_feature (71): n=a or g
gaaatcgtcagttgactatatatctaatcgctcgtaggacgccatcgtcgccggagcaagaacggtggtgntcaccgggatgataccgctgggctgcgagc

SEQ ID NO: 24997 - DNA, 101 bp, rice(Oryza sativa)
  misc_feature (71): n=t or c
cgaaacagagcccacaatggaggcccatgtggtggcctctatatatcaacccatcacaaagctagggtttntctccccgcctcgctgcttcgcctctcgtt

SEQ ID NO: 24998 - DNA, 101 bp, rice(Oryza sativa)
  misc_feature (71): n=t or c
tttccttcttctcttctacctcgctctttcttctgtaaaaatctctgggtttcttgcgaggaagatctctntctcttctctctttcagctctgagcagcta

SEQ ID NO: 24999 - DNA, 101 bp, rice(Oryza sativa)
  misc_feature (71): n=t or g
ggaaaataaaaaaacatacataatggccataaatatcatgatggcttaaggggttttattatagcataaanatcatgatggcttaaggggttttattatag

SEQ ID NO: 25000 - DNA, 101 bp, rice(Oryza sativa)
  misc_feature (71): n=a or c
aattatctagtgctctataaaaggttgctgtggggacttcagctcctaaagcaagtcagaagtgaaatctncaagattcagtaaggttggagaacgactct

SEQ ID NO: 25001 - DNA, 101 bp, rice(Oryza sativa)
  misc_feature (71): n=t or c
gggaaggaatcgggccgcctccacgtgcatcgtcttcgtattctggaagagcgctaccatgaccacacgangagatcgacagggtactcccgatagaaaca

SEQ ID NO: 25002 - DNA, 101 bp, rice(Oryza sativa)
  misc_feature (71): n=a or g
ttgcgtgtgtgggcgtgggtgtggagagacgggaccgagaaagggggtcggatttatagtgtgacgggtcntgtcgaggcgaagttacgggattgcccctc

SEQ ID NO: 25003 - DNA, 101 bp, rice(Oryza sativa)
  misc_feature (71): n=a or g
cttatggccataggctattagccatcagtacaatcatatcttaggccaacattcattcattaccaaaggtntttccgacgatattccacaagataattttc

SEQ ID NO: 25004 - DNA, 101 bp, rice(Oryza sativa)
  misc_feature (71): n=t or c
ccaaaggagaagtgggctttattgttcgataaggatggttcacgctacaatgtaatgactacaaacttggnagagctatacaactgggtcatgccagacac

SEQ ID NO: 25005 - DNA, 101 bp, rice(Oryza sativa)
  misc_feature (71): n=a or g
ggtgacgttgttgaaggtgaggtctaatggcttgaggccgggtagaaactggagaagggccatggtgaagngaggtacgacttgggttgcgacgatgtcgt

SEQ ID NO: 25006 - DNA, 101 bp, rice(Oryza sativa)
  misc_feature (71): n=t or c
tggctagacgtagcgttcgggttgttcggtggttgagaagacggcatggtaatttgtcggcttcggctcgnggctagattggcaggtggtcaatcggaggt

SEQ ID NO: 25007 - DNA, 101 bp, rice(Oryza sativa)
  misc_feature (71): n=t or c
ggatctcttggttgcttgtactcaggctcaggtcatgatccagattgctatttgattttcttttttcatcncttggaattctttactcaaaccattaagct

SEQ ID NO: 25008 - DNA, 101 bp, rice(Oryza sativa)
  misc_feature (71): n=t or c
agaaattcatggccaccttcttggttgggtggagtgattagacgatgggagttgcaacctttgcattggcnaggatccaaattatatttggaaggtttacc

SEQ ID NO: 25009 - DNA, 101 bp, rice(Oryza sativa)
  misc_feature (71): n=t or c
atcgggaggtggcaagggagcaggtggttttctcttgcaaagtagttcagagtgttttcgtagtcttcatngaatccatccctgaacaagggagcgcagcc

SEQ ID NO: 25010 - DNA, 101 bp, rice(Oryza sativa)
  misc_feature (71): n=a or g
gactatatattacttacccggctgaagagtatatgcctagtttaagccccttgctgtgcacataatctgcnagtgccttaatccccgaagggaacttcttt

SEQ ID NO: 25011 - DNA, 101 bp, rice(Oryza sativa)
  misc_feature (71): n=a or g
aaccgtgtaccaccaggtggaaaccaaccccctgagcaagatggtggagggaaaaatcctccaccattagnaaacttcatggcatagtggaacctaatgta

SEQ ID NO: 25012 - DNA, 101 bp, rice(Oryza sativa)
  misc_feature (71): n=t or c
attcaatattttcttctcttattggccccttctccactaatatgtccctagctttatgatcaagtttatcncaatttcttggatcatacatatcgacagta

SEQ ID NO: 25013 - DNA, 101 bp, rice(Oryza sativa)
  misc_feature (71): n=a or g
agtcaacggtgtcaaatatttagggaaggagggagtattcatttttgacgactaaaaaaatcatttactcntgatttataaaattttccttcattcatatg

SEQ ID NO: 25014 - DNA, 101 bp, rice(Oryza sativa)
  misc_feature (71): n=a or g
tatgcagttctgcacaacgataacgaaacgtagtggcagctcaggatgaacaaaatgttcagcttttttcncgaatgcgcaaaaaaattgcatgtcaatat

SEQ ID NO: 25015 - DNA, 101 bp, rice(Oryza sativa)
  misc_feature (71): n=a or g
attttgtactaatcactgaccaaaattcctcctaaaatttgcacattggatgaagcttaagattttcgtgncacgcttttcaaactgctaaacggtgcgtt

SEQ ID NO: 25016 - DNA, 101 bp, rice(Oryza sativa)
  misc_feature (71): n=t or g
caagattgtttgggttgggcttttgaatatttgcatcaatgcaaacattctaagagggaaattgttttgtnaaagctggattttgaaaaagcttttgacat

SEQ ID NO: 25017 - DNA, 101 bp, rice(Oryza sativa)
  misc_feature (71): n=t or c
cttggccgggagagacgttggagagaaatcatctccagacgccttcccccgattcatcgttgcaacgccanggcctaacggccctggactcgcgtccgccc

SEQ ID NO: 25018 - DNA, 101 bp, rice(Oryza sativa)
  misc_feature (71): n=t or c
atgatgacgaagtatcttgcgttcttcgtttgcatatatactagggttggggactggcagggctagtgcgngaattgttgcgaaaaagcccctcgtcttta

SEQ ID NO: 25019 - DNA, 101 bp, rice(Oryza sativa)
  misc_feature (71): n=a or c
cacttctttttttctcaccgtagttatttttttggggcatgttaggtctagattatctgcacacaggttgnaacaggccaataattcaccgcgatgtgaag

SEQ ID NO: 25020 - DNA, 101 bp, rice(Oryza sativa)
  misc_feature (71): n=a or g
aaaaacaaatagaacatacgtaatgtgatctatccgacctaatcttttaaatcaacaattggaccgacttntaaacctgacagagtaaactagacaaacca

SEQ ID NO: 25021 - DNA, 101 bp, rice(Oryza sativa)
  misc_feature (71): n=a or g
ctctcacccgatcggatgtgaccggattgtcgcgcgtgtaggcgtttacaggttgagcattaatgcggcgncaacgcaggagcaaagatcagcagcatggg

SEQ ID NO: 25022 - DNA, 101 bp, rice(Oryza sativa)
  misc_feature (71): n=a or g
aacttattgatgtccaaaactgtgtctttccctggcggccctacctaccatggcaatcaagaatatatttngggtgtaatatgagtaatttccatggcggc

SEQ ID NO: 25023 - DNA, 101 bp, rice(Oryza sativa)
  misc_feature (71): n=a or g
cgcctcctttagtgttcttgaacggtgcagaacagatatagatattcctatggggagcatcacccccaccntaaaaacttctgatggagaaaatatctata

SEQ ID NO: 25024 - DNA, 101 bp, rice(Oryza sativa)
  misc_feature (71): n=t or g
tccaccgtcttgcaccacgctaccttgccatatcccgctgcgtctgcaagacctggtgtaccatcatcgangcccacaacctgctgcatgtggacctcctc

SEQ ID NO: 25025 - DNA, 101 bp, rice(Oryza sativa)
  misc_feature (71): n=a or g
tccatcgtatagaagtccagcagcccacacaagaaaacctagtttttcatccctcacgtcccaatccctcnagccgccgccgccacccctctcctccttct

SEQ ID NO: 25026 - DNA, 101 bp, rice(Oryza sativa)
  misc_feature (71): n=a or g
atatgacgttgggtcttgtgagtcctttaacacaacggccaggttaatctaacaaacatggagtgattccntgtagaaattaattaatttgccactagttc

SEQ ID NO: 25027 - DNA, 101 bp, rice(Oryza sativa)
  misc_feature (71): n=a or g
aacaactagagaactagtcggacaagggatttttctctatgcaagctaatttctgtccatgtggtaccagncaagtaacaactagagaactagtcggataa

SEQ ID NO: 25028 - DNA, 101 bp, rice(Oryza sativa)
  misc_feature (71): n=a or g
tggtgcatgagtatacgacggcatgagctcaagcttgaagcactgtaagatcatacacaatgccatcttgncctcaagcaatgcgaagttttgacctatgc

SEQ ID NO: 25029 - DNA, 101 bp, rice(Oryza sativa)
  misc_feature (71): n=t or c
tcatcaacattatcaccatcaccatgattttccacttgttcatgtgtgctctcactaagaacatcgtcaanagtggtttctatctctgtttcaccatcatt

SEQ ID NO: 25030 - DNA, 101 bp, rice(Oryza sativa)
  misc_feature (71): n=t or c
ctcgttgctgggaacgagaggcaattccgaggcctgcgggagaagtcgtctgagctggaggaccacctgangacaatcagggaatcccttcgcaaggactt

SEQ ID NO: 25031 - DNA, 101 bp, rice(Oryza sativa)
  misc_feature (71): n=t or c
agtacattggagcaacttttcctttgcaagaggaatataagagggactgagcaaccacattgaggccaatnagctcactgaaggaccgagggcgaaatttc

SEQ ID NO: 25032 - DNA, 101 bp, rice(Oryza sativa)
  misc_feature (71): n=t or c
ttaatggtatttgcatatggtcgggttgtgacagaaaatgatggtcagttttgatgaaccctgagttcctntcgacactcaaggctgttgttggcccgatc

SEQ ID NO: 25033 - DNA, 101 bp, rice(Oryza sativa)
  misc_feature (71): n=t or c
caatattcgactttgcaagcacatgatgggcattggcctggtgactacagtggaatcttgttcattatgcnactcctggtatgcactttattctattcatc

SEQ ID NO: 25034 - DNA, 101 bp, rice(Oryza sativa)
  misc_feature (71): n=a or g
acttcgcatataaccctcctgagttgaccgatcacagctctccaaatatgtctgtaaccgattaaatctcncattccagtattgattgcttgacttatggg

SEQ ID NO: 25035 - DNA, 101 bp, rice(Oryza sativa)
  misc_feature (71): n=a or c
gatcgttggatcaatttagtgatctttattgcttagggacactgtgcttgaagcattgctgcaacattacntacctacccttacacataagaagcctcctt

SEQ ID NO: 25036 - DNA, 101 bp, rice(Oryza sativa)
  misc_feature (71): n=t or c
gactgagtggctatcgatgccacgcttttggaggagattggtcatccagcaatgttgctgaaatgcaaacnagaggaaggacttacatttagcaagaccat

SEQ ID NO: 25037 - DNA, 101 bp, rice(Oryza sativa)
  misc_feature (71): n=t or g
atgattgtcgatcattctgctagcttttctcagtgcggtcgatcatgtgcatgaggcatagtcaaatcaancatctcattctaatcttaaagcgtcaccaa

SEQ ID NO: 25038 - DNA, 101 bp, rice(Oryza sativa)
  misc_feature (71): n=a or c
taatacgaacactgatctataagcctgtgcatttaaaggttaaggcacctgtacaaaggcaattccttgtnatctcgaaggatgtaatcctagcatgaaaa

SEQ ID NO: 25039 - DNA, 101 bp, rice(Oryza sativa)
  misc_feature (71): n=t or c
attataacctttggaggttaaccgggaaaaaaaacaaaaacaaacacaccagcaccgcacgctggcagctnctcacacaacccaaaagaaggcgctagcac

SEQ ID NO: 25040 - DNA, 101 bp, rice(Oryza sativa)
  misc_feature (71): n=a or g
gtgagggtgacaccttccgactacgtaattaacaacccaagagacttaccgatggggaggatgcttttcgncggctgccgagcacggaggtgaatttcctc

SEQ ID NO: 25041 - DNA, 101 bp, rice(Oryza sativa)
  misc_feature (71): n=a or g
tgctgctgctccagcgccgagaagttgagtgagctggacgagccattggtgagggagaagaagctgtcacnaattgcagcagctgctggtgtgtggccctc

SEQ ID NO: 25042 - DNA, 101 bp, rice(Oryza sativa)
  misc_feature (71): n=t or c
tttagaactgataaagccagaatcctatttttgaggttagacaccaggaggcgctcatcatctgacaaagncctagtttcctgagctatgtccagctgaaa

SEQ ID NO: 25043 - DNA, 101 bp, rice(Oryza sativa)
  misc_feature (71): n=a or g
attaacttctaaagttaagaacattaagcatcgtcacaaatacatatgtgagagcaacgacctcggccccntctctcacaacgcgttacacaagctcgcag

SEQ ID NO: 25044 - DNA, 101 bp, rice(Oryza sativa)
  misc_feature (71): n=t or c
aagtccacatccggttatgcagtttttctcggtgacaaccttgtgtcatggtcatccaagcgccagaacantgtctctcgctcgagtgctgaagctgagta

SEQ ID NO: 25045 - DNA, 101 bp, rice(Oryza sativa)
  misc_feature (71): n=a or g
accatggtgcggacactgcaagaagctggctccaatcttggatgaggcagctacgacgcttaaaagcgacnaggatgttgtcatcgctaagatggtaattt

SEQ ID NO: 25046 - DNA, 101 bp, rice(Oryza sativa)
  misc_feature (71): n=a or c
agagagagataccagtaggagggttcaaaagctcgagtatagctgttggcattggagagtggggaagcatnttctgccagtatgctgttaccatagatgca

SEQ ID NO: 25047 - DNA, 101 bp, rice(Oryza sativa)
  misc_feature (71): n=a or g
tctggacgaggaaaacattaggccagaaatttgcggcccaaaacatagtgaaagcccagacgagcaaaacngtctgcaaatccgggcaggcggcccaaacg

SEQ ID NO: 25048 - DNA, 101 bp, rice(Oryza sativa)
  misc_feature (71): n=t or c
ccaatgccgatgctgatccatccattcaccaacggactaaccatccattcatttgtctcggacacattganctccatgctgttgggtacatggcaggcttg

SEQ ID NO: 25049 - DNA, 101 bp, rice(Oryza sativa)
  misc_feature (71): n=a or g
gttcccaatgaaagaactgaaggatggtctttgtgttttgttggacgataatgtttgccaactgatgtcanactgtactagtgaagcagaggttgcagata

SEQ ID NO: 25050 - DNA, 101 bp, rice(Oryza sativa)
  misc_feature (71): n=t or c
aagcttcttgcaccgtcgacttcggttgcatatgtcagggatattctagattcgatgaacttcttgttcgngatgccagtcatctttcgttattaaaaaat

SEQ ID NO: 25051 - DNA, 101 bp, rice(Oryza sativa)
  misc_feature (71): n=a or g
tacttccttattcaaagcaagaattacacttcagtgtatgccacatactatttggttggatacataacccncagcaacgcgcggggtatccatctctctct

SEQ ID NO: 25052 - DNA, 101 bp, rice(Oryza sativa)
  misc_feature (71): n=a or g
gccaagtgcatcaaggaagattatgttgacaagttataggcacacacctggcggcaactcgctaaaatgtntactctgcatgtcaagctttgaaagtaaag

SEQ ID NO: 25053 - DNA, 101 bp, rice(Oryza sativa)
  misc_feature (71): n=a or c
agtagagataatacatggtagcttgaggcatcactagcagcagcaacaaacaattctcaacggttatacantatcagtgttgaagggaataccgttaaata

SEQ ID NO: 25054 - DNA, 101 bp, rice(Oryza sativa)
  misc_feature (71): n=t or c
gggtccgtggcccatacacaagtcggattcttagtacagtaaagaatgataattgtaggatcgtaaagggncttttccaccccaaaagctagccattaagg

SEQ ID NO: 25055 - DNA, 101 bp, rice(Oryza sativa)
  misc_feature (71): n=a or g
ggcccgcccggggatttgacacgtgcaacaccaaacgaaggcgatggctggctggcttaagctgcattatnctcgattgattgattgctcgtaatatcgca

SEQ ID NO: 25056 - DNA, 101 bp, rice(Oryza sativa)
  misc_feature (71): n=a or g
tttaagggatgatcacaagcagtatctgcagtcccttaattacctgcttagccgcttgccgaacccggccngccagccagccgccgcctggccatgctgat

SEQ ID NO: 25057 - DNA, 101 bp, rice(Oryza sativa)
  misc_feature (71): n=t or c
aaaaccatcgaagatatcatccaaagtaggatcgggtcctccgtccagagccttgccgagaagctgagtgncaacaaccggaaacacaataaggtctcgct

SEQ ID NO: 25058 - DNA, 101 bp, rice(Oryza sativa)
  misc_feature (71): n=t or c
cttgatcatatcaatcatacttcatcacatattcaaccacaagaggaaaaattacacagcaaaaattatcngtgcatagcaccgcctcctctcgcttcctc

SEQ ID NO: 25059 - DNA, 101 bp, rice(Oryza sativa)
  misc_feature (71): n=a or g
cgcgcttgtggatgcggctcggattcggagtccatgcccagagcaagttcactctcatgtcgccggcttcnacggggtggaccagatcaatctccaccaac

SEQ ID NO: 25060 - DNA, 101 bp, rice(Oryza sativa)
  misc_feature (71): n=t or c
aactcaggaacctaatttgatagaggatcaatctcatgccacactgacatcaagcagaaactaccagttcnatgttcggctagacttgcgggcactccttc

SEQ ID NO: 25061 - DNA, 101 bp, rice(Oryza sativa)
  misc_feature (71): n=t or c
gcggtgcaacgcagcacgtatacggaggagagcttttacaagaaggcagaaggccaccacgcggagctctntgctcttccattgctagttttgcttcattt

SEQ ID NO: 25062 - DNA, 101 bp, rice(Oryza sativa)
  misc_feature (71): n=t or g
ggtggacaaattctccaaatatagtcattttgtaccgttggctcacccctttactgcccttgatgttgcanaggcttatatgcagtacattcataagttac

SEQ ID NO: 25063 - DNA, 101 bp, rice(Oryza sativa)
  misc_feature (71): n=t or c
ggagagaaagaattatacatagatgttacaaaccccatcaagggatgtaaccactcaagacaagaaagaanttcatcgttttttcacacaactcctagggg

SEQ ID NO: 25064 - DNA, 101 bp, rice(Oryza sativa)
  misc_feature (71): n=a or g
tcaacaataccgtcgaaatattctgcttcggagcgatacaagtgattctttcttaagaaacgccggtgccncatgtacactagcttcttcgatcccttaag

SEQ ID NO: 25065 - DNA, 101 bp, rice(Oryza sativa)
  misc_feature (71): n=t or g
cataatggcgacatagattatggatggattattcatgttttatacacttctaaaaatacactttcttctanaactttacattttagtaccaattaaatatt

SEQ ID NO: 25066 - DNA, 101 bp, rice(Oryza sativa)
  misc_feature (71): n=t or c
caactcgccgtggaagtcgccttcagagaaaggttgttcgcggatgatacgacaacaacagaagctctgcnagtggagaggaatgggaagggaaaggggga

SEQ ID NO: 25067 - DNA, 101 bp, rice(Oryza sativa)
  misc_feature (71): n=t or c
atcaataaagctttctggtgccttataatgttcggttgtaaacctggtagacatgttatgatgtgccttanactcgtgttcttcatggcaaattactattg

SEQ ID NO: 25068 - DNA, 101 bp, rice(Oryza sativa)
  misc_feature (71): n=t or g
caccgaggtatactgcttccttaggcacatgcaagccatgcaaccgcacggggcccctaatttttaggtgncccaaaattttatggttcaatataattagg

SEQ ID NO: 25069 - DNA, 101 bp, rice(Oryza sativa)
  misc_feature (71): n=t or c
agcgatcgctcttgcgtagtagattagacccttgtccactgcgcggccttccgtggctgtgaacatcaccnagccaaaaagccagagcaggtacgcctcca

SEQ ID NO: 25070 - DNA, 101 bp, rice(Oryza sativa)
  misc_feature (71): n=a or g
gtcaagattcaaatcggctaccaattgttcaagcaagattgataaagtaaagatttacctgagggataacntcagggaatagatctgtcatgtacatagaa

SEQ ID NO: 25071 - DNA, 101 bp, rice(Oryza sativa)
  misc_feature (71): n=t or c
gaagcaacttggaactgcaaacaaggagcaagaagcattggtagatatctttacagaagaaagagcgcgtngagaccaagaggtggagaaccagcggacga

SEQ ID NO: 25072 - DNA, 101 bp, rice(Oryza sativa)
  misc_feature (71): n=a or g
tagatctagccattggctcgccactatctcatacagacggtggacatgaaattgatgagtaaagaacctanttggaagagaggcattgttatgcagcgcat

SEQ ID NO: 25073 - DNA, 101 bp, rice(Oryza sativa)
  misc_feature (71): n=t or g
aggcagtagctgagggaaatctcatggaattgatatacaggaatatgcttcaagttacagagtatgatganctcggcagggtgaatacttgtggaatgcat

SEQ ID NO: 25074 - DNA, 101 bp, rice(Oryza sativa)
  misc_feature (71): n=t or c
ttctgtgaaatgctataaaaaaaatctgtcaaacttatcacactctggtcagcactcctcagacccaattntagaattcatacatgttaaaattcatgtga

SEQ ID NO: 25075 - DNA, 101 bp, rice(Oryza sativa)
  misc_feature (71): n=t or c
ttctcccacttccaaagctcgccatgctatacgtcgaatgtccgaatcccgcaaagatgctattgacacgnaagctcaagcctctgaagatatagcagctc

SEQ ID NO: 25076 - DNA, 101 bp, rice(Oryza sativa)
  misc_feature (71): n=a or c
ctccaataagaagacctggatcggtcagcttgaatcagtcacccaggacactgtcgtatagtccaactganaatgccgtcctgatttgctctgatgtggat

SEQ ID NO: 25077 - DNA, 101 bp, rice(Oryza sativa)
  misc_feature (71): n=t or c
aaaaacaactccccctcaaatcaaaccataggggtggatcacccctaactcacttcgcaagaactcaaaangagaacgatcaagttgttttgtaaaaatgt

SEQ ID NO: 25078 - DNA, 101 bp, rice(Oryza sativa)
  misc_feature (71): n=a or g
agtgctctagagaacttgtccagatccggtaggcctaaccctctcaagcttttcggtttgcaaacagtctnccaattgactagactatcacttggatttga

SEQ ID NO: 25079 - DNA, 101 bp, rice(Oryza sativa)
  misc_feature (71): n=t or c
gcaactcgtacgggtaagccacccccgcgtacttgttcctctcatggtggcgctccaccgtcatcgtctcnagctcgacggagaagagccacgtcttctcc

SEQ ID NO: 25080 - DNA, 101 bp, rice(Oryza sativa)
  misc_feature (71): n=a or g
gtcgccactgctgctggcctcatggagcacaacacatcaggagaggaagtggatggacgggatgcgcattnggactgcggacgacgatggtgacgacacat

SEQ ID NO: 25081 - DNA, 101 bp, rice(Oryza sativa)
  misc_feature (71): n=t or g
tcgacttattatcttcctcgtatccttttcccatctctctactactttttacacgacaataacacatacancaatagatacagaataattctacaataaaa

SEQ ID NO: 25082 - DNA, 101 bp, rice(Oryza sativa)
  misc_feature (71): n=a or g
gttaaaggaactaaactaaattttcttgttttgagcggcacggcatggaatccggcttcagatgctcagtngaattctttttgcttcgaggggcattgcga

SEQ ID NO: 25083 - DNA, 101 bp, rice(Oryza sativa)
  misc_feature (71): n=t or c
agtagaaaatcctattttaaagcccatcgatttttttttcaatgacaaccgatatatgctttttttttctntactttatcgcttttatcgtataagtccgt

SEQ ID NO: 25084 - DNA, 101 bp, rice(Oryza sativa)
  misc_feature (71): n=t or g
gcaggtaaaccagtccagcgaattaacccgtaaggaactgcagaattacctctcttaatgagttgacgacnaagtatttcttctggaaccacctcagcttc

SEQ ID NO: 25085 - DNA, 101 bp, rice(Oryza sativa)
  misc_feature (71): n=a or g
tcttggttctttatccaacaggggaaatgtgttaaacgactactgctaaaaacatgcacccacatttatcntgtccgtgtttttgctaccagaaatggtta

SEQ ID NO: 25086 - DNA, 101 bp, rice(Oryza sativa)
  misc_feature (71): n=a or g
catttgaagactagattgatatatttttatcttcagatttcatcacaggtgactccctgtcaaggggtatntcatctataaccaacagaataatatctaat

SEQ ID NO: 25087 - DNA, 101 bp, rice(Oryza sativa)
  misc_feature (71): n=a or g
caactgaccacgtgatgtgcacgggacagaattaaaacacaaatgcatgtttattatatgatttatttacnatgttcgatgacatgcctatttcccacagt

SEQ ID NO: 25088 - DNA, 101 bp, rice(Oryza sativa)
  misc_feature (71): n=t or c
tttctttgcaaaagcagcccatagtagccgaagcccaataactgaccggctgaacgccacagttgatgtgngtcctcagaaaagccgatcgaccagctcat

SEQ ID NO: 25089 - DNA, 101 bp, rice(Oryza sativa)
  misc_feature (71): n=a or g
catctctttcagcttctggttttcttcagcaagtttgttctcattgtcactctttgaactataaggagtcncataatctgaagtagtttcttcagcaacct

SEQ ID NO: 25090 - DNA, 101 bp, rice(Oryza sativa)
  misc_feature (71): n=a or g
ttgtgcttaattggacatatgcagtgaaacactgaaagatggtaataagcaaggtgataataagaaagganagaagaagtgagtcgtcgacgacgacctct

SEQ ID NO: 25091 - DNA, 101 bp, rice(Oryza sativa)
  misc_feature (71): n=t or c
cacgtttacgcctgtatatatacggtacatgcatgcatatgctgtcacatactcacatggagtaccactancgaacagtagtttcccagcagcaaaacttc

SEQ ID NO: 25092 - DNA, 101 bp, rice(Oryza sativa)
  misc_feature (71): n=a or g
aacgggatgcctgatctttcgttaggtgaatataactatcaatttggcggaatcttgatatacacaatccnacttccgatcagcaagatccgaaccctgta

SEQ ID NO: 25093 - DNA, 101 bp, rice(Oryza sativa)
  misc_feature (71): n=t or c
tttgaaatatcttacattgtcaaaagggcaaggactatctagcactttgcgagttacttgaactaaacgangtgcatcacacccttccaccatcccacaac

SEQ ID NO: 25094 - DNA, 101 bp, rice(Oryza sativa)
  misc_feature (71): n=a or g
aatgttttgaagcttgccactaccattatacctctctcatttgatactatgcatgtgcggtcaactttttnttgctgttgctcttctctatatgtataggt

SEQ ID NO: 25095 - DNA, 101 bp, rice(Oryza sativa)
  misc_feature (71): n=a or c
agcggtatgaaccaatttttatagtgttgtgatgacgtcattccaattatgcaaatagtatggtacacatntaattaacgctatatttaaaggaactagct

SEQ ID NO: 25096 - DNA, 101 bp, rice(Oryza sativa)
  misc_feature (71): n=a or g
aatcacatacctctagctattgcactatcaaatacatctctagatagttttagcttcatggagttgagctngttgtaatgctctcacaaaataaactagag

SEQ ID NO: 25097 - DNA, 101 bp, rice(Oryza sativa)
  misc_feature (71): n=t or c
tcaggcaaatgtaaatgggcattgaggtgtaatcattgttttcctggttgaaagcagtatgtgaggtgcangaagaaaaattttggtcgttaccacgttag

SEQ ID NO: 25098 - DNA, 101 bp, rice(Oryza sativa)
  misc_feature (71): n=t or c
tgttgcattgcagtagaagaatgcatgataccttcttgggtagttgtcgaggaggacagggacacctgcanggtggccggattcgccatcgtctttgtccc

SEQ ID NO: 25099 - DNA, 101 bp, rice(Oryza sativa)
  misc_feature (71): n=t or c
aattcacaagcctgcaaaatatatcaagagaggaggtcaccagccgatgataggctggattgagccggccnatggttcagtcgaaccctccctggacagtg

SEQ ID NO: 25100 - DNA, 101 bp, rice(Oryza sativa)
  misc_feature (71): n=t or c
cggggccctcactgtccctgtcatctcccagttcttcttatttgggatgctgcgcttcgaattcagctctngccgggtgtcagagaccgtcttgtttggtg

SEQ ID NO: 25101 - DNA, 101 bp, rice(Oryza sativa)
  misc_feature (71): n=t or c
atgtatttgatgggaaaattggtatgttgctctccgtttatgtagaaccagctaacagatcaagcataaanaggtgtcacatcctgatttttgtttcagga

SEQ ID NO: 25102 - DNA, 101 bp, rice(Oryza sativa)
  misc_feature (71): n=t or g
cttcgcgagtgcagttctccctaagaaggcattgtacacagtgccgaactcagcaacatcgaaggtgaccnattctgttccaaagttatcggcctgtccga

SEQ ID NO: 25103 - DNA, 101 bp, rice(Oryza sativa)
  misc_feature (71): n=t or c
ctatctctttcctgcttacattcagacggtcatttttagagttttttttaattcataggatttgaagtgcnagggcattctaagtctctaattatgtaacc

SEQ ID NO: 25104 - DNA, 101 bp, rice(Oryza sativa)
  misc_feature (71): n=t or c
tgattttaggcctatttcactcatgcgagtcagcctaaaatttataacaaaactgctggttgatagattgnagggggtaagtgaaaataagtatggtttca

SEQ ID NO: 25105 - DNA, 101 bp, rice(Oryza sativa)
  misc_feature (71): n=t or c
ccatcaactttccaatcgcccgggtttacctgccatgtagttagaattcatctttaagcaagatgagttanatataactgataagaagccactcaagagtg

SEQ ID NO: 25106 - DNA, 101 bp, rice(Oryza sativa)
  misc_feature (71): n=t or c
aaaccgctcaaactgccccttgagaatctccaccttgaactcgctaacactatccgtaacttcatgcaaantccgaagcgtgtcccaaatcactttggcac

SEQ ID NO: 25107 - DNA, 101 bp, rice(Oryza sativa)
  misc_feature (71): n=a or g
gggcatgccaccagtgcatggtgaagttgtttggcagctgggtggaaagactgggctgagtacgatttcgntggccacagtgtatttggtactggactttg

SEQ ID NO: 25108 - DNA, 101 bp, rice(Oryza sativa)
  misc_feature (71): n=a or c
aggttgacaaggactatgcaggattttcgccaatcctcataaaatccgcattcacggacaaaaaatcgttnttttacatgaacaggagggacctggacaag

SEQ ID NO: 25109 - DNA, 101 bp, rice(Oryza sativa)
  misc_feature (71): n=t or c
aggaagatggttggggtgtatgagctgaagaagggggatttctccatcagggtcaccaactggggagctantatcatgtctgtgattcttcccgactccaa

SEQ ID NO: 25110 - DNA, 101 bp, rice(Oryza sativa)
  misc_feature (71): n=a or c
cggaccgcggttctcatggcccatatgcattatgatgacatcgtgtactatactactgctgttgactttgnttgtgacttcttgtattgacttccaccgag

SEQ ID NO: 25111 - DNA, 101 bp, rice(Oryza sativa)
  misc_feature (71): n=t or c
tcattgtataaaaaaaatcggaccagtggataacccggtcgatatcttggttcacatccacctatccaacngtgaaccaagcggtcgaaccgcggttcaat

SEQ ID NO: 25112 - DNA, 101 bp, rice(Oryza sativa)
  misc_feature (71): n=t or g
caaattatttgttttgttgaatgactgtaggttggacaacaagaagaacaagaagattacggactggcatnctcatcatctccatcttattgagcggtggg

SEQ ID NO: 25113 - DNA, 101 bp, rice(Oryza sativa)
  misc_feature (71): n=a or g
cccgatccgtatccatactacaattctactagtcaaagcgatactgacaccatctaatatcttaactttcntaatatctcgattctattatttattaccac

SEQ ID NO: 25114 - DNA, 101 bp, rice(Oryza sativa)
  misc_feature (71): n=t or c
acaattcagtttttcatccagatattaagaagctgtagttgtggcgtatgttttggcatggctctagcttnaggaggagctagagtccatctaaacagttt

SEQ ID NO: 25115 - DNA, 101 bp, rice(Oryza sativa)
  misc_feature (71): n=t or c
gaacaggcagaacaaagggttctctgtagtttagctgacattgactggatggctaatgtcttgacaaagantgagatgatgaacgagtttgtctctggttg

SEQ ID NO: 25116 - DNA, 101 bp, rice(Oryza sativa)
  misc_feature (71): n=t or g
cttcacgtcagatgatcccaatccggttcgaaggtccgtgatttctagaccctcacatttccttgggtcgntacaccttgggccaagcgacaaggcaattc

SEQ ID NO: 25117 - DNA, 101 bp, rice(Oryza sativa)
  misc_feature (71): n=a or g
tacgtgtcatgaatgcgtccgtattgtggtgcgtcgctgattcaggagtgcgataggcagaggcaggtccncataggcagtcatggcgagccggagcgatc

SEQ ID NO: 25118 - DNA, 101 bp, rice(Oryza sativa)
  misc_feature (71): n=t or c
ccacgtgggttagtttttctttggattatttcccacagctagcgaacaaggccctatttatttaagtattnctcattacacctcccagtcttgatgctggg

SEQ ID NO: 25119 - DNA, 101 bp, rice(Oryza sativa)
  misc_feature (71): n=t or c
tagcttctcctctactattaataccccttctacttctccctcctcatctcattcattactcactcttttantcttcttgacaagagtagaacaacaacaac

SEQ ID NO: 25120 - DNA, 101 bp, rice(Oryza sativa)
  misc_feature (71): n=a or g
tccaatccccacccctccaaaaaaaatccccaaaatcgaaggaacgtgcgggcacggacctggaggttacnagcgagggcgtcgaagtcgatggcgtcaac

SEQ ID NO: 25121 - DNA, 101 bp, rice(Oryza sativa)
  misc_feature (71): n=a or g
tccgaagatgctcatttgcatgtatctctattatctctctatagtgatatcctggatggcaccattagcanattatgtcatcaacagtggtaggtagcatg

SEQ ID NO: 25122 - DNA, 101 bp, rice(Oryza sativa)
  misc_feature (71): n=t or c
cttcagatggaggtggttgaggttgccctcagttggctaaaaacctgcgtgcggcgggtatatatgagctngagctggcatgggtgcttgcacgggatcac

SEQ ID NO: 25123 - DNA, 101 bp, rice(Oryza sativa)
  misc_feature (71): n=t or c
aattactctgaagtagaatgaagcagcatatatgatctgatagctttggttttaccagttagcacatagcncagccctgccggggtagaagtatctgcctt

SEQ ID NO: 25124 - DNA, 101 bp, rice(Oryza sativa)
  misc_feature (71): n=t or c
tataaaaaagaatcctaccttttcaggaaaatggccaggcagatgcgactacaacagctaaaagacatcanaggcaacttctcaaaagagcaggaacttgg

SEQ ID NO: 25125 - DNA, 101 bp, rice(Oryza sativa)
  misc_feature (71): n=a or c
aagaggctcatgcccaggtcaccgtcagattcttcctcgggctcttccttcttctcttcctccttggaagnagctacagcagcagcgccactgtcagcagc

SEQ ID NO: 25126 - DNA, 101 bp, rice(Oryza sativa)
  misc_feature (71): n=a or c
ttgctactgtatataaatgtgcagacaaaatatatgtacaatgatgtattttcaacttgctagttgataanaattttagcagagtctccccgagaaacctt

SEQ ID NO: 25127 - DNA, 101 bp, rice(Oryza sativa)
  misc_feature (71): n=a or g
cttttgatcagctgtacaagtcgtcgtcttctcccaccaattcaattgcctggaaggttaacaagagtcgntattccctttcacacatgccatccattgaa

SEQ ID NO: 25128 - DNA, 101 bp, rice(Oryza sativa)
  misc_feature (71): n=a or g
ttctgcaaggtgattggcaacaagagattttgtagtgccattgatccgcatcaattcttttgaagaggctnaatagtatctctgcagtacaatgtttcatc

SEQ ID NO: 25129 - DNA, 101 bp, rice(Oryza sativa)
  misc_feature (71): n=t or c
ctggtggttcaatgtaggagggtaagagctgcacctgcaccaccttatttaggttgtgtttagttcaagtnaaaattaaaagtttggttgcaattggaaag

SEQ ID NO: 25130 - DNA, 101 bp, rice(Oryza sativa)
  misc_feature (71): n=t or c
tttcaaacacggcatttacttcaatatttgcttcctttttttttgaacaggcacaccaagaattgtccccntcaagtagcctcgtctccgcacttcgctgc

SEQ ID NO: 25131 - DNA, 101 bp, rice(Oryza sativa)
  misc_feature (71): n=t or c
cccgccccctgcccctgctgctgcgccatcgacagaaaggatcactgcaacgaaatcactagttgtattgnattgatggaagcagctgcagggaaggagta

SEQ ID NO: 25132 - DNA, 101 bp, rice(Oryza sativa)
  misc_feature (71): n=a or c
aatcaaagaattcgttaggaaagaaaggaaatacactcaagccgagatcagtcgcttcgttgctcaagttnttcatgtgtaagggtggctttacctccgta

SEQ ID NO: 25133 - DNA, 101 bp, rice(Oryza sativa)
  misc_feature (71): n=t or c
tcagttcgcccgccgtagatcgcctcccctgcgggctgtggttgcgcggcttcgtttgcattttgcgtttngtgatgtggtgggttttgtgggcgccgcag

SEQ ID NO: 25134 - DNA, 101 bp, rice(Oryza sativa)
  misc_feature (71): n=a or g
gtcttaaggtatcaaggactgcagacacctgctatatgctatcgccactaagttaatttcaagctagttgnggattgattttgcaactgaatcaaactaca

SEQ ID NO: 25135 - DNA, 101 bp, rice(Oryza sativa)
  misc_feature (71): n=a or g
ggtattcttataaataagcgttgattgtaagctcaacaatcagtgccaattgttgatatgatccggaactnatgccttcgcaccctggatttttcacaatt

SEQ ID NO: 25136 - DNA, 101 bp, rice(Oryza sativa)
  misc_feature (71): n=t or c
cagcatcaaattaattgtattaaatctaacattctcccaaagtcccttttcacaattgatattgaaaacantgttatgtatttttataaactttgtcaaac

SEQ ID NO: 25137 - DNA, 101 bp, rice(Oryza sativa)
  misc_feature (71): n=t or c
gatgcatgcagtttcaggcgagactctcgttgccaaaatgagacaaaggaagcaaacaatggtcacggccncatctacattttcgtccaccgcagcgagta

SEQ ID NO: 25138 - DNA, 101 bp, rice(Oryza sativa)
  misc_feature (71): n=a or g
tactaactcctcttcatcattgtctgcatatggggttccattcccttcttcatcactagcttgcattgtcngttctgacctctggctttgcaagaaacaat

SEQ ID NO: 25139 - DNA, 101 bp, rice(Oryza sativa)
  misc_feature (71): n=a or g
aaagcgataaaactcgagcatctcattctattttattcttttgggatttaatttagactatctcttgaaancaaaagtttttttttactttctattattaa

SEQ ID NO: 25140 - DNA, 101 bp, rice(Oryza sativa)
  misc_feature (71): n=a or c
atgaggtggagaaaccagctaatggaaatggcactggaattaacaatttgaatactgggatgcagaatganaatggaattgacgtttcaaatcatggagct

SEQ ID NO: 25141 - DNA, 101 bp, rice(Oryza sativa)
  misc_feature (71): n=a or g
atcatctagtataatgtttaacaattgatagtctatcattatcttgtatagcatggcttcaaaatttcatntgctactacatatacggttgaggtggtgca

SEQ ID NO: 25142 - DNA, 101 bp, rice(Oryza sativa)
  misc_feature (71): n=a or g
ctgcgctgttgtggacgagataaaccggaagtacaggctactggactttttggcagttgaagcaatgttgncattggagccggaccttgactctggttaga

SEQ ID NO: 25143 - DNA, 101 bp, rice(Oryza sativa)
  misc_feature (71): n=t or c
caaggtttgatggagaggagagggagaagaaagtacgcacaggagaggagtggagggggaagaggcgccgngagggggaagagggaatccggcccctcctc

SEQ ID NO: 25144 - DNA, 101 bp, rice(Oryza sativa)
  misc_feature (71): n=a or g
tacaagcataggaacatgaaagcgaaaaacatgagttcatatagcaggttcacgatgaggatcttgtggcnctggcggttgcacgccacggacgtcttttg

SEQ ID NO: 25145 - DNA, 101 bp, rice(Oryza sativa)
  misc_feature (71): n=t or c
gtgacagtttaatttgtcactggcattggtattagctatatatttctttgcattttttttgttccatgcangccttattggtatatctctaaaggtgtgtt

SEQ ID NO: 25146 - DNA, 101 bp, rice(Oryza sativa)
  misc_feature (71): n=t or c
actaattttgaccatgagatcaaaataacccttctctcctggccccacacaacaaacaacatcaaacttangtatgtaagtacgcctatcctcctctcatt

SEQ ID NO: 25147 - DNA, 101 bp, rice(Oryza sativa)
  misc_feature (71): n=a or g
gccctggactttatgggcttagcgggagcgcaaaaaaaaaaatgccttgtcagtggccagcctattcacgnaaatccatgcagcccaattcaacggtcctt

SEQ ID NO: 25148 - DNA, 101 bp, rice(Oryza sativa)
  misc_feature (71): n=t or g
attcaggaagaatgctaagttagcagattgtctgccaccacatcctagatagggtcgacgtcgaccccctnaacatcgtggtatgatgccgaggatgagag

SEQ ID NO: 25149 - DNA, 101 bp, rice(Oryza sativa)
  misc_feature (71): n=a or g
actctcagctcttctacctgcccttctgaagaaagctggcgagtctctctccacagagtttagtttcattnggggtattgaacaccggcgttcagagctgt

SEQ ID NO: 25150 - DNA, 101 bp, rice(Oryza sativa)
  misc_feature (71): n=t or c
atgttggttgtcaattaaaatcgacactcatgatgacatcactcatatatgtgttgtttacctaacttttnatgaatttgtagaacttgacaagatctaca

SEQ ID NO: 25151 - DNA, 101 bp, rice(Oryza sativa)
  misc_feature (71): n=a or c
tgcatggttcgaattagaggggtttgatcgtttccgcaatgctcaacatatagaatattggtggccgattnaaaaaaaaaaccaaatttcagtaattttta

SEQ ID NO: 25152 - DNA, 101 bp, rice(Oryza sativa)
  misc_feature (71): n=a or g
attccatcaaggcccccttgtgatgcaagatccaggctcagaagtagaccagattcctgccttcatcttcngtgaaagcagaatagactcaacgcaataga

SEQ ID NO: 25153 - DNA, 101 bp, rice(Oryza sativa)
  misc_feature (71): n=t or c
agctgtactagtgcaggtagtaacagaacgggacgaaagctcagaggagcgtttgtttccaaagaccaggnttctttctgatattctgagctcttcggcgg

SEQ ID NO: 25154 - DNA, 101 bp, rice(Oryza sativa)
  misc_feature (71): n=a or c
attcagacagacagacagacagacagatcaattgcggcattgcatcgttgcgtgtggtaggatcgattatntggatgatcgtcttggcgctgcatcaaaaa

SEQ ID NO: 25155 - DNA, 101 bp, rice(Oryza sativa)
  misc_feature (71): n=t or c
taatgcggtttatgctgctgacataaataagccggtagatcctaactttgcaagagttcattatcgtgtcnagaatgatgaagaattccagccatttgctg

SEQ ID NO: 25156 - DNA, 101 bp, rice(Oryza sativa)
  misc_feature (71): n=t or c
ttcaaaagctatacaaaatgaattcgctgaacatttctaaatggtttgttcctgccaaaatgcgatttggnagttcagttttttttttaacattgtaaatt

SEQ ID NO: 25157 - DNA, 101 bp, rice(Oryza sativa)
  misc_feature (71): n=a or c
attctcccctgccaacaattaataaaacagttttctctgctcaccaccaagaacggagattgcgaaacganagaaaatacaagaaccaccaaaaaagaaac

SEQ ID NO: 25158 - DNA, 101 bp, rice(Oryza sativa)
  misc_feature (71): n=t or c
atggaagacgcccatcaactgcgcctcctatataacaggagcttgcaatggcgctttacaaatgcttacgnagatgaaatgcaatcagttcagaagatgag

SEQ ID NO: 25159 - DNA, 101 bp, rice(Oryza sativa)
  misc_feature (71): n=t or g
ttcttgccatattttatatttgtttaggtgtgttgccaggttttcaaggagacagaagatgagatttgttnactttgatgggttggagttatggaatcgag

SEQ ID NO: 25160 - DNA, 101 bp, rice(Oryza sativa)
  misc_feature (71): n=a or g
aacgcaacccaaataggaatgtgctttacgtcctgtcaaacaagaagaagcatgcccattaatggtaattngcgaatgaaatgtttgatgttgattgcatt

SEQ ID NO: 25161 - DNA, 101 bp, rice(Oryza sativa)
  misc_feature (71): n=a or g
aattacgagaagatgcatatttgaaaataagacagtgacaaggttgctcgtgtagtaactttgacagtganggtattgggaagggagcggcgctcagctgc

SEQ ID NO: 25162 - DNA, 101 bp, rice(Oryza sativa)
  misc_feature (71): n=t or g
ctcgtgagtcctgagtcgtcgtgacaccagataaacgcgctgcacattaatttatcgatctcgcgccgtcncgcgccgctgctactagaggctgccataca

SEQ ID NO: 25163 - DNA, 101 bp, rice(Oryza sativa)
  misc_feature (71): n=a or g
atcaaaatattttcaaccaatgaacttgctataatagagccccttaatccatcgtgagatttatggctatncatgtatgtattttctctttgccaaatagt

SEQ ID NO: 25164 - DNA, 101 bp, rice(Oryza sativa)
  misc_feature (71): n=a or g
cagattgaacccatctgattgctatgctctgaaaaatgacaaaggcatgtttgaatacatcatttgtttgnctgaaatcgaagacaaaattgcctcgatac

SEQ ID NO: 25165 - DNA, 101 bp, rice(Oryza sativa)
  misc_feature (71): n=a or g
tgccttgcattgtaaaatgacattctctgccaatgacaaataatggttggcgcaattcagggttaactctntactctctttaaaacttcagctgttcgtcc

SEQ ID NO: 25166 - DNA, 101 bp, rice(Oryza sativa)
  misc_feature (71): n=t or c
gaggtttaaggttctatcatacaatatactagctgattatctggcccaggagcaccagtttctttatgagngcataccatctttcatcatggattggaact

SEQ ID NO: 25167 - DNA, 101 bp, rice(Oryza sativa)
  misc_feature (71): n=a or c
attatatgttatgataaaaagaacacttttacaatgctcctgatatcaatcagtcccacttagatcccaanaagagggaaacaagaaaatgtacacacgca

SEQ ID NO: 25168 - DNA, 101 bp, rice(Oryza sativa)
  misc_feature (71): n=a or c
atacacatagctatgtattatggtactgcagccaagctcaatccctgattcacatgctacccctttcttgntaatggatattcaatattcaaattggcttc

SEQ ID NO: 25169 - DNA, 101 bp, rice(Oryza sativa)
  misc_feature (71): n=t or c
catgccctcggcccactggagaaggagagcaacgcgttgggatattttcccgcctttgacaccccattctngaacctctccggcttgaatatgtcggcgtc

SEQ ID NO: 25170 - DNA, 101 bp, rice(Oryza sativa)
  misc_feature (71): n=a or g
gaaatatctcggtgaagaagagaggaaggagttgatcaagcatctgctcattaccgtggatcgctatgctntcgaggggttgaagacgatgctcgaagacg

SEQ ID NO: 25171 - DNA, 101 bp, rice(Oryza sativa)
  misc_feature (71): n=t or g
acctcaacagaaagaagcccaaagcccaactagtcactagccagcccgcatttcgccatttccccgcagcngaaaatatcccccaaatccctagctaaacc

SEQ ID NO: 25172 - DNA, 101 bp, rice(Oryza sativa)
  misc_feature (71): n=a or g
ttttgagatgaaatagtatatgatctacaaaattagagtaaacatgatgcactccctaaaaaaaaacatgntgcacgtagagaagcttatgaaatacttca

SEQ ID NO: 25173 - DNA, 101 bp, rice(Oryza sativa)
  misc_feature (71): n=t or c
tgtgtttcttcttaagaaaagcattcaagccagacttccaacacaaggtgcacatcaagttctcggtttangctttccatctcgccttctaggacgtgcaa

SEQ ID NO: 25174 - DNA, 101 bp, rice(Oryza sativa)
  misc_feature (71): n=a or g
aagcgatgatgtggatgtggatatatataatcctactcctactccactattgctagtagtaggagagtacntaggccgcggcgacggcgagagtggcaagt

SEQ ID NO: 25175 - DNA, 101 bp, rice(Oryza sativa)
  misc_feature (71): n=t or c
agaggaatcacctgtcaaaagtagaatgcatatccatctaagtgctacctttgctctggagcctcttcacnttcaaacctcatcttaaatctcatcccaat

SEQ ID NO: 25176 - DNA, 101 bp, rice(Oryza sativa)
  misc_feature (71): n=a or g
cccacctccagcacgtgcggctcaagcgtaatcgctagaatgaccaccggcgtatcaggctgcccacgctnttggacatcctcgacatcaacatctctaca

SEQ ID NO: 25177 - DNA, 101 bp, rice(Oryza sativa)
  misc_feature (71): n=a or c
gactactggatgaaaatttcaggaaatgataaaatgacaattgacatcgaatctctggtaaaggatgtgangatctgctggcagcgtgccgagggagcgaa

SEQ ID NO: 25178 - DNA, 101 bp, rice(Oryza sativa)
  misc_feature (71): n=t or c
gaaggagggagtacatcacaaattatcaaaaaaaatcatcacaaatcctaaaatccggccgcacccaggcngaccgccgtccggccgcacccagccccgcc

SEQ ID NO: 25179 - DNA, 101 bp, rice(Oryza sativa)
  misc_feature (71): n=t or c
gctgggagcagaatcgaacaaaatagatcctatctctgcgtgcgcaagataggaaggcacaagagttgtgnctagtagttatccaattggttagcttttgt

SEQ ID NO: 25180 - DNA, 101 bp, rice(Oryza sativa)
  misc_feature (71): n=a or c
tcactttgtggctcatattctgataatactatcaaggcaatggaaaaggaggttctctctctctctctctntctatctacatgtgtggccccgtaaaattg

SEQ ID NO: 25181 - DNA, 101 bp, rice(Oryza sativa)
  misc_feature (71): n=t or c
tagcagctaataagaattcctgaaacttttatcaatgaaaagctggatgttttaagtatggattgcaatgngagaacatgtgaaaaacataaaccaaccac

SEQ ID NO: 25182 - DNA, 101 bp, rice(Oryza sativa)
  misc_feature (71): n=a or g
tatactcttagagcatatattcctagtggtccatgttatcgagttcctacagtaattaataaggtgctacncaagagagttgtaatgagatgagagatcga

SEQ ID NO: 25183 - DNA, 101 bp, rice(Oryza sativa)
  misc_feature (71): n=a or g
tgtttctctcctctatctcatcacctaatcttatgtgacactcttaggtcccattcgtttctgctcaagtngcgtagctgaatgtggaaaaaaaattaaaa

SEQ ID NO: 25184 - DNA, 101 bp, rice(Oryza sativa)
  misc_feature (71): n=a or c
agttaatacctctaagtttccaacttcttccattggctgtctatttttagggaaggcaggtattgcattgnctcttttaattctatacatgtcagggcttg

SEQ ID NO: 25185 - DNA, 101 bp, rice(Oryza sativa)
  misc_feature (71): n=t or c
attaactcgtggtatccaggttagacgctgctttgcacttgagttatgttgagcaggggctgacgttcgancggatgcagtccaagatgcgtgtcttctcc

SEQ ID NO: 25186 - DNA, 101 bp, rice(Oryza sativa)
  misc_feature (71): n=t or c
ttctcccccgagccgcccatgttagagccatgcgagggatataaagtacgcaaaagttgcaaatgaagatntatctagctatgtattggtgcgataaaatg

SEQ ID NO: 25187 - DNA, 101 bp, rice(Oryza sativa)
  misc_feature (71): n=t or c
aaattcgtcaaccttgtcacaggtattgagcagttttataatgttgatgacatgccattcgaagaagctgngggccggcttaaggcttacgaggaacgggt

SEQ ID NO: 25188 - DNA, 101 bp, rice(Oryza sativa)
  misc_feature (71): n=t or c
aggagtggagcggcagcggccggcgggagaggacagctgccatggctccttcaattaagcagcatcaaacnactgctcaatccccacttcaaaccatgtag

SEQ ID NO: 25189 - DNA, 101 bp, rice(Oryza sativa)
  misc_feature (71): n=t or g
attcttcagttctttttcatcttcttgcttgaattttgtacttcatcattgcagcttttgcctcccattgncttgtccttctgagattttcttttacttgg

SEQ ID NO: 25190 - DNA, 101 bp, rice(Oryza sativa)
  misc_feature (71): n=a or g
tggttgataattatctgcttggtatgtaggtggtgaacagtcaacattaattgagccagtcatctctcctntcatcctagatgtttgggcccaacatattg

SEQ ID NO: 25191 - DNA, 101 bp, rice(Oryza sativa)
  misc_feature (71): n=a or g
ttgaaggggtggacttttcgtactcgtggatgggcctaccaaaatgaggcccaagatggagtttgagatgngcccgtttctgtctccaattccagcccgtc

SEQ ID NO: 25192 - DNA, 101 bp, rice(Oryza sativa)
  misc_feature (71): n=t or g
gtgttcaccagagtttgatatatgaaagaggtggtgttgctgccgtatgcttcgccggacactgacacacnaccaatcacgacgaagcggtaatatggctt

SEQ ID NO: 25193 - DNA, 101 bp, rice(Oryza sativa)
  misc_feature (71): n=a or g
aacccaaacaaagcttcccagttgagcttagcattgcctgaggatgtgcgatatctgcttgaagaatacangacacatggtcgagctgaattttatgtcct

SEQ ID NO: 25194 - DNA, 101 bp, rice(Oryza sativa)
  misc_feature (71): n=a or g
tcaggtatccccccaccccctctttttttttgaaagaatagcaaaccgagttgtatgttatattactaganaagtttaaaaaaacagagctaatattaaat

SEQ ID NO: 25195 - DNA, 101 bp, rice(Oryza sativa)
  misc_feature (71): n=a or c
tatatattgacctgcagagtcgatcgtacacacaaactagctgatgtacagaatcatgttgtatcctgagngccgccaagagaatctcttcctacgggaac

SEQ ID NO: 25196 - DNA, 101 bp, rice(Oryza sativa)
  misc_feature (71): n=t or c
accttttgttgtgtgttcaacagaaagtgaggtcgaccggcggcacggcgagagcaactagaacgttgtgngttgggaaaacagcctgcaacgctgtggta

SEQ ID NO: 25197 - DNA, 101 bp, rice(Oryza sativa)
  misc_feature (71): n=t or c
cgactacgtacacttattcgacacaaactctaacattctcatcgccagcctctctccgccctagtcaaccntgctgatggaggcgccggcgtcggagtcac

SEQ ID NO: 25198 - DNA, 101 bp, rice(Oryza sativa)
  misc_feature (71): n=t or c
aaaaaatcctatagggaaaaaaaaagaatctaataaaaaaaatcaacgagcagttagccccgtcccttgcntaattccatagttttgtcactacgcatagc

SEQ ID NO: 25199 - DNA, 101 bp, rice(Oryza sativa)
  misc_feature (71): n=t or c
acaacgactgttgaagtggcagcttgcttatccaaggggaaccacggaggagtgcatcgagtggatgaagnagtcgcagtcgaaacggcaaaaagtatagc

SEQ ID NO: 25200 - DNA, 101 bp, rice(Oryza sativa)
  misc_feature (71): n=t or c
aacgaccataggaccaaacaacacttcaccgtcatgatctgggtttgtgtgtctactacctttgatgtcantgagctcaccacaaaaatccttaactccct

SEQ ID NO: 25201 - DNA, 101 bp, rice(Oryza sativa)
  misc_feature (71): n=a or g
cgataaagcatagtccgtttcacagaaaatcaaactaaatgtgaataagacataacctagctagtataatnaatctagataacctcttattcagatttgtt

SEQ ID NO: 25202 - DNA, 101 bp, rice(Oryza sativa)
  misc_feature (71): n=a or c
acaacattcaccgtcctggttgtctgtggtgcctttctgccagtagaaacatcagccaacaaaaaaaagtngagaactggaggtgcggggaatcgaacccc

SEQ ID NO: 25203 - DNA, 101 bp, rice(Oryza sativa)
  misc_feature (71): n=t or c
gacttgttgggagtgtagcgtggctctgcccactccgttgtttggagtagcgttcgagtttttctttttcntttttctcttccttgttttttgactttgtt

SEQ ID NO: 25204 - DNA, 101 bp, rice(Oryza sativa)
  misc_feature (71): n=a or g
tttggtgaactcatacaaatcctccaatacatcagaagttgcgaaccaggaaatgcgttacgtaaacgagntggtttctattctaattttgcgtatataat

SEQ ID NO: 25205 - DNA, 101 bp, rice(Oryza sativa)
  misc_feature (71): n=a or g
ataagaacttacttcatatacgttgtcattctggttcttccaagggtcttgcctcatagcatcgtcaggtncttcacacaacaaatattaatcaacaatag

SEQ ID NO: 25206 - DNA, 101 bp, rice(Oryza sativa)
  misc_feature (71): n=a or g
atgtttaaaatcctttcttaaaactgaataaatggaagcaatccatttttatcctctatggacttgttcgntagggctacaacaactaaatgtaactctaa

SEQ ID NO: 25207 - DNA, 101 bp, rice(Oryza sativa)
  misc_feature (71): n=a or g
caacgcacaaaggaatacccatgcttcggaaaatgcacaaacacaatcggaagctacacctgcgaatgccnaccggggactagtggaaatgcaacccagga

SEQ ID NO: 25208 - DNA, 101 bp, rice(Oryza sativa)
  misc_feature (71): n=a or g
aggtgccacaaagtcgtcgtcatcatcatcttcttcttctttatggacttcctttgctggcaaaggcttcntgtcatcctcaagctcatcactgactttct

SEQ ID NO: 25209 - DNA, 101 bp, rice(Oryza sativa)
  misc_feature (71): n=t or c
actccggtggcaaccatcacccatggattgcaacaactgaattgcagaaatcctagccatgtatggttaanattcattttggaatggcctttttcagattg

SEQ ID NO: 25210 - DNA, 101 bp, rice(Oryza sativa)
  misc_feature (71): n=t or c
cactcattttcgtattctaagtccacctcttctaactactactctatcttaaaaaaaagaaagacaaatcncagctacgatcttcgacacaactaggttgg

SEQ ID NO: 25211 - DNA, 101 bp, rice(Oryza sativa)
  misc_feature (71): n=a or g
ccattgatcatggaaacagtatagtgtacgctctaggtattccggaattcaatccccgggtgccaacaccngatctgttggaaagagaattctaagatatt

SEQ ID NO: 25212 - DNA, 101 bp, rice(Oryza sativa)
  misc_feature (71): n=a or g
taggttttcttttaattgcctcccatttttgcagttgatggattggtgaaatgtgagcaatggggtggaanctatggcagcaaactcaatgagttgaagaa

SEQ ID NO: 25213 - DNA, 101 bp, rice(Oryza sativa)
  misc_feature (71): n=t or c
atacgggttatggtacaccagaccaaccaaatgcttggtgctctcagcatgtaaactggagtgtacagtgnagaaaggcttttcacatcccaagcacacaa

SEQ ID NO: 25214 - DNA, 101 bp, rice(Oryza sativa)
  misc_feature (71): n=t or c
tttcaattgttcgaacagtcgccctacccggtctatttaactcaatgggtaaaaattagattctgcctgcntaaggaagttaaagtgaacttaagaaagtt

SEQ ID NO: 25215 - DNA, 101 bp, rice(Oryza sativa)
  misc_feature (71): n=t or c
taatacaacgagctacaacacatgcacatattatttccacctctattgaccaccgtaacaggaccggggtncacgctagaacgaaacggagtaaagcttaa

SEQ ID NO: 25216 - DNA, 101 bp, rice(Oryza sativa)
  misc_feature (71): n=t or g
ttcataattgcccataagtaactgaactttagctttacgcagatagcctttcagaaaagtaggatccaacnctatgcatttatctgcatcttcaagacctt

SEQ ID NO: 25217 - DNA, 101 bp, rice(Oryza sativa)
  misc_feature (71): n=t or c
ttgcatgggctttgcaatacccctgaagaggacatcatattgaaaaacatcttttcaccagaaagagccanggcttctggcaacttgaggggcctccagag

SEQ ID NO: 25218 - DNA, 101 bp, rice(Oryza sativa)
  misc_feature (71): n=a or g
gcgctgctgatttcgctcttgggcttcttgggctttctgctgggcctaattctctctgttttctcgatctnatccatttatttatttagtagatcggtaag

SEQ ID NO: 25219 - DNA, 101 bp, rice(Oryza sativa)
  misc_feature (71): n=t or c
attgagattcatcctcttaattgacgcagtagcaacatcgtcatgcacaacgaaaatttttatcatggatnttgccggccggccgtgacgttgttgatgat

SEQ ID NO: 25220 - DNA, 101 bp, rice(Oryza sativa)
  misc_feature (71): n=t or c
tggatgatagctggattgagagccgtcggatcgaatccaacggatcagattgagtccaggaagagagacangcgggtttgcacgggcgagctcgccgtctc

SEQ ID NO: 25221 - DNA, 101 bp, rice(Oryza sativa)
  misc_feature (71): n=t or c
tccatgaatataggtatgtagtgatctccaaatcaatttttcttcaaaactacttatcaaatcgacaaatnggataagaccgttcaattcgttgtgattaa

SEQ ID NO: 25222 - DNA, 101 bp, rice(Oryza sativa)
  misc_feature (71): n=t or c
ccaaaaatattgacaggaatgtgtccatggcctattggcatttactttgtagtctgttccatctgctaaanaatttttaactcgtcttcgaatctatactt

SEQ ID NO: 25223 - DNA, 101 bp, rice(Oryza sativa)
  misc_feature (71): n=t or c
caaacccgagcagtctggaccaaaggatcaggtatctgaagtcaaccaagatctagagtctcaaattaagngtgtgtcaatttctcctgatgatatactag

SEQ ID NO: 25224 - DNA, 101 bp, rice(Oryza sativa)
  misc_feature (71): n=t or c
ttcgcgctagctcgcacccacccgaaaaaagcgatgtgtgctcgtccgtactgttcttgacggcgagtttngtgctgtggctggctggatgcagagatgcc

SEQ ID NO: 25225 - DNA, 101 bp, rice(Oryza sativa)
  misc_feature (71): n=a or c
aggtgagactgagagtgagagtgagacctcgtcgtcgtctcggcgtccgacgagtgatcgatgacgtcgangatgttggccgccgccgctgccatggaagc

SEQ ID NO: 25226 - DNA, 101 bp, rice(Oryza sativa)
  misc_feature (71): n=t or c
ttgtacaggacagatggcactgttaaacaggacgtacgaagtaccagagtagtacgtaatatatgatgganaccgctaagagcaagtataatagtacaacc

SEQ ID NO: 25227 - DNA, 101 bp, rice(Oryza sativa)
  misc_feature (71): n=a or g
ctgaatggcactcgtagtagcctcaagaaattcctatacaacgcagagaagaagctcattgccagcaactngatcttcacaggactggatcaggaaacttg

SEQ ID NO: 25228 - DNA, 101 bp, rice(Oryza sativa)
  misc_feature (71): n=a or c
gccacaacggtgctccaggagttgttgtcagcggcgacaacggcagcattccaggagttatcggcagtganggcggtgctccagggatcatctgcaactgc

SEQ ID NO: 25229 - DNA, 101 bp, rice(Oryza sativa)
  misc_feature (71): n=a or c
ctgaaatagtagccactgatgcaatacaaggatcatagtggctccctggttctcacttcctagtggggccntgcatttcaacaacgtcatgtcctaactcc

SEQ ID NO: 25230 - DNA, 101 bp, rice(Oryza sativa)
  misc_feature (71): n=t or c
caacatagactatgacacatgtgtgaaaaatataataggagtatagcggttttcatcgctcgctggttagntatcatcttcagccaaatttaaatttcaaa

SEQ ID NO: 25231 - DNA, 101 bp, rice(Oryza sativa)
  misc_feature (71): n=a or g
gtccgtctgctgttggggtctcttcttgccagctccatctcgctactagcggtgtggtggtggtatggtgnccttgtgctccaacctcgaggcacggatgc

SEQ ID NO: 25232 - DNA, 101 bp, rice(Oryza sativa)
  misc_feature (71): n=a or g
gcaacaactactcaccccggtcgcagctcgacaggcccccacgagactcgtagggaccacctatacatttntcgataaattttctattaaaaatttgacag

SEQ ID NO: 25233 - DNA, 101 bp, rice(Oryza sativa)
  misc_feature (71): n=a or g
tggctgctggctgcttgtgtgtgtagggcgtgtatataccttggaattgacgtgtgctctttcgaaacagntgttggtggtgaccacgcacaagggagctc

SEQ ID NO: 25234 - DNA, 101 bp, rice(Oryza sativa)
  misc_feature (71): n=t or c
aagtgccggcacacaaccctgctgcaacatgctctgcacaacttcatcgcccttaccatggttgacctcanctggaggaaggggcaccagagttgagtcac

SEQ ID NO: 25235 - DNA, 101 bp, rice(Oryza sativa)
  misc_feature (71): n=t or c
gctctaagtgcggctccatatttttttcattggttgttggagccgctaacaccactcaggccttgttcggntgcttgggaattaatccccaagggatccta

SEQ ID NO: 25236 - DNA, 101 bp, rice(Oryza sativa)
  misc_feature (71): n=t or g
ccatcgtcatgttgggatccgccgtcgtggtcgtcgatcgaggccaccactgatgtggtcgaagtcacctnggcccagtggtccaacaacggtggatctgc

SEQ ID NO: 25237 - DNA, 101 bp, rice(Oryza sativa)
  misc_feature (71): n=a or g
ttaaaccgaattattgagcaattattaattattttctgaagggataagctcatcgctgacatcagcaaagngccggcgccgacgggcgggcccaatgagtc

SEQ ID NO: 25238 - DNA, 101 bp, rice(Oryza sativa)
  misc_feature (71): n=t or c
tcttggatggaatagcttctctggaacactgccaatgtggattggggacttggtgcagctacaatttctgnagttaagctataacatgttctccggtaata

SEQ ID NO: 25239 - DNA, 101 bp, rice(Oryza sativa)
  misc_feature (71): n=a or g
aaaatcatttgagatttggtacttaagaactgcaaacatgtagagaagagtatgtggaggagaaaagagantcatctataggtgggagaaaggcagtgcat

SEQ ID NO: 25240 - DNA, 101 bp, rice(Oryza sativa)
  misc_feature (71): n=t or c
ggttatcctttgcattgtcaaggacaaggaagaatctcttgttctgtatggtcctggagagatcatgttcngaactagcttggagtgtttccagacccatt

SEQ ID NO: 25241 - DNA, 101 bp, rice(Oryza sativa)
  misc_feature (71): n=a or g
caccacactccttccctcgctaatcttcatagggcctgtttaatcgctacttgacggaagctcgctacttnacggaagctcctatagtctttttatttaga

SEQ ID NO: 25242 - DNA, 101 bp, rice(Oryza sativa)
  misc_feature (71): n=t or c
cagagatgatgctgccaatgatgttggattggggaacctccctctgctcaataccatccatatttggctgnaatgtgggggtgcgacggccaagcaggtgg

SEQ ID NO: 25243 - DNA, 101 bp, rice(Oryza sativa)
  misc_feature (71): n=a or g
cagctcgcgacctgcacacggaaattaataattaaccaagaattacttactgatcagtaattgagcagganttaaatcatcatcaagaacaagatgatttt

SEQ ID NO: 25244 - DNA, 101 bp, rice(Oryza sativa)
  misc_feature (71): n=a or g
cttggtggcgtactatctgaggttgtgggtgcttcctctttgaaaacaaattggctttggctctgatcctnattccagcttgcatctaggcttgtacatgt

SEQ ID NO: 25245 - DNA, 101 bp, rice(Oryza sativa)
  misc_feature (71): n=t or c
gttgtttgtgaacttccaagtaatctgatctggttctctaacgtctaagtgcacatttcggaccacttccnacagtgcggctagctgttcgacaaggtcga

SEQ ID NO: 25246 - DNA, 101 bp, rice(Oryza sativa)
  misc_feature (71): n=t or c
acattgggtgtcaatacaacactctccggctttggtcatgagaatgttgaaaaagtctactcagacaccancacgtatgttgttattagtctcatcaacat

SEQ ID NO: 25247 - DNA, 101 bp, rice(Oryza sativa)
  misc_feature (71): n=a or g
gagcaggttcatggagacccccactagtgagcacatggcggctgtgaaacgaattttgagttacgtcgccngcactctcgactttggttgttgctacaaca

SEQ ID NO: 25248 - DNA, 101 bp, rice(Oryza sativa)
  misc_feature (71): n=t or c
gtagggatatggccaaatagactatttccttgtagcttcagtgttccgagatacttgaagtgatcacccangaactcggggattgggccaatgatatttgc

SEQ ID NO: 25249 - DNA, 101 bp, rice(Oryza sativa)
  misc_feature (71): n=a or g
gtttgggggggggggggggggttgtgacattcttaggccctgtttggggggcttacgattatgagaatctnctagttggtaggtagcttatgagaatctag

SEQ ID NO: 25250 - DNA, 101 bp, rice(Oryza sativa)
  misc_feature (71): n=a or g
tcatgccccgatagcttgttcgacaagaacttgatgatggtgtgtattgtgtcgcccttccccaacttctncaaaattgaaactaagaatcgatcaactat

SEQ ID NO: 25251 - DNA, 101 bp, rice(Oryza sativa)
  misc_feature (71): n=a or g
ccggccggcagcttggttgcgacaatcgaattgagtgcaagagaatacaaaaaattcgcgtctcgtcccgnccttagtgaagagggcatgaggttcctggg

SEQ ID NO: 25252 - DNA, 101 bp, rice(Oryza sativa)
  misc_feature (71): n=a or g
gtagattagatataactactacaaatatgagaacaatgcgtagctgagctagcagggagctatcgggaatncaggttttttcacagttttcttctctctta

SEQ ID NO: 25253 - DNA, 101 bp, rice(Oryza sativa)
  misc_feature (71): n=t or c
agagtgtgcatttggtgttttgcaatctcgttttgccattatacgtatcccagcacatatgtggaaaaaangaactcttggtgagattatgtatgcttgca

SEQ ID NO: 25254 - DNA, 101 bp, rice(Oryza sativa)
  misc_feature (71): n=a or g
tacaaatatttgataaaaaaaattaaaaactttgggtagatttgtgcttgacgggagggccgatattaccnaaatttcaaaccatgtgttacgtatgctgc

SEQ ID NO: 25255 - DNA, 101 bp, rice(Oryza sativa)
  misc_feature (71): n=t or c
atgcgtgacaccacatagaacaaagttcggcttgtctaactggtagaaaatttcacccataagttctacgncatctgttacaaaatataagaatttatgat

SEQ ID NO: 25256 - DNA, 101 bp, rice(Oryza sativa)
  misc_feature (71): n=a or c
tgctctatcaggtaagctaagtttaatgctgttcttgttcttgcagattgttgaagctagagcgatgcttntgcaatgtttgcagcaccagtcaaagtttg

SEQ ID NO: 25257 - DNA, 101 bp, rice(Oryza sativa)
  misc_feature (71): n=a or c
aatctggacatcgatccagttaaaaccaaatttacaacggttcaataactaaaataatcgacatgcagctnttcgccaacttcaggtagaggttcacaaat

SEQ ID NO: 25258 - DNA, 101 bp, rice(Oryza sativa)
  misc_feature (71): n=t or c
tcaacgacatcagaaaggggaaaaaatcgaacttccagacgggcagagacccaaatcatcgcaaggaagcngcacgagcagctcaaaccgcacagaaacgg

SEQ ID NO: 25259 - DNA, 101 bp, rice(Oryza sativa)
  misc_feature (71): n=t or g
tagcgagtagccgatcgagtagtacctaacttggatgacacgcgtgatgcgtgatcgatgccatgcaaaancgatgcaaagccatgcaggattgcagtgca

SEQ ID NO: 25260 - DNA, 101 bp, rice(Oryza sativa)
  misc_feature (71): n=t or c
taacttaacacaaggataatactgccttgcagcagccaactggtaagtcatgtacaagtacacaccactcnggaaacctctcatcatggagaattggcctc

SEQ ID NO: 25261 - DNA, 101 bp, rice(Oryza sativa)
  misc_feature (71): n=t or c
ccccttaattcttaaaattttaagctcttcgaaatagttccgaaggctcttgaacccagaactatgtgacntttcaaaatgtcaaaagttgcaggggcaat

SEQ ID NO: 25262 - DNA, 101 bp, rice(Oryza sativa)
  misc_feature (71): n=a or g
acggccttgggcagtcccacagatggcgtcgtgcacagagtgtacatgctcgccttgttcttgccctgctnctcacgcccctgcaattccttctctgcaag

SEQ ID NO: 25263 - DNA, 101 bp, rice(Oryza sativa)
  misc_feature (71): n=a or g
ccgccgaggaaatcttcgcgatgaggagcgagagcgagagagatgggcgcaatgtggcgtacgtccagcgnatcgatgcgtgggtggatcggtggaccaac

SEQ ID NO: 25264 - DNA, 101 bp, rice(Oryza sativa)
  misc_feature (71): n=t or g
gcaagaaaatttattccctgggcttgaggaccaacagaacattcaaaaagagagtgaagggagagagatantatctcaagatgggcttctcgaagagcatc

SEQ ID NO: 25265 - DNA, 101 bp, rice(Oryza sativa)
  misc_feature (71): n=a or g
catgtgcagttggatcagtatgcttcagaaccatgttatggcagctgactactacttcatcattacggacnacgactgctccaaaggggcctccatcaccg

SEQ ID NO: 25266 - DNA, 101 bp, rice(Oryza sativa)
  misc_feature (71): n=a or g
atggaaacaaggagatggtagcacttggaactatgaacatagcagggtcaatgacatcttgttatattgcnacaggtaactatatcaatttatcagggtca

SEQ ID NO: 25267 - DNA, 101 bp, rice(Oryza sativa)
  misc_feature (71): n=a or g
ttcttggtgctggtgagggcgagtagcaggttgagagatcttgctcttgtttttaagttgaacatgtcctngatcatcgtccatccttctgccgccgtggt

SEQ ID NO: 25268 - DNA, 101 bp, rice(Oryza sativa)
  misc_feature (71): n=a or g
cagccccgtgtcaggtgccaagttccgccagcgataagtaaaaatctcggaaaaagggtggcgatgcaccnagagtagttgtattgatcgagagatagatt

SEQ ID NO: 25269 - DNA, 101 bp, rice(Oryza sativa)
  misc_feature (71): n=a or g
tcgatgttaccgtcattcggtggcttagtaggtgatgcatcatgtgaagaactaccattctcatggtcagngtctttggatatctcagcaggcacggcagc

SEQ ID NO: 25270 - DNA, 101 bp, rice(Oryza sativa)
  misc_feature (71): n=t or c
cctaggtactcacaggcttcatcgcggactggaccatccccgaggatggcaaagtcgaccgaacggacaangagcgatggacaatggccttcgatggagtt

SEQ ID NO: 25271 - DNA, 101 bp, rice(Oryza sativa)
  misc_feature (71): n=a or c
ttgatagactctgtgctattcccgacacatcaaatttgctgaaaaccaagtcaaggcctcctatatcatgnacaaaactatccaccataccaactggcaaa

SEQ ID NO: 25272 - DNA, 101 bp, rice(Oryza sativa)
  misc_feature (71): n=a or g
gtttccagcagatgtactgacaggaaagagaggttgtgacacctgaggggtaacaggtgaaggtactccancatgggccatagggaacgaagtctgaagta

SEQ ID NO: 25273 - DNA, 101 bp, rice(Oryza sativa)
  misc_feature (71): n=t or c
tcctgaatatctccttgacacatcctttacaggcgtcttccaagctgacattgttggctatcatcttctgnacgtcctgcagcacaaactcctaaaaacct

SEQ ID NO: 25274 - DNA, 101 bp, rice(Oryza sativa)
  misc_feature (71): n=t or c
gattagcggcgggaggcagcgcaatacgttttcactcaacgtagacgcatttgcactctccacccctatgnactcaacgtatgatggatgtctatgcttat

SEQ ID NO: 25275 - DNA, 101 bp, rice(Oryza sativa)
  misc_feature (71): n=a or c
gtgcatcacttacagaataccccctccaaaaggttttagacagttttcctgtaaatggacagaggcttcanaaaaggaagcaaatatctttagatatgcat

SEQ ID NO: 25276 - DNA, 101 bp, rice(Oryza sativa)
  misc_feature (71): n=t or c
catgaccaagaagtcaagaagtaaaacctgaatagtaggaatccaaaactcagttcaaccttgggctctgnatcagatgctaccagaataaaagcaattgc

SEQ ID NO: 25277 - DNA, 101 bp, rice(Oryza sativa)
  misc_feature (71): n=t or c
ggggtgattcttttttaaaaaaaaactttatttttcttaaaaaaacaatggtgtgattctctctctctctnttttttaaaaaacaatatgctgtgattcaa

SEQ ID NO: 25278 - DNA, 101 bp, rice(Oryza sativa)
  misc_feature (71): n=a or g
ctgccattagggcactctgtcgaacaggtggtgagcgtcaccttggactgctcatccccaaccaaaaactntaggtcttcagcattcttctggatttcagg

SEQ ID NO: 25279 - DNA, 101 bp, rice(Oryza sativa)
  misc_feature (71): n=a or g
ttgtcgttttggccatcgattttcgagaggaattttgcggtttcggatcggttaaatagcgtagttgattngtgtttgtttgtgagattttgagttgtttt

SEQ ID NO: 25280 - DNA, 101 bp, rice(Oryza sativa)
  misc_feature (71): n=a or g
atttgggggatgaataattgtttctgtataagagtcgtttggacttttcggtcctatttgctaaagcttcnactcctagagtgaaactgtggatgggcctg

SEQ ID NO: 25281 - DNA, 101 bp, rice(Oryza sativa)
  misc_feature (71): n=t or c
attaatttggcaaaatttattacagatccagagatcattgattccagttttgggctacttagagcaggtanaataacaggctataagccagctataaacat

SEQ ID NO: 25282 - DNA, 101 bp, rice(Oryza sativa)
  misc_feature (71): n=t or c
aaaccaagttgagagcagattcagcaccagaaaagagtgtttttatcaggataaaagccacagggcaaagnttgtcatgttgatattttaatgtggtgtca

SEQ ID NO: 25283 - DNA, 101 bp, rice(Oryza sativa)
  misc_feature (71): n=t or c
cttgtgttgttttgtttaccagatgcacaatctaagggagtatctctgatgcaccctccaatcggatcacnggcatcccaatcctgcggtgacttgggaga

SEQ ID NO: 25284 - DNA, 101 bp, rice(Oryza sativa)
  misc_feature (71): n=t or c
agaggccacaggtgtaaatcatttctgtctctgcaaaaagatacacgtcgaacctgtagaaatttagaagnaatgcatgatttcccaacgcaagtatctac

SEQ ID NO: 25285 - DNA, 101 bp, rice(Oryza sativa)
  misc_feature (71): n=a or g
ttaatttagttgatgatccaactaaactaggttgatgatcttgtgtgattttcagaaagttggacgtgggnttgcagggcttcagggcatattttattgtg

SEQ ID NO: 25286 - DNA, 101 bp, rice(Oryza sativa)
  misc_feature (71): n=t or c
aggcgcgtgtccacaaaatgctgattatacaacaagttagtactcctatccagggtttacctttcagtttncaaagtgaaaaccgctcccttccggtttat

SEQ ID NO: 25287 - DNA, 101 bp, rice(Oryza sativa)
  misc_feature (71): n=a or g
gctcgtccaccgccaccgccagccaccgtcctcgccatttgtgagagaaaagagagagataggagataganctgacatgtgggcccaagggcatttttgac

SEQ ID NO: 25288 - DNA, 101 bp, rice(Oryza sativa)
  misc_feature (71): n=a or g
taatttaaggaggagggggttgtcactttcattttagtggtctatttcaggaccataagaagataaggatntataaatatctgtctaaaattattattaaa

SEQ ID NO: 25289 - DNA, 101 bp, rice(Oryza sativa)
  misc_feature (71): n=t or c
aagttcctcacaaacaggcgacagtgtaggatgttcaattcgggcacgagatatttttcttgacaaagtgngcccttcatctttgaaagactcctgcttct

SEQ ID NO: 25290 - DNA, 101 bp, rice(Oryza sativa)
  misc_feature (71): n=t or c
caaaatcatgaactctaaatacaaacacaaatacctgataaaggtcccatcaaatcccacgacttctgttnggcatctctgccgtccagcaagtttcagcc

SEQ ID NO: 25291 - DNA, 101 bp, rice(Oryza sativa)
  misc_feature (71): n=t or c
gtttgactgtctgacctgttctcaggcatagtccagtcgattacaacatcagtgaggacctgggacttaanagctgttcgtggcacaaagtggacatcaaa

SEQ ID NO: 25292 - DNA, 101 bp, rice(Oryza sativa)
  misc_feature (71): n=t or c
agctccacattgggcagagcggtgatggcagcgacatcctctccccttccccatcccacggtgacgagctnggtgcagttgccacatctagcccggtgtga

SEQ ID NO: 25293 - DNA, 101 bp, rice(Oryza sativa)
  misc_feature (71): n=a or c
caagggtcttgattccaaattttctctaggcaattaggcatggatcaatgtacacaaacactcccacgttnaaaaaaaaagaaagttcacaaacactttca

SEQ ID NO: 25294 - DNA, 101 bp, rice(Oryza sativa)
  misc_feature (71): n=a or g
caacatccacgttggatccgcccccagctgcgttcaagttaattagaggaattgatttgagctttttcttncacacataacaagacaagtattgcacatga

SEQ ID NO: 25295 - DNA, 101 bp, rice(Oryza sativa)
  misc_feature (71): n=a or g
gtcctcgattttgattttgacttgctatctctctctatgacggcatggcccacgcagaactagtccaacanagtgggggcaaatgttgagttgaattgttt

SEQ ID NO: 25296 - DNA, 101 bp, rice(Oryza sativa)
  misc_feature (71): n=t or c
caatctaccaagaacaccaaaaacttacaaggccaaatggagatggggaagatcgacgttagcctcctgtntgttgccggtgcatgcccagagaggaggga

SEQ ID NO: 25297 - DNA, 101 bp, rice(Oryza sativa)
  misc_feature (71): n=a or g
tcggggtggagcggtgcacggtggtggggttcagctacggcgggatggtgtcgttcaagatggcggagtcncacccggacctggtcacctccctcgtcgtg

SEQ ID NO: 25298 - DNA, 101 bp, rice(Oryza sativa)
  misc_feature (71): n=a or c
ttggaggtacggacacgctgcgagtcctggtggaatttgaccggtgaatctattatgggagattgagaacnactgcagaaccgggaggctgaaacttgtgt

SEQ ID NO: 25299 - DNA, 101 bp, rice(Oryza sativa)
  misc_feature (71): n=t or c
attaattatatgctaataagatattgttttctgtgtggaggtaattagtttctgacacaaggaaacggggnagcacaaccttgggttgggaacttgaaagt

SEQ ID NO: 25300 - DNA, 101 bp, rice(Oryza sativa)
  misc_feature (71): n=t or c
aatgagctgaatcagtgagcggtattcacttatctacaccattttccccaagaccttggtggcctcatctngtagaagcttccaagcggcatccacgtgtc

SEQ ID NO: 25301 - DNA, 101 bp, rice(Oryza sativa)
  misc_feature (71): n=t or c
ttttatatagggtgataattccattatctaaaaaaatataaggcgataattgagccgtataggatgagaantcgacggtctaaaatgttttagacgaccgc

SEQ ID NO: 25302 - DNA, 101 bp, rice(Oryza sativa)
  misc_feature (71): n=t or c
ttctcaattctcttttgtgtccgttgccattttctttttgagcacgaatatgtatacaaaatgcaggtttnttgagcattgactgcggtctagaggccaaa

SEQ ID NO: 25303 - DNA, 101 bp, rice(Oryza sativa)
  misc_feature (71): n=t or c
ttccgtggttggatctttggctccatagccagggccggggtcttcggatgccttgccttggactcctatcnagagccgccggaacctaccaaagcgcattg

SEQ ID NO: 25304 - DNA, 101 bp, rice(Oryza sativa)
  misc_feature (71): n=a or c
tacccagtagcattgcctttctgtgtgaatctgtaccaacgtattctcggtggagaaaagttgcacaaatntgtttgtagttttgctccttttcctttttg

SEQ ID NO: 25305 - DNA, 101 bp, rice(Oryza sativa)
  misc_feature (71): n=t or c
gtgtcctgccactggcaattatgtgaatctcgactatgtgcattctttggttgatgtccagatgtggagtnagtatgattggtgcacatatgtggcgagct

SEQ ID NO: 25306 - DNA, 101 bp, rice(Oryza sativa)
  misc_feature (71): n=a or g
ggtgcaacgagattatgggttatattgtcattttcaaaaatatcgcgggttatacaacggcggatctaatnggtggtccggtggtccccagaccaccaaaa

SEQ ID NO: 25307 - DNA, 101 bp, rice(Oryza sativa)
  misc_feature (71): n=t or c
gatttcattgcacataccagctagagacacgcgatgcatagtttgcactgctactgccctaagagcaccangcaacaaaggtgaaacatactggaaacagt

SEQ ID NO: 25308 - DNA, 101 bp, rice(Oryza sativa)
  misc_feature (71): n=a or g
atcaccgacttgctccgcctactatggtgacgacacgtactcactagctagaataagcaccccttgacatncaaaaccaaaacaaacatttatattcttgt

SEQ ID NO: 25309 - DNA, 101 bp, rice(Oryza sativa)
  misc_feature (71): n=a or g
gggaccaggggtaggaggcttctttgtagtccacaagctagagagagagagatttgaggaagagggatagngagagagaggtgagagggaaaaagatggaa

SEQ ID NO: 25310 - DNA, 101 bp, rice(Oryza sativa)
  misc_feature (71): n=t or g
gtgaagagcacactggtcatgttcatgccttgacgtccgtgaagatggtgggctcgatgtagtacccgttntcgccgcagggcttccctccggtgaccaac

SEQ ID NO: 25311 - DNA, 101 bp, rice(Oryza sativa)
  misc_feature (71): n=t or c
ctaactcatctgttcatacagtgaagagtttcatgtttagagatatgagtaatgttttgacccattgttgnagttgagcgacagaaaatagctagttcatt

SEQ ID NO: 25312 - DNA, 101 bp, rice(Oryza sativa)
  misc_feature (71): n=t or g
ctcttcctctttttttttttataaaggaaatgtgaagaatacgtatccgcgcatgatgatgaagcccattncgatgcatcaggtttttccccttgctcctt

SEQ ID NO: 25313 - DNA, 101 bp, rice(Oryza sativa)
  misc_feature (71): n=a or c
ttgtttttctattcctactattctgcaacgtcgtctcctttgcaacggctgtttactacgtctacttcctntacatcacgatgtcttccaccgacatcagt

SEQ ID NO: 25314 - DNA, 101 bp, rice(Oryza sativa)
  misc_feature (71): n=t or c
gcaaaggagccctacatcatgggttacagtgttgacaagcgccttcgtcctactgccgagttcctcaagtnggcggtcgggcttgaggggtcaaatcttca

SEQ ID NO: 25315 - DNA, 101 bp, rice(Oryza sativa)
  misc_feature (71): n=t or c
tcttaacttgtattttttttctttcccttttttccctattgttttagcggggatttcgccgaaagtcatgngttcggccccctttcggggattggcgaaaa

SEQ ID NO: 25316 - DNA, 101 bp, rice(Oryza sativa)
  misc_feature (71): n=a or g
tcacaatcactagcagaagtatacttaccatcagcgttcacaaatagagctcgccgatttggacagtcacntgcaatgtgtccaatgccatggcacctatg

SEQ ID NO: 25317 - DNA, 101 bp, rice(Oryza sativa)
  misc_feature (71): n=a or g
agccaagctgagaggagctcaaaagcacaagctgatgctgaagctaagaaggttgctgacaagctcaaggncacaaaattatctggtaattatctggacat

SEQ ID NO: 25318 - DNA, 101 bp, rice(Oryza sativa)
  misc_feature (71): n=a or c
agagcgctcgaggacaattcgcgcctgcaacctgcgcatctttccccgcctccgctcgtactcacaaaccntggctaccactgcagtcatcgctagcacga

SEQ ID NO: 25319 - DNA, 101 bp, rice(Oryza sativa)
  misc_feature (71): n=a or g
agatttgcagtagctggatcaggattcagaacagtactatgagcattagcaaccaatcaatcatcgaatantcatgcatgcacatagtcatatacagtcca

SEQ ID NO: 25320 - DNA, 101 bp, rice(Oryza sativa)
  misc_feature (71): n=t or c
cctcaacccaactcccatccctccccatcagtccgtttcaggtcctcctcccagcccagccatgggttgtngccttcctccagccgccgcctgttcatctc

SEQ ID NO: 25321 - DNA, 101 bp, rice(Oryza sativa)
  misc_feature (71): n=t or c
aagatcattttgttgatatattagatagacaagataaaaaaacatgatatagctggtgaccaagagccgantgaggacatcgataacctgttggaagcacc

SEQ ID NO: 25322 - DNA, 101 bp, rice(Oryza sativa)
  misc_feature (71): n=a or g
gtttatgtacagagggggcagtatactaaggccttgtttagttaaaaaaattgtccaaaaacgttacatcnaatctttggacacatgcatagaatattaaa

SEQ ID NO: 25323 - DNA, 101 bp, rice(Oryza sativa)
  misc_feature (71): n=a or g
agtagtcagagtgagtgatatcctctcgcagctgcaggaaacgggaaacatcatgagcaatccggcaatgngcgccgcgctggaggatctctccgagacgc

SEQ ID NO: 25324 - DNA, 101 bp, rice(Oryza sativa)
  misc_feature (71): n=a or g
tcaagaagagcacggcgaagaagaagaccaaggatatgttattttggctcaagaggagcacgacgaggaanacgaagaagagcatggagaatttcaggagg

SEQ ID NO: 25325 - DNA, 101 bp, rice(Oryza sativa)
  misc_feature (71): n=t or g
caatgtgtgacaaagataagaaaagattagagaggaatatataccaacgtgagtaccgtgcaaagaagaangcggagaaagtcgaagttaacaaatcgagc

SEQ ID NO: 25326 - DNA, 101 bp, rice(Oryza sativa)
  misc_feature (71): n=t or c
atattaccaaatctctgttgcatatggatccactcttggatatcggttttcgcttgaatgccgttttcttntgttattttgttgttcctttttttaagcta

SEQ ID NO: 25327 - DNA, 101 bp, rice(Oryza sativa)
  misc_feature (71): n=t or c
catcttctgcggacacacatgttcgtccatggtgacattattctccattaccaatgctaagctagctaacnagcgcctgtgttcgtctatgtgtgtgtagc

SEQ ID NO: 25328 - DNA, 101 bp, rice(Oryza sativa)
  misc_feature (71): n=a or g
tgactcaatttgtttcaaacatactaggctgtgttcagacgttgaagttgggaactaatgcctcacgcatnaaaaacgaagtgattcatcagcgttatgat

SEQ ID NO: 25329 - DNA, 101 bp, rice(Oryza sativa)
  misc_feature (71): n=t or c
ctctgaataaacgtatctctagtgtagtagtgtatccggtgcggagctagaatgaaattgaggagtgtgtnacttgtttaatttactttatcatggatctt

SEQ ID NO: 25330 - DNA, 101 bp, rice(Oryza sativa)
  misc_feature (71): n=t or g
ctcctcgatcggctcctcgctgcaggccttcctccgccgatcgagagcaatctcctcgccactcgtacgcntccctctgcacctgtgctggcagctgccgc

SEQ ID NO: 25331 - DNA, 101 bp, rice(Oryza sativa)
  misc_feature (71): n=a or g
gcaaataaacaggtcgctaagaatgtttgcgagcagttgctaatttgctagtagttactatttttcaaccncaatttcaatttcaggcactgtgacggggc

SEQ ID NO: 25332 - DNA, 101 bp, rice(Oryza sativa)
  misc_feature (71): n=a or g
accataattggccgcctccaagtatatataaggaggaccgaaaaccctaattcaaggaagaggacgatacnttctacgtgctattcacacgttatgctgcg

SEQ ID NO: 25333 - DNA, 101 bp, rice(Oryza sativa)
  misc_feature (71): n=a or g
ggttgtgtgtgtagaattgtcatcatcattttgtcctggtttggggggtgtcaaaaacgtaattagggacngtcgttgtcctcttgctcgagtgacctcta

SEQ ID NO: 25334 - DNA, 101 bp, rice(Oryza sativa)
  misc_feature (71): n=a or g
acgtgcatcgggcccagaaacctaataattgaggccctagaagatttgttcatcggccaggccttgtttanattcttaaaaaattttggccaaaaacgtca

SEQ ID NO: 25335 - DNA, 101 bp, rice(Oryza sativa)
  misc_feature (71): n=t or c
gtggacggcgacggtagggcggcgatccagtagatgccgccgaggatgcacggcgacgttttggtcttgangaggtagggtgggtcggcgaccggcctcca

SEQ ID NO: 25336 - DNA, 101 bp, rice(Oryza sativa)
  misc_feature (71): n=t or c
tttacaccttggaggacctaaccagacatgcaagtattgtggtgctctcttttggtataaggagcatgtgngtggtcaaggataggcagcttcacgtgtgt

SEQ ID NO: 25337 - DNA, 101 bp, rice(Oryza sativa)
  misc_feature (71): n=t or c
aacccatcgaagtgaggaggtgacgaagtgattccgaacacctgcacgcgtacctcctccaagtcatcttngtcatcaccccgcatccccatcaacctcaa

SEQ ID NO: 25338 - DNA, 101 bp, rice(Oryza sativa)
  misc_feature (71): n=a or g
tcgttattttgctctcttccggcgatcaggcacagcttagtcttcatagctggcgatgcctctgcctcacnaacacaacacttttcttactagtattattt

SEQ ID NO: 25339 - DNA, 101 bp, rice(Oryza sativa)
  misc_feature (71): n=t or c
atttgatttgtcaggtgtaagcatgagttcacactctccctaagttgcgattcagggtgtgtttagttcgngaaaagaacatttttaggtgtcatatcgga

SEQ ID NO: 25340 - DNA, 101 bp, rice(Oryza sativa)
  misc_feature (71): n=t or c
atttcaagaagcagtatgccaaaactgtaaacgttccctgccagtctagcagatattggttcatgatgatnattattcgctgtcgactttttgccgtcgga

SEQ ID NO: 25341 - DNA, 101 bp, rice(Oryza sativa)
  misc_feature (71): n=a or g
tggattgcaaaccaattcgatacaaaggctgaagcattcaaaatccaaggtagctatctgagtctaaccantagggacgctgaacatttgcttgacctgcc

SEQ ID NO: 25342 - DNA, 101 bp, rice(Oryza sativa)
  misc_feature (71): n=a or g
aacaacatttgctgaatatatgcagaaaataagttcatagcctaaagtacgggctagcgagtcgccctcangctggggcgaaaaaggcgcatgggtcctag

SEQ ID NO: 25343 - DNA, 101 bp, rice(Oryza sativa)
  misc_feature (71): n=t or g
atgtgatactagcaaggtatcatccctagtatggattaataaatacatggtaccttaagtatcagaaatgntacccatggagatcggatctggtatccata

SEQ ID NO: 25344 - DNA, 101 bp, rice(Oryza sativa)
  misc_feature (71): n=t or c
ttcaaccatatgtaagatatgtataggcctgacaaatcttggtctgggtttgaccaggcttaggccgtgcngtgccgagcggcccatatggctaactatag

SEQ ID NO: 25345 - DNA, 101 bp, rice(Oryza sativa)
  misc_feature (71): n=a or g
gattattgaccacaatgtgaattgtcccaccagtagtgtagtttggaagagcactgagatgcagggtttcntacactacaccctgccctgagaagcttcca

SEQ ID NO: 25346 - DNA, 101 bp, rice(Oryza sativa)
  misc_feature (71): n=a or g
aaatgtgcaatttgacctcactcaaaggaatcttcaggaaattatatccaataatcgatatggaattatantacgtatatatattcgtctctgaaggaacc

SEQ ID NO: 25347 - DNA, 101 bp, rice(Oryza sativa)
  misc_feature (71): n=t or c
ttggtgggtccaccttatttaaaagtgccacatgttaaattaagagcgtttgtagaaagacatgtggcagnttagaagtgtttataggaagtttaatgtat

SEQ ID NO: 25348 - DNA, 101 bp, rice(Oryza sativa)
  misc_feature (71): n=t or c
aattattacatcaaaataaggtaataatcatagaaaaggagacgctatattttttccttgtaaatacatangtagctttagaactcacattataaatacac

SEQ ID NO: 25349 - DNA, 101 bp, rice(Oryza sativa)
  misc_feature (71): n=t or c
ctggtgaggttcctagttctagttttttccgattcaatcggcggtgagcgatcacacgcccctcccctaanatggctcctcccccttattactgcaccata

SEQ ID NO: 25350 - DNA, 101 bp, rice(Oryza sativa)
  misc_feature (71): n=t or c
ccgaggatgacgacgaggaggccggcttctccaggagctacttcctggccaaggagaaggagccctcctcnggcaagaagcgcgcccgcgccgccggcaag

SEQ ID NO: 25351 - DNA, 101 bp, rice(Oryza sativa)
  misc_feature (71): n=a or c
tctgctactaacaaaagcaatctgaataaattgtttaaactcttccacctggaggtccttaagctactgangatagaaggagaagaacaggcgagcgtcag

SEQ ID NO: 25352 - DNA, 101 bp, rice(Oryza sativa)
  misc_feature (71): n=a or c
aagaagagagagaatatataataaggtacaaacatacccactgtaagggttagcaagcctcatgatcctcngattgtggttatcgacagccatggcacagc

SEQ ID NO: 25353 - DNA, 101 bp, rice(Oryza sativa)
  misc_feature (71): n=t or c
tcttatgaacacgccttcaatgcaaatgcacactgtgccacttatcttaccttgtaaaaaggagtcctccnaatgctgctactacatgagcaacggatgag

SEQ ID NO: 25354 - DNA, 101 bp, rice(Oryza sativa)
  misc_feature (71): n=t or g
cttcgtccccatctcctgcatgtaccagggtaacctggagaagacctccttgggtgcaaagctcgccgtcncaaccggagagggtgtggaggacaaggagc

SEQ ID NO: 25355 - DNA, 101 bp, rice(Oryza sativa)
  misc_feature (71): n=a or g
catggagggagagggtgttgatgtgaagaaacgtactgacgagctgactgaggaactaaatgagaagattnaggagatggaatatatggaaggtctgaatc

SEQ ID NO: 25356 - DNA, 101 bp, rice(Oryza sativa)
  misc_feature (71): n=t or c
tatatgcctaaaaatgtccataccttgtgacaattttgtcatgaaaatgggcttctctcgatcccaacgcnacgtgtagacatccaggtcttcatggtgaa

SEQ ID NO: 25357 - DNA, 101 bp, rice(Oryza sativa)
  misc_feature (71): n=a or g
tgtgctcatgcctgacaagtttccaaatgctggaaaatcattaattgtgtcgaaactagattttggcaatnataaaagggggtggctatcaagctaggaaa

SEQ ID NO: 25358 - DNA, 101 bp, rice(Oryza sativa)
  misc_feature (71): n=t or c
cgatcacatccagctgcgtcaacttttcgtacgtatggaagtggattttttttctgtcgaggggatgtccnctcattttgtgcaaggtgtttaaaaagtta

SEQ ID NO: 25359 - DNA, 101 bp, rice(Oryza sativa)
  misc_feature (71): n=a or g
ccacggattgccatcgctcaggtatccgacctccccgccaccggatccacatgtcgccaaggtctccgctntcggatccaccataactgaggtcccagcat

SEQ ID NO: 25360 - DNA, 101 bp, rice(Oryza sativa)
  misc_feature (71): n=t or c
gcatgtggatctcctacacggctcggtggtggatctgcaagagaagatggagaaattgcagtccgtggttnaggatccttcccgtgaatgttctcctgctc

SEQ ID NO: 25361 - DNA, 101 bp, rice(Oryza sativa)
  misc_feature (71): n=a or g
tttttggtttgctagaaactgactctctaaatatatttatctataatactatggatcactgagcacctggnttaacttttctcacatattcccttcgtatg

SEQ ID NO: 25362 - DNA, 101 bp, rice(Oryza sativa)
  misc_feature (71): n=t or c
accttggttcctgcattaaaagactacccagtaagcggtagatcctgtacaggaaatagacagacattgcngtacacaatgatggctgagataaaacgtat

SEQ ID NO: 25363 - DNA, 101 bp, rice(Oryza sativa)
  misc_feature (71): n=t or g
ctgaagtcatagttgcaacagcaagaactcctgatgctacagcagtatcggctaatgttgtcgttgacganagacagatgaatgcattgtttcttgatctg

SEQ ID NO: 25364 - DNA, 101 bp, rice(Oryza sativa)
  misc_feature (71): n=a or c
gtggagaaaagaaaactagcatgtcctttgtggtctatatggtgaggaaaaaacacatcatcacgactcangcgccagtatatactctcgtaagctaacac

SEQ ID NO: 25365 - DNA, 101 bp, rice(Oryza sativa)
  misc_feature (71): n=a or c
tcaattttgcatatttgatccgacatacatgattctatattatgcatggcaggtagtatgggggtgatccnatttaaaactctgataaacttatgtgggac

SEQ ID NO: 25366 - DNA, 101 bp, rice(Oryza sativa)
  misc_feature (71): n=t or g
agtaccagtaagaaactagggtggcccattgagattcagcaacagttttgggcacagtttgcaatgctcgntccataggtaagttaggcttgtaatagccc

SEQ ID NO: 25367 - DNA, 101 bp, rice(Oryza sativa)
  misc_feature (71): n=a or g
aaagaatcgtgggcagactgccgtgttaacggctggtgagccggctgaactttagagaaggataatagtanactataaatcaactataagcttattatgtg

SEQ ID NO: 25368 - DNA, 101 bp, rice(Oryza sativa)
  misc_feature (71): n=t or c
ctaagggggcatccggtcgttgccgcgcgtgatttgtgcttctactgtcactaccagtaaatgatttttcnatacgaggaccaatcttaactaaatctgta

SEQ ID NO: 25369 - DNA, 101 bp, rice(Oryza sativa)
  misc_feature (71): n=a or c
gatccaaatgccgcaacagaaacctccaattccccctcaaattcaacagaaacaacacgccttgacagctntatcatgccatcggcagtgacagacatctt

SEQ ID NO: 25370 - DNA, 101 bp, rice(Oryza sativa)
  misc_feature (71): n=t or c
aaggaccgtgtgaaaaataaatctgtagcaagtggttctgctcagatgtctggtagttcaaggaagcgggnaagaaaggggtggactacgctgaaacagat

SEQ ID NO: 25371 - DNA, 101 bp, rice(Oryza sativa)
  misc_feature (71): n=a or g
attgctggaatgggtttcacgcagaattccaacaagatgggcctattcacattacattagcttgggtaaanaggaagcaaagcacaaatttaatggatcag

SEQ ID NO: 25372 - DNA, 101 bp, rice(Oryza sativa)
  misc_feature (71): n=t or c
aagacgacgatgatgatgcagaaaaagaatgccgtccctgcttcttgccggccaccaccatctatacagancgatcgatcactatgcaattagctactgct

SEQ ID NO: 25373 - DNA, 101 bp, rice(Oryza sativa)
  misc_feature (71): n=t or c
agctcctcagcttacacttatctatctgtccttcctgtttgcttttcaggggaaagtgataacagctcgcngtgccctccattgcaagaattactgataac

SEQ ID NO: 25374 - DNA, 101 bp, rice(Oryza sativa)
  misc_feature (71): n=t or c
tggtaaatcacaaattttcagcagaaacaaggggagatgatttaatttaccttcttctggaggaagcaagnttgctatgcattgctcatactcttccatgt

SEQ ID NO: 25375 - DNA, 101 bp, rice(Oryza sativa)
  misc_feature (71): n=t or c
atcgggaatttcggcagaaatgaagccatcaataatgggcacgctaaattcagcatttgctgcagcaagcnagataaggcaatggatatggggaagcccac

SEQ ID NO: 25376 - DNA, 101 bp, rice(Oryza sativa)
  misc_feature (71): n=t or c
aagcgccgctcaggaggcgaattggaagaagcgcgtttgctgggccaatcaaaattaattgaggctgccangggagatcaacgttatatataagggcaatt

SEQ ID NO: 25377 - DNA, 101 bp, rice(Oryza sativa)
  misc_feature (71): n=a or g
tgggttctcctaaaagctaactttttggcttccactacaagttgctggcttacgctgcaagcttccttccntgataagatatcttttggtttcttctggcg

SEQ ID NO: 25378 - DNA, 101 bp, rice(Oryza sativa)
  misc_feature (71): n=t or c
tcgtcgggatgggatcaccatagcagcaatagaaatggaagtggatgaaaaaggagtgcattctctcacgngggagatcgaatcaattctccttttatagg

SEQ ID NO: 25379 - DNA, 101 bp, rice(Oryza sativa)
  misc_feature (71): n=a or c
aacattatcgatacttaagagttatttcatggtactccatgatgatacgtatgtatatgtacaagttgagntactgttaattgggttggattataaaatct

SEQ ID NO: 25380 - DNA, 101 bp, rice(Oryza sativa)
  misc_feature (71): n=t or c
ttctcctgcaccgaattttggttcgagagatcatccttcttgtcagccagagcattttgtatagctgccangtaagcttcagccacatcggatattcctac

SEQ ID NO: 25381 - DNA, 101 bp, rice(Oryza sativa)
  misc_feature (71): n=a or g
ctgtatatgggaagctgctgttggaagttcatgattaaggaataaatcccagtgtcgtttgtgtggatctnctgctgcggcatttcagtgggggcacccga

SEQ ID NO: 25382 - DNA, 101 bp, rice(Oryza sativa)
  misc_feature (71): n=t or c
atcgctatacttggcattaacaattttgcgtccattctcttcaacattggcaggacggccatcgccataangagcaatgaactcagttgcagccccattct

SEQ ID NO: 25383 - DNA, 101 bp, rice(Oryza sativa)
  misc_feature (71): n=t or c
tcaccatctctcccttcccaaatcccttcactcacaccacaagcatccttctactctcccttcctagatcngagaggtgcggcagtagaggataggtgcgc

SEQ ID NO: 25384 - DNA, 101 bp, rice(Oryza sativa)
  misc_feature (71): n=t or c
cggggagtcctgtcagatccatctcagactcttgtggccgtcaagaaaattcagaggatgtctgaagcagngtggcaggaattcgtggcagtgataaccat

SEQ ID NO: 25385 - DNA, 101 bp, rice(Oryza sativa)
  misc_feature (71): n=t or g
gatatgtggatctatttccaaattgacatacagtgactacaatttcattcaagataagggtgatttctcanatcaaatcaaatattaacctttttgttgct

SEQ ID NO: 25386 - DNA, 101 bp, rice(Oryza sativa)
  misc_feature (71): n=t or c
ctcctgctccaccacgcggctgcctcctcctctctctcctcctgctccaggctactggtaccaggtatcangggtatcaggtaccatgtatcacgggtacc

SEQ ID NO: 25387 - DNA, 101 bp, rice(Oryza sativa)
  misc_feature (71): n=a or g
aatgtagtttctcatttctacaattcgtgcccttcggaatattggtgcttcaagggcaaaggatacttccnttgataatattgagtctgatgattccaaca

SEQ ID NO: 25388 - DNA, 101 bp, rice(Oryza sativa)
  misc_feature (71): n=a or g
gtaccaagtaccaactaccaagttccaatattaattcgattcttatgttgaggcgcggccaaactgccgcnggatcatccttctgccaccggagactcccg

SEQ ID NO: 25389 - DNA, 101 bp, rice(Oryza sativa)
  misc_feature (71): n=t or c
gaggtttttagtagtgatgcagtcattcaaaaagataaccttgtgctggtccttttgcctttcggctgcanttgcatgtgcgttttctcagagatgctgca

SEQ ID NO: 25390 - DNA, 101 bp, rice(Oryza sativa)
  misc_feature (71): n=t or c
tggtaccccagttttgtggacaacccatgaatttgtctaacctccattgtgctctcagatactactaaganactaattaatgtagtgctgtcaggagatac

SEQ ID NO: 25391 - DNA, 101 bp, rice(Oryza sativa)
  misc_feature (71): n=a or g
gatcaaaagcaagcgatcttgtctaatgttctttaatttacctcgagcagaccgtggggctcgagcacatnagccgtcgcggcgccaatggcgccgtaggg

SEQ ID NO: 25392 - DNA, 101 bp, rice(Oryza sativa)
  misc_feature (71): n=a or g
ttcatcaggactaaaatttagaacaaaaggcccaccatttgtgagttagaaatgctagatcctaaagaccntgcactgggtaaaaaatggccagagcatat

SEQ ID NO: 25393 - DNA, 101 bp, rice(Oryza sativa)
  misc_feature (71): n=t or g
attgtgtcaatttggtctcccctgatcaatggttttatactatttgcagccaccgtcaatgaacttgactnagtatgttctagtgaattctcccaattctc

SEQ ID NO: 25394 - DNA, 101 bp, rice(Oryza sativa)
  misc_feature (71): n=a or g
taacattctaacttcaacccgttttcttttcggcagaaaatcatctcctgaatttggaattaagcttgtgnatgggcggatctttggtggactctagcgcc

SEQ ID NO: 25395 - DNA, 101 bp, rice(Oryza sativa)
  misc_feature (71): n=a or g
ccagtaggatagatagtcccttgcagatcggcagaatgcatagaacactgttcgaagagagaataaagcangaaatacatgtagttcacttttgaataaat

SEQ ID NO: 25396 - DNA, 101 bp, rice(Oryza sativa)
  misc_feature (71): n=t or c
cacacgaatatgggaaatatagatcatgaaaacgtcatacatagctcgatagttttcttcttttactagangtgcttttatctgtaaatgcaaagctagct

SEQ ID NO: 25397 - DNA, 101 bp, rice(Oryza sativa)
  misc_feature (71): n=a or g
atttttggacactcagattgttcatcacttgcaaggagtagtgaagcttcctgttcctgttaaggttacgnttgctgatggggggcttttacagtgtgaaa

SEQ ID NO: 25398 - DNA, 101 bp, rice(Oryza sativa)
  misc_feature (71): n=t or c
tagaaaacgacgatgtcccatgaaagaatacttgcgaccatgtatcaaacgtttagaacatgtttcatcangacatgtaatacatgcaaattcaccattta

SEQ ID NO: 25399 - DNA, 101 bp, rice(Oryza sativa)
  misc_feature (71): n=t or c
gagaggcctctggcctttgacttctcttgcagttcagcccagtttagttcagttctgtgacagtgtgatangcagttcagttcagggaggaagagaagagg

SEQ ID NO: 25400 - DNA, 101 bp, rice(Oryza sativa)
  misc_feature (71): n=a or g
gcagcaaaaagtggctgcaactttcaagttggtcaaatgatgaactgaaaatggtatatacaaagtttagngttaaataattttttgttccaaactttagg

SEQ ID NO: 25401 - DNA, 101 bp, rice(Oryza sativa)
  misc_feature (71): n=t or c
ggagcttgatgctgcccttggagggcgtgctgtccagtacagggaagtacaaggcggtgaaactgaaaagnttctctcctattttagaccatgcatcatgc

SEQ ID NO: 25402 - DNA, 101 bp, rice(Oryza sativa)
  misc_feature (71): n=t or c
gagaaagatttttcatttgaatcatacaaaaaagtttgagctatcctaaactgttgcagaatgttatttgnttcataggaagtgatgaggaagttgttggt

SEQ ID NO: 25403 - DNA, 101 bp, rice(Oryza sativa)
  misc_feature (71): n=a or g
tactgatcaaccaacaatcaacaccataactgataaaacgtacgtagtacctgaaactgaaggagacatanaggtaatatagtgatcaaagacacttattt

SEQ ID NO: 25404 - DNA, 101 bp, rice(Oryza sativa)
  misc_feature (71): n=a or g
taaaaatataactgcatctgatcaggactccgagagtctgagccttgtgaccactgatcagacatgaagtngtagtagtatgacatatcggcttgtgaacg

SEQ ID NO: 25405 - DNA, 101 bp, rice(Oryza sativa)
  misc_feature (71): n=t or c
acagttagctgctctagtcgctacaaatgagtctaggaggattctaggacaacccgaaccttccttagagnatgttaaggcgatcaccatgagccggggaa

SEQ ID NO: 25406 - DNA, 101 bp, rice(Oryza sativa)
  misc_feature (71): n=t or c
tcttcctgctccaggaagttcatcatgaaagtgttgaggctatccgtccttcgggattttactttgacctnctttggtttggtccgttcttgatctacccc

SEQ ID NO: 25407 - DNA, 101 bp, rice(Oryza sativa)
  misc_feature (71): n=a or g
gatgaatttgggggtaatacagaagcagccttgccgcatggaagggaagagactttcaactacatgcacanttcactgtgtaacacagtggaaagggcatt

SEQ ID NO: 25408 - DNA, 101 bp, rice(Oryza sativa)
  misc_feature (71): n=t or c
acaagcaagaatcgggatcttgcctactagtcgtatgtgaatcgcatgtctctattgattgttgctcatangacatgcctaaaaaggcttgcttaattaac

SEQ ID NO: 25409 - DNA, 101 bp, rice(Oryza sativa)
  misc_feature (71): n=t or c
tgaggctttagtgtctatcaagtctgctttcaattggcaccaccagtttttgcagctattagtacagtacnagagcctcatgcagctcaagagtttacatc

SEQ ID NO: 25410 - DNA, 101 bp, rice(Oryza sativa)
  misc_feature (71): n=t or c
tccaagaaacgtgcgggcttcgagggcttccatcttctaccaggagccggttgaaaggcgggattcctctnccccttctcggcggcggccggtgattcgcg

SEQ ID NO: 25411 - DNA, 101 bp, rice(Oryza sativa)
  misc_feature (71): n=t or c
tgatggggcgctcattggcgttgatgtcaacaatgacaacacaactcatggcttccctatggtggaggtgnaggtgccagcctatcagaccccctctcgtc

SEQ ID NO: 25412 - DNA, 101 bp, rice(Oryza sativa)
  misc_feature (71): n=t or c
accttcctcctcttgcagctcatcatcaccatggttgtcaagctcaaattcgccgaaaaaaaagagagtanggcagaacgaagttgcttgtatatcaggac

SEQ ID NO: 25413 - DNA, 101 bp, rice(Oryza sativa)
  misc_feature (71): n=a or g
ccggccttaatggaggtagcactctgtgcatcctttgttgccattctgctaaccaccatgctcttcctaanagccatctcgacgaggtgccgccgtcgaaa

SEQ ID NO: 25414 - DNA, 101 bp, rice(Oryza sativa)
  misc_feature (71): n=t or g
tgatctcaactaggcacgtccttccccgttccaatttaccgacttatccagacacgcagtgtttggaaaangtctaagggaaataatttcccacccatctt

SEQ ID NO: 25415 - DNA, 101 bp, rice(Oryza sativa)
  misc_feature (71): n=t or c
ggaggaacacatggtgaatttcttggtcactttcatgtaagaggtgatggacaaaatttgtgtgattaacnaaaacaatttttgcatttaaaataggtaat

SEQ ID NO: 25416 - DNA, 101 bp, rice(Oryza sativa)
  misc_feature (71): n=t or c
aaagttcttaaaagacgtaccgtttagcacttgaaaataagtgttaacgaaaactaaggtaaaatcatcancttaattacctttcatgaagatgaagataa

SEQ ID NO: 25417 - DNA, 101 bp, rice(Oryza sativa)
  misc_feature (71): n=t or c
gtgccgtcatgccgttagtctagagctttcttcgtcttttttttttcttaatccatatttgacttggatgntgttttcgttttgaaaattggaactgtagc

SEQ ID NO: 25418 - DNA, 101 bp, rice(Oryza sativa)
  misc_feature (71): n=t or g
tacgcaaaaaacacgcgtacacttacatctataagcacacacgcatgtgtcgtcccatacgccctcggaanactcgccatcgccggtacatcatataccac

SEQ ID NO: 25419 - DNA, 101 bp, rice(Oryza sativa)
  misc_feature (71): n=t or c
tatgcacctattaaaaaaacgaaaaagtacgttttacccctgtactattgcggttgaccgaaaaacccccngaactcgaaaaccggtcatttcgtaccccg

SEQ ID NO: 25420 - DNA, 101 bp, rice(Oryza sativa)
  misc_feature (71): n=a or g
agttaacggttaaagtttgcacttatcgaccatcaacactctctccggaggactaacacatgtgaaggganagagttgccaccagcattgctacaccaggc

SEQ ID NO: 25421 - DNA, 101 bp, rice(Oryza sativa)
  misc_feature (71): n=a or g
agagaggtgcaatggtgtgggtttaatgtccaagtattcggttactctatgtcgggagctcagatgtagantagtatttaataatgtaagcgtggtgctta

SEQ ID NO: 25422 - DNA, 101 bp, rice(Oryza sativa)
  misc_feature (71): n=t or c
gctgacatggttgatttgtttctgccaaacagcaatgtcacccatctgctgcaccttggtccagcaaaggntcttggcaatggcctcaatggccgattgct

SEQ ID NO: 25423 - DNA, 101 bp, rice(Oryza sativa)
  misc_feature (71): n=t or c
agtgagatcgatattcatacacaagtcaacaaacagcaggcagtagaactgaccatccgatgaagacaatncagttgtagaaagagaggtagagcctccgc

SEQ ID NO: 25424 - DNA, 101 bp, rice(Oryza sativa)
  misc_feature (71): n=a or g
gggtgaccttcgtgtacaagtatcacttggtgaaacagtgcaaattaagcaaatctacaggttatgtaacnatgcagccttttatgctcgtactgagctgc

SEQ ID NO: 25425 - DNA, 101 bp, rice(Oryza sativa)
  misc_feature (71): n=t or g
attaattcaaagctagcaaagcaaacatctccgtccgttgctgtaattaaattaaccgcgtgatcatactncaccacagcacatccgtgagcagtactccc

SEQ ID NO: 25426 - DNA, 101 bp, rice(Oryza sativa)
  misc_feature (71): n=t or c
tcagcaaacaactctcttattttggtgtgcacaactgttagatacccgggggcaatattctcctagctttngctgctcatatgcactaatgcagtccccct

SEQ ID NO: 25427 - DNA, 101 bp, rice(Oryza sativa)
  misc_feature (71): n=a or c
cgatttccggcagcggcaaggcagaggtggagggaggatagtggcggcggctaatgtttggggcactcctnccgtcgtctgcacggggtgacacaagaggc

SEQ ID NO: 25428 - DNA, 101 bp, rice(Oryza sativa)
  misc_feature (71): n=t or g
aactgttatgatatctggagcattgaccggtgtgttgaccaccgttgataggtagggcttgatgacttgtnggatcaagaagtttgactgaatgtatatta

SEQ ID NO: 25429 - DNA, 101 bp, rice(Oryza sativa)
  misc_feature (71): n=t or c
caaccatcacctgtaatcgcagatagcaaattgttgcaatccacgtgttcaccatcgcacaaagaatctantatttgaacccccatgtcgctgttcaaaga

SEQ ID NO: 25430 - DNA, 101 bp, rice(Oryza sativa)
  misc_feature (71): n=a or g
accgcacagggttcaaagttatggaaatttcggtcatattggaaccccacacacaccctacccccgatatnatattatttcggctaaaaagattgtttttt

SEQ ID NO: 25431 - DNA, 101 bp, rice(Oryza sativa)
  misc_feature (71): n=t or c
caaagagctttgcaactccttttcctcagctgcattattgtatattggtagttctatctcgatctccatgngcatgcatgattcgctgcacgcatgtgaga

SEQ ID NO: 25432 - DNA, 101 bp, rice(Oryza sativa)
  misc_feature (71): n=t or c
accagagtgatgcttagctgcttgcaccattacttaccacaacgacaaagttatccctcagcgactcttcntccaactcttcgaaatagtgcttgaacacc

SEQ ID NO: 25433 - DNA, 101 bp, rice(Oryza sativa)
  misc_feature (71): n=t or c
taaatatatgcaacaaaatggcaggaagataaagaagctcttacccaaattgctcttgctgcactgctaangtccagcttctgacggcgcagaccaattgg

SEQ ID NO: 25434 - DNA, 101 bp, rice(Oryza sativa)
  misc_feature (71): n=t or c
gagggcatttcttttcatactgttgaagaaatctaatgctcctttcaaatcaccaatgcagcaaaggccanggatgagaacattgtaagagattgttgatg

SEQ ID NO: 25435 - DNA, 101 bp, rice(Oryza sativa)
  misc_feature (71): n=a or g
cgtgccgcaccaaggcagccaccgcacttcctcaaaacaccaccgaagcaacctcttccaccatcaacctnaggccgttgccatattcgccacctcaggcc

SEQ ID NO: 25436 - DNA, 101 bp, rice(Oryza sativa)
  misc_feature (71): n=t or c
acccatcacggactcatcggaagactcatccgagctgagcgccgcgcccgaagcatcgtacctgatcacantgccctcatgctccagcacgaagccgccat

SEQ ID NO: 25437 - DNA, 101 bp, rice(Oryza sativa)
  misc_feature (71): n=a or g
tgcatctcgtctcttctccttgtcttcatcatctcctacatcttccaacctctgctcgatgctcgccgccnttttccgccaggacctcaccggctgccggt

SEQ ID NO: 25438 - DNA, 101 bp, rice(Oryza sativa)
  misc_feature (71): n=t or c
ccatcttataatgagggacatatacgttattttacctttctcctaatttgtgcttcgactcctagaattanagatattttggaacggaggtattccgtcta

SEQ ID NO: 25439 - DNA, 101 bp, rice(Oryza sativa)
  misc_feature (71): n=a or g
gggagttattcacactacttttcctccactggaaagctcaaggaatgcttgcttgatggactgtagttcantagaaacttgtgccatccctaaccggtctt

SEQ ID NO: 25440 - DNA, 101 bp, rice(Oryza sativa)
  misc_feature (71): n=t or c
tgaagcgaatattcgtgttggcaattcgtattaacaggctatgataatactactgctgatgtacaaggcanactagtatcagacagagggtatgtctgccc

SEQ ID NO: 25441 - DNA, 101 bp, rice(Oryza sativa)
  misc_feature (71): n=a or c
aacaacagctttcttcgcagcatcttttcttttggttaagatgcagacgggcctcgtcaataacaacccanccaataacatcgcctctacacaacgggcaa

SEQ ID NO: 25442 - DNA, 101 bp, rice(Oryza sativa)
  misc_feature (71): n=t or c
ttgttatcagatacctaagatggaagacattgctcctgcccaatccccagtgtttacagcaaattatgtancggaacactctaggaacgtaatgcactcac

SEQ ID NO: 25443 - DNA, 101 bp, rice(Oryza sativa)
  misc_feature (71): n=a or g
aggctccaaggaggcaaccaaacactgccttggcgaggaaggcatagcgcagcagaggcctacttcctccntcaaaaaaaaacttaattcagtataggatg

SEQ ID NO: 25444 - DNA, 101 bp, rice(Oryza sativa)
  misc_feature (71): n=t or c
atatgcttatcttcctcgatagcctaatatcagttcccgttttgctctgctcgctctctactctgtttcgnctgtcgtaaccgtcggtgtgataaaggtac

SEQ ID NO: 25445 - DNA, 101 bp, rice(Oryza sativa)
  misc_feature (71): n=a or g
acccctaccttgagttgagaaggctgacacgaattgattgttctcctgcaggaatggttgcttgtgacaanaaccgctaatcctgacacgctacgcatacg

SEQ ID NO: 25446 - DNA, 101 bp, rice(Oryza sativa)
  misc_feature (71): n=t or c
gacaacctgatggagggcagcacgatcaccgtggacgacgccatccaattccggaaccttgacctgtaccngacgaggccatccaggatctgcatcgttga

SEQ ID NO: 25447 - DNA, 101 bp, rice(Oryza sativa)
  misc_feature (71): n=a or g
accactggagttactcttgcggaagtacctcttactgctggctattatggcagccacagtgacatatgccncaggtttcaatccacccgggggtgtctggc

SEQ ID NO: 25448 - DNA, 101 bp, rice(Oryza sativa)
  misc_feature (71): n=t or c
cagctacataaagctgttttctccgaaggatcaccaacaactatgcgctctttttcagaactgaaatcacnatcagatctcacaattgcaacagaatatat

SEQ ID NO: 25449 - DNA, 101 bp, rice(Oryza sativa)
  misc_feature (71): n=t or c
gacccagactatgaggacatgaaacttggagagcgtagccaataactaaagcaaacttacctgggctggtnggggcttcctcaaagaagtaaatgcatttg

SEQ ID NO: 25450 - DNA, 101 bp, rice(Oryza sativa)
  misc_feature (71): n=a or g
gccactgctagatccatgagactcgtagtcattgttgcagccttagctcccccacatccactatgataccnccacatgcatccaggagagcctcacgcgcg

SEQ ID NO: 25451 - DNA, 101 bp, rice(Oryza sativa)
  misc_feature (71): n=t or c
gttggttggctttgagcaagcaatagcagtagcaaccagccacgacgcagtcccaatccaacaacaacgtngtcatcgtcgtggtgcttggcctcctcgag

SEQ ID NO: 25452 - DNA, 101 bp, rice(Oryza sativa)
  misc_feature (71): n=a or g
tacagatttcagagtgcctgtagattctgttggggatctacttatggtttgggacttctgcatgacttacnggaggattttatgcttgtctccattttccc

SEQ ID NO: 25453 - DNA, 101 bp, rice(Oryza sativa)
  misc_feature (71): n=a or g
agcttcggggtaccagccgaggctggcgtcacagttctacaaggatttctcggtctgggtctaccatggcntcaccgggagcacgccgcaccggcggccga

SEQ ID NO: 25454 - DNA, 101 bp, rice(Oryza sativa)
  misc_feature (71): n=a or c
accagaacaatcatgagcagcctactttgtgagaagaaaatgtacatatgctaaaataaatggtataggcnctctccaagatttcttggagctaggtattt

SEQ ID NO: 25455 - DNA, 101 bp, rice(Oryza sativa)
  misc_feature (71): n=t or c
ttcttcttcttcgccgcaacgaggacgacggcggcgacaaaggcgatggtcatcaccatgtgcattgttancctccaagaagtatgtcctcgacgccggtg

SEQ ID NO: 25456 - DNA, 101 bp, rice(Oryza sativa)
  misc_feature (71): n=t or g
gtggatctggatgtgcttagatgcctagaaaggcgatacagtcggcgctgttgcatcggatcgtgatgcangcatcaccttttttgtactgcctgttggac

SEQ ID NO: 25457 - DNA, 101 bp, rice(Oryza sativa)
  misc_feature (71): n=t or g
tttttttttttgaaaaaaaggtaatgagagcacaaataacaaaatggacaatgctgagcacctgatggatngtgacagtgtgaatgctactggagtaagct

SEQ ID NO: 25458 - DNA, 101 bp, rice(Oryza sativa)
  misc_feature (71): n=t or c
aaattttggtaaaccggtgtattctggaagaagcagtcgcttataaccaccttcggtttgcctcggttaangaccataacccccacagaggactcgggtac

SEQ ID NO: 25459 - DNA, 101 bp, rice(Oryza sativa)
  misc_feature (71): n=a or g
ttattgatgaactatgacaagataaaaaagtggtatgaaaacaactaatctcttttgtgccgcttgaaccntgtgctcggagaatgaacatccttcggtgg

SEQ ID NO: 25460 - DNA, 101 bp, rice(Oryza sativa)
  misc_feature (71): n=t or c
gagagaaagagagcttacgtccatggcattgtgaaaattatgtggattggtaccttcagagcctcagccanatgcacatgccctgtataggcattcattta

SEQ ID NO: 25461 - DNA, 101 bp, rice(Oryza sativa)
  misc_feature (71): n=a or g
catctcaatctccgccaacacatgcagacacaccaggactaggtgcagcccactgcaagtatcggaagccntgcatccatactagaaaataaaagttaggt

SEQ ID NO: 25462 - DNA, 101 bp, rice(Oryza sativa)
  misc_feature (71): n=t or c
gcaaagttttctctttttctctctccttccttttcattttagggcaactgtcataatccacaaaatggggnaatcaagctaactcggtgatttacagggtt

SEQ ID NO: 25463 - DNA, 101 bp, rice(Oryza sativa)
  misc_feature (71): n=t or g
tcatacaggtaaatcagtaacaaacatgaaggtaaagaagtaccggcgcctacgcgttcctttagctcganctcgtcccatgaaatctcgagccaatcggc

SEQ ID NO: 25464 - DNA, 101 bp, rice(Oryza sativa)
  misc_feature (71): n=a or g
gaactgttaaatccataaccaaagaagcagttaactcagatactatcaagcgatcaagaggaaggccaccnaaaatcttgatgccaactattgaaagcacc

SEQ ID NO: 25465 - DNA, 101 bp, rice(Oryza sativa)
  misc_feature (71): n=t or c
cctgcctgttatggatttctcgtaaaaaatacttatggatgttgatatatttttgggaatagataatgaanataggattggtggataatcgtttcagatgt

SEQ ID NO: 25466 - DNA, 101 bp, rice(Oryza sativa)
  misc_feature (71): n=a or c
gtcaccaacctgagcacctgaccacatcaagcaaaagcaaagcaccatttcattttccaccatacaaaccnatgggcttcccggcggtgtactactgcgtc

SEQ ID NO: 25467 - DNA, 101 bp, rice(Oryza sativa)
  misc_feature (71): n=a or c
aaacctagctggagacgcgctagaggcttacgatgaagcttatgaggaattcatgagaattgcggactccncttgcaccacaagtaccaacgggaagcctc

SEQ ID NO: 25468 - DNA, 101 bp, rice(Oryza sativa)
  misc_feature (71): n=t or c
tacctagaaagtcccaaaatctataacacccgaacgaaccctaggcctccagaaacagatcaaagaaatantttgccataaatcaagatcaggcaagatat

SEQ ID NO: 25469 - DNA, 101 bp, rice(Oryza sativa)
  misc_feature (71): n=t or c
gctcttacgcataaaattttctcaggtactttcctcaagtcaccaaccaaacagaggcctaaatactactncctccatttctaaatatttgacaccgttga

SEQ ID NO: 25470 - DNA, 101 bp, rice(Oryza sativa)
  misc_feature (71): n=t or g
caagtggtcagtagaacacctgtgtatattcccctgaccatatctctctataaatagccatgcacaactcnagctccacatcacagctgcagcaacgtacg

SEQ ID NO: 25471 - DNA, 101 bp, rice(Oryza sativa)
  misc_feature (71): n=t or c
ccatggttgaaggctgccttggagataacaaacaggcctgtgttgatcagctgtatgacgatgacgatganatatggcttcttggcgtccatcgctcagta

SEQ ID NO: 25472 - DNA, 101 bp, rice(Oryza sativa)
  misc_feature (71): n=t or g
tcagtggcactcaactctgaaatcaacctgaaattcaaggggttacgaacttatatgattcaattcaaacnaactgttgagaaacacctaggggtcttccg

SEQ ID NO: 25473 - DNA, 101 bp, rice(Oryza sativa)
  misc_feature (71): n=a or g
taatttgagacggagggaatcctaccttattcaaacaatgaagtatatacggttatacttatggagaaacntaatttgaataatgttaaataattttaact

SEQ ID NO: 25474 - DNA, 101 bp, rice(Oryza sativa)
  misc_feature (71): n=t or c
ataataattacccgtaaatgcaaatgctcatgtcaagtataggatttgaatcaaggggacttcgttctacnacgagaaagctaaccagttgagttgcgttt

SEQ ID NO: 25475 - DNA, 101 bp, rice(Oryza sativa)
  misc_feature (71): n=a or g
gctgttcaagaacgccggctatggaggaggatgcttgtagagagaggacaccgagagcagcagcaataaangtagcagcagcaatggtaatagtggtggta

SEQ ID NO: 25476 - DNA, 101 bp, rice(Oryza sativa)
  misc_feature (71): n=a or g
acaggttctccacctccaccttgacgacgtccttcctcaccccgatgtcggtgatgtacctgccggcgcantacatcccggcggtgacggcggccatgccg

SEQ ID NO: 25477 - DNA, 101 bp, rice(Oryza sativa)
  misc_feature (71): n=t or g
cgccttggccatgggaggatcacgattcacgagctggagctggagctcgagcagtcaacagaagaagggangaaaggaatcctccctcaccccacccgagc

SEQ ID NO: 25478 - DNA, 101 bp, rice(Oryza sativa)
  misc_feature (71): n=t or c
ggtcaataagccttgcaagaccgaagtcgcctagctttgcattgaaggattcatccagcatgacgttgctnggcttgatgtcacggtgcacgacacattga

SEQ ID NO: 25479 - DNA, 101 bp, rice(Oryza sativa)
  misc_feature (71): n=t or c
acagccaaacgttaaaagaaaaaaagactaaacttcaaactcttgctaaccttacgcgcgcagcaacatcnatcgtcatttaagatactttacatgtctaa

SEQ ID NO: 25480 - DNA, 101 bp, rice(Oryza sativa)
  misc_feature (71): n=a or c
actagcctatcagaagcatatggaagcttaggctttgtttcctttggggattgggcttgttaagttgaatntgtgcatattgagccatttctgtggatttg

SEQ ID NO: 25481 - DNA, 101 bp, rice(Oryza sativa)
  misc_feature (71): n=t or c
agctgcactgaggcactgataaagtaataatgatcattattcctatgtggcttggatgagatttcatttcnagtctcaaaattattgtactttaccactct

SEQ ID NO: 25482 - DNA, 101 bp, rice(Oryza sativa)
  misc_feature (71): n=a or g
tcgttcattcacgttcgttcacgatcgttcgttaacgtacacgttatcattaagttctcgcctaagtcacntttcgtttgttcacgagcgatcgttcgttc

SEQ ID NO: 25483 - DNA, 101 bp, rice(Oryza sativa)
  misc_feature (71): n=a or g
agctagctagaagcaatcattcatatagatcgagttgttagccatggcggcgaagctgcagggaggaggangaggagcggcggtgatggcggtggtggtgg

SEQ ID NO: 25484 - DNA, 101 bp, rice(Oryza sativa)
  misc_feature (71): n=t or c
gacgttgttctttctggtggctttaaagctagcagaaatgcaacaggaagtacacgagctacgttggatgngctgcataagacatacatgacccgtaaaga

SEQ ID NO: 25485 - DNA, 101 bp, rice(Oryza sativa)
  misc_feature (71): n=a or g
attgatgaaattgcacctgccatggattgaggcagaaacagaggagaacaactcaagctcctgcatcgccncccgtaccaccggccttttccagcttccat

SEQ ID NO: 25486 - DNA, 101 bp, rice(Oryza sativa)
  misc_feature (71): n=t or c
gcagtagcgaggctaggcaagaatcccaagaacagcaggcaggctatggcagaagcagaagcagcagccanggacgatcttgtcacgagctcaccagcggc

SEQ ID NO: 25487 - DNA, 101 bp, rice(Oryza sativa)
  misc_feature (71): n=a or c
atttgtcacgatgtactcattgactgcacacgattaattatgctcagcgcggaagcaacaatgagaacgangatgacgcccctctgtgcagcggcggcgac

SEQ ID NO: 25488 - DNA, 101 bp, rice(Oryza sativa)
  misc_feature (71): n=a or g
gaaaaggaagagggttttgatatggatagtgaatctgaagaagataccaaatctaaacctgagagtgaagntcatcaagcaaaattagatgaagagttaga

SEQ ID NO: 25489 - DNA, 101 bp, rice(Oryza sativa)
  misc_feature (71): n=t or c
ttccagttgacaattgtttctaggatcctctatcagaatacgcagttactagttttgaagctggatacaancatacattcatgcactcgactctttttcta

SEQ ID NO: 25490 - DNA, 101 bp, rice(Oryza sativa)
  misc_feature (71): n=t or c
tttccctttgcaaaacttcactccaacgccggagcccatcttcgcgctgaaatatctcttatactagaatnagctccatatatccctaggggtccccaaca

SEQ ID NO: 25491 - DNA, 101 bp, rice(Oryza sativa)
  misc_feature (71): n=t or c
aacacggatcagccactagttaaaaagggccataggtgccggttcctaaccggctataggtgccggtttcnggactgacacctattggtcgacactaatgc

SEQ ID NO: 25492 - DNA, 101 bp, rice(Oryza sativa)
  misc_feature (71): n=t or g
acatgcaattacgatcattttgagagtgaaaagttcatgtttgctagctcaactattggcctaatataatncatatccctcaacccaaaaccagattcaaa

SEQ ID NO: 25493 - DNA, 101 bp, rice(Oryza sativa)
  misc_feature (71): n=t or c
ccgaggattagggggagtcctaggtatttgatcgggaagcatgctctcactgctgggactccctctaagangtcgtccaaatcaatgttattgcatttgat

SEQ ID NO: 25494 - DNA, 101 bp, rice(Oryza sativa)
  misc_feature (71): n=t or c
gcagcgacaagcaagacatcggcaggagtcaaaatgctagcagtagctgccgtttagttttttttatgcantatatagatggacctacagctgccctgtaa

SEQ ID NO: 25495 - DNA, 101 bp, rice(Oryza sativa)
  misc_feature (71): n=t or g
ataggttcttacattgatcactggataattgcaagaaatgaaagtgatgcaatcctggaggcaaagcagangtatccagggaaaaattataagttagacca

SEQ ID NO: 25496 - DNA, 101 bp, rice(Oryza sativa)
  misc_feature (71): n=t or c
cctattggaagatcgggtacctaggcacatcaagtgttattagagcattaggttgaccgataggtatcatntgttttccaagtgttaattttcatttccat

SEQ ID NO: 25497 - DNA, 101 bp, rice(Oryza sativa)
  misc_feature (71): n=t or c
tgactatggcctatgggccatgtggccagcgaattctcttggcccgaggcaacacaatttgttagctgatngagagcaggtataatagcaggctataagcc

SEQ ID NO: 25498 - DNA, 101 bp, rice(Oryza sativa)
  misc_feature (71): n=t or c
atatgttggaacataataaaacaaaaaagtgcttttgaagatagaggtgacaaagaacggttggaacaganaggaagggagattgcaaggaaatgtggcag

SEQ ID NO: 25499 - DNA, 101 bp, rice(Oryza sativa)
  misc_feature (71): n=a or g
gtctattgaagaagcggacatgttgatcagaacacgtgctaagcagagtgagattgctgcaaattatgtcnaagttgtaggtgaggaggatattagttatg

SEQ ID NO: 25500 - DNA, 101 bp, rice(Oryza sativa)
  misc_feature (71): n=t or g
gatcggattgggggaagagaggaggggggcggatttattttggtgtccatcaattttggtaggtggtgggncgagggcgagatggacgcggctacggccta

SEQ ID NO: 25501 - DNA, 101 bp, rice(Oryza sativa)
  misc_feature (71): n=t or c
acggtgacgacgcctgtgccgtcggtggccatggccggaggggaaatttggggatggggaaggagaggccntaagagcgcagatgcggcggcggccggggg

SEQ ID NO: 25502 - DNA, 101 bp, rice(Oryza sativa)
  misc_feature (71): n=a or g
atctccaagggcgacaatgctctgttttcttgtgcaatgtccaaacggaggattagctcatttacgagatngaattggatgcgactgtcacttaggatgcg

SEQ ID NO: 25503 - DNA, 101 bp, rice(Oryza sativa)
  misc_feature (71): n=a or g
ctgacttgtccttgccacgtcgttgtatctctgctgccacctagccaccttgttgtctgtgctgtgccatntctacccaaaccttagatcggattcaatat

SEQ ID NO: 25504 - DNA, 101 bp, rice(Oryza sativa)
  misc_feature (71): n=a or g
agaagttggagctcaggcagacaaccctcgtaaacaagacaccagcagtgacccgacaccaggatctcccnttaagacgcaagagtcgactcgtccccgtc

SEQ ID NO: 25505 - DNA, 101 bp, rice(Oryza sativa)
  misc_feature (71): n=a or g
gttttcaaagaaaacgatcttgggctcaaaccgtttggttaggaagaaggtattctctataaatatattgntgattccaacgttgcaactatacgtagcgt

SEQ ID NO: 25506 - DNA, 101 bp, rice(Oryza sativa)
  misc_feature (71): n=a or g
tcttgttagcaagaaaagtattgttgacttagcttctcctatttagcaaaacaaacaggtcgataggagtnaaacccaattttcttttctattctggtccc

SEQ ID NO: 25507 - DNA, 101 bp, rice(Oryza sativa)
  misc_feature (71): n=a or c
agtcttgggtcgtccttgttgaacatctgcacctgtatttacctgatagtgtagaggttcagtcgcttctncctcggtttcctcaccttgtgtcagttggt

SEQ ID NO: 25508 - DNA, 101 bp, rice(Oryza sativa)
  misc_feature (71): n=a or c
gatatccgatccaatcttgataactacactagaaaggacaggcaagtgagctatagagtgggttgctgaangttgcaagcaagcattccaacaagaggcca

SEQ ID NO: 25509 - DNA, 101 bp, rice(Oryza sativa)
  misc_feature (71): n=a or c
ttgttgcatttctctgatataaaaagaagtccactcatcgtcaagtaacaccaccataacctaatgacaanacaaagtttgagttccagatcttcaacaaa

SEQ ID NO: 25510 - DNA, 101 bp, rice(Oryza sativa)
  misc_feature (71): n=a or c
tgtcctataaggtggttgtcggagaggtcaaggaaccataaacttttaagatgccttagggcatgttcaanggtagagaccagcataggctctctctacac

SEQ ID NO: 25511 - DNA, 101 bp, rice(Oryza sativa)
  misc_feature (71): n=a or g
gtgtaaaaactttatccaatcctacttcattgtttcttttctctctgtacattatttcagctctcacccantgacttaccatgcatgacatattactttat

SEQ ID NO: 25512 - DNA, 101 bp, rice(Oryza sativa)
  misc_feature (71): n=a or g
tcgtctttttccgttgacgcactgtgctttcgattgtgactagttaacttttctgggcttcgtgaaaaaanaaatttaggagttacataggatatttgacc

SEQ ID NO: 25513 - DNA, 101 bp, rice(Oryza sativa)
  misc_feature (71): n=a or g
ttcagtggcacccaacaaaatccacagttgggcatcaactaacaaggttaacacatctacaacagcgtggntataaaaatacatgatcttatagataaatt

SEQ ID NO: 25514 - DNA, 101 bp, rice(Oryza sativa)
  misc_feature (71): n=a or g
tatagtgtcattcaaaacaacgtaatatttttggttcgcatttgtgatttccatgttgactaatcatatcnacggataacaaaagagtaaattatgttggt

SEQ ID NO: 25515 - DNA, 101 bp, rice(Oryza sativa)
  misc_feature (71): n=t or c
taccgttgaagcttggtgccacaggctagggtttaattgttcgcatgctgtccactctgctatcgcccccnagattctccgggtgtatctacactccgcga

SEQ ID NO: 25516 - DNA, 101 bp, rice(Oryza sativa)
  misc_feature (71): n=a or c
atccgcagcctgacgaccagcccttttagacgtgatatccacctccgggcaatgcccttgcccttgttgcngccggcccgccgccatcgccgacatccatg

SEQ ID NO: 25517 - DNA, 101 bp, rice(Oryza sativa)
  misc_feature (71): n=t or g
tatgaagtgaagctacacaagaattcatatgtggttgtagtagtaaggtgtaagagctttgaagcaatcancattaataacacttggtatgaattaacaca

SEQ ID NO: 25518 - DNA, 101 bp, rice(Oryza sativa)
  misc_feature (71): n=a or g
ttcactttcaaattgcaatgcattcctaaaactactccagtccttcccaaactcaataatagcgttgcccnaaggtctacctttactgtatacagaataca

SEQ ID NO: 25519 - DNA, 101 bp, rice(Oryza sativa)
  misc_feature (71): n=a or g
cccgggccgcttcggcgtccccttcttcgcatgcttaatcaggttctgcacgtaggtccgcgcgatgtcgntcgtggccgagtccccgccggccgacggcc

SEQ ID NO: 25520 - DNA, 101 bp, rice(Oryza sativa)
  misc_feature (71): n=t or g
tgggccacaccgcttctcatataaggatctgtttcatgctacagacggatttaagaataggaatctacttngtctaggaggatttgggaaggtgtataaag

SEQ ID NO: 25521 - DNA, 101 bp, rice(Oryza sativa)
  misc_feature (71): n=t or c
gatgagcaagagaatgggcaaggtgtttattggatacaaatatgaaaaagaggagggaagggatggtgagnggttctttaaaaaaatataatttatgagtg

SEQ ID NO: 25522 - DNA, 101 bp, rice(Oryza sativa)
  misc_feature (71): n=t or c
gagtctgcagagagcatgacagaaaatagattccttgacaagacgtcgccaaaagacgaatcagagggtgnccaaatcgccacgccgatcagtggcgacga

SEQ ID NO: 25523 - DNA, 101 bp, rice(Oryza sativa)
  misc_feature (71): n=t or c
ccaaggtgttgaagacatcattcgatggaaatggacaccaagcggatcttacacagcaaaatcagcctatnaaatgcagatcttgggcggcataccgtcca

SEQ ID NO: 25524 - DNA, 101 bp, rice(Oryza sativa)
  misc_feature (71): n=t or c
agtaagtaacgaacaccattcatgtcatcgtacaggagatcaaagtcattatctatggcaccatcttcttnattgttcacaaagccttcaagttcaaatgg

SEQ ID NO: 25525 - DNA, 101 bp, rice(Oryza sativa)
  misc_feature (71): n=a or c
gaggttgttcctcctgacgagacatcagctttgcctctttctcattgacaagccgacaacaatatcgaganaacgatgcacatatttgagttaaaagtttt

SEQ ID NO: 25526 - DNA, 101 bp, rice(Oryza sativa)
  misc_feature (71): n=a or c
ggtgaaacatttattgttgccaccaccaatatttggcttcttttaggagcaagggatatattgtcatccanctacttcagattcgtttattcacattaaga

SEQ ID NO: 25527 - DNA, 101 bp, rice(Oryza sativa)
  misc_feature (71): n=t or c
cacgtgaaagacgacgattaattaaactaataaagcagcgttaatctcccccctaattagttattctctcngtctcatctctatctctactattataaaaa

SEQ ID NO: 25528 - DNA, 101 bp, rice(Oryza sativa)
  misc_feature (71): n=t or c
atacctctataagcacctcctaagatttgggatggtatattttaaggattgacaaagtcaccacagcgcgngtcgacatcctacccttaccttatgagcac

SEQ ID NO: 25529 - DNA, 101 bp, rice(Oryza sativa)
  misc_feature (71): n=a or c
ccaggtggcattctgactattgaattaactgtagaatgatgggacactcgtgttctgaacctttcaagaantaccaaatattggtgatagaatattaagca

SEQ ID NO: 25530 - DNA, 101 bp, rice(Oryza sativa)
  misc_feature (71): n=a or g
gtattttccctgacggtactcctaacgtgcacttctcctggttaagcttcatttgatatcgtcggaggctntcgaacgtttccctaaggtcgttgattagc

SEQ ID NO: 25531 - DNA, 101 bp, rice(Oryza sativa)
  misc_feature (71): n=a or g
gtggtcatcacaatagtgatgccgtgttgatgcagtcgttgttgttgtagatgatgtgatcgatgccctcnttggtgacgcggtcgttgccatcgtagagg

SEQ ID NO: 25532 - DNA, 101 bp, rice(Oryza sativa)
  misc_feature (71): n=a or g
ccttgacgaagcagttgagcatgaggagcactgccatcctgacctgctcttgcttcattatcaatcaatcnatcgatcggtttgtgtgtgtcagtgtgtgt

SEQ ID NO: 25533 - DNA, 101 bp, rice(Oryza sativa)
  misc_feature (71): n=a or c
gaaacctagacgagcaaggcgcgaatcacagatcatcaagctaagatcaacgaccaatggaacacaaacantgcaacaaacattttgtccacgcctctgac

SEQ ID NO: 25534 - DNA, 101 bp, rice(Oryza sativa)
  misc_feature (71): n=a or g
accgccctcactaggtaacctttcttccctacttgaacttcgcctttctaagaacaatttagttggtagcnttccagagagcttaggtcatatccgaacac

SEQ ID NO: 25535 - DNA, 101 bp, rice(Oryza sativa)
  misc_feature (71): n=a or g
acaaaatatttttccatcaccaatttctcctgttcttgccttttcaattatcttgtcaacaacagcttcancctagagaatgccaaaagggaaaaagaaag

SEQ ID NO: 25536 - DNA, 101 bp, rice(Oryza sativa)
  misc_feature (71): n=t or g
tcgccgtacaccggcttcacggccttggatgaatgcaccgtgatcttcatagccgatcggtagatcaatcnatccgtatggttaaaatgcaaagtaattta

SEQ ID NO: 25537 - DNA, 101 bp, rice(Oryza sativa)
  misc_feature (71): n=t or c
atggagagagtacatgatagtggttggttggtgggagtgatagactcaccatcaccactaacatcttttanagggaacatatcctatgtatacaaactttc

SEQ ID NO: 25538 - DNA, 101 bp, rice(Oryza sativa)
  misc_feature (71): n=a or g
ttccgacgaggtggattttccgttcgtaacatgggttgatgcattggactctaaggaactagaggtgttcncagaagcggcgttgtttgtggtgtggttgc

SEQ ID NO: 25539 - DNA, 101 bp, rice(Oryza sativa)
  misc_feature (71): n=a or g
gagatcgcgagtttcaggaatgcattcctatgcttagtttcttccctggagagcctctcgaagaagcaccngctacttgaagacgattggaacatgattgc

SEQ ID NO: 25540 - DNA, 101 bp, rice(Oryza sativa)
  misc_feature (71): n=t or c
cagcgcaagatcagacgatcttgatttactccggaatttcctctgaaatctgtcaacatattgttgttccntttttttcccatttgtttgattgtttgaca

SEQ ID NO: 25541 - DNA, 101 bp, rice(Oryza sativa)
  misc_feature (71): n=a or g
agtgaattattttgctatggcaaggcaaaatgtggagaacgagtacgtcaaattattttggtgtgataccngggcttatccttgaaatacttagggattcc

SEQ ID NO: 25542 - DNA, 101 bp, rice(Oryza sativa)
  misc_feature (71): n=a or c
agcacacctaggttggacaacttagagagagcaggaggtaacacacctgtgatcatgtttccttgaaaatncatttcctcaagctgggggctagcaaccca

SEQ ID NO: 25543 - DNA, 101 bp, rice(Oryza sativa)
  misc_feature (71): n=t or c
atctaccacatggagatgacctcaccttcgcagttcctaagctagggccactactaggaaaatcgttttcncaggcagccataaatagtttttccaggcgg

SEQ ID NO: 25544 - DNA, 101 bp, rice(Oryza sativa)
  misc_feature (71): n=a or g
acttgtaccagcatcatctccatcatcgttcactgacacaattccaccggctgattcacatgggtttttcnactcctcggtaggcaactgaaacctacaga

SEQ ID NO: 25545 - DNA, 101 bp, rice(Oryza sativa)
  misc_feature (71): n=a or g
tgaaacggagggagtaccatatagtgtagtatagttagccaaatgggctgcccggcatggcacggcccaancccaatcgtacctgggccaaggttagtcgg

SEQ ID NO: 25546 - DNA, 101 bp, rice(Oryza sativa)
  misc_feature (71): n=a or g
tgaccaagtatgtactgctaccacctaaattcctagtaccctccaccacacctgcaacaatattaatactnctgctatctggcaacatacatcatcaccac

SEQ ID NO: 25547 - DNA, 101 bp, rice(Oryza sativa)
  misc_feature (71): n=a or g
tgctgcattggttcacaggttgttatcttggactgcattgaagggaatgacttgcaagtgaatgaagctgntagaatgtacctatacaatgatgacaaggt

SEQ ID NO: 25548 - DNA, 101 bp, rice(Oryza sativa)
  misc_feature (71): n=t or c
gttgctggagcactagtaaggccgaaaggaagaacacgaaactcaaagtgtccattatgagtcttaaaggntgtcttgtgttcatcagcaggttcatgcga

SEQ ID NO: 25549 - DNA, 101 bp, rice(Oryza sativa)
  misc_feature (71): n=a or c
atagaagagatacaacctgagacctcggaattgcccgatggaaggatacaagtgcatcaagagatagacgntgcagttgcagagctgatagaacaagaagc

SEQ ID NO: 25550 - DNA, 101 bp, rice(Oryza sativa)
  misc_feature (71): n=a or g
tgtgagcgaagagaagactgatgtgctgaataggagaaaagagatggacaaatatttgaagcaggtccttngcatagatgttaaaaggagatccagtgtga

SEQ ID NO: 25551 - DNA, 101 bp, rice(Oryza sativa)
  misc_feature (71): n=t or c
gcaaaaaggccatctgcttgaatagttgccaggattcctcaaaaggtaggcaactcacattgtaggggtgnattgtctggactattgttgacacacttgta

SEQ ID NO: 25552 - DNA, 101 bp, rice(Oryza sativa)
  misc_feature (71): n=t or c
caataacttgtaaattgcttattccggtacaataacttggctagttcatgcaaagatgggccaaaccaatncacacaagtaaaattgatgtaatatgatac

SEQ ID NO: 25553 - DNA, 101 bp, rice(Oryza sativa)
  misc_feature (71): n=t or c
tgctcctcctccacccgcgaagacttcgcttctcctcctcctcgcttgctcctcctccccgcatgttctgncaccacatcgctgcatcctcgctggagatc

SEQ ID NO: 25554 - DNA, 101 bp, rice(Oryza sativa)
  misc_feature (71): n=t or g
attggtagacccaaaacatctattgccaaccctgccactaagacatcaccagaagtgacatatttgacaantcaagaatcactcaattacaactctgatgt

SEQ ID NO: 25555 - DNA, 101 bp, rice(Oryza sativa)
  misc_feature (71): n=a or c
atgggatggcctgagtgcattgttaacttggaacaacgggacacaaattatcatccatggtatgtcaaaangagggaagatgacctcatggaacatcttgc

SEQ ID NO: 25556 - DNA, 101 bp, rice(Oryza sativa)
  misc_feature (71): n=t or c
tccaactaaaccaatcttggatcatgtgatccatgtcctatcttcagatgatgaagactccccagaacctngtaataatctgaataagacatcactgaagg

SEQ ID NO: 25557 - DNA, 101 bp, rice(Oryza sativa)
  misc_feature (71): n=a or g
tatagggacgggtaagtgcatgatagtagtgattagtggtaccgaaagaattgatacttatgatgaaatcntcatcgacaatgttaggacacacgaagcat

SEQ ID NO: 25558 - DNA, 101 bp, rice(Oryza sativa)
  misc_feature (71): n=a or c
ttttttcatttactcggtttctttttctggttttctcatgagagccggtggttgtgagcatgagggagganggaggtgggcgaatgacttcacttttatta

SEQ ID NO: 25559 - DNA, 101 bp, rice(Oryza sativa)
  misc_feature (71): n=t or c
tgcgccgattcgtgttcccttgatttgttgcctgtgatttgggattccaaggacaaccagctgacctttangaacttgatttgtacttaccccacaatgga

SEQ ID NO: 25560 - DNA, 101 bp, rice(Oryza sativa)
  misc_feature (71): n=a or g
gagatttccaagaggagattacatgacgatcatcttttttaaacctctctgcccacagtgaagcatcttcnatacatttcgtgagcaagtgacggagcgag

SEQ ID NO: 25561 - DNA, 101 bp, rice(Oryza sativa)
  misc_feature (71): n=a or c
caggtacttgtccagatgcatagcctcaattaaaagaaatcattttgggacggcggggtagcaatttaacngtagatttaaaatctatatgaattcaacaa

SEQ ID NO: 25562 - DNA, 101 bp, rice(Oryza sativa)
  misc_feature (71): n=a or g
cgaggtggcaactcttccactagactcattgatccatttgtccgatcaactgacaggaacaaatcagcaanaccgtcaactggttcaaatacgtaacggtc

SEQ ID NO: 25563 - DNA, 101 bp, rice(Oryza sativa)
  misc_feature (71): n=a or c
gtttagtactaaatggagaaaacctaattggtgttatctcaatttgtaggcgccaacgtggtttgtgctcnagatcacattcttgctactggctttctgtt

SEQ ID NO: 25564 - DNA, 101 bp, rice(Oryza sativa)
  misc_feature (71): n=t or c
atgccctcatcagtaaaggaaaaggtgggcgcagtggcgtcatccctaatcttagaaccataaaaggcaantactataaactccatattagtagcctagta

SEQ ID NO: 25565 - DNA, 101 bp, rice(Oryza sativa)
  misc_feature (71): n=a or g
acacagcgagcgcgagttcccggcggcgttggctttggtgaattcaatggttgaggtagtagaccctcttntcgccgtaacccgtctcattccagccgtcc

SEQ ID NO: 25566 - DNA, 101 bp, rice(Oryza sativa)
  misc_feature (71): n=t or g
aatattgtcctgacacgtatgaatgatggatctgctcgtctctttccctgtcactcttatggcgtgtttanttcacgataaaattaaaagtttgattgaaa

SEQ ID NO: 25567 - DNA, 101 bp, rice(Oryza sativa)
  misc_feature (71): n=t or g
acatggatcaaggaggagaaaagagaggaagacctaaacaagaactcaaaaacagtgcgccaccgctgccncatgaactaaacaagaataaaaaaaaaact

SEQ ID NO: 25568 - DNA, 101 bp, rice(Oryza sativa)
  misc_feature (71): n=a or g
cggtcggcgtctatgagctcaggaagggagatttctccatcagggtcaccaattggggagcggtcatcatntccgtcgtgcttcctgactccagaggtgag

SEQ ID NO: 25569 - DNA, 101 bp, rice(Oryza sativa)
  misc_feature (71): n=a or g
actctccgagtaggactcgaacatatcaaacccggcacgatacgttggcaacccagttcttgttcgagaangactcttctcatctattgaattcgtgaaag

SEQ ID NO: 25570 - DNA, 101 bp, rice(Oryza sativa)
  misc_feature (71): n=a or g
gtatagaatcctaactccaaatctaatttcaactgcctaatcatgaaaatgtattattttttgccgggccngcaaaaggatgccggccagagtatattaag

SEQ ID NO: 25571 - DNA, 101 bp, rice(Oryza sativa)
  misc_feature (71): n=t or c
aatttctcttagatgattgcgctgcacacaaagatccagggggtggtgcgaaactcgtattgccgataaancagtagaggacccacttcaagttgcacaac

SEQ ID NO: 25572 - DNA, 101 bp, rice(Oryza sativa)
  misc_feature (71): n=t or c
tgatacatatggcagtaaaagagacacatcgtgtgttaataccagctgaagcctaaaattgtgctgtgctnatttggttatttacgaaaatgctacacaca

SEQ ID NO: 25573 - DNA, 101 bp, rice(Oryza sativa)
  misc_feature (71): n=t or c
atacacaaagtctaggaatgggaatgttgtcccatgtaggaaattttcctctgtcatccacatagtagcgngaggattataaatttctgacagtactgttt

SEQ ID NO: 25574 - DNA, 101 bp, rice(Oryza sativa)
  misc_feature (71): n=t or c
tcatcatggagaccatggtagttggcccacgacagggcatcttccacgacaaccgtgaaaccagaatcatntatcatgaaatggagttccgtagcgtcctt

SEQ ID NO: 25575 - DNA, 101 bp, rice(Oryza sativa)
  misc_feature (71): n=a or g
cgccgcccgccgtcgccgcgatagagagagagggccaaggagtcaaggatgcctagcagaagaggaagagngggagaaagaaggggaagaagttgggatgt

SEQ ID NO: 25576 - DNA, 101 bp, rice(Oryza sativa)
  misc_feature (71): n=t or c
gctaggatttgatcatgccatcattcgctgatgaaaactaggaacatgaacgtcaggtactccctttattntaaattgtaagggattttaggtggatgtaa

SEQ ID NO: 25577 - DNA, 101 bp, rice(Oryza sativa)
  misc_feature (71): n=t or c
atggaaacaaattatctgtaaaattaagattagtgccaaaagcaggctagtgcagacaagatggaacatgntagtatttgcatacattgattcagtgctgt

SEQ ID NO: 25578 - DNA, 101 bp, rice(Oryza sativa)
  misc_feature (71): n=a or g
acagctgaaacaccagtcctggcacaaagagatcacctagaaaacaaaccagggaatcagcaaaacgtgcnaaaaggtcacatggagcgatgtcaaatcgt

SEQ ID NO: 25579 - DNA, 101 bp, rice(Oryza sativa)
  misc_feature (71): n=t or c
tcttcggcttccggtcgccgcattcaggtgatcaacgtctccagcaactcgttttcaggacggtttccgtncagctcatgggaggagatggagaatctggt

SEQ ID NO: 25580 - DNA, 101 bp, rice(Oryza sativa)
  misc_feature (71): n=a or g
tcgacttttgtgcgtatgcttctcaaactactcaacggtacttaattaatactgcgttaatatgttttctntgtggaaggtgaggttctcatccccttgat

SEQ ID NO: 25581 - DNA, 101 bp, rice(Oryza sativa)
  misc_feature (71): n=t or c
cccaaggagacgatattgagattcgtcagtttgcccagccatggtgggaaagcaccttggaataaattatnaggcaggccaagaacttggaggtactggca

SEQ ID NO: 25582 - DNA, 101 bp, rice(Oryza sativa)
  misc_feature (71): n=t or g
ttctctggtcacttcacaaggatcaccatcccaagtctccgaatctcacaaaaccaaacctgagatttttntgatgtttgaaggtttctggctgattgcac

SEQ ID NO: 25583 - DNA, 101 bp, rice(Oryza sativa)
  misc_feature (71): n=a or g
ggaagaattcagtggcggtggggaacgggtagtggatcttggttaggggtctaggtgagctcattcgggangcagagctcaagctggcagatatagtcgat

SEQ ID NO: 25584 - DNA, 101 bp, rice(Oryza sativa)
  misc_feature (71): n=a or g
aatttcttataatcgaaggaacttaatgaaagccttattgcgtaccatatctctggcaacatatgtgcccngtagctctgctcgtgttgatggttcagaag

SEQ ID NO: 25585 - DNA, 101 bp, rice(Oryza sativa)
  misc_feature (71): n=t or c
cattcataaaaccctttttgggtttgggaggcttggggaagtgaggtgctactatcttgcatttcttgctnagctgctgcgaagatttcagctgcatcatt

SEQ ID NO: 25586 - DNA, 101 bp, rice(Oryza sativa)
  misc_feature (71): n=t or g
tagaactctattattcacctatccgtgaagatgatttttatagtattttgtaaatttccttatcatatacngacggagcgtggggctcctcaccaggagac

SEQ ID NO: 25587 - DNA, 101 bp, rice(Oryza sativa)
  misc_feature (71): n=t or c
tcaaacatgattggaaaatgttgcaaaagacatggatttactactaactttagtgcctcaagggggcggcnggggaaagaagaggcgagagcaccatccag

SEQ ID NO: 25588 - DNA, 101 bp, rice(Oryza sativa)
  misc_feature (71): n=a or c
ttttcttgcactactaggatgaaatggaaaacaagctgtctgaacatgcagaagatgaagaggccccttcnatgaccgaggtagttgctggtgttcttgct

SEQ ID NO: 25589 - DNA, 101 bp, rice(Oryza sativa)
  misc_feature (71): n=t or c
ccagcacgcactcgtgctcggcgccgccgtcttgtgggtgcttgtcacacccggagagtttcccctttttngtagtttctaattcaccaataaattgtcta

SEQ ID NO: 25590 - DNA, 101 bp, rice(Oryza sativa)
  misc_feature (71): n=a or g
ggccatggaggatgtagcagaagtggaccttgcggaccctaacccggacatactgttagattaatgggctnggcccaattaaatcctaataaattccattg

SEQ ID NO: 25591 - DNA, 101 bp, rice(Oryza sativa)
  misc_feature (71): n=t or c
aagaatatatttaagatgaatgggacactaccacactggggttgcaatggtatcaaaggttagttccacantgtttttggttgacagaacagaggagaaag

SEQ ID NO: 25592 - DNA, 101 bp, rice(Oryza sativa)
  misc_feature (71): n=t or c
atagctaatggcaaaccttcacatttattgactatcttttcaccccacttctgcaattccggggagcaagnatgattttctgttttccagaatacctttct

SEQ ID NO: 25593 - DNA, 101 bp, rice(Oryza sativa)
  misc_feature (71): n=a or g
gaccacgccctgcaggagaccaacgctagcatccacgctgcgctcgactgcgctcgaggttaccttgccgncaagctccctctccggcttgactccgggaa

SEQ ID NO: 25594 - DNA, 101 bp, rice(Oryza sativa)
  misc_feature (71): n=a or g
gcagccgaggtcgtgagcatcattttttttctcttttgctcgaggccgaaacgagacgacgctatccgctnatccgttcgggatgggcgccggtcgcggtc

SEQ ID NO: 25595 - DNA, 101 bp, rice(Oryza sativa)
  misc_feature (71): n=a or g
cccagccgtcggagtcggattttgagtctcagtctgcacgaaccgcaaccgaattggattcctcctacacngtaaatcagaacctgacgagtttttcaaac

SEQ ID NO: 25596 - DNA, 101 bp, rice(Oryza sativa)
  misc_feature (71): n=a or g
ctacatgaggaatacgatcgaataattcacaaggtgggaatcgcgcttggggtatacaacttaactaagancacagccgaagaatccaacaccgtggttac

SEQ ID NO: 25597 - DNA, 101 bp, rice(Oryza sativa)
  misc_feature (71): n=t or c
tccttgaagcttcgtggtggggcccgccggctcggctcaactgataggtgtcagtttagaaaaaaaggcanctataatttattataggtgctggtttttaa

SEQ ID NO: 25598 - DNA, 101 bp, rice(Oryza sativa)
  misc_feature (71): n=t or c
agcgcactataagaaatgagaaatatttattttttctcacctcgagcatcatatagcgagttatagtgaanttccgaccagaaacttagccaaatttctga

SEQ ID NO: 25599 - DNA, 101 bp, rice(Oryza sativa)
  misc_feature (71): n=a or g
gaatgcaaagggatcggatcgatcattctcgtggcttatacttggaatctcttttctttttctttgctggnatgactgactccattaattcatccaaactg

SEQ ID NO: 25600 - DNA, 101 bp, rice(Oryza sativa)
  misc_feature (71): n=a or c
agcgaagtgatgctaccgctcacctttttcggtagcgaagttgtcggatttggcactaatttcgacttggnatgtgggagtcgctccatgcttgatgaacc

SEQ ID NO: 25601 - DNA, 101 bp, rice(Oryza sativa)
  misc_feature (71): n=t or g
aacggtagtccagtgcatcttgttaatatcttgtgcattgtttctaccaaatgctgtgggcaatcttgttnagggccaaatactgcattaatgaacaattt

SEQ ID NO: 25602 - DNA, 101 bp, rice(Oryza sativa)
  misc_feature (71): n=t or g
ggtatataagcgcacaaaaatccatagggttatttgacttaggtgtgtttggaaggaggggaaatgaaaanattgagaagatgcgtaaaacaagataaacc

SEQ ID NO: 25603 - DNA, 101 bp, rice(Oryza sativa)
  misc_feature (71): n=a or g
ggatgggagctcgccggttgacgatggagatgtttggaggctcgactcgaccccgtctcttcagcggttgngaatggcggcgacggctggtggcggaggcg

SEQ ID NO: 25604 - DNA, 101 bp, rice(Oryza sativa)
  misc_feature (71): n=t or c
aaccctaagcttaccattcttttttattaccggaactatattagaaatccattcaacatatcggcatggcngaataaaaccagcatcatacaaacgagtaa

SEQ ID NO: 25605 - DNA, 101 bp, rice(Oryza sativa)
  misc_feature (71): n=t or c
ttggtaacacagctaaaaataaaaagagaaaaaaaaactagaatgtgatacctaagagcatcaccaacagnatcttgatatcattccctgtgtggtattcc

SEQ ID NO: 25606 - DNA, 101 bp, rice(Oryza sativa)
  misc_feature (71): n=a or c
gcgtgccctctttctctactgcacatttctttctttcttctatactaattcatcaccatacctcgccaatnacgacagtggaggctgcggcctcgttcgtt

SEQ ID NO: 25607 - DNA, 101 bp, rice(Oryza sativa)
  misc_feature (71): n=t or c
gaggagaagactggggagatggggagaagggaggagagcaaaaatacttaattggaggaagaaaaataganggagccggtcgagtatgaaaattcgcaagt

SEQ ID NO: 25608 - DNA, 101 bp, rice(Oryza sativa)
  misc_feature (71): n=t or c
ggtggtccacccagtgaggtatagttcttctctcactatgtgcatatatagggcatgtttggtacagctcnaactcctaaatataactccaggagttgagt

SEQ ID NO: 25609 - DNA, 101 bp, rice(Oryza sativa)
  misc_feature (71): n=a or g
aaataaaactctcaatctatacatgaacatgcctatatttctgagatagcgaaaggcctaggggtcttctnattagcaccacaaggtgcgctagccgaccg

SEQ ID NO: 25610 - DNA, 101 bp, rice(Oryza sativa)
  misc_feature (71): n=t or c
agatcactagtccaaagtacaaagagtttaattactaggaataatccggccaataataagtaggtataaanaagggcggatccagaaaaaataaattgaag

SEQ ID NO: 25611 - DNA, 101 bp, rice(Oryza sativa)
  misc_feature (71): n=a or g
ccatttcagcctcctttagcttttaaaacttctcgtgctagtggcatagcacatgtaggttacttcttccntttcaggttagaagactttctagcattatc

SEQ ID NO: 25612 - DNA, 101 bp, rice(Oryza sativa)
  misc_feature (71): n=a or g
atctctagacaaaaatcgcttgtactgtgatattatggagatctaatttgtcgcatgcatgggatggatgngtaatatctctagacaaaaatcgcttgtac

SEQ ID NO: 25613 - DNA, 101 bp, rice(Oryza sativa)
  misc_feature (71): n=a or g
tgtggtccctgcagtccctgcatacttgcctgcatgtagataatatatttagtgattacccagcagtgtanaaccatatgttaaaagggtgcattgaaaag

SEQ ID NO: 25614 - DNA, 101 bp, rice(Oryza sativa)
  misc_feature (71): n=t or c
atgcgtctactgatcgatggatcccttatttcgcgccgaatattcaaggattttcccacgcgattatgtgncccctgtgatcctagcccacccattactct

SEQ ID NO: 25615 - DNA, 101 bp, rice(Oryza sativa)
  misc_feature (71): n=t or c
cccattaggagcccatacgagcaaaagacattgtatgcccataaagatgtccctatcataagggcaaccangtaaattcctctgtagagcctaaaccctaa

SEQ ID NO: 25616 - DNA, 101 bp, rice(Oryza sativa)
  misc_feature (71): n=t or g
tgtccacaacattctttgaagatgagctggacgatgagaacaacgtcatctattactactcagacacaatntcacagctctcggaaccgagcttggagacc

SEQ ID NO: 25617 - DNA, 101 bp, rice(Oryza sativa)
  misc_feature (71): n=t or c
atatactgacaagcttaatgcatgatgatgagtacgtagcttacaacttggttcattaagctaaagagtgntgtcttataatataagagattttgtttatt

SEQ ID NO: 25618 - DNA, 101 bp, rice(Oryza sativa)
  misc_feature (71): n=a or g
gcatcagagtagacaactaggtcagtgacaggagacttctgaatgtgcaatccataatccaacgtgccccnaacataccgcaatatcctcttgagcgcagt

SEQ ID NO: 25619 - DNA, 101 bp, rice(Oryza sativa)
  misc_feature (71): n=t or g
cacattataagatgttttggtctctgaatttctcattagattcattaatatccgagtaaactgcatattgngatatatttagttagcatttttttactttg

SEQ ID NO: 25620 - DNA, 101 bp, rice(Oryza sativa)
  misc_feature (71): n=a or g
aatatatggtaagagaatgttctaaaggattcagcatcagtttagcacacatgtttctcggggtccgtctnacttcatggctccacggaactccacacctt

SEQ ID NO: 25621 - DNA, 101 bp, rice(Oryza sativa)
  misc_feature (71): n=a or g
tttaagcacagcctttgatgccaactttttcgccaacttgcagggacctgattttgttgcggagtatgtantctctccagccttcacccgagcaatgaccg

SEQ ID NO: 25622 - DNA, 101 bp, rice(Oryza sativa)
  misc_feature (71): n=t or c
ggatatcaaaatctgctccaaggcggtgaagcatacgtttgaacccttcatgtcccacgtgggtggcctcnagtaaggctggcagcgatggggatgccacc

SEQ ID NO: 25623 - DNA, 101 bp, rice(Oryza sativa)
  misc_feature (71): n=a or g
tggtaggcctaagacaacaaggagaaaacaaccacaagaacttgatgcaggcacaaagatttccaagcatngtgtacaaatccattgtagctattgcaaga

SEQ ID NO: 25624 - DNA, 101 bp, rice(Oryza sativa)
  misc_feature (71): n=a or g
tgggcagtaccgagaattctcatccgttagatcgagctcaatggatggctctgattacaggtaccaggagntaccaccagtcatgatggactgtaaaaaaa

SEQ ID NO: 25625 - DNA, 101 bp, rice(Oryza sativa)
  misc_feature (71): n=a or c
aaccgcaggtaattaccccgtttgtggggaggctttatgattgggcttaaaaaaaaacctagacaatatcntgttggaacggaatactcttatataagata

SEQ ID NO: 25626 - DNA, 101 bp, rice(Oryza sativa)
  misc_feature (71): n=t or c
caccagcggcgacgggtggagggagaggggtggcggcgcattgggatggaggaaagaagagaggaagcgtngaagacgagaagaggagaggaggcaacagc

SEQ ID NO: 25627 - DNA, 101 bp, rice(Oryza sativa)
  misc_feature (71): n=t or c
ctgtatgcctgtatctgcgcccccatttggcacacaaattaacaagaggaacaatccaagggcatggaaanaaatcttcaggatcgcacttgcaggacatg

SEQ ID NO: 25628 - DNA, 101 bp, rice(Oryza sativa)
  misc_feature (71): n=t or c
cgggaaggcacgagtaacaaaaaaagaaaagaaaatctatcgtggtgtgccgtccgcccgttcctctcgtntctccacgcgtcgcggacctatacgaccac

SEQ ID NO: 25629 - DNA, 101 bp, rice(Oryza sativa)
  misc_feature (71): n=a or g
tacactcaaattccctggcaggctcatctgtttgttgggagagagagaagagatgagtaatattgggatgnggatgggggtgatagaagctgggcgattta

SEQ ID NO: 25630 - DNA, 101 bp, rice(Oryza sativa)
  misc_feature (71): n=t or c
gaaattaaacaatttaacgagtgaattaggagcttgtatggccgagaaacgaccatccgaattttaagtgnaattaaagtggatatttccgagttgtttaa

SEQ ID NO: 25631 - DNA, 101 bp, rice(Oryza sativa)
  misc_feature (71): n=a or g
tggacgacccactgggtgggtacaaacggcagggacgtggagaacgagacccagatgatgatcctagaccngtcggggacgaagtcctcgccgaccggccc

SEQ ID NO: 25632 - DNA, 101 bp, rice(Oryza sativa)
  misc_feature (71): n=t or c
acataagagagagagaatactactccagttgagcgggcctcggtatcacttggtcgtccgatctgctgctntgtgccctcaaccgtccggatagcaccacg

SEQ ID NO: 25633 - DNA, 101 bp, rice(Oryza sativa)
  misc_feature (71): n=a or g
cttgctatatatacacataaataggatcccattctgttagcgtatacgtgtaagcatgcacacaatccttntgtaatcgtgtaacgaaaatcgaaagattg

SEQ ID NO: 25634 - DNA, 101 bp, rice(Oryza sativa)
  misc_feature (71): n=t or c
agccagcgcagccactggcgggagcgatctccggtcatgcagcggagacacatggcaatggccttgttcanggccttcgactggccgtccgactgtggatg

SEQ ID NO: 25635 - DNA, 101 bp, rice(Oryza sativa)
  misc_feature (71): n=a or c
tgttgcggatgagaagattgcaacatatgaatgggtacttaagcgctttttggattgcatgtgtcagaaanatcctaaagggttgattacagatagtgata

SEQ ID NO: 25636 - DNA, 101 bp, rice(Oryza sativa)
  misc_feature (71): n=t or g
tgaatagaccaacggcaactccctactcttataaaagtccttttgaaagcggagttgagggtgtgagcacnactatgtctccatagtattggtactttgcc

SEQ ID NO: 25637 - DNA, 101 bp, rice(Oryza sativa)
  misc_feature (71): n=a or g
aaactcaaccatgtattattggtttctgtctcttctatatgttagaggacacattagcggagtgcgtgagngcggtgttgtatgtgtacctaccgtgtaat

SEQ ID NO: 25638 - DNA, 101 bp, rice(Oryza sativa)
  misc_feature (71): n=t or g
gaagggtttcggtgctcgagggtcacccttctggtgccattggtgtatagttgtacactataagagccagngcccatatcaatgaggctcttcttcgaaac

SEQ ID NO: 25639 - DNA, 101 bp, rice(Oryza sativa)
  misc_feature (71): n=t or c
agtgggaagtcctttggtgaagatgtccgcacactaggaagatattggaacattcaacactcgaacagcancgagggcaaccttctcacgcacgaagtgta

SEQ ID NO: 25640 - DNA, 101 bp, rice(Oryza sativa)
  misc_feature (71): n=t or c
atgccaggaatcgcaggggagcatgtgccgctttgccctggcgtgcacatcctcgatgaattgttgcccancagaatcgcgtctttaaagacactaaatgg

SEQ ID NO: 25641 - DNA, 101 bp, rice(Oryza sativa)
  misc_feature (71): n=a or g
tttgtcgtcggcctttccaagtacggcgagaggatacatgcgctcagatgtaacaagctgagcaacatctngagctccccgaaggaagtatatcgtaataa

SEQ ID NO: 25642 - DNA, 101 bp, rice(Oryza sativa)
  misc_feature (71): n=a or g
tgactcctccaactatcaaaaccggtgtaaaatatatccctgagtagttttggaagcgattttggctgacntggcgcctacgtggcactgttgacccaatc

SEQ ID NO: 25643 - DNA, 101 bp, rice(Oryza sativa)
  misc_feature (71): n=a or g
tatactgtacaagaatgtattcttcagtagcggcggcacgattgtccgggtgtcctcatcagtcatgttcntcatgggcattgtcaagtatggggagagag

SEQ ID NO: 25644 - DNA, 101 bp, rice(Oryza sativa)
  misc_feature (71): n=a or c
ccacccctagctagctgccaattaaacaaaattcaaatattctcttcacacaaagcatgtattagactagntaaacaaaatccaaatattctcctcactgg

SEQ ID NO: 25645 - DNA, 101 bp, rice(Oryza sativa)
  misc_feature (71): n=a or g
accattaacacacaagaggttcctccgaagaaatagaggaacctatggtccagccataaaagctggggagnccactttccctgggcaggcaacacctatac

SEQ ID NO: 25646 - DNA, 101 bp, rice(Oryza sativa)
  misc_feature (71): n=t or c
caaaattgacagccacatagtatttaacacatcacagcaactgaacatccatcaaccatcatctagagtcnaacacatccatcaaccatcacatccatcta

SEQ ID NO: 25647 - DNA, 101 bp, rice(Oryza sativa)
  misc_feature (71): n=t or c
cttagccactttttttgtggtcgaagtctttggcgtatttatgattatacccatttcgcattatgcaatantttctcttttttggcctattctcactatgc

SEQ ID NO: 25648 - DNA, 101 bp, rice(Oryza sativa)
  misc_feature (71): n=a or g
ggcagcggcggcaacaacaactttagcaacaaccgtggtggaaggggtcgcggcaaccctagttcaggtcncggcaatccagctcctggaggggttgataa

SEQ ID NO: 25649 - DNA, 101 bp, rice(Oryza sativa)
  misc_feature (71): n=t or c
gatattctataggttgtttcagcagtggtgaattccagcttatgatgagaggcaagaatacattttcagcnacagatgtgcacacttctgatggaagactc

SEQ ID NO: 25650 - DNA, 101 bp, rice(Oryza sativa)
  misc_feature (71): n=t or g
ataatccccctctcgcttggcgtttaagcaaggccatgaaaatcactgaagcctcatcgcttgctttacanattggcggaaccagcgacactagcgataag

SEQ ID NO: 25651 - DNA, 101 bp, rice(Oryza sativa)
  misc_feature (71): n=t or c
aggttttattagtattggtgttaccgtcgggttttgtttagtttaaacgagacagaaatgcgacgttgagnttttaaaaatatctcgagttcctttttttt

SEQ ID NO: 25652 - DNA, 101 bp, rice(Oryza sativa)
  misc_feature (71): n=a or c
gacatctagatctaatggggctcgtcgtcttcggctcttcagatccggccacctcggcagagcaacaatgncggcaaaggcggtgcagcaatggagacgac

SEQ ID NO: 25653 - DNA, 101 bp, rice(Oryza sativa)
  misc_feature (71): n=a or g
ggtacctttaaactcaggagcatgcttgaatgggtcaaaacctaacccatgcaagtcctgcttgggatgangaacgtatacctaaagtatttatggaatat

SEQ ID NO: 25654 - DNA, 101 bp, rice(Oryza sativa)
  misc_feature (71): n=a or g
ctgggaatcctggaagccacctcgatcccatgttgcatgaagcggtagttcagcattctatttactcaccngatacagtctcccgtcgtgtttcttcccct

SEQ ID NO: 25655 - DNA, 101 bp, rice(Oryza sativa)
  misc_feature (71): n=t or c
cgactacaacttagtaagttaaattcaactgatgcagcataagctgtaacagaaatcgtaaggcctaacangcctttgattgtttttcaggatggtagata

SEQ ID NO: 25656 - DNA, 101 bp, rice(Oryza sativa)
  misc_feature (71): n=a or g
tccctttctcttgtaggcactacaatatgaatcgcatcaggcttgtctggtcaagcatatggcatgtcttntctgatttttttgttacaattggctgctca

SEQ ID NO: 25657 - DNA, 101 bp, rice(Oryza sativa)
  misc_feature (71): n=t or c
gaggactatgatacaaatattcttgatgattttggaacttctgaaggtgtggaagtccatactcgtgagcntgcaaaaaaaacaggaagtagctctaagaa

SEQ ID NO: 25658 - DNA, 101 bp, rice(Oryza sativa)
  misc_feature (71): n=t or g
cagaaatttgatatccaaccaaggaatagtttgcaagcctcactgtggtaaaactcatacttggatagtgntagtgtttgattgctttccgtagtttccac

SEQ ID NO: 25659 - DNA, 101 bp, rice(Oryza sativa)
  misc_feature (71): n=t or c
cccctatattactgatcacacatgttttcctccaaagcttagaaccttcaagcctgacagaaactctgatnggaaaaccgcaaagtcgcaccagattaacc

SEQ ID NO: 25660 - DNA, 101 bp, rice(Oryza sativa)
  misc_feature (71): n=t or g
cacctagtttgggccagcccattcaagccaatccaacacggcccagcccaatcattcagaaacattcaganaaaaccagagttgactgacatgtgggtccc

SEQ ID NO: 25661 - DNA, 101 bp, rice(Oryza sativa)
  misc_feature (71): n=t or c
agtctgggctgtgtgcatcaatttatgggcttatatatgagccaaaattgccggaggccacaatcacattnacattagcctccactaatgtccgtcccgga

SEQ ID NO: 25662 - DNA, 101 bp, rice(Oryza sativa)
  misc_feature (71): n=a or c
aaattagggtgcacaatgcagaaaccacttgacgatcaaacacaggcagcattgagttccctataagtagngatcaaaggggtcatcgatagaaaaatcaa

SEQ ID NO: 25663 - DNA, 101 bp, rice(Oryza sativa)
  misc_feature (71): n=a or c
agagaacttgaagatcgtctgttgccagggactggttacagttggaggatcagagtcgattgcagggatanagaatgtggacatcaggcactgctcgaagc

SEQ ID NO: 25664 - DNA, 101 bp, rice(Oryza sativa)
  misc_feature (71): n=a or g
aaatatgctcatcattcatcttggcatgaggtacacacctgtgcaatccaccatctccgatccattttacnatgatttttaaccaatctcccatctatctc

SEQ ID NO: 25665 - DNA, 101 bp, rice(Oryza sativa)
  misc_feature (71): n=a or g
aggttgtgaatttattctgtcaagacacaggccgaatcagcacgttcaaactttagatggacaagttaganttagtgcaacccattaagatcactcgatcg

SEQ ID NO: 25666 - DNA, 101 bp, rice(Oryza sativa)
  misc_feature (71): n=t or c
tcaccgttggatctaaacacaacctaagtttgcaatgtaactagatgaaccctgcatgttgctgcaggagntttgtacgataatagtagaaataacacgtt

SEQ ID NO: 25667 - DNA, 101 bp, rice(Oryza sativa)
  misc_feature (71): n=a or g
ctcaaaatcaattttaaaaattgagtttcaacaagaggggccatccgcccatcacaggaaaatatgtagtncaaactctatatgcgtagtggaaacttgga

SEQ ID NO: 25668 - DNA, 101 bp, rice(Oryza sativa)
  misc_feature (71): n=t or g
ctgatttacctcaatgacaggcatcgctatcatgtgctgaaggacctccatatcatgcttgctaaatattncaggatgatgcatggctgccgcagaagaag

SEQ ID NO: 25669 - DNA, 101 bp, rice(Oryza sativa)
  misc_feature (71): n=t or c
cggcccagacctcatctcagccccgcatcctccctcttcttccttctcaactacgataacatcaaccttgncactgtaaccgcatcccttcttgctgactt

SEQ ID NO: 25670 - DNA, 101 bp, rice(Oryza sativa)
  misc_feature (71): n=a or g
ttgaagatgtctctacggtgtttggtaaaaggaaattttaggcggtcaggtggtggatggatgaatgtatngtagcaggtccatctagaagaagaagtccg

SEQ ID NO: 25671 - DNA, 101 bp, rice(Oryza sativa)
  misc_feature (71): n=a or g
ttggaggagattggacttgaagcggtagcgtgcatgtctcttgaaagccttgagcagccagacctaatacnatggctcatggacaggactaatcccgtgtc

SEQ ID NO: 25672 - DNA, 101 bp, rice(Oryza sativa)
  misc_feature (71): n=a or g
gcctctcctgacatgactaaagttgttaactcttccccatttctaatgccaagtgccacaaatagtttgcnccccatcagttcagctagtggcagtctgag

SEQ ID NO: 25673 - DNA, 101 bp, rice(Oryza sativa)
  misc_feature (71): n=t or c
tatttgcagcaaatgcatccaaagcccttcctatctgtttttggctgacatgttgctccttttcttcagangtctcttaaagagagattaagtggactgga

SEQ ID NO: 25674 - DNA, 101 bp, rice(Oryza sativa)
  misc_feature (71): n=t or c
caccatttgagaacttacaaatgttctgcattaacaagctgatccagccctgggtttgaacctgatgaaancggtattttccccgacagctgattgtctga

SEQ ID NO: 25675 - DNA, 101 bp, rice(Oryza sativa)
  misc_feature (71): n=t or g
ttcttcgaccttatggttgtcttgtgccaagcagatgatgcatctgtcataagtgtcatctgtggatgctnctgtagctgaacattgtaacttgtcggggg

SEQ ID NO: 25676 - DNA, 101 bp, rice(Oryza sativa)
  misc_feature (71): n=a or g
ttgaggataaggatttcaagtgttgagaaatgcttccaaattgaactttagttctgactttgcttgttttntaatggttgatgacaatttcaagtacaaga

SEQ ID NO: 25677 - DNA, 101 bp, rice(Oryza sativa)
  misc_feature (71): n=t or c
gccgaagttagaaggagaaggagcatctggtgccaaaggagagcagaaagaagatgataataataaaaaanagttgatgactttataggatcgtcttgatt

SEQ ID NO: 25678 - DNA, 101 bp, rice(Oryza sativa)
  misc_feature (71): n=t or c
ggagtgatgaactgccttcttgccaagcttgccaccctgattgatgaagagcatgttaagttcagcaacantcctaaggaggtgggcttcctcagggatga

SEQ ID NO: 25679 - DNA, 101 bp, rice(Oryza sativa)
  misc_feature (71): n=t or c
atgaatgacaaaatactttatacaaggcctaagccacataattcagaattcagtttcgatcaagcagtcangcttgacagcatagtgcaatggtgatctga

SEQ ID NO: 25680 - DNA, 101 bp, rice(Oryza sativa)
  misc_feature (71): n=a or c
tcgcattctcagttctcacgttgcgttataggcgttgatgcttactgtgtagctggggttagagcaagtantccctccatattttaatgtataacgccatt

SEQ ID NO: 25681 - DNA, 101 bp, rice(Oryza sativa)
  misc_feature (71): n=t or c
tgcatttgtttccaagacaactaatgtttgagagaggtctttagttccaatgttgcttgaagcatatctangaatatgggttgtaaaaatcatgggacttg

SEQ ID NO: 25682 - DNA, 101 bp, rice(Oryza sativa)
  misc_feature (71): n=t or c
tctggtacagctcctggtttctcttacccatctggcgacaagatagtgcctgtgatttgggaagagaacantttgtatgactacctgcttactcctaagaa

SEQ ID NO: 25683 - DNA, 101 bp, rice(Oryza sativa)
  misc_feature (71): n=a or g
tcggtatatcgacacgttccgatagaaacattcaaactgaaagattaaaacctggctacaaggaggaggangaggattatacgtacccggcgatgaggatg

SEQ ID NO: 25684 - DNA, 101 bp, rice(Oryza sativa)
  misc_feature (71): n=a or g
agcggtcgggtccagccagcccaggatcgaggaaagggaacaaatcatcgatactacggctatgtttaganctgaaaaagttgagaggctggaagaaagtt

SEQ ID NO: 25685 - DNA, 101 bp, rice(Oryza sativa)
  misc_feature (71): n=a or c
gcataagaaatccaagaatgatagtccaaaataaaacaaaagggcataaaaagcataccagtactgacacnagaaccgcaacttctcgatctcaggcttgt

SEQ ID NO: 25686 - DNA, 101 bp, rice(Oryza sativa)
  misc_feature (71): n=t or g
ctttggctctctttctttatgcttataaaccaacttatctctatctctaatgaaagaaaaatatgatttanaatctaaaagaaaatgatgattagaattta

SEQ ID NO: 25687 - DNA, 101 bp, rice(Oryza sativa)
  misc_feature (71): n=t or g
ggaagaatatgacaagtggggcaagggatatttttgacttttcacgctctttatctctcctactcaactgnaaattaatattttaacgcgcgaggtgtcta

SEQ ID NO: 25688 - DNA, 101 bp, rice(Oryza sativa)
  misc_feature (71): n=t or c
aaaggtttctcaaaacggtgtaaagaaagcaaacccatcaaatgctgtgaagaagccccagaggaagtcantccccaaattgccatcggaggaaacgggtc

SEQ ID NO: 25689 - DNA, 101 bp, rice(Oryza sativa)
  misc_feature (71): n=a or g
agtcccattcaatgcctgttgagatatagccaacagattcacttcttcttcttcttcaggtggggtagcangatctgaactcacttcactgtcagtatgca

SEQ ID NO: 25690 - DNA, 101 bp, rice(Oryza sativa)
  misc_feature (71): n=t or c
agagcctctatcttcggctcagtaagattgtaatagtcggtcagcgcagcggaatgggctttttccttctncagtttggccttaaggcgatcgacctcagc

SEQ ID NO: 25691 - DNA, 101 bp, rice(Oryza sativa)
  misc_feature (71): n=a or g
taaaagagtctaacaatcaagcgtttgtaaaattgggttttcgcagatggcctccttaagtgcccctcctntgaaaatggatttttcacgtgcaattgtga

SEQ ID NO: 25692 - DNA, 101 bp, rice(Oryza sativa)
  misc_feature (71): n=a or c
ttagagcagctataaatgtaacagaattgggttttacatgtcctagcatataccggaaatagtacaaagcntcaaaactcctgtggttaaagcaaaatcca

SEQ ID NO: 25693 - DNA, 101 bp, rice(Oryza sativa)
  misc_feature (71): n=t or c
gtgtatgcaagcaaagcaaaaacagaaagatcgacgtccctgcatggtatgattggtatccgactatccgngacagcgatgcgggtgtgacttgctgacgt

SEQ ID NO: 25694 - DNA, 101 bp, rice(Oryza sativa)
  misc_feature (71): n=t or c
atgaagagagcgtagttcagctggttagcttatggtgcacctacctatccgatctaattcgagtaataganttgacaagggtgcttgtatttatggctaat

SEQ ID NO: 25695 - DNA, 101 bp, rice(Oryza sativa)
  misc_feature (71): n=a or g
tggctttcctgttaatgtggttagaaaagtttctcttttgtgggtctagctgcggtcttacaaataaattngcagttcgtagccgaagccttggagacaaa

SEQ ID NO: 25696 - DNA, 101 bp, rice(Oryza sativa)
  misc_feature (71): n=t or c
caagttgtcccaacaatgttgagagctccaatttggaaaagattggtttgctctatggaggtggcagattngaagccaggtatgtgcggggtagacaaaac

SEQ ID NO: 25697 - DNA, 101 bp, rice(Oryza sativa)
  misc_feature (71): n=t or c
cacaagtgtgcacggttgttctacattgagtatgatgactccacggatgatgacggagccaacgacgatgnggtgccacaagtgaacacgctatcaggcat

SEQ ID NO: 25698 - DNA, 101 bp, rice(Oryza sativa)
  misc_feature (71): n=t or c
actgtgggcaccacgcgtatagcagtacgtggatgactgggtcttagccccggacaaggtgatcgacgagntcgtaccacactcagaggacacctacaggg

SEQ ID NO: 25699 - DNA, 101 bp, rice(Oryza sativa)
  misc_feature (71): n=t or c
ctattctaccactagaccactggtgccttgttgatagatttttcaattaacaagttctaatccatttcatncattcttcgttacactacgctctgcaatct

SEQ ID NO: 25700 - DNA, 101 bp, rice(Oryza sativa)
  misc_feature (71): n=t or c
gcgatctctttccacgcgggaggaagaaaacgaaaatttatgttggtacgtagtttatttaatagaagggnccacttttagtttttaggaattgaatttag

SEQ ID NO: 25701 - DNA, 101 bp, rice(Oryza sativa)
  misc_feature (71): n=t or c
ttgattttagtggaaatgttggtactgtcgaagataacgctcaatgacgggatgagcccgttcgttattantgtgtaccgcaacctgatcgccgctgccgc

SEQ ID NO: 25702 - DNA, 101 bp, rice(Oryza sativa)
  misc_feature (71): n=t or c
acagtacaatcgttggtgcttataacacacgcatacgcatacgcataccctgtctctatgagtatatccangaggctgggccggtatatcttaaaattgat

SEQ ID NO: 25703 - DNA, 101 bp, rice(Oryza sativa)
  misc_feature (71): n=a or g
ctcctgcatgttgttagtgcatcgttgccatcaaacatgggacagccaacgcaaccaagtcaaagcttctncaccaatgaattggcagctaactacagtat

SEQ ID NO: 25704 - DNA, 101 bp, rice(Oryza sativa)
  misc_feature (71): n=a or g
cattcgattcattccatgaagatattcccagaatcccaggtgtcgattttaagggtttcgtgtcaattgcncggcagattcgtgttctagtgcgttcagtt

SEQ ID NO: 25705 - DNA, 101 bp, rice(Oryza sativa)
  misc_feature (71): n=a or c
cgggacaacatcgtgaacgtaagtgctatgtgtggttgtctatcactaggcgtctgttgccctcaaagagnagacgaggtcgaatcaaggagccgccaaca

SEQ ID NO: 25706 - DNA, 101 bp, rice(Oryza sativa)
  misc_feature (71): n=a or c
tgcatgtgttgcagataagcttgtagaactggatccttcagacagtggaatctatgtacttatgagccaantatatgcaagtaaaaataaatgggatcagg

SEQ ID NO: 25707 - DNA, 101 bp, rice(Oryza sativa)
  misc_feature (71): n=a or c
ctaagtttcaaaccaactgttgatagcaagtcgagaaggggttctatgtgcaagagtagtacaaaagccantgtttctctcttctgcttcttcttcttctt

SEQ ID NO: 25708 - DNA, 101 bp, rice(Oryza sativa)
  misc_feature (71): n=a or g
acaaaaccgccgttggagggtggggggaggcgaagagaaagacgaagccgccgtcgaggacaccgccacangcgtgctcctcggagtcgagcacaaagcca

SEQ ID NO: 25709 - DNA, 101 bp, rice(Oryza sativa)
  misc_feature (71): n=t or c
cctactccacggtataaagctcgtgcgcctccttccttgtaaacagttttgaaaacgtccttgataccacnatatgctggctgtctaccagcatttcccaa

SEQ ID NO: 25710 - DNA, 101 bp, rice(Oryza sativa)
  misc_feature (71): n=a or g
gctgatcgattatcaccttgttataaatcctcaggatgtcttttttgggggaatagacacatcagctttgntccttgaattcaccatcgcagagctcatgc

SEQ ID NO: 25711 - DNA, 101 bp, rice(Oryza sativa)
  misc_feature (71): n=t or g
gttgtactagcgagatcagaacagacatggtggtcgttaatctctaccgtatatatatatgatctccccangttatatctagataagatatagatatatat

SEQ ID NO: 25712 - DNA, 101 bp, rice(Oryza sativa)
  misc_feature (71): n=t or c
tgagcaatgcgggacaaattaagtactgttcaatgcggaatctgtacaatcgtagataatgaagcaaaagnaacagctgaaactgaacaggaaaaacatat

SEQ ID NO: 25713 - DNA, 101 bp, rice(Oryza sativa)
  misc_feature (71): n=t or g
taagcgagaaatagatgctttgacgagaattcggcatcgaaatattgtgaagctctttgggtactgttctncagtccacggcaaatttcttgtctacgaat

SEQ ID NO: 25714 - DNA, 101 bp, rice(Oryza sativa)
  misc_feature (71): n=t or c
aaggaaaacatcccgtgaaaagatggacaacttcaacatttctgttcaaacgggcaggcttaggatacagngacacagagacgttctcaagctcacatatt

SEQ ID NO: 25715 - DNA, 101 bp, rice(Oryza sativa)
  misc_feature (71): n=a or c
ggaaactcggtaggcgcggtggaaccaatcgaagtggattggctagcagtgtggcaaccgtactactaatngtggaagattagaagtgacaacaactgatg

SEQ ID NO: 25716 - DNA, 101 bp, rice(Oryza sativa)
  misc_feature (71): n=t or c
ttgtgatcaaagtccctgtgtggtggtaagctggtgggctcctgaaaccttgctacaaactcagttaaaanttctgtcacctgagggggtacactatctga

SEQ ID NO: 25717 - DNA, 101 bp, rice(Oryza sativa)
  misc_feature (71): n=t or c
tatacgtaagtacctagcttgaccgccagttagttaattaaactctatcagactcatggctgatgctgctngtaatgaaggcagccattgccgactagtca

SEQ ID NO: 25718 - DNA, 101 bp, rice(Oryza sativa)
  misc_feature (71): n=t or c
ctatagaaataatgggtttgctgatagtctggttgcagccacagaaattgcacttgaaatgggagtagagncatccttcccagtagagcgtcagtctcaaa

SEQ ID NO: 25719 - DNA, 101 bp, rice(Oryza sativa)
  misc_feature (71): n=a or c
tgcaaatttgcatttcacatgttcctggcgtgatggacataatccggccaagagtaatctacaagagaaanacacggatttaatgattgcgcagattacta

SEQ ID NO: 25720 - DNA, 101 bp, rice(Oryza sativa)
  misc_feature (71): n=t or g
cgatcaatgggacaattatcgcccgtgaattctacctgatgatttatccacgtgctcatcacagccagcanggaaggccagaggcgggatgattaatttgc

SEQ ID NO: 25721 - DNA, 101 bp, rice(Oryza sativa)
  misc_feature (71): n=a or c
tactcaataaaaaacggtgagtctttatgagtacttcaatagtactaatattagtagtggaggctcgaacnccacctcccggttggatccgcccctggacg

SEQ ID NO: 25722 - DNA, 101 bp, rice(Oryza sativa)
  misc_feature (71): n=t or c
ctgacaaagatgaatctcgggaatgagatattcgccccattcatgttccgcgtatttttcgaatatcttcngagcatcaaatgaagcatccggacagtagc

SEQ ID NO: 25723 - DNA, 101 bp, rice(Oryza sativa)
  misc_feature (71): n=a or g
tttgattgttgatgactttacatggtggatgtgggtgtttgtgattaaatccaagggccaagctttggaanccttcaccaagttcaaacccctggctgaga

SEQ ID NO: 25724 - DNA, 101 bp, rice(Oryza sativa)
  misc_feature (71): n=a or g
catctatagacttctcccatgagagggacttgtgctgcaagtatctcatcaatttctacaaccttgtgccnaagtgtacttaagtttgaaggccacaaaaa

SEQ ID NO: 25725 - DNA, 101 bp, rice(Oryza sativa)
  misc_feature (71): n=a or c
ccgcgtcctccgtccctcgccattcctcgtcgtcacctccagctccggtcagccaacctcgtcgcacaccngtggtcctgccacataagaggggacggttc

SEQ ID NO: 25726 - DNA, 101 bp, rice(Oryza sativa)
  misc_feature (71): n=t or g
tcggaagattcgaattcgggtgtgtttgcgtggattggttcgctttgttcgctcgaattagcgaggatttngggctaatcggtggaatctgtgtctactgt

SEQ ID NO: 25727 - DNA, 101 bp, rice(Oryza sativa)
  misc_feature (71): n=a or g
gcatatagggatttatgtttagatgcttatagtatttgctcttagtacgtagtagctagtaccaaaagctngccagtacagcaagaggaagaactataaaa

SEQ ID NO: 25728 - DNA, 101 bp, rice(Oryza sativa)
  misc_feature (71): n=t or c
gcctactcctctcccgcctcgtccccgcggcctacaaatcgtgaaggaggaggatgtacatgcaggacaanagtcgtggaaggagcggccatcggtgcggg

SEQ ID NO: 25729 - DNA, 101 bp, rice(Oryza sativa)
  misc_feature (71): n=a or g
gttgatgttcttcgctaaattgccacaatttctcctcaactaatttctgattgatctgccagtttgcatgncacagaggaatatctctgtacttaattaac

SEQ ID NO: 25730 - DNA, 101 bp, rice(Oryza sativa)
  misc_feature (71): n=a or g
ttcttgcaaagaacaaatggcagtggtcttgagatatgttgataaatatggaattgtgagagagagatttnttggtcttgtccatgtgactgaaacaactt

SEQ ID NO: 25731 - DNA, 101 bp, rice(Oryza sativa)
  misc_feature (71): n=t or c
ccagttattgcaaaatgttgctctccattgatttgtgccctcgctttcatcccctttttctcactaaatgngaaaggtccctgatcctgttcttgcgtggg

SEQ ID NO: 25732 - DNA, 101 bp, rice(Oryza sativa)
  misc_feature (71): n=a or g
gtatatctgctatggacaccgcaaaaaaactggtaaatgagctgctggatacccgtggcattattttgttntatccaaaggaaaaggggagagaaacaatc

SEQ ID NO: 25733 - DNA, 101 bp, rice(Oryza sativa)
  misc_feature (71): n=t or c
gctgcacaaccacggacgcttccatcaccggtccccatggtggatggccaaatctagctaccatgaactcngggaaaagcttgatcccacaatggtcggcc

SEQ ID NO: 25734 - DNA, 101 bp, rice(Oryza sativa)
  misc_feature (71): n=t or c
gcagatgtcctacgtggcgggctagagcttctgaagcctttgatagtgctttcagaacactctgtctgtcnatgtatatacatacaaaactatcatgtgta

SEQ ID NO: 25735 - DNA, 101 bp, rice(Oryza sativa)
  misc_feature (71): n=t or c
ggtaaaaatcagaaaaaaatcgccatcttggaagaggagaaggaggagaagcaaatccaagaaaaaatatncaagtaaagtacacatgaagttcaaattct

SEQ ID NO: 25736 - DNA, 101 bp, rice(Oryza sativa)
  misc_feature (71): n=a or g
taatacctaatgataaactattcgcaatctgcaagagagtagaccataccacgtatctacagctgccactngtcatcttatggataaaatttaattgattt

SEQ ID NO: 25737 - DNA, 101 bp, rice(Oryza sativa)
  misc_feature (71): n=a or g
tgttgcttcccgactcacgggaacaacgtcagtagatgctgtcacgggggatgtgctagaagttcctccanatttggcccgaccagccttcgaccgcgctt

SEQ ID NO: 25738 - DNA, 101 bp, rice(Oryza sativa)
  misc_feature (71): n=t or c
ctcctgtaatcatggtcacattcatcccctacatgtaacaggggaggttcctccacagtgaatgaatcatntgtatcaagctccatttcactatcaatatc

SEQ ID NO: 25739 - DNA, 101 bp, rice(Oryza sativa)
  misc_feature (71): n=t or c
accttttgttggcgatcttgaaccggacgatccgctccaagaacttggcgaccatgagcgcccagagcgcncagagagggtaccggaactgcgaggcattg

SEQ ID NO: 25740 - DNA, 101 bp, rice(Oryza sativa)
  misc_feature (71): n=t or c
gtcctctccctcagcgactccatcatgggatccatgtacgaccgcgtgtttaggtatatgtgtgtcggctngtcgatgcctctcttggtgtactggtactt

SEQ ID NO: 25741 - DNA, 101 bp, rice(Oryza sativa)
  misc_feature (71): n=t or c
tgatggatcggctgctcaatctccaaggacctcctttgggtaacattgaaaatgtagagctggcgaggttnaggagcaaaaactttgacatatggtggggt

SEQ ID NO: 25742 - DNA, 101 bp, rice(Oryza sativa)
  misc_feature (71): n=a or g
cacctgttgagtattgactggcattttttttcctccatcttgcaggtatgcttcacgagtgcgttgcattntcaatgatacgagcaagcatgttgccccaa

SEQ ID NO: 25743 - DNA, 101 bp, rice(Oryza sativa)
  misc_feature (71): n=t or c
cagctcctgagcagggagggcttgccgaacatctgctccagcgccagcacgacggccatggccaccgacanctccatccccggccgcaccaccagccggaa

SEQ ID NO: 25744 - DNA, 101 bp, rice(Oryza sativa)
  misc_feature (71): n=t or c
ttctctttcttccttcctgtaggttttcccgatagctgcataccattagctggaataagattctctatctngaggaacgcagctctgaggaccaaaaggtg

SEQ ID NO: 25745 - DNA, 101 bp, rice(Oryza sativa)
  misc_feature (71): n=a or c
taggtgtgtaggtatgtcttagttcgactctctttgtcacaaacttgcatatttcgtggttcctcctaaangatgatcatgagaacccatgcatttctatt

SEQ ID NO: 25746 - DNA, 101 bp, rice(Oryza sativa)
  misc_feature (71): n=a or g
caaacaggaacggcgtatcgcggaggtcgtcctgcgaggaggtgctttcgtattcggtggtattgtacgangtatagcagttggacacgacgtgggtgtac

SEQ ID NO: 25747 - DNA, 101 bp, rice(Oryza sativa)
  misc_feature (71): n=t or c
gcaagaaaaagagaccgaaatcggctgttgctccattggctgcataaaagaagtccaagaaacagaaaacngccgttgccgatgacttgccttctattgac

SEQ ID NO: 25748 - DNA, 101 bp, rice(Oryza sativa)
  misc_feature (71): n=a or g
gccctcatgcacgcggatccgcttgtggcttagagcgacattggcaatgacggtagtggcggtgacttctngattctagggttaggttttagggctaagag

SEQ ID NO: 25749 - DNA, 101 bp, rice(Oryza sativa)
  misc_feature (71): n=a or c
gttattggctccgttcacctcggccattgtacttactttttcgccggagatcgaagaaaaaagaaaagagnaattagagcttaattagcttagcttagcta

SEQ ID NO: 25750 - DNA, 101 bp, rice(Oryza sativa)
  misc_feature (71): n=t or g
tctttggaacatggcagcaaaattatccgtggagaaataagctggtatcagagccatggtttggttccttnatgtaatcactgttttgtgaaattttattt

SEQ ID NO: 25751 - DNA, 101 bp, rice(Oryza sativa)
  misc_feature (71): n=t or c
ctcgatgtcctatgacgaccatctcacattcaactccctcgccaagctccattgatgatttcctcatgttngttccctcgtagcactatctgtcctgagct

SEQ ID NO: 25752 - DNA, 101 bp, rice(Oryza sativa)
  misc_feature (71): n=t or c
ttatagggtggtctaagctctggatacaagaaatttattgctgaaaatggtattgatgatgacacttattnggaagatggacttgcgctcttccgaattca

SEQ ID NO: 25753 - DNA, 101 bp, rice(Oryza sativa)
  misc_feature (71): n=a or g
tctccccaaaacatccgaaaaatccaaagcatgacgaacaggggtagttgatcgaaacgtacttttgaccngaggtggcacaagggtggtgaccatcccat

SEQ ID NO: 25754 - DNA, 101 bp, rice(Oryza sativa)
  misc_feature (71): n=a or g
ttttgtagctgactggactatgcctgacaacaggccagatagtcagactgataacgagacatggacaatgncgtttgatggtgcactcaatagccaaggag

SEQ ID NO: 25755 - DNA, 101 bp, rice(Oryza sativa)
  misc_feature (71): n=t or c
gtacgagcggaaagccagggagatgaacacaaccctcacataaatcgcctgttcgggcacaagcacaatgnccacatccacctcgcctacatgcctccact

SEQ ID NO: 25756 - DNA, 101 bp, rice(Oryza sativa)
  misc_feature (71): n=a or g
ttggatacctgaaatcaagcaccaacattagaatgccggtacatacacaattgcacaaggatgaagcaccncatacaaaatatggaagaacaaatgaaact

SEQ ID NO: 25757 - DNA, 101 bp, rice(Oryza sativa)
  misc_feature (71): n=t or c
cattcctgatatgccaaatagtgttcgagtgctggatctatcccacaacaacttgtctggatcattaccanaaagctttggagacaaagaattgcaatacc

SEQ ID NO: 25758 - DNA, 101 bp, rice(Oryza sativa)
  misc_feature (71): n=t or c
cacatggctaggtctggattggcgtcatgattaagaagatacttggcaattccccgatgcccagaatgtancgccttaagtagagatgttctacctgtcaa

SEQ ID NO: 25759 - DNA, 101 bp, rice(Oryza sativa)
  misc_feature (71): n=a or g
tattttatctcttgctacaggtgtagtaaactgtgagtaagtacttgttttcatgtctgttctctctgtangtcatgaaaaatggtttattatgcaaaaac

SEQ ID NO: 25760 - DNA, 101 bp, rice(Oryza sativa)
  misc_feature (71): n=t or c
tgagaaggcgattcgacgcttcgcttcgaggggagatttttttttctctgcgattttggggttcgattganggaggaagaggcgaggagggggtggggtat

SEQ ID NO: 25761 - DNA, 101 bp, rice(Oryza sativa)
  misc_feature (71): n=t or c
ttaaccacgggtgtcacgggcaaaacatgtgtagtgaaacacgaagagaaattcctttttcgacggagttnaggggcttattcactttgctattattttca

SEQ ID NO: 25762 - DNA, 101 bp, rice(Oryza sativa)
  misc_feature (71): n=t or c
tagaagaaccaagtgagttccaggagaggcacaaatacaaccagtgccttccaacttgcagagatctaganaaccaagtttttctccttcggccaaccaag

SEQ ID NO: 25763 - DNA, 101 bp, rice(Oryza sativa)
  misc_feature (71): n=t or g
atcacccaatcataaattccagtcaccttcccattacaacctgcatagctgctcaccttttctaccatccnttctatcctctttcttcttttctctctttc

SEQ ID NO: 25764 - DNA, 101 bp, rice(Oryza sativa)
  misc_feature (71): n=t or g
caaggcggagctcttcggccagatgaaggagagcagcagcagcaacacagtggtgaacgtggacgacatgnaggcggaggtgttcagggccctcctcgtct

SEQ ID NO: 25765 - DNA, 101 bp, rice(Oryza sativa)
  misc_feature (71): n=a or g
ggcatgtggctgacatagggcggctggataggacaaaagtatatgacgtaagcgatcccactgtgtgatantggtatgtggagtactggagtgtgctgttg

SEQ ID NO: 25766 - DNA, 101 bp, rice(Oryza sativa)
  misc_feature (71): n=a or g
aaaagatggggctgtcaagctaccaatgtggaaggagaatgaggaccgggtaacagcttaacctatgccanccaggagtattttggcaagaacacatttca

SEQ ID NO: 25767 - DNA, 101 bp, rice(Oryza sativa)
  misc_feature (71): n=a or g
atacccagcccttgctgatgagtttcagttgcaagttttgagctcgaggacaatagcaattgtgcatgagncgagatcaaacaaggtgacaaccacaagta

SEQ ID NO: 25768 - DNA, 101 bp, rice(Oryza sativa)
  misc_feature (71): n=a or c
agcggagagcacaaacgattctgatggaccatgttggggatcgtgagtagaggaggaacgatggatgacgncctggcagtgagtggcgaaggggtggcgtg

SEQ ID NO: 25769 - DNA, 101 bp, rice(Oryza sativa)
  misc_feature (71): n=t or g
tcaaggaccaggtgagggaggccatggagaaggcccgcgagatctccagcaacgccatcgccatcatccancagggcgccgccttcgccgccatgctcgac

SEQ ID NO: 25770 - DNA, 101 bp, rice(Oryza sativa)
  misc_feature (71): n=t or c
cagatatcctgaactccattcttgtcttggcattgtagaggtcagatcctcagccgaacaaaaagggtagncgctacctctcacctatgctaagtcgccat

SEQ ID NO: 25771 - DNA, 101 bp, rice(Oryza sativa)
  misc_feature (71): n=t or c
cctgctgcattcagctcatgggaggtgagaagttctaattcttttggttactgtgattgggtaggagttgnttgtacagatggccaggttacgtccctctc

SEQ ID NO: 25772 - DNA, 101 bp, rice(Oryza sativa)
  misc_feature (71): n=t or g
tttggctcctaagagtactctaggtagaagaaacagcactgaagctgcccatgagcaagaaaacactgccngtgtatgggcgtaggtacaccaagccaact

SEQ ID NO: 25773 - DNA, 101 bp, rice(Oryza sativa)
  misc_feature (71): n=a or g
gggctagtggaacttgaatctgccagaaaactgaatcaacgataataattgaagggtgacagtttggaggntgacaattttattatagttactcataacgt

SEQ ID NO: 25774 - DNA, 101 bp, rice(Oryza sativa)
  misc_feature (71): n=t or c
tctataaagatctacaactttctggttgaaagttcttttcatttgagattgtttggaatattcattagaanttctcatatttatttttgaaaatatacctt

SEQ ID NO: 25775 - DNA, 101 bp, rice(Oryza sativa)
  misc_feature (71): n=a or c
cccaagttaccaagagagcagagtttactggctttgacttagactctcaatttggagacacttcaagtagngcgttttcagcaagcaatcaatgagaaata

SEQ ID NO: 25776 - DNA, 101 bp, rice(Oryza sativa)
  misc_feature (71): n=a or g
ggacatgttttcatccctagccaatgcaaatacatcctggccatagtttatgcccaagccaaaagaagggncctgcaactggaagtctcccttgacctcca

SEQ ID NO: 25777 - DNA, 101 bp, rice(Oryza sativa)
  misc_feature (71): n=t or c
gcggaaaaccacatgtattataacgtgtgacacataactagagatagcaatgggacccataactcgagacncgatggatttttactctattagaagctaat

SEQ ID NO: 25778 - DNA, 101 bp, rice(Oryza sativa)
  misc_feature (71): n=a or g
tcagattaaacaaaaaaaaaagaagccgagaaaaagaaacggaaacaaaccatgcagcagcagttcaatcnatcagtctcatcaaagaagctctcctagaa

SEQ ID NO: 25779 - DNA, 101 bp, rice(Oryza sativa)
  misc_feature (71): n=a or g
ttctcatgccttgtgtgctcatccagccggaggaaggatatttggccgatcgatggtatatgatgaagtanatatattgcaatgagttatgcactacgggg

SEQ ID NO: 25780 - DNA, 101 bp, rice(Oryza sativa)
  misc_feature (71): n=t or c
tcaaacaatcatcgtgttaatttgctgaattacgattacttccgctatgatacagattccaggtggacgangtgccggtgaggacgttcaagaagtacgac

SEQ ID NO: 25781 - DNA, 101 bp, rice(Oryza sativa)
  misc_feature (71): n=t or c
aaattttggatttcaagaaactgggagaaacattggtccattgaggacaaggatctgtgcaagaacttcgntggctttggcagtgcctactatttaacaag

SEQ ID NO: 25782 - DNA, 101 bp, rice(Oryza sativa)
  misc_feature (71): n=t or g
caatgttggagccgtgttctgctgatgcaattgcccttcctttatcctcaattcctaccatcgagccaatngaagatgcttcaatgggttcagcagagccg

SEQ ID NO: 25783 - DNA, 101 bp, rice(Oryza sativa)
  misc_feature (71): n=a or g
atgcgcagggaatttgagatgagcatgatgggtgaattagatttgttgacgctaaatttggtcgttaacangattataattgaatgatgatcacatatgaa

SEQ ID NO: 25784 - DNA, 101 bp, rice(Oryza sativa)
  misc_feature (71): n=t or c
tatatttccacgttctaatggcatctcaagttttcatgtattcgcttccctgtccatagatctgcttggcntgatcaaagcggtttattctgtttctgttt

SEQ ID NO: 25785 - DNA, 101 bp, rice(Oryza sativa)
  misc_feature (71): n=t or g
gtggcatttttgaatttctccttttaaaactatccttttggcgaccttcccaccagatgaaaatgctaaanttgaagatgaactgaaattcaagccgttta

SEQ ID NO: 25786 - DNA, 101 bp, rice(Oryza sativa)
  misc_feature (71): n=a or g
taggacacactgtgctgaatcggatgctccagtaccataagaccgtgaacacctgaataagtacagcttanttatttcgaccgctcatatgttgagctacg

SEQ ID NO: 25787 - DNA, 101 bp, rice(Oryza sativa)
  misc_feature (71): n=t or c
acgcctttgcgtatttatttgcgaaaaaagagaagaagagagtgagaggaaaaccaaacacttcttttatnaatcaccaccgttcacgtcgcctataaaac

SEQ ID NO: 25788 - DNA, 101 bp, rice(Oryza sativa)
  misc_feature (71): n=t or c
tcgttcggataggaatccgacggtgggtacagccgatcagtaattaatcatattttatagtttactactcnctccgtctaaaaaaagacaaactgtaggtt

SEQ ID NO: 25789 - DNA, 101 bp, rice(Oryza sativa)
  misc_feature (71): n=t or c
tcttcaaacaaacatcagcatgaacacgcaatgatgatagcatctagtaacactgatcatcaggtttcaantttcacctgtaagaacaaaacaagaaccat

SEQ ID NO: 25790 - DNA, 101 bp, rice(Oryza sativa)
  misc_feature (71): n=t or c
ctttttacctgtaaatcgcgtcacacgtgtgatttttttacagccgcctctgcctgtgaatgacatgcctncggcttacttggctggatttctgtactgga

SEQ ID NO: 25791 - DNA, 101 bp, rice(Oryza sativa)
  misc_feature (71): n=t or g
aatagatgataactaatggatttttgtgttgtggtccggtttgccgtatttagagatgcaagttgatcganctatagacttatttatatgtcaaattaata

SEQ ID NO: 25792 - DNA, 101 bp, rice(Oryza sativa)
  misc_feature (71): n=a or c
catccatccaattacctgagcctccgattggcattcctgctcattattagaaccagacccttccagtaacncgtcagggatggactggtcattgacagact

SEQ ID NO: 25793 - DNA, 101 bp, rice(Oryza sativa)
  misc_feature (71): n=t or g
agacttttcaatagcaaggttgaaacattaagagaggacatggtttgataaaaagctgctccaacacaacntccctctatttatggaccccaattcacagt

SEQ ID NO: 25794 - DNA, 101 bp, rice(Oryza sativa)
  misc_feature (71): n=a or g
cttattcaaccatgcattagattagatctatggaactaattcctcatatccctctagatctcgtgtatgtnggagagagaaaacgccagaaaaaaaaggaa

SEQ ID NO: 25795 - DNA, 101 bp, rice(Oryza sativa)
  misc_feature (71): n=a or c
ttcaatctggacttcaggctgaaagtggatttagagacgttcggaagctactgcttgcaattggaaaaagnaacaatggttcttgtaatagatagacctat

SEQ ID NO: 25796 - DNA, 101 bp, rice(Oryza sativa)
  misc_feature (71): n=a or g
acggatcgagtaactttagatcgaagtatgtgaagtacgcaccgatcatgcgaataaatgcacgtatccantacgaccgagacgcgtaaccgaccacgtta

SEQ ID NO: 25797 - DNA, 101 bp, rice(Oryza sativa)
  misc_feature (71): n=a or g
tgtttttgtaagctcaccctccctctcggatctcttgaccaccatattagtgttatcggatgtcgcgcccntcgtcggctcaagccaccacatcgagccca

SEQ ID NO: 25798 - DNA, 101 bp, rice(Oryza sativa)
  misc_feature (71): n=t or c
tgtgaaacaatacgcggtgcatacttttgtaaagtaggaacttctccaaattggaaccaccaagcacctgncaaattaggaacaaatgtgccatttgatta

SEQ ID NO: 25799 - DNA, 101 bp, rice(Oryza sativa)
  misc_feature (71): n=t or c
attggtaggcttaatttgggaggttattggctagagaggaagaaagatcaaggtggacctttctgctgcgngcaacgaatgatacaatgtcatttgtttaa

SEQ ID NO: 25800 - DNA, 101 bp, rice(Oryza sativa)
  misc_feature (71): n=a or g
gcagacgagctcgctcgagctcggctcgttgacagccctaactgctactcctacaaaacaccagatgtaanggcatccatgcatgatgacggcacgcgcgt

SEQ ID NO: 25801 - DNA, 101 bp, rice(Oryza sativa)
  misc_feature (71): n=t or g
ctctaatttttgctgctgctcggtttccagatttgccagaactgtgtgaccttaggcatattttcacaganagatatggacattttcttgagccttttgtt

SEQ ID NO: 25802 - DNA, 101 bp, rice(Oryza sativa)
  misc_feature (71): n=a or g
aaccttgaatttgtatagatcgaagattgaacatgcctagtttacagagggacgtgactaagttatctgcntaaattttgatgtcacaatttgaatcactg

SEQ ID NO: 25803 - DNA, 101 bp, rice(Oryza sativa)
  misc_feature (71): n=t or g
ctgaaacgaaccaaagataacaacggtcgtaacataccaagcagaattattaacaggagtgagtgacacancacaatccatcactccaacagaacttaaac

SEQ ID NO: 25804 - DNA, 101 bp, rice(Oryza sativa)
  misc_feature (71): n=t or c
agaacatgattctctgctaaccaaacttggacagcagacagcacataatagattctgattgaatgtgatanatctagtactaaaaaatcagataatatttt

SEQ ID NO: 25805 - DNA, 101 bp, rice(Oryza sativa)
  misc_feature (71): n=t or g
gcaacaaactgtactgagacagcttgaagctattctccatatctataggcttgctcgagctggacagactntagatgctttgagggaaaccatcaaactcc

SEQ ID NO: 25806 - DNA, 101 bp, rice(Oryza sativa)
  misc_feature (71): n=t or c
ctgctgctactctatagctaactgtattctttcatacgcttgttccatcaagttaatctgctgcttaatgncattgattcaatagtgaatcatcgttcttt

SEQ ID NO: 25807 - DNA, 101 bp, rice(Oryza sativa)
  misc_feature (71): n=a or g
ctcatgttcaggaatattaaccaatgcggaaggaacatgcagctctctgttaacaaatattattatgattnccatccgaatttattttatggttgcccttg

SEQ ID NO: 25808 - DNA, 101 bp, rice(Oryza sativa)
  misc_feature (71): n=t or c
tgtttattaagtggacttgcttacaggtgtgtgcatatagaacagtgggtagtggcagggttcgacttacngactgtaaccgcgcggttaccacggttacc

SEQ ID NO: 25809 - DNA, 101 bp, rice(Oryza sativa)
  misc_feature (71): n=a or g
cctcatccatttttattgtttgtgtgttcggtagcaatgcacatctatctatacttctgtagctgacgggnagacccgccagcttattggtcgagctgaca

SEQ ID NO: 25810 - DNA, 101 bp, rice(Oryza sativa)
  misc_feature (71): n=a or g
tgatactacgtagcttcttatatgaaaagatctagggccaccatggaccacacctatttagtgaccaactnggcttcctatcatttgaacctaaaggaaaa

SEQ ID NO: 25811 - DNA, 101 bp, rice(Oryza sativa)
  misc_feature (71): n=a or c
tgatcatgcctgtgaagaagctactctcatgatgatggcaagactgcgagacctgcacgacaacgaccttngtagcaccgcctaccgctactatccccgcc

SEQ ID NO: 25812 - DNA, 101 bp, rice(Oryza sativa)
  misc_feature (71): n=t or c
aacgtacaacagatagtagtaacgagtagtaatgctatcatgtgatccaaaaaacccaagcttcgaagaanaatatctctcatgtgatgtatgattctttt

SEQ ID NO: 25813 - DNA, 101 bp, rice(Oryza sativa)
  misc_feature (71): n=a or g
tgaagtttttagtaagtttcaggaacaactcatagttgcaagagaccattgcattattcaagggatttcgnagtccggagatatgaaaattgtcaccatca

SEQ ID NO: 25814 - DNA, 101 bp, rice(Oryza sativa)
  misc_feature (71): n=a or g
gatgatccattccccttcaccagcacttcgctgtagttgctagtttttgagttgattgcttgggcaggatnatccttagatgaaccaacactaccctgcga

SEQ ID NO: 25815 - DNA, 101 bp, rice(Oryza sativa)
  misc_feature (71): n=a or c
gattgtgcaatgtgcaggggtttattcagatggagactttatggttcatttcgctggcctagatgacaagnttggttggataaataagattcttagggaga

SEQ ID NO: 25816 - DNA, 101 bp, rice(Oryza sativa)
  misc_feature (71): n=t or c
agtagtagtactccagtagtagagcagggcgcgtgtttgtgtatctggtctgacgagcaatgagcacaagngtgggcgaaggagctcaagtcaccacccta

SEQ ID NO: 25817 - DNA, 101 bp, rice(Oryza sativa)
  misc_feature (71): n=a or c
gcttccctcatccatacggcaaccaacccaaccaaactaaccaacgcccatgcaccatattcattcatatntatctatcagcgatcgatgagcgatagata

SEQ ID NO: 25818 - DNA, 101 bp, rice(Oryza sativa)
  misc_feature (71): n=t or c
cttttttcaagagaactcagaactgcttggtacaaaccagtactagttacatgatcagtagcaatggcgtngaattgcaggtattgcagatgaaaccacct

SEQ ID NO: 25819 - DNA, 101 bp, rice(Oryza sativa)
  misc_feature (71): n=t or c
cgtcttttgaaatgtggtctattgacgggaccaatcaaatcccctggtctttcacgtaagtactacaaaanatattgtaaatttccatttaataaacttag

SEQ ID NO: 25820 - DNA, 101 bp, rice(Oryza sativa)
  misc_feature (71): n=t or c
ttctccaccaccgtggtctcctccactttcgtgccgagagagcgaatctcgttcacgatcgtggtaacctntaaagcaaaatcattaattttctcagaatt

SEQ ID NO: 25821 - DNA, 101 bp, rice(Oryza sativa)
  misc_feature (71): n=a or g
aagcaaaagcagagagcctggtcttgacaaccggagttcatacaatcaagagacaaggggaagacagaganaacgagctgctgacatcaatagaagtagaa

SEQ ID NO: 25822 - DNA, 101 bp, rice(Oryza sativa)
  misc_feature (71): n=t or c
taatcatctgatacgacaagaatttcaatatcagttgaagacaaaggcatagaatgtaggaaggcagaggnggtagtatcaacgaacttatttgataaact

SEQ ID NO: 25823 - DNA, 101 bp, rice(Oryza sativa)
  misc_feature (71): n=t or c
ccagtgggtacttccagagattaaggaagaggtgaaaaagtccatgttcttttgctagtcgtccttgtgcncccctgaaactgaagcctggagccagccgg

SEQ ID NO: 25824 - DNA, 101 bp, rice(Oryza sativa)
  misc_feature (71): n=t or c
gcgatgcaagcccggcgaatcagtcgaggacttcacttcggcttcagggggttgtcagcgacctccgtctncttggtgatgacatcaccgaggagaaaatc

SEQ ID NO: 25825 - DNA, 101 bp, rice(Oryza sativa)
  misc_feature (71): n=t or c
atttgacgtgacagactgctgcgtgccattttgggtctgtgaagaagaatctgtagatgcttcaggggggntgtacagggtgaggcttagaaggtcgatca

SEQ ID NO: 25826 - DNA, 101 bp, rice(Oryza sativa)
  misc_feature (71): n=t or c
acgagctcttcaatgccatccatgtgctggtcctccaagttgtcgcagaggcctttcgttcgactgatcgnccaattcggcgaagaggtcatcgtccgcct

SEQ ID NO: 25827 - DNA, 101 bp, rice(Oryza sativa)
  misc_feature (71): n=t or g
gcatcttgtattgagcagaaactgtccatgtcaaagcaggtcaatgctctaatattgtcatggagggttgntggtgaatgcaatattgactctgtccattg

SEQ ID NO: 25828 - DNA, 101 bp, rice(Oryza sativa)
  misc_feature (71): n=t or g
taagattgaggtgattgatcaactcccacctcctatgaatatcaaagggatccgtagcttcttaggtcacnctagcttttatagaaggttcattaaggact

SEQ ID NO: 25829 - DNA, 101 bp, rice(Oryza sativa)
  misc_feature (71): n=t or c
tcatatcccttctgtttcacgttataagacacgttttagccttttcgtccctccgtgttattattcgtatnggttgggaactctaatatcatatctgtatt

SEQ ID NO: 25830 - DNA, 101 bp, rice(Oryza sativa)
  misc_feature (71): n=a or c
cggggacttttgttgcagagcaatacgaactagctagctaggaagcatacgttgctcgctgatgaacaagnaatagaaagttttgcaattcggcaacgatc

SEQ ID NO: 25831 - DNA, 101 bp, rice(Oryza sativa)
  misc_feature (71): n=t or g
atcctataatattcaggagaccatacagctttggcaaaggaaatgtgaggatgctctccaatccttgcttntccttggggctcgtcgccctgttcggcgat

SEQ ID NO: 25832 - DNA, 101 bp, rice(Oryza sativa)
  misc_feature (71): n=a or g
aaagtaatgggaattgtactagcaacactacttgaagtcaatatgccccttattccttagcatataggccnagtttagttccaaactttttcatcaaatta

SEQ ID NO: 25833 - DNA, 101 bp, rice(Oryza sativa)
  misc_feature (71): n=a or g
ggacgtgtgtgagatcttgcccgatgggtggagagatcattatgattttggaaatatggacaatttggatncgagggtaacacgtaccaagcgagacttgg

SEQ ID NO: 25834 - DNA, 101 bp, rice(Oryza sativa)
  misc_feature (71): n=t or c
gaaacaacatccccgtataactccaaacttcacacttcccaaacttgtctccaatccaaatatgactcctnttttcataggcacacaacaccacgtgtgta

SEQ ID NO: 25835 - DNA, 101 bp, rice(Oryza sativa)
  misc_feature (71): n=t or c
acacgttgagatcgatgtagattttgtccgtgatcagggggttgttggttttgtttgtgttctccatgttncgacaacttcatagtatgctgatatttttg

SEQ ID NO: 25836 - DNA, 101 bp, rice(Oryza sativa)
  misc_feature (71): n=t or c
tgtctaattttgcattttaatttgctttgctttggccgtctgtgctagctatgaactcatttcatcgtgtnctcccactctgtcgctcgcctgctctgcct

SEQ ID NO: 25837 - DNA, 101 bp, rice(Oryza sativa)
  misc_feature (71): n=t or c
cggcgtcagtgtgttactccctccttcaaaaaatctgagaactatttcattcgttggtttctgtaaaaatntgagtcctatttgcagtcaccatgtgctaa

SEQ ID NO: 25838 - DNA, 101 bp, rice(Oryza sativa)
  misc_feature (71): n=a or c
ggctggccaccaaggctcatcaagagagatctcatgcaagtcggccattgaccatccatcacctttccccnaaaaatttcaaaaatatttgtacggtgcag

SEQ ID NO: 25839 - DNA, 101 bp, rice(Oryza sativa)
  misc_feature (71): n=a or g
agcttcccatcagagaaagatagcagaaatccaaagccaaatggcttcaccctcttccctctgtctcctcnctgctcttcttgcgttggtctcatggcaga

SEQ ID NO: 25840 - DNA, 101 bp, rice(Oryza sativa)
  misc_feature (71): n=a or g
cgactgactaattaacgggccatcatcatgcatgaaccggcaaggagcagtcgccagagaagaacaccaantccgtcttggtcacaatcacctgaactatt

SEQ ID NO: 25841 - DNA, 101 bp, rice(Oryza sativa)
  misc_feature (71): n=t or g
gaattgacttgcacaagtccattgatgaaaatgatgtcaccagcaagtctttcacaaggaaaataagtttnagttccatcagaacacctgcatacactgtg

SEQ ID NO: 25842 - DNA, 101 bp, rice(Oryza sativa)
  misc_feature (71): n=a or g
ccatggctcatcctatggcgttggtgtcaagcttggtgcggtaagggcggagtatgctgttgatcacaatnctggcacaggggccttcttcttgagatttg

SEQ ID NO: 25843 - DNA, 101 bp, rice(Oryza sativa)
  misc_feature (71): n=a or c
caggccccacaaacctacagtattagcctgtcctgaggcagtgacacatatttgggattacaacctttatnaaaaatccaatgaaaatccagggacacgta

SEQ ID NO: 25844 - DNA, 101 bp, rice(Oryza sativa)
  misc_feature (71): n=t or c
taattttaatgtgaactaaacaccctaagataaacagaaagtgatactgtaaactccatgcatggatgatnaatcgatccacatgcatcggtaattccttt

SEQ ID NO: 25845 - DNA, 101 bp, rice(Oryza sativa)
  misc_feature (71): n=t or g
caccacatccattccccatccattcttcagccatttccaaagcaaatcgcatcacccaattcgcatccatngcggaggagagagaaagcttcgagagccaa

SEQ ID NO: 25846 - DNA, 101 bp, rice(Oryza sativa)
  misc_feature (71): n=t or c
agaacttgctggtcttgagcctcccaatctgcataagccgagttcggcttcttcacctcttttccaccttnggtgacggtgatctcctcatctggttttgg

SEQ ID NO: 25847 - DNA, 101 bp, rice(Oryza sativa)
  misc_feature (71): n=t or c
agtatgtggttattggaagggatgtgaggagtgaacaccgccaccatgttcctacttagcagcaaagatgnggcgaggaacatgggagcgttgaagttcca

SEQ ID NO: 25848 - DNA, 101 bp, rice(Oryza sativa)
  misc_feature (71): n=a or c
tctacttaaatagcactatgtgttcttgctgaaaagatcccggaggcacacaatgacacaatacatctacncaatacatctacccggtctctgtcaagcac

SEQ ID NO: 25849 - DNA, 101 bp, rice(Oryza sativa)
  misc_feature (71): n=a or g
atagataattataattttctattcaaatgatgccaataatcctgtttcataatactagtttggtacacatnaaaaaattattattattattttggtaatta

SEQ ID NO: 25850 - DNA, 101 bp, rice(Oryza sativa)
  misc_feature (71): n=t or c
gtaccgccatccgaaccactggactggtctgacatgatggccaagtgtcgccgcctctttgagaaaacttntcgggaggtgggggctcaaatggactgctt

SEQ ID NO: 25851 - DNA, 101 bp, rice(Oryza sativa)
  misc_feature (71): n=t or c
gcctataccaacgtggccggtttcacatcagaaagcatctctataaacacataaatttcaggagtccaagngacagtggtgcaaaagaacatgcctgggaa

SEQ ID NO: 25852 - DNA, 101 bp, rice(Oryza sativa)
  misc_feature (71): n=t or c
atgtgcacttataacttggtaataagcatgctttggatggggtcctgctgtgatgtaaaaattcagttctngctgtattcaaatattgcaccagtatgatt

SEQ ID NO: 25853 - DNA, 101 bp, rice(Oryza sativa)
  misc_feature (71): n=t or c
actgctagcgatggaggcataggtgaggttatgcaatacatcaaatccagatacctatcaacttgtgaatnattctggagattatatggttttgagatcca

SEQ ID NO: 25854 - DNA, 101 bp, rice(Oryza sativa)
  misc_feature (71): n=t or c
ctagattgttaattaatggagggactaacaactgtgttaagctagcgtgctaattagccagtgtaattgancattgctttgcttccatgcacggcaacatt

SEQ ID NO: 25855 - DNA, 101 bp, rice(Oryza sativa)
  misc_feature (71): n=a or g
aatttcttcacaatcacagtcttcaggagggaatggtgtgaggttttgatttagatatgtgcaaagttgcncatacgtcgaacagaaggctggctcagcaa

SEQ ID NO: 25856 - DNA, 101 bp, rice(Oryza sativa)
  misc_feature (71): n=a or g
tccgtagcgccgcccaccacgtccttaagtgtcgtagacttgttaattttctccccgtcggcatcggggcngtgcctcatgttcgcctcgacggcctgctg

SEQ ID NO: 25857 - DNA, 101 bp, rice(Oryza sativa)
  misc_feature (71): n=t or c
aatcacgcacactgattagtgattacctcaaggtgtggcagatggttaatttcagatgaaacccacacttntcccaactcgatatacgagcgcagctagct

SEQ ID NO: 25858 - DNA, 101 bp, rice(Oryza sativa)
  misc_feature (71): n=t or c
atccatccatgtatttctctttgtatttccggcggcagttcttccactacggctggatcgatatcttcaangttgaacatccatgtgctactgctggcaga

SEQ ID NO: 25859 - DNA, 101 bp, rice(Oryza sativa)
  misc_feature (71): n=t or c
aggaatgcagatggccagcatttgacaaaggatgtgcctgactcacacaacttccctcatcgcaaaaactngagggactccagtaaggccaatggaagtgt

SEQ ID NO: 25860 - DNA, 101 bp, rice(Oryza sativa)
  misc_feature (71): n=a or c
ggggcccacttgtacatgagaaggaaaaaatatgttggccccacatgtacgtgccccacttctttcttctntattttgccctaaccacgtatgcgaggtcg

SEQ ID NO: 25861 - DNA, 101 bp, rice(Oryza sativa)
  misc_feature (71): n=a or g
aaactgtttctagggagttagacttttagaatcggtactaaagaatcttataccagttcttaatccaaccnagatattttttattttggataccacaataa

SEQ ID NO: 25862 - DNA, 101 bp, rice(Oryza sativa)
  misc_feature (71): n=a or g
cttacctggaaacttacaccgatgtatgtctcatcttccaacaagtttattgtcatcgtttcatcaaaatnatcaacttaggttccttaaaaaaaatgatc

SEQ ID NO: 25863 - DNA, 101 bp, rice(Oryza sativa)
  misc_feature (71): n=t or g
cctccccgacgccgtcgccgcgctgccgttcttgcaggttcttgacgtgtcctacaatggcctctcgggcnctctgcctccgtcgttgggggcggcggcgt

SEQ ID NO: 25864 - DNA, 101 bp, rice(Oryza sativa)
  misc_feature (71): n=t or c
atatttgttgacaactttttttgtcatgccaatgccaccgaatgtgatttgcggtatacctaaagctttgngttgatatggagttgtcaaccaccttgacc

SEQ ID NO: 25865 - DNA, 101 bp, rice(Oryza sativa)
  misc_feature (71): n=t or c
tagggtgggtacatggaaggatcgccaacacctatatcatcgtcgcaatccatcttatgagtgggtacaanagccgtcgtagcagcccccctcttccgcgt

SEQ ID NO: 25866 - DNA, 101 bp, rice(Oryza sativa)
  misc_feature (71): n=t or c
caccaccaaatttgcatcagataacttatttgcagtattgatcttgttgtaccacaggttggccatgatgnggatcacttcacgtctcccgagggaatgcc

SEQ ID NO: 25867 - DNA, 101 bp, rice(Oryza sativa)
  misc_feature (71): n=a or g
ggtcagtgattggattggattggattggattgtgttggatttggattggttgggttcagagtttaggagtngagagaagcaaagatccgagtacaaatctt

SEQ ID NO: 25868 - DNA, 101 bp, rice(Oryza sativa)
  misc_feature (71): n=a or c
cacattctagcaaaaaaaaaatttggacaaggtcccatccattcaaataccctatgggatggagggagtanctggcggcaacagtagtggtggataacaga

SEQ ID NO: 25869 - DNA, 101 bp, rice(Oryza sativa)
  misc_feature (71): n=t or c
ttatgggtcattcaggtcaaacataggccgggctggtgctttgccaacatacagattatagattaatacanagtcctgccatcaccatccaggatcatgtc

SEQ ID NO: 25870 - DNA, 101 bp, rice(Oryza sativa)
  misc_feature (71): n=a or g
cattccttcgagcagatggcccatttgatgatgttcaatgtagttcttggcccgctcgtgatatggatagnaatttaccttcactttaagtctatatttca

SEQ ID NO: 25871 - DNA, 101 bp, rice(Oryza sativa)
  misc_feature (71): n=a or c
agtcgctgccgtcgctagagttgcagcgcagtacccttgcggacactcttgcctcgagcttcggttcttgnagccttgccactgaccacgtgatggatccc

SEQ ID NO: 25872 - DNA, 101 bp, rice(Oryza sativa)
  misc_feature (71): n=a or g
ttgaggaagctctggccaaggttcagaagagtgtatcacccgctgatatagaaaagcacgagaagtggcangccgagtttgggtccgcttgaaatctccat

SEQ ID NO: 25873 - DNA, 101 bp, rice(Oryza sativa)
  misc_feature (71): n=t or c
aatcaatctcaacagaaaccgatctaatctaatctaccaaacagacgcccccttccctttttttttcacgngcaacagcacggccacgggacctggcagaa

SEQ ID NO: 25874 - DNA, 101 bp, rice(Oryza sativa)
  misc_feature (71): n=a or g
ctagaatcaggaacaattattggaccaataaatggtggccattcaatttaatttccataaggaagaaattntccagcccaggtactagcaagtgcttgaga

SEQ ID NO: 25875 - DNA, 101 bp, rice(Oryza sativa)
  misc_feature (71): n=t or c
gatggaggaaacatgagtgaaattagagcaccctgtaaacatatcctcattttggttcgtctatcagtcangtaactttgttatttctgtcggttacctag

SEQ ID NO: 25876 - DNA, 101 bp, rice(Oryza sativa)
  misc_feature (71): n=t or c
tatcctcattcttcggttcttcctcatccccaaccacactagcgaagttaactctcgcggcgaagggcagngggacctgatccaggacggtgcggaggctg

SEQ ID NO: 25877 - DNA, 101 bp, rice(Oryza sativa)
  misc_feature (71): n=a or g
taaaaacatggtataaattgtgaacaaaaacagtattaatactactattttggtttagctaataggatcanccagtttgcgtccccatggcacgtcctcgc

SEQ ID NO: 25878 - DNA, 101 bp, rice(Oryza sativa)
  misc_feature (71): n=t or g
caatgactcaattcgaagattatggcgaagaacttgctgtcttggtaactcgatggagagggttgaagaanaggagaccatctatgccatatccacgccac

SEQ ID NO: 25879 - DNA, 101 bp, rice(Oryza sativa)
  misc_feature (71): n=t or g
ctggactgattcccacctgagatactattaacattctggcttcattttgcaggatatcgaggtcctttttncagtcttggctcatctgccaaaagatgagg

SEQ ID NO: 25880 - DNA, 101 bp, rice(Oryza sativa)
  misc_feature (71): n=t or c
ggattgtattggagctattgatggtacacacattagagcctctgtccggaagaatatggagtcttcatttngtggtaggaagtctcatgccacgcaaaatg

SEQ ID NO: 25881 - DNA, 101 bp, rice(Oryza sativa)
  misc_feature (71): n=a or c
catttgatcttgtaaccttttcccaagcacttgtgagactggactttggctttgttgactttggcgaaaanccagcagtcgaacttgcaagtgaaaccggc

SEQ ID NO: 25882 - DNA, 101 bp, rice(Oryza sativa)
  misc_feature (71): n=t or c
gaaaactgatccgcagctgcttgttccttgtactgctgctccatcctccaaaatctgttctgatattgcanaaaatagtgaccccacacaacaggctttga

SEQ ID NO: 25883 - DNA, 101 bp, rice(Oryza sativa)
  misc_feature (71): n=t or c
atggagagcaagaaggtattagtccttgattcactgaacacccaagatccactggggaatcacgtttcacnaggcatgacaagattaagatcatggtgtcc

SEQ ID NO: 25884 - DNA, 101 bp, rice(Oryza sativa)
  misc_feature (71): n=t or c
tcctggattccttgttctattctcttcagtctttggagaaccatctcaacacctttggcaatgcctagtanggagggatcaactgcatccgattcagcaat

SEQ ID NO: 25885 - DNA, 101 bp, rice(Oryza sativa)
  misc_feature (71): n=a or g
aagatctattaatttgtgatttgtttgcatctgtactcttacacttgtgtatcagtttattagtttttctnttataaatatgcatgcagtgatttttctgt

SEQ ID NO: 25886 - DNA, 101 bp, rice(Oryza sativa)
  misc_feature (71): n=t or c
agaaatgtcttcagatgctattttccgcgtaccacattctaccaaattcctagtggtactgtatgaactantgcacagaatgaaggtaccatcattataga

SEQ ID NO: 25887 - DNA, 101 bp, rice(Oryza sativa)
  misc_feature (71): n=a or g
aggtggcgaagaagaggcgcaagaagcgaatgatggggtaccagacttgactaggaagacgaaggctgacnagagtacacctgacttgacaatgatggtat

SEQ ID NO: 25888 - DNA, 101 bp, rice(Oryza sativa)
  misc_feature (71): n=t or c
cttggatgaaatctcatgtgatgtcctgtgattatcgatggggttgaaaacggttacgggaattcctgatngacctacgctttccgatttttaccaaccaa

SEQ ID NO: 25889 - DNA, 101 bp, rice(Oryza sativa)
  misc_feature (71): n=a or g
tattttatatacaatagatgttgaatttgatcatatacaactcttagggtgtccccctcgtctttttcgcncatgtttttctaagtgctaaacaatgtgtt

SEQ ID NO: 25890 - DNA, 101 bp, rice(Oryza sativa)
  misc_feature (71): n=t or c
tcatttttactaattaatagtactgctttggggttgtttggactgtcccatcgcatgtttgaatactaatnagaagtattaaacgtagattattgataaaa

SEQ ID NO: 25891 - DNA, 101 bp, rice(Oryza sativa)
  misc_feature (71): n=t or c
gtggatggtgaggtgcatagcgaccaataagcaaatggataacatggtggctcacccgagatagagttcancgacaaggacttacatcaacagcatagtgg

SEQ ID NO: 25892 - DNA, 101 bp, rice(Oryza sativa)
  misc_feature (71): n=a or g
cttgatttgatcagctcaacggtgatttgatgctatctagattcatccttttttttaagttcaacactgtncacatttgctggacataatgcatatatgtt

SEQ ID NO: 25893 - DNA, 101 bp, rice(Oryza sativa)
  misc_feature (71): n=a or g
gtggagcctctggatatctggagtttccctcatgaaatgcatgatatcatggttgatgatcctgtggttgntaaccggttccacggtagctggcatagtgt

SEQ ID NO: 25894 - DNA, 101 bp, rice(Oryza sativa)
  misc_feature (71): n=a or g
tctctctcccagcactacccgcgagcctttcttctcaataataaagcttgctcttaccatggtggccgacnatggtgttgacagagcatactgcacgggag

SEQ ID NO: 25895 - DNA, 101 bp, rice(Oryza sativa)
  misc_feature (71): n=a or c
gtccaaaaaaaatcctgaagtttccgtaaaacagtctaccttccatcccagactggaagctcgtttgtagncagcaccacccacaaggagcaagtctctta

SEQ ID NO: 25896 - DNA, 101 bp, rice(Oryza sativa)
  misc_feature (71): n=t or c
ctcgggcattattatgatgatgacacagtagctgctgtgattattggagctggcaccaatgcttgctatantgaacgcaacgatgcaattattaaatcttt

SEQ ID NO: 25897 - DNA, 101 bp, rice(Oryza sativa)
  misc_feature (71): n=a or c
ccagctcgcacagttccgtgcccgtatcgatcgacgtcatagcggtaagccaaccaaatacatatctttcnattatgttcacatcgggcattgttaacagt

SEQ ID NO: 25898 - DNA, 101 bp, rice(Oryza sativa)
  misc_feature (71): n=t or c
acgaatggaaaaacagttgggaaatcacagggagcttccagagtagcatcatcaacaagaagtaccaaganaacaaggtttgcccccacaaaaaaagagta

SEQ ID NO: 25899 - DNA, 101 bp, rice(Oryza sativa)
  misc_feature (71): n=a or g
tggggggtcctaaggtatcaaatcatagcaccaacaccaccaccataacctacaatccgaaggacgtgaancctacccgccgggagatctcgttgaaacca

SEQ ID NO: 25900 - DNA, 101 bp, rice(Oryza sativa)
  misc_feature (71): n=t or c
gagcacggcctgcatggggcttcctccaaccatggtacttacgtgataggttactgtaaaacaaacattgnacattaattttcacagagagttagttaatt

SEQ ID NO: 25901 - DNA, 101 bp, rice(Oryza sativa)
  misc_feature (71): n=a or g
tggaagaagatttgaatgcaaaatatatcaaacctggcccaagtctacagcaggattcaaacttttgccanagtcataaataagatcactccttagtatgg

SEQ ID NO: 25902 - DNA, 101 bp, rice(Oryza sativa)
  misc_feature (71): n=t or c
aagatcagatctaagagttctcttccttcggcggttatcttgtatgcgaatgatcctcccacggaaatatngagatttgtagcagactccttgtctaaccc

SEQ ID NO: 25903 - DNA, 101 bp, rice(Oryza sativa)
  misc_feature (71): n=a or g
aggataaggatgtgcatgaataccatcaacgagatacacggtttcgccgccacgtcaataataaatggtantaggttggagaaagaaactagtattgtact

SEQ ID NO: 25904 - DNA, 101 bp, rice(Oryza sativa)
  misc_feature (71): n=a or g
ctaacgatggcaagcgagagttttagcggggaggtggcaatggctccgtttggttgggccttcctagcacngtgtggccatatggtgagaccggttgacaa

SEQ ID NO: 25905 - DNA, 101 bp, rice(Oryza sativa)
  misc_feature (71): n=a or g
ggtgatggggtgaggaaccggcgatgccacaaaagaaaaggcaggggccggtgttggccgcagcagaatgnagcaggggccggggaggtaaggagcagagc

SEQ ID NO: 25906 - DNA, 101 bp, rice(Oryza sativa)
  misc_feature (71): n=a or g
catttgcagccggtaatggacaaaatcagagcaaggatgggggctggaaaacaagctagtttatcaaagcnggcagaaggttcttgtgcaatcagttctca

SEQ ID NO: 25907 - DNA, 101 bp, rice(Oryza sativa)
  misc_feature (71): n=t or g
aggtgaatctggacctggagagcagtgcgtcaaaacatcgaaagaagaggaatgtaaacactggcaggagncatggtatcggcccttcaaacccatacgga

SEQ ID NO: 25908 - DNA, 101 bp, rice(Oryza sativa)
  misc_feature (71): n=t or g
taccccgttttattattgccgaattcatgtttcgacacaacctatcgctatactatgcattttaggggctntttagggggtatttagattaagggtgtaaa

SEQ ID NO: 25909 - DNA, 101 bp, rice(Oryza sativa)
  misc_feature (71): n=a or g
tttttcagatggaacataataaagcgccgggtcctgatggttttcctactgaattttatcaagttttttgnaatgtcataaagaatgacttacttgagctg

SEQ ID NO: 25910 - DNA, 101 bp, rice(Oryza sativa)
  misc_feature (71): n=a or g
aatttcaatcaaactttcaattttgggcccagcgaaaactttttttgtccagtgaaaactctcaattttgncgtgaactaaacacacccaaaaatggattc

SEQ ID NO: 25911 - DNA, 101 bp, rice(Oryza sativa)
  misc_feature (71): n=t or c
cactgcacttgcactgcatatattccatcctctagctaaatgaattaggtgaatactcggcctttattccngattcctctgaaaacaccatcgcagtggat

SEQ ID NO: 25912 - DNA, 101 bp, rice(Oryza sativa)
  misc_feature (71): n=t or g
gttaaattttttgtgctacggcgattgaaagaatgtcaaccaaagtagaggaaagatcaagatggacgttnctaaatcggtcgataaaattagtaataaga

SEQ ID NO: 25913 - DNA, 101 bp, rice(Oryza sativa)
  misc_feature (71): n=t or c
aaagagtgtctagcaattatgatggcagtagaccactggcgcccttatttacagtttcaggaatttcagancttgacagaccaccatagcttgatgcatct

SEQ ID NO: 25914 - DNA, 101 bp, rice(Oryza sativa)
  misc_feature (71): n=a or g
gatgtctgtagcaaattttgccttataataacgttcttttagtcggtggtactactcagtaccaatgcagnttgaggtgccattttgcgctgcttgggtgg

SEQ ID NO: 25915 - DNA, 101 bp, rice(Oryza sativa)
  misc_feature (71): n=t or g
cagggttgttgagacctctgccgccaccatgcatacgaagcacatacatcactagctccgacgagaggttnctggaagatgtacgtggccctccagcctgg

SEQ ID NO: 25916 - DNA, 101 bp, rice(Oryza sativa)
  misc_feature (71): n=a or g
gaaactggaggaaaaccaaggagctgaagctggaagtaaaccaaagagctgaagcttgagaagacaagganataacaaacttgaacaagttgaataacttt

SEQ ID NO: 25917 - DNA, 101 bp, rice(Oryza sativa)
  misc_feature (71): n=a or g
atccaatcaaaacgattccatgtaatagtttcgacattagatagagaaagaggttcggatccttaccgaancgggaggagtgcttgaagaggccgattgct

SEQ ID NO: 25918 - DNA, 101 bp, rice(Oryza sativa)
  misc_feature (71): n=a or g
aatcaagcttaacattcatactctacaacaatcctgaacaaaaaaaaaactacccatctcaaaataacacngctggtattggcagccacaaagccccatat

SEQ ID NO: 25919 - DNA, 101 bp, rice(Oryza sativa)
  misc_feature (71): n=t or c
acacaaaattgatgggtcatggatatgactcaaaaacatgatggcatatacaagtttctcaccacagttgnaatagtctttccggcggcggcggcggcggc

SEQ ID NO: 25920 - DNA, 101 bp, rice(Oryza sativa)
  misc_feature (71): n=a or g
tgggcgtgatgatatctttgaactattatctaatacatgataagtatcaactcatactttgatcagacagnatgatacctctctaatgtacctctcaggta

SEQ ID NO: 25921 - DNA, 101 bp, rice(Oryza sativa)
  misc_feature (71): n=a or g
acaaaaacttaaaagaaaatgaaatcaatctcaacattatccctttcttgaggctgaggttcatcgtctanaaagtgccatctatcttatattacttgtga

SEQ ID NO: 25922 - DNA, 101 bp, rice(Oryza sativa)
  misc_feature (71): n=t or c
atttttttctttttttcagatctagagctgaaaggtagccaaatacttttcaacaagtcttcaactccaanaggagctagctattaatagagttggagttt

SEQ ID NO: 25923 - DNA, 101 bp, rice(Oryza sativa)
  misc_feature (71): n=t or c
ggggagaggaaagggaagagaaagagagagaaggatggagcaggtgataagaagtgaggagaaggactgtngcgcacaggcacatgagcatctgtcaccgg

SEQ ID NO: 25924 - DNA, 101 bp, rice(Oryza sativa)
  misc_feature (71): n=a or g
gaaaagttgatgcccttatgtaggagtaggtggcactatcatgccagctactgaattatgatgcaataatntgtacaggaaacatgcttgatctgtacgat

SEQ ID NO: 25925 - DNA, 101 bp, rice(Oryza sativa)
  misc_feature (71): n=t or c
gcacactaacacagagcgtatgcacaagacgagattaaaatcagttccacaactgcgacgggcacgcatanttgcacaggattcaatttcaatcgtgccag

SEQ ID NO: 25926 - DNA, 101 bp, rice(Oryza sativa)
  misc_feature (71): n=a or g
agtctatgttgatggacttccagtagaggtcctatgggatgttcatgactggctatttggttcatcgaatnaatgtgccgtgttcttgtttcagtcaggcc

SEQ ID NO: 25927 - DNA, 101 bp, rice(Oryza sativa)
  misc_feature (71): n=t or c
tgtcagttgggtttacttgccaaacagtgatgttgtgacctgctgcaatgcttctgaattaacatttgtcntgttttcacttcctgattttgttcgaaaga

SEQ ID NO: 25928 - DNA, 101 bp, rice(Oryza sativa)
  misc_feature (71): n=t or c
accgccaaaaattacacgcgaggaaaaaaaaaactcccacaccttcccccacacggcacgcccaaacaaanatcggggcctcaaacctcaaacccccccga

SEQ ID NO: 25929 - DNA, 101 bp, rice(Oryza sativa)
  misc_feature (71): n=a or g
ccattgggaaatgttgactgaatgtgatttgacagaatttgccattggtctataccttgctcaggaagtgnggtgtgaaaaagctcttctaagtcacccag

SEQ ID NO: 25930 - DNA, 101 bp, rice(Oryza sativa)
  misc_feature (71): n=a or g
cgacagcgcatcgtcatgtgcaaaccctaacagcgtgttgattgtgccatgaccgtcttacggtgtaagtngtaccgcttattttgacatgtaagtagatt

SEQ ID NO: 25931 - DNA, 101 bp, rice(Oryza sativa)
  misc_feature (71): n=t or c
ttggcacaaacgggttactttgtctttgtgatttggatttggatactagaactccttccatggatgccacngtagattgtataatgcctttaaccctaatg

SEQ ID NO: 25932 - DNA, 101 bp, rice(Oryza sativa)
  misc_feature (71): n=t or c
taaaatagtcattctgatctattttttccatattaaaatattaatagttcctcagaacatagcacaactcnaaaatatgatagaatcgtaaaatgaataaa

SEQ ID NO: 25933 - DNA, 101 bp, rice(Oryza sativa)
  misc_feature (71): n=a or g
agctagcttaatgagtggattgagtggtggaggtagcaacatctttgaacttaggcagcaaaaactatttnttatattaacgtgcaatcttttgcgtgtta

SEQ ID NO: 25934 - DNA, 101 bp, rice(Oryza sativa)
  misc_feature (71): n=t or c
agatactcccccaataattaacatgtgggtttcacttttttacggctcacatggcagtgacttaacagcanaataattaagttagatgatccctttccatg

SEQ ID NO: 25935 - DNA, 101 bp, rice(Oryza sativa)
  misc_feature (71): n=a or g
aggatagctgattggttgcgcttgggaccaagaagatatgaccatattcaacaggatatgccttcagaacnagaaaatgcaggtgtcaactagcagttata

SEQ ID NO: 25936 - DNA, 101 bp, rice(Oryza sativa)
  misc_feature (71): n=t or g
agaacaacactgaccctttgactagcactcttggcaacatcatttagacctctaacattccacactagcanattaaaactctacattaaaaggacatatac

SEQ ID NO: 25937 - DNA, 101 bp, rice(Oryza sativa)
  misc_feature (71): n=t or c
ggtgacaccccagagagcagcagatccagtgaaccatgcagaagtaccaccatacgcatggcattcatttnaggaacgtgcgcatagtcttgagcatcatc

SEQ ID NO: 25938 - DNA, 101 bp, rice(Oryza sativa)
  misc_feature (71): n=t or g
gtttgctatggtgatcttttttggtggtgcaggctttcaaaccctcatacaatatcagtcacgtcaaagtncaatacaagcttatggtgctttacatgtag

SEQ ID NO: 25939 - DNA, 101 bp, rice(Oryza sativa)
  misc_feature (71): n=t or c
tcctttatttagttgcatgtctccattacgtgtggattctaactctatacatttgttagggaggttgctgnaagatatgtggtgaagttacacacctggcc

SEQ ID NO: 25940 - DNA, 101 bp, rice(Oryza sativa)
  misc_feature (71): n=a or c
accagcattgtctataaagaaaaaatgtgcatggatatgctgtactctctctgttcttttcagcctattcnctgaattattaaaatgaattctttaactcc

SEQ ID NO: 25941 - DNA, 101 bp, rice(Oryza sativa)
  misc_feature (71): n=a or c
gccctaacacatgtacttgaacttctgtccattgtagtatccgtatttgtggcgagtccgggtttcattanggggcagatcgtccggatgacaccaaaatg

SEQ ID NO: 25942 - DNA, 101 bp, rice(Oryza sativa)
  misc_feature (71): n=a or c
gatctaagccaccaattcgttccccttacaatggcccaatacacggtgtagcacgccaaatggagtagtgngatgcagaaatacctgcatgattattcaaa

SEQ ID NO: 25943 - DNA, 101 bp, rice(Oryza sativa)
  misc_feature (71): n=a or g
gtcgcccatgacacggatgaagagcagttgccgtcgatgtcgccggagattgtggctatcaatgtcttccnaagtgtccgctccaccgctgcgcgccgcat

SEQ ID NO: 25944 - DNA, 101 bp, rice(Oryza sativa)
  misc_feature (71): n=a or g
cgctcgggcttgtcccgtactcgggttaatccctataggtccttttttgcagatcaaatgagatggtggcntcgtctttctttgtgatggaggtgtccagc

SEQ ID NO: 25945 - DNA, 101 bp, rice(Oryza sativa)
  misc_feature (71): n=t or c
tcaagccacacccacagctggtactgcttcttgcactgcccccagatatactccaattgcgccttcgtcancttcttcttgcacttgttcttcattttctt

SEQ ID NO: 25946 - DNA, 101 bp, rice(Oryza sativa)
  misc_feature (71): n=a or g
agtaatagtgaatgcatgggctattcatcaaagtgttaaagtttggatacaaccagaaaagttcctccccnagagattcattacaaaagatatcgattttg

SEQ ID NO: 25947 - DNA, 101 bp, rice(Oryza sativa)
  misc_feature (71): n=t or c
cactgcagcttaaggcctataggaatcaatgatttatataagcggattccacagctgcatgtaaaaatagnttttcacatgtggtttatgaccctaagaca

SEQ ID NO: 25948 - DNA, 101 bp, rice(Oryza sativa)
  misc_feature (71): n=t or c
ttcactggttgaactgcaggcaggttataatcacctaaaggctcttcctgaggcggttggaaagctagagnctctagagatcctctccgtgagatataaca

SEQ ID NO: 25949 - DNA, 101 bp, rice(Oryza sativa)
  misc_feature (71): n=t or g
aaagttcttctgtacagtactaccggtctactccacggtgtcactgtcaccccagaaacctagtaaaaggnaagaactgccttgttttagtttagtgctat

SEQ ID NO: 25950 - DNA, 101 bp, rice(Oryza sativa)
  misc_feature (71): n=a or g
gatgaccatcgtgaacaacgagtccaaggcaacaatggtcgaggtcgacaacgagacgatggtgattgacnacgacgggacacacgttccccagcctctcg

SEQ ID NO: 25951 - DNA, 101 bp, rice(Oryza sativa)
  misc_feature (71): n=t or c
taaaatatgacacatcctactactactacagcgaaattgacggtacgaagggatcatataactagaaatgnaaaattgttcatcgccatttcttgcatttt

SEQ ID NO: 25952 - DNA, 101 bp, rice(Oryza sativa)
  misc_feature (71): n=a or c
cccaccctgtggctggaactggcttgtttgtaaatataaaggagtcccagccatcaggagctgtattatcncttttgggataagaacgccgcgatttctca

SEQ ID NO: 25953 - DNA, 101 bp, rice(Oryza sativa)
  misc_feature (71): n=t or c
tggtgaagttatgatcgtatgactattatattactcagggtttacaacctagtgcttatcagtggcgaatncataaaattgattcgttagtattataacgt

SEQ ID NO: 25954 - DNA, 101 bp, rice(Oryza sativa)
  misc_feature (71): n=t or g
tagcacttatgtttgatttcccacctcctgtgtgtctttattgtgtgtgtatttgtgcatggccttcaatngtgagaaaattgaactgaaattcatgctca

SEQ ID NO: 25955 - DNA, 101 bp, rice(Oryza sativa)
  misc_feature (71): n=a or g
ctatttagagaacgggatttgctttcatttcattgccataatgtgtattttcaattgatgctccaaaggtntaacttgttttgttcccgttttgatgcttc

SEQ ID NO: 25956 - DNA, 101 bp, rice(Oryza sativa)
  misc_feature (71): n=t or c
gtcatttcctccttttttttgtgtgttttccttttggggaaacttatacacggtactgtagatgcttcagntactttatatcaagccatgtacttctgcaa

SEQ ID NO: 25957 - DNA, 101 bp, rice(Oryza sativa)
  misc_feature (71): n=a or g
ttctctcctcgtctcccccacctctactttttcctctcctccttcccactactctctcccattctaggccnccctccctgaccaactctctcgcctcgatc

SEQ ID NO: 25958 - DNA, 101 bp, rice(Oryza sativa)
  misc_feature (71): n=a or g
tatccactcatctctcacaacaatctgatcacgaccatcgagaaaaccaaattgagaggagacagaaaagntggggagcgaaaacttgctaggcaacgcca

SEQ ID NO: 25959 - DNA, 101 bp, rice(Oryza sativa)
  misc_feature (71): n=t or c
atatcatcccatccggtcatgaaaactagaactgcaccagaccgctctttacgacatatgtggcaaagaanagcttctataaggttaaaccctatgcaatc

SEQ ID NO: 25960 - DNA, 101 bp, rice(Oryza sativa)
  misc_feature (71): n=t or c
gggcatgtttgggcctcatcccgagcccccaagtcgcctgcgccttgtacttgggagcggccagtatgctnggggcagccgtgcgcccagggcacccaaca

SEQ ID NO: 25961 - DNA, 101 bp, rice(Oryza sativa)
  misc_feature (71): n=a or g
tacattgtccatatgattgcacctaacatcgttgttcaattttcgtgatcactagttttttaacttgccgncgcttagaaagtacgaagtttcttaaatat

SEQ ID NO: 25962 - DNA, 101 bp, rice(Oryza sativa)
  misc_feature (71): n=t or c
gctcgccggatctgtatcggtgccaccttgccatcacagacgaatccgatgtagggggctagggagaggcnggccactggctgtcgagcaccggccgaggc

SEQ ID NO: 25963 - DNA, 101 bp, rice(Oryza sativa)
  misc_feature (71): n=a or g
gcctccttgagggtgttggcgaggctctccatttcaaggctcttgcgacccagttcgtcgtccttagctcnaaaacggcctttaaaaccgtcaagacgagc

SEQ ID NO: 25964 - DNA, 101 bp, rice(Oryza sativa)
  misc_feature (71): n=t or c
gtggtttcttgtttcttgatttttgtttgttggtgcagcagcagtggagtgcctcttcgagaccctccgcngcctccccggtggctgcgagcgcggcgcct

SEQ ID NO: 25965 - DNA, 101 bp, rice(Oryza sativa)
  misc_feature (71): n=t or c
aatacacaaaccaaccgtgatccagggtttactacttcggtatgcacaaagctactgcatgcaggggcgcnaggaggggggtgggggctgaaattttggaa

SEQ ID NO: 25966 - DNA, 101 bp, rice(Oryza sativa)
  misc_feature (71): n=a or c
ctcctaccaccgcgctgtaggtcgatgatgccctttgtgtccagttgcctgcaaatcttctctgcttcccngctgccgtcacacggccttgctcttcctct

SEQ ID NO: 25967 - DNA, 101 bp, rice(Oryza sativa)
  misc_feature (71): n=a or g
tgtgtacatagatctcaaatgtccaccttgaacatcctggatacaccactttgcactttgatggaggagancctcaccaaagagttggaggagatggaagc

SEQ ID NO: 25968 - DNA, 101 bp, rice(Oryza sativa)
  misc_feature (71): n=t or c
cggaggagttcagaggggactttgtacaagtcctcgtcaactgccctaacaaccctaggcctcctcgatcnatggacaactaccccaccatcaacaacaac

SEQ ID NO: 25969 - DNA, 101 bp, rice(Oryza sativa)
  misc_feature (71): n=a or g
ttattcagttatatgtccttatattttgggacgacgtaagtatttaacaagcctctgaccttctgaaaggncctgcggtctacgtggtgaagggtcggggt

SEQ ID NO: 25970 - DNA, 101 bp, rice(Oryza sativa)
  misc_feature (71): n=a or c
gttcaggatgagagattacctgaagaagacttcatagaagatccggacatagcaaattcaaaggggaggcnaagacaaagatataaaacaattagagagca

SEQ ID NO: 25971 - DNA, 101 bp, rice(Oryza sativa)
  misc_feature (71): n=t or g
ttgttagttgcatcaccaacttaatttgttgcagtcttgtataggcttttgatcggcgtaccctactggcntgtggcattgatgattgatgaaaagatcca

SEQ ID NO: 25972 - DNA, 101 bp, rice(Oryza sativa)
  misc_feature (71): n=a or g
ctaattaaaggataaaatgtaccctataaaaatgaaacgggattgactttccatcgacaccaagccgaganctttatgagtttatggggatgcaatgatat

SEQ ID NO: 25973 - DNA, 101 bp, rice(Oryza sativa)
  misc_feature (71): n=a or g
ggtgttagggtttagggagggaggaatttatatgatcttcgatgggaggagatgcggttgattgagatccnacggccacgatttatttggtataaggaaac

SEQ ID NO: 25974 - DNA, 101 bp, rice(Oryza sativa)
  misc_feature (71): n=a or g
tgcagggaccagctgtaaacctttgtttaacagtaacttcagattccagtgcaacaggaaaggatggaacnaagaaatcagcgtttggaacaattatacaa

SEQ ID NO: 25975 - DNA, 101 bp, rice(Oryza sativa)
  misc_feature (71): n=a or g
agcgcaaacgaagagttctttctgatgcttctgaaagacccaagctctaggatgttgcaatgcctgcagancctgtacacggcactaggaaatcccatgtt

SEQ ID NO: 25976 - DNA, 101 bp, rice(Oryza sativa)
  misc_feature (71): n=t or c
agatgttacaaaactatcttttgcactatacatcctttgaatggtctgtgatttgaatagttttggatcantcccgtttatctggtctgaattctcactga

SEQ ID NO: 25977 - DNA, 101 bp, rice(Oryza sativa)
  misc_feature (71): n=a or g
ctgctatcatgccagataatttgcagtcgacctatccagtgattgttccagcttatttctcgccctttttncaattctcggttcctttctggcaaaatcag

SEQ ID NO: 25978 - DNA, 101 bp, rice(Oryza sativa)
  misc_feature (71): n=a or g
ttatactacagatgtggttacagtgatgagcgaaagtgtcaagcaaagaaatatgtgcagcaagaaaacancaaacatcccccagagttcagggtcaccct

SEQ ID NO: 25979 - DNA, 101 bp, rice(Oryza sativa)
  misc_feature (71): n=t or c
cacggattacttgtaaataagctagcggtgaaagtcttatgacaacataccggcaatcagactctaatccnatgtctacaaataaggattcctaaagttat

SEQ ID NO: 25980 - DNA, 101 bp, rice(Oryza sativa)
  misc_feature (71): n=a or g
agaagtcatcgtggttgcctttcttcgaagagtttcaacctaaatatatgttgatcgctttgctacgtggntgctatatgcactaacgcatcacaaaaaat

SEQ ID NO: 25981 - DNA, 101 bp, rice(Oryza sativa)
  misc_feature (71): n=t or c
gagtcaccctaaccctagtcctctccctctataaatagccactggcaccacctttttcccctcctttttcngttgctgccgccgcagccgccatctccacc

SEQ ID NO: 25982 - DNA, 101 bp, rice(Oryza sativa)
  misc_feature (71): n=a or g
acttcttttcttctgcttcaactgcagttctccttaatggggtgcctggcaaattctttaaatgcaaacgnggtgttcggcaaagtgatccactctcccca

SEQ ID NO: 25983 - DNA, 101 bp, rice(Oryza sativa)
  misc_feature (71): n=a or g
actgtctgaatctttgagcttaagtaaacaagagaggttatagaagcagagcactgtcattgtcatgctanttttgatccattgaatgacaggattgttat

SEQ ID NO: 25984 - DNA, 101 bp, rice(Oryza sativa)
  misc_feature (71): n=a or g
ttgtatcagtcaggtccatataattagaaatagggtaggagttcataagttaacaggttagacacgtatanttagggagggacggtgattacttttcacag

SEQ ID NO: 25985 - DNA, 101 bp, rice(Oryza sativa)
  misc_feature (71): n=a or g
acgacatcttatgagaacataggaagtaccgaagtaatagaatacgtgtaatctgatcttagtttctctcngtccaaaatataaaaaactagtattgaatg

SEQ ID NO: 25986 - DNA, 101 bp, rice(Oryza sativa)
  misc_feature (71): n=t or c
ctcattttagtgttaaccctcattcagtaacagtggacccgcaaccgcaagaagaaaaaataatggatatngaggcagtactgaaactttttgtccatact

SEQ ID NO: 25987 - DNA, 101 bp, rice(Oryza sativa)
  misc_feature (71): n=t or c
aggaaaatggtatctgaagtttcggagagaaaagagctgcataagatgcttggtcacctggaaagcattgnttcagacatgcaggagtttgttgtgtttgt

SEQ ID NO: 25988 - DNA, 101 bp, rice(Oryza sativa)
  misc_feature (71): n=t or c
atagcatctcacttagcaggggtagcatttgttttattttgcatagtacttgcttgggggtcttcagttgncttggatgaagcaccgtcaatggcaatgtt

SEQ ID NO: 25989 - DNA, 101 bp, rice(Oryza sativa)
  misc_feature (71): n=t or c
aatctgctgctctgcttgcctatctgcaacaactttgctcggtcggtcagccctttgcttgttggcttgtngcttgatgttagtacacacatgcactgcct

SEQ ID NO: 25990 - DNA, 101 bp, rice(Oryza sativa)
  misc_feature (71): n=a or c
ctaatcttcagcacctccatttttgcttttgtttttcttgaagaaaccatagcacccaattctctttctgnacaaaacaaaagaatgggtttgttagatca

SEQ ID NO: 25991 - DNA, 101 bp, rice(Oryza sativa)
  misc_feature (71): n=a or g
tctaatgcttaagcatcttataccacatagggaaccattcacagtgtttatttgtacacaacatccttttnttaatgtccatccattactcacagacttac

SEQ ID NO: 25992 - DNA, 101 bp, rice(Oryza sativa)
  misc_feature (71): n=a or g
tatcataactgactactcatataatcaaagagaacgaatttaccttctcagaagagaattcgatgcctgtntcataaaaagaatcatagtttccaatctca

SEQ ID NO: 25993 - DNA, 101 bp, rice(Oryza sativa)
  misc_feature (71): n=t or c
acatttcaggtcgacttccccagcttgaacctgacttgaatcatttgaatatggaggagcaaatgcttctncaacagatccggagggagcaacggcagcag

SEQ ID NO: 25994 - DNA, 101 bp, rice(Oryza sativa)
  misc_feature (71): n=t or c
gttaatagaatcatcattcgtgtcgaaaaaaccttccgttttgtgatcattcatcaaccttttgatataancctttagctgaaattgtatttgaaatttga

SEQ ID NO: 25995 - DNA, 101 bp, rice(Oryza sativa)
  misc_feature (71): n=a or g
tgaatattggcatggtatgaaatggtttactaatgagtaatcatcgttgatgaactgtgtagattgtcgcnatgcaattattggggttgtctggtcatttt

SEQ ID NO: 25996 - DNA, 101 bp, rice(Oryza sativa)
  misc_feature (71): n=t or g
cacagaggcacatgagccttgctgccacaagagatggaggatgcatcccaacatgtcaataactttgtctngggaagtaagtgcatggtgccccaggactc

SEQ ID NO: 25997 - DNA, 101 bp, rice(Oryza sativa)
  misc_feature (71): n=a or g
tggagggtctgaaaagttggagtgcacttcaggattaggtgcaattgctgggctggaaccaattaattttnttaccttagcaaccccacaccttggtgtta

SEQ ID NO: 25998 - DNA, 101 bp, rice(Oryza sativa)
  misc_feature (71): n=a or g
ataatttgcatgcgtgattcttcagaaagtgcagctagcaggtagctaagccagcctaccacatgggggantagggacaggatgggccaggacggcgccgc

SEQ ID NO: 25999 - DNA, 101 bp, rice(Oryza sativa)
  misc_feature (71): n=a or g
ttaaggcgttttgcttctcggccggattgtccaagcgcctgttttcccttcttctcgtcgacggaaacaanggtgcgatgctggcattattggttctgggc

SEQ ID NO: 26000 - DNA, 101 bp, rice(Oryza sativa)
  misc_feature (71): n=t or c
aagctttctaagtgcctcggtgccaacattatgcttgatcatagtgtgcacaatagtgccatatgccatantaaactccccagtgccaccaacaatggccc

SEQ ID NO: 26001 - DNA, 101 bp, rice(Oryza sativa)
  misc_feature (71): n=a or g
ggagattagtgtaaaagtattggcagagaaaagtaacagagatgggagatacccagtggataaaacagaancattcaacaaaacaacattttcggtactag

SEQ ID NO: 26002 - DNA, 101 bp, rice(Oryza sativa)
  misc_feature (71): n=a or g
cgatttctatagattatgatctcttcatctgtggctgcttagcactggaactgaaacatttgttggcgtcnaactttatcaattttcaggttattagccat

SEQ ID NO: 26003 - DNA, 101 bp, rice(Oryza sativa)
  misc_feature (71): n=t or c
cttcactctctgtcttgaaatttttttcattcctcttgagtgaatttttctaagtcaaaattagtctatcngatgtgatcggactatcctatgatccagag

SEQ ID NO: 26004 - DNA, 101 bp, rice(Oryza sativa)
  misc_feature (71): n=a or g
gtgtcatgcctcgatcttagccgcatatcgttcgtctgacggacaatgttagccatcaggaatacttgcangttgaaggaatagaaaccttttgcactgtt

SEQ ID NO: 26005 - DNA, 101 bp, rice(Oryza sativa)
  misc_feature (71): n=a or g
gattattgcagatcaagaatattcagacattgtgggataaatttgagggcactgccatagatttcagcaantttagagtattttttccgcttgttccgtga

SEQ ID NO: 26006 - DNA, 101 bp, rice(Oryza sativa)
  misc_feature (71): n=a or g
ttgcctggatgtccaagtctggtgagagatgcttgataacaaaaaagaggtacccaagaaagacttgcgtngcttggtccttttggttgtctagaaaatct

SEQ ID NO: 26007 - DNA, 101 bp, rice(Oryza sativa)
  misc_feature (71): n=t or c
cgagaacctggaattattgattccttgattgaaattcattttctttatgtaggttatatagtacatgttgnccatagatgacacgtgggtccacatgtatc

SEQ ID NO: 26008 - DNA, 101 bp, rice(Oryza sativa)
  misc_feature (71): n=a or c
ttcaggaggtgcagctacaggatgatgtcgacgattccatcagatggagactaacttccaatgggactttntgcacggcatctgtgtatgagctcttcttt

SEQ ID NO: 26009 - DNA, 101 bp, rice(Oryza sativa)
  misc_feature (71): n=t or c
cgaattacgtgctgccctactgctctaagctgattggtgtaccactgaacctgaatctggtatctattttncccgtctcaaaataagtccaaatttagata

SEQ ID NO: 26010 - DNA, 101 bp, rice(Oryza sativa)
  misc_feature (71): n=a or g
tagcgaagttcaaacccaaagcttctagagcagacttgtcaaagtagatttcagcatgagctggagtcacntcaatcaattgagggaacaaactactagtt

SEQ ID NO: 26011 - DNA, 101 bp, rice(Oryza sativa)
  misc_feature (71): n=t or c
tgccaaagtagaagctccctccactgacacaatctgccccgagggacaggagaagctcaagttgaaatcgntcttccctatctccttcactgaagaaaaca

SEQ ID NO: 26012 - DNA, 101 bp, rice(Oryza sativa)
  misc_feature (71): n=t or c
acgataaattgtttaattgtttcatacagtaggagagactatgctcagagttgtttgtgtctatgtggtgnactctctctgctgtaaaatgtaagtatttt

SEQ ID NO: 26013 - DNA, 101 bp, rice(Oryza sativa)
  misc_feature (71): n=t or c
ctcgaagatggtccgagcggccattgatcttatcaagaagatggtgtccaacatgggctggagcgaagaangactccagacccgccagcgtggtatgcata

SEQ ID NO: 26014 - DNA, 101 bp, rice(Oryza sativa)
  misc_feature (71): n=a or g
taatgttttcacttaattttgagggcaaaaaaatcaaattgactctttgctcagtttcttttactccactntagctagtttttactttgccatgtgtatcc

SEQ ID NO: 26015 - DNA, 101 bp, rice(Oryza sativa)
  misc_feature (71): n=t or g
ctcttctttttttttttgccctcatcaccctacatctatgaactggaccggcatatccttttttttttttnagaaacacagcatatcaccctacccctatg

SEQ ID NO: 26016 - DNA, 101 bp, rice(Oryza sativa)
  misc_feature (71): n=t or g
cccagtgatccagttacttttgcctgtacactgaaatcacaaattctcaaggatgtactgactactgagtngctatctggataatcatgtctaacatggaa

SEQ ID NO: 26017 - DNA, 101 bp, rice(Oryza sativa)
  misc_feature (71): n=a or g
aacaattaggtctctttatccaattgtacagcgatacttggagagttcgtaggtaccgttggaatgaattntccgcctttccctatcagcttaagcttttg

SEQ ID NO: 26018 - DNA, 101 bp, rice(Oryza sativa)
  misc_feature (71): n=a or g
ccaattagagaagccactgagagcactttgaattccgaccgctaggtttgctagaccaaatctttgaaagnagacacaaatcttcccccagcgaataaatc

SEQ ID NO: 26019 - DNA, 101 bp, rice(Oryza sativa)
  misc_feature (71): n=a or g
caagtcagatgtatacagtttcggtatgttggttttagaaatggtgagtggaagaaggaatctggacccangtattgataaccaacatgaagtttattttc

SEQ ID NO: 26020 - DNA, 101 bp, rice(Oryza sativa)
  misc_feature (71): n=t or c
taacatatttctgcaacattaatttaccattgatgttgtgcagtgtgaggacaaaggggaccatggttganattcttcttcaccatatgttgagcaatgaa

SEQ ID NO: 26021 - DNA, 101 bp, rice(Oryza sativa)
  misc_feature (71): n=a or g
taaccatctcacctttgcttcgttttgttttagagatatacatgttgtatataataacttattgagccgcngttcaaccggcggttcaccggtcagaccgt

SEQ ID NO: 26022 - DNA, 101 bp, rice(Oryza sativa)
  misc_feature (71): n=t or c
gttgtgtatttcgttggattttcccctcaatatgcggatttaatttagctttgtacgtgtggggtgtaagnggcacgagtcatgccaggaacctaccggac

SEQ ID NO: 26023 - DNA, 101 bp, rice(Oryza sativa)
  misc_feature (71): n=t or c
cttctcgcctttgctgactaccactgccttctcaacatcgtcgttgctgacaatattctcatggggctcangtctgctgaccagatctacaatgccaacgc

SEQ ID NO: 26024 - DNA, 101 bp, rice(Oryza sativa)
  misc_feature (71): n=t or c
accctcacctggtcactgacaaggattacttgcatactgcaatgaaacatgctattacatgtggtgtcatngaccagtggttacttgcacgagaacgaggg

SEQ ID NO: 26025 - DNA, 101 bp, rice(Oryza sativa)
  misc_feature (71): n=t or c
gcgaccgccccactctgtgctacacccatggcgcatatcagtgtggttagagaaagctctgctgggtaacncctcagtgtgtatgactgaaaacaagtagt

SEQ ID NO: 26026 - DNA, 101 bp, rice(Oryza sativa)
  misc_feature (71): n=t or g
taggagcagtgttatttacgtggagatgtctattatgttgagctgtgtatggattacaggaaacataaagnttcaacttttctttgccccacagttaatgc

SEQ ID NO: 26027 - DNA, 101 bp, rice(Oryza sativa)
  misc_feature (71): n=a or g
aggttcccacgagcccgcgcccatcgtatcttggcaacttttttgttcaattttgttcccgtgctcctcgngtgaggtactagtttggttccatctctggg

SEQ ID NO: 26028 - DNA, 101 bp, rice(Oryza sativa)
  misc_feature (71): n=t or c
ttttttatttctggccggactgccgatggtaagcatttccgctatcagcgtgttccaattcaccaagtttngcacgggtattctgttgaacaccgcgtgcg

SEQ ID NO: 26029 - DNA, 101 bp, rice(Oryza sativa)
  misc_feature (71): n=t or c
taatgtaaaggaaaggatttaaattgacataattggttcgattctcaagcgaagctaagaaatttaaaatnatgaaaattaatacacataacattaaaaga

SEQ ID NO: 26030 - DNA, 101 bp, rice(Oryza sativa)
  misc_feature (71): n=a or g
gttcgccgtctgggtgagcgccaacgccaacgagtccaggccggtcgtcatatggtacgcccacaacgacnaccactccgccgtggagggcgacgccaatt

SEQ ID NO: 26031 - DNA, 101 bp, rice(Oryza sativa)
  misc_feature (71): n=a or c
gcgcgccccacattctctcttccttgcacagccatgacaccactgcccgggcccctcaaccgcattccgtngaacaccttcatggcgtccgcgacaaggtt

SEQ ID NO: 26032 - DNA, 101 bp, rice(Oryza sativa)
  misc_feature (71): n=t or c
gatatgaccgaatgagatcagaatcatcaccacccaacaaatagatctatcaagatcgatcaaacttcaangcatacaacgccgcggggaacaacagttca

SEQ ID NO: 26033 - DNA, 101 bp, rice(Oryza sativa)
  misc_feature (71): n=t or c
tgctgctcttcctgaaggtctttcatgagagatctagtagagggcactgctacagaaagggtaaaaggtgncggttcggaaaccctaataggtgccggttt

SEQ ID NO: 26034 - DNA, 101 bp, rice(Oryza sativa)
  misc_feature (71): n=a or g
cgaggaggatcatggcacttcccaagtatcacatgatcgtacttagttataatctgtgaaacccacagganccatgataccagtcatgatattgagcagaa

SEQ ID NO: 26035 - DNA, 101 bp, rice(Oryza sativa)
  misc_feature (71): n=t or c
ttaaggctcttaggggaggtactggatgaacacaatgatggattatcaaaagggcgtgcctggattctgtntcatggcagtgcaactgtagcaccacaatg

SEQ ID NO: 26036 - DNA, 101 bp, rice(Oryza sativa)
  misc_feature (71): n=t or g
gccgattcggttggtatactaattcaaccaggggcaacttaatccaaacaaccaagccatagtcaaatacngtcagattaataatggcatggatctaatta

SEQ ID NO: 26037 - DNA, 101 bp, rice(Oryza sativa)
  misc_feature (71): n=a or g
tatgtagtgaacaaatatttcattacaaccacaaaattgacactacgcgacagtgatgaaactgttaagtntagtagtatgtcaagggtattagagtactt

SEQ ID NO: 26038 - DNA, 101 bp, rice(Oryza sativa)
  misc_feature (71): n=a or g
aaatgagtagatgaccattgaatgtttggtgatccaacgtgacgttacgaacatgggtgaaaactatatgnaaatttccgaccatactgacacaccgtttc

SEQ ID NO: 26039 - DNA, 101 bp, rice(Oryza sativa)
  misc_feature (71): n=t or c
ggagggaataccatggacctcacaacggacctggtgtgggaacttgctactgagaggacaaatcctggtgnactccagctctgctgggaaaccaaccacaa

SEQ ID NO: 26040 - DNA, 101 bp, rice(Oryza sativa)
  misc_feature (71): n=t or c
agtctatgtaggggtaactcgccactatgaaaatctctaaagacggacattaagtcttctttaattacttnccagaacacttgatagaactccgctgggaa

SEQ ID NO: 26041 - DNA, 101 bp, rice(Oryza sativa)
  misc_feature (71): n=t or c
ctcctcataagaacttgaattttctggctttatcagctcagtatcaccagttacaccaagacgataagaantcggctccatctcagtcttctgcggaccgc

SEQ ID NO: 26042 - DNA, 101 bp, rice(Oryza sativa)
  misc_feature (71): n=t or c
aggccgctattgcaatcgctacgttctcatccactatgcacagtagcaccatgctcctactactgctgtcntagccactacaactgattactctctctatc

SEQ ID NO: 26043 - DNA, 101 bp, rice(Oryza sativa)
  misc_feature (71): n=a or c
tttgaggacgctgtcacgacaaggcttgtgatgaacaactctcggttgcctcttcttgtagaggggagtgnaacagaagaaggcggcgacggagacggcca

SEQ ID NO: 26044 - DNA, 101 bp, rice(Oryza sativa)
  misc_feature (71): n=a or g
atgttgcacttgagattggatgatcagttgcaaaacaaactcctcacgagattcactcacgttagtgaaanccttcactgccactctggtattgtcatcaa

SEQ ID NO: 26045 - DNA, 101 bp, rice(Oryza sativa)
  misc_feature (71): n=a or g
tgaaatatgaatacagtggtattacttttgtgttacttccagttccgtttggacttatttggttttgtagnagaacttctatatataaatttttttcatga

SEQ ID NO: 26046 - DNA, 101 bp, rice(Oryza sativa)
  misc_feature (71): n=a or g
cctcactcctcgggctcgacatgttcgtcaccactgccgacacaatcaaggagcccatcctttccatggcnaactccatcgccatctccaattgcctctat

SEQ ID NO: 26047 - DNA, 101 bp, rice(Oryza sativa)
  misc_feature (71): n=a or g
atcatcggagtagtcgtagtagagattgggatcatctggaagcttgaccttagacatggtctcctcccacngccgatccagaagcgctctgcgctgtattt

SEQ ID NO: 26048 - DNA, 101 bp, rice(Oryza sativa)
  misc_feature (71): n=a or g
ctcttcattcaataaatcgtatttatcatggcttggggaaatcaccagtctttcaatgtttactaccttgngtctccactctttcctatgtttttattaga

SEQ ID NO: 26049 - DNA, 101 bp, rice(Oryza sativa)
  misc_feature (71): n=t or g
atctgatttgttgggcatcggcagatgacctttctcattttctgaagagtcatctttccttggggcatttnatttcgaattcatcttctggacctcctcct

SEQ ID NO: 26050 - DNA, 101 bp, rice(Oryza sativa)
  misc_feature (71): n=t or c
gggtgctgggccggcccatccggcccggcagcaaaaggtaggagggggcggcaacagtacatttatacaangtgaagcggtgtcaaccgcaggggacgcga

SEQ ID NO: 26051 - DNA, 101 bp, rice(Oryza sativa)
  misc_feature (71): n=t or c
tttttttaaaaaaaaagaaaaggtaaaatgggagccttgtgtatctgcaattcttcagggaaggagaatgnggagtatgggcagcgtctcaaacgaccgaa

SEQ ID NO: 26052 - DNA, 101 bp, rice(Oryza sativa)
  misc_feature (71): n=a or g
cgtagcaataatatcctcgttcgtcgctccacaccaccatattggtggtctaaggggcgatgctagagatnggagccccagcctgattacccatggcccta

SEQ ID NO: 26053 - DNA, 101 bp, rice(Oryza sativa)
  misc_feature (71): n=t or c
attttatttttagcgtgttaaactgcatagattaaagaagttggtaagaaggaattatgcttaccccatcntggatgtgaatggagagttgttcgattctt

SEQ ID NO: 26054 - DNA, 101 bp, rice(Oryza sativa)
  misc_feature (71): n=t or c
tatgaaagttgctctacagcgcggaatattagtttgagcactgcacaacgccctctccttctggttttccngttttttaccacaccacttttcctccgcat

SEQ ID NO: 26055 - DNA, 101 bp, rice(Oryza sativa)
  misc_feature (71): n=t or c
tccttcatcagcatagatattggacagaagaacatagactccagagtcatctgctccgagactggccagangctcaactgatagctcagccagctccacac

SEQ ID NO: 26056 - DNA, 101 bp, rice(Oryza sativa)
  misc_feature (71): n=t or c
tggattttggacatgatatccaaagaagaaacatcgtaactagtgaggacgccaccatgcaccggtgcccngagataggggacagtagagaggaagctagt

SEQ ID NO: 26057 - DNA, 101 bp, rice(Oryza sativa)
  misc_feature (71): n=t or c
tatacatccgcagccatgtcacacacatccactagccatcaaaaagcatgctgctcacaagatcaatcaancgggaggcagagaatggccactcacactgc

SEQ ID NO: 26058 - DNA, 101 bp, rice(Oryza sativa)
  misc_feature (71): n=t or c
agacttgaagagattgaattttggtgttatttctttaatcccaaaaaacaatgacccttctgacataaaanaattcaggcctatctgtgttttgaatgatt

SEQ ID NO: 26059 - DNA, 101 bp, rice(Oryza sativa)
  misc_feature (71): n=a or g
ttcgtcagatgcccctacatggctacatcgctcacatttggcgcctctcactggctctctgtcgagaactnccatggttgtgccaccaaattacccaatct

SEQ ID NO: 26060 - DNA, 101 bp, rice(Oryza sativa)
  misc_feature (71): n=a or c
gtggataccagcaaagcgacaggtaggcggagtggtgacaacccgcggtgaggttaggggcggctaagacntgtttaaatgggactaaaacttttaagtgc

SEQ ID NO: 26061 - DNA, 101 bp, rice(Oryza sativa)
  misc_feature (71): n=a or g
gagcgcaaggccaccatgtggtaccaacatggaaaaactcatcagaatgtggtgatgggagaaagagcacnagtagtgcgatgtgctgtggataggtaata

SEQ ID NO: 26062 - DNA, 101 bp, rice(Oryza sativa)
  misc_feature (71): n=t or c
attagccggccattaattggttgatcaaagaacaatggtaaggtgagcataggtaccccagcaaagacagnttccagcgtcgagttcattccacaatgggt

SEQ ID NO: 26063 - DNA, 101 bp, rice(Oryza sativa)
  misc_feature (71): n=a or g
tcctatcctctctcctgcgtggggcacaagttatgatctcatcaaccctgagaatcatctcagccgcctcngtggcggagagaaggatggcttgcttcacc

SEQ ID NO: 26064 - DNA, 101 bp, rice(Oryza sativa)
  misc_feature (71): n=t or c
aggctggcgcatggctgcagccagagcccaaggcgcaggtacaatagtctaggagacaagtataagatcanccacaatggtaaagtaagttgctctctata

SEQ ID NO: 26065 - DNA, 101 bp, rice(Oryza sativa)
  misc_feature (71): n=t or c
atggcgggagagtgagggggaatatataggcggagatggaggagtctgagttgccgcgttttttttttttntcgtttctgtcacttgctgcagtacagcac

SEQ ID NO: 26066 - DNA, 101 bp, rice(Oryza sativa)
  misc_feature (71): n=t or c
atattttcgaagttagacttgaggtcaggttatcatcagattagaatggctgagagagatattccaaaaantgcattcagaattcacctaggtcactatga

SEQ ID NO: 26067 - DNA, 101 bp, rice(Oryza sativa)
  misc_feature (71): n=t or g
atgccctgatcggctgccttaggtaacatcgcggctgtgtcaagacatgtagtacagccgatcaagtccanacccagtttggattcacaattatatataaa

SEQ ID NO: 26068 - DNA, 101 bp, rice(Oryza sativa)
  misc_feature (71): n=t or c
tcagcagccacctcctctaatggcatcttacttttttagccacaacctcttttcctaacttttgattcacntcctcagatttttctacattaccttcctta

SEQ ID NO: 26069 - DNA, 101 bp, rice(Oryza sativa)
  misc_feature (71): n=t or c
aaaattttgctgaaaaattaattcaatcactactgctaccacgtaatgggctactgctgtcctatcactgncggtcgggcgtgagcaacacagctcgttca

SEQ ID NO: 26070 - DNA, 101 bp, rice(Oryza sativa)
  misc_feature (71): n=a or g
gtctacggcgcctcctctcctcggaaatcgcatcctcccgtcgcaaatcacatcctacagccgcggaatcnccggaaatcgattcctctcgccgacggacg

SEQ ID NO: 26071 - DNA, 101 bp, rice(Oryza sativa)
  misc_feature (71): n=a or g
tggaacaatgacattttgggcctcaggagaggaggaaagagtcctctcttctataaacactcttatcatgnatcgatcaatatgcatgggtggattaagga

SEQ ID NO: 26072 - DNA, 101 bp, rice(Oryza sativa)
  misc_feature (71): n=a or g
ttaataagattgctcttttgttccaacaagtgttgtttatgtcttttccaggtaagtggtgggcgtgacanccgtcctataggagcatatgaactagccaa

SEQ ID NO: 26073 - DNA, 101 bp, rice(Oryza sativa)
  misc_feature (71): n=a or g
aaaaataaaaaccaaaactcctaatgattactagattcaatatttagaaaccaaaggatgattagaagganagattttgggtaggctgtaaattaaaagag

SEQ ID NO: 26074 - DNA, 101 bp, rice(Oryza sativa)
  misc_feature (71): n=t or c
ccagtggttacagatcaagactccagaggatgccctagctctatccagaaaagggcctcaactgattgcanatcaaaagtgaaaaaagtagaggatctaag

SEQ ID NO: 26075 - DNA, 101 bp, rice(Oryza sativa)
  misc_feature (71): n=a or g
agctatccccgccaggtcgacgaactctctcttcgacgggttcacattacactattataggcgctaacatntgtgacaataaaaagaatgggacccacata

SEQ ID NO: 26076 - DNA, 101 bp, rice(Oryza sativa)
  misc_feature (71): n=a or g
cataaaacagccaccctgcagcatagctccagagctgtgtttctggaacaacaatcttaagattacctccncaatggtaccaaatagcacaagagaaaagc

SEQ ID NO: 26077 - DNA, 101 bp, rice(Oryza sativa)
  misc_feature (71): n=t or c
agcacaccaatcaaacgttgtttcactctgattggcccccaacacgccgctgaaccatgtgagcgacaatnagacggccaggcaggcaggcagtaggacgc

SEQ ID NO: 26078 - DNA, 101 bp, rice(Oryza sativa)
  misc_feature (71): n=t or g
acttagtcaaaaaaaaaatacttacttgcaacctgaccagttcgtgtcagctcgtgcgtgcaatgcttttngcacatcgggattgttgaggtaacgaggga

SEQ ID NO: 26079 - DNA, 101 bp, rice(Oryza sativa)
  misc_feature (71): n=a or c
catatttacagaatgtagttttacaagcaaaacatcatagctcattgactgtaattcactcctggaaatcncccccccccccaaacacacacacaaaaagg

SEQ ID NO: 26080 - DNA, 101 bp, rice(Oryza sativa)
  misc_feature (71): n=t or c
agcagagaagataatccgtgtcaatctcggtatggcttttattggaaatcgagcctactcttcataggagnaccaatcaggtacaatgttgaaattagaaa

SEQ ID NO: 26081 - DNA, 101 bp, rice(Oryza sativa)
  misc_feature (71): n=a or g
actacttgccttatcgaggttccccgagaaagtagatgcattaacatcctctctttttgagaacttcgccngcgttttttctaaccctgccgtcctcttcc

SEQ ID NO: 26082 - DNA, 101 bp, rice(Oryza sativa)
  misc_feature (71): n=t or g
ttttccttgtcaggcgttcattcaggggaacttcaagaatgcactgcgatatgtttcacttgagtgccttnatctacatcttaggatggtggaatttatta

SEQ ID NO: 26083 - DNA, 101 bp, rice(Oryza sativa)
  misc_feature (71): n=a or g
atagggtttggctgtgctgaaggcttcgttgcagtcaaagacagtgctcactgatgtcttcctcggtgcgnggcggactgctcaccgacgtcatcctatgc

SEQ ID NO: 26084 - DNA, 101 bp, rice(Oryza sativa)
  misc_feature (71): n=a or g
ctctcgggtcgttgccgatcctacactataggagaaactgcatctttagtaatgagtaaaataatcgggantaaagttgaattcgggtgaatttttagttg

SEQ ID NO: 26085 - DNA, 101 bp, rice(Oryza sativa)
  misc_feature (71): n=t or c
gtcaaatcgtcagctataaaaaagttgggttaggttaaccaaatatgcttgattgatactacctccgtccnaaaataaatacagccatagatatccgtgtt

SEQ ID NO: 26086 - DNA, 101 bp, rice(Oryza sativa)
  misc_feature (71): n=t or c
tagcaccgagcggcggcacgggaaacggggaaggaggggaataaatggagaggaggaggagggagggcggntcaccgagaggcgcggcgacggagggagtc

SEQ ID NO: 26087 - DNA, 101 bp, rice(Oryza sativa)
  misc_feature (71): n=t or c
aaacagaatcaacaccacccaaataaaaagttaaaaacaaaaaaggaaccggagacctatagtttactccnttattcagtacaattgatatatcgtgcttt

SEQ ID NO: 26088 - DNA, 101 bp, rice(Oryza sativa)
  misc_feature (71): n=t or g
tacctaccatgaaaaggtggatttctagaggcttctaaagattcaaatgctgcgggtggagcggcttcttnaactgtaggatatagaaaaagtaaatgctg

SEQ ID NO: 26089 - DNA, 101 bp, rice(Oryza sativa)
  misc_feature (71): n=t or c
aggttccatccaagcgagtcatgtccctactgtaaggctaagctgtggagcatgttggaagcaaatatgtngccggggagttcttctgccaggcttggtgc

SEQ ID NO: 26090 - DNA, 101 bp, rice(Oryza sativa)
  misc_feature (71): n=t or c
tcgtcccgtataatagtacataggatccaagtagccaatcgttccttgaactgcagtagttattcctgttncattgattgagatatatcttgaagctctaa

SEQ ID NO: 26091 - DNA, 101 bp, rice(Oryza sativa)
  misc_feature (71): n=a or g
tggcacaacttgaagacaaggttgatagtgctatactgaaacgcactgtgcttcattttcaggtgtgctgngccagcgcctcaaggtatatttgccaattt

SEQ ID NO: 26092 - DNA, 101 bp, rice(Oryza sativa)
  misc_feature (71): n=a or g
atttcggagacagcgacctgcgctggtgctgttggtgaggtgatggaggtgggaaagatgaagatgaagcnagttggaatggatggagtagtggtttgcaa

SEQ ID NO: 26093 - DNA, 101 bp, rice(Oryza sativa)
  misc_feature (71): n=a or g
ccacaccatcattaactagttgctttagacaagtttcatattcatctgcagccccttcagctgatagtgtntcgtttatggcatagatttggcttgcagga

SEQ ID NO: 26094 - DNA, 101 bp, rice(Oryza sativa)
  misc_feature (71): n=a or g
cctagcctttctggcctccaagcccaaatctgcccaatctaggaaaaactgggccgcataatcccgttccngacttccggtccatgtccatagaagtcccg

SEQ ID NO: 26095 - DNA, 101 bp, rice(Oryza sativa)
  misc_feature (71): n=a or g
tctcattctattcatgcatttggtcgtagtgttgagtgcatgaagcgaataagtcagcacagataatactntagaaaatccatgacctttcataattaaag

SEQ ID NO: 26096 - DNA, 101 bp, rice(Oryza sativa)
  misc_feature (71): n=a or g
tttttgcttttagattttgacccaatagaatgttattggtcttgacatctccatgaataattggcaggttncaacccttgtgtagataatccaggcctaca

SEQ ID NO: 26097 - DNA, 101 bp, rice(Oryza sativa)
  misc_feature (71): n=a or g
atcttgtcctaatgagggatgcaatgtaaggattcacgtgtactgtttgaagaagaaattttctcagaganaggtagttacctatttttaattccacttta

SEQ ID NO: 26098 - DNA, 101 bp, rice(Oryza sativa)
  misc_feature (71): n=a or g
ttgcccaattgcgacggcttcccaggatagctcccagctaaaaccaagcacgagaaagcccaaataagccntatatcatatatggacatgggcgtatatac

SEQ ID NO: 26099 - DNA, 101 bp, rice(Oryza sativa)
  misc_feature (71): n=t or c
catcttgatgtcaagctcgagatgtttgagaaatttgcaccgaccaataacacataacacgctagcaatgncatacatctcgttcatttcaataactcgta

SEQ ID NO: 26100 - DNA, 101 bp, rice(Oryza sativa)
  misc_feature (71): n=t or c
caggctgtacaattttttgggtagtttgtcacgatcaaacccacggtagtgcgcacgcaccatatcataanagtatcatgtgaggtggctgattcttttaa

SEQ ID NO: 26101 - DNA, 101 bp, rice(Oryza sativa)
  misc_feature (71): n=t or c
ttctgtattacagaacattccagactcctaagtaagaaaagtaagatagcattcgcaccatcctgtttggnagtagaatcctcaagtcttttgtttgatgt

SEQ ID NO: 26102 - DNA, 101 bp, rice(Oryza sativa)
  misc_feature (71): n=t or c
tcaaagtcaaacttgtagtccttcccttcagggtcatcatcgagctcttttagttttgcagaagcatcatncatcaatggggtgccacgtgcagaatcaag

SEQ ID NO: 26103 - DNA, 101 bp, rice(Oryza sativa)
  misc_feature (71): n=a or g
acaaattaagttgtgatcatccgagcaaaagcaaagcaagagaacggtagctagctagttgacacaatganggcgggcaggttggtgatcctcgtggcggt

SEQ ID NO: 26104 - DNA, 101 bp, rice(Oryza sativa)
  misc_feature (71): n=a or g
gcactctgtgtttagggaggattgtagagggctgtaagtacggggtaaatctactgagagcggattagaanagaaataattgtattactagtatattcttc

SEQ ID NO: 26105 - DNA, 101 bp, rice(Oryza sativa)
  misc_feature (71): n=a or g
accacacggtccacacccaccaaacatccttatctagtcgtccacaccacacagtccttatctacacatcnatcccatcccttctcgcgtctctctctctc

SEQ ID NO: 26106 - DNA, 101 bp, rice(Oryza sativa)
  misc_feature (71): n=a or c
gcaggaagtgatcagtgagagtgaagggtggactcttgagaacgttcctgatggcatggaggaaatatgtntccccatctacttagcctattacagtctgc

SEQ ID NO: 26107 - DNA, 101 bp, rice(Oryza sativa)
  misc_feature (71): n=t or c
gactcttgaaagcaaactacagaggcattagaggaaacaacagactcttgcacgagggcacgcttagcagngttattaagccccctcacattccaaactag

SEQ ID NO: 26108 - DNA, 101 bp, rice(Oryza sativa)
  misc_feature (71): n=a or g
tttctgaagttaatatttacttttcccccttcagttcttgggagacatgctgcttgatagatccaactctncagtcatgatgcgttatgttagttcaaaag

SEQ ID NO: 26109 - DNA, 101 bp, rice(Oryza sativa)
  misc_feature (71): n=a or g
cgaatcagtcgacctgataatcccattttgtgaattgaaggaactgaagcaaaattctgtaaggacggagnaagcagagcagataatgcacccaaggcttc

SEQ ID NO: 26110 - DNA, 101 bp, rice(Oryza sativa)
  misc_feature (71): n=t or c
gtctgccgatgcctcggcggcatctgctgagtggatccaccagtcggcagtgttggcaaaaacattgaagnaatttgctcttgggacagccgattgatatt

SEQ ID NO: 26111 - DNA, 101 bp, rice(Oryza sativa)
  misc_feature (71): n=t or c
attcaacctggaggagcagatgttggttcatttcttggattttcctccatctctttttttcttctcctttnggctgtgttcttgagttcttttagatctgc

SEQ ID NO: 26112 - DNA, 101 bp, rice(Oryza sativa)
  misc_feature (71): n=t or c
gcggcagagactagagattccattgacccgaaggacataagttctgttactaccgtataatctaggactcnatgaattcttgatgtccaatgggcgtttga

SEQ ID NO: 26113 - DNA, 101 bp, rice(Oryza sativa)
  misc_feature (71): n=a or g
agggaacaatcttgatcgtgaatgtatggactattggcagagaccatagatattgggatgacgcagaagtntttataccagagcgtttcgaggacacaacc

SEQ ID NO: 26114 - DNA, 101 bp, rice(Oryza sativa)
  misc_feature (71): n=t or g
tctgtttttcagagaacatccagctcaggagattaacacagaaagtacgagttctactataaataccaaanctgcacaagctctaagtgaagtgctaaggg

SEQ ID NO: 26115 - DNA, 101 bp, rice(Oryza sativa)
  misc_feature (71): n=t or g
ctagatgtagaaaatgaatggagcatctaattggcctttcctttcttcttaagatctaaagctcgtagcanaaataagatgcactatagtagcttcgaagc

SEQ ID NO: 26116 - DNA, 101 bp, rice(Oryza sativa)
  misc_feature (71): n=a or g
aatgatggctacatgtcccctgatcctaaattgggtgttggaaaacctagagggaaaaccaaggcaaagantactaaaaggcttaaggctttggctgaaga

SEQ ID NO: 26117 - DNA, 101 bp, rice(Oryza sativa)
  misc_feature (71): n=a or g
aaatccataaaaaatatttgtcaccaccttgttaaacagaatgtatggcactggatgcaaagattactgcnagagttaagctcggacttggccttgaaacg

SEQ ID NO: 26118 - DNA, 101 bp, rice(Oryza sativa)
  misc_feature (71): n=a or g
gggaacaaccatatggcttatatcgccacaaacaatatgtattgcttataagtacgggaacatatcctgtncacacaagcttcccgtacacatcaactagc

SEQ ID NO: 26119 - DNA, 101 bp, rice(Oryza sativa)
  misc_feature (71): n=a or g
ctggcctcgcctccaccttcccaagtcaccttcactagtgctgttagcctcaccaccacctcctagagcancgtccacaatgaccccgcgcatgctgcccc

SEQ ID NO: 26120 - DNA, 101 bp, rice(Oryza sativa)
  misc_feature (71): n=t or c
ttacgaaaaggaaaaaagtccaagtcatcccaaacatctttaatccaaatgaattaccgccttgatcagtntggagttgttttggttagtggtactaattt

SEQ ID NO: 26121 - DNA, 101 bp, rice(Oryza sativa)
  misc_feature (71): n=a or g
gatcacctttcacaacatcacaatgatgctggtcgtctcactgcattttcttaattctagctctgcacccnttcaggtcagcgcaaaactaccaaatccta

SEQ ID NO: 26122 - DNA, 101 bp, rice(Oryza sativa)
  misc_feature (71): n=a or g
aaccatgcctttgctaacgaaatatctcaaattgttgattgctatcaagttgatccagaacctaactctgnctagtgtggcagcattatttggtcacgctg

SEQ ID NO: 26123 - DNA, 101 bp, rice(Oryza sativa)
  misc_feature (71): n=a or g
ctcctgttcatcatctccacgacatctatcttgaagatttcgcagtttttcagaggggatgacttccaganctttgatatggctgactctttcttcttgga

SEQ ID NO: 26124 - DNA, 101 bp, rice(Oryza sativa)
  misc_feature (71): n=t or c
tcagtcgttctagcttcctacgatgcttgatccacatctaccctcgccgactcccagggcgttaggtatgncacctctgccacctccaccttctctagcac

SEQ ID NO: 26125 - DNA, 101 bp, rice(Oryza sativa)
  misc_feature (71): n=a or c
ttggacaatggtatctgactatgccgaacaattggtccaactcatggttacaattgattcccacccttaanacataacagcagtgccaattaacaaatatc

SEQ ID NO: 26126 - DNA, 101 bp, rice(Oryza sativa)
  misc_feature (71): n=t or c
ccgaacaaattgatacattattaccttataagcacatcggaaagggcattttcaccgggagggacatgaangatgtggctgctatcactactgttcacagc

SEQ ID NO: 26127 - DNA, 101 bp, rice(Oryza sativa)
  misc_feature (71): n=t or g
ctggtgcatccttcaatgcctgatacgatctgcaaaacatgattcgcatggtttgctcatatgtatgactncattcaacccatagtattttcaaattcatg

SEQ ID NO: 26128 - DNA, 101 bp, rice(Oryza sativa)
  misc_feature (71): n=a or g
tgagcaagaagggagagccctacttcaacaatatgtcggtgttttcgtttggcggcgccgttttgttgatntgtatgggggcaagagacatagtgagtgat

SEQ ID NO: 26129 - DNA, 101 bp, rice(Oryza sativa)
  misc_feature (71): n=t or g
cagtattactcggctcgctcggtctaccaggcttcttcctaggccatccagcactcctttcacttgcactngtctgctttggcaggctaaaggacctgcta

SEQ ID NO: 26130 - DNA, 101 bp, rice(Oryza sativa)
  misc_feature (71): n=t or c
ttgggatcaaactttgctttgcctctcccacccacccaaaaagcaatgggcaggtagagtgaacaaacgcngaaatcttgaaggtcctcaagataagatag

SEQ ID NO: 26131 - DNA, 101 bp, rice(Oryza sativa)
  misc_feature (71): n=t or c
agagaactcgatcttctgttcgaaccacttcatctcaggaggaactccttgtgatgtagaacagattccgngctctaccttcttgtattccctctttgagg

SEQ ID NO: 26132 - DNA, 101 bp, rice(Oryza sativa)
  misc_feature (71): n=t or c
gcagccgattccggcaggtgcagatgctactactgatctggaacagtgatctccaaacgaaaagacgcttnttttttcttttcatccatatgggcaggtca

SEQ ID NO: 26133 - DNA, 101 bp, rice(Oryza sativa)
  misc_feature (71): n=t or c
gatgaaatggtggacactggagtgcaaacacctcatgcccctgctccaattcatacagttcccctacaagnagtggcaccacctggtggtttccctactac

SEQ ID NO: 26134 - DNA, 101 bp, rice(Oryza sativa)
  misc_feature (71): n=t or g
tatgtttcataccatttgtagttagtaatgtatttgtatgctggtgcctgcccctgatttgttttcctttnttctgttacagatggatgccaccactccca

SEQ ID NO: 26135 - DNA, 101 bp, rice(Oryza sativa)
  misc_feature (71): n=a or g
ggtcagttcactcgaatccactgacttcatgcacggggactcgaccatcaatcctttcttgtgacgagctntaaaatctttccataactcttcgcgggatt

SEQ ID NO: 26136 - DNA, 101 bp, rice(Oryza sativa)
  misc_feature (71): n=a or g
cggcgcaacacgacgtgcacgctcgatattttttgctaattaatgttacagttcatacatgcggacaacantatattatatacatacatatatagtataat

SEQ ID NO: 26137 - DNA, 101 bp, rice(Oryza sativa)
  misc_feature (71): n=a or g
agcaaggttccctacatagagcttgttggatgaatcaaagttgctcccaccacccctaggtgatcttggcncgaaatcatcccgaggcggaggcggccctg

SEQ ID NO: 26138 - DNA, 101 bp, rice(Oryza sativa)
  misc_feature (71): n=t or c
gtagtcctcaaaagtatggcctcttacattgaaagggaggtcccaagtaaaacactgaaactgtggcgctnacagtcacccaggcacttctatggaggtga

SEQ ID NO: 26139 - DNA, 101 bp, rice(Oryza sativa)
  misc_feature (71): n=t or c
tccctgtaacttgcaccagccacagcaagaacaacggacctgttcttgtcagcaacaagttcaaggagcanttctaaagaatgtggcaaattaactgctga

SEQ ID NO: 26140 - DNA, 101 bp, rice(Oryza sativa)
  misc_feature (71): n=a or g
ctcttgccagagttttgccgctgcttctatgcttgaaatgagctggttttggatatttcctttcgcgaacncgtgaaaagattgcacgtcaaaatattaga

SEQ ID NO: 26141 - DNA, 101 bp, rice(Oryza sativa)
  misc_feature (71): n=t or c
atccataaagagtgggtgcgtgcagcatttgctcaacagcacactctgctgctattaattaaattatactncctctgttttttaatagatgatgctgttaa

SEQ ID NO: 26142 - DNA, 101 bp, rice(Oryza sativa)
  misc_feature (71): n=t or c
ttgctacatggtccaaaaaggtggcaatagacataggctagagatgttaaccttgccaactaccccggaancagacagccaatccaccggtagtccgtact

SEQ ID NO: 26143 - DNA, 101 bp, rice(Oryza sativa)
  misc_feature (71): n=t or c
acattcatcaccccgcacatcatatcaaagccaaagagaaaccaaagagctggggagatcgagatacacanaaagagcgatgtcatgccgtacgaacccca

SEQ ID NO: 26144 - DNA, 101 bp, rice(Oryza sativa)
  misc_feature (71): n=a or g
ttgtggcatccagctgctaattaaacgcagttggaacggcagtagtcgccgcagcggggcaggcacctgtngaagtaggcctgcatgcagccctggcacga

SEQ ID NO: 26145 - DNA, 101 bp, rice(Oryza sativa)
  misc_feature (71): n=a or g
atccatcaaaactgcacaagctatcgcaagtacgctgaaaaataagttttctatggtaagagtggccaatnatcaattggggcgcaccgcatcaatttgat

SEQ ID NO: 26146 - DNA, 101 bp, rice(Oryza sativa)
  misc_feature (71): n=t or c
tgagagtgctaaaacccatgcagcttcaaatgaccatcgaagaaactggggcaaatgagctgtagaatgangtaatttgcgaaggctcatatttgatgtca

SEQ ID NO: 26147 - DNA, 101 bp, rice(Oryza sativa)
  misc_feature (71): n=t or g
aatccagtactcctcaatcatatcgaatccagcggttagggcatacagtagatataaacagcggcctaatnggaggacatgggatatactgcaagatatac

SEQ ID NO: 26148 - DNA, 101 bp, rice(Oryza sativa)
  misc_feature (71): n=t or c
tgcgatgacctagcaagatgtccgacaagatggcatatgtgagagaacaattttgagtattccacttcggncacgattctctgcaggactccagatgacaa

SEQ ID NO: 26149 - DNA, 101 bp, rice(Oryza sativa)
  misc_feature (71): n=a or g
attctgtcctgaaatacaagatattttagatagatggaacatttcctacagtaatatgaatctgcacaggnagcttgtccagatacatattattaggaaat

SEQ ID NO: 26150 - DNA, 101 bp, rice(Oryza sativa)
  misc_feature (71): n=a or g
agttaacgatataatgtccacatatccaaccagacaaccagtatccaagcaaaaatgtatacagcaggcanacaaaagactaacctcaagagctttgcaga

SEQ ID NO: 26151 - DNA, 101 bp, rice(Oryza sativa)
  misc_feature (71): n=t or c
aaggacgagctgtgcttgcaagacgtagatgttggtggggtgtttgtcccatgttccagtgatcatcctancattcacctggccgatttgcctcctgagca

SEQ ID NO: 26152 - DNA, 101 bp, rice(Oryza sativa)
  misc_feature (71): n=t or c
aacaccctggctcacaggaaagcattcatcagaactgtcttcagaacacctagcattgccatgagtggtgnccaattcaaggcgctcaagtgacgttgtgt

SEQ ID NO: 26153 - DNA, 101 bp, rice(Oryza sativa)
  misc_feature (71): n=t or c
caggagctgcacaactacaggatccaaggtggcaaaggtaacaaaataagcgcaatcagcaacttgagtantcttcgtgaactagaggtgcttggtcttga

SEQ ID NO: 26154 - DNA, 101 bp, rice(Oryza sativa)
  misc_feature (71): n=a or g
tttttcatgtttgagtccatgtcgagtgcatggcctaagaaccatactatgtagaggtggaatccagttantttgccggcatgcctaatcatagttgggct

SEQ ID NO: 26155 - DNA, 101 bp, rice(Oryza sativa)
  misc_feature (71): n=t or c
gtcacaacccgcaagttccttcactgctggcaaagaacggatgtactgtgactacccctatgagcatctcntcgctgtcgatgggtacgtcgtctaccact

SEQ ID NO: 26156 - DNA, 101 bp, rice(Oryza sativa)
  misc_feature (71): n=t or c
gcagacaactcagccgatacagcaacagatggtccagctgatgccgactgggttgaggacgcctgataatnggctgacgcatcaaaatgtgactcaggttg

SEQ ID NO: 26157 - DNA, 101 bp, rice(Oryza sativa)
  misc_feature (71): n=t or c
tgattaaggccaaccactctagcttagcagtctcgctagtcgctaggcgacgcgagaatctgtgcttctgnagattttcttttcgccggaacactacaaga

SEQ ID NO: 26158 - DNA, 101 bp, rice(Oryza sativa)
  misc_feature (71): n=t or g
ccattgcagctccatcataagtacggcggtccaagcaatacacaggtctgtatcctatttctgccttcttnttctaggtggtaactggtagttccatcttg

SEQ ID NO: 26159 - DNA, 101 bp, rice(Oryza sativa)
  misc_feature (71): n=t or c
actatgctaactattgtcgatgcatgtaaaacatggttcaccacttaaagaacggtagtccaatagaaaanattatgtcattcagtcacaagatatcgtaa

SEQ ID NO: 26160 - DNA, 101 bp, rice(Oryza sativa)
  misc_feature (71): n=t or c
agaagaaaggccatgcattgcgcagacaactattgttagttttattatatgtttttgtggccggtgatggngaccagggtttcccttaccgctggttaccg

SEQ ID NO: 26161 - DNA, 101 bp, rice(Oryza sativa)
  misc_feature (71): n=a or g
cattttcaaaggtaagattaagatactttgcgaatagtacctttagcctctccctctgtattctctgggcntgatttatcactttcttcaagactcctacc

SEQ ID NO: 26162 - DNA, 101 bp, rice(Oryza sativa)
  misc_feature (71): n=t or g
atgttatgtctgcatctgccaggtgcatgatgaagtgatcttggaagggcctacagaatctgccgaggagnccaaggccatcgttgtggagtgcatgtcca

SEQ ID NO: 26163 - DNA, 101 bp, rice(Oryza sativa)
  misc_feature (71): n=a or g
aagcagaatacataactgggacaaattagttgaatagtatcagggaaatcttaggctgagtttgagaaagncgagatagagaagattgggaagatacgtaa

SEQ ID NO: 26164 - DNA, 101 bp, rice(Oryza sativa)
  misc_feature (71): n=a or c
ctcaccattcgcctactcttaagcaccaccaccacaaaacaaagcgcctccccttaatcctctcctatccnctcctctcaagctataaaaggagctcccaa

SEQ ID NO: 26165 - DNA, 101 bp, rice(Oryza sativa)
  misc_feature (71): n=t or g
accgtaaaaccggataggtataacccatcctctaactcacaaaatgactctctctcagcagtattagacgntggttttcgctgacgtggctcattgacctg

SEQ ID NO: 26166 - DNA, 101 bp, rice(Oryza sativa)
  misc_feature (71): n=t or c
caacgatggctcgcttggaatgggaggtattaggacgtacaaatgtacagcgagagatgaactaacggggntagcatggtgtcctgaaactgcaagtcaaa

SEQ ID NO: 26167 - DNA, 101 bp, rice(Oryza sativa)
  misc_feature (71): n=t or c
tgtgaggagcttggcaatggagggggtagggttttaatggaggcaagaggaggatttggtgcagctttttngtggagcaactctcaggtgtagtggtagta

SEQ ID NO: 26168 - DNA, 101 bp, rice(Oryza sativa)
  misc_feature (71): n=t or g
tgatgttcctggggaggctcaaggagttcatcctgaaatgaggagaagcttgagtgctcacgtgccacaangaccagagcgtgcaagcttttttagagatt

SEQ ID NO: 26169 - DNA, 101 bp, rice(Oryza sativa)
  misc_feature (71): n=a or g
ctaaagcaacagttaaaggtaggtacgatttaatgagagaccaaagctttcccgaatagtgaattatgcanaagaacagaatctttgttaattaattaacc

SEQ ID NO: 26170 - DNA, 101 bp, rice(Oryza sativa)
  misc_feature (71): n=a or g
gcttccttggttgagcaccatagtcatggacttgtatcgccagataagctgcatttgataagatcaaatcntgaagttagtgagagggcaaaaactacact

SEQ ID NO: 26171 - DNA, 101 bp, rice(Oryza sativa)
  misc_feature (71): n=a or g
caccgctgctgatcaattcatcctggacatcctttgacatattagaggaaaaaagcaacacgatatatttncaaatataaaatagtttataaataaaactt

SEQ ID NO: 26172 - DNA, 101 bp, rice(Oryza sativa)
  misc_feature (71): n=a or g
tataatggtgcatggatgtttgcctgacatagctttgagaaatgtattgaacaaccatacaaaagtctctnttgtctcatcatgtaagaatgcacacccaa

SEQ ID NO: 26173 - DNA, 101 bp, rice(Oryza sativa)
  misc_feature (71): n=t or c
tcatataattcatgaagtatacgaatatttgtgtttgagaacagcttctctgcgttcagcttcttccaaangtttatgttgtacatccatatgttccaaag

SEQ ID NO: 26174 - DNA, 101 bp, rice(Oryza sativa)
  misc_feature (71): n=t or c
gggcaaaaacaacgaatagccattgcaagggccatcgtcaaggatcccaggatactactcctagatgaggngacgagcgcattagatgctgagtcagagcg

SEQ ID NO: 26175 - DNA, 101 bp, rice(Oryza sativa)
  misc_feature (71): n=a or g
tcatgtacgtaccagatataagtactattcatcaaaaaaaaggaaaaacatacatacccacatacgattgnaaaaagctattaatctttccctcctaatcc

SEQ ID NO: 26176 - DNA, 101 bp, rice(Oryza sativa)
  misc_feature (71): n=t or c
tgatgtgtaacttgtggcatgtccattaacttgtgtggagttccgttccgtaattgaacagcgtgaagaanatcaggatatgccacccgcaagagcctagc

SEQ ID NO: 26177 - DNA, 101 bp, rice(Oryza sativa)
  misc_feature (71): n=t or c
gatcacgttcttctccaaataagactcggagaaatgaaacatgacatgggcttaaggagaccttatcactnccaagtaggactctgacaccatctattacg

SEQ ID NO: 26178 - DNA, 101 bp, rice(Oryza sativa)
  misc_feature (71): n=t or c
acgacacgacacgacggggtcccggtccaaaccaaaccaagccaaactatataaagggtctgttcagatcncaccttaaaattttacaccctatcacatat

SEQ ID NO: 26179 - DNA, 101 bp, rice(Oryza sativa)
  misc_feature (71): n=t or c
gtagtctgcccttcatgtacaatacccatttactgttcaaacaggtgccaggagaaggctataggacaaangtcttgtaatcaaaatactcatctagaatc

SEQ ID NO: 26180 - DNA, 101 bp, rice(Oryza sativa)
  misc_feature (71): n=a or c
ggacagagggaatatttatttgagtaaaacatgcagccctgttactttaaaaacgaatactccctccgtcnaaaaaaaaaagacaaactctaggtttccgt

SEQ ID NO: 26181 - DNA, 101 bp, rice(Oryza sativa)
  misc_feature (71): n=a or g
atataaggatagatccaacggctgctgcggttactgccattgccaatgcgaagttaccgtaactcgactanttagttatgtttcttttttataaaatatgc

SEQ ID NO: 26182 - DNA, 101 bp, rice(Oryza sativa)
  misc_feature (71): n=a or c
ctaggtttatgatgttgacaggagatcagccacgcggttactcttccttttgttgcaaaaaaaaaaaaaancctaatctccttgcttgtagccaggtaaca

SEQ ID NO: 26183 - DNA, 101 bp, rice(Oryza sativa)
  misc_feature (71): n=t or c
ggtcttgatgcgggaacattactcctttggcgtcttccgacccgaacgagattttctggtttagatattgnggggccccttcgcccgccgaagtgatgttg

SEQ ID NO: 26184 - DNA, 101 bp, rice(Oryza sativa)
  misc_feature (71): n=a or g
gtttagctgctgctgctgctgctctttggcttcattggcctctgcagattcagctggcactacaagatcanacacagcaccttcaccactaggaggctcct

SEQ ID NO: 26185 - DNA, 101 bp, rice(Oryza sativa)
  misc_feature (71): n=t or c
ctaagttatttcaaagcggtatagcccggaaaataaggagttgacaaaagcgacgtagccatcaattgaanatttggcttgattgtcttgccgcgtggatg

SEQ ID NO: 26186 - DNA, 101 bp, rice(Oryza sativa)
  misc_feature (71): n=t or c
cagcaattacgactacttcacaatttaacgattccctgtttttcagatattgaagcgggggtaagaccgantcttaatctcaaggttagccatctgtctgc

SEQ ID NO: 26187 - DNA, 101 bp, rice(Oryza sativa)
  misc_feature (71): n=a or g
ttgccattgtcctgaagggcgtattctcaaatgccattctctagaataactttgactttttgctatcgganaaagaagatttcttgttcgtgagccatttt

SEQ ID NO: 26188 - DNA, 101 bp, rice(Oryza sativa)
  misc_feature (71): n=a or g
ggaaagcccgaactctgctttaattgtaacaagcccggacaaatggctgataagtgcccgaagcccaggcntgccggacccaagttcgttcaggcccgtgt

SEQ ID NO: 26189 - DNA, 101 bp, rice(Oryza sativa)
  misc_feature (71): n=t or c
tgtaggtacaagctcaatcaaatcagactttcctgtaggtatggactcaatggaatcaggctttggggtantgacagtaacttcacccagtaagctaccat

SEQ ID NO: 26190 - DNA, 101 bp, rice(Oryza sativa)
  misc_feature (71): n=a or c
cacctaccgatcgaaaataaacggatcagatctcatcctcatcatttggttagttggctgactccacacgnctcgccgtctcagtgtcgacagtgtcccct

SEQ ID NO: 26191 - DNA, 101 bp, rice(Oryza sativa)
  misc_feature (71): n=a or c
tatgtgtctggcaaccacctacactagcctctggtatgtctcacacattcattgcttacgactagcttcantttcgtcgccgcctctcgtggtggcaagga

SEQ ID NO: 26192 - DNA, 101 bp, rice(Oryza sativa)
  misc_feature (71): n=t or g
acgtccaaacgaacacagccttggtgttgtaggacgagccgagtatgatgttgcttggcttgatgtcgccntggacgacgcactgctcccactcttgctga

SEQ ID NO: 26193 - DNA, 101 bp, rice(Oryza sativa)
  misc_feature (71): n=t or c
tgctgggaaaaggaatcgagtggaatggggctatggactagcaaagtatgagaaagagaagaagcagatgnccaacagcttaccttcagatggggacaata

SEQ ID NO: 26194 - DNA, 101 bp, rice(Oryza sativa)
  misc_feature (71): n=t or c
cgtggtgccatattccttgtacagttccaggcacatatctgcaatttggctttcttcaattcgcagatggngacgcatgtaatctggcagtcaaaattacc

SEQ ID NO: 26195 - DNA, 101 bp, rice(Oryza sativa)
  misc_feature (71): n=a or g
tcctttcctgactgcattcaacacaaggctgtgctcaggggaaccatcatcttcgaatgatctcctggaanagaatgactcccttatgcttaggtccttgg

SEQ ID NO: 26196 - DNA, 101 bp, rice(Oryza sativa)
  misc_feature (71): n=a or c
ggctagctgataagttaactggacagattctccctagtgtcatgaaagccatatatgctaagagcaagaanctagggtacaagctgtactctgctcacagc

SEQ ID NO: 26197 - DNA, 101 bp, rice(Oryza sativa)
  misc_feature (71): n=t or c
cgatggctgcgccccttggctcgtgacaatagattttaattcctatgcggtttcgaagagccaccgttctnggtatattcattttctttcgtcccgttttg

SEQ ID NO: 26198 - DNA, 101 bp, rice(Oryza sativa)
  misc_feature (71): n=a or c
ggccattctcctcagcaagtccaacatgtgcatcttgaagtgatgtaagctccaaaagctccatcacattntcaacaaacatctacatcaaaagttgccat

SEQ ID NO: 26199 - DNA, 101 bp, rice(Oryza sativa)
  misc_feature (71): n=t or c
cgccgccgttagaacccactgtcatcgcagctaacaactggcaaattacagtagtcatcgtagccctcgtngtggttgaggtcgtcattgtctatgcatgg

SEQ ID NO: 26200 - DNA, 101 bp, rice(Oryza sativa)
  misc_feature (71): n=a or g
tttattttctcatcagtcacggtattaacgtttcaatatttctgagtagctgatttgttcattcatctttntcagatttttgtaactaatcttctttaaat

SEQ ID NO: 26201 - DNA, 101 bp, rice(Oryza sativa)
  misc_feature (71): n=t or g
agcctgaacattcttaggatctgtagagacgcccgccccactgataacatgtcctaaataagtaagacttngctgggcaaatgtgcatttggagtgtttaa

SEQ ID NO: 26202 - DNA, 101 bp, rice(Oryza sativa)
  misc_feature (71): n=a or g
cagcacaacagactcgatggtaagactattctatgtccaactcactttccctctccctcatcgagtcatcntcgcgtcggtttaattttgcttccttgaga

SEQ ID NO: 26203 - DNA, 101 bp, rice(Oryza sativa)
  misc_feature (71): n=a or g
gggaacaagcatacaaagaatcaaggcatgcagctcaggaaaatagcatgcaggtgtgtatcctagaggtntgtaatgtgcaagcccaaaatagttacttt

SEQ ID NO: 26204 - DNA, 101 bp, rice(Oryza sativa)
  misc_feature (71): n=t or c
gattcgcaggcttagagatgatctggagaaggagagagaagaaaggcagaaacaaagcggttgcatcattntttaactcgtccgatcttctgttgggagag

SEQ ID NO: 26205 - DNA, 101 bp, rice(Oryza sativa)
  misc_feature (71): n=a or c
cagataatgcagaaatctaacatatatcctaaatctaagtgcacaacctaaataatctagctgcttttgangactccgacatacggcaattcaacatttcc

SEQ ID NO: 26206 - DNA, 101 bp, rice(Oryza sativa)
  misc_feature (71): n=t or c
tcggaacctcggtaaaacccgtgtatctctgtagtggcatacacccaacttcaatcgaagcatgcattgtnccccctccccttcccttccattcaacccaa

SEQ ID NO: 26207 - DNA, 101 bp, rice(Oryza sativa)
  misc_feature (71): n=t or c
aaacctttcgcgaaaatagacccaaaactcggcacaaaattcctagctttgttatccaggttaaatgtctnaggcgaaaagacctgtagcctagtggttac

SEQ ID NO: 26208 - DNA, 101 bp, rice(Oryza sativa)
  misc_feature (71): n=t or c
cgtgtgctcaaaatctatttttcttggaagcatttctcttattggagtgttccggaaattttcggatgttncgaaaatacacagaaccatgtttgagtgtt

SEQ ID NO: 26209 - DNA, 101 bp, rice(Oryza sativa)
  misc_feature (71): n=a or g
agcttcgtttcgtacgatgctgtcaaccgacgatttcgtccatgccggaataatcacggccgccgtgttcnccgtgttgctggtagcgttgagcacgtacg

SEQ ID NO: 26210 - DNA, 101 bp, rice(Oryza sativa)
  misc_feature (71): n=a or g
caaagctcatgtctttttttcttctttttttttcacgtaggaggacgtggttaaggaggcaaaatacctgngagagaccaacgagaggctgacgcggcaga

SEQ ID NO: 26211 - DNA, 101 bp, rice(Oryza sativa)
  misc_feature (71): n=a or g
aggagctgaagaaagctttgtcaaaccactgcaacttaaggtgaaggattaccctttacttggagtccatntctcggaatgccagatctatgacctagaga

SEQ ID NO: 26212 - DNA, 101 bp, rice(Oryza sativa)
  misc_feature (71): n=a or c
cttaatttagatcaatcgaccacactctgcctctctagcttatacacatacaagtactctccatcgccccnaaatttaatttcctaccgttacttattata

SEQ ID NO: 26213 - DNA, 101 bp, rice(Oryza sativa)
  misc_feature (71): n=a or c
ctgatgcggatcatgttcccagcttttgcagcatcactgatgtacgacctcagaacaggcaataaaggatntttttccaccaaattaagagcttgaatgaa

SEQ ID NO: 26214 - DNA, 101 bp, rice(Oryza sativa)
  misc_feature (71): n=t or c
tcgtgaagaagtcttggcggaacatctgcatcctccatcaaaacatcaatggatgaacgagcactcgactngtcttggtgacgacttaattgggtgctcga

SEQ ID NO: 26215 - DNA, 101 bp, rice(Oryza sativa)
  misc_feature (71): n=t or c
gttacaccaattaaaagtgcagcccacactctatggattgaaggtgctagctagatctctgtactctatcngtcccaaaatataagcatttttagttataa

SEQ ID NO: 26216 - DNA, 101 bp, rice(Oryza sativa)
  misc_feature (71): n=t or c
cagcacacacgtaccacgccaagcagagaacacacaatcgtagcccggcttgcttattttacagttgctgntgtcgtcgaagcagtcaaagaggtcggtgg

SEQ ID NO: 26217 - DNA, 101 bp, rice(Oryza sativa)
  misc_feature (71): n=a or g
gtcgatgagtactttgatcttgtcgggtacaattcgtactacgacaaccgcatcgaaaacaaccaagatcngcagtatgggatgcatgaacagcaagagca

SEQ ID NO: 26218 - DNA, 101 bp, rice(Oryza sativa)
  misc_feature (71): n=t or g
tcatcagcaacataatcttagatatcgtttgatgacatttgatatttccttcattttagattgcttcaganggcctcaagcaccgtgtgtttgaggtctcc

SEQ ID NO: 26219 - DNA, 101 bp, rice(Oryza sativa)
  misc_feature (71): n=t or g
atgtgatcaacacggcacggatgaagattttgcgtgttgctgaatgtactttaggttcagcttacacgttncttaagtgcagtcaccttatcataatgatc

SEQ ID NO: 26220 - DNA, 101 bp, rice(Oryza sativa)
  misc_feature (71): n=t or g
acagagaatatatagaagagtggcaagacaaagaaaaactctacatgcatattccagtgatttctgaatantcactgttatatgttctcgctttgttcacc

SEQ ID NO: 26221 - DNA, 101 bp, rice(Oryza sativa)
  misc_feature (71): n=a or g
atcggtgctgtcatcagtgccttctccggtcactgatcatcagtgctctcccagacaccgatttttatggnacttccagaaaaagaagtcaaagatagcac

SEQ ID NO: 26222 - DNA, 101 bp, rice(Oryza sativa)
  misc_feature (71): n=a or g
tagcaactttggaccaaatgtcccgtccaaattcgtatgtactataaaatatcacatttggtattagattnttatattataggacgaaagaagtatgaccc

SEQ ID NO: 26223 - DNA, 101 bp, rice(Oryza sativa)
  misc_feature (71): n=a or g
aaaaaaagtttgaaactattttaggaggaagttatcctataaatgactttttgcttcattaacataagcanatctttcttggtatctatgcttctaggttc

SEQ ID NO: 26224 - DNA, 101 bp, rice(Oryza sativa)
  misc_feature (71): n=t or c
cagaaggtcaatctcattgacgtcctggttaacactcaaccagatcttctctttaaagtggttctccaacncgctgtcattgaaaaccatggtagcaaggg

SEQ ID NO: 26225 - DNA, 101 bp, rice(Oryza sativa)
  misc_feature (71): n=a or c
tcggcctaataggttttgggcctagaattttacacattttttaagcgaaaactaggcttccgcttccctcngaaagaaagagtagcccatttggtaaagct

SEQ ID NO: 26226 - DNA, 101 bp, rice(Oryza sativa)
  misc_feature (71): n=t or c
aaccagttaatctgatgattgatatggtcttgcactgtaatttgtagtgacgcaaccagtaaattcagtcnatttcttgaatcattgatgctgtattgtta

SEQ ID NO: 26227 - DNA, 101 bp, rice(Oryza sativa)
  misc_feature (71): n=t or c
cttttgcagggtggtgaaaatacgatgaagaaagtttcattgactggagctgttctccatcctttccttgngtatgtctgaatgatctcagttccttgttt

SEQ ID NO: 26228 - DNA, 101 bp, rice(Oryza sativa)
  misc_feature (71): n=t or c
aagccattgctgcagggactcgacacgtaaaatttctgagattccggcggagtcgtggaagtaatagtagnattcgcgagcaccactcgcgaatgcggcgg

SEQ ID NO: 26229 - DNA, 101 bp, rice(Oryza sativa)
  misc_feature (71): n=a or g
gtgagattgaatgtgaagattcctggagtaggctgaatatctttaaagatagaagcacgattgctgaaagnggttctctgaacattcgtggtctcaaacag

SEQ ID NO: 26230 - DNA, 101 bp, rice(Oryza sativa)
  misc_feature (71): n=t or c
atcccttcgaacatacaaaacagtgttcactgtcactggcattcaactagctagagaaacaataccacttncccttttagtttcatcagctatgaattgtc

SEQ ID NO: 26231 - DNA, 101 bp, rice(Oryza sativa)
  misc_feature (71): n=a or g
attggggaaaaaacagtattaagacaaccagaagtacgttggaaataataactcacctcaagagcagtagnatcattaggtgatgtccgcagtgttgcttc

SEQ ID NO: 26232 - DNA, 101 bp, rice(Oryza sativa)
  misc_feature (71): n=t or c
accaggccatccgcacgctcttgagaaattaccgaaaattaatctattgcctccgtgacaccgattctgangcaacgcggagggagtgaaacgcaaccgtc

SEQ ID NO: 26233 - DNA, 101 bp, rice(Oryza sativa)
  misc_feature (71): n=a or g
atctcaacttcaggttgagttgcctcttctggggctttctcaacttcaggttgagcttcttcaactggagntctccccatcttcctaggatggggggtaag

SEQ ID NO: 26234 - DNA, 101 bp, rice(Oryza sativa)
  misc_feature (71): n=t or c
ccctgcaagttctccttcattcagtggtgtactcttcttgttgaacatgcccttcagttggttgtaggcanctgtgaataagtttcgcctgctgcccgcca

SEQ ID NO: 26235 - DNA, 101 bp, rice(Oryza sativa)
  misc_feature (71): n=t or g
acgtagtagaaaaggcctgtaaaacaaaaagaaatgcaagagatgtttttatctccgttccaaaatataanaacctagaatcggattacaaagaatctgca

SEQ ID NO: 26236 - DNA, 101 bp, rice(Oryza sativa)
  misc_feature (71): n=a or g
gagatggaagttgtgattaacgaaagcaaaccacttgcacgaggctctgattgaaaatctgatctgtattnggcggtgcagtgacatgcatacgctactaa

SEQ ID NO: 26237 - DNA, 101 bp, rice(Oryza sativa)
  misc_feature (71): n=a or g
ccctctccctctctctccctctccttagagcctgcaaggagaatagctagctgtagggtcggcggtggctnagtgaggaggaggaggtccggcggcggcgg

SEQ ID NO: 26238 - DNA, 101 bp, rice(Oryza sativa)
  misc_feature (71): n=t or c
aaattcagaacctgaattatgcgccaatggacgtagcatagttctctatggaaatcacctccccctgtggnccgatggttggcagcttgccatcctcaaca

SEQ ID NO: 26239 - DNA, 101 bp, rice(Oryza sativa)
  misc_feature (71): n=t or c
gtctcggatcttatggttccacatcagcaaatttggaatgaagagctagttcgtcgaatcttctatccccnggatgctgaggaaattttgaggatccaatt

SEQ ID NO: 26240 - DNA, 101 bp, rice(Oryza sativa)
  misc_feature (71): n=t or g
gaatttgtacaagtgtggcaggtcctgtacaatgctgaaatagaacttcatgaaggagaagaggacacgantcaatggataggaactgctagcggatcata

SEQ ID NO: 26241 - DNA, 101 bp, rice(Oryza sativa)
  misc_feature (71): n=a or c
ttttatttttctttgctctccaaacagccttgctgtggaaaaaaggggtatttctatcaccttccttcagncatgagatgcgagaccgttgtaaccacatc

SEQ ID NO: 26242 - DNA, 101 bp, rice(Oryza sativa)
  misc_feature (71): n=t or g
acaagaaagaaccgtgtcaaattaatccaaagcagaggacggttttgttccaagggagagaggatgatatncccaagaagcttaatgttttatctgttgat

SEQ ID NO: 26243 - DNA, 101 bp, rice(Oryza sativa)
  misc_feature (71): n=t or c
agcacctccaaacagatcatctggggtagacgtgcaaaggagaacaaggtcaacatcatcagcatttactngagccatctcaagagctttttttgctgcct

SEQ ID NO: 26244 - DNA, 101 bp, rice(Oryza sativa)
  misc_feature (71): n=a or g
gcaggggatgatgaacggagcaggggttacgtacgctacggatttaaggttggattcagtaggtacacttngcacgttctttagagctgtttcattccgat

SEQ ID NO: 26245 - DNA, 101 bp, rice(Oryza sativa)
  misc_feature (71): n=t or c
cggagctatcatgctcctcgccggagtgtgtgcaggtatatcgtgaaatgcaacctccacagtcgatactngtaagtaccatgtccgatactggtatcttt

SEQ ID NO: 26246 - DNA, 101 bp, rice(Oryza sativa)
  misc_feature (71): n=t or g
accatgggacgcacccacggtacgcatcccagccttcccaaaagaaaaccgagatctgcacgaatgttgcntatcaaccaccacgggagatcgggaggcat

SEQ ID NO: 26247 - DNA, 101 bp, rice(Oryza sativa)
  misc_feature (71): n=a or g
tctattttgcagaacaaggctatgcaggacccagaaatccagaacattctgaaggatcctatcatgcagcnggtaaacataattagatgacctgttgaatt

SEQ ID NO: 26248 - DNA, 101 bp, rice(Oryza sativa)
  misc_feature (71): n=t or c
gtctgatgtgcaacaggtgagtgcaagtatttgctcgctcattaaagtgcagagttcaatatgtgaaatgntaagatttatcgacaacaattatatgatca

SEQ ID NO: 26249 - DNA, 101 bp, rice(Oryza sativa)
  misc_feature (71): n=t or c
acggagggatctacgcctcttgatctgatctcattgcgctgtacaatcacaacctcttcgctgcttactgnaacctcttcagatgccaacttgctgggctc

SEQ ID NO: 26250 - DNA, 101 bp, rice(Oryza sativa)
  misc_feature (71): n=a or c
tgaagttgagtggctgaaaggtagaaagagaagagaatcacgaattaccggaattagtgtgagtgaagcgntcatacgactgcttgggaaaaacagcatga

SEQ ID NO: 26251 - DNA, 101 bp, rice(Oryza sativa)
  misc_feature (71): n=t or c
agcacacacagtcaacatactgagaatgcttaagtcaccgaatttgcagcctatctatctccagagtaaangaaattgcatcgtccacatgatgggttgct

SEQ ID NO: 26252 - DNA, 101 bp, rice(Oryza sativa)
  misc_feature (71): n=t or c
caacgagaaaaatgaaaagcgaaacaacaaaaggactcaaacgcccgtgtagtagccgacatgtctaatgntttggaacaagttcactttgagtctcttaa

SEQ ID NO: 26253 - DNA, 101 bp, rice(Oryza sativa)
  misc_feature (71): n=t or c
gatgaaggcatatggctgtggaaagtggaggttccttctctgactgccattagatctttgagtactggtanggtcctaggttgtcaagttgaaaaacatat

SEQ ID NO: 26254 - DNA, 101 bp, rice(Oryza sativa)
  misc_feature (71): n=t or g
actacatacatgcgatcccaatctacaaagttattctcttccataattttacgagcaattttacggttctngaggaggtaccactttttctattgtaaatt

SEQ ID NO: 26255 - DNA, 101 bp, rice(Oryza sativa)
  misc_feature (71): n=t or c
ctgaactatggcatatgacaattcacctggaaaccatatctcatgctgacatgaccggatgccatgttaancaaaatcttgggaatgaaatatggactgag

SEQ ID NO: 26256 - DNA, 101 bp, rice(Oryza sativa)
  misc_feature (71): n=t or c
tgagtttgaccaccaagaaataggcccccacataaatgctaagaaataatgaccatagtattcctctccangaatagacatagacatactcaaggtaactc

SEQ ID NO: 26257 - DNA, 101 bp, rice(Oryza sativa)
  misc_feature (71): n=a or g
ggatggaatggttaatagtgcacctactgcaaaatataaattttctgagttgttcccagtatccgcatccntttttgaagtttcccatattctatattgaa

SEQ ID NO: 26258 - DNA, 101 bp, rice(Oryza sativa)
  misc_feature (71): n=a or g
tcaggctcaagtaattgtaatatgatagaagaataccctgcctttctcagagacaatccatgttgtgttgntggtgtggattttatcactatggttggtag

SEQ ID NO: 26259 - DNA, 101 bp, rice(Oryza sativa)
  misc_feature (71): n=t or g
ataggttccccttgggggtttaattccaaggaaccgaacatagccttaagatatacatgtacttcccacangctagcatgtgctccaggctaaatctaaag

SEQ ID NO: 26260 - DNA, 101 bp, rice(Oryza sativa)
  misc_feature (71): n=a or g
tttatacttataatttggtccgcctttgtgctaaattatgttttcacaacaaaatgctagcttacatatanttcttatctcatgtatgattacaaattacc

SEQ ID NO: 26261 - DNA, 101 bp, rice(Oryza sativa)
  misc_feature (71): n=t or c
attacacttcttttccacactcaaatcacacatcatttattacaggttccctcatacatctcaagatccgntgcaggaagctatgataatgaagccgtagc

SEQ ID NO: 26262 - DNA, 101 bp, rice(Oryza sativa)
  misc_feature (71): n=t or c
atcactccattgcccaaataggagaaagcgagagatttagagatcagattagcaccggccgtttgatgaancctgagctccactcgagacactcgaggctg

SEQ ID NO: 26263 - DNA, 101 bp, rice(Oryza sativa)
  misc_feature (71): n=a or g
atattttgtgggtggtgtgtacatggtaagatgccatgtccagtctgtatggaggtgcttaaaggaagacngctgaagtttggtggaaagtactccttctt

SEQ ID NO: 26264 - DNA, 101 bp, rice(Oryza sativa)
  misc_feature (71): n=t or c
ttgacttgatcctttgctggcacttgcagatttttttgagcaccagatgggccatcttgttgaatttgcangccgagatgtttcgaacaaatacgtatccc

SEQ ID NO: 26265 - DNA, 101 bp, rice(Oryza sativa)
  misc_feature (71): n=t or c
gccaccccgccaagcctctcgcacctctccgtcgactgccctggtctggtggatctggatcccaatccctnagataagtttgtggcgcccacggtgatcag

SEQ ID NO: 26266 - DNA, 101 bp, rice(Oryza sativa)
  misc_feature (71): n=a or c
accggctcttcgtcaagcgcagcaagtgcaccttcggctccccctcggtgtcctacctcggccacgtcatntccgaggcgggcgtcgccatggatccggcc

SEQ ID NO: 26267 - DNA, 101 bp, rice(Oryza sativa)
  misc_feature (71): n=t or c
agaatgacttacattgtgaaacggatggagtatctctcaacggtaaaatcgagtatattgtatcctccaantgttaaaaccgtgcaacatgactcccatga

SEQ ID NO: 26268 - DNA, 101 bp, rice(Oryza sativa)
  misc_feature (71): n=t or c
tacatcttcactaataataatatggcgggaacgtttgttgacatcagaatcatgattctccaatgagctgngcagattgcccttcagaaatttagataggt

SEQ ID NO: 26269 - DNA, 101 bp, rice(Oryza sativa)
  misc_feature (71): n=a or g
tggctcttggttgccatctgcaccaaggtcttcaactgtaccatcttgaggaatgtcacctttgtcacctnagccagttgcagtacctttgtcaccttgag

SEQ ID NO: 26270 - DNA, 101 bp, rice(Oryza sativa)
  misc_feature (71): n=a or c
cgttgttcttgtgcttctctgctattctgtgcaggtcaaagatttggaggttgagttggaagctacgaagnaaaaagacaaagagattctacatcaggctg

SEQ ID NO: 26271 - DNA, 101 bp, rice(Oryza sativa)
  misc_feature (71): n=t or c
tgcactgcattctcttgatgatcaatccccggtttagtactagtattatatatagggctgcggctgtgttngccattgctggtccccaatgggaacagtac

SEQ ID NO: 26272 - DNA, 101 bp, rice(Oryza sativa)
  misc_feature (71): n=t or c
gattggactactaccaatgaagtcaaaaggcaatccatcaaacgaattcccattgaacttatcagcagtancactgtcgaaaggatctcccatgagctgat

SEQ ID NO: 26273 - DNA, 101 bp, rice(Oryza sativa)
  misc_feature (71): n=t or c
tgcaccgatgtcgatgcaaccttgaacagctccaagactgcactgggtgtcgtcaactttttcaggacaanggagtaatccttatgatggttaactgatgg

SEQ ID NO: 26274 - DNA, 101 bp, rice(Oryza sativa)
  misc_feature (71): n=a or c
gatccaacagcagagccaccgatgcttgtcatctccactgttttgtctgtcatggcttatgactacctgcntgagaagctgaacatctacttatctgatga

SEQ ID NO: 26275 - DNA, 101 bp, rice(Oryza sativa)
  misc_feature (71): n=t or c
gtatgaaatcagtctaattaagtactgatagttgcagaaatagcaattttcacacagaaggcacttctggnaatggtaacaaactatagtgctatgtaggt

SEQ ID NO: 26276 - DNA, 101 bp, rice(Oryza sativa)
  misc_feature (71): n=a or g
ctccaagaaatctgacctatttaacagcgcctcgaatgtcaaggcttctagttttccagcacatgtaactnccatcagcccagttgtacctagtggaaatg

SEQ ID NO: 26277 - DNA, 101 bp, rice(Oryza sativa)
  misc_feature (71): n=a or g
gcctcttttaaccatgcgacgatccaatatggcagaaggagataatgactgaacatctagctccaaagacntagggagggtagaaaaaactggtgcattat

SEQ ID NO: 26278 - DNA, 101 bp, rice(Oryza sativa)
  misc_feature (71): n=t or c
tgatgaatcgtgtgagttggtgacgaactagtttagtgcagtagtagtcccaatgatgttgaggtgaattntagtgtccgagtcgtacaggtcatagtcgg

SEQ ID NO: 26279 - DNA, 101 bp, rice(Oryza sativa)
  misc_feature (71): n=a or g
gtttgatctataggaggttggttagcagtgatagatgctttatcctttaacatgtaatcgtccataggagngccgaatttaatccttaaaaacccatcaaa

SEQ ID NO: 26280 - DNA, 101 bp, rice(Oryza sativa)
  misc_feature (71): n=t or c
atccatgaggtcatccatcacttgctcgttattagtagtaagtagtagtagttgttagctggagtggtagnggtacacgattagttcaacctataataaca

SEQ ID NO: 26281 - DNA, 101 bp, rice(Oryza sativa)
  misc_feature (71): n=t or g
attggttttttagtttttgcaacaattaggtgagcaaacagtataatgtcattttgcaataagccccccanttcgcaaatgtaaaccgcaaacagctccgg

SEQ ID NO: 26282 - DNA, 101 bp, rice(Oryza sativa)
  misc_feature (71): n=t or c
taatttggcttacatttttcctatattaaggaggccacctggctctcgcttcgcgaaatttggcgacacanactttttattgtttcccatactttattaac

SEQ ID NO: 26283 - DNA, 101 bp, rice(Oryza sativa)
  misc_feature (71): n=t or g
ggctgtttcggacgtgggtgatgttgggttggggctttgttctttgtgtttaggaaaaagtacaccgaagntccctcaacttgtcaccgagataaaaaaac

SEQ ID NO: 26284 - DNA, 101 bp, rice(Oryza sativa)
  misc_feature (71): n=a or g
ccaacccttgcctggcccagttctgtcatccttcgccgtgtggttaggtttgcgtgtctcctctcttatcntcccctgtttgtgattgaaacttggtagaa

SEQ ID NO: 26285 - DNA, 101 bp, rice(Oryza sativa)
  misc_feature (71): n=a or g
cctcaagtctatcgctcttgtattcaactgtaatggtgccgttgctgccgaggtggagtcttcggaggatnacgccagggctgcagcggtttcccacccca

SEQ ID NO: 26286 - DNA, 101 bp, rice(Oryza sativa)
  misc_feature (71): n=t or g
acgaaggttgtcggaaccgttcgcgtgactgtccaatagcgaacattcatatactagaccctcttggtgtntagtgtcaagtataaccagatctaacgctt

SEQ ID NO: 26287 - DNA, 101 bp, rice(Oryza sativa)
  misc_feature (71): n=t or g
cctcgtgtgcataactgcatactggttggagtaccaaccctttttttagttgttggttagagtatagattnatagttctggtttaaattaagcgttttaat

SEQ ID NO: 26288 - DNA, 101 bp, rice(Oryza sativa)
  misc_feature (71): n=a or g
gcggtagatcatgcaagattttctcctgttgatatttcccctttatctccaaccctaagttcctaaatgancatgaacacaacctcaaaatacatcctaaa

SEQ ID NO: 26289 - DNA, 101 bp, rice(Oryza sativa)
  misc_feature (71): n=t or c
tgttggtcaagaagttgtgaaggcatgttcaggaaaattccatcctctctaccaggtttgtgttatgactnatctgttgcttttatgataatccattgacc

SEQ ID NO: 26290 - DNA, 101 bp, rice(Oryza sativa)
  misc_feature (71): n=a or c
cttctctgcatcagtctagttacctttttcatggtctcgttctgcgacgacaaatctgcaacttttcttgncaattcatctcggatcgcctaagcacatcc

SEQ ID NO: 26291 - DNA, 101 bp, rice(Oryza sativa)
  misc_feature (71): n=t or c
tgaagcatctctctatccagagagatgttagaccagcactatacgaaagatttcatatgcctgaatggttncaaaaacatggcatcccccaaactgatcag

SEQ ID NO: 26292 - DNA, 101 bp, rice(Oryza sativa)
  misc_feature (71): n=t or c
ctaatttcatccccccagttaagcttcgctgccaaagcagtcttgttaaaagcatggataatcttagagtncctagcaggatcaaaaatatatgtagtcct

SEQ ID NO: 26293 - DNA, 101 bp, rice(Oryza sativa)
  misc_feature (71): n=t or g
gtgtacatgtatacatgcatatgagtaagtacacgtgtacatgtgagtacctacgtttatattatgtttcntttttcatgcattacccccttgaaaacgat

SEQ ID NO: 26294 - DNA, 101 bp, rice(Oryza sativa)
  misc_feature (71): n=a or g
aacatccatcaggctcgtcagaactactattgctgcatactgtccgggaaatacatatggtcaccacagancaactcgtcatcgacactgaattcgcacgt

SEQ ID NO: 26295 - DNA, 101 bp, rice(Oryza sativa)
  misc_feature (71): n=a or g
actgaccattggagtagtgcaagagcagagaaaggaagtgaaagcacacactcaccaaggatcaaaaccangcacaggagacgttcccatcgttacagaag

SEQ ID NO: 26296 - DNA, 101 bp, rice(Oryza sativa)
  misc_feature (71): n=t or c
ccagcagatactatttgctagtactacgtacaaagacctagtcaaataagccactagacgccacgtcagcnaaaaccgaagacgacgctgccaagagatct

SEQ ID NO: 26297 - DNA, 101 bp, rice(Oryza sativa)
  misc_feature (71): n=a or g
ttgtttttaccgtcatttgcagcgagcactatacaccagtacactcctcctaccctgaggataccacaatnattatctataggctttttacaagagatcca

SEQ ID NO: 26298 - DNA, 101 bp, rice(Oryza sativa)
  misc_feature (71): n=t or c
ctacctaaaactacaaaaattaccaattgaaatctgtttccgcctctcgctcctgcgagatcacgctcacngactcctgataaaaaaacaaggaatgacat

SEQ ID NO: 26299 - DNA, 101 bp, rice(Oryza sativa)
  misc_feature (71): n=t or c
agaccccctttagtttgccgatggaccgtaacttgtcacgtttgtaaaaatcgatcagcattttcgcatanggctccttaatagattagtatgcaaacatt

SEQ ID NO: 26300 - DNA, 101 bp, rice(Oryza sativa)
  misc_feature (71): n=a or g
cctccatctaaaagtgtaaggcatatttcttttgtctccaagatcaaggagtaattagatcatccaccatntgacaaaaccaaataaccatacacatgcat

SEQ ID NO: 26301 - DNA, 101 bp, rice(Oryza sativa)
  misc_feature (71): n=a or g
gccctggccctggtctggccaccagggctcagttttggtgcttttgtagctagcttggtcatgcaaagttnctttctcttcggaagatcccaatcggtcga

SEQ ID NO: 26302 - DNA, 101 bp, rice(Oryza sativa)
  misc_feature (71): n=a or g
cttttcccaatcgagggtgttcacaatcaagggcttctttggaacaaagggtgttttgaaatttttggagnaactcaatccaatgaaaatattttccgatc

SEQ ID NO: 26303 - DNA, 101 bp, rice(Oryza sativa)
  misc_feature (71): n=t or c
gacacatttgtgaaacataagtgccggttctaactaaaaccaataccagtagtattagtgctggtttttcnataaaaaccaatacctatacttatattata

SEQ ID NO: 26304 - DNA, 101 bp, rice(Oryza sativa)
  misc_feature (71): n=a or g
aactaagcaaagaacatcaaaacttgaactctccaactaactttttatattttgaagtatatatcttgggnaaaaaatcacatctgccatgtagtactata

SEQ ID NO: 26305 - DNA, 101 bp, rice(Oryza sativa)
  misc_feature (71): n=t or g
tccgagatgtttcctgataatgaattcccatacagattaagcgaacttagagatgcactggcacatcttgntatagatcctgataagttgttgtttgaaag

SEQ ID NO: 26306 - DNA, 101 bp, rice(Oryza sativa)
  misc_feature (71): n=a or g
taagtatgttattttagttacattgtttatggtggccttttaggacaccacttaactcaaccatttacatntctctacaatatttatgatggcatagcaag

SEQ ID NO: 26307 - DNA, 101 bp, rice(Oryza sativa)
  misc_feature (71): n=a or g
acgatttctatgttacttgcgtcacgggacacttgtgatcctgaaactctgcattcctatttgcaaacctnagtactatgttgagcaaggattataacaac

SEQ ID NO: 26308 - DNA, 101 bp, rice(Oryza sativa)
  misc_feature (71): n=a or c
agggaaaagaacaggaatacaataatgaagcatgcaacagcagatcaatgctgagccatttgcgtctggcnggacgacgaccggcatcctatgaaatcgta

SEQ ID NO: 26309 - DNA, 101 bp, rice(Oryza sativa)
  misc_feature (71): n=a or c
tcagctatcttgaggattccatcgttactgacaaggaggttggaactcttgatgtctcggtgcagaacacncttgttgtggcagtgttcaatcccagtcag

SEQ ID NO: 26310 - DNA, 101 bp, rice(Oryza sativa)
  misc_feature (71): n=t or g
cgagcctcatggttgctgttatggatcggcgaacgattgccacataccacggcagggcggaactagaacanaacgaaatagaggatggtgcttcttgctta

SEQ ID NO: 26311 - DNA, 101 bp, rice(Oryza sativa)
  misc_feature (71): n=t or c
attttccacataactttcaaggttatagagttctaataatccatatatgatatcactctcaaatattccanccatcttttcatcgtcttggggtaccccta

SEQ ID NO: 26312 - DNA, 101 bp, rice(Oryza sativa)
  misc_feature (71): n=t or c
gatatgcaacattggaagactatcaaggatgccttgcctgatgtcaattgtggtagcagattgatagttanaactcgtctaaacaacatagccaaaacatg

SEQ ID NO: 26313 - DNA, 101 bp, rice(Oryza sativa)
  misc_feature (71): n=t or c
aaaccaagctccttgtatattttcccagcaggcgcactagaaccaaaacggtcaacaccaatagctttacntttttctccgatatatttctcccatccaaa

SEQ ID NO: 26314 - DNA, 101 bp, rice(Oryza sativa)
  misc_feature (71): n=t or g
tggttggatcttgctacaggtgcattttgggcgtttcttgaagaagaatggctttggtggtggttcagagnccgaaatgctgccgatgcaaatgcagggaa

SEQ ID NO: 26315 - DNA, 101 bp, rice(Oryza sativa)
  misc_feature (71): n=a or g
ttgttggtcattaaaaaacatcctcgacgttacgttgtgctatatatatattggactggtcactgcaagtntgtgtatatatatatgtgcgcgcgcgcaca

SEQ ID NO: 26316 - DNA, 101 bp, rice(Oryza sativa)
  misc_feature (71): n=a or c
tgctagatctaccaaaattgtccatgttaatttcacggtgttcatgcacgagctagttagactcaccaagncattaagaacaattttcttacaaaaattct

SEQ ID NO: 26317 - DNA, 101 bp, rice(Oryza sativa)
  misc_feature (71): n=a or g
gcatatattgtgggctatttgaatttaattagtacaacgacacatggagttagcgtgtggcctcagctggnataaaagagaaggaaaaagtccacataacc

SEQ ID NO: 26318 - DNA, 101 bp, rice(Oryza sativa)
  misc_feature (71): n=a or c
atttggtgcatgttacaagaaaggaacttgagaacatgttgtgcaactgttgctgtcttgagtggttgagnatggtcagatgccatctgaaggatgacctt

SEQ ID NO: 26319 - DNA, 101 bp, rice(Oryza sativa)
  misc_feature (71): n=a or c
aaagaaagaaaaaaaaagaaaattcccctctgccctgaatcctgattctatctctcgagcgggctctcctnctcgtcggcgttcctccgcctccgccgtct

SEQ ID NO: 26320 - DNA, 101 bp, rice(Oryza sativa)
  misc_feature (71): n=t or c
atattacgcacatacaattacgctttcaacagggatttagtgacattagggatatgccactggtttccatntcttaaagcatatgttaggtgacatattca

SEQ ID NO: 26321 - DNA, 101 bp, rice(Oryza sativa)
  misc_feature (71): n=a or g
agggtattacgctccacagcggctcgaacctggataatctctcgtctccattttcattgccatccacctcncgagcctaacccccgtggagacccgtccaa

SEQ ID NO: 26322 - DNA, 101 bp, rice(Oryza sativa)
  misc_feature (71): n=a or c
gagtaaaaacaatgcaataaggattttctgttacaatgtactccctgtatcccacaaaaaaaatcaaatcntgggaaattttttttttttttggggggggg

SEQ ID NO: 26323 - DNA, 101 bp, rice(Oryza sativa)
  misc_feature (71): n=t or c
gcgctaacctgcatcccacccaattccagcatccatgtgatcccctgcttaattaccacccgaccaacatnacccacccccataattatttaattacttct

SEQ ID NO: 26324 - DNA, 101 bp, rice(Oryza sativa)
  misc_feature (71): n=a or c
ctacggatacttgaaaatcatgcgaaatggcaacaatccagccaatactttcgttgttatttcactcaagntttatcttgtccaatttcaaaaggcaaacc

SEQ ID NO: 26325 - DNA, 101 bp, rice(Oryza sativa)
  misc_feature (71): n=a or c
aaatgacatcaaagtgaataggcccaaaatgatggtttttatgagatggagtaagcctactccctccgttnaaaaaaaaaggcaaactgtgggttcccgtg

SEQ ID NO: 26326 - DNA, 101 bp, rice(Oryza sativa)
  misc_feature (71): n=t or c
ggacaggagttatatattacctgtttttcactccctcgatgaaatctggaatattctccacacttccaatntcatttaacattttaagtaccgcctggcat

SEQ ID NO: 26327 - DNA, 101 bp, rice(Oryza sativa)
  misc_feature (71): n=t or c
gaggagactactacaactgagaaaattgtagaggataaagaactagctgaggagacgacagaaggtgaaantacagctgaagtacaggttgcggagactac

SEQ ID NO: 26328 - DNA, 101 bp, rice(Oryza sativa)
  misc_feature (71): n=t or c
aattttaaaacttagttttagactcaattttgagagttttttttttcaccttccagtgctagctattaaanagcaaataatgcaaatataataaaaatttt

SEQ ID NO: 26329 - DNA, 101 bp, rice(Oryza sativa)
  misc_feature (71): n=a or g
aaggaggatggcaaatctcgcatatataaagtgaccaaatctgcaggaagtgagaagcctcatatggttgnattcaattcttttggaagttctgcaacatg

SEQ ID NO: 26330 - DNA, 101 bp, rice(Oryza sativa)
  misc_feature (71): n=t or c
gggcgtcctcgccggcgcggcggcgttcggaagggagaaggaggaagggttcttcaacatcaacgtgaagntccacatgagggtgcgtctcaaggtgatgg

SEQ ID NO: 26331 - DNA, 101 bp, rice(Oryza sativa)
  misc_feature (71): n=a or g
atacgggaacagcggaacagcagctggtgtttgaaatacttctaagtcatgtgcctactactgtagtagcnagtagtaacctctattaatctctcactact

SEQ ID NO: 26332 - DNA, 101 bp, rice(Oryza sativa)
  misc_feature (71): n=t or c
agggaaaggagaatcctgggacggtgaacacggcctgtcacaaagtctgtttcgcctcccttaactatagnccctggtgggttctcctcctcgagcggtat

SEQ ID NO: 26333 - DNA, 101 bp, rice(Oryza sativa)
  misc_feature (71): n=t or c
aactgatcttgtcagcaccaagttctgctctgtattttccaggtctcggttgaagtgaagggtaaatcgangtgcttcatgagatcctctcatagtatgct

SEQ ID NO: 26334 - DNA, 101 bp, rice(Oryza sativa)
  misc_feature (71): n=a or c
gccctaaatatagtgcaatcctaaatatgcaaagtttggtgatgactcaataagtatatttgggctaggcntttgtgggccaagcccaaagtttcttttaa

SEQ ID NO: 26335 - DNA, 101 bp, rice(Oryza sativa)
  misc_feature (71): n=a or c
ggaggggcgtcgaaggcatgcatgtagatggtgtcatcacgtagatgcagtagtacgaaaagcagatcatntcgaagaaagcacacaacataataccgctt

SEQ ID NO: 26336 - DNA, 101 bp, rice(Oryza sativa)
  misc_feature (71): n=t or c
ttagaaaaatggcctactaaagaagcacaagagtaccaaaaatggcctgctaaagaagcacaagttcactntaggtccctaaatttgtcactgagtctgaa

SEQ ID NO: 26337 - DNA, 101 bp, rice(Oryza sativa)
  misc_feature (71): n=t or c
attagccgataaaggaaaccaattcctgatgactcaccaagatgatgagtgaactggtcaatgcagtcctnggcatcataggcaatctccctcacctgctt

SEQ ID NO: 26338 - DNA, 101 bp, rice(Oryza sativa)
  misc_feature (71): n=a or g
caaccacactgcttcgagaatcatctactccttgagcaaaaccttgacagtgtgaactcttactccattcntattttattttgtcatgataaggtttaact

SEQ ID NO: 26339 - DNA, 101 bp, rice(Oryza sativa)
  misc_feature (71): n=t or c
aagccagcaccatctgattacttgcatcctctgaaatgcagagtctcagacctgaagatcgacgctcccanggagttaaagtacaaggactatgaattgct

SEQ ID NO: 26340 - DNA, 101 bp, rice(Oryza sativa)
  misc_feature (71): n=t or c
tgattcctaccaatccctttaaaattcctatggaataaagtattgtagaggaattttggagggaaattagnatgatgtcttatctcgggtctcatcttttc

SEQ ID NO: 26341 - DNA, 101 bp, rice(Oryza sativa)
  misc_feature (71): n=t or c
tgatagagatatctacataaagcttagtacgggtgcatgtcatttgtgacaaacctacgtgttagggaccnaatatctttttgcatgcttctaaaatagga

SEQ ID NO: 26342 - DNA, 101 bp, rice(Oryza sativa)
  misc_feature (71): n=t or c
cctgtaggccactcaagggttgaagtggaagacgtgccaagccaatacagaggttatgtgctacagtttcntccggaggaaggggttgacactctgggcgc

SEQ ID NO: 26343 - DNA, 101 bp, rice(Oryza sativa)
  misc_feature (71): n=t or c
gtgagtaagacggagggagtactattctattagtataaaaaaccgattgagacatcagtgatttcagcccnatcgttttgcttatttgaggaataagccaa

SEQ ID NO: 26344 - DNA, 101 bp, rice(Oryza sativa)
  misc_feature (71): n=a or g
cttgatgaagcacggatggtgttggaggacatgatgctgaagggaattgttccaaccattttgacataccntacatttctgagacaagaaaacattgatga

SEQ ID NO: 26345 - DNA, 101 bp, rice(Oryza sativa)
  misc_feature (71): n=t or g
caccttaggttgcatgaacttgaagaaaatggaaatctacagatcttctgccaacttgctttggctgatcngaatgaaagatcagaagattatgcggaact

SEQ ID NO: 26346 - DNA, 101 bp, rice(Oryza sativa)
  misc_feature (71): n=a or g
gaggtgaggaacggtcagttctcttggaacacatcttctgaggttcctactctccgaaatttgaacttccntattcgacaaggaatgagggttgctatctg

SEQ ID NO: 26347 - DNA, 101 bp, rice(Oryza sativa)
  misc_feature (71): n=t or g
cttgcccaccacaccagataggcgagcactaggatagatactcaattgctcaccactagctacctgcatanctagcccaacctcctctagctcttccattg

SEQ ID NO: 26348 - DNA, 101 bp, rice(Oryza sativa)
  misc_feature (71): n=a or g
agtgcgcacgagggtgttgatctctactgcaactttgttgaaacaaggccagttctaatggaagatatcgntgccagtgcctttgagcaggattccaagat

SEQ ID NO: 26349 - DNA, 101 bp, rice(Oryza sativa)
  misc_feature (71): n=t or g
aaacatcaacattttctcaagattaattaaccgagttcttggatcaactaatggcaggtgcacaagaatancaaggcgtgcgtggcgtcgtacccgagcgt

SEQ ID NO: 26350 - DNA, 101 bp, rice(Oryza sativa)
  misc_feature (71): n=a or c
ctcaccgcaacgggcacctcatagcaccatcagatcttcccacatatccgcccataagcagttcttcgttnggttacatatcacagaataaaaatcgttct

SEQ ID NO: 26351 - DNA, 101 bp, rice(Oryza sativa)
  misc_feature (71): n=a or g
ctgggaaaaggttcattcggtaaagtctacaaaggaatgctggatggtcgatgccctgttgctgtgaagcnatacatacatggaacccggaaagaggagtt

SEQ ID NO: 26352 - DNA, 101 bp, rice(Oryza sativa)
  misc_feature (71): n=t or c
ctcttctattcttatggaaaaaacatcaaagagctctccttgccctgtgaatagtggggcagaaaagaggnatctccctttgattctgctgacttaattta

SEQ ID NO: 26353 - DNA, 101 bp, rice(Oryza sativa)
  misc_feature (71): n=t or c
tcgcgactgatggtgggagctatgggagggggaaacgcaatagacgagtcaacaacgacagcggcaatgcntaagcatggcctgctctcggtttcctcaag

SEQ ID NO: 26354 - DNA, 101 bp, rice(Oryza sativa)
  misc_feature (71): n=t or c
ttgcacatagagttaaagtagtttcttccttgctcaaccattccagtatgactacaggcaaaaagaacacnaataaaactgatatagtcaggcctgggccc

SEQ ID NO: 26355 - DNA, 101 bp, rice(Oryza sativa)
  misc_feature (71): n=t or g
tcaacatcgtcaacccacacaacacaatacaactgtctcttctcaagcatagtattgactcgccgtccagnccagctggatttcgctcgtcgttatcttgc

SEQ ID NO: 26356 - DNA, 101 bp, rice(Oryza sativa)
  misc_feature (71): n=a or g
tactagcttatgatagttataccttcctagatagatgtttgcgccgagcaacagtgagtccatgacggtgntgatgatgagcgagagcgagttgaacatgg

SEQ ID NO: 26357 - DNA, 101 bp, rice(Oryza sativa)
  misc_feature (71): n=a or g
ttatcaaattttgttgtcaaagtcaactgcgttatgaccagaggaaagtacccgaatctcttaacatacanttggcattgtcttaattgtattggacttgt

SEQ ID NO: 26358 - DNA, 101 bp, rice(Oryza sativa)
  misc_feature (71): n=a or g
atgtgtcacatatagtagtactagataacaacatttcattttgagacaagtatagtagctgggatgggatnacctgatgacagtcttttacttgccttttc

SEQ ID NO: 26359 - DNA, 101 bp, rice(Oryza sativa)
  misc_feature (71): n=t or c
gccggtccgaagaggacggtgttcgggtgcgtaaattttatactccaccctgagcgctcatacgcctggcnggtgcctgcctcgatggtgaaatgggagcg

SEQ ID NO: 26360 - DNA, 101 bp, rice(Oryza sativa)
  misc_feature (71): n=t or c
ttgacgatgcggagctttccgccacggcagcgtaccacctccacgccagtgagcatagcgaaatttatttnacccctttctctgcgattaacactgaacat

SEQ ID NO: 26361 - DNA, 101 bp, rice(Oryza sativa)
  misc_feature (71): n=a or g
agcagattgcagcaatgttcaagccaactcaaccggttgttgaactaattcagcagataccaatcgggcancagacacctattattcaacagcatcagccg

SEQ ID NO: 26362 - DNA, 101 bp, rice(Oryza sativa)
  misc_feature (71): n=a or c
aataatggcctatctgagaatagatcgggtaactgtagagtccacagaataaatatcaggatggtgtcaangtcacaatctaagatgactataaatccatc

SEQ ID NO: 26363 - DNA, 101 bp, rice(Oryza sativa)
  misc_feature (71): n=a or c
ttcacgtctgcccttttcgctgctggacgactgtttgcagcggcatagaattcttcaactttgaacagtanggtagcaacaacagcattctgctcatgggc

SEQ ID NO: 26364 - DNA, 101 bp, rice(Oryza sativa)
  misc_feature (71): n=a or g
ttctctggttagtctttcctctaccgcaattttttctttacagagtgaattctcccgtgctctaaactgcnaaaaaaaaggtttgcaatttcgatataaag

SEQ ID NO: 26365 - DNA, 101 bp, rice(Oryza sativa)
  misc_feature (71): n=t or c
gatatccattacctgtatgggtatggtttggggagaattttgcacccgcggttagatgtgggtattagagngcgaacttttaatcataagtttgagtatga

SEQ ID NO: 26366 - DNA, 101 bp, rice(Oryza sativa)
  misc_feature (71): n=t or c
ttgaaaattgagggatcgtttggctgttaaccagctactactacttattccagctactgatgtgcagctcnaacctgtatagtcaagcatggccgagttta

SEQ ID NO: 26367 - DNA, 101 bp, rice(Oryza sativa)
  misc_feature (71): n=t or c
acgggacccggcacgtgccaaaccttccggtacggctcgtacaagtaggccaccaccaggagacccacagncatggccaccaaggtgaccgcccactccgc

SEQ ID NO: 26368 - DNA, 101 bp, rice(Oryza sativa)
  misc_feature (71): n=a or c
tgttcttctgcaattaatttaattaattactcggtcggctgcaacctgatccgatcctgtacagctccagntaatccatgatgatgtgcaaaccgagctca

SEQ ID NO: 26369 - DNA, 101 bp, rice(Oryza sativa)
  misc_feature (71): n=t or c
ttttggtgctctatagctaatttcttcactcaatgccttgtcctcagatgatcctcttatgtggcccaatncttcagcgtgatgtttcggcggtagttcag

SEQ ID NO: 26370 - DNA, 101 bp, rice(Oryza sativa)
  misc_feature (71): n=t or c
tagagatttattgatgagttcatggagcttgtggagctctttcccttaaaagatgcattggttggattgcntggcttgagtggattatcaactgaacaaag

SEQ ID NO: 26371 - DNA, 101 bp, rice(Oryza sativa)
  misc_feature (71): n=a or c
atttcattatccccatcacaagaacaaatgaggtcatccttgtttgggtggaaatccagtgacataacagntgctgagtgcccagtgaacgttcgaattga

SEQ ID NO: 26372 - DNA, 101 bp, rice(Oryza sativa)
  misc_feature (71): n=t or g
taacagcttgagtaacctatgtccatgatccacctcatcaactttgcagagtccctcaataatctgcttanatgggaatctatggatagagatccttaatt

SEQ ID NO: 26373 - DNA, 101 bp, rice(Oryza sativa)
  misc_feature (71): n=t or c
tccgtcaaagatgtctccactcgacggcggtggattgctcggcgtcttcaccaacagcactggcatgaatncgtccgccgccgccccgatcgtcgcggtgg

SEQ ID NO: 26374 - DNA, 101 bp, rice(Oryza sativa)
  misc_feature (71): n=a or g
cagttgtagtgatgctgaaaatgtgttgaacaagctgcaggtgtgtcaagctccttttgactcaacaattnctggtaacattcctgatctttcagaggaca

SEQ ID NO: 26375 - DNA, 101 bp, rice(Oryza sativa)
  misc_feature (71): n=a or g
ctaaaagtatataaatactcctatactgccacgtggtacgcctataaacactactaaaccaccacatcganttataataaatcggtaaaccatctattttc

SEQ ID NO: 26376 - DNA, 101 bp, rice(Oryza sativa)
  misc_feature (71): n=a or g
tgtgtggtcaggattagcaatttagtaggcatttagtactactttgatatctttctccgatagaagtttgnccatggttttgctttgtcacacctgaaatt

SEQ ID NO: 26377 - DNA, 101 bp, rice(Oryza sativa)
  misc_feature (71): n=a or g
atggattggttagccaagaataatggactgatcaattgtgcaacaagagaggttatccttactgatgaacnaggaatgaatacaaggataatagttaaatc

SEQ ID NO: 26378 - DNA, 101 bp, rice(Oryza sativa)
  misc_feature (71): n=a or g
ctgatctgatacaggatccttgtgatgatgcagaccttcgagagcatgactcataagctgttgcctttgcnattttatttatcggaacttttctcttgctg

SEQ ID NO: 26379 - DNA, 101 bp, rice(Oryza sativa)
  misc_feature (71): n=t or c
ttaaattctagaaggagcacttattttaggatggggagttaaaaaaaaagtaaaaatcctggttttgtatngacccgtaatcttttaaattgcgaatttag

SEQ ID NO: 26380 - DNA, 101 bp, rice(Oryza sativa)
  misc_feature (71): n=a or g
gctccccattggtggaggatctaatgaaacagttggtccacgaacccatccaccccaaaatgcatatgtanccttctcttgtagggtgtcaaagagcttac

SEQ ID NO: 26381 - DNA, 101 bp, rice(Oryza sativa)
  misc_feature (71): n=t or c
aactcaatgacgacgcaactgctagggacgagggtctcgaagacgatgttgtcctacttgccagtggtgtntgtgaccttgtcaaggcctacgatgtccat

SEQ ID NO: 26382 - DNA, 101 bp, rice(Oryza sativa)
  misc_feature (71): n=a or g
cataccttttgttctgagtagcttcaatgctctgtaattaagatgacccattctcttgtaccatagatcanaaatatcgacttcacttctgagagccattt

SEQ ID NO: 26383 - DNA, 101 bp, rice(Oryza sativa)
  misc_feature (71): n=t or c
ctgggtcctgtgatattctcccccgggttcccggaaatggccaatataaagatggtctaaattaggatggnaattaattagtactactaatatttctttat

SEQ ID NO: 26384 - DNA, 101 bp, rice(Oryza sativa)
  misc_feature (71): n=a or g
tactgtgtattttaaatgtattcggactttcggagagcatattttcttgagaaagaaatatgtaataagcncacaatttgaatgcatttgtatattattac

SEQ ID NO: 26385 - DNA, 101 bp, rice(Oryza sativa)
  misc_feature (71): n=t or c
taagcttggcttctgttccatttctactaggcgatgggccagcttcacctttttctctgtcaagttaccgngatattcttccttgggcaatatttcatcgt

SEQ ID NO: 26386 - DNA, 101 bp, rice(Oryza sativa)
  misc_feature (71): n=a or g
catatcgcagtgcacgaagcttcagcaagtagagcagccctttaaaagtgacctgctgactatggaggagnaggaggaacatcataaatttttcgaatttg

SEQ ID NO: 26387 - DNA, 101 bp, rice(Oryza sativa)
  misc_feature (71): n=t or c
acatgagcagcctggtatactaatcagcctagtgtctctctattctatacgggagcatattctatgcacanaagtttcccatgcacactccgtacacacca

SEQ ID NO: 26388 - DNA, 101 bp, rice(Oryza sativa)
  misc_feature (71): n=a or c
cacttatactcacaattccggatctttgcaaacgcttgccacctctgttgttgcctgctataaagcacatntctatactacaaccatccctagatatttta

SEQ ID NO: 26389 - DNA, 101 bp, rice(Oryza sativa)
  misc_feature (71): n=t or c
cagaggttgggcccggtgcactagaatcgtgaaaatgatgaagatgaaggtagaaaatcacaatagtgtcnttctggtattttcaccaaaaatcataagag

SEQ ID NO: 26390 - DNA, 101 bp, rice(Oryza sativa)
  misc_feature (71): n=a or g
tggccggcgcacctaaccgcgcgcaaagtagaaagacagtatgggttgcgaaagagcacgtaatctagtcnttgcagtgacctaggtagcatcatgaaata

SEQ ID NO: 26391 - DNA, 101 bp, rice(Oryza sativa)
  misc_feature (71): n=t or c
ccaccaccaaggccatccagatccggaaactctatcttactttggggctcttgctcggggatgatttgacngccatgtcttcgattcgccgtccacgaggc

SEQ ID NO: 26392 - DNA, 101 bp, rice(Oryza sativa)
  misc_feature (71): n=t or c
gtgcatcggagctcgtgcgcgggcaagccatctggatatgtcgtgactggaaagccagctctatacaaaanaggaagagtaaatttcaaatcatcttaaaa

SEQ ID NO: 26393 - DNA, 101 bp, rice(Oryza sativa)
  misc_feature (71): n=t or g
cgcactctactccttctaatgacatgggagatatggtaggagagaaaccagatagtgttttatcacaaaanctttcggcaattttcctcgcagggaaaatc

SEQ ID NO: 26394 - DNA, 101 bp, rice(Oryza sativa)
  misc_feature (71): n=t or c
ttagtggccacttcaccacccctccttttatttgtccgtgcgccaccaaaaaaatggattgggtgtaccgntgatggatctggagatccccatgccatgat

SEQ ID NO: 26395 - DNA, 101 bp, rice(Oryza sativa)
  misc_feature (71): n=a or g
ttttgagttggctttgatcgattgcttggtgtcatgctatttactacaacggttagctaaattcgtttatnacaccgattcatttctagttgatccattcg

SEQ ID NO: 26396 - DNA, 101 bp, rice(Oryza sativa)
  misc_feature (71): n=t or g
ctgatgatgggtttgtggcatgcaggcctctcaactgacccgtctgcgaaatatgtttattttcacaaacnattcttgaaccgtcaggatggttcttatct

SEQ ID NO: 26397 - DNA, 101 bp, rice(Oryza sativa)
  misc_feature (71): n=t or c
ccctcttctctcccttcctcatctctctctcccttctcttctgcggccagcaatgcctcggcggtgatggnggcgacaggcaacgcggcggcggtggagca

SEQ ID NO: 26398 - DNA, 101 bp, rice(Oryza sativa)
  misc_feature (71): n=a or g
ggctgggaccatggcggcggtggcgatgtactctctctgtttcataaaaaacaaacctaggatcagatatnacatattctaatataataaatctgaatata

SEQ ID NO: 26399 - DNA, 101 bp, rice(Oryza sativa)
  misc_feature (71): n=t or c
tttatcactacagtattcatccaagggttctccatttcttttggtatgagtaattacatagagttcagccngtccaacttttctgttctctttaagctcct

SEQ ID NO: 26400 - DNA, 101 bp, rice(Oryza sativa)
  misc_feature (71): n=a or g
tttctgcttcgccgaggcgcctgtgatctcatatttctgtgcgcactgctacaatcccagggttaaggttnagttcttcaccgagcccatcatagtggccg

SEQ ID NO: 26401 - DNA, 101 bp, rice(Oryza sativa)
  misc_feature (71): n=a or g
gctgccgcatttgatcgaacaccttgaacgccacttacgtctttgcgcgtgcagaagcagcggaaagtgcngtagagatccctcatgtgcgggtccgtcgg

SEQ ID NO: 26402 - DNA, 101 bp, rice(Oryza sativa)
  misc_feature (71): n=a or g
aataaaagaagatatcatccaatctcttaagcattctctcacagataaaaatagcacgtctgccaggcatnactatgaaattagttggtgtaaatgtacaa

SEQ ID NO: 26403 - DNA, 101 bp, rice(Oryza sativa)
  misc_feature (71): n=t or g
ggcgtcgccggggaggtggattccgttcatcaggttgtgtggcagatggtcttgaagaatcggctgctggngtggtggtaatggcagcggcggcggcggcg

SEQ ID NO: 26404 - DNA, 101 bp, rice(Oryza sativa)
  misc_feature (71): n=t or c
atcaaataaaccaaatatggcaaagcttgagctataaacctattatattatttcaataactcacctgatcntgtgaacgatgtcggtcgagagggcccaaa

SEQ ID NO: 26405 - DNA, 101 bp, rice(Oryza sativa)
  misc_feature (71): n=t or c
ggtgaaaacggcctattccctcctctgtgccgcgaagatgcggtcagtggtcggaaggcttgtttgacggnggacaacctccagtggtggggttggcatct

SEQ ID NO: 26406 - DNA, 101 bp, rice(Oryza sativa)
  misc_feature (71): n=t or c
gaggcatcatcagaagtaaccttctcagtcgcagcatcactctcctatacagcagcatccacagcagcctnaggatcagtcccctctgactcaacatttgg

SEQ ID NO: 26407 - DNA, 101 bp, rice(Oryza sativa)
  misc_feature (71): n=a or g
gattgttatcatttggtatcagagttgaccccttgttaagtgggtgggaatgtgttgatgcgaaaaacacnaggcctggaagatctgcttaacttcagtgc

SEQ ID NO: 26408 - DNA, 101 bp, rice(Oryza sativa)
  misc_feature (71): n=a or c
aattcggtgaccctcacttcgtcaccgatgcaagaaaacatccttttcctcgccaatgaatcatggcagangaagagcaccacatttccaaagtacttttt

SEQ ID NO: 26409 - DNA, 101 bp, rice(Oryza sativa)
  misc_feature (71): n=t or c
tagtacatttatgatgacataaggtaattctttagccattaatggaatatacattacttgtggcatatagngaacaattagcacaaatcagtcaatcttag

SEQ ID NO: 26410 - DNA, 101 bp, rice(Oryza sativa)
  misc_feature (71): n=t or g
tgggggttgtccgaagggcccagagaacagataacatttcctcgagccatttacccttcgctgccccctcnagccttttctttagtgcttctaggatcttg

SEQ ID NO: 26411 - DNA, 101 bp, rice(Oryza sativa)
  misc_feature (71): n=t or c
aatagaggccacaagccccagcggtctcaatacaccacgttggatagaaccacgtaaagatcacactaccnacagtgaaaaccactccaaaaggtattttg

SEQ ID NO: 26412 - DNA, 101 bp, rice(Oryza sativa)
  misc_feature (71): n=a or g
caatccggtggggaacacgtctctggttagaccagctcaaccaaatgtgtcttttcaaacttgcttgaggncagtagtagggcaaggcacactatttatgc

SEQ ID NO: 26413 - DNA, 101 bp, rice(Oryza sativa)
  misc_feature (71): n=t or c
cactcccaaataccttatcaccctctcccagtggaggacttcgaggattatagttctggagacttgctctncgggtagccgatgcatactaacaggaagga

SEQ ID NO: 26414 - DNA, 101 bp, rice(Oryza sativa)
  misc_feature (71): n=a or g
tttatttttgttttaccatatcacttatcaaatatccaagctaactaaaaatccttcagctagctatccanaaatcataccctgttaatttgtatggatgt

SEQ ID NO: 26415 - DNA, 101 bp, rice(Oryza sativa)
  misc_feature (71): n=a or g
tgataggaaatacacttagtggatttggtcctttctctaaagtccatcctaagcctattgcaccctgcctnagccggggtgctctggggcctagggtggtt

SEQ ID NO: 26416 - DNA, 101 bp, rice(Oryza sativa)
  misc_feature (71): n=t or c
accaaacccttttttagctgttactgcggtaaccgcgtggttatcctgaggtgtatcatgctttcaaaaantaaaaaaggttatcgcacgtgataaccacg

SEQ ID NO: 26417 - DNA, 101 bp, rice(Oryza sativa)
  misc_feature (71): n=a or g
tgcaatgtcatcctatgaagatgaagcgtatgagataatgcagtcactggatgtgaattatgtgcttgtcntatttggtggtgttactggttattcttcag

SEQ ID NO: 26418 - DNA, 101 bp, rice(Oryza sativa)
  misc_feature (71): n=a or g
atcacccacaccggtgccggtgcggcagtgcaacctgcgtctctcccatcactagtgccagtgaaggcccntacgttgccatcttcctcttccccaggttg

SEQ ID NO: 26419 - DNA, 101 bp, rice(Oryza sativa)
  misc_feature (71): n=a or g
cctttgacggcgaaggaggcggcgacggccccgagaatttgtgaagaaatgtaaggtagaagatgagcagnagggaggtgaccaaagacggccatggcgat

SEQ ID NO: 26420 - DNA, 101 bp, rice(Oryza sativa)
  misc_feature (71): n=t or c
aagccggatattccccgggaagaagagaggaaacaacgcgaactaggactgcgcttgaaaatgtgaaggcngaggggttttttcgcaaaacacctttcccc

SEQ ID NO: 26421 - DNA, 101 bp, rice(Oryza sativa)
  misc_feature (71): n=t or c
gcttagacgtgcaaagatgtttacctctattattaagagtggtggcagcaagatggctgatttgtcaactncagctgatcaaactaatgaagctggaaggg

SEQ ID NO: 26422 - DNA, 101 bp, rice(Oryza sativa)
  misc_feature (71): n=a or g
gcagcaacggactatggcgagcacgatgatggcagtggtggcagcggcgatgacatcaacttgggagctanggtttcgctggttgcaggtagggggctgtg

SEQ ID NO: 26423 - DNA, 101 bp, rice(Oryza sativa)
  misc_feature (71): n=a or g
tccatcaagattgcttgttccttcacaaaacgaaaaaaaaaaacccaatcagtaagtgttggcagtctgcnatgcagagatagatatagtccgcggctccg

SEQ ID NO: 26424 - DNA, 101 bp, rice(Oryza sativa)
  misc_feature (71): n=a or c
aaaatacaagaacaacttaggcaccattctgatcaactcaattatcagctgggttactctctcgttttctntcagcaatgttttgtgtcgcactgtgaacg

SEQ ID NO: 26425 - DNA, 101 bp, rice(Oryza sativa)
  misc_feature (71): n=a or g
tgccctgcatcatggatggcaagctgtctgtcatcagcatggtgacccagcaacaagtggatcgatttcantactcctttcgtccactaatataagggatt

SEQ ID NO: 26426 - DNA, 101 bp, rice(Oryza sativa)
  misc_feature (71): n=t or c
caagtttaagcattatttggactataacttgtacagctcggctcccatgttgcgagttgctgaagcatttnctctcctactcccgaaagaaacacaggagt

SEQ ID NO: 26427 - DNA, 101 bp, rice(Oryza sativa)
  misc_feature (71): n=t or c
ataaccacgtttacatagtgtttttccccaaaagtaagttcgtaataaccacgtttacagagtgttttccnaaaacgtaagttcgtgcggtgtgctatagc

SEQ ID NO: 26428 - DNA, 101 bp, rice(Oryza sativa)
  misc_feature (71): n=t or g
taactcgtatagcggttatattgtgcgataaatgggctcctcagagctgcttcgttgtgtaagggagtaanagctagtttaacagtgagaactaacatgta

SEQ ID NO: 26429 - DNA, 101 bp, rice(Oryza sativa)
  misc_feature (71): n=a or g
caaaaaaactctcctcccctcgtctcgaatttgccccaagaaactaaacaaacaaacggcgaaaatcaggntgggaatccgcaggcaaaggcgggatcgag

SEQ ID NO: 26430 - DNA, 101 bp, rice(Oryza sativa)
  misc_feature (71): n=a or g
agtggaaaacttcttggattatcttgcggagcaaaagtcagtctctggaaaggaaaaccttggtgtacgantacaaagcttgaggtatgaatgttagaatt

SEQ ID NO: 26431 - DNA, 101 bp, rice(Oryza sativa)
  misc_feature (71): n=a or c
tctatctctaggtggtttgtttgattatgctaaaccaggttattggcaatgttaatagtcgacttgttgtnacactaaaatttcattggggggagggggca

SEQ ID NO: 26432 - DNA, 101 bp, rice(Oryza sativa)
  misc_feature (71): n=t or c
tgtggtggcaacaatagtgtttcttgaatccatattcttgagttcttccaatccccaagatcctctgccanatttttgcttgctgaatttgaggattatgc

SEQ ID NO: 26433 - DNA, 101 bp, rice(Oryza sativa)
  misc_feature (71): n=t or c
ctaccttcacgtcgcggacgatgaacagcaggtagtcaactgcagatgagaggtaagaaacaggtttcagngcagggcggcataatgttcgttcttacact

SEQ ID NO: 26434 - DNA, 101 bp, rice(Oryza sativa)
  misc_feature (71): n=t or c
gggtttgaccaatttggccgagttacctcgagcaagccttgtaaaaatggcaaatgtcttttccaaaaccnatacagtcaatccctaatcatcaccatccg

SEQ ID NO: 26435 - DNA, 101 bp, rice(Oryza sativa)
  misc_feature (71): n=a or c
atgatctgtaatggtgcgatgtaatagtaatgtacgtgtctcggatggcgtcgagatgcaacgaacgaatnaaatggaggaattggaatcaatggcgatcg

SEQ ID NO: 26436 - DNA, 101 bp, rice(Oryza sativa)
  misc_feature (71): n=t or c
ctgtcacatatttgacatcactgtataagtatattccatttctgagtaatttgagatattcgtctacaggnggatgaaaagcaatcattgaaagagcaact

SEQ ID NO: 26437 - DNA, 101 bp, rice(Oryza sativa)
  misc_feature (71): n=a or g
ctgcaggacaacatggaataacttcctcatggatttcggcagatactatgcgcagtttcaagcaactgttnaatctcttgccactctggactgcttatact

SEQ ID NO: 26438 - DNA, 101 bp, rice(Oryza sativa)
  misc_feature (71): n=t or c
taataggtgtaccattgccaggtgggagcatcccatcctagatcatgtgacaaccacttgagtggagtacnttaggtgcactttgtaaatacatattgata

SEQ ID NO: 26439 - DNA, 101 bp, rice(Oryza sativa)
  misc_feature (71): n=a or g
aaccctacccaggcctcagcgggtcccacatatcatcattgctaagatgtggttggggtgtggtttactgnaagagaagtatcaaaataactctagatatc

SEQ ID NO: 26440 - DNA, 101 bp, rice(Oryza sativa)
  misc_feature (71): n=a or g
cgtcgccacgcactgcgacggcctcatcgccgtcacgacggacgccggcgagacattcgtctgcaacccanccaccaaggagctcgtcacgctgccgctcg

SEQ ID NO: 26441 - DNA, 101 bp, rice(Oryza sativa)
  misc_feature (71): n=t or c
cattttagtttcttctactatagggttgtgaagacccttgacgattggatgttgggcgtcaacgctaaggnctatggcattgatgtgtaggttcatttttt

SEQ ID NO: 26442 - DNA, 101 bp, rice(Oryza sativa)
  misc_feature (71): n=a or g
aagtcaacaccaagacattttacctctatccccacgccaacgcaattccgccaacgtagtgagtatacatnctacctccgtccaacaaaaaaaaaaaaaac

SEQ ID NO: 26443 - DNA, 101 bp, rice(Oryza sativa)
  misc_feature (71): n=a or g
gatgttggactgtaagcctgtggatactccgttgtctacaacagaaaagttgtctgcatatactggttctnttcaagatgctaccaggtacaggagcattg

SEQ ID NO: 26444 - DNA, 101 bp, rice(Oryza sativa)
  misc_feature (71): n=a or g
gggaatgaactctctaatagcagaaacctcatgctcgtgttgctgtccacattggtttcccctcaaagcanaatcaccatcaccatcaccatcaccatcat

SEQ ID NO: 26445 - DNA, 101 bp, rice(Oryza sativa)
  misc_feature (71): n=a or g
ttctcacacatgtcaacaatataactgaccaaacaggctcagtggcaagattcctccacataaaaaaaaanttggtttgcacagtgctgctgcatatgcaa

SEQ ID NO: 26446 - DNA, 101 bp, rice(Oryza sativa)
  misc_feature (71): n=a or g
tcaaagccgatctaacggcaacggctgtaggtggacgtccgcttagagcaagtataataggctataagaangctgaatgctgaggtggatgggagataaga

SEQ ID NO: 26447 - DNA, 101 bp, rice(Oryza sativa)
  misc_feature (71): n=a or g
tatttgcatgcccactaaaaaggagataagaaatttgatacttcaagaagctcatgagtctgcttattctntccatccaggaagtaccaatatgtaccagg

SEQ ID NO: 26448 - DNA, 101 bp, rice(Oryza sativa)
  misc_feature (71): n=a or g
ctatttccagctttgtgccaaaatagccctggggaattcaaccatatttccccatttaataccttgtagcncgcctcatctgttgtcagcgaattctggag

SEQ ID NO: 26449 - DNA, 101 bp, rice(Oryza sativa)
  misc_feature (71): n=t or c
gcacagttcttcatttatggattcgtccaccttacatggaatggcctctaggacttcctctactgactcanactgctcagaggtgaaaagttttttaaaga

SEQ ID NO: 26450 - DNA, 101 bp, rice(Oryza sativa)
  misc_feature (71): n=a or g
cctgccaaggacgatatggcacccatctatcacctcctcgagcacttcgacactgtctcgcaatagttctncggtgacggcggcgtggactatgcagctac

SEQ ID NO: 26451 - DNA, 101 bp, rice(Oryza sativa)
  misc_feature (71): n=a or c
gctcgtcgtgtgctcacgctccgtggtttggaccaggagtacgagggcaatgttgaggtacaaatataatncttataatttttttactctatatgctcatg

SEQ ID NO: 26452 - DNA, 101 bp, rice(Oryza sativa)
  misc_feature (71): n=a or g
gctttgcagttaagaatgagaaggcccaacaggcaacagcccattagatgctagctagtgcagtacttagntggtgtttagatccagggaattaactttag

SEQ ID NO: 26453 - DNA, 101 bp, rice(Oryza sativa)
  misc_feature (71): n=t or c
acttcttgcccaatgaccatatttgggtcttcaagatatatagaccctcaatattgtagcacaggctgtancagtccggcgtctgatatttacggcttcgg

SEQ ID NO: 26454 - DNA, 101 bp, rice(Oryza sativa)
  misc_feature (71): n=a or g
ctatgtgttcaagatcatgcgcaagaacgtcctgatatccctgcggtcatactgatgttgagcagcgacanctccagccttcccatgccaagaccgcctac

SEQ ID NO: 26455 - DNA, 101 bp, rice(Oryza sativa)
  misc_feature (71): n=a or c
gcaatgacaaacacaatatttttttctccggaaattaatgatttgctagtggtacctgccaacttcatccntgtataatctttttttttaacgactcgcac

SEQ ID NO: 26456 - DNA, 101 bp, rice(Oryza sativa)
  misc_feature (71): n=t or g
cagttcaagcattcatcattttaaaaagaaaaaaacttatgataaaccagcattgttaggaacttgtgacntttgttggtaggtctcttatgacaaaataa

SEQ ID NO: 26457 - DNA, 101 bp, rice(Oryza sativa)
  misc_feature (71): n=t or c
agtaagatacttctcggactttgcatcatacaacatccaaaaggttttgaaccacatcactgcaatgcacngggaaaacctgagctacaatggcgctttca

SEQ ID NO: 26458 - DNA, 101 bp, rice(Oryza sativa)
  misc_feature (71): n=t or g
tggaagatggtaaaagatgatgatgatgttgggatcaaatgcaaggaagaggatagtatgaagcatccgcnggagtgggagaaggatgtttaaacccattg

SEQ ID NO: 26459 - DNA, 101 bp, rice(Oryza sativa)
  misc_feature (71): n=t or g
gagtgctgcctaatgctgaccgattccgtgtgtgtggttttattccaacacaagatctgctgcctagattngtgacaagagtgacagccaaggctaagctt

SEQ ID NO: 26460 - DNA, 101 bp, rice(Oryza sativa)
  misc_feature (71): n=t or c
tcgatcagctccccgccgccgcactcccacgcgccgtactgatcaacctcctcgtcttcttcctcctcctnctggtccgccgcctctgtcgccgacggccc

SEQ ID NO: 26461 - DNA, 101 bp, rice(Oryza sativa)
  misc_feature (71): n=a or g
tctactaactactaactttcattatccaccaagacaacaaggttcatggggaggtgatcaacaggtggtcngggctgtacaagttcagcaagggcgagatc

SEQ ID NO: 26462 - DNA, 101 bp, rice(Oryza sativa)
  misc_feature (71): n=a or c
gcccacagaaatctgcaatctggtaaaggccgaaacaagctgttaccgtgccccttggaagccaagtgaancatgcactgatttggaatatttctggcagg

SEQ ID NO: 26463 - DNA, 101 bp, rice(Oryza sativa)
  misc_feature (71): n=a or g
ttttttttagtgcaaaaccattcaaacgtagctatagtttcatgtgcagctacggacaaaataacaccttntgatcctttgatctgcaggataggaaaaat

SEQ ID NO: 26464 - DNA, 101 bp, rice(Oryza sativa)
  misc_feature (71): n=t or c
ttctagtcgtgactatgaccgttcaagccatgaccgtgatcgtgaccattccagtcgtgactatgaccgtncaagccatgaccgtgaccgtgatcgtgacc

SEQ ID NO: 26465 - DNA, 101 bp, rice(Oryza sativa)
  misc_feature (71): n=a or g
caagtccacagaacaccgtttgttgaatcccagatgaagactgagattcttcactgagagatggtattccntcccgaagaatcggaacgtaataccatcgc

SEQ ID NO: 26466 - DNA, 101 bp, rice(Oryza sativa)
  misc_feature (71): n=a or g
ggacaagagttcccgaggtcaacatacaaaagtaaactaggatgataattgcccgcacgaaggtggtcagnattcaggttttacaaattgtgccttggaag

SEQ ID NO: 26467 - DNA, 101 bp, rice(Oryza sativa)
  misc_feature (71): n=a or g
catcagcggatgagattttctcccacgatccacccgtcgcaccacttctcatctccctgatccgcattgcnctccctctctctccgatccgtaatttcgca

SEQ ID NO: 26468 - DNA, 101 bp, rice(Oryza sativa)
  misc_feature (71): n=t or g
tagtattggtatggattcctccacatcaacatcacacacaagcagagctttgggctttttcttctcatggngggggggggaatgtagggtttagggggcta

SEQ ID NO: 26469 - DNA, 101 bp, rice(Oryza sativa)
  misc_feature (71): n=a or g
attgaggagaaagacaagaaaattgggatgttgaccaatgactgggacaaattagcttctgacataggaancttccttttggatggaaatgcagctcttga

SEQ ID NO: 26470 - DNA, 101 bp, rice(Oryza sativa)
  misc_feature (71): n=a or g
ctacaactgatgcgaatagacaggcttggtccagttggtacttagtagtaacatttctattaaagaaaagnttggccatttatttttttctgtttttttgt

SEQ ID NO: 26471 - DNA, 101 bp, rice(Oryza sativa)
  misc_feature (71): n=a or g
ttctttggatgatgaaatcatgtcagttgttggcctgctatctccttctgcttatgaaagcctatgtgatngtacaatccagttgagtagcactgtcaagg

SEQ ID NO: 26472 - DNA, 101 bp, rice(Oryza sativa)
  misc_feature (71): n=a or g
tgcaagaagcgtatagcatgagagcctttaatgtgttgtcttagtcccgatcctgcatgatgtccatttgngaggagcaatatgtacatatgcatgaatca

SEQ ID NO: 26473 - DNA, 101 bp, rice(Oryza sativa)
  misc_feature (71): n=a or g
tatgtccaaatgttgtgtcttattcgactctatgctatttatattttgggaccgaatgttgagattatagntagcttatccgactggagataggaggtggg

SEQ ID NO: 26474 - DNA, 101 bp, rice(Oryza sativa)
  misc_feature (71): n=t or g
tgtttttctagctcaactgactcatcatgctttaagatggatatccttctagcctcgtcagcaagagaatngagtgcaggtttcataatagttttgtaact

SEQ ID NO: 26475 - DNA, 101 bp, rice(Oryza sativa)
  misc_feature (71): n=t or c
ttgctctatacataagatggcaagatgacgtatacataagatggcaagatgacgtgtgatgagggagttcnaggtttgagtcagggatagcaacaggtcgg

SEQ ID NO: 26476 - DNA, 101 bp, rice(Oryza sativa)
  misc_feature (71): n=t or c
tcaacttcgaagcacgacaagccatttatagtggaacgcaagaggtcaatcttgcgaaccgcggcaacttnagccaaggtgggcacagcgacaacagcagc

SEQ ID NO: 26477 - DNA, 101 bp, rice(Oryza sativa)
  misc_feature (71): n=a or g
acagatcggacgcccgatcaaaagagcaaaaaaatcgggtgccttctttacctttccgtattaagcttggntgcaaagctgagacctctccctagactcgc

SEQ ID NO: 26478 - DNA, 101 bp, rice(Oryza sativa)
  misc_feature (71): n=t or c
cggaagcaatgttgccaagtgaggtggaatttgagtccctgtgatttcgcaatttcaaataggagcgctanggagaagaccgagtggatgatctcaacgga

SEQ ID NO: 26479 - DNA, 101 bp, rice(Oryza sativa)
  misc_feature (71): n=a or g
ttaattgagtgaaatatcagcatagccgcataggtgcatataaaagatggctatttatgcagaacgttgtncatggtactgactgaccgtgcaaggttagc

SEQ ID NO: 26480 - DNA, 101 bp, rice(Oryza sativa)
  misc_feature (71): n=a or g
gactttcatcaagaatttgccctgcatatgtacagagcaaaagtaacatatcttccaaactggcaatcatngattgacaactttctttaattttcccttgt

SEQ ID NO: 26481 - DNA, 101 bp, rice(Oryza sativa)
  misc_feature (71): n=a or g
ttttttgggaaacacaggtttgtgtggaccaccgttatctagacaatgtgacaaccctgaagagccaatcnctataccatacacttcagagaaatccatag

SEQ ID NO: 26482 - DNA, 101 bp, rice(Oryza sativa)
  misc_feature (71): n=t or g
gagtaagtgcaagctctctggtggattcctctggatcatcaagcatctcaagtagagaagaggacatctgntgtaaattctgaaaagggaactagttaaaa

SEQ ID NO: 26483 - DNA, 101 bp, rice(Oryza sativa)
  misc_feature (71): n=t or c
gacgtcgctgcaagaggactgtcgtctagatcgaagcccgtcgtagacctgcaacactcacctcacagttncactgtcgtcgtcgctttgggcgaactacc

SEQ ID NO: 26484 - DNA, 101 bp, rice(Oryza sativa)
  misc_feature (71): n=t or g
taacatagttatcttctagggaaggacatgcatgctgggaagagaaaacttgtgctgtttcgcctttcggnctatcaataacaactttactactagtagca

SEQ ID NO: 26485 - DNA, 101 bp, rice(Oryza sativa)
  misc_feature (71): n=a or g
gaattcccttctgcctttagttgtgcccatgaacagagagactgtcaagatgttgaatgatgatgggaggnaagtagttcttatgattttacaggatgatg

SEQ ID NO: 26486 - DNA, 101 bp, rice(Oryza sativa)
  misc_feature (71): n=t or c
cctccatattggcttcggcttgtgcttcggggttggtgttgactggcgcaacggcgaacgcggtcgaagtngttgtcggctgtgacgaagcggcttggggc

SEQ ID NO: 26487 - DNA, 101 bp, rice(Oryza sativa)
  misc_feature (71): n=a or g
tgcctttttattcacggactgtaacattgaaggtaaactgttaaaataccctaaaactacccccaaaaaanaaagttcacacaacattcattcgaagaaat

SEQ ID NO: 26488 - DNA, 101 bp, rice(Oryza sativa)
  misc_feature (71): n=t or c
tcgtgaaaggaatatcgttcgtaggatctcgcagatcaatggctcagaaacaaaagtggatccgaaggatngtaggattgctggatgaacttgtacctttt

SEQ ID NO: 26489 - DNA, 101 bp, rice(Oryza sativa)
  misc_feature (71): n=t or g
ctactctggatatatttttagagattccatacctcattctcaactgttttttctggcttgacaacctttgnagttcctgaaccattgcaggtgaggataaa

SEQ ID NO: 26490 - DNA, 101 bp, rice(Oryza sativa)
  misc_feature (71): n=t or g
cccccacctatgaccggtggtgcaatggctaacttcactcctggagcacctcctcgtcctccaatgcaagnatttcctgggccgcagcagtagatgaccca

SEQ ID NO: 26491 - DNA, 101 bp, rice(Oryza sativa)
  misc_feature (71): n=a or c
cctaccaagaagaaatggatagaaccaaaggaacattgaagcatataccctgtgctggatgtgctgatgcnaccaaggccaccaagtgagaagtccgcagc

SEQ ID NO: 26492 - DNA, 101 bp, rice(Oryza sativa)
  misc_feature (71): n=t or c
aactgacaggcttctaaggatggacagaagagcgaagaaattcttatttgggacgatggatgacaagagcnccttcaagccccaaggcactagagagttga

SEQ ID NO: 26493 - DNA, 101 bp, rice(Oryza sativa)
  misc_feature (71): n=a or g
cagtccacctcacaatgaagctttgaagcacctacctctaagattagccagaatagggcacaaacaagctnaaaggcagcgacgatgagggtgcttgccct

SEQ ID NO: 26494 - DNA, 101 bp, rice(Oryza sativa)
  misc_feature (71): n=t or c
tataaactttgtaaggtatggtatcaccctctgcttcgttctgtagtgcattcagtaatcctatctgttgngaatttatatcagatcttagaattggccat

SEQ ID NO: 26495 - DNA, 101 bp, rice(Oryza sativa)
  misc_feature (71): n=t or c
tccgcattggtctttctttaatttctaaccccttttgttcagagcattgcaccagaacagcttgcatggcncaatcccttctgagatcaagaactgcaccg

SEQ ID NO: 26496 - DNA, 101 bp, rice(Oryza sativa)
  misc_feature (71): n=a or g
cagcaacatcgtacgcatagcatttttctataccaagtggtacatgtgtgacaccagggtggtactacatntaccaatatgatacatatgtggtatcatgc

SEQ ID NO: 26497 - DNA, 101 bp, rice(Oryza sativa)
  misc_feature (71): n=a or c
tgttcctgtttttgatgagaaggtagtcggcatgattaccatcggtgacgttgtcaagacaatcgtggacnagcagcaccaagaagtaaaacaattgaaga

SEQ ID NO: 26498 - DNA, 101 bp, rice(Oryza sativa)
  misc_feature (71): n=a or g
aacagattgtctcttctgtttggaaaattccaagcgcttcagtacactaaaggcagtctcaacccataatntctataagcaatgtctatagtgccatatca

SEQ ID NO: 26499 - DNA, 101 bp, rice(Oryza sativa)
  misc_feature (71): n=a or g
taccaatacttgcgcctaccagctagctaattagtgcaccttgacaaggatgtgtcatatacccactcccnaaagatttgacgtcgtaatcaaaacaattt

SEQ ID NO: 26500 - DNA, 101 bp, rice(Oryza sativa)
  misc_feature (71): n=a or g
attgggacttccatcgacacatgtagagggtgaatttccatgtgtcagtcgaagtgccctagcctaatgtnacatgtcatgaacggatgaccgacacatag

SEQ ID NO: 26501 - DNA, 101 bp, rice(Oryza sativa)
  misc_feature (71): n=t or c
ccatgtttttgaagtccaggatttcaatattctaatcgggcaccctattgagaaacatctcatcaacaccnctcgagtaggcaggttcaatttctctttag

SEQ ID NO: 26502 - DNA, 101 bp, rice(Oryza sativa)
  misc_feature (71): n=a or g
tattgtaaggaatctgaaggaagacctttaccttgggagttatggtaggaaatggaaaatttgaacttggnaacaggcaacaaaggttttgttgccgcttt

SEQ ID NO: 26503 - DNA, 101 bp, rice(Oryza sativa)
  misc_feature (71): n=t or c
caatcattagtgtgaggtttgggacaaagaactcttgcctaaagtagaaagggataatactaccatgtacnactcctacttcctatatacatagtagcggt

SEQ ID NO: 26504 - DNA, 101 bp, rice(Oryza sativa)
  misc_feature (71): n=a or g
agaactgatgaaaagggagatagaagacctcaagacaaacgcaaaggtctttcagcttagcaagtgtacgncgtgcacctttacgcttgaccttcctgcgg

SEQ ID NO: 26505 - DNA, 101 bp, rice(Oryza sativa)
  misc_feature (71): n=t or g
ttgaaaaaccttttttttatgccgcagcttttttggctggagtcgggagtttaactagtatcttgttaggnttagtccttgctgttacttttgttgtgttt

SEQ ID NO: 26506 - DNA, 101 bp, rice(Oryza sativa)
  misc_feature (71): n=a or g
gggagaaaacagcatatcctgacttctttcactagcaaatactgagttactagtaggatttaggaccctcncatgatcaaacaacaaacatactaaacatt

SEQ ID NO: 26507 - DNA, 101 bp, rice(Oryza sativa)
  misc_feature (71): n=t or c
actacttgcgataagaccttatgtccaaattcacatattagaaattaaatatttcatcctgtactgatttntatattttgggacggaggtagtatatatct

SEQ ID NO: 26508 - DNA, 101 bp, rice(Oryza sativa)
  misc_feature (71): n=a or g
ggtcacaatcacaaatccatagcagcaaaaaaagaacaccaaaaatctgggtgcatcagctcgagagttcnattcacaccccagggacccagggccgttgg

SEQ ID NO: 26509 - DNA, 101 bp, rice(Oryza sativa)
  misc_feature (71): n=a or g
accaccacacagcctcgccaaccgctttcatcgttctcccacgtcgccatcaccatcctatctgctgccgncgctctccagtggtcctgcctaccgccggc

SEQ ID NO: 26510 - DNA, 101 bp, rice(Oryza sativa)
  misc_feature (71): n=a or g
atacatgcagctgcatccaatacacctatggggctttttggaatggagaaaacggagccggctgattggcncataatgtttctcataataatcttatcttg

SEQ ID NO: 26511 - DNA, 101 bp, rice(Oryza sativa)
  misc_feature (71): n=a or c
gccgcaccatcagcgtcgtctagagggacagtatcgtcatcaacatcaagaactcgctgctgacggagaangtcgccatccactggcacagcatccggcag

SEQ ID NO: 26512 - DNA, 101 bp, rice(Oryza sativa)
  misc_feature (71): n=a or c
actgaaaatcacttgtacttacaatcgcggacaatactgctaaggagttaaggaactcaaagcatgcctcnttgagaccatagcaatagtgcttctcagct

SEQ ID NO: 26513 - DNA, 101 bp, rice(Oryza sativa)
  misc_feature (71): n=t or c
tcgtccctgatgatgaccgtcttcctggcgccaactctttccaagacctagtgaaggtaaaaactacaaanatacctagctccgactcaaaatataaggat

SEQ ID NO: 26514 - DNA, 101 bp, rice(Oryza sativa)
  misc_feature (71): n=t or c
ctgcccgcgccatcctccaggatatgcttgttggccatagtcatggttgggaggttgctggtgtggtggcngttggtagtgaccagggtggggcgcgccat

SEQ ID NO: 26515 - DNA, 101 bp, rice(Oryza sativa)
  misc_feature (71): n=a or c
agcaggcaattcaaggaggccagatagggatcactctcatggttcggtggcatgagccatacaccgacaanacagccgatgcagctgctgccattaggatg

SEQ ID NO: 26516 - DNA, 101 bp, rice(Oryza sativa)
  misc_feature (71): n=t or c
ctggcaactttggtatggagcacaggcgataagcagataagcttggatcatcaaaccgtgggtactgtacngagcagtacattcagatcaataataaagtc

SEQ ID NO: 26517 - DNA, 101 bp, rice(Oryza sativa)
  misc_feature (71): n=t or c
ttttttaaaaagaaaataggctctacaagataactatggtggaagatgagatggggaaactattttgatcnctcgagaagatgtcctcttgttctttgcat

SEQ ID NO: 26518 - DNA, 101 bp, rice(Oryza sativa)
  misc_feature (71): n=a or g
aaatctaatatgccaatctgaccacaatgcctctggactgtagtgcatgatattttccaaggtatatgganactttggatgcaacatgtagcaacaatcat

SEQ ID NO: 26519 - DNA, 101 bp, rice(Oryza sativa)
  misc_feature (71): n=a or g
caacccccagaaaaagataagtgataaatacaacataccccatatttttcctcgagagactgcatcgcgcngtcaaactctagcatgccacgatacctaag

SEQ ID NO: 26520 - DNA, 101 bp, rice(Oryza sativa)
  misc_feature (71): n=a or c
aaaatcacaattttctcgttgttgaggtactcggtacattggtgcctacttgagggaaactattctaatcnttcgaggggatgttctttcatttgcttaaa

SEQ ID NO: 26521 - DNA, 101 bp, rice(Oryza sativa)
  misc_feature (71): n=t or c
tttcaatttcttcaattgagcatagttgaacaacttgagcaatagctctagatttgaacattccttttaantgcttagcagtaactgatttgcaatcagac

SEQ ID NO: 26522 - DNA, 101 bp, rice(Oryza sativa)
  misc_feature (71): n=a or c
tgttaaagcatccttgttaggagctggtgctttgagcgcctatattaaatcttaatctgtgttcaaaatantaatcttcggattgagtcacaaacaaatta

SEQ ID NO: 26523 - DNA, 101 bp, rice(Oryza sativa)
  misc_feature (71): n=a or c
caaacgtatatgcctaataccatcgcacaaacaaacagacgacacaccaaacggggcaatgcttatttcangactataaattttagctaaggatttctttt

SEQ ID NO: 26524 - DNA, 101 bp, rice(Oryza sativa)
  misc_feature (71): n=a or g
aaaccttgacatctccttgtctgaaatcaaaagctccagggccatctgtggttccagcagcaaaagcaaancccattgctgctgggcatgttttcacggtc

SEQ ID NO: 26525 - DNA, 101 bp, rice(Oryza sativa)
  misc_feature (71): n=a or g
atgcaacgtttctcttcatgtttcaactccctgagtaacaagaccattgctcaatgatgcagatacggaanaggggttaaaagtaacagtgcactgtaaaa

SEQ ID NO: 26526 - DNA, 101 bp, rice(Oryza sativa)
  misc_feature (71): n=a or g
agtgcgcggcggcgcgtaggcgtagcagttcaggcttcgccctaactctggatcccaaatcccccatgcgngcgtctctccctccaccaatcaggtcaggc

SEQ ID NO: 26527 - DNA, 101 bp, rice(Oryza sativa)
  misc_feature (71): n=t or c
attggcggtgggggctttgtgagctacaaacgagacatcgcatgcgcatatgcctcctcaccattctccgntgcgagcttctcccccgtgagcttctcctc

SEQ ID NO: 26528 - DNA, 101 bp, rice(Oryza sativa)
  misc_feature (71): n=a or g
tctttttgggccgggtttgggttcgggcttgggtgtgggctcatccagttgaatataactttagagagtgnaaaggaaaaagtacaccgaaggtccctcaa

SEQ ID NO: 26529 - DNA, 101 bp, rice(Oryza sativa)
  misc_feature (71): n=a or g
ggcaatggtggatacggccatggttatggctatggttcaggatatggttttggcaatggaggtgttggcgnaggtggctatggaggtggaggtgggtatgg

SEQ ID NO: 26530 - DNA, 101 bp, rice(Oryza sativa)
  misc_feature (71): n=a or c
cctagtataggatagttgctatatattgggaccgagggagtatgacgttaaccgcttgattattgttattntaatcgagcccgtacaaattaagaaaccac

SEQ ID NO: 26531 - DNA, 101 bp, rice(Oryza sativa)
  misc_feature (71): n=t or c
aatcgaaaatcaacaactagtcttgaaggctcaatgggccgataatagtttgtcattgttttatcgattgnagttgacccagattgaattttgaggtatcg

SEQ ID NO: 26532 - DNA, 101 bp, rice(Oryza sativa)
  misc_feature (71): n=a or g
agcttttcttctagccaccgtccacatccttcttcaaaacctcaacatcactttgtgtgggaattaaaagnaattggtcttcttgaccttgcaagaccttt

SEQ ID NO: 26533 - DNA, 101 bp, rice(Oryza sativa)
  misc_feature (71): n=t or c
tgtcgcaatctagatagccactcggactccagccaagacggagatgaacaacctgggtatccatcaacagncaattcctcaaggccagggtgaggtattaa

SEQ ID NO: 26534 - DNA, 101 bp, rice(Oryza sativa)
  misc_feature (71): n=a or g
aatcacattcatttggacaatcatatatcacatctggcagtcacaaatagaactcatcaaaattactctcntccccatctccaacccccttcgccccgagc

SEQ ID NO: 26535 - DNA, 101 bp, rice(Oryza sativa)
  misc_feature (71): n=a or g
tttataggagctacctagtgtggctgtgcctaggcgtctaagtgtgtccaatataacggttaagtgcctcntgggggaacggatgtgttagctgccacggc

SEQ ID NO: 26536 - DNA, 101 bp, rice(Oryza sativa)
  misc_feature (71): n=a or c
cttctttttggttagaagttcagctctattcctcaggctcattcttgaagtaatagcaggttctgctttcntgggtctgttcttcttgtaaggaacctctt

SEQ ID NO: 26537 - DNA, 101 bp, rice(Oryza sativa)
  misc_feature (71): n=t or c
ttagccaccgtggccgcgttggccttgccagcggcagattccttactcgtggtaggcgtgtcagccttggnggctggggatttcttagtcaccgtgaccgc

SEQ ID NO: 26538 - DNA, 101 bp, rice(Oryza sativa)
  misc_feature (71): n=t or c
gggcggcctcggtcgggctctaagtacccaatgttagcgccaactattttggcgctgaggttaggcacctnagcgccgaagtggttggcgctgaggtacct

SEQ ID NO: 26539 - DNA, 101 bp, rice(Oryza sativa)
  misc_feature (71): n=t or c
cctattcaacagctctgcgtggtggattatgtcttgtgcctaaaataaccagcatcgtaaactcatattantctttttctttaccgagatttgctcatggc

SEQ ID NO: 26540 - DNA, 101 bp, rice(Oryza sativa)
  misc_feature (71): n=t or c
cagttataaaacaatctaactactgaaacggcaaagccaaatgattttgaagattaaatcaatgaaatcgncgggactaatcccttcggctggattgaatc

SEQ ID NO: 26541 - DNA, 101 bp, rice(Oryza sativa)
  misc_feature (71): n=a or g
gctgggaactgcactgcacgcgagctaggtttcgtaattagtagttctccacaattctgagtaccgacgantatgttccaagagcagcgcttatggtgccc

SEQ ID NO: 26542 - DNA, 101 bp, rice(Oryza sativa)
  misc_feature (71): n=t or c
ccaagaaccaccaaagatatgacaatcccagcaacagccccacctcctatcttagaacttctgcctccacngtcaccgccactgccatcgccattgccacc

SEQ ID NO: 26543 - DNA, 101 bp, rice(Oryza sativa)
  misc_feature (71): n=a or g
ccatatataagagtaattaattagttactcgctcagtgcgaaaatatagctagttctatgttgagattttntctgatttctccttcatctcaaccaatcac

SEQ ID NO: 26544 - DNA, 101 bp, rice(Oryza sativa)
  misc_feature (71): n=a or g
attcgtgcacccagtgatggtgaagccaatgaagtattattcgcaaataggtccgggaggtcacggcagcngcaacacattagattcaggatggtgtagga

SEQ ID NO: 26545 - DNA, 101 bp, rice(Oryza sativa)
  misc_feature (71): n=t or c
atataggtaaaaactattatgttagactcttaactcacagcactgattgatttttgtcttgtttaaacttnggtgaatcaatttgctggcactagtataac

SEQ ID NO: 26546 - DNA, 101 bp, rice(Oryza sativa)
  misc_feature (71): n=a or g
cttctgagtcctatccagaaagaaattgccagatcattccatctggggcttcctttgcagagagaaacttnaagggtattatatgtgcaaaattgtcatac

SEQ ID NO: 26547 - DNA, 101 bp, rice(Oryza sativa)
  misc_feature (71): n=a or g
tgacgatcgacgcgcgcgtgctcggcggcgtttggtttgtgtgatcgatcgatgtggcgatccatggagancggcggcggcggaggtggaggtggagggat

SEQ ID NO: 26548 - DNA, 101 bp, rice(Oryza sativa)
  misc_feature (71): n=a or g
ccggatcatctacttgcttttgtctgcacttgtcctgatttcagtcatcggatcggttttctttggcatcncaaccagagatgacctacaagatggcaggc

SEQ ID NO: 26549 - DNA, 101 bp, rice(Oryza sativa)
  misc_feature (71): n=a or g
gtgcgcggttaattaagcaaagtacataaaacccaaaataaaagcatggaacaacggatacaacgaatatncgataacggtatgtctagattcattataat

SEQ ID NO: 26550 - DNA, 101 bp, rice(Oryza sativa)
  misc_feature (71): n=a or g
agtaaatactacacttttgattctgctagcttctaagactgtttttctgaatcatgtttttcagagctttntatcaggaattggcaattggattgcagatg

SEQ ID NO: 26551 - DNA, 101 bp, rice(Oryza sativa)
  misc_feature (71): n=t or c
aatagcctccggatccaaagaggtcctttgttttcttgtgttgctcttttcttccttttgcttctgcttcngcttccgcttccgctgccactgcacgcaca

SEQ ID NO: 26552 - DNA, 101 bp, rice(Oryza sativa)
  misc_feature (71): n=t or c
aaaaacagaggtagtatataatataatttagggatttctttctctccagagaaatatgagggacataatcngtaagagatccaacatcatcgttcataaat

SEQ ID NO: 26553 - DNA, 101 bp, rice(Oryza sativa)
  misc_feature (71): n=a or g
cctctggaggctgatggcagcataaatccgccgccactgtcattgtctctgctctcagtgcccaccgacancggatccgtccttcacaagactggcaccat

SEQ ID NO: 26554 - DNA, 101 bp, rice(Oryza sativa)
  misc_feature (71): n=t or c
gttcagcttgctattgtgttcagcgctgctcaatttgcatacgatgttcagcttgctattatgttcaatgntgttcaatttgcacatgatgttcagcttgc

SEQ ID NO: 26555 - DNA, 101 bp, rice(Oryza sativa)
  misc_feature (71): n=t or c
ttcagcaccgtgatgaactggttttcgaagtgcttgctcggatcgccgaaacggtgaggaactccaatggngtggtgatcagcacattcgaagagctggaa

SEQ ID NO: 26556 - DNA, 101 bp, rice(Oryza sativa)
  misc_feature (71): n=a or g
tgcgcatgaaagcagcggtggcatgcggaccgaggaaaataaagagagaaaaagaagggggcttagttatnttgcatgaatctcaacgcgatccaatgctc

SEQ ID NO: 26557 - DNA, 101 bp, rice(Oryza sativa)
  misc_feature (71): n=t or c
caagtgcaactcttttcggatattcatatcttctaagtccatgcgggccttaagtgtatcttttgtcttgncatctatgtttaataaagttcctaataaac

SEQ ID NO: 26558 - DNA, 101 bp, rice(Oryza sativa)
  misc_feature (71): n=a or g
ggagagtaccctcttctgggaagatagttggtgggggggaggggtaaaccaattaaagagtctgctccagntctttataacataaccttgacaaaaatgtg

SEQ ID NO: 26559 - DNA, 101 bp, rice(Oryza sativa)
  misc_feature (71): n=a or c
tgaagttccccctctggcgctgcagttgcaccttgtggggataagcagacgacgttgatggctatcaacancaccaggaagacagcggccatgctcgacct

SEQ ID NO: 26560 - DNA, 101 bp, rice(Oryza sativa)
  misc_feature (71): n=t or c
ataacatccctcaaccggaaaactgggtataacgcctctttcttatctaaaaaccagaacaaatcacctcnctcggtggtttcagaggtggtttgttctac

SEQ ID NO: 26561 - DNA, 101 bp, rice(Oryza sativa)
  misc_feature (71): n=a or g
ctggtgatgagaatcctacctgcatcgaagatttgcatgttccatgggatcccgatagaaccgctacatcngcttgggcacaagccgattttcgaggaggg

SEQ ID NO: 26562 - DNA, 101 bp, rice(Oryza sativa)
  misc_feature (71): n=t or c
atcaataccagccgctagctagatatccaggtcctttttattaatttccaagagttctcccatatacaacnccctctatttcaggttataaaatattttga

SEQ ID NO: 26563 - DNA, 101 bp, rice(Oryza sativa)
  misc_feature (71): n=t or g
ggtttttccaattttcgtttagctccaggttcaggttgtgtgtaaatatgaggcgatgtgattgggatagnatcaccacgatcttgtggccttggttcatt

SEQ ID NO: 26564 - DNA, 101 bp, rice(Oryza sativa)
  misc_feature (71): n=t or c
atagccactgggaactgtctggaaagtagacaattgctggctgtagagatggcagaacctaaattcataancatgtaaggcaggtaaaaattattacatgg

SEQ ID NO: 26565 - DNA, 101 bp, rice(Oryza sativa)
  misc_feature (71): n=t or c
ccctgaccgtgctagatcatccgccctagtcaccattgaggagtaagagttggtatgcaatatgcattatnccgtgaatcttagttcagtgatggtatgct

SEQ ID NO: 26566 - DNA, 101 bp, rice(Oryza sativa)
  misc_feature (71): n=t or c
cctccatcgatcgatcacaaggttttctgctcatccagctatcggcctagctaacatcctagtcttttaanaacaatcaacttaattgcaacgccttttgg

SEQ ID NO: 26567 - DNA, 101 bp, rice(Oryza sativa)
  misc_feature (71): n=a or c
gcgggaagacccaaagccattgacgtgtagtaggattgcagagatgcaaatagttgttgtaggacatgagnaggagaccatcgcaagaagcgtggacggtg

SEQ ID NO: 26568 - DNA, 101 bp, rice(Oryza sativa)
  misc_feature (71): n=t or c
tgcaaaggagggataaatagtgaaggtgtgagagggggacaattggtaggttggagacaccatcgatgacngggatagactatatatggataaaatggggt

SEQ ID NO: 26569 - DNA, 101 bp, rice(Oryza sativa)
  misc_feature (71): n=t or g
tggagatgatggactagggacaccccatcagatcagtcgtgatgatgttgtatcagcaaccccatactaanggttcaccactgtagcctctcctggcttgc

SEQ ID NO: 26570 - DNA, 101 bp, rice(Oryza sativa)
  misc_feature (71): n=t or c
acccggccaacgcttgaaaagagatcgggtaacaccttgattccaggacacgtatagtccttatgtcacanaagtacatgcatatacggtgggccctctgt

SEQ ID NO: 26571 - DNA, 101 bp, rice(Oryza sativa)
  misc_feature (71): n=t or c
ctagtctgaacatattaagaaatagaacagactccctcggtcccataaaccacgaatctagaattagatangaatctagaattagatatgacatattatag

SEQ ID NO: 26572 - DNA, 101 bp, rice(Oryza sativa)
  misc_feature (71): n=a or c
gttgaggtggtattatattaaggaaaaagatagaaaaataccgtggcctcacgtgtgagtgaaacctcttnattggttcgaggaagccaagcagcggccaa

SEQ ID NO: 26573 - DNA, 101 bp, rice(Oryza sativa)
  misc_feature (71): n=t or c
ccatcctcacttggaggatcagaaaaaacagtttcctcaacctgagaagaccccacatcattttgtccttngacattcctactcgccttagtgctattctt

SEQ ID NO: 26574 - DNA, 101 bp, rice(Oryza sativa)
  misc_feature (71): n=t or c
gccctcaccgaccacgtcctctctgacgacgcttttcctcatcatgcgtcctgggctcggacggattgtgncgtgctctcgtggctctatgggaccatcgc

SEQ ID NO: 26575 - DNA, 101 bp, rice(Oryza sativa)
  misc_feature (71): n=t or g
ctaatagtaacctttggcacaaacctgacttgagctttgactcttaagtagcggccaaatctgaattctanatttaattcatataccaggattttttttct

SEQ ID NO: 26576 - DNA, 101 bp, rice(Oryza sativa)
  misc_feature (71): n=a or g
ccccgtacgcacgtagagtcaattgatcaatatcgatcggcactatagcgagcgagagatcgatcgatcangatgagtggatccgtgatgatgatgcagcg

SEQ ID NO: 26577 - DNA, 101 bp, rice(Oryza sativa)
  misc_feature (71): n=a or g
aacatgtggagcagggcagctgaactcttcatcctagttatcaatgggcccacccgtcagccaccgagctngtaggggagggggcgggcttggatgagtgt

SEQ ID NO: 26578 - DNA, 101 bp, rice(Oryza sativa)
  misc_feature (71): n=t or c
aactgtaaaactaaacaacgcagcattctagaatactaattacaatcagctcgttactttatacacgtganactatcataagtgttgaccctgaaaattgt

SEQ ID NO: 26579 - DNA, 101 bp, rice(Oryza sativa)
  misc_feature (71): n=a or g
ccatccttggtctccttgtggacggttcccgttgctgttgttcatgagcatgacgtctttacgggttttcngaccatccgtcccagagtgaccggcattgc

SEQ ID NO: 26580 - DNA, 101 bp, rice(Oryza sativa)
  misc_feature (71): n=t or c
acaacgatgcaaaacatgatgattattaaagcgaaacgaatattagttggatgcttagttaaattattgcnagtgattatatacgctgacatgtttttttt

SEQ ID NO: 26581 - DNA, 101 bp, rice(Oryza sativa)
  misc_feature (71): n=t or c
taaccgcctagcggttttagtcctacattgccacacacgtggcacaagccccagatgtcaacctccacctngttctccctctcttatgaagctagagggcc

SEQ ID NO: 26582 - DNA, 101 bp, rice(Oryza sativa)
  misc_feature (71): n=t or c
cagagctcatggtgctagggttcatctcgctgctgctcgtgttcggccagaactacatcatcaagatctgnatcactgagaaggccgccgacaccatgctc

SEQ ID NO: 26583 - DNA, 101 bp, rice(Oryza sativa)
  misc_feature (71): n=t or g
tatgccacatgaattactgttctgttttgcaccatcatgaactcaatgtttacaagagcaacagtaatttntttatggttattgataatctaggcaattaa

SEQ ID NO: 26584 - DNA, 101 bp, rice(Oryza sativa)
  misc_feature (71): n=a or g
atggtgggggcttcccctaccatggttctttcaaaaaaagagtctagccagggagagagaaggtagtagcncccgaagacgttgtcactgccagctcaacg

SEQ ID NO: 26585 - DNA, 101 bp, rice(Oryza sativa)
  misc_feature (71): n=t or g
taaaaaaaaattgatacacagggaacgttaccgataaatttctctaacaacaagtcaataagtccaaaganaactgaaaccgtaaaaccattatgttccat

SEQ ID NO: 26586 - DNA, 101 bp, rice(Oryza sativa)
  misc_feature (71): n=a or g
gcgaaaaccaccttcaaaaccactggaggtgtcatttttgaggggtcaaaatatctttattttggttaagngatatgaatcagattgcacttgtaattgtg

SEQ ID NO: 26587 - DNA, 101 bp, rice(Oryza sativa)
  misc_feature (71): n=a or c
tatgaaatttcactctgtagtgttcgtaattcttcactcttcccaagcttctcggtaagtaacttgttgantgaaaacaaaaaaaaaatgctagagaatca

SEQ ID NO: 26588 - DNA, 101 bp, rice(Oryza sativa)
  misc_feature (71): n=a or g
acaaacaaagccgaattaacactcacgctaaaacgttagcgcgccccgtggtggcaacacacacagtcacncgtacgctagctcgatcgttagctgcagct

SEQ ID NO: 26589 - DNA, 101 bp, rice(Oryza sativa)
  misc_feature (71): n=a or c
acgaatagccgctgcaccagggtacgtaggtgtgttacccctcacaggatgtcctaaaataccttaccaanttgtaatatagaatcatctttaaaaagatt

SEQ ID NO: 26590 - DNA, 101 bp, rice(Oryza sativa)
  misc_feature (71): n=t or c
caacacatgatacaggatgcctcattcaattttgtcatgtgcagactgcagaagtggatggttagagggancaaacaaggtctacatcccatttctggctt

SEQ ID NO: 26591 - DNA, 101 bp, rice(Oryza sativa)
  misc_feature (71): n=a or g
tgtaacaaaaatacaagagcacaatgagaacgtcaaaaggaaggcacccattaccattgttgtttgtcatnagtaaagtccgccgtcaagcgcaacctcct

SEQ ID NO: 26592 - DNA, 101 bp, rice(Oryza sativa)
  misc_feature (71): n=t or c
aagtggtggggccccctcgtggatcttgaacggctgaaatggacggagaaatattattgctattgggggancgatctatgatccataagttatttgattat

SEQ ID NO: 26593 - DNA, 101 bp, rice(Oryza sativa)
  misc_feature (71): n=t or c
tcttacttttccctcttctcttccacctcttcctctttgtagcgagcggcggccatctttccttgtctaangatggctatctccctctctcctgtgatggc

SEQ ID NO: 26594 - DNA, 101 bp, rice(Oryza sativa)
  misc_feature (71): n=a or g
aggagagttttaacgcttagaagcaaacctaggattgggctagcttgtgcctatatggctctattgggctncatttcacttttaggtcaaatttcgtagta

SEQ ID NO: 26595 - DNA, 101 bp, rice(Oryza sativa)
  misc_feature (71): n=a or c
tcgcgcgagacatcggcaaaaccatacctatttgccaaattaacgaaaaacgaatccgtgcgacttgaggntgtagagtttgaagaagttcgtagtagttt

SEQ ID NO: 26596 - DNA, 101 bp, rice(Oryza sativa)
  misc_feature (71): n=t or c
cagtgcgggcgaaataaacaattcaggctgtatttatggtggaaaagttacgaagttgagagaaagttagnagtttgaaaaaaaagttggtattttatgtg

SEQ ID NO: 26597 - DNA, 101 bp, rice(Oryza sativa)
  misc_feature (71): n=a or g
gtactattgtttatgtttagtgtgagaagacatcaagacatgcatcatgcgtgtatatatttactggaatnaaacacgagttatatgaacaatgattttgt

SEQ ID NO: 26598 - DNA, 101 bp, rice(Oryza sativa)
  misc_feature (71): n=t or g
tctagcaaagcgattacacactatctcacataggtccggccaggaaattcccccaagttgtgttctgacanattgtaaccaaaaagcagcgttgcccacaa

SEQ ID NO: 26599 - DNA, 101 bp, rice(Oryza sativa)
  misc_feature (71): n=t or c
agctgatgcccccacgctcccaatgacggaggtctggaagctctggttcccggccatggtcccgagaaatncgtcatcagcggcgcctccagacagatcac

SEQ ID NO: 26600 - DNA, 101 bp, rice(Oryza sativa)
  misc_feature (71): n=t or g
ttagacaggttgcgtagggttggcagtgttcctagttttgactttaatgtgaacctagtcattgacaagtnggagcaagagattgaagcgaagtttgttct

SEQ ID NO: 26601 - DNA, 101 bp, rice(Oryza sativa)
  misc_feature (71): n=a or g
cgtcaatgatgaggacaaaacaaagcaactggttaggaggtggtggtagattcaacgatggggagctaacngagacggggaagatggcatagcagggacac

SEQ ID NO: 26602 - DNA, 101 bp, rice(Oryza sativa)
  misc_feature (71): n=t or c
ttctccacatgaatacatcttttgatttcctgcccgcctctgttccgcgccaaaattgaattattcctggncatttgtctgcccgtcaggttctatggcgt

SEQ ID NO: 26603 - DNA, 101 bp, rice(Oryza sativa)
  misc_feature (71): n=a or g
aattgatcctgaggaggacaaggcagaactggtagtgtcctcactcctgctacacttagcttttaatactncctccgtttcaggttataagactttctagt

SEQ ID NO: 26604 - DNA, 101 bp, rice(Oryza sativa)
  misc_feature (71): n=a or g
aaccctgaaccctaaaccctaaaccctaaaaccctgataccctacaccctaaggcaacaattagggtttanggtttaggtttttgaatgaaaaccgtcata

SEQ ID NO: 26605 - DNA, 101 bp, rice(Oryza sativa)
  misc_feature (71): n=t or c
aacttattactactggtctagtagacagatattcagagaatcagaggatgtacaatagtaggatataagcnaactataaacacattttaagaagataagat

SEQ ID NO: 26606 - DNA, 101 bp, rice(Oryza sativa)
  misc_feature (71): n=t or c
tggtggtggtggtggtggtgatcgagccgttgttgccagaagtgttgccaccaccttggatagtcgtgggngcaccgccagatgcgccacccataggtgaa

SEQ ID NO: 26607 - DNA, 101 bp, rice(Oryza sativa)
  misc_feature (71): n=a or g
ttaattgtctaaaaattgttttgtggactgcagaagcataagaaacgtcttcaaaaagaatatcagaaacntcagaatcttcttgaacaaaaagaccaaca

SEQ ID NO: 26608 - DNA, 101 bp, rice(Oryza sativa)
  misc_feature (71): n=a or g
ccgaaaattttttatggacggttgactgcgaggaagactccaagtaatttaatggatgttacgtgggtacntgtcgcttgtactccatttgattggtgcag

SEQ ID NO: 26609 - DNA, 101 bp, rice(Oryza sativa)
  misc_feature (71): n=t or c
ctgcctggccatccaactgcgatctctcaagattcatcgtcacgggaacctaacatggtcgcgtcgtacanggatcagcgctcttttggacctgccaaaga

SEQ ID NO: 26610 - DNA, 101 bp, rice(Oryza sativa)
  misc_feature (71): n=t or c
tgatgacacaatcatatgtaattaacttggtctctgaaaagcttaacattcttctagggaacctaaccccnctcttgagagccctatgattagttgttaat

SEQ ID NO: 26611 - DNA, 101 bp, rice(Oryza sativa)
  misc_feature (71): n=t or g
gaattgctaaatggtattcgatgggaaattggggctaaaaccttgaaaacttctaatcgtaggatttgctntgcgtttcgtgcttcaaaatccacaatcca

SEQ ID NO: 26612 - DNA, 101 bp, rice(Oryza sativa)
  misc_feature (71): n=a or g
ggagcattttgatctttcatctctcttcttaactgcaccttggaatctaggaatgaagttttatgggacanagtgagaagtttcctctgtgttgactaata

SEQ ID NO: 26613 - DNA, 101 bp, rice(Oryza sativa)
  misc_feature (71): n=a or g
taggacggagggagtaggagatagcatggcattgtcgtgaaagaacttgagccgtgcatttccaggtactnactagtgatgatctcaagtgttgtgccctt

SEQ ID NO: 26614 - DNA, 101 bp, rice(Oryza sativa)
  misc_feature (71): n=a or g
ggttaggcaacccgaaccaagccattttggggataagcctaggtcattggtataaaccctgagatcatgcntgcggttgtagttgcccccccttgagtact

SEQ ID NO: 26615 - DNA, 101 bp, rice(Oryza sativa)
  misc_feature (71): n=t or c
tagcacaatagataacagaatacggaacaaacgacatagaagattcaatactgaagacgacaccaagacanaatatttgttaacgagattcaaccgaaact

SEQ ID NO: 26616 - DNA, 101 bp, rice(Oryza sativa)
  misc_feature (71): n=a or g
agcaccattgctggctaacctaaatatgtgaacaagatcggtaaggcccgttgaaccaacctccttacctncccttcccttttccatccctctttatcaag

SEQ ID NO: 26617 - DNA, 101 bp, rice(Oryza sativa)
  misc_feature (71): n=t or c
gggctacagattgcagctcgtgctccaagaactgagagaaatatggagtgcacaataatggtgcagtatangtatctatagttaactattgtatgagtggt

SEQ ID NO: 26618 - DNA, 101 bp, rice(Oryza sativa)
  misc_feature (71): n=t or c
caatcggttcgattgcatatccagtcttttaactagaccggactggtataggctctggttttggtttttanaggtccaaccgtcggtatggttcggtctta

SEQ ID NO: 26619 - DNA, 101 bp, rice(Oryza sativa)
  misc_feature (71): n=t or c
ctccagcaggcacggcatgttcaggaagttggcggcattgatcaggccgaacaacttcttcctgtcgacgntgacgaactcggcgtcgaacttactgagct

SEQ ID NO: 26620 - DNA, 101 bp, rice(Oryza sativa)
  misc_feature (71): n=a or c
aaaaagatggattcttccgtatggatggtgcacgcacacaatcaatcgatcgccttgtacttctctaattntatgctttgtacatatctacggatataccc

SEQ ID NO: 26621 - DNA, 101 bp, rice(Oryza sativa)
  misc_feature (71): n=t or c
gcaatgtggagtcaagggagatatatctgactcacccagtttttagcttggtgccagcgctgtagatggcnatagagtcagaggcccgatggcctggtgat

SEQ ID NO: 26622 - DNA, 101 bp, rice(Oryza sativa)
  misc_feature (71): n=a or g
ctgggccagtgtgttttcagccgggaataagtccatctccaactataagatttgtttcttggtctacatcntctatgtgacaataaaagaagggaaaacca

SEQ ID NO: 26623 - DNA, 101 bp, rice(Oryza sativa)
  misc_feature (71): n=a or g
atcacctagcccttcaaactagtgagtcaagccgtccgcgtctataaaacaatgtgcccggctcaactccncctttcccacttggcacgcacatgtcgcct

SEQ ID NO: 26624 - DNA, 101 bp, rice(Oryza sativa)
  misc_feature (71): n=a or c
tgtagaagaggaacacccagactgtcttgaagaagccagtgaggaggcagaagaatgagccaaacgatgtngcggcaatgaggatgagcgactgatactgg

SEQ ID NO: 26625 - DNA, 101 bp, rice(Oryza sativa)
  misc_feature (71): n=t or c
taccgatctatcaagaatctacaaagcaagaacatgcttcatctaatctgagtctaatttgcgcctttggncttgtaattgtatcttgagctaagcccaaa

SEQ ID NO: 26626 - DNA, 101 bp, rice(Oryza sativa)
  misc_feature (71): n=a or c
ctataattcggttacaactcttaacttacggatacagtagacccacatgtcatacatgtgtcttttggcanactgaaatggtgagacacatcaacactcaa

SEQ ID NO: 26627 - DNA, 101 bp, rice(Oryza sativa)
  misc_feature (71): n=a or g
gtggagagcgagtagaagaggacgttttcggaatattcgtcctcaagccagcggcttgccatgatccaagnctggaagaaggcgtgctctttatgcgacac

SEQ ID NO: 26628 - DNA, 101 bp, rice(Oryza sativa)
  misc_feature (71): n=t or c
tgggttttgaaatataccaaaatggtaggagttgtgctattgacactctttgttaagtttctgtttgcacngtaagccaactccagtatttttgtaagaaa

SEQ ID NO: 26629 - DNA, 101 bp, rice(Oryza sativa)
  misc_feature (71): n=a or c
gcaatagacccgggttcgactcccggcaaacgcatgttttttaattttttgcttataaatttcttgggctngcgtggatagagactctctttcaccttcct

SEQ ID NO: 26630 - DNA, 101 bp, rice(Oryza sativa)
  misc_feature (71): n=t or c
attgtctcgggtatatgtcgtgggcggaagaacctaaccgcaaccactcaaggcgcgtccttgaggaggcngaacttgtaggagtcacggtcgagcgggtt

SEQ ID NO: 26631 - DNA, 101 bp, rice(Oryza sativa)
  misc_feature (71): n=t or c
cttcctatcagcaaccatcataatcaacacatctaaagccataacagtgttcttccggcgtagttgtgcanggtgctcgttttgcttctcagttgaaaccc

SEQ ID NO: 26632 - DNA, 101 bp, rice(Oryza sativa)
  misc_feature (71): n=t or c
acttacatgctcaggaccttcagtccgagcttaataaactctagccaactgccgagatgtttcgcacccgncaaggcccaagtcttggcttcttccttaat

SEQ ID NO: 26633 - DNA, 101 bp, rice(Oryza sativa)
  misc_feature (71): n=t or c
gccgcgcaatctgcgtgggccaccatgctagttatatttattacatttcagctcctgcacgaggacacgangaacgaatgaaaagaaaaaaaaacagaaaa

SEQ ID NO: 26634 - DNA, 101 bp, rice(Oryza sativa)
  misc_feature (71): n=t or c
cagcttgcgttgcgttgcctccatcaacgaaaatggcaaaagatgaaaggaaattatgctattactagaanaggggtgaatagtcaaagtggtcctccaaa

SEQ ID NO: 26635 - DNA, 101 bp, rice(Oryza sativa)
  misc_feature (71): n=t or g
gcgcaggcctcgtggcgcggcgcgatgcgcgtggcgagcgcgtaggagaagtactccgggaactcgaagangtcgtcggcgtcccgggccatgtcgccgag

SEQ ID NO: 26636 - DNA, 101 bp, rice(Oryza sativa)
  misc_feature (71): n=t or c
tactggcggcacgccaacgaaaacctaatttggccgctagcaaaaatcattttcctagtagtgcgatgtangttaattagcacataattacatacttaatt

SEQ ID NO: 26637 - DNA, 101 bp, rice(Oryza sativa)
  misc_feature (71): n=a or g
acgtcaccatgtgtcactctacaaacgcttctacgttgctaagtagcgctataataaattaaataaaatantataaattcttagttaaaataaaacattta

SEQ ID NO: 26638 - DNA, 101 bp, rice(Oryza sativa)
  misc_feature (71): n=t or c
ttggccttatgcagctccttggataagtggtcgtagcgttcaacgagagctctgtaggccctgtaaacctnttccacatggttaatcacctctggcctcct

SEQ ID NO: 26639 - DNA, 101 bp, rice(Oryza sativa)
  misc_feature (71): n=t or c
ataagctggttgcctcccaatggacatgagaaacttgtccagattgcttgagctgagagctgaaatggagnaaatcaggaaaagaaagccattttactaat

SEQ ID NO: 26640 - DNA, 101 bp, rice(Oryza sativa)
  misc_feature (71): n=t or g
aaaaaaaaatggtggcgatttagaaagaaaagtattgacggttacaaagggaagtgttgtaattcccattnttgagtcatactgtattgacttgtgagcga

SEQ ID NO: 26641 - DNA, 101 bp, rice(Oryza sativa)
  misc_feature (71): n=t or g
gtctgtacctgagcatctcttttggctgatcggcaagaatgggagcttcttctgtgtcggatcagaactgngttccatgagactcttctggctggatggcg

SEQ ID NO: 26642 - DNA, 101 bp, rice(Oryza sativa)
  misc_feature (71): n=t or c
aaggttgacacaattgctcagtgatgatggcactgttccattaatgtaattgtttggcaggagaagtttcngaagtgacggcaatgatgagcacagatccg

SEQ ID NO: 26643 - DNA, 101 bp, rice(Oryza sativa)
  misc_feature (71): n=a or c
agggacgaaacggggttaatttctgttgtttcgcactcgtggtttcttacttgcgcacgctagctgtaacncaccagctactggtggtgaagcgtgaaggt

SEQ ID NO: 26644 - DNA, 101 bp, rice(Oryza sativa)
  misc_feature (71): n=a or g
actacttactacatccataaaaaaaaaacccaaacacgaatatagacattgatttgttgtattaggatatntcccatcctatattattattatattattat

SEQ ID NO: 26645 - DNA, 101 bp, rice(Oryza sativa)
  misc_feature (71): n=a or g
gccaggcagctactggctacgactacctagagctcatcatatcatgcaatgcatggagcttgcagtacgcngccggttgctgccgccggccgggcgcagcc

SEQ ID NO: 26646 - DNA, 101 bp, rice(Oryza sativa)
  misc_feature (71): n=a or g
tttgatctgatcaatagaagggctgcctgtttgacaaatctggaacgaggaaaaactcaacaagtggaacnttttttgaatgtctgtgtttggaattgctt

SEQ ID NO: 26647 - DNA, 101 bp, rice(Oryza sativa)
  misc_feature (71): n=a or g
agaactggatggggatgccagttgtgggatggcgcaaggatctctctaggatagcgcatgtgatatctttncatgcttggatggcgtatcctctagagcta

SEQ ID NO: 26648 - DNA, 101 bp, rice(Oryza sativa)
  misc_feature (71): n=t or c
cctcttcctcatctccgcgggcacctccgacctctaccgcatcgccaacatactcgactcgccgtcgccgncgccgccgccgcccgacaacgagaccgaca

SEQ ID NO: 26649 - DNA, 101 bp, rice(Oryza sativa)
  misc_feature (71): n=t or c
ctgtcccagtggagaatccatcgcttttccgcttttcccgcaccaaatccaggtactaccctcctccctcngttccatattaattgacgttttgaataaag

SEQ ID NO: 26650 - DNA, 101 bp, rice(Oryza sativa)
  misc_feature (71): n=a or g
gattcatttactttcttcccttcttgaggagattttgcagcaaaatgggaagaaaatcctacccacatganggtagcataggtcaacagaagcataacctt

SEQ ID NO: 26651 - DNA, 101 bp, rice(Oryza sativa)
  misc_feature (71): n=t or c
ctgccacgccacaccaagcaccaccatagcgcttttattggcaggtttgtctttgggctggtgcgggtggnggtaggagggctcaggagtcgtcgtcgcca

SEQ ID NO: 26652 - DNA, 101 bp, rice(Oryza sativa)
  misc_feature (71): n=t or c
gagaatggggataagcatgtgtatttcgaatgtaaagcgtgtggggatgaagcgggtgggggacatagccngaattttttccgaagcatcggacgtacgta

SEQ ID NO: 26653 - DNA, 101 bp, rice(Oryza sativa)
  misc_feature (71): n=t or c
tctgtctttggttctaaaacacggccgggtggttgtttcagacttgtgcgcaatagtaataactagctccnggctagcacctaaataaaatcatatatttt

SEQ ID NO: 26654 - DNA, 101 bp, rice(Oryza sativa)
  misc_feature (71): n=a or c
gggcgatcagtgggttggtcgcttttataggtagcaatggatggattcctcagcattcgactgcatcgcgnctttatcacttgggactcatttaggacatg

SEQ ID NO: 26655 - DNA, 101 bp, rice(Oryza sativa)
  misc_feature (71): n=t or c
tattcttgcttggtgtaagaaggttatactgtatcttaagcaacatgcaaactctcatattcaattttccnctccaaataacctagaatcatataattaga

SEQ ID NO: 26656 - DNA, 101 bp, rice(Oryza sativa)
  misc_feature (71): n=a or c
gacatgcggacatgtgaaggttgtcattttttttgctatagaaactcatctaccaactcaagaattacaanctatcctgctttcatggcccgtgttaatgc

SEQ ID NO: 26657 - DNA, 101 bp, rice(Oryza sativa)
  misc_feature (71): n=a or g
ctgggatcctacgcctcacatccacatacttcatgcctactacttcccgaaagctgaaaaggttgaagacnttttctgcatgataagaacaacataagtca

SEQ ID NO: 26658 - DNA, 101 bp, rice(Oryza sativa)
  misc_feature (71): n=a or g
tcaattacaaggataccctttcccatcgtgcaggcgacctgagtttttttttctttttcttttacacatgngccctaccttaagccggcacgccggagagt

SEQ ID NO: 26659 - DNA, 101 bp, rice(Oryza sativa)
  misc_feature (71): n=a or g
gatctactccttttctccagttcgtttttctttccgttgtttctcgcttattaagcggagatcagaacggnttataggtcagctgctagagtgccgcaagg

SEQ ID NO: 26660 - DNA, 101 bp, rice(Oryza sativa)
  misc_feature (71): n=t or c
gcctttcccagaggtgatttgttccactccctcaagtgtgcgtgttcatccttctacctggtctacgacgnctccgacgcgtccatcaccatgatccccga

SEQ ID NO: 26661 - DNA, 101 bp, rice(Oryza sativa)
  misc_feature (71): n=a or c
cgtaccactgacgggtacactactgcgtttgttcgagtcatgcttaaattagtgaaacccatcaacaagtnaaaaaaagcttattcttttttaataaaaca

SEQ ID NO: 26662 - DNA, 101 bp, rice(Oryza sativa)
  misc_feature (71): n=a or g
actggaccttatatgcttgggaggctggaatcgtgcacgggggcaagcagatttgatgtgggaggggaagncggcgacgtcagctcgggcggctcggctca

SEQ ID NO: 26663 - DNA, 101 bp, rice(Oryza sativa)
  misc_feature (71): n=t or g
aatcacacgagagatacctagacagtcccatggtctgatgcgagctaggcctagtacaggcaaccaaacanaccctaaatagaccctaagtgtccagctac

SEQ ID NO: 26664 - DNA, 101 bp, rice(Oryza sativa)
  misc_feature (71): n=a or g
ttagtaattcggaacttctgtttgtgtttcaagcagtatcacaatttcgttcaggtgtcacgccttaaacntttttttctgaatatccaggagctgttgat

SEQ ID NO: 26665 - DNA, 101 bp, rice(Oryza sativa)
  misc_feature (71): n=a or g
tcagtgagggctcagttgatgggggtcacttggtttgaattatgtgacagagtttgtgctagattctctcnggacagacagcaagctcttattagacagtg

SEQ ID NO: 26666 - DNA, 101 bp, rice(Oryza sativa)
  misc_feature (71): n=t or c
catcacgtcgtggtcggcgtaccagacggccaaggagaaaggcgtcgagctgctcgacgaggcgacggtgngcgggttcgccgacgcgtggggcggcgaca

SEQ ID NO: 26667 - DNA, 101 bp, rice(Oryza sativa)
  misc_feature (71): n=t or c
gcatcatcgacaagcttgcggatcaactcaaaatggaagaattcccaccaaggaggtcccaaggcttcaanagattgacgacctagttgccggtccctctc

SEQ ID NO: 26668 - DNA, 101 bp, rice(Oryza sativa)
  misc_feature (71): n=a or c
tacatccccctaggtctagtttccacgcctagtagagtgatgatgttgaagactggtgtagctttccctgnccgaagccccccatacccagacctggttgc

SEQ ID NO: 26669 - DNA, 101 bp, rice(Oryza sativa)
  misc_feature (71): n=a or g
cacccgcactcgcgctccttaagcccttacgctttcgccactccacgctatttcacacaccaaacctctcntcgcttcaccgccagtcaccatggcccaag

SEQ ID NO: 26670 - DNA, 101 bp, rice(Oryza sativa)
  misc_feature (71): n=a or g
taaccatgataaaagagactccaaatcgttcgtagattgttcgtaactgcaagaatataagcagacggatntaatctcacaactgatcaaatttaacatac

SEQ ID NO: 26671 - DNA, 101 bp, rice(Oryza sativa)
  misc_feature (71): n=t or c
attaatattgaacctcaatttggcatcctggttggtgttgtctttggcagagacgatagcttcgcgggaanggaggtccggggcagcgcagagagcccgtg

SEQ ID NO: 26672 - DNA, 101 bp, rice(Oryza sativa)
  misc_feature (71): n=a or c
aaagtggtttagtggagatatggcgctgaagggtgaaactatctttgaatttaaagaattactcaccgatnaacttcagaaaatccttatccacattatgg

SEQ ID NO: 26673 - DNA, 101 bp, rice(Oryza sativa)
  misc_feature (71): n=t or c
tattgatgtttatttctataggttcctcctccactttattcaaatattgatatctacatacagatacgtgnagagacgtgcagggtctctaatacatgaga

SEQ ID NO: 26674 - DNA, 101 bp, rice(Oryza sativa)
  misc_feature (71): n=a or g
aaccggtatctttgtagaaagcaaagatatatgtcactactacagaaagtatttctgcaggcagcccaacngacatcttcccgtgcggaaaaccggtccgc

SEQ ID NO: 26675 - DNA, 101 bp, rice(Oryza sativa)
  misc_feature (71): n=a or g
attatcgttttctccaaccatgcagagacccatatgttgaacaaaggtgaagctgtgctgtggagacctgntaaaattttctaataatgcttgtgcaaatg

SEQ ID NO: 26676 - DNA, 101 bp, rice(Oryza sativa)
  misc_feature (71): n=t or g
tgttacggatggatgcatggatgatgtggttgaccaacccgtcgtcagttgttcattgatcatacgcatcngagaaagaaagagactttccgtctttcttt

SEQ ID NO: 26677 - DNA, 101 bp, rice(Oryza sativa)
  misc_feature (71): n=t or c
cacaatctcaccgtttgaactactaataacgactctaactaccagccaccagcttccgtgcactttttgtngtaataagtgtcgatctaatttgaattttg

SEQ ID NO: 26678 - DNA, 101 bp, rice(Oryza sativa)
  misc_feature (71): n=a or g
aaaaaatacacttttatatattgttctacatcaggactcatgatttacaatgttagtaagttttaccacanaattaaaattaaaaataaaggacatggtct

SEQ ID NO: 26679 - DNA, 101 bp, rice(Oryza sativa)
  misc_feature (71): n=a or g
ttagagcaacgcgaagccgtccagcataacatgcaactgactttactgccatcagctcacggcgtcaaacncctaaccgcagctagaccttggcgtcgatt

SEQ ID NO: 26680 - DNA, 101 bp, rice(Oryza sativa)
  misc_feature (71): n=a or g
tcagcgtaagtattctcttgcatctttgtccaagttgcttttttctcaaaacagaattggaactgtttctntcttgtatgtttgaaaccagaattatttca

SEQ ID NO: 26681 - DNA, 101 bp, rice(Oryza sativa)
  misc_feature (71): n=t or c
aaaggcaagcgagtatgcgttgtcaagacgaacaaagagacgactcctcacgaaccggactcagcgtatcnagactccgacctccacgtctcacacatatt

SEQ ID NO: 26682 - DNA, 101 bp, rice(Oryza sativa)
  misc_feature (71): n=a or g
ctgcgtttcatttcattaaggagaagaaaacaaaggagagaccaaggccctcccaccgagacacacacgcncacaacccagcccacactgggaagtgctag

SEQ ID NO: 26683 - DNA, 101 bp, rice(Oryza sativa)
  misc_feature (71): n=a or c
ccattgtgacgcaagggcaatatgctagtggccttaaaacctgcaaagcaataggttccaacaggtcgaanttcagtgaagaacactgaatttgtggactt

SEQ ID NO: 26684 - DNA, 101 bp, rice(Oryza sativa)
  misc_feature (71): n=t or g
accggctactactcactccgtcccaaaaataacctaaccctggatttgaacctgacatatctgtgtccaantttaaacctaacatgtgtctaggtttaaat

SEQ ID NO: 26685 - DNA, 101 bp, rice(Oryza sativa)
  misc_feature (71): n=a or g
ggcaagtgcagtcgcattcatctccaagagtaaagaagctagataggcagcctaccttgctacgaacatgngcagctgcagaagcagcaatggcggcaacg

SEQ ID NO: 26686 - DNA, 101 bp, rice(Oryza sativa)
  misc_feature (71): n=t or g
ctccccgagaaagcgcaatcttttttaacagcacaagtaagacaattctcacggacatcgtgttatcggcnctacgttatatgcggctaggaatctatgac

SEQ ID NO: 26687 - DNA, 101 bp, rice(Oryza sativa)
  misc_feature (71): n=a or g
tgctctatttcaaactctgcttgtacaagcacaccggcctgaccacgctgtctacttgtaaaaatatgatnttttctaatccatttagattagaaaatatc

SEQ ID NO: 26688 - DNA, 101 bp, rice(Oryza sativa)
  misc_feature (71): n=t or c
cctaaacccttgggtagtggtccattcaaacggttttcccctagggttcgaaaagtctgggttaaaaaatnggttgtcaagcctaagtccccccgtcttcc

SEQ ID NO: 26689 - DNA, 101 bp, rice(Oryza sativa)
  misc_feature (71): n=t or c
caaaggccagacacaagaggaggcattgcaaacatggtgaggcggttgatgcaaaaccaagatatagtggnaggccaggcggcttcatctgcaccccggcc

SEQ ID NO: 26690 - DNA, 101 bp, rice(Oryza sativa)
  misc_feature (71): n=a or g
atgcatgcatctacagacttacggttataccaggtcatagagattccatttttccatagaccaacactgtntttagttccacgccaaaattgaaagtttga

SEQ ID NO: 26691 - DNA, 101 bp, rice(Oryza sativa)
  misc_feature (71): n=a or g
tatatatatatttaaaaaaaaggtatggtgagttatagtgactagtgactagggcacaccaagcagagcanagaagaaaatttctgcattgtgcacttaat

SEQ ID NO: 26692 - DNA, 101 bp, rice(Oryza sativa)
  misc_feature (71): n=a or c
agcaactgattttaggttcgtttcgctaatccctagtaatgattttaggatatatatataagctgtcatgnatttatcaacaccgcttgaacctcgacaac

SEQ ID NO: 26693 - DNA, 101 bp, rice(Oryza sativa)
  misc_feature (71): n=t or c
gtcgatgtgcttgctgcgatcgtggaagacagggtttttgctaagcatgatggcagattggttgtcaatcntcaatgtgacggcgtcggcctcctctccct

SEQ ID NO: 26694 - DNA, 101 bp, rice(Oryza sativa)
  misc_feature (71): n=t or g
ttacctccgaggggcggggatttggcctccgaagtcggaggagtcggccctcgcccagtgcatctgcttcngctgcagctgcggcgtcattgctctctctc

SEQ ID NO: 26695 - DNA, 101 bp, rice(Oryza sativa)
  misc_feature (71): n=a or c
tcaaaacatacgtactaccttaaccataggagtatctctcttacatgtgggggagtgaattttaaactcgngagagacatcccctcattatttacatatca

SEQ ID NO: 26696 - DNA, 101 bp, rice(Oryza sativa)
  misc_feature (71): n=a or g
attgttttttttgctacttgcatgttgatttcgagtcaaactcgcgccatgccccacatgagttgctcccnacatccctgaatcatccacgagaatgaaat

SEQ ID NO: 26697 - DNA, 101 bp, rice(Oryza sativa)
  misc_feature (71): n=t or c
tgatctgtgatgccgcatttacatgtggtgcacactcatcactacaacttctcctatggtattaacatacngtctctctgtttggtcatgatcctggtagt

SEQ ID NO: 26698 - DNA, 101 bp, rice(Oryza sativa)
  misc_feature (71): n=t or c
gtagtatgctttgtgggctggaatttctttttagcaataattggaggcccattcgattcacagaaactgtngcatatgcccccaactatgcatgctctttc

SEQ ID NO: 26699 - DNA, 101 bp, rice(Oryza sativa)
  misc_feature (71): n=t or c
atgaccccatgagactactgtctacgatgtataaagcggcccacctatgatgtcgttggcctcgtggttgnagcgccggcgatcgatgagggtctcctcca

SEQ ID NO: 26700 - DNA, 101 bp, rice(Oryza sativa)
  misc_feature (71): n=t or c
cacatatattgttagatcaattattaagacatatttccttcctttccaaaataaataaacaaatcttgtangagatgtggcctattatgaaatgtgacatc

SEQ ID NO: 26701 - DNA, 101 bp, rice(Oryza sativa)
  misc_feature (71): n=a or g
taaaaaaattggatagcataagaaaacatgcagcttgtgaataaaaaaaacagaatccacagcaatcgtcntggccaaccaggcggcggcggcgcgcgtgg

SEQ ID NO: 26702 - DNA, 101 bp, rice(Oryza sativa)
  misc_feature (71): n=t or g
agggcactgcgatagttggaaggaaccggcgaaacagcatcatgagtggctgtataagtgaaacgctgganaggtcggagatggccggtctgagaacgagt

SEQ ID NO: 26703 - DNA, 101 bp, rice(Oryza sativa)
  misc_feature (71): n=t or g
ctgatcctctgattaaaaataattactagatcaaaagactggccaaaacatacgcacattcaccccccatnaacatctccaaaaatttcggtgcgtgttgt

SEQ ID NO: 26704 - DNA, 101 bp, rice(Oryza sativa)
  misc_feature (71): n=t or c
gtcaattggacaaagacatgtctgccaactaggcaaggaggcctgaggatcctgaacctagaaaaattcangagagccctgcgtctacgctggctgtggca

SEQ ID NO: 26705 - DNA, 101 bp, rice(Oryza sativa)
  misc_feature (71): n=t or g
attttgttactggtgaaaaaagatggggtatcagtaatgtaggaaaatttgaccaggccacaaatggaatngacataatatatagctccgaccattttcag

SEQ ID NO: 26706 - DNA, 101 bp, rice(Oryza sativa)
  misc_feature (71): n=a or g
ctacttgtgcgtccgcatctttaatcagaagcatcggttctgaagttctgatcagtctgaaactcacatcntacgaagcaattactagttaatttgaattt

SEQ ID NO: 26707 - DNA, 101 bp, rice(Oryza sativa)
  misc_feature (71): n=t or g
gacaacgtacacaagcatgcatgtccaagtagtagtagtattagtttgaactagagaaagagcaagcaaancgccgtcggggcggggcatcgtgttcgcag

SEQ ID NO: 26708 - DNA, 101 bp, rice(Oryza sativa)
  misc_feature (71): n=t or c
tgcaaccaatagttactactcctactacatgttatttgatgttaagctatagctacagagaggcagcatcnagcaagcaggttaggtagagatagatactc

SEQ ID NO: 26709 - DNA, 101 bp, rice(Oryza sativa)
  misc_feature (71): n=t or g
gtgagtttgagttgacttgaaataggataggtcgtcagcggctgatttcccttggacagaaacataaacgnttgacgatttggatgcagtaacgacggaaa

SEQ ID NO: 26710 - DNA, 101 bp, rice(Oryza sativa)
  misc_feature (71): n=a or g
gcccgcagtgaatttccatttcgacctaactgaaatggtgagatctgctcggtttaggccggagaattganggccagagctggcttccagttgggtggtga

SEQ ID NO: 26711 - DNA, 101 bp, rice(Oryza sativa)
  misc_feature (71): n=a or g
gccgccaccgccggtgcaatggtggtggacaagagcgtggagatggtggacgtctcgtcggcggtgtacgncggcgcgacggcgacggcgttcgatctaga

SEQ ID NO: 26712 - DNA, 101 bp, rice(Oryza sativa)
  misc_feature (71): n=a or g
aaatgtgattgacattaagtcaaagactaaccaacgaccgtccattctactagtatcattagaaatcaccntgaagatcataataatactgctgatagaat

SEQ ID NO: 26713 - DNA, 101 bp, rice(Oryza sativa)
  misc_feature (71): n=a or g
ctataagtgaaagtgaccagaaactagaccccggacccacttactagattttcagatataagttgtagggnccagtaccccggtgtacacctggccaccca

SEQ ID NO: 26714 - DNA, 101 bp, rice(Oryza sativa)
  misc_feature (71): n=a or g
caattttcatgttagggctgatgacgaggctgggatcatctatacatggggcggtgaagaattctcattcncgggtgagagcgccagggtcccacgaattt

SEQ ID NO: 26715 - DNA, 101 bp, rice(Oryza sativa)
  misc_feature (71): n=a or g
ttttgaattgtcaataatctcctacaagttcttctgtttaagggcgattatttctggagtgcttctatatngtttgttcagctctaccttagtgaaagtac

SEQ ID NO: 26716 - DNA, 101 bp, rice(Oryza sativa)
  misc_feature (71): n=t or g
gtacagccgtacactgactcactgctcaccggccgccgtctccgtttgtcgtacacaaaactcactgctanatacaccctccatcctaaaataagttcatt

SEQ ID NO: 26717 - DNA, 101 bp, rice(Oryza sativa)
  misc_feature (71): n=t or c
catatattgctgcgttaacacgtaaagcggggttgctacctgtttgaacctatacatcacagggcaagttnaagtttgaggacgacctgaaaatgcatttt

SEQ ID NO: 26718 - DNA, 101 bp, rice(Oryza sativa)
  misc_feature (71): n=a or c
ccaaagttcttttgtcagtggcttcaagaatacccatttggttgttgattcagattcattcttcgcaagcncaagcattgaaaccccagactcggtgtacg

SEQ ID NO: 26719 - DNA, 101 bp, rice(Oryza sativa)
  misc_feature (71): n=a or c
ttgattctcaaaagctatgaaggtgaatgagcactttctggaaagtttattgagtctattttcaacccaanaaaccgctcgtccattgaatttcccactaa

SEQ ID NO: 26720 - DNA, 101 bp, rice(Oryza sativa)
  misc_feature (71): n=a or g
gcagctgtcaaccaagcacctcactcgatacaaccttgatgcctctgcttatctcaccaatgcaacctcgntctcctacctcatctccctccccagactga

SEQ ID NO: 26721 - DNA, 101 bp, rice(Oryza sativa)
  misc_feature (71): n=a or c
agaaatagaatatgggggcttggtgtaatgttgtttagttggcatggttggcagtgctagcatctaatatntgtggggtttctggttgaattctgaaaggg

SEQ ID NO: 26722 - DNA, 101 bp, rice(Oryza sativa)
  misc_feature (71): n=t or c
gatattaatagaacatatcataagttaagattatgagcaagcacgtgtaatgctactcctaattaatcaantaattaagttctccagctctgtaaaggcat

SEQ ID NO: 26723 - DNA, 101 bp, rice(Oryza sativa)
  misc_feature (71): n=t or c
gtgccgtggtggtcaggggagtagagcagtatctctacatcgtcgtcgccgccgcctcccatgtcgttgcngtcgccgccgcttgagaagggaggcgggag

SEQ ID NO: 26724 - DNA, 101 bp, rice(Oryza sativa)
  misc_feature (71): n=a or c
aacgatttgacaagttttccggaaggaaaaaaggctgcaaaagccgatctggctgagtgcggttgtgtaantgtaacttttttcttctaatatatcgacgt

SEQ ID NO: 26725 - DNA, 101 bp, rice(Oryza sativa)
  misc_feature (71): n=t or c
ctttgggctgttgctatgttggaatacatctgttgggatgagatttggaggttttggtggccattttgccnaccattcttgctctctcatcttaatagcga

SEQ ID NO: 26726 - DNA, 101 bp, rice(Oryza sativa)
  misc_feature (71): n=a or g
actagtgacatcattcagctacctcatgttgatatgcatgtttataaccatgcaaggcgcttgactaatcnaaaattggaagcagtgttcagaattctaac

SEQ ID NO: 26727 - DNA, 101 bp, rice(Oryza sativa)
  misc_feature (71): n=t or g
ttgaagtaactcagaggagcgttaatgcaattcagaagattaaacccctagaagacaagaagcagctacanaagttgatcgacaaggtgaattttgttagg

SEQ ID NO: 26728 - DNA, 101 bp, rice(Oryza sativa)
  misc_feature (71): n=a or g
tactaataaacagtttgtgtagttggacagtacatgttgcaccgtacaatgctaataatatactcccttcntactcataaaggaagtcgtttagtacagcg

SEQ ID NO: 26729 - DNA, 101 bp, rice(Oryza sativa)
  misc_feature (71): n=t or c
gtttggcacgctgttcacgcggactcggtagtcctcaccatttcccacgaaaaatggcgcgactcctccgnagtgcttgcttcggccttgagaacctcctg

SEQ ID NO: 26730 - DNA, 101 bp, rice(Oryza sativa)
  misc_feature (71): n=a or g
aactccaacattggagctactaggatatcttaattagcatgtattaccatcttcattcatatacaacgccnttaacttttcaataagataaatgatcaaaa

SEQ ID NO: 26731 - DNA, 101 bp, rice(Oryza sativa)
  misc_feature (71): n=a or g
gagggatttgatcgatctcccgagtccaatttcatgcagctacagtgcagaatctatatacgtactgatcnccacgcatctagcacacgctcgatagaccc

SEQ ID NO: 26732 - DNA, 101 bp, rice(Oryza sativa)
  misc_feature (71): n=a or g
ctcccgtctccaagcaaaagcaaagcaagcaagcgaacccacccacttaattagctgctactggtatggtngagaacggaccgatgggcgttgctattcgc

SEQ ID NO: 26733 - DNA, 101 bp, rice(Oryza sativa)
  misc_feature (71): n=a or g
tgttgtcttaccccatccgagacaaatattcacgccaactataaagaaactgcaccctacagaggtgtgcnaaccatgcaggaggtccatgtgtcctcagc

SEQ ID NO: 26734 - DNA, 101 bp, rice(Oryza sativa)
  misc_feature (71): n=a or g
taggacatcattcctgaatttgaacgatacttcatccgttcccaattgttcatcatattacatgatcaagnaaaatcaataactcttctatactatattta

SEQ ID NO: 26735 - DNA, 101 bp, rice(Oryza sativa)
  misc_feature (71): n=a or g
tcgcattctgattcaagtgcaagcttaaagaagcccaacgatatagagtgcttggaagcagcctctgcaancctgatttgtgtcatccaatatgaggttga

SEQ ID NO: 26736 - DNA, 101 bp, rice(Oryza sativa)
  misc_feature (71): n=a or g
ccctgagcttgccgatgcggcaacagtgtcatgaggagctgcaaccatcgctggttgtggacccgagctcngtggtggcggcacaagaaggcggtgcacgg

SEQ ID NO: 26737 - DNA, 101 bp, rice(Oryza sativa)
  misc_feature (71): n=a or c
ttcttgtgttctgacgtgcatgcatgcatgattatatatatacttgtcttttagcagtacaattaatgatnaaatgatgcagacagattaacttaaaagat

SEQ ID NO: 26738 - DNA, 101 bp, rice(Oryza sativa)
  misc_feature (71): n=t or g
attcaagtgaacaagttgatatctaggagtaataaggcagtagtttgtcttaatgaactgtgccttgctcnggagagtaatacattccctgcttctgtttg

SEQ ID NO: 26739 - DNA, 101 bp, rice(Oryza sativa)
  misc_feature (71): n=a or g
acgtcctactcgtcggccgccgccacagcatctgcacgagactcgctacttgtacaatgggtggcaccctnccttccgtaggtgatccagttcatcttcca

SEQ ID NO: 26740 - DNA, 101 bp, rice(Oryza sativa)
  misc_feature (71): n=a or g
gaaaacgtgctcgctcgaaaactctgaaactgaagtggtttacttgggagaacaagtcgaggggatgcttncgcacaacggctttggctttataccacccc

SEQ ID NO: 26741 - DNA, 101 bp, rice(Oryza sativa)
  misc_feature (71): n=a or g
tggatttgggaatgtcctgataggttgggctaaggtgaatgtgaatagatcgttctccacttcagatggtnctgctggtattggtgtggtcattcgggacc

SEQ ID NO: 26742 - DNA, 101 bp, rice(Oryza sativa)
  misc_feature (71): n=a or c
caccgtctctattacggcaacctaaatcgagggttcgcccaacatactctaagttaccaaccaacacaacntgtaatcaatcaaggaaaaatctcgaaggg

SEQ ID NO: 26743 - DNA, 101 bp, rice(Oryza sativa)
  misc_feature (71): n=a or c
tcattcaccccccatgggtacttctctctaatgtgatcaataaaatccttgaagtttgttctgtcgctatntatcacttcctctgttctaaatgtaaagtt

SEQ ID NO: 26744 - DNA, 101 bp, rice(Oryza sativa)
  misc_feature (71): n=t or c
ttccttcactccgaaggtggtgaactccaaaccagtcaacaccggcgccagggcctcctccacaatcttcncagagaggtcaccgggaaactcctccacaa

SEQ ID NO: 26745 - DNA, 101 bp, rice(Oryza sativa)
  misc_feature (71): n=t or c
cttgtgtgtaatttgattcagctacaaaggtcatgaccaaattgttaatctcaataggagccaatctaggnttccacatgactatgatttcttgatgtgtt

SEQ ID NO: 26746 - DNA, 101 bp, rice(Oryza sativa)
  misc_feature (71): n=a or c
ccgaccccatttgacgttttctttcttaaaaaaaaaaggaactgacgtcagtgtggcaacgttgttcgggntggtctcccctccggcacgtctcaagccag

SEQ ID NO: 26747 - DNA, 101 bp, rice(Oryza sativa)
  misc_feature (71): n=a or g
aaatcgatgagaaaatccttctcactgatttgctttaccttccaatctcacctctcatgtttgaacaaatntttcatctcagcaatcattttatccacata

SEQ ID NO: 26748 - DNA, 101 bp, rice(Oryza sativa)
  misc_feature (71): n=a or g
cgagtttaccgtgcatcagaatcggttgcttgatcagtagagagagctgctctctgatgagctcgtgaganagcatggaaatttttggctgctggaacggc

SEQ ID NO: 26749 - DNA, 101 bp, rice(Oryza sativa)
  misc_feature (71): n=a or c
agatgagcaaataaacacattcatgtcaatgtcacgatgagttgattgctgtcatcagctgctataacacntgtacttgatttttttctttttttttccgg

SEQ ID NO: 26750 - DNA, 101 bp, rice(Oryza sativa)
  misc_feature (71): n=a or g
tgtgatcaatttacttttttatgaatgtaaatattccactacatcggaaatctagtggtgcggtgtacgcntgaatgcctttggccttgtccaggcactac

SEQ ID NO: 26751 - DNA, 101 bp, rice(Oryza sativa)
  misc_feature (71): n=a or g
atctaagatgctacttcgatgatcctcctgagaacgatgtcgatgatcctcttttgaattacagtaaagtntatgggttgtacttacaacttgtagagatg

SEQ ID NO: 26752 - DNA, 101 bp, rice(Oryza sativa)
  misc_feature (71): n=a or g
taaactagtcttggttgtacccctctttaaatgcttcatatcgccgcgaaagttaaatatggacacagctncgaacaccaccattcaggcctaaaattgta

SEQ ID NO: 26753 - DNA, 101 bp, rice(Oryza sativa)
  misc_feature (71): n=t or c
cccgactagttttttggttagtgcatgtcgagtcaagaaagaaaacgagagctgatctgcaattatcatgngatgatacgacgactaattaataaaatctg

SEQ ID NO: 26754 - DNA, 101 bp, rice(Oryza sativa)
  misc_feature (71): n=t or c
aacttgcttgagatactcgaaatttgttgggaactcatcagagatagactggagcagcggacggctcaatnggtgactttagggacactgacatgtagatc

SEQ ID NO: 26755 - DNA, 101 bp, rice(Oryza sativa)
  misc_feature (71): n=t or c
ggtggttttgcatattttgatgcttaaacagacagttttaagtaaagaatatacatatgtactacctccgnttcaaaatgtttgacgccgttgacttttta

SEQ ID NO: 26756 - DNA, 101 bp, rice(Oryza sativa)
  misc_feature (71): n=a or g
caactgcccactgcaccgaggctgattccgttggatccacatacaggttaggccctttaccaaatatgttngatactactccttgagatgaaaatctgaat

SEQ ID NO: 26757 - DNA, 101 bp, rice(Oryza sativa)
  misc_feature (71): n=t or c
ccgaggcagatcttagctcatcttcttaagatatagctcttgcatgtttctatgcctctcttgccgaggancatagaacctgcaaggggcccagggccgag

SEQ ID NO: 26758 - DNA, 101 bp, rice(Oryza sativa)
  misc_feature (71): n=t or c
tccaaattaatccgttgttgttcaagtgcaagtgcagctctgtacctctcctctctttggcgctccttctnagcatcggcctctttcttcttagcccataa

SEQ ID NO: 26759 - DNA, 101 bp, rice(Oryza sativa)
  misc_feature (71): n=t or g
gtgcttacttctggacgtgtccgccttctcctccacaggggtagatgtttaagatgcttacatttgaatgnttatgtttcattttgctttgctggcaggtg

SEQ ID NO: 26760 - DNA, 101 bp, rice(Oryza sativa)
  misc_feature (71): n=a or g
tgtcacgtacaagttgctggctggactgtgtgcaactgactagtcgtggtcacagaagttagtacagtgtncctttgacagctgttgctgctgtcgatggg

SEQ ID NO: 26761 - DNA, 101 bp, rice(Oryza sativa)
  misc_feature (71): n=t or c
aagcttgaaaagcacaatctaagggtgagaaagattagtgatggtgcaatttcaagtggtagctttatagnaataactaccactaagtgggtttcaactgt

SEQ ID NO: 26762 - DNA, 101 bp, rice(Oryza sativa)
  misc_feature (71): n=t or c
gttttttttgggacggagagagtactttgctacaggcatactatgccagggttgttcctgcatacaagctnatttgaaataagggagaatgctttgcatta

SEQ ID NO: 26763 - DNA, 101 bp, rice(Oryza sativa)
  misc_feature (71): n=t or g
aacacttgttaggcccggacttcataatttggtccgaaaggatgcattactttacatgggctttctcatgnactagtaatgtagcccaatgtcatcgtcat

SEQ ID NO: 26764 - DNA, 101 bp, rice(Oryza sativa)
  misc_feature (71): n=t or c
gccacgacctcaatgtactcagatcagtgacatcatgagttggaggttgtgaagcacgactgatccgattnatcaagtaaggttgaatactctctagacgt

SEQ ID NO: 26765 - DNA, 101 bp, rice(Oryza sativa)
  misc_feature (71): n=t or c
aaaggtaggacctaggagacaacggattgtgcaggggctaaaaataaaaaaaaataatgggctttcggctnaaaaccaagaaaatattttgattaaccttt

SEQ ID NO: 26766 - DNA, 101 bp, rice(Oryza sativa)
  misc_feature (71): n=a or g
ctttggtcacatcatccatgtaccgaaacgacaatgcagcaccaaagttcttcctctcctccgcgaaatcntcatcgtcatccgtatcgtcactggaggag

SEQ ID NO: 26767 - DNA, 101 bp, rice(Oryza sativa)
  misc_feature (71): n=t or c
taggttagtttttcacagaagcatcataagtttgaacggaatgcactgtcaagttctacattgtaaacaanaacttgtggtacttttatttttgatgagta

SEQ ID NO: 26768 - DNA, 101 bp, rice(Oryza sativa)
  misc_feature (71): n=t or g
tcgtactctccatacatgtgcacccccttcgaagaaactgcctgcaaaaggtcgaaaaatttgcatcaatnctcccgagattcgcaccacttccatcagcc

SEQ ID NO: 26769 - DNA, 101 bp, rice(Oryza sativa)
  misc_feature (71): n=t or g
ccaaattcatttgctcggttgatgactgaaaaagaaacattataccgtgcttggttgctctcagctttccngttgctcgccgcaatacgacctttaggagc

SEQ ID NO: 26770 - DNA, 101 bp, rice(Oryza sativa)
  misc_feature (71): n=a or g
cctgtacatgtcactaaatggaagcaggctaggctaccctctggattcgagcaatgatctgtttctatgtnagaaatcttttctggatggatttgtgcatg

SEQ ID NO: 26771 - DNA, 101 bp, rice(Oryza sativa)
  misc_feature (71): n=t or c
aacaaggaagcaacttgcagggttgatagagaggaatgcagacaggaaggaaattagacaagctactgatngtatgaatgaattgttatatagagaagaga

SEQ ID NO: 26772 - DNA, 101 bp, rice(Oryza sativa)
  misc_feature (71): n=t or c
tctttgatttaaaggggccttagcttttgaagtggcatgcatgtgcttagaaatgacatctaccaatctcngttgcatcacagaccattagtggtaattga

SEQ ID NO: 26773 - DNA, 101 bp, rice(Oryza sativa)
  misc_feature (71): n=t or c
cctttacagtcgatgaaatagtcttctctcgtaatccaaaaggataatgcgagtgctccaacttcttctgntttggcctcccgagtactaagatcaaagac

SEQ ID NO: 26774 - DNA, 101 bp, rice(Oryza sativa)
  misc_feature (71): n=a or g
catttgtctatctcaagataattttctataattctggtgcagtgcactatttatcatttatcggtgccgtncacttggatcgacaaaggacacgatataaa

SEQ ID NO: 26775 - DNA, 101 bp, rice(Oryza sativa)
  misc_feature (71): n=t or c
ctctctttccgacggaatgagaaggactctctcggtgtagcctgggccagattctcattgttaactcaatntggcccagacttgtctttaccccaccatgt

SEQ ID NO: 26776 - DNA, 101 bp, rice(Oryza sativa)
  misc_feature (71): n=a or g
cctccatcttcttcaggagcaaatcgagtttgctgtcctgatcgaggacctttgccgccatcttcatcacntagcggggcttgtcatagtcagccgtggct

SEQ ID NO: 26777 - DNA, 101 bp, rice(Oryza sativa)
  misc_feature (71): n=t or c
ccacatgtcatgagaaatagtgtctgactgtttttatgtcatttgataaaaatacctcacaaaaatctttngaattttgaaccatcagattgctttaagat

SEQ ID NO: 26778 - DNA, 101 bp, rice(Oryza sativa)
  misc_feature (71): n=a or g
tgatgccaatgggatgtacattctccttgtccaatcttagggcttgttcagtttgtaggattatcaaaatntagaaaaagagaaaagataggaataatata

SEQ ID NO: 26779 - DNA, 101 bp, rice(Oryza sativa)
  misc_feature (71): n=t or c
ttaactcctaaaaatgaaaatggatctaacactacaccaacataattgtctcatctctccactgccttgcngtcgccgaagcaggccgctcggcatgcatc

SEQ ID NO: 26780 - DNA, 101 bp, rice(Oryza sativa)
  misc_feature (71): n=a or g
acctccctaacataatattgacataggacgtaccattacgcatctgatcaagaagccagaaaagcatatgnttgtcacatatccaacctatgaaaaagtag

SEQ ID NO: 26781 - DNA, 101 bp, rice(Oryza sativa)
  misc_feature (71): n=a or g
agacctcggcgtctgggcttaggcagttgtcctgtgctgcagtggtgatcacctcgaacatgtcttcatcngagcggtcatcaccgatgcagaggacaaag

SEQ ID NO: 26782 - DNA, 101 bp, rice(Oryza sativa)
  misc_feature (71): n=t or c
atgggagcacctatatgtagtcgattcggaaaagtttttggaatgaatgttgctcggacagcactgtgttnatcaattaattttgccctgaacaatagtca

SEQ ID NO: 26783 - DNA, 101 bp, rice(Oryza sativa)
  misc_feature (71): n=a or g
atacttgaggatggtccaaaatgccacaaaggtaaaagcgcctggttcaaaagtgaaaatattggttaaanggtaattcaaagcgaaacatcgataataaa

SEQ ID NO: 26784 - DNA, 101 bp, rice(Oryza sativa)
  misc_feature (71): n=t or c
atgccccccctgtctttttggcaaacttatgagccaaaaaaatactatgcatgagatcatctaagggcganatccaccaataccgaccatgaattcctcta

SEQ ID NO: 26785 - DNA, 101 bp, rice(Oryza sativa)
  misc_feature (71): n=a or g
ccacgatgattggaagtggtgctaatagtagagattgatgcgacgttaggtagagggagaggcgagatgtngggggggggggtgagggggagcgatatata

SEQ ID NO: 26786 - DNA, 101 bp, rice(Oryza sativa)
  misc_feature (71): n=a or g
gggatacgcttttcatttctgttctgcagcatggcttgttattcttagatccactagtttaatttaaaacnttttgactttgtatgtgccttttcatcttt

SEQ ID NO: 26787 - DNA, 101 bp, rice(Oryza sativa)
  misc_feature (71): n=a or g
tatactttgaaaatggaaagtataaatcggtatggatagaaatatgccaatcacaccgaaattagggggcnaaattagggggcttaatttttgtacgatca

SEQ ID NO: 26788 - DNA, 101 bp, rice(Oryza sativa)
  misc_feature (71): n=a or g
caggatcagtttagcacaactatctggaagcatgcattagcaatttcagctgaaaaatcttaggtttccgngtcaaagaagtactccatccacaaatataa

SEQ ID NO: 26789 - DNA, 101 bp, rice(Oryza sativa)
  misc_feature (71): n=a or c
ttagcaattcgagatgtgcgtaaaggactagtaaaggactagtgtgtagatctcaagaactttgcacattngaacacagccaagcatagttggctcaattt

SEQ ID NO: 26790 - DNA, 101 bp, rice(Oryza sativa)
  misc_feature (71): n=a or g
ctttgcgtaaattcgatctagtgtcaaattttaggatcaatggtatatatgcacacgtcaaatttttttantaattaaaaaagaagaacatagtagaaacg

SEQ ID NO: 26791 - DNA, 101 bp, rice(Oryza sativa)
  misc_feature (71): n=a or g
tgatttttcttatttttttttcacatgcataggcatttgaattttcaagttcagatactccacgaggacantaaaatttaggagatgttaaaacaaacaaa

SEQ ID NO: 26792 - DNA, 101 bp, rice(Oryza sativa)
  misc_feature (71): n=t or g
agaagagaaaaaggaagggagagatctatttctgtttttacgtggggcctttcgatcctaaggtcgacggnagtcaatctccacctagtgagtcgtgtccg

SEQ ID NO: 26793 - DNA, 101 bp, rice(Oryza sativa)
  misc_feature (71): n=a or c
ttagatgagagaaaattcagatgggcccatatagaaagagcttctgtgattaattggtactccctccgtcngaaaataagcgcagtcataagtttccgtgt

SEQ ID NO: 26794 - DNA, 101 bp, rice(Oryza sativa)
  misc_feature (71): n=a or g
aatcctcaatgtgtgctctccatttctagagattaccatgttattagtgggataaaaagagagataagtangcataaaacttatccaatgtaggaaataat

SEQ ID NO: 26795 - DNA, 101 bp, rice(Oryza sativa)
  misc_feature (71): n=t or c
tattagcttggaataattggcagtcactgctgcatgatgcaggcaaggcctgctcaaattaatgatagaantagaagaaactaaccttcgtactacgttct

SEQ ID NO: 26796 - DNA, 101 bp, rice(Oryza sativa)
  misc_feature (71): n=t or c
aaaagaatctcgatgagaaattcatgaaaaccaacccacaccactccacggtaaaacgtactccctccgtnccaaaatacttaatttctaattgtcctgtc

SEQ ID NO: 26797 - DNA, 101 bp, rice(Oryza sativa)
  misc_feature (71): n=t or c
acttagccacaatttttttggcaaagtgtggcaagcaacacattgtgttgtcaataatttgttgcattgtngcaagaaaataaaactatgacaatgcaccc

SEQ ID NO: 26798 - DNA, 101 bp, rice(Oryza sativa)
  misc_feature (71): n=t or c
tcacatatatgttttcaatcctagcgccacgtcaacatcacatattaggtcacacactgtcatgtagatgncacgttagcaaaactgtcctccaaaatcgt

SEQ ID NO: 26799 - DNA, 101 bp, rice(Oryza sativa)
  misc_feature (71): n=a or c
ttctctagtacaaagaaaagagtatctatccaggactaagtgagtgaccatgttatgggcaactgatgagntgcatcccatcaccgtctacaatgcatacc

SEQ ID NO: 26800 - DNA, 101 bp, rice(Oryza sativa)
  misc_feature (71): n=t or c
atctgagcccgcataaggactcccatactcccacttattctcatggtggtcgccactgctcgcggaccgcngtcattcgtcggcaaaatttggaccgccac

SEQ ID NO: 26801 - DNA, 101 bp, rice(Oryza sativa)
  misc_feature (71): n=a or g
aggacccagcaagtgttatcctctccgtttgaataatcggcggtgaaaaaaaaaattgaagcttcgtggcngcctcgactctgaacagaaacggccaacat

SEQ ID NO: 26802 - DNA, 101 bp, rice(Oryza sativa)
  misc_feature (71): n=t or c
cgtacttcaagaaaatgtttatgtaactatccgaatacttaatatacttttaatccactagattgtcacanttactttttaaagaactacattcaaaggaa

SEQ ID NO: 26803 - DNA, 101 bp, rice(Oryza sativa)
  misc_feature (71): n=a or c
aaattgatgtccgggggccgaggatctttagtccggttggtgttggttgggaactaaagatcggtttgatntttagtcccggttgggaacaccaaccggaa

SEQ ID NO: 26804 - DNA, 101 bp, rice(Oryza sativa)
  misc_feature (71): n=a or c
aaaacctggagcaattcgaggaacctgcattttgttttcacttgaattttcggttgcaataaaaacctgcnaatttgggtgtaaattttcagatacatggt

SEQ ID NO: 26805 - DNA, 101 bp, rice(Oryza sativa)
  misc_feature (71): n=a or g
tttgcatatgtcaaaaaccacattgtttaggagcctgaaggaaggattgtttaggtgccatacaaatgccntaaatttcaccctgaccgaagataacatga

SEQ ID NO: 26806 - DNA, 101 bp, rice(Oryza sativa)
  misc_feature (71): n=t or g
attcgcaatggtttgtttcaggggataacgggatatatgttgatatattgatatggtgtgtggatgatttnttatgtattatagagcatatgattttaaaa

SEQ ID NO: 26807 - DNA, 101 bp, rice(Oryza sativa)
  misc_feature (71): n=t or c
gaagatcttttgttttggtttcttgccaaaaatttattctctgcctcggtgtgagagggagaaagggctcncaggaccagccatcgcctgtggtgggtgga

SEQ ID NO: 26808 - DNA, 101 bp, rice(Oryza sativa)
  misc_feature (71): n=a or g
ttccacttcttcaagattttagacatgcgcatgtctcttaaaaacatttctttggatgcaagcatttcccntgttaccttaaccacacttccacgcggtaa

SEQ ID NO: 26809 - DNA, 101 bp, rice(Oryza sativa)
  misc_feature (71): n=t or g
agcagcgtctccggctcatccggaatctggattgtgagacgactagtgctggggggaatacttacgcattnccagttgccgccgacgaagaacttcctggc

SEQ ID NO: 26810 - DNA, 101 bp, rice(Oryza sativa)
  misc_feature (71): n=t or c
tctacagtgcagagttacaatgtttctgtgactactgtgaaaaaccttgtgctttgtctgcaagtgatatnaactgagattagtagtttctatctgacctt

SEQ ID NO: 26811 - DNA, 101 bp, rice(Oryza sativa)
  misc_feature (71): n=t or c
tatgtaattaccaaacccttgaagtcgacatgtttcctagcttctgaatctatagctccatcgagtatccngctagatgttgcactgtcaaataagataaa

SEQ ID NO: 26812 - DNA, 101 bp, rice(Oryza sativa)
  misc_feature (71): n=t or g
atagaccatttctaaaagtatttcaagaaatgaatattttagttagctagccacagtggtgtgacaagtanctggcgtggcataccagtattgccatgcta

SEQ ID NO: 26813 - DNA, 101 bp, rice(Oryza sativa)
  misc_feature (71): n=t or c
tcaaagttgaatgttgttgccagagataggtccttaacgggctttattgctgctgagatgaaatcattggnaagatgttttacttaagtttcttttgttca

SEQ ID NO: 26814 - DNA, 101 bp, rice(Oryza sativa)
  misc_feature (71): n=t or g
cctaatcttctcaagcatggacaacattggaagctctctaggttcaagaatatacttgttgaatacctcanaattgttgttcagcaaaatatcacacttgg

SEQ ID NO: 26815 - DNA, 101 bp, rice(Oryza sativa)
  misc_feature (71): n=a or g
gaagacacatctacatgattagcaatccaagaggcaaactgatttggaacaaatgaagactggaaattcancaggcttttaaagcaagtccttccaataac

SEQ ID NO: 26816 - DNA, 101 bp, rice(Oryza sativa)
  misc_feature (71): n=t or c
gaccgccaaaccgactgacggagcagagaggggggataattaatggagggatctctgggcgcgttcttgtncatatatacacaacactagcaaaatgccca

SEQ ID NO: 26817 - DNA, 101 bp, rice(Oryza sativa)
  misc_feature (71): n=a or g
aaaaataaaaaatcgaaaaaaaaacaatattgaaatatacgaaacccttaccctagccgttgccgccgccnccgccctctcgtcgccgtcactgtggccgg

SEQ ID NO: 26818 - DNA, 101 bp, rice(Oryza sativa)
  misc_feature (71): n=t or c
tacgtattttgtatattcgcgatttccaaataaagaaacaaatctggagacggcaaagctcgccgctgccnttcatccgccgccctccaccgccgggcata

SEQ ID NO: 26819 - DNA, 101 bp, rice(Oryza sativa)
  misc_feature (71): n=a or g
aggatgcctgtggaatggtgtcgctccgctgttagcgttaagttctagaataagctcgcttttattttccncttcatttatgtaggatttttatatgtttg

SEQ ID NO: 26820 - DNA, 101 bp, rice(Oryza sativa)
  misc_feature (71): n=a or g
tcgccatgatcacgcacgccgtctttgccatcttcatcgacgatcgacaaggaggacgcgccgggatctcntggtgggggttggtggccggcgccactacc

SEQ ID NO: 26821 - DNA, 101 bp, rice(Oryza sativa)
  misc_feature (71): n=a or g
acgctagcacccatcccctaacacaatggccggcaccctcactacctcccctaagactgtctccaacaagngacccataagggcacccaaacccaaaatag

SEQ ID NO: 26822 - DNA, 101 bp, rice(Oryza sativa)
  misc_feature (71): n=t or c
taacctgaaacggagatagtatctaacatcaaaatcatgcactacaggtatgtcagaagcagaacttcttnccctgcaaaaatataagatacaagcaatgg

SEQ ID NO: 26823 - DNA, 101 bp, rice(Oryza sativa)
  misc_feature (71): n=t or c
aggggttgtaaactgggagtagagagcctttttccagcggcaagaatttctaaattatcatgctacaacgngtagggtgtccactggttttaattacaact

SEQ ID NO: 26824 - DNA, 101 bp, rice(Oryza sativa)
  misc_feature (71): n=t or c
aatcgatcgatcagtagacgggtatgcagcaatcagcatcagcagcatatgcgatgtgaattgtgatgtangcaacggtgtatttttgcggtaaataaagt

SEQ ID NO: 26825 - DNA, 101 bp, rice(Oryza sativa)
  misc_feature (71): n=a or g
gtagtactctcctgtacacggcactgtagggtgtagtagacatatgatctaggagtacagccaaatgtgcntgggccctcccggcttggaaggataggatg

SEQ ID NO: 26826 - DNA, 101 bp, rice(Oryza sativa)
  misc_feature (71): n=a or g
taagaaacaaaatacaaacgcgcatacactttatacacgggtgactcaccgtcgaccgcacccgtattaantctagaacttaaacccttataccacggacg

SEQ ID NO: 26827 - DNA, 101 bp, rice(Oryza sativa)
  misc_feature (71): n=t or c
agctgggcaggacgcaagaaagctccacgaggacaggcatgctactgttcattttcctcaccaattaaacntttacataatacctacaagcacctttatag

SEQ ID NO: 26828 - DNA, 101 bp, rice(Oryza sativa)
  misc_feature (71): n=t or c
ataggtttatggtcctctagtttttcatctactccacatgtggctctcttcttctttttatttggctccgnttataaattttattgttcttaatacatagg

SEQ ID NO: 26829 - DNA, 101 bp, rice(Oryza sativa)
  misc_feature (71): n=t or c
gaatccaagaaacagggaggagatgagatatatggataacgacgaacgggacagaagtagatacagctctntgaagaaggaaagaattagatgcacagaag

SEQ ID NO: 26830 - DNA, 101 bp, rice(Oryza sativa)
  misc_feature (71): n=a or g
ttcaggcattggctctcctctgatctaccaaactgagtccagcctacggctttatgatgtacctgaacgtngagggatacaaagaacggacagggatatca

SEQ ID NO: 26831 - DNA, 101 bp, rice(Oryza sativa)
  misc_feature (71): n=t or c
aagatgccctaagcaaaatctaggtcgcgaggtacttttttttttcttgtttgaagtggatgtagaacttnaccattaaatttaattctttaaaaccacca

SEQ ID NO: 26832 - DNA, 101 bp, rice(Oryza sativa)
  misc_feature (71): n=a or g
ttgtctgctgacgtggcgtcatgcatgcatatcctaagctggcagcgttttccatttcaaaacgcatgagncagttaactcttcatataatgtttgatcat

SEQ ID NO: 26833 - DNA, 101 bp, rice(Oryza sativa)
  misc_feature (71): n=a or c
ctacactaattggaaatataattaagcacatgtgggtacactaaacatgcatgtatatcaatagatccatntcatatgtatatgatttatacatgtatacg

SEQ ID NO: 26834 - DNA, 101 bp, rice(Oryza sativa)
  misc_feature (71): n=t or c
gttcattgcatttagcgatgaaagagagctgaccactaacccacatacatgctatttaagtggaccaaccnaccaaccacgtactccatccttgctataaa

SEQ ID NO: 26835 - DNA, 101 bp, rice(Oryza sativa)
  misc_feature (71): n=t or c
acaagctagcacaacttgttagtgctgatgatcatcgaaaagtgggcatcttcttcgtgtgttcctcaagnactgatgtcaacgtttgacaatgatatact

SEQ ID NO: 26836 - DNA, 101 bp, rice(Oryza sativa)
  misc_feature (71): n=t or c
ttagtttatcgtgccatatttgctatatagattgtaccttgtccaggccctcatctttgtcaacaagtacnggtggtttccctctcccaacaggaacttca

SEQ ID NO: 26837 - DNA, 101 bp, rice(Oryza sativa)
  misc_feature (71): n=t or g
tcaaaaattagtttgtttcctacgaaattcctctaaaatgcctccatgccaaaaggggacgtaatttctcnagttatgtcaaccttacaattcctatcgtc

SEQ ID NO: 26838 - DNA, 101 bp, rice(Oryza sativa)
  misc_feature (71): n=t or c
aagcgacaccgtaactaatccaagaggacgaaacagttaaagcctaaatttgttgtagtcggcaaagcaantttgtcataactgttgtagtatttgtgtct

SEQ ID NO: 26839 - DNA, 101 bp, rice(Oryza sativa)
  misc_feature (71): n=a or g
tagccattgaaaccatctggtccaggtgctttgtgagctgggataatggagatgagactgtcaatttcctnagtagaaaacagatcaaccagactactcaa

SEQ ID NO: 26840 - DNA, 101 bp, rice(Oryza sativa)
  misc_feature (71): n=t or c
gcccataaatcgatttctgaagcatttcccaatcagatgccaccaatgtctgatgagtcaccttcttcttngggccaagaagtggaaccacatactccaga

SEQ ID NO: 26841 - DNA, 101 bp, rice(Oryza sativa)
  misc_feature (71): n=a or g
ttggtagatatagacttttctcttgcatactctctttgtttaaaaaaatcaaatccagataggagtgtaancgggtttgtccgtgaacctgcttataggta

SEQ ID NO: 26842 - DNA, 101 bp, rice(Oryza sativa)
  misc_feature (71): n=a or c
attttttctcacgttgaaaaccacaattacactaactacaggggtaaactcctctgaagcgttcactaatntctcacacatacaaaaaatttgatccaacc

SEQ ID NO: 26843 - DNA, 101 bp, rice(Oryza sativa)
  misc_feature (71): n=t or c
ctgggtcgcagtcaatcaacatgggagcaagaacatcagtccttgtcctaataatgtaaaccctgatggantggttttactttcacttgctgactgattct

SEQ ID NO: 26844 - DNA, 101 bp, rice(Oryza sativa)
  misc_feature (71): n=a or g
caaaacctacctcagtcccgattttaaagagaaatgaagggtcaactagcatcctgttccggagaagtgancaggacctaatggctggacccaacggccaa

SEQ ID NO: 26845 - DNA, 101 bp, rice(Oryza sativa)
  misc_feature (71): n=t or c
agggatcgatggctattgtgctgggaacaagttcctctgacatgctgttctctaacgcgtggatcgttaanatatcaatcatttaaattcagaagatagta

SEQ ID NO: 26846 - DNA, 101 bp, rice(Oryza sativa)
  misc_feature (71): n=a or g
cagttggaattcgtggtcatcctctacctagttcctactgcggcggcggcttctttttttcttcgtaaaanaaaatacaaagaggaaaaaaaaagaagtgg

SEQ ID NO: 26847 - DNA, 101 bp, rice(Oryza sativa)
  misc_feature (71): n=t or c
actagttcaaaatatttgataaaaaagttcagccttaagccatattgctccgtcaattaacatgtcatccnaaaccactctattagggtggtcaaggatga

SEQ ID NO: 26848 - DNA, 101 bp, rice(Oryza sativa)
  misc_feature (71): n=a or c
ttaggatatcatccatgtgtattacatgctccgtgcatgcatttatgtgtttgggcacgcatgtagtatgnaattttttcgcaaggaacaaaatataataa

SEQ ID NO: 26849 - DNA, 101 bp, rice(Oryza sativa)
  misc_feature (71): n=a or g
ggggagagagttatgggagagagagagagaaagaggagtggagatataaaaaatgggagtgggaatctttnggtatttttgcatgtgggtgagttaagagc

SEQ ID NO: 26850 - DNA, 101 bp, rice(Oryza sativa)
  misc_feature (71): n=t or c
aaccccaaggagcggccggcgatgagggaggtcgtcgaggagctcgagagggtgctccagatggagccacngacgacgacggcggccgacaaggacggcga

SEQ ID NO: 26851 - DNA, 101 bp, rice(Oryza sativa)
  misc_feature (71): n=t or c
cttggatgtaccaaactcaagctgtagagacaaacgatatcgatcaggccggtgaaacttggtttttagangaaggacgtaactaatattcagttggttta

SEQ ID NO: 26852 - DNA, 101 bp, rice(Oryza sativa)
  misc_feature (71): n=t or g
atctgaaccacaataccatatatatagcgcatttcccaactcccaaaaaccagtgtaaaagagatcacaanatgttttgaacagtagtttcgactgacatg

SEQ ID NO: 26853 - DNA, 101 bp, rice(Oryza sativa)
  misc_feature (71): n=a or g
ttctctcgtggccactcacaaagagtttgagtatgttaaatatggagtacaggtggtatttgaatcttctnaagatgaagataaagattaaggacctgttt

SEQ ID NO: 26854 - DNA, 101 bp, rice(Oryza sativa)
  misc_feature (71): n=a or g
aattattgctctaccctgtcatttttatattgatcaaacataaagccaatctgcctaatcatgccataacntggttccttcgcaacaagccaatgaatcaa

SEQ ID NO: 26855 - DNA, 101 bp, rice(Oryza sativa)
  misc_feature (71): n=a or g
atgggtacatcacagaaggggcagcaaattcatttataattgatttaccattactccaaagaacgtcaagntgacttccttttttacattcacatggcaaa

SEQ ID NO: 26856 - DNA, 101 bp, rice(Oryza sativa)
  misc_feature (71): n=t or c
caaattcccctaccccgtggcagattttgtatccgagggtagaacaatattacacctacgactcaaccagnatatcactagtgcttctattaggtaatcac

SEQ ID NO: 26857 - DNA, 101 bp, rice(Oryza sativa)
  misc_feature (71): n=a or g
taaaaattgatgcccttgacaagttcataacagttttagtttgagaatgcaattgcaatttccttcctgangattacttgttctatttactggatttctag

SEQ ID NO: 26858 - DNA, 101 bp, rice(Oryza sativa)
  misc_feature (71): n=a or g
gcatgattgatataaccctggcatttatcattaggatgcgcaacgtacgtatcagctgaaatgctcaaacngcatacttttcgcttgcttcacctaaagaa

SEQ ID NO: 26859 - DNA, 101 bp, rice(Oryza sativa)
  misc_feature (71): n=a or c
attgacccaggagcaaaaggatgagaggaacaagaaggaccatgagagaagaaaacggaagaaggaggaangtcaagttttaaagtctgcaaccaatagtg

SEQ ID NO: 26860 - DNA, 101 bp, rice(Oryza sativa)
  misc_feature (71): n=a or g
acgaccggaagaacgactggttctacaccgccctcccagatcatgcccacctccgacttcccaccgcgccnccggtacaggtgttgacagtcgttatcgat

SEQ ID NO: 26861 - DNA, 101 bp, rice(Oryza sativa)
  misc_feature (71): n=t or c
ttgttcatcctccatatttgcgctcggtgtactccatgtaggggtgggcgtttggttagactaaaaaattnggtctcggtcttcggtttttcggttagttc

SEQ ID NO: 26862 - DNA, 101 bp, rice(Oryza sativa)
  misc_feature (71): n=t or c
tagtggtggagtagtgggtggatgatccattcaccaaggtttaaattttaatgttcacgaatattacgtanatataggtggattttcaatagtattgtagt

SEQ ID NO: 26863 - DNA, 101 bp, rice(Oryza sativa)
  misc_feature (71): n=a or g
acgacttggcgtaaaacatttgattcttttcgtgacgtttcacgtgtcgatcagcagttgcccaacatcancactgctattaattcccgcccggcccagcc

SEQ ID NO: 26864 - DNA, 101 bp, rice(Oryza sativa)
  misc_feature (71): n=t or c
gggaagtcgattagtttaaaactaacgctgcttccgtgttgtttgcttccagaacactaaagacaccacanaaatgtgcaaaggaaatagaatgatacatt

SEQ ID NO: 26865 - DNA, 101 bp, rice(Oryza sativa)
  misc_feature (71): n=a or c
ttccaacaaatatttgatgccatcattttgcttatctaacctgtggcaagggcaatgccagggaagcagtngaattgctgggatctgaccggcttctgcaa

SEQ ID NO: 26866 - DNA, 101 bp, rice(Oryza sativa)
  misc_feature (71): n=t or c
cccgtcactatttccatccttctccctcatgccgccaatctcaccgtcacagccgcccccaacgccacttntgctggccacggattgggaaccataggaag

SEQ ID NO: 26867 - DNA, 101 bp, rice(Oryza sativa)
  misc_feature (71): n=a or c
accatggctcgaaatcatgcactaaccatgcctctggagacctgcagcggcaggtcctcgaggaacttganaaacgcggcatgagacgagcccccttcctt

SEQ ID NO: 26868 - DNA, 101 bp, rice(Oryza sativa)
  misc_feature (71): n=a or g
ttcctctcggtatccatgggcatcttcacaacaatcttttgctgcagcaagaacacccacacaaatttcanataaaccaagcaattataccaaagactatt

SEQ ID NO: 26869 - DNA, 101 bp, rice(Oryza sativa)
  misc_feature (71): n=t or c
cgtgcaatcgcgcgggccacccaggtagttggagataaaataaccatgcattgaatttagagagagtgtgngcgccaaacggacatgactgattttttttc

SEQ ID NO: 26870 - DNA, 101 bp, rice(Oryza sativa)
  misc_feature (71): n=t or c
aaaaaagaaagagggcagcatccaggccttcagggccattacacaagtcagcctatacacctatagatggncatatggcccgaggcccgatggcccagtga

SEQ ID NO: 26871 - DNA, 101 bp, rice(Oryza sativa)
  misc_feature (71): n=a or g
gaagatatggctcagcgtgacacaagacgtgaacgaggtgaacctcctgaggacggccatcaagtctgtcngcggcgccagcgatggtcgagagagcaaca

SEQ ID NO: 26872 - DNA, 101 bp, rice(Oryza sativa)
  misc_feature (71): n=t or g
gctgggaattgtagtcagaggagtacttgcaagaattaagagaaattttaccccttatgaaactgcacatnagcactaaatggtaccagtgctgcacatca

SEQ ID NO: 26873 - DNA, 101 bp, rice(Oryza sativa)
  misc_feature (71): n=a or g
tagtaacttttcaagcgtggaagtgggagcattaattataccgggtcatcagctacacccccaaactattnctgtagtacgatcccccccctctaggccct

SEQ ID NO: 26874 - DNA, 101 bp, rice(Oryza sativa)
  misc_feature (71): n=t or c
cctcatctcaggaaagaagacattgtgggcttcatatcgtttcaaatttgggcttgggctagagtgtgcanatcccaacttcccaaggcccatttacctct

SEQ ID NO: 26875 - DNA, 101 bp, rice(Oryza sativa)
  misc_feature (71): n=t or c
ataattactacaaatccacaacatcacattagcagataaaggaactcaccatgctcctccttgagttttcncttgtgttcttctgttagataaaatgtttc

SEQ ID NO: 26876 - DNA, 101 bp, rice(Oryza sativa)
  misc_feature (71): n=a or c
agttgttatcatcatctcgttagaaaccttcgtatacaacatggtccaaagaggccttgaactaatcatgntcgagaagttccttttattattggctgaat

SEQ ID NO: 26877 - DNA, 101 bp, rice(Oryza sativa)
  misc_feature (71): n=a or g
agagcgatgggcgaagcatatcgacgtgggtcccccggagtagcgtcagcaaccaagatctagagaggacngcgtggtagtggagcggcgtagttgggggg

SEQ ID NO: 26878 - DNA, 101 bp, rice(Oryza sativa)
  misc_feature (71): n=a or g
gatcaggccaccattagctctagggtggccagatctggttgcatctgacttcagggtagcccgatctggtncccctaaggtggcggtgatcgaccccgacg

SEQ ID NO: 26879 - DNA, 101 bp, rice(Oryza sativa)
  misc_feature (71): n=a or c
atgaggaagagtagtgggaggtcggggaagacgacgaaggttatcgagacatcgatgtcggttaagaacanggcagagggaatgaggaggacgtcaaggcc

SEQ ID NO: 26880 - DNA, 101 bp, rice(Oryza sativa)
  misc_feature (71): n=a or g
tcaaaagacccacaaactcatctatgatcctgatcggagagttttaagattctgataagctagctggtaanaatccgaagaaactgagagtatctgattga

SEQ ID NO: 26881 - DNA, 101 bp, rice(Oryza sativa)
  misc_feature (71): n=t or c
gttatttggtcaagtgaggtggtccatttttggtgttgtaaagctgaaacgtgagcttttggtaatactcntagatcattcgattgtattgtaaagcagaa

SEQ ID NO: 26882 - DNA, 101 bp, rice(Oryza sativa)
  misc_feature (71): n=a or g
atgaactcaaagcaaattcagtgtgtcataccagtgctgcagggaaactaagtatctcacaaaagtaatangcaaaatttgccttaggtaataggtaatac

SEQ ID NO: 26883 - DNA, 101 bp, rice(Oryza sativa)
  misc_feature (71): n=t or c
ccttcgacagtcgaatcacaacctgaactttccacttcgaccgactcgactgatgaagtagttcccgagcngccatccattcagaatgaagaaattcagac

SEQ ID NO: 26884 - DNA, 101 bp, rice(Oryza sativa)
  misc_feature (71): n=t or g
agtgagatgatactatgcgtgttcatgtgtttgcttttgcagggaataatgggagcccgccggtggcgctnctggtgctgatggcggcggcgatggtggcc

SEQ ID NO: 26885 - DNA, 101 bp, rice(Oryza sativa)
  misc_feature (71): n=t or g
ccataccggcacagcatgcaggacacacagtgacgtcggtttgttgccacatgcgtgatgcagcggcggangcagcgcgcgaggcagagagtcacgggaga

SEQ ID NO: 26886 - DNA, 101 bp, rice(Oryza sativa)
  misc_feature (71): n=t or c
ggcctgccccttgactgccttaggtgattgatatcggaggtcaaattccgtaaggcgaaaatccatttccngatccttccttttaacactagagccgatag

SEQ ID NO: 26887 - DNA, 101 bp, rice(Oryza sativa)
  misc_feature (71): n=t or c
aaatttataaacagctacacttattttagacagagaaagtactataataatcaatggccatgtttggatcnaagggatattttttagtccttcctcaaata

SEQ ID NO: 26888 - DNA, 101 bp, rice(Oryza sativa)
  misc_feature (71): n=a or g
gggagaagagaagagagaagagagaaaggagaagaaaagagatgaaaacaagatatgcaggcatgcagctnacatgtgggctccacgtgttttgtttaatt

SEQ ID NO: 26889 - DNA, 101 bp, rice(Oryza sativa)
  misc_feature (71): n=t or c
tgtgcgtcttgtgcagataagtaaagaaggaagaatgtgtaaaattcttctgggactgattggtttcctantatttttcttgaccactttagtgtatgtct

SEQ ID NO: 26890 - DNA, 101 bp, rice(Oryza sativa)
  misc_feature (71): n=a or g
ctgttttctaatcgcgtctctgcactgcttgcgccgcgctggtgccaccactacatgatgcagttcacgcncaccgcgccacctccaccgcctctgcaccc

SEQ ID NO: 26891 - DNA, 101 bp, rice(Oryza sativa)
  misc_feature (71): n=t or c
tgtgaacagtgagctagcttactgctgtgagcctgtgagctgtatatatggtggatcaatcatgtatactnctacttgggttgccgacatcaacagcttcc

SEQ ID NO: 26892 - DNA, 101 bp, rice(Oryza sativa)
  misc_feature (71): n=a or g
gacttaaaaaacttaaaaagcaatcggatcctactttttccacaggaacggcgagccatcttgtgccgacntcgatggggaggatgattccatggcgagct

SEQ ID NO: 26893 - DNA, 101 bp, rice(Oryza sativa)
  misc_feature (71): n=a or c
gatttaaagcagtttttgaatagattagctatgcttctaaaagatgaggagattaagtggtaccaacgtgntaaagtaaaggacttgttggaagatgattc

SEQ ID NO: 26894 - DNA, 101 bp, rice(Oryza sativa)
  misc_feature (71): n=t or g
cggcattctaaaggtgcgcccttttttccttctttcatccggaatcactgacttttgtccactgatcactnagatttccttctttctgtgattgtaggtgt

SEQ ID NO: 26895 - DNA, 101 bp, rice(Oryza sativa)
  misc_feature (71): n=a or c
ccgtgctgaatgtgctattgagggaggggaagattaagagatatgggagagagatggacttgttgagaccnttgcagcgtagcaatataagtttctttgag

SEQ ID NO: 26896 - DNA, 101 bp, rice(Oryza sativa)
  misc_feature (71): n=a or g
agctaatttccatccaatttcaatccgttttcatccgtagattgagcgggccgggtaaataacttggtacntcaactaacctatgctacttactttgattg

SEQ ID NO: 26897 - DNA, 101 bp, rice(Oryza sativa)
  misc_feature (71): n=t or c
ctacagcattatacagtgacatcttgatggtattgccaagcggccaggcatattggaccaagtctattagnactattttttttctcattctacagtagaat

SEQ ID NO: 26898 - DNA, 101 bp, rice(Oryza sativa)
  misc_feature (71): n=t or c
agtattatgaaagatattagccgttactaaattatatccagcaacaataatgattctacttcatccgtttnaaaatgtggctatttatagcacagtttcgt

SEQ ID NO: 26899 - DNA, 101 bp, rice(Oryza sativa)
  misc_feature (71): n=t or g
tacattactagtcattaagccgtgaaacagtactttccattatttggcgtactggtagaaaaacaaggctnccatggcatgcccgatgattcccctatacg

SEQ ID NO: 26900 - DNA, 101 bp, rice(Oryza sativa)
  misc_feature (71): n=a or c
gagttatactgatggtgtaagtatagtatagggtcaagtataggctttatatagggcagtttccttcagcntaaaggagaacatatgtcccagattcatga

SEQ ID NO: 26901 - DNA, 101 bp, rice(Oryza sativa)
  misc_feature (71): n=t or c
ggaggctaaggcatcgacttcgccgacaggtacagagccaaatgctgggtccatgaccgttccttcgccanaccctccgctccctcgccgtcgcttagatg

SEQ ID NO: 26902 - DNA, 101 bp, rice(Oryza sativa)
  misc_feature (71): n=a or g
ccgagcacggaatttactacattcaacccaaaagaggatctccaactcagctgtaggaattttaccaactngatcgagacagtgcgagggacttgctactt

SEQ ID NO: 26903 - DNA, 101 bp, rice(Oryza sativa)
  misc_feature (71): n=t or c
gtaattgcgactttaattaatgcaatgctgatgattgatggaacgctgtttcgaaggtgaggcttttcatnacggatgggcttttcttccttactaaatgg

SEQ ID NO: 26904 - DNA, 101 bp, rice(Oryza sativa)
  misc_feature (71): n=t or c
gaacggtctccatctctcaatccacaacaatgcaaatcaattaggcctctcacagtgcgtcgacctggacngtgtcttagtcgcgccacgttggatttttg

SEQ ID NO: 26905 - DNA, 101 bp, rice(Oryza sativa)
  misc_feature (71): n=a or g
atgcaccccagttgacggctcagtatttcccaatatgaccgcattggggcgttccaatgtcccatcatcanaaattgagtgcactgttgatgtgggaagtg

SEQ ID NO: 26906 - DNA, 101 bp, rice(Oryza sativa)
  misc_feature (71): n=t or g
taagatatatgtatacgctggtgcaaagtgtatataatatcgtaaaggttaaacagggtacggatatctanaatcgtaaagagtaagaagaaatatgctgt

SEQ ID NO: 26907 - DNA, 101 bp, rice(Oryza sativa)
  misc_feature (71): n=t or c
ttgttgggtacagatgtttctagtggtaaaacaagtaggtatctggtagcaatgcttctcaattgtactanttttcaaggacttgaaaacatctgtacata

SEQ ID NO: 26908 - DNA, 101 bp, rice(Oryza sativa)
  misc_feature (71): n=a or c
gctggccgcgcgccatgcaaatgcgcaatcaaaaacgctgctgctgcatcaaagggagggaaaggactccnaaacagagtatcattatcctttcttctgtt

SEQ ID NO: 26909 - DNA, 101 bp, rice(Oryza sativa)
  misc_feature (71): n=a or g
gtgtgaagatgacaaaataactttgtccacaaagacatgaacttttctagtggccacataatacaagtcantaaaaacaaaagcaaaatatccctttcaca

SEQ ID NO: 26910 - DNA, 101 bp, rice(Oryza sativa)
  misc_feature (71): n=t or c
tcttctgaatattagtgccaaatataaacccatcctgctaccagttgtactaaaaaaaattgactgccaanaaccaaaatgctaactactaaaaaaatcat

SEQ ID NO: 26911 - DNA, 101 bp, rice(Oryza sativa)
  misc_feature (71): n=t or c
catacccctgcctctcactcctttttttttctccctgcctgtcgcatagagaagcaccagagagagttgangggcgatggcaggaaatagccaagggacca

SEQ ID NO: 26912 - DNA, 101 bp, rice(Oryza sativa)
  misc_feature (71): n=a or g
ttaaatctactacaagtagtgcatattagtatactataaggatgtacatgcatgtaccattaccatttagncattgtttagttccaaactttttcttcaaa

SEQ ID NO: 26913 - DNA, 101 bp, rice(Oryza sativa)
  misc_feature (71): n=t or c
aaaccaagaaactaagcaaagcttgttagataaagtgctgcagcattgcatacacatgcctttccgaagcncttagcttgaataagcgacatgctgagaac

SEQ ID NO: 26914 - DNA, 101 bp, rice(Oryza sativa)
  misc_feature (71): n=a or g
tgccacgtcaggcaaaaacaactaacaatcctatcacggaactttatttaccctggttttaaaagttggangaccctctatatgattatatctgaggctag

SEQ ID NO: 26915 - DNA, 101 bp, rice(Oryza sativa)
  misc_feature (71): n=t or c
agcgcaggttttgttttctggatttttttttattcacctgaggtcctggttgttttgttccccaatcctcntatgtacttgtactacaaatcgaaggcaaa

SEQ ID NO: 26916 - DNA, 101 bp, rice(Oryza sativa)
  misc_feature (71): n=t or c
ggggagagagagagagcgatatggaagcgagaaacgtcatcattcctgcactaatctcggtgtaatcctanggccaagaaaacatcaaatatgagagaaga

SEQ ID NO: 26917 - DNA, 101 bp, rice(Oryza sativa)
  misc_feature (71): n=t or c
ccatgtatagttgtgcagcacatgtgtcgtcattcgaggttcatttcgttcatgactttatttaatccganctgtgaaaattgtacaaagaataatcaacc

SEQ ID NO: 26918 - DNA, 101 bp, rice(Oryza sativa)
  misc_feature (71): n=t or c
gggcctcttaagcgaccgctgatgataatcggtcttcgcttgcgaaatccctaatacaaggatatctgcgngccgcctctcccgtgcggcgcagctatgtg

SEQ ID NO: 26919 - DNA, 101 bp, rice(Oryza sativa)
  misc_feature (71): n=a or c
tcaagagattatgcagcttccgagtggtgcacaagaacagcatgagtattatctgtactcaaaatggatgntgctgcttgcgaatgcggagaactgagtcg

SEQ ID NO: 26920 - DNA, 101 bp, rice(Oryza sativa)
  misc_feature (71): n=a or g
cagtgctcctatgacttttagagtgttactaatttcttgttgctgaccaaagcataactggtaccctcgtncttggcaccacacaaattccactttttttt

SEQ ID NO: 26921 - DNA, 101 bp, rice(Oryza sativa)
  misc_feature (71): n=t or c
tcagtccaccgtatgacaccttgttattatggccgctattatatcctagaggagcgccataccgaggaagnagaccaacacaaatcgaatactcattccgt

SEQ ID NO: 26922 - DNA, 101 bp, rice(Oryza sativa)
  misc_feature (71): n=t or g
gtatcaaagtggtgtggctacttattctttcggtggtagaagacatacccatcgataacgaagctctcttnttaacttcgtcaatttgaatatacaccggt

SEQ ID NO: 26923 - DNA, 101 bp, rice(Oryza sativa)
  misc_feature (71): n=t or c
accaggaaccatctaggtagaaaaactacttcagcagcctcacataacaaccaccccaatgccaaacctgnacatgaattatgtgtgtcacaatcagcaca

SEQ ID NO: 26924 - DNA, 101 bp, rice(Oryza sativa)
  misc_feature (71): n=t or c
tttttatcttgattaggcagagtctgacacagagttatctgaatcttttctgaacctgtgtgttgtggcangcaatatggcaggctggctggcatacatgg

SEQ ID NO: 26925 - DNA, 101 bp, rice(Oryza sativa)
  misc_feature (71): n=a or g
tggctgcttccttactgcagatttgcaaaccacacccatgacatgagcaaatcattggggggagagccgcntgctaattgattaacccagctaacctggct

SEQ ID NO: 26926 - DNA, 101 bp, rice(Oryza sativa)
  misc_feature (71): n=a or g
cgactgtgtcagattccgacttcgggatggcctgaaatcaagatacatccccttccaatgccctcttctcncagcaaatggcgggcgggatggttctatct

SEQ ID NO: 26927 - DNA, 101 bp, rice(Oryza sativa)
  misc_feature (71): n=a or g
tggtcgaagtcagcgggtgcacctgaaaggcgcggcgctgtgggtgttggatgcaggatgctcttcggggnggccacggtgggtggcttgacactgtggcc

SEQ ID NO: 26928 - DNA, 101 bp, rice(Oryza sativa)
  misc_feature (71): n=t or c
ctgacttggaaggacggcttctacaacggcgagataaagacgaggaagatcacgaactccatgaacctcanggccgacgagctggtcctgcagagaagcga

SEQ ID NO: 26929 - DNA, 101 bp, rice(Oryza sativa)
  misc_feature (71): n=a or g
caacacagcctgggagagagagtagaggggttaggaagggaggaggaggcgcggtaccaagggaaattgcngccagaggcagcaatgggggaggtggctcg

SEQ ID NO: 26930 - DNA, 101 bp, rice(Oryza sativa)
  misc_feature (71): n=t or c
gctaatcttgacgaggtcaaaattcagttagtagataatactactatactaacgcggtcgaaatcggtgangctcgtcctgctctgtgctcaagctaccta

SEQ ID NO: 26931 - DNA, 101 bp, rice(Oryza sativa)
  misc_feature (71): n=t or c
ccgtgacatcaccgttggcattgcacgaaatccaaatgaatacaacgtaaacagcttctgcccgccgggcncccatggccccatcatcggccatccgagtc

SEQ ID NO: 26932 - DNA, 101 bp, rice(Oryza sativa)
  misc_feature (71): n=a or c
ttaaaaaatcttggatcgggagatgcgtcaaaagagagcctcaatgtttgatatcaatttcaaaatcttcntggcggcccttctttccttatttatttttt

SEQ ID NO: 26933 - DNA, 101 bp, rice(Oryza sativa)
  misc_feature (71): n=a or g
tatataccccctctgtttcaaatataggtgctttgatgttgtttgtcattcgaactcatctcccccttccngtcctatagaatttccaaggcatatccttc

SEQ ID NO: 26934 - DNA, 101 bp, rice(Oryza sativa)
  misc_feature (71): n=t or c
tgtgatgtctcggttttattggtatgagtcaaacacgagctcgttcggctatctaactcgttatccaatangaaacggaaatcgctggtatattacgtcag

SEQ ID NO: 26935 - DNA, 101 bp, rice(Oryza sativa)
  misc_feature (71): n=a or g
atcatggtgatcggaggttcacgtgtttgcgtaatatcaccacactatatccgaggtacacattcacgctnatacttaactgattacttagtgatcgaata

SEQ ID NO: 26936 - DNA, 101 bp, rice(Oryza sativa)
  misc_feature (71): n=a or g
gccgggtagcgtagcgtaggctaggtatggacaaacgggagagaatcatcacaaggggagcagagcactanccctaaggccatcaccaatgtatatggcaa

SEQ ID NO: 26937 - DNA, 101 bp, rice(Oryza sativa)
  misc_feature (71): n=t or g
ttacatcaatcccccataaatgttttttatttccatgatactgcatcatgaacctagtaacctactggatnggttaccactgtaacgatcccctagctgcg

SEQ ID NO: 26938 - DNA, 101 bp, rice(Oryza sativa)
  misc_feature (71): n=t or c
aatctttatccaatattttgtctacgacaagagggtacatcaaggtattgtctgttgcatatctgatttgnggttttttttacactgcatttataggcatt

SEQ ID NO: 26939 - DNA, 101 bp, rice(Oryza sativa)
  misc_feature (71): n=a or g
cgattatggatctgactgaccttccaacagcgacagtaggagtagttattacatccggtatgctgacagtncattttactatctcacaacacatcagttag

SEQ ID NO: 26940 - DNA, 101 bp, rice(Oryza sativa)
  misc_feature (71): n=a or g
caaatggatcaatttttcacatgggcttgagatggcaattgggaaattgactcttctccttgtccagtacngcaatactcgatcttgatggcagcacgcgc

SEQ ID NO: 26941 - DNA, 101 bp, rice(Oryza sativa)
  misc_feature (71): n=a or g
gttcatcaaggaggggatctttcatattgctactcatcgtgaggggggggtctttcagattgttgattccnttcatcaagagggagtggggatgggatctt

SEQ ID NO: 26942 - DNA, 101 bp, rice(Oryza sativa)
  misc_feature (71): n=t or c
acaaaaatgtcataacagtcccttatgcttttacataagcagccgctcgtaaatctaagtattttttttcngcagtaatacatcctttttaacaattgatg

SEQ ID NO: 26943 - DNA, 101 bp, rice(Oryza sativa)
  misc_feature (71): n=t or c
tttgtaaaagattgtggaaatatacacataccgcggggtgaaaatacgggaccggttgtttggcgtagcangaaaggatgggagcgcggtaccaggtcaat

SEQ ID NO: 26944 - DNA, 101 bp, rice(Oryza sativa)
  misc_feature (71): n=a or g
ctatcatatctgactaactatgtttgtttcttagggcaatccaggaaggtgcgcattcactttatggatcnacaatgtcaatcccacatatgatggccaaa

SEQ ID NO: 26945 - DNA, 101 bp, rice(Oryza sativa)
  misc_feature (71): n=t or c
tcacatccttttgtttctggttggccttcctcatattcatctgcataaaggcatgacttactccttttctngacatgctgtactgatgaagttcttcatgt

SEQ ID NO: 26946 - DNA, 101 bp, rice(Oryza sativa)
  misc_feature (71): n=a or c
tttggaattttctgaaactactctcactcaaatatcaaatcaaacaccacttaatctcaccttacctctcnaaattttcataacgataacatttgacatta

SEQ ID NO: 26947 - DNA, 101 bp, rice(Oryza sativa)
  misc_feature (71): n=t or c
tgttcgtgctctttccagttttctaatcgcgtcatcatgctcatcatcgaataagattctcctataatccntcggttccaaaatatatcaataacttcttc

SEQ ID NO: 26948 - DNA, 101 bp, rice(Oryza sativa)
  misc_feature (71): n=a or g
atgagctcgagaggaggagacgacgtttttgagctggatgacgttgccgcctccaccatctcgatctcctnctgctgcccaccgccagcccctgcgccgtc

SEQ ID NO: 26949 - DNA, 101 bp, rice(Oryza sativa)
  misc_feature (71): n=a or g
acgtgcttcccccactcctcctcctatagcgcatgcactgtggaaaggggaaaagctcgatatcaacctcnttcgaccacctcccccatttccctctagcc

SEQ ID NO: 26950 - DNA, 101 bp, rice(Oryza sativa)
  misc_feature (71): n=t or c
atcatttctttgtttgttcatgttgacataatctttgctgatatcctcttattgtcatagttgcactggcngagtggccttcactgtcttcaccaatatat

SEQ ID NO: 26951 - DNA, 101 bp, rice(Oryza sativa)
  misc_feature (71): n=a or c
aggaagggtttaacccaagtaaattttggttttaatctctggctcatcgagtgctcaaaagctttgcatcngactggcctctcggctcatgaagtgcccgg

SEQ ID NO: 26952 - DNA, 101 bp, rice(Oryza sativa)
  misc_feature (71): n=a or g
ttgctgatttgtgggtgcggtgctttagtcaatagctggactctattcagcgtgccaattcaaggatcaantggataaaacccaattgaaccaattgaatt

SEQ ID NO: 26953 - DNA, 101 bp, rice(Oryza sativa)
  misc_feature (71): n=a or c
tttgttacacattgcttgcccatggtaccaactgattgttacaatgacactgactggaccaagcatagatnttttggccaaactttaatgaactgaaacga

SEQ ID NO: 26954 - DNA, 101 bp, rice(Oryza sativa)
  misc_feature (71): n=t or c
acattgcgccacgtcatctttttttcctgagccattggattgtctgcaggtctccagatggacgttagatngacattgaacagtattgggccagcccatgc

SEQ ID NO: 26955 - DNA, 101 bp, rice(Oryza sativa)
  misc_feature (71): n=t or c
atgttgtggaatgttttagtaattttctcggagaaggaaaatgggttttaaggggctgttcaaattgatgncatttttaatcataccattttttttctgac

SEQ ID NO: 26956 - DNA, 101 bp, rice(Oryza sativa)
  misc_feature (71): n=t or c
catctggagattttgacataggcattgaacacatatcttccctcaggcatctccgtatcggtatagattgnatagatgcaagaccttgtgaggttgaggtc

SEQ ID NO: 26957 - DNA, 101 bp, rice(Oryza sativa)
  misc_feature (71): n=a or g
agaatggattgcaagagggggaggagaattgctagcagattgtgtggcagtgtgattatatatagtggtcngagctcaactagtacagtgaaacatgtggt

SEQ ID NO: 26958 - DNA, 101 bp, rice(Oryza sativa)
  misc_feature (71): n=a or c
tttctaggggacatgtcatcctgcaatgtgtggttgggtggtacatgtcatcctttttctacaactcatcntgctgcttgagttgcacacttaggttttat

SEQ ID NO: 26959 - DNA, 101 bp, rice(Oryza sativa)
  misc_feature (71): n=t or c
atgctgtcttcttgctgaccgacacaagggaaagtaggtggcttccaacacttctctgcgcaaatgaaaanaaggtaattcttgtgtgtattcttcactaa

SEQ ID NO: 26960 - DNA, 101 bp, rice(Oryza sativa)
  misc_feature (71): n=a or g
catggaaagcttagcaagtatactttcaaatagatccaacctcatgtccaatatctgttctggagtggccncaatcaccttatttgggcccaaggggttgt

SEQ ID NO: 26961 - DNA, 101 bp, rice(Oryza sativa)
  misc_feature (71): n=a or g
ttactcctctacagcccctcagattgctctccttggcaagtgacacctctatactcctttacgcctctccnctcctttctacattagacaccttacaaatc

SEQ ID NO: 26962 - DNA, 101 bp, rice(Oryza sativa)
  misc_feature (71): n=t or g
acagggcgaggccgagcaaaggccatgaggcttggttgatggcagcgatgaataaaacgtctcagcggcgnctctgagctccggcgagacgacgccaactc

SEQ ID NO: 26963 - DNA, 101 bp, rice(Oryza sativa)
  misc_feature (71): n=a or c
aattgccactccagatgataccactgctatctgatccactagactgctactgaatacttcttttcatcgcnattagctctggttcttctgggagcttagct

SEQ ID NO: 26964 - DNA, 101 bp, rice(Oryza sativa)
  misc_feature (71): n=t or c
taggggagagaaggattagaaggtatatttggtccaagattcgtgcatttaggtgtgaaaatctgaagggngcgacaggggtggaatagtcacagaaattt

SEQ ID NO: 26965 - DNA, 101 bp, rice(Oryza sativa)
  misc_feature (71): n=t or g
ccgctatcacctcatccgtcgtatccacaatagattggaacggcaatagaaaaatgtagctacgaattctnctgtgctcgtgcgttgttcggacttcggag

SEQ ID NO: 26966 - DNA, 101 bp, rice(Oryza sativa)
  misc_feature (71): n=a or g
tatttgttcgtaattccgtataggtctctcagtaacgtatttggagaggagaaatcgcggataggaacctntatgtaaaaagtgaaaataataggggcttt

SEQ ID NO: 26967 - DNA, 101 bp, rice(Oryza sativa)
  misc_feature (71): n=t or g
cgggggatcagggtttctgtacaaatcttgaagcaggtcagctggcatttgagagaagggggatctcatcngtcgcccatatatattctctagtagaacaa

SEQ ID NO: 26968 - DNA, 101 bp, rice(Oryza sativa)
  misc_feature (71): n=a or g
cgattgctgcccatgtcaccccacatggatgacgcaaggaccctatgtgtaacaggtgcaagtttaacatnaaaaaaacaattgtttgcaatttaaaactt

SEQ ID NO: 26969 - DNA, 101 bp, rice(Oryza sativa)
  misc_feature (71): n=a or c
tggaaaaaccaaccatgcactttggaaggtgcaggtctatgctgcaattcacggcgcgcgtctacaggggnacctgactggcgcaggaaagaagctagacg

SEQ ID NO: 26970 - DNA, 101 bp, rice(Oryza sativa)
  misc_feature (71): n=a or g
gtttttttggcgacggaggaagaaagaagagagttgatctttgggagtacaaccggccggctggaaacatnacaacctaggggagtcgaggagtttggtcg

SEQ ID NO: 26971 - DNA, 101 bp, rice(Oryza sativa)
  misc_feature (71): n=t or c
ataagtccatatctgactttggcaaatgcaagtgcagatgcaatcatggctaagctctccatctttgtatntagtagtagtagttgttacctttgagttca

SEQ ID NO: 26972 - DNA, 101 bp, rice(Oryza sativa)
  misc_feature (71): n=a or g
tttttttaaaaaatactccgatgaacctacgaacaaactccttttcaggcagatgccaatgaggacgagtngaatgaggcaccgaacacaaccgaacgaca

SEQ ID NO: 26973 - DNA, 101 bp, rice(Oryza sativa)
  misc_feature (71): n=a or c
cgccgcgcgcgcggacgccggggtttgagttttgcactttcacacatctcctttagggcttgtttggttgnttgggaattaatccccaagggatcctagga

SEQ ID NO: 26974 - DNA, 101 bp, rice(Oryza sativa)
  misc_feature (71): n=t or c
tcaactccacggcgcggcaccgctctgtaaatggcatatgggctctgtaatttttttattccttctttgcngactaggcggatgccatgtcagcaaaacca

SEQ ID NO: 26975 - DNA, 101 bp, rice(Oryza sativa)
  misc_feature (71): n=t or g
gaggatgcaggttgaatgatgaaatcatgaaagtcgcaaggaagcctggtttcatgtgtccattcttttgnctgtagatatgtatggtattgactgttaag

SEQ ID NO: 26976 - DNA, 101 bp, rice(Oryza sativa)
  misc_feature (71): n=t or c
tcactggatattcgtattatttgtttccgtcgaataccatgattacatatttgcatctagcaaaaacttanccgcattcattttcatatccgagttatatt

SEQ ID NO: 26977 - DNA, 101 bp, rice(Oryza sativa)
  misc_feature (71): n=t or c
aattaggctgcatatatatgcctggtgatgccttgacccactttcaactgcgtatagcacacaattgaacncaatatatagagttgtataatcatgcactt

SEQ ID NO: 26978 - DNA, 101 bp, rice(Oryza sativa)
  misc_feature (71): n=a or g
attctgtatatcaagattatctcagctaattttcaatttgcacctttcgtctaaccaggtacttgaacgcnatccagacaaatgcaccccatcttctgaga

SEQ ID NO: 26979 - DNA, 101 bp, rice(Oryza sativa)
  misc_feature (71): n=a or g
ttgcttcaagttggggcatcggcttcgattttccggcaagaggtatggcatgtcacagtggtttgcattgncggattaggatgtcgttttagatgttctaa

SEQ ID NO: 26980 - DNA, 101 bp, rice(Oryza sativa)
  misc_feature (71): n=a or g
tttttaatcttttgttgtacttttgactaacgcttttgttttgtatagccagatccaatctctccccgganaagatatgagctttgcctgtaaataggggt

SEQ ID NO: 26981 - DNA, 101 bp, rice(Oryza sativa)
  misc_feature (71): n=a or g
gcttttgcatgttactgacgctcagtatatcagttggtcacagaaactgaactcatcaggtatgagtaaanatgttattttttacacatgataaacgcaac

SEQ ID NO: 26982 - DNA, 101 bp, rice(Oryza sativa)
  misc_feature (71): n=a or g
aaaaaagtttgcttctaaattgtacgctacttttagggcatacaccctttttccccccttatgtattctgntgctttactgcccagaacatttctacctct

SEQ ID NO: 26983 - DNA, 101 bp, rice(Oryza sativa)
  misc_feature (71): n=t or c
gaatattttttttttattccttgctagtatattgtactactattttgtgacatttcttgcttagtacagancttttagtatttattattggaaaaagtatg

SEQ ID NO: 26984 - DNA, 101 bp, rice(Oryza sativa)
  misc_feature (71): n=a or g
cgctacaaccgactggtcgaaaactaggaggaggcatctctgaatcacctaaagagaactaataggtgganagaaatcactacaaccgactggtcgaaaac

SEQ ID NO: 26985 - DNA, 101 bp, rice(Oryza sativa)
  misc_feature (71): n=a or g
aaaatttgtacattttacttagttacttcgtaccaagatgcagatatttctattccaatctgtgacagaangaaaatcttgtacatcttcatgttgaattt

SEQ ID NO: 26986 - DNA, 101 bp, rice(Oryza sativa)
  misc_feature (71): n=t or g
atattttgatggacaagagctaaagagcagtatgcacctaactggttctgtcctacaaaccaatttcgatnatacacacattgtgcgtaaaagaacatgat

SEQ ID NO: 26987 - DNA, 101 bp, rice(Oryza sativa)
  misc_feature (71): n=t or c
atgttcccatccatattcaattttgactctagatccccatgtgtacagagggtgcaaattatttgcactcnagacgacggttctatcggatgacttagaga

SEQ ID NO: 26988 - DNA, 101 bp, rice(Oryza sativa)
  misc_feature (71): n=t or g
acttgatggtgaaccgacaaggcatacaagggaaaggggtagtgaagttacctgctaggggagagatcttnccggcttgctgccactcctcccgaaagcaa

SEQ ID NO: 26989 - DNA, 101 bp, rice(Oryza sativa)
  misc_feature (71): n=a or g
tatttaacaaattttgcatggttttatattgttaccacgcgataaacatgcttaccgccagccgaggtgcnatatccccagccccgacggtttcccggtcg

SEQ ID NO: 26990 - DNA, 101 bp, rice(Oryza sativa)
  misc_feature (71): n=t or c
gatgctgaacgctgcaatgactattactatgttcctgacatattgcacaccctagaggtgtttggaggtcngtctccagttctgtttcttcttatgtccac

SEQ ID NO: 26991 - DNA, 101 bp, rice(Oryza sativa)
  misc_feature (71): n=a or g
catatatagtaccatcaacatggtatccaatggtaccagatttgtaccctacgatattgtgatggtgtcancacattaactattgcgttgcaacggtatac

SEQ ID NO: 26992 - DNA, 101 bp, rice(Oryza sativa)
  misc_feature (71): n=t or c
atgcatcgatcagctgctagcagctagcagctgtggttttctctttccggcaggagagggacatgaaattnagatcgtccaacaaaaatctatgcatgtga

SEQ ID NO: 26993 - DNA, 101 bp, rice(Oryza sativa)
  misc_feature (71): n=a or g
ctggaagcaggagaattgaactgcactgcactccatcaaatttgggtttttttttctttcctttttcagangatcaaattcctgagttctaaaaaagatag

SEQ ID NO: 26994 - DNA, 101 bp, rice(Oryza sativa)
  misc_feature (71): n=t or c
atagggtatgcatgaggaggtggcaagaagggtggacgaacgacttgcgtcacagcggagccaggagcccnagccctacattccgcctaccacggtcagcc

SEQ ID NO: 26995 - DNA, 101 bp, rice(Oryza sativa)
  misc_feature (71): n=t or c
tacaagcttttatatatttgtaacatggcattcgtgatggtatgcgtacatgatgtacatgcacgtacacnggctaggctggacactactagaaaaagtat

SEQ ID NO: 26996 - DNA, 101 bp, rice(Oryza sativa)
  misc_feature (71): n=t or c
gtctaacttttcaactagactatgagaaactataggtacaacacctagaaaataaactagaaactagaaantagacatcttaaaattcccaaaaaaggtca

SEQ ID NO: 26997 - DNA, 101 bp, rice(Oryza sativa)
  misc_feature (71): n=t or c
ttgggcttaaaagacgatggtacctgcagatcaaatatagagatgtgttacctagccactattttgttgcntttcaatgtgtgagtaaagtgctccctccg

SEQ ID NO: 26998 - DNA, 101 bp, rice(Oryza sativa)
  misc_feature (71): n=t or c
ttgtccattttcccccggaaccgtcattgggaatcaatttggagcgtccacgtggagggctgacctgagcngacgtagccagggtttggctgaacctgggc

SEQ ID NO: 26999 - DNA, 101 bp, rice(Oryza sativa)
  misc_feature (71): n=t or c
ctcatgatacagtcatatgagaagctgataattgctaagaaaatcttggtccccccgcgtcgcccacacanaggcgaccggggggcgaagccctagcccct

SEQ ID NO: 27000 - DNA, 101 bp, rice(Oryza sativa)
  misc_feature (71): n=t or c
ctccataaaaaaaaactaaacttaggaggagacgtgacatctttacaatgaatctggacaaccctttatcnagattcgttctactagaaaacattacatac

SEQ ID NO: 27001 - DNA, 101 bp, rice(Oryza sativa)
  misc_feature (71): n=a or c
ttggcttgcttgctacaatggatgtatatttaggtaagctaaaaatgcagcaattcaggatggatgttggntgcagtggacaaatatttgaagcccaactg

SEQ ID NO: 27002 - DNA, 101 bp, rice(Oryza sativa)
  misc_feature (71): n=t or g
cacgcatgtgcgctctttccctgcgcaatcgagggcatatgccttcccaaaatttttacctcgtcacatcnaatgtttagacatgtgtatggaatactaaa

SEQ ID NO: 27003 - DNA, 101 bp, rice(Oryza sativa)
  misc_feature (71): n=a or g
aattaattagcttctttttcccatcttcaaggaaaggagctagctagccaagaacttttgtgaagtttctntttcgaaaaaaatgtgaataatgtaagtaa

SEQ ID NO: 27004 - DNA, 101 bp, rice(Oryza sativa)
  misc_feature (71): n=a or g
ctgttgctgtctcttttccccaagctgtcaatgttttcattacaaggttgtgggaagataagagtgcttgntgtggcgaaggagcagacaatggcaatgtc

SEQ ID NO: 27005 - DNA, 101 bp, rice(Oryza sativa)
  misc_feature (71): n=a or g
taatgagtgatttcgtcttgcatgcatgatggattagttaccaataccagcaaacgaccatagccttaggnttgtttacgacaaaggaaatttacatctaa

SEQ ID NO: 27006 - DNA, 101 bp, rice(Oryza sativa)
  misc_feature (71): n=a or g
accttgcattcgctgttaaacgctctattgtttcgttcgttccttgcaaatcacccgagctactagaatgncaatggtgtcaaactgaaatgacaatagct

SEQ ID NO: 27007 - DNA, 101 bp, rice(Oryza sativa)
  misc_feature (71): n=a or g
aaagggtggggggagagaggggttacggttaggtaaaccctaaccaccctgcggttattgcacagtcgtcnccaccgtcacatccactgcctttccaccac

SEQ ID NO: 27008 - DNA, 101 bp, rice(Oryza sativa)
  misc_feature (71): n=a or g
atacatcaatcattaaaacaggagagacgccaatatagtagcatggcgtgcgtactacacgtacaggtctnaaggggtggaacgtgggcctttcaattttt

SEQ ID NO: 27009 - DNA, 101 bp, rice(Oryza sativa)
  misc_feature (71): n=t or c
gctgaaaagccacagccttataagccaaacgatgggcttcggctgaaaagaaaaggcccaagcaagccatncgatggcagcctcatattaatccatatttt

SEQ ID NO: 27010 - DNA, 101 bp, rice(Oryza sativa)
  misc_feature (71): n=a or c
gctacttggaacctgagaagataaggctgcaagaatttgtatcagtaaaactgaggcgtgtgtttcaaccntaacatcagcaagcccctctactccataac

SEQ ID NO: 27011 - DNA, 101 bp, rice(Oryza sativa)
  misc_feature (71): n=a or c
ctactacatgcacatgactaaccaatgcgcacttctggtcgaagttctagtttagtgatgtctaatgtgancttcatcacaacagacggttcaagtaacct

SEQ ID NO: 27012 - DNA, 101 bp, rice(Oryza sativa)
  misc_feature (71): n=t or c
aacgcgcgaaaaaaagaaaagaaaaatcgggggaaaaatgaatttgtctggttccccaaaactaattgtcngataaaaaaaactgggcgaaagaaaaaaaa

SEQ ID NO: 27013 - DNA, 101 bp, rice(Oryza sativa)
  misc_feature (71): n=a or g
atcatcaatacttcctatcactgcaccagaaacagttctcagaccacaagctgtgaacctactagtttgcnatatttcctatcatacttcttgaagaagct

SEQ ID NO: 27014 - DNA, 101 bp, rice(Oryza sativa)
  misc_feature (71): n=t or c
ggttcatgctttgatctagataagctgaacgacaagtcgaagttagtaatttgcatttgtgttcttcaggntgactcagtacagcaaattgaaccaacgtt

SEQ ID NO: 27015 - DNA, 101 bp, rice(Oryza sativa)
  misc_feature (71): n=a or g
ggtggcctagcggcggccggttacacatagcagcgatcggtccgatgctagtcttcattcattcaggtatntattcaggtatcagtgtgtgggtgatagtt

SEQ ID NO: 27016 - DNA, 101 bp, rice(Oryza sativa)
  misc_feature (71): n=t or c
tggagagctttccattccctctgttttaattggagattcggagggatctatcggcccatcgtttcgcttanggtatatttacagacgaaaaataatttgta

SEQ ID NO: 27017 - DNA, 101 bp, rice(Oryza sativa)
  misc_feature (71): n=a or c
cgatcgctgcaggtgtaccatccgaacatagacgacgaggggcagatggtggtggacgtgcttcacggctnctgggcttcgtctccatcctctacgacccg

SEQ ID NO: 27018 - DNA, 101 bp, rice(Oryza sativa)
  misc_feature (71): n=a or c
agttgtagccgttaccattggttctgaagtgaacggcacaaattaacctaggacactgtagcaaaaagggnacggcacaaattaacctaggacactgtagc

SEQ ID NO: 27019 - DNA, 101 bp, rice(Oryza sativa)
  misc_feature (71): n=t or c
gaggcagaagatgatgacctttatttatcaaattgtagaatttctctggtgggttttgaggagaaagagtngtcaaggttagtcatgatgatacgcaatgg

SEQ ID NO: 27020 - DNA, 101 bp, rice(Oryza sativa)
  misc_feature (71): n=a or g
attgctaacaatgccttttctgtagtctttcaaccgagtggaaactccgttaaacagtaaccatcaaacgncatgaaagaaaactttggcagttcattcga

SEQ ID NO: 27021 - DNA, 101 bp, rice(Oryza sativa)
  misc_feature (71): n=t or c
ctcatctcatatcatctgtcccccctcctgttcgtaatcttgattgattaattttgcgtttttgtcccganttttctttggaacctgtctgtgattcttgg

SEQ ID NO: 27022 - DNA, 101 bp, rice(Oryza sativa)
  misc_feature (71): n=a or c
catgtctcccacctgtatgtttctctccttacatcgtgtgcaaaacttcatttaaaaaaagtactccatcngtcccaaaatataaaaacctagagtcggat

SEQ ID NO: 27023 - DNA, 101 bp, rice(Oryza sativa)
  misc_feature (71): n=a or g
ttaacagcctttattttatcttcttcagtagcaaccccatttggtctgatgctgtgacccaaataagacantttctgttgagcaaaagagcacttgctctg

SEQ ID NO: 27024 - DNA, 101 bp, rice(Oryza sativa)
  misc_feature (71): n=a or g
acacaccttggcccacagattcctaccggtctagatactactgctactcccaggtagaaagtacacgcatncttgcaacctgcaagcaaggcaaccaggca

SEQ ID NO: 27025 - DNA, 101 bp, rice(Oryza sativa)
  misc_feature (71): n=a or g
ttggcgtgtgttggcttgtgtattgtgtgtctatctatttttgtttttgttgttccctctctccctatggngtcttgtatttatacccatagatgtccact

SEQ ID NO: 27026 - DNA, 101 bp, rice(Oryza sativa)
  misc_feature (71): n=t or c
gatacacccgcgcgagttaaggaatcgctcgtgcacttcacttatgtgtaagttggatgttagttaataanaaaaataggtactccttccatctatttttg

SEQ ID NO: 27027 - DNA, 101 bp, rice(Oryza sativa)
  misc_feature (71): n=a or g
gccgttttctttcaaaaagagatgttcaggattgacagggtaaattcttccgataagttaccagcatgtcngtgatcaaaataactagtacagtcatagtt

SEQ ID NO: 27028 - DNA, 101 bp, rice(Oryza sativa)
  misc_feature (71): n=t or c
ggcccagccatctactataatccaaattagacaatgtgtggctgaactccctgttcaccttcaacccctcnagcaggcagggagccacatcctcctcaaac

SEQ ID NO: 27029 - DNA, 101 bp, rice(Oryza sativa)
  misc_feature (71): n=t or c
taaaattcttaaacatttataatttaacatacaaccttcaaataatctattatgtaactgtgacgtggaantgtgccaaacaggacctaagcgtgaaaaaa

SEQ ID NO: 27030 - DNA, 101 bp, rice(Oryza sativa)
  misc_feature (71): n=a or g
tgatcgttatgattttatcaccggaaattacgccctttttccactcgggggtgatgcattaattaacgggntgatataacaaaagggttcatttttttatt

SEQ ID NO: 27031 - DNA, 101 bp, rice(Oryza sativa)
  misc_feature (71): n=a or g
ctaacagtaaacccagttaccatagtaactgtgcttaccgctaaggtggattgggattgggtgacataggntaggcatgtcacaaggtgacatagggtgaa

SEQ ID NO: 27032 - DNA, 101 bp, rice(Oryza sativa)
  misc_feature (71): n=t or c
cttaattattttccaaggatagtagttggcgatatttggtccaacgtttgtttgtagtaaaaagtaacggnaggagtacaaaaattaattaagtatggttg

SEQ ID NO: 27033 - DNA, 101 bp, rice(Oryza sativa)
  misc_feature (71): n=a or g
accacgacacctagcctattgacaaaaataaaggagaaagcaagaacttgggctttggcatgtgcaaagcngcttcgggagtttctaccaaactgcataag

SEQ ID NO: 27034 - DNA, 101 bp, rice(Oryza sativa)
  misc_feature (71): n=t or c
gcaatgttcaggtatcgcatactgccggttcttttctcactgttatgctgggtatatttcaggataggtgngagtgtgacaggatttccttattgcttctt

SEQ ID NO: 27035 - DNA, 101 bp, rice(Oryza sativa)
  misc_feature (71): n=t or c
cagtttaatgctttgcatacctcgaaaccaggcggtgtaaactggtacaaatgcacgaatgatctttgganacaattgaatcaatgagctggttccggttc

SEQ ID NO: 27036 - DNA, 101 bp, rice(Oryza sativa)
  misc_feature (71): n=t or c
gccatgggcgctttgttgctgtggggtccagctttaactaaatgtaagaattcgttcttctgttcctttgnttcgacagagagataatttggagtatgaat

SEQ ID NO: 27037 - DNA, 101 bp, rice(Oryza sativa)
  misc_feature (71): n=a or g
acacccccaccgaattgccaccctcatttagttctcacagaaatactataaccatactcccacctctcgtntatatttgtgaacggaagcggtagacaatt

SEQ ID NO: 27038 - DNA, 101 bp, rice(Oryza sativa)
  misc_feature (71): n=t or g
ctctgaaattctactactctatttccgccattgtataacgtatcataaagaaaaacgcgcgccctgattgncttgttcctaaataattacattgcgggcac

SEQ ID NO: 27039 - DNA, 101 bp, rice(Oryza sativa)
  misc_feature (71): n=a or g
tctagcaccaaatacgttgtagcccctcttttgagcttcttaacgtcatttggtttagagtaaatttcacnagactacatgcattttgaccaaactacaga

SEQ ID NO: 27040 - DNA, 101 bp, rice(Oryza sativa)
  misc_feature (71): n=a or g
tatacaatgagatgtctatgatgacttaatcatattatagagtgtgtgcgcacgtgttgtaagcgcttatnttacatagcttgccgaaaactaagcaagtt

SEQ ID NO: 27041 - DNA, 101 bp, rice(Oryza sativa)
  misc_feature (71): n=a or c
gggacttggtggctgcaacaagagaaatcaataataaccaaaatcattcgaatcggagtacattatggggngcagaaagggcgggcgaggaggtgtgccac

SEQ ID NO: 27042 - DNA, 101 bp, rice(Oryza sativa)
  misc_feature (71): n=t or c
gcaagctagatagtcgcctctcaatgggagggcatcgcattcacatcgaaagaagaagaaattgatcgatngatcgaacatcgaaggtagtacgtacgtag

SEQ ID NO: 27043 - DNA, 101 bp, rice(Oryza sativa)
  misc_feature (71): n=t or c
cgccaattagctctcacggtaagatgcagggtcaatccacaatcccattttatccgtccggttactcactnatttaactatttaattaaacatggacttac

SEQ ID NO: 27044 - DNA, 101 bp, rice(Oryza sativa)
  misc_feature (71): n=a or c
aaccttgattattctcgctgcgtgtatcccattcccacccgcccaccacatatccttttccttttcttttnttttatttttttttgttttttcccgttggc

SEQ ID NO: 27045 - DNA, 101 bp, rice(Oryza sativa)
  misc_feature (71): n=a or g
gagaaaattttcatgatgcacgagagggaaaggaaagggaggtgcaagtagaaggaaggaaggaagaaagnaagaaagaaagaaagaaagaggagggtgag

SEQ ID NO: 27046 - DNA, 101 bp, rice(Oryza sativa)
  misc_feature (71): n=t or c
aacataattttcaaattatttgttctttaccatctgctggaatgaaaaatacagaactgtacaacctggtnggacgacctgatgtcttcagtaactctgaa

SEQ ID NO: 27047 - DNA, 101 bp, rice(Oryza sativa)
  misc_feature (71): n=a or g
cccaatagagccttattcatgatatctaaatccaggacacccaaaccctaccctgatctctaggagagcanacaagaggccattaaaccaggtggtatttt

SEQ ID NO: 27048 - DNA, 101 bp, rice(Oryza sativa)
  misc_feature (71): n=a or g
ttgttggagaagcatcatggtgatttatttacttgaacaatgtcatgcttagccatatgatggccctccancgtcttctccgtgttctcaaggactcgtgc

SEQ ID NO: 27049 - DNA, 101 bp, rice(Oryza sativa)
  misc_feature (71): n=a or g
gtctgctgtaattggatttttttttctctctccttagtctgttgtttctctcctcccttcctctgttgtcngttgatgtaagtaacctttgttaatttaat

SEQ ID NO: 27050 - DNA, 101 bp, rice(Oryza sativa)
  misc_feature (71): n=t or c
gaataccagcatccgctgctccctctccttacagtatcccaacatgcggaccaggttccggtggtgaatcngcccgatggactgcacctcgttcgcgaact

SEQ ID NO: 27051 - DNA, 101 bp, rice(Oryza sativa)
  misc_feature (71): n=t or g
attttagtttttgctgttttcataaccttactctgtataaatattatatattctacatacagagactatanaatgatatatgtattgaaagattatacaat

SEQ ID NO: 27052 - DNA, 101 bp, rice(Oryza sativa)
  misc_feature (71): n=t or c
aagcatataaatttctcaggcttggtgctgagggtagcaaccaaacagactcttactttcccctctccttncccatccaatctgccgccggaaccttgccg

SEQ ID NO: 27053 - DNA, 101 bp, rice(Oryza sativa)
  misc_feature (71): n=a or g
tgttgtcctgttactaaaatgtgtagtagcttgttgtgtatttgttgtggtgaacaagatgtatgacatanccctacaagtttagggaccgcccctgcact

SEQ ID NO: 27054 - DNA, 101 bp, rice(Oryza sativa)
  misc_feature (71): n=t or c
tggctgtgtgtgtgtgagtggcaaccagcctagatgacaagcagaaagtataggggatcttgggtcagggngtaaagttttgatgtgtcacatcaattatt

SEQ ID NO: 27055 - DNA, 101 bp, rice(Oryza sativa)
  misc_feature (71): n=a or g
tgtctggtacatttttttttaaggttgaagtggatttctctgccctacatttccctttatcttttcaggtnaaactgtccttgatggtccggctgatccac

SEQ ID NO: 27056 - DNA, 101 bp, rice(Oryza sativa)
  misc_feature (71): n=a or g
cctaaccaatgcagagctgactaatttgcggaagttagcaagggatcttccatgccattttgctctaggtnattatttcgacagtgttcatattgtttatc

SEQ ID NO: 27057 - DNA, 101 bp, rice(Oryza sativa)
  misc_feature (71): n=t or c
ggagccatccacagcgtccccagaatccaacgacgatgcaaccctttccaaccgggatggagaatggagtnccttgcttgccgttgccgccgtatggcccg

SEQ ID NO: 27058 - DNA, 101 bp, rice(Oryza sativa)
  misc_feature (71): n=a or g
agccataacttttctcatgttatgatcattgaaaagctcggccaccccgccaaatcaaacacagcctaagngaaaagtccgaattacacccctgaactatt

SEQ ID NO: 27059 - DNA, 101 bp, rice(Oryza sativa)
  misc_feature (71): n=t or c
ttgtttgggtgagacaaagatgccaatgcagtaactcctgagttagtgaagaaactgccattcttgggagnagagagagagagtgtgtgtgtgacatgttt

SEQ ID NO: 27060 - DNA, 101 bp, rice(Oryza sativa)
  misc_feature (71): n=t or c
cgaaatgaaattattggtagtattaggctattgttagccactccctccactttatattagtatgttgtttngatttttttctaatcaaaatcctttaggtt

SEQ ID NO: 27061 - DNA, 101 bp, rice(Oryza sativa)
  misc_feature (71): n=t or c
ttgccagatttcctggatgcatctattgggaagatcttgaaggtattatttgcttgattgcttctgcaccntttgctatcatgctacgatgtaaggcctgc

SEQ ID NO: 27062 - DNA, 101 bp, rice(Oryza sativa)
  misc_feature (71): n=t or c
ctgttgtccacctaattaaatgaacaatgcaagagcttcactcttcctagtgatggtttaaactttttganaattggaaaaaaaagctgaggatatatatt

SEQ ID NO: 27063 - DNA, 101 bp, rice(Oryza sativa)
  misc_feature (71): n=a or c
ctttattctcgcgacttgatcaatcagtagccttttctcgttacatggaagcgcttctcatgatgatcgcncaatgacatttccatttcctaaatcgaggt

SEQ ID NO: 27064 - DNA, 101 bp, rice(Oryza sativa)
  misc_feature (71): n=t or c
ttcttatgattaattgaaggagcctgtctgcctgtaaacagaaaacactgtagattatggctatctaatgnggtcactgtttttattacacattattatcg

SEQ ID NO: 27065 - DNA, 101 bp, rice(Oryza sativa)
  misc_feature (71): n=a or g
ccataagtctatgtaatgtcgtatataaagtggtcgcaaaatgcttggtcagcaggctccgaccattattncaggacattatctctgaatctcagagtgct

SEQ ID NO: 27066 - DNA, 101 bp, rice(Oryza sativa)
  misc_feature (71): n=a or g
caaaggatgggtctcttcacaagaggaggcaggctctggcttttatctatgagaagcatatagtccatgcnttgttcgctgaggttgcagacaggtatggg

SEQ ID NO: 27067 - DNA, 101 bp, rice(Oryza sativa)
  misc_feature (71): n=a or c
gaaacaagaaaaaatcccgacctaagatgcaaactttatccccaaaaatcgccgttaccacaaaaaaaaanctggtcaaaaagatgtacctcaagtagtaa

SEQ ID NO: 27068 - DNA, 101 bp, rice(Oryza sativa)
  misc_feature (71): n=a or g
caggatgccgtaccctagctaccctcttatgtagacaaagtgatactttaaggaccaagtcgtgcctttgntaaaagttgcataagatcagttaatttcat

SEQ ID NO: 27069 - DNA, 101 bp, rice(Oryza sativa)
  misc_feature (71): n=t or g
ttacatgggatctataaattcaactacaccaagaaataatacaaaagaagcagaggctgcacgcgtcagtntgccatgcgccttgtgtgtgaccctgatgc

SEQ ID NO: 27070 - DNA, 101 bp, rice(Oryza sativa)
  misc_feature (71): n=t or c
gtttcctctactcctgtcataaacaccaccctgaagatcccatctgaccatattgaggaaaaaaaaacagnaactagcatcaatactaaatatggagcaaa

SEQ ID NO: 27071 - DNA, 101 bp, rice(Oryza sativa)
  misc_feature (71): n=t or c
cttatgatttctcgtttgtgttcttcttttggtcatgttactgattgtattactcttttgcttaactaagntagtggattttgctactctgaaaaaaatat

SEQ ID NO: 27072 - DNA, 101 bp, rice(Oryza sativa)
  misc_feature (71): n=t or c
gaatcttgtacgttaacaccggccaccacagaaactataaccataatgaatgaacctgactttagcatcangtgccttgacgctagagagaatccactcag

SEQ ID NO: 27073 - DNA, 101 bp, rice(Oryza sativa)
  misc_feature (71): n=a or g
gccccaaggtgttccagactgtggcagttgcaacggctggatgaataattcaggtttgagtttgttatgcntgcacgagagatgtggtgcgctgcaggagt

SEQ ID NO: 27074 - DNA, 101 bp, rice(Oryza sativa)
  misc_feature (71): n=t or c
ccaggatcttcaccaagtcaccaaccgttttagcataatatatagcatcatcacccgggttaagaccatgngtcagctccacctagggttgagatgaatta

SEQ ID NO: 27075 - DNA, 101 bp, rice(Oryza sativa)
  misc_feature (71): n=a or g
aaagtgataactctctaggcttgtcagttttcttcttaatgttgttgagccccaccattgtctttctgtcnttcacatgtgtgcaacaaatttgatgatga

SEQ ID NO: 27076 - DNA, 101 bp, rice(Oryza sativa)
  misc_feature (71): n=t or c
ggctacttgttagtattagattcagtcgtcatggctagctagctagtggcgtcttctacaactacaaaaancctcctagggaccgggttataggtgccggt

SEQ ID NO: 27077 - DNA, 101 bp, rice(Oryza sativa)
  misc_feature (71): n=a or g
ggttttgcagccgattcagcagatgccattaaagcaactggttgttcagctgattcaacagcaaggctcantgaatgcatcggctaggtttgcgatacctg

SEQ ID NO: 27078 - DNA, 101 bp, rice(Oryza sativa)
  misc_feature (71): n=t or g
cttcgccattttcaccgaaaaggtgagaacgaatgactccgggggtatgatccagtggcgtaaagttttgntgtgtcacatcgggtattatatagaatgtc

SEQ ID NO: 27079 - DNA, 101 bp, rice(Oryza sativa)
  misc_feature (71): n=t or g
tagctaataaggtaacaaacatataacaagaaaaagtgtattgatgtaagcataccagtgaatcttgacanagagaaaaatgggcatggacgtgtaacagc

SEQ ID NO: 27080 - DNA, 101 bp, rice(Oryza sativa)
  misc_feature (71): n=a or g
aaatacaaaccaacctttgcaagaactcacctgcagatgcaagtaaagggcatttagggttgttcagattntaaccaaaataaaccttatcagattttagt

SEQ ID NO: 27081 - DNA, 101 bp, rice(Oryza sativa)
  misc_feature (71): n=a or g
gactttacataatcccgtgccagtcactttgtatcctatgaagctaactgtagcattcatttgtcggtctnttgtacacctacctgcgtgccttgtgggcg

SEQ ID NO: 27082 - DNA, 101 bp, rice(Oryza sativa)
  misc_feature (71): n=a or g
tatggcgcatgtggtgcactgtatattcatagattttatgcctggactatactactactccctccgtttcnaaatgtttgacgccgttgacttttttaaac

SEQ ID NO: 27083 - DNA, 101 bp, rice(Oryza sativa)
  misc_feature (71): n=t or c
attctcaaagaaacaagcatggataagagagaggttgatagagtatagagaaactaacctcaaacaggggnggtgctagagtcattaggggggggggttcc

SEQ ID NO: 27084 - DNA, 101 bp, rice(Oryza sativa)
  misc_feature (71): n=t or c
tccgatgatcatgtgcatcagcatcagtttatcagccaagttatgtctgttctatttcaacgtaatcattnttatcggttgacggattatatagttgaatg

SEQ ID NO: 27085 - DNA, 101 bp, rice(Oryza sativa)
  misc_feature (71): n=a or g
aatatcgtgtccggcgcaggattccctgggtcccgtggcccccaccgacatgttcatcatgctcctcgctnacgcgtagtgcttcgtcgcggcctctggag

SEQ ID NO: 27086 - DNA, 101 bp, rice(Oryza sativa)
  misc_feature (71): n=a or g
tagaacggcggatgtggtttatggtgatgtatgtgtctctgttgcgctggcatcccctcgtgtcttcattntagaatccttgaccatctcccccacgctca

SEQ ID NO: 27087 - DNA, 101 bp, rice(Oryza sativa)
  misc_feature (71): n=t or c
ttccgcttaaatttaatcaacttgactctgacagtcacgagcacaggttacctacccgttttctcgccacngcatatcaacataattttttcgtaaaatgt

SEQ ID NO: 27088 - DNA, 101 bp, rice(Oryza sativa)
  misc_feature (71): n=a or c
tactactacatcgtctatagtatgtggctgctagctacaccggctctgtctcaaaatatagcgatctagtncttattagaatttaaagcatacaataccat

SEQ ID NO: 27089 - DNA, 101 bp, rice(Oryza sativa)
  misc_feature (71): n=a or g
ctcagatgtccatcgtcgcgtaagctcatgcaatttccaagcacgagggagcaaaatcagaagaaaaaaanaagaagaagaagaagaagattaacacgtag

SEQ ID NO: 27090 - DNA, 101 bp, rice(Oryza sativa)
  misc_feature (71): n=a or g
ctggcactgatgtcttttcccaccaaaagtgtagtcatctcgcttcaactggtaagacccaacactaattnttgcaaaacaatccgtatcagttggttata

SEQ ID NO: 27091 - DNA, 101 bp, rice(Oryza sativa)
  misc_feature (71): n=t or c
ttagtgatgactaatccatgctataattcatggccagcaaggtggtatgatcaccacaactaaattatccnatttctcaccaggtttactttaactaacaa

SEQ ID NO: 27092 - DNA, 101 bp, rice(Oryza sativa)
  misc_feature (71): n=t or c
taagggtcaatttttcaaattttcgcggaagtaatccctagctaactagctagctgaccaattaccattgnttctttaatatatgacttatttggtttttc

SEQ ID NO: 27093 - DNA, 101 bp, rice(Oryza sativa)
  misc_feature (71): n=a or g
ttggcgtgcttgtacttgtgttcctcttgacttatcaaaagccagttctcgtttaacaggtctgagcagcnaagctatagagcggcgcgtcggtcaagtga

SEQ ID NO: 27094 - DNA, 101 bp, rice(Oryza sativa)
  misc_feature (71): n=a or c
cacatgtcaaatgtgaataaactacatacatactgcaaatcagcatcaaaacttacatccaaaacatgganaataacacacatcagaaaaaaagcatttga

SEQ ID NO: 27095 - DNA, 101 bp, rice(Oryza sativa)
  misc_feature (71): n=a or g
ttggtgtgtacgtgtcctttgctttcgccatagcaacactagatacacattaagcagctgcttagcgtgancgcatacacagaaacgaaattttctgaaaa

SEQ ID NO: 27096 - DNA, 101 bp, rice(Oryza sativa)
  misc_feature (71): n=a or g
gccggagcacgtccgccatggcgctcttgtgaaaaccggcgggaatttatggtgtcaactccaccagctanctggtccaattcacggccgtcggccgctgc

SEQ ID NO: 27097 - DNA, 101 bp, rice(Oryza sativa)
  misc_feature (71): n=a or g
agtaaggtttcagttgagtatatatatgcccttggttgatgggccaaatgggccaaaagaaagagggatcngaattaagaggtgggccaaaattagctaaa

SEQ ID NO: 27098 - DNA, 101 bp, rice(Oryza sativa)
  misc_feature (71): n=t or c
caaactaaattatatttaaactttcgatgcaggtttgacttacaaacaggggaggataagggaggagacgngcaaacctgaccacacggcgaaagggtgac

SEQ ID NO: 27099 - DNA, 101 bp, rice(Oryza sativa)
  misc_feature (71): n=a or g
atggaacacagaatagcattacatatataaaatgaacggagaaacagacgaggcgggtacttgatgttacntgtgctcgaatttatctttctttgcttcat

SEQ ID NO: 27100 - DNA, 101 bp, rice(Oryza sativa)
  misc_feature (71): n=a or g
catggacgtcgccatgtgcgacagtcgagacgctgccactatcacctcaactcttgacgacagcctcaacnaagtcgttggcctttacttcgcggccgctg

SEQ ID NO: 27101 - DNA, 101 bp, rice(Oryza sativa)
  misc_feature (71): n=t or g
aaaatgttaggccattctcagcgatgaatggcagcaaaagcagagtgcatggttgattgtacaatttcttncccttaggctggatcgcagcatagaagcaa

SEQ ID NO: 27102 - DNA, 101 bp, rice(Oryza sativa)
  misc_feature (71): n=a or c
gaaatttcatagaaaacgagaaaactcctggtatttcaaaggaggtcgaaattcctatggaaaatgtgaantggcctattctttggaatttaggagaaaaa

SEQ ID NO: 27103 - DNA, 101 bp, rice(Oryza sativa)
  misc_feature (71): n=a or g
aaggcaggagacttgatatcccaaaagatttaaatcctcaagtggctgcattaattgagtcgtgctgggcnaagtatgcattgacccatctatttttgtat

SEQ ID NO: 27104 - DNA, 101 bp, rice(Oryza sativa)
  misc_feature (71): n=t or c
ttatgccaatttccccttcaatgcttgtgagcctctgcagtaccttcaacgatgactttaagagaaccttntgttgtgcttcggaatttaccattgcactt

SEQ ID NO: 27105 - DNA, 101 bp, rice(Oryza sativa)
  misc_feature (71): n=t or g
ttctttcgaggcaaatgttgcaagcaaagctaagatagatagcgagatgagatccatggttggatggatgnatatatcaacatacaccgctctatcttgtc

SEQ ID NO: 27106 - DNA, 101 bp, rice(Oryza sativa)
  misc_feature (71): n=a or g
tcatgtgtctctcaacacaatgggcaatgtgtcttaggcatgcgatgaggcatgttgtttttatctttttnttatagtctttcaagattacggtgttgtaa

SEQ ID NO: 27107 - DNA, 101 bp, rice(Oryza sativa)
  misc_feature (71): n=t or g
caacgtcggacataccatgaacactgcacaattgggtctaagttacagcagagcaaagtttagctgttccnctccataatccatgaagatttcaaaataca

SEQ ID NO: 27108 - DNA, 101 bp, rice(Oryza sativa)
  misc_feature (71): n=a or g
tgtctagctagctagctctgagtccagcagttgagccggaaatcaaagttaggtgcatctagtcgatcatnagatgcagctctatgcatgcatgcatgtgt

SEQ ID NO: 27109 - DNA, 101 bp, rice(Oryza sativa)
  misc_feature (71): n=a or g
aaattaatgtcagctcaacacactatattgccatgagcttaatcaagtcataggcattaacgcaagttagnccctgtttctttcagcttaggattattata

SEQ ID NO: 27110 - DNA, 101 bp, rice(Oryza sativa)
  misc_feature (71): n=t or c
aggacatgatgatgttgaaattcaagtcaaaacaggggcgaagttcataccaaaatgaagcttgcgcttancctcattttttttcctgaataaagcagtga

SEQ ID NO: 27111 - DNA, 101 bp, rice(Oryza sativa)
  misc_feature (71): n=t or g
gcataggactcgactgttgaagctccaaggtaacgggcaactcatgataattctttgaatgacagagtatnaattacatacttagttataagagataaatg

SEQ ID NO: 27112 - DNA, 101 bp, rice(Oryza sativa)
  misc_feature (71): n=a or g
caagcagtatgcttttaaatcttttttcggcggacatgcattctctaaactaggtgatgccccacgctttnctgcgggattcatgaatatgataaatatta

SEQ ID NO: 27113 - DNA, 101 bp, rice(Oryza sativa)
  misc_feature (71): n=t or c
tattcgcgttgtaaaataaacttcttctcatatccctagaatattcgttctagctaagagcttatcgtctncccagacagtttcacccgaagagaacactt

SEQ ID NO: 27114 - DNA, 101 bp, rice(Oryza sativa)
  misc_feature (71): n=a or g
tacatatcatatcatcacatgtagctagtttaagctttcgctggaataattatatatacatgctttaatcnattgatttagattgtttgcttaggaaaata

SEQ ID NO: 27115 - DNA, 101 bp, rice(Oryza sativa)
  misc_feature (71): n=t or c
gtttggcttggccaagaaacggagcagctgaaatctgaacacctcttttgatgttgctacaaatttattanattagtatcaattactatcagattgaattc

SEQ ID NO: 27116 - DNA, 101 bp, rice(Oryza sativa)
  misc_feature (71): n=t or g
tgccctacggcaaagggtcacagtggactggcattatggccaaatatcttgcccaaatgatcagaaatgangcctaattcaagtgctataataaaatcgcc

SEQ ID NO: 27117 - DNA, 101 bp, rice(Oryza sativa)
  misc_feature (71): n=t or g
agacatcttatttatagtctagagacgttttgaacccgtctttaggcatacatagagtcgcttcttcaaancgtcccagaagcgtctccgttaggaccgtc

SEQ ID NO: 27118 - DNA, 101 bp, rice(Oryza sativa)
  misc_feature (71): n=a or g
tcccaaagatatacttttacggtatagctaagaccgcaaagttaaggtattcggtagacaattttgccttnaaatatacatcccatatggattgttccact

SEQ ID NO: 27119 - DNA, 101 bp, rice(Oryza sativa)
  misc_feature (71): n=t or c
gaattttggtaattaaccgtctttcgcaggagcggagcgaggagaggtgtgcaatatatccacacgctaanccctctgttaatccaacttgcgacgtgagc

SEQ ID NO: 27120 - DNA, 101 bp, rice(Oryza sativa)
  misc_feature (71): n=t or g
ccgtacaatataagtacagtagattatagatcatcatggtaggagtagattataagtacaggatgtgttcntgtttatagtttcccagtactacctcgtct

SEQ ID NO: 27121 - DNA, 101 bp, rice(Oryza sativa)
  misc_feature (71): n=t or c
taacatatatgtggtcctttcaaggaaccacaatcgagaaacgaataaagctttgataaattatctcaganagacgtcttaagaaatcaccgaggacaatc

SEQ ID NO: 27122 - DNA, 101 bp, rice(Oryza sativa)
  misc_feature (71): n=a or g
tggtgggcctcgtgggccggagtggtgggattctgctttttctttgtgggctggtttgggccttagctacntgcagcatgggctgaagggtccttttttca

SEQ ID NO: 27123 - DNA, 101 bp, rice(Oryza sativa)
  misc_feature (71): n=t or g
cagatccatataaatctagccaccaagcccgcagaggaggcctagtcatgaccttccgtcgcgctctatcncagctgccccaacacgccactgctccactt

SEQ ID NO: 27124 - DNA, 101 bp, rice(Oryza sativa)
  misc_feature (71): n=t or c
caactaacaacggccatggacgttgcagggtacactaccaactatacatgcactgcagattagttagcacntgccatcttcaccaacacagtaaccgtcta

SEQ ID NO: 27125 - DNA, 101 bp, rice(Oryza sativa)
  misc_feature (71): n=a or g
agattgatgcaaggagagtttcttctagttggtccgattaacttatgggccgtgctcgcactacgagtccncgggttctcaaacaaaagcttattgggcct

SEQ ID NO: 27126 - DNA, 101 bp, rice(Oryza sativa)
  misc_feature (71): n=t or c
ttctttttcatgtttctcaatcatgggttttagagtgtatgcacttgtgtaaacaacctttggctgtgtanatccactttagatatagaggctggatttta

SEQ ID NO: 27127 - DNA, 101 bp, rice(Oryza sativa)
  misc_feature (71): n=t or c
gatcgaacagataaagctataccttagcctaccagacagaactaatgcccatcagtcccccaaaagcagcntcctccccctcttgtcacccccatgagggc

SEQ ID NO: 27128 - DNA, 101 bp, rice(Oryza sativa)
  misc_feature (71): n=t or c
tggtaatggaagttttaaggtgggggaaagtctctcccccgtctaccttttgaaaaaaaacatactacctntgttttttaaataaataacgtaattgactt

SEQ ID NO: 27129 - DNA, 101 bp, rice(Oryza sativa)
  misc_feature (71): n=t or c
gtgagtggtgacatgtctgtttgttgcggtggtcgcgctgcgcccacagcaggaaaacggtcatagcagtnctacgaaaaggattctcagttgaaaaaaaa

SEQ ID NO: 27130 - DNA, 101 bp, rice(Oryza sativa)
  misc_feature (71): n=t or g
ggttgagagttatttatccacttgatctcctctttccatttcccaaaatcagagcaagtccgcaaaattanggataacagtcgccacggctggctcaattg

SEQ ID NO: 27131 - DNA, 101 bp, rice(Oryza sativa)
  misc_feature (71): n=t or c
aattaatacaaacgacaacgacgagctttggtaatgaaaacggtctggtgagcgcgtcaaaacgtgttcgngaacgagggtgttctgttgtccttcaacgt

SEQ ID NO: 27132 - DNA, 101 bp, rice(Oryza sativa)
  misc_feature (71): n=a or g
tcttctgtggaaaatataatttttgctcttttactgtacatggcttatatgtgtatgaaaatatctaatgntagtgtgatctgtataggacagcttcctga

SEQ ID NO: 27133 - DNA, 101 bp, rice(Oryza sativa)
  misc_feature (71): n=a or g
tctgtctctgtccaccactacgacaactagaactccagtgattatttattctttgcagtgtgtttcccccnccataatcctcggcctcgcatcttctaatc

SEQ ID NO: 27134 - DNA, 101 bp, rice(Oryza sativa)
  misc_feature (71): n=t or g
tctcttcatatctggattcgaagacaataaagggggtgtgtggttgaagggattattctcagtgttatttngatttcaaatttataataggatcctgagga

SEQ ID NO: 27135 - DNA, 101 bp, rice(Oryza sativa)
  misc_feature (71): n=a or c
tgcatcacattcagagagcaaagctaatccaaccatttggttgcttgttggcccttgatgagaagaccttnaatgttatagcgctcagcgagaatgcacca

SEQ ID NO: 27136 - DNA, 101 bp, rice(Oryza sativa)
  misc_feature (71): n=a or g
ggctataattaagcccatgtagaaacagttgttcgaccgagccataagtcggccacaaatcccttgatacntacgggactaaagatcgcatatgttcgttg

SEQ ID NO: 27137 - DNA, 101 bp, rice(Oryza sativa)
  misc_feature (71): n=t or c
ataagcttgcagagttatatatggcaagagttgtatgtttacatggtgctcccaagaaaatagtatcaganagaggtagtcagtttacttcgaagttttgg

SEQ ID NO: 27138 - DNA, 101 bp, rice(Oryza sativa)
  misc_feature (71): n=t or c
cctgacgatttaaatagaagcgcaaacatcttagtgttgcaaaacagtgatagcctattggttgatgtctnaagctctgaaccagagggttctaggttcga

SEQ ID NO: 27139 - DNA, 101 bp, rice(Oryza sativa)
  misc_feature (71): n=t or g
gacgttgacagcgtgtatcgtccacagactagccagtcattggacatggattgccgcaagctggtaccccngctgccttctctccaaagtatcatccttcg

SEQ ID NO: 27140 - DNA, 101 bp, rice(Oryza sativa)
  misc_feature (71): n=t or c
cgcctacgtataatatccttttaggtggccatcataacctagccgttgcgaaaacattcttcattagtgantgctttacgacaaccgccaacgaatatatt

SEQ ID NO: 27141 - DNA, 101 bp, rice(Oryza sativa)
  misc_feature (71): n=t or g
aaaccacgaagtgtaaaaggaaggtattagaagattgcaatggccaagatcatcttgatgaatttggcaangaatatagagtcaagtcagacaaagctatt

SEQ ID NO: 27142 - DNA, 101 bp, rice(Oryza sativa)
  misc_feature (71): n=a or g
tgcgttgaaatttgataagactaatagatgcactaggaaacggataataagaaagtccatgagtattgtcngggttatggataaagcatgtccaaaagttt

SEQ ID NO: 27143 - DNA, 101 bp, rice(Oryza sativa)
  misc_feature (71): n=t or g
gcaataagagacaagtttgagaaacatgtgtccaatgaaggaacatcaagccaatgaagacaatgaagcantccaagatcatttttgcgcatggcatgata

SEQ ID NO: 27144 - DNA, 101 bp, rice(Oryza sativa)
  misc_feature (71): n=t or g
acatttccgaactcgttcccggacgcttgtggtaatatgttctccatcagggcatgagtttattaactgtnctcgatcggattaatgctagtgcctaacaa

SEQ ID NO: 27145 - DNA, 101 bp, rice(Oryza sativa)
  misc_feature (71): n=a or g
ttatgaaaaattatttagagtatagtgatatttattggtccacaaaaatcaaagaaaaagtggcctacacnttaagtaaaaaaagataaatctgggtatga

SEQ ID NO: 27146 - DNA, 101 bp, rice(Oryza sativa)
  misc_feature (71): n=a or g
gtcaaccagtaatgccttctcacagctgatcaacacagaagggaggtgaatttggagtgaaattgtcctangagtcactgcaaaaaaatgttgaacatgtt

SEQ ID NO: 27147 - DNA, 101 bp, rice(Oryza sativa)
  misc_feature (71): n=t or c
ccgagtcaaatgggctagttgtcatttgtttgaagaaaacagtcaagttgcagtggcgagcaaacattcancatttctatttttcaaccttctcacaataa

SEQ ID NO: 27148 - DNA, 101 bp, rice(Oryza sativa)
  misc_feature (71): n=t or c
acaatgcaggctgagtatgtggcatgttatgaagctactagacaggcaatatggctgaagaactttatccngggattgagagtggtcgacagtatatcaaa

SEQ ID NO: 27149 - DNA, 101 bp, rice(Oryza sativa)
  misc_feature (71): n=t or g
gttcagattataatatgcacactcaccgatccaatctcaccaggtatcctgctaaaagggcccaaagtcanaactacatctgcaaattaacaatcattcta

SEQ ID NO: 27150 - DNA, 101 bp, rice(Oryza sativa)
  misc_feature (71): n=t or g
ttcgtagccttcacgccataatcctcaaccacgagtactcgtttttacaggccggcaccatgtgcatgccntgctagatgaattatttccatttccttatt

SEQ ID NO: 27151 - DNA, 101 bp, rice(Oryza sativa)
  misc_feature (71): n=a or g
agaaaaagcaaaatgaaaaacatagtaaatcagacagcaacagagcttgctaacacactactctctctatntctttcgtcccgatacaatacataatttta

SEQ ID NO: 27152 - DNA, 101 bp, rice(Oryza sativa)
  misc_feature (71): n=t or c
tactacttcccaatccaaccggccactgttcatgattatctatatttacagatgtattgctaggcacgatnttttttaatcaagtaaatttctagtgaata

SEQ ID NO: 27153 - DNA, 101 bp, rice(Oryza sativa)
  misc_feature (71): n=t or c
tgttgctctttctcttgtgctgtcccgactaagctttaagccagattacaccatgaatgcagtgttcgtgntgtcaatgtacaaccattcgaagggaaatt

SEQ ID NO: 27154 - DNA, 101 bp, rice(Oryza sativa)
  misc_feature (71): n=a or c
ttgcacaacggcatgatgtataacacggtagtagtactgccgctagttgtctatttgtacttatcctctgnatgcacgcgttgcgttgcatgcaatcgcat

SEQ ID NO: 27155 - DNA, 101 bp, rice(Oryza sativa)
  misc_feature (71): n=a or g
tccgacgcgagcgagccaagctgctgacctacataggagtgtacatgttgatgaggtgtggtgtagtaatnacttggggttgggacgtgaacgtgacgagc

SEQ ID NO: 27156 - DNA, 101 bp, rice(Oryza sativa)
  misc_feature (71): n=a or g
ccttcctggagttgcatcttgagcatgcagtcacctaggcagttcaaaagattagcaaaacaccaattaanctgcctttttttgttgttgttcgagtgaac

SEQ ID NO: 27157 - DNA, 101 bp, rice(Oryza sativa)
  misc_feature (71): n=t or g
ttgtggggatgcctgctgcattattactgcaagtatgaattaattctcacttcaattagttggagaaattntattggagtgtttaattaacatgtttttat

SEQ ID NO: 27158 - DNA, 101 bp, rice(Oryza sativa)
  misc_feature (71): n=t or c
tcggcggggaagcgtggaggagctcggcgatgaagtcgattgccacagtgcaacgtattaattatatgtantctttcgtggtttaagccccagcgtgatgc

SEQ ID NO: 27159 - DNA, 101 bp, rice(Oryza sativa)
  misc_feature (71): n=t or c
tttggcaagataccaggtgcctaccattagaatgtgcttggtgccttggttagttgtcatatactgttccntccatgtttagtgtgttaacaatttactct

SEQ ID NO: 27160 - DNA, 101 bp, rice(Oryza sativa)
  misc_feature (71): n=a or g
gcgaaacaccatcgatgtaattaatacatggtgggtagtaagtttcatttctggcacctcacccctcacanccatcacatatcttctagcgcaaacacttg

SEQ ID NO: 27161 - DNA, 101 bp, rice(Oryza sativa)
  misc_feature (71): n=a or g
cgtctgggacatgggaatcaaagtaatttttttactcgctcctcctcgtggatatcggatgaggtgtggcntacatatccaaccgaaacagtaaaaaggga

SEQ ID NO: 27162 - DNA, 101 bp, rice(Oryza sativa)
  misc_feature (71): n=t or g
agtattatgagcgacatctcaacgatcaccactactcagtagtttctattctctccaccccgaaatataanatattatagcactcaaaatttattgtacaa

SEQ ID NO: 27163 - DNA, 101 bp, rice(Oryza sativa)
  misc_feature (71): n=a or g
ttgacatgtagcctgctggattcaatagacagtagaatcatataacctggaaatgagcagctcaatcttantgtctttttgtgtctcacagtatgtaactc

SEQ ID NO: 27164 - DNA, 101 bp, rice(Oryza sativa)
  misc_feature (71): n=t or c
tttgcttcattgagttgaggctgatgtcttttagctcaagcgtggtacaccaatgccactgatattgtccnatgctcgagagtgatcagatggcatcagtg

SEQ ID NO: 27165 - DNA, 101 bp, rice(Oryza sativa)
  misc_feature (71): n=a or g
aggcagacaccgagccagctactagtatatttgttcgacgaatgttcaacacacctgaatgtaaatatgtnttgtgctaggaaatactactaatgtaataa

SEQ ID NO: 27166 - DNA, 101 bp, rice(Oryza sativa)
  misc_feature (71): n=t or c
aacgggatctattcttctatccagcttggacgtattccttgccatcatggatccttaagacccctatctcnttcctcaatacgattgtttgggtcttccta

SEQ ID NO: 27167 - DNA, 101 bp, rice(Oryza sativa)
  misc_feature (71): n=a or g
gggatatgcagcagcagcagcagcaacacatctggattctggacagatgtccatgatgaacaatgcaatcncctcgatgacgaccgtcggatcggcgatcc

SEQ ID NO: 27168 - DNA, 101 bp, rice(Oryza sativa)
  misc_feature (71): n=t or c
tcgaaatttcacatgcgaaaaaaatctctcacaacagtatgactgtgaagtctgactgtctgagtgtctgnttcatcaagcttctggtgtagtggcagtag

SEQ ID NO: 27169 - DNA, 101 bp, rice(Oryza sativa)
  misc_feature (71): n=a or g
aaataaaatgaatggccaagcctatctttaataaaaggttaatggaggtagtagtaatggggggcgatgtntgtacgtacccgacggcgaagaaggcgtag

SEQ ID NO: 27170 - DNA, 101 bp, rice(Oryza sativa)
  misc_feature (71): n=t or g
catatatggaggaaggctatataaggaggagaggggtgctcatattgtacacttgtacttgaggatgatanaatgatgaatgagaagagagtctcacccct

SEQ ID NO: 27171 - DNA, 101 bp, rice(Oryza sativa)
  misc_feature (71): n=t or c
gtggggggggagtattgtgatagatatccaagctgagaatggcaccataataggctcacattgattagtcnaataattgtgtagagtttgatggagctcca

SEQ ID NO: 27172 - DNA, 101 bp, rice(Oryza sativa)
  misc_feature (71): n=t or g
cacacggagtggagtactgattagtacatttcttcagacggcaggcatgatcgatcctgaagccattgcanatctacagggaccaaaaactcttagaataa

SEQ ID NO: 27173 - DNA, 101 bp, rice(Oryza sativa)
  misc_feature (71): n=t or c
ctgatcgtgcaatgattaagaaataacattgatcgtgcagggcaaaccaaacaaattaaggaacccatacnatatattaaaaacatactttgtactttaac

SEQ ID NO: 27174 - DNA, 101 bp, rice(Oryza sativa)
  misc_feature (71): n=t or c
ttaagatgccgatgctctgtaccctctggcttctcgaaaactgtctgatctggtgacaaagttaatttagncgattcttcttcaacttcatcaacatcggc

SEQ ID NO: 27175 - DNA, 101 bp, rice(Oryza sativa)
  misc_feature (71): n=t or g
tagtaattgatccatcaccaattctccatccactgcctagcgttcacgatttccttttctcgattccagtntttaaccctaatcaattccaaatttccaat

SEQ ID NO: 27176 - DNA, 101 bp, rice(Oryza sativa)
  misc_feature (71): n=t or c
gagccctgcgaagttggcaagcccgtagagggcagttggctccggaggcctcggaaccaactgaagggctncgagggtctcgaagcccagtcaagggaccc

SEQ ID NO: 27177 - DNA, 101 bp, rice(Oryza sativa)
  misc_feature (71): n=t or g
taaaaggaaaagtttatcttttcccatcgcgtgataggtaaacgagaaaccggaaaacacctttttttttntggctccgtttttctttttgtcgttttctg

SEQ ID NO: 27178 - DNA, 101 bp, rice(Oryza sativa)
  misc_feature (71): n=t or c
agtgtcatgcaacatgtatcttaatgcagtttactccaaacagctcctccattctcaaaatagatgtcatngtcaaatcttcaaatgttaactccctaaca

SEQ ID NO: 27179 - DNA, 101 bp, rice(Oryza sativa)
  misc_feature (71): n=a or c
agacgttactccatgtgctgaagattgttgtatccctagggatctgacatctagtggttcgtggtgattcntagttggttgtcaatcaagtcatgaaagat

SEQ ID NO: 27180 - DNA, 101 bp, rice(Oryza sativa)
  misc_feature (71): n=t or c
aaccgtattggctctaacatcagtattagcagtaataatctcaagcccaacatcagtttttcctctcaggnaggagtggcaaaccaaacaaggaaagcatc

SEQ ID NO: 27181 - DNA, 101 bp, rice(Oryza sativa)
  misc_feature (71): n=a or g
ctgcctctaaaaatattttagttctccagtaaaatcaggcaactggaaagctacatatagcactacaactngtagtggtaatacttaactatgtggcggct

SEQ ID NO: 27182 - DNA, 101 bp, rice(Oryza sativa)
  misc_feature (71): n=a or c
tcttccagaagaacaggtcaggttacctagagaatcttgcagcaagtgcgtcaactttgaattcctgcccngaaaaggaatataaacagtgagaaacataa

SEQ ID NO: 27183 - DNA, 101 bp, rice(Oryza sativa)
  misc_feature (71): n=a or g
atgtccccaaaggaatgccaaaatacctcggccgaatcatgtagtgaaacggtattctcgtgtggaacctnatctcaatctcgttttcaatatttaacaag

SEQ ID NO: 27184 - DNA, 101 bp, rice(Oryza sativa)
  misc_feature (71): n=t or c
cttttcattaccgctagccggagtgcttgtgtggacctgaacatcgatcccatcagctagcttcttcttcntgcatgcgcgcatgcacacagtatttgcaa

SEQ ID NO: 27185 - DNA, 101 bp, rice(Oryza sativa)
  misc_feature (71): n=a or c
tgatgatggagaacctttttagcgtgttttttgcgctttttttctgacttttgcctcacgttattttaacngttttattttctcatgcattttctcttttt

SEQ ID NO: 27186 - DNA, 101 bp, rice(Oryza sativa)
  misc_feature (71): n=a or c
ccgtataacccgtcaacattgctgagcccaacccaaaactagtgcgtatacactaacactagacactttanaaaaacgacggttatttacatgcgcttgga

SEQ ID NO: 27187 - DNA, 101 bp, rice(Oryza sativa)
  misc_feature (71): n=a or g
tcaagagaaagaacacacctgcccaaaatggtggtacaccgcaaagaagtatgtaaagtatcactcctgcnctccagacatcaacttcagggccatagtgt

SEQ ID NO: 27188 - DNA, 101 bp, rice(Oryza sativa)
  misc_feature (71): n=t or c
ctatatatatctgcagtgtgcactctctgatcctcatccaacccaattattgatgtcacatatgggctaanagtatatctgtcctgatgcaaatgacgcta

SEQ ID NO: 27189 - DNA, 101 bp, rice(Oryza sativa)
  misc_feature (71): n=a or g
tggtatcaccactctcctctttgtcttctggtatctgctctatgctcgatggcgagtttgacacagatctngcgacgacgacctcccacactcctcttccc

SEQ ID NO: 27190 - DNA, 101 bp, rice(Oryza sativa)
  misc_feature (71): n=t or c
taatccttggatttaaaacagcaataaacacccttccaaactcacttttccttgttgttttcatatcaacngtttgggtggcccctaataaggatcccaca

SEQ ID NO: 27191 - DNA, 101 bp, rice(Oryza sativa)
  misc_feature (71): n=t or c
gagccgcgctggtgcgctgccaccattccaccgccgcttgactccactatgccgccatcgtccacggcttntgtcccaacgaggagaggtggaagctaggg

SEQ ID NO: 27192 - DNA, 101 bp, rice(Oryza sativa)
  misc_feature (71): n=a or g
tgtagttatcttcctggcacaacttgctggtttatcaaataggagtgctagcttagtaactaacttgctgntaaatcattttcaaaacagatcatctattt

SEQ ID NO: 27193 - DNA, 101 bp, rice(Oryza sativa)
  misc_feature (71): n=t or c
gtgaggacatgaactatttatgaccagagggagtagtcattaatggaaaagagcaaaacccataacaccanattcgcaattattactaccaagcaaaaatt

SEQ ID NO: 27194 - DNA, 101 bp, rice(Oryza sativa)
  misc_feature (71): n=a or g
agtataagtagcagatacagacctcggttaagacatgaataccttcaacaccatcagcagcaagatgttcntcaagcatattaaatcggctcagcagctgg

SEQ ID NO: 27195 - DNA, 101 bp, rice(Oryza sativa)
  misc_feature (71): n=t or c
atgtatgtatgatgcagcgatagggtaggcgtccgatatttctgttttcataaacttctaacttttttttncaaactaccaactttcctcaaacttcttca

SEQ ID NO: 27196 - DNA, 101 bp, rice(Oryza sativa)
  misc_feature (71): n=t or c
aaagggaaaggctgattgtgaattgagcacctcttcccacagccgatccatcagtaagatagtagaacggnaataaatgagtggacgtccacctaaatgat

SEQ ID NO: 27197 - DNA, 101 bp, rice(Oryza sativa)
  misc_feature (71): n=a or g
agcaaattaatctgaaagtccaaaattctgatccagcaagttcttgtatcatagagcaagaattgcccccncaactctcttacacaaaacaaaatcctgaa

SEQ ID NO: 27198 - DNA, 101 bp, rice(Oryza sativa)
  misc_feature (71): n=a or g
tctccatttatatagtagctatagattatgtttgttacgtagtagtatgtccctctgaaaactttgttgtntcacaaggtgtgcctagttaatatgaagta

SEQ ID NO: 27199 - DNA, 101 bp, rice(Oryza sativa)
  misc_feature (71): n=t or c
aattgaaagtagaataatactcgtggcagtcaaattcctcctgttgttatgtggcagaaataggagttacntggacttgaaagtatattcccatcttaaca

SEQ ID NO: 27200 - DNA, 101 bp, rice(Oryza sativa)
  misc_feature (71): n=t or c
tgttattataattacgtattatcccgtcctaaaataaaatatagtaacctaaaacttgatggaacatatcntatcctagtcaacgaatctggacaacctct

SEQ ID NO: 27201 - DNA, 101 bp, rice(Oryza sativa)
  misc_feature (71): n=t or g
caagtttcatgtatatatggagggagtattaaggtttgagaaggaggagtgtaatgctcctcattaaatgntgtataagtaagagcgagagaatagttatg

SEQ ID NO: 27202 - DNA, 101 bp, rice(Oryza sativa)
  misc_feature (71): n=t or c
tggatacaaatgccaagttgtcagctattgttggtgctcctgttgctgatcctaccgactaccggagtctngttggcgccctgcagtacttgagtttcacc

SEQ ID NO: 27203 - DNA, 101 bp, rice(Oryza sativa)
  misc_feature (71): n=t or c
gagaacagctgtgccatacaagatggatagtaaaaggacagtattcatcgaaatttatctctctctctctntctctctctctctcaaataaagttaagttt

SEQ ID NO: 27204 - DNA, 101 bp, rice(Oryza sativa)
  misc_feature (71): n=a or g
agtaggaagtcaacatgaatatccatataactggcaatatatttgggttgaggccaataaatcgagtttcntgctaggatcacttcgttgcaccaatatgt

SEQ ID NO: 27205 - DNA, 101 bp, rice(Oryza sativa)
  misc_feature (71): n=a or g
catggcaggcagcggagcggtctcctctttccacctatactttgatgatcagcgcttcctattccacgacnagaaaggcagcaagaagatgatatcgacga

SEQ ID NO: 27206 - DNA, 101 bp, rice(Oryza sativa)
  misc_feature (71): n=a or g
ggatccgttgttattttagagaggatgagagtctgttgaagtgatcatctaccatatgggtgtttggaaantctaatttagagagactgttggagatgcta

SEQ ID NO: 27207 - DNA, 101 bp, rice(Oryza sativa)
  misc_feature (71): n=a or g
cggataataaattaatccttcctaacaactgtaaatagggcatggattcggttccatacattggtctgcgngatttggaatgaaaaactcacccggaggtt

SEQ ID NO: 27208 - DNA, 101 bp, rice(Oryza sativa)
  misc_feature (71): n=t or c
tgaaacatgagaaaaagccgaagtcaggtaaaaccgagaacacggaatagcggttaaggaaagacagaaantacgacatgagaacaagtaccccgtgacga

SEQ ID NO: 27209 - DNA, 101 bp, rice(Oryza sativa)
  misc_feature (71): n=t or c
aagaaaaactgccattttacagctcaaatccaaaatctaatctcctcatcttgctaatcaaccattgcctntgccagaaggagaggcctacttttggcttc

SEQ ID NO: 27210 - DNA, 101 bp, rice(Oryza sativa)
  misc_feature (71): n=a or g
gtgtatatagagaagatggactgggagacgtcctgtcagcatgtgtgatccttcatctatctttctatatnaaagtttgtaatgtgtgtctgttctttttg

SEQ ID NO: 27211 - DNA, 101 bp, rice(Oryza sativa)
  misc_feature (71): n=a or g
catcgctcttgacttccacgctcttgtcacaaattagtgtcaccagtgacgctaaggaaagcacaatgacngtggccgcaacaacgacacaaagacaacac

SEQ ID NO: 27212 - DNA, 101 bp, rice(Oryza sativa)
  misc_feature (71): n=a or g
actattgctgtttttagatgtatcattcctgatggccatatcatcttgaaaaaggttaggaattgattacntcatcttatattgactagtgaactaattat

SEQ ID NO: 27213 - DNA, 101 bp, rice(Oryza sativa)
  misc_feature (71): n=a or g
attcatgcaaaaccacactgcaaacccctgcatctgaaagaagaccaatgtaccaacaaagagaaacaaanatccaactaagggcccctttgaattggagg

SEQ ID NO: 27214 - DNA, 101 bp, rice(Oryza sativa)
  misc_feature (71): n=t or c
gtaagggttgggttttgggcgatctcggccatgtttcgttgtcagcctagcagcgatcgatcacgcttagnaacggccggtccggtgctatccttctcttg

SEQ ID NO: 27215 - DNA, 101 bp, rice(Oryza sativa)
  misc_feature (71): n=a or g
tgattccgaaatcttacgcctacgatcactctcctgttatatctgtctggttcgtgtttgtgcgaaaaaanaggctattatattcatttatcttggtagga

SEQ ID NO: 27216 - DNA, 101 bp, rice(Oryza sativa)
  misc_feature (71): n=t or g
ttaccctcacttaaatatctctttttgttcccctctattttggtttcaatgagaattttatgtttcccaanagggagatagaaattctcttttaatattag

SEQ ID NO: 27217 - DNA, 101 bp, rice(Oryza sativa)
  misc_feature (71): n=t or c
ttcgtccacgatcaattgtaaaagagggagacaaagctatcattgacacaggaaaaatatactccctccgnttcaaaatatttgacaccgttgacttttta

SEQ ID NO: 27218 - DNA, 101 bp, rice(Oryza sativa)
  misc_feature (71): n=t or c
ggcaccaaagtgaacaggcctttagaacacatgatgagtatagcacgatctagtttctatgtgcacaaaantactttaaataaaaatcatatgctacacat

SEQ ID NO: 27219 - DNA, 101 bp, rice(Oryza sativa)
  misc_feature (71): n=a or g
gtgtgcgtgaaaacataagagtgggaatttagtggcaatttaaggggattcttttcgtttgatttagattntcgagtagattattacgacggattatcgat

SEQ ID NO: 27220 - DNA, 101 bp, rice(Oryza sativa)
  misc_feature (71): n=t or c
gatatattcaggagcatttttaatggcaaacaacttcacatctcaacaaccagctcatcacccaaagcatnatcctgctagatgaaagggtttacaggtct

SEQ ID NO: 27221 - DNA, 101 bp, rice(Oryza sativa)
  misc_feature (71): n=t or c
gcaatcaacttgaccattgctcataggatgcgctatggaagcataataaatctgaataccaaagtcttcanagaaatctttaaaaaccccaccagtgaatt

SEQ ID NO: 27222 - DNA, 101 bp, rice(Oryza sativa)
  misc_feature (71): n=t or c
ttatagtaggcttatagcctgctattgttcctgctttaagtactactctgtccgtaccaagatataagcanttttggacctcgtcaaagtcttcgggatgc

SEQ ID NO: 27223 - DNA, 101 bp, rice(Oryza sativa)
  misc_feature (71): n=a or g
ggtcccatcagtactatctttttttttctttttcatatcccaatctctctctcctctctttcttcttatcngggaatccaattttggagaggggctcggcc

SEQ ID NO: 27224 - DNA, 101 bp, rice(Oryza sativa)
  misc_feature (71): n=t or c
tacctgcaagctgtcaagccagacccacccgttttcgtagcgtcctccgaacaacagtctcgtgcttgtanaatgcggagctgaccctccccatcaaatcc

SEQ ID NO: 27225 - DNA, 101 bp, rice(Oryza sativa)
  misc_feature (71): n=a or c
agcaggtacagttacactgagcaaccgaatactcaatagggtcatagatgaaacggagtactattctgggngtgctctttcatctctcaatcgaattaccc

SEQ ID NO: 27226 - DNA, 101 bp, rice(Oryza sativa)
  misc_feature (71): n=t or c
cagaatcagaaattgatcatgcaagagggctccgacagggagatccgctctcccctatgctttttattctngcaatggaacctttatacaaattatttgag

SEQ ID NO: 27227 - DNA, 101 bp, rice(Oryza sativa)
  misc_feature (71): n=t or c
acattctccctcatttggatcgaaagactttaacaagactcatcatgactcatttagtggtgtaaggctcnagttcaagactcgggtaacaacattgtgga

SEQ ID NO: 27228 - DNA, 101 bp, rice(Oryza sativa)
  misc_feature (71): n=a or g
attgtgctgaaagccaaggacaaagtgaaagacatctatcacaaagactttgtcattgatgaagacagtgnatggctccttcaagggtggaaaggaaggat

SEQ ID NO: 27229 - DNA, 101 bp, rice(Oryza sativa)
  misc_feature (71): n=a or g
tttattattattataccgttaaattatgtgtattgaaatatcgctcgaggaaagaaagggtcgagcggctngcagccgggactaccacgtgagctacacac

SEQ ID NO: 27230 - DNA, 101 bp, rice(Oryza sativa)
  misc_feature (71): n=a or g
gggggggacccaatacatcccttattaataggaaagtcattgtaccagtgggtggatagtgaagggtgttnaagggataaaacttcgtgaattgtgaaaat

SEQ ID NO: 27231 - DNA, 101 bp, rice(Oryza sativa)
  misc_feature (71): n=t or c
catcgaggaacagatatgctgatggcttgacaatcttccacctcagtctgcctggatagagcatctgctgnggtgttctcagctcctttcttgtattgaat

SEQ ID NO: 27232 - DNA, 101 bp, rice(Oryza sativa)
  misc_feature (71): n=a or c
ccaaaacacacacacacacacacacacacacacactatcattcacagttaaacctctttctcagtgtcacnattgtcggtcatgacagtgccgcccgcagg

SEQ ID NO: 27233 - DNA, 101 bp, rice(Oryza sativa)
  misc_feature (71): n=a or c
ttgtatgagagggagtatagtaggccaaacaggtggcctagcccaacacagcaagggcctgatggcaggcnaaggccacgacgcaatgaggacccgcacca

SEQ ID NO: 27234 - DNA, 101 bp, rice(Oryza sativa)
  misc_feature (71): n=a or g
gaaacaagacgaccttcttcattgaagaccatcctgttggacacaaccttaatgttcttgaatgatctgtngagtttctgccggaagacctagaagacaaa

SEQ ID NO: 27235 - DNA, 101 bp, rice(Oryza sativa)
  misc_feature (71): n=a or g
cggctgttgccggggttgttcaacataaactggggtttggtacctgtaaagaacatattagcattccaaantaatttcctttgtatagaactgcaattcaa

SEQ ID NO: 27236 - DNA, 101 bp, rice(Oryza sativa)
  misc_feature (71): n=a or g
gtcatcaatatcctagctggaagagtgagaaacgaggagagatggaagaacgggcgcttatattgtcgccngctacagcacagaaaaaaagacagtgtcgc

SEQ ID NO: 27237 - DNA, 101 bp, rice(Oryza sativa)
  misc_feature (71): n=a or g
cgatctctatgtgctgactgctaattaaagcagggaaaattaccggacaatgacaaaagggaaacgtaccngccatcgctttgtgctaactgctaattaaa

SEQ ID NO: 27238 - DNA, 101 bp, rice(Oryza sativa)
  misc_feature (71): n=t or c
actatgtacacatattcaacacaaactctaacacagtctgcaggctacagccacacactctggatttggtnagtctttgtccttactactagtatgactga

SEQ ID NO: 27239 - DNA, 101 bp, rice(Oryza sativa)
  misc_feature (71): n=a or g
actacaagcccatcatgggcccaactttggcccttatatttgaagaagaagcccattatggaaatcagagncccacatttggcccatttatgatccgttca

SEQ ID NO: 27240 - DNA, 101 bp, rice(Oryza sativa)
  misc_feature (71): n=a or g
gaataaataaaggggttacctaatttgcatgcatgcggtgctggatctttgtgtttcctttccaacaaggnttgcagccgacaccactttttcaatataat

SEQ ID NO: 27241 - DNA, 101 bp, rice(Oryza sativa)
  misc_feature (71): n=t or c
acatcctcttttccctccgcgactccctccgcaagagcttaacaagcctgcaccaactagcgttgtcgtgnggcgtggagtcttctatcccgacgcacccc

SEQ ID NO: 27242 - DNA, 101 bp, rice(Oryza sativa)
  misc_feature (71): n=a or g
agtgaatggtgtcacgtgttcattgttcttctcctcctgcaacacaaaggtgttagaaaacgatacgcaantaaacgataaataataatagatcaatgaca

SEQ ID NO: 27243 - DNA, 101 bp, rice(Oryza sativa)
  misc_feature (71): n=t or g
agtgcatcgagcgcggccaccgggttggttttttttgttcgttcgttccccctttgattttactttttttnggggggttctttttaaggattgaggtgggt

SEQ ID NO: 27244 - DNA, 101 bp, rice(Oryza sativa)
  misc_feature (71): n=a or c
atttaatataacactaaaccgcctcatggcaacttgatagcttgatagcgtttgtaagaaatttaatgaanttttagtataatagattctataaaaactta

SEQ ID NO: 27245 - DNA, 101 bp, rice(Oryza sativa)
  misc_feature (71): n=a or g
gagggggaatcaacgacgaagacatgaccaaggaggaggggattggatcgcaaatttggggctaagagaanaggaacacactctctctctttttataatat

SEQ ID NO: 27246 - DNA, 101 bp, rice(Oryza sativa)
  misc_feature (71): n=t or c
aatgtggctgggaaccaaacagccccaaaatcctgcactttagccggtaaaacttccttataaactgctantggtttatatttcaaagctggaatactatt

SEQ ID NO: 27247 - DNA, 101 bp, rice(Oryza sativa)
  misc_feature (71): n=t or c
ttccaccatatacgtgttattttccatgtccttgctgtgttgatctggcaagttcgctcaaggttcaaganccatctgctttgttggctttgtttagtttg

SEQ ID NO: 27248 - DNA, 101 bp, rice(Oryza sativa)
  misc_feature (71): n=t or c
ttttctaggtaagatccttatttgcccataaaagttgaccaaatcctttgtttgcccctcattctctcaangacatgtgggtccaaggtccacatttattg

SEQ ID NO: 27249 - DNA, 101 bp, rice(Oryza sativa)
  misc_feature (71): n=a or g
gagaagaaaggaaagcaatctaaccgtgatgtggtgatactaatttctcctgagaaccgtggaaaggtgcntcctctgcttcgattatcgaagcctgaagg

SEQ ID NO: 27250 - DNA, 101 bp, rice(Oryza sativa)
  misc_feature (71): n=t or g
gcgagcgagatcggcagtggcagagtgccagagtactgatggtgaagtgtgaggtggggggcggggcgggncgggtcgggaggtgtgttgggtttgggtgt

SEQ ID NO: 27251 - DNA, 101 bp, rice(Oryza sativa)
  misc_feature (71): n=a or g
gaacaattttgcttgatttgagtccatgtcttggtgttacttcagacctcaaattatcatctgaatcccanatttgaaactgtggcttctcatgatcaaaa

SEQ ID NO: 27252 - DNA, 101 bp, rice(Oryza sativa)
  misc_feature (71): n=a or c
atgggggaaccaataatacaataacagaacttactccaaattacaaccagctgaccaaagcgtagaacagnatcatatcatgcgtacggcaatgagaagtt

SEQ ID NO: 27253 - DNA, 101 bp, rice(Oryza sativa)
  misc_feature (71): n=a or g
gatgccttcctattgaattttcaccctcagcaaaggacacatcatacttatgtagtatcggcatttgtgcnttgcaaagtgtcaagtgctaaattacaaat

SEQ ID NO: 27254 - DNA, 101 bp, rice(Oryza sativa)
  misc_feature (71): n=a or g
atttcctcttgcaatgaatatctctacccagtacattttgtactactacttcgaacgggcatggtcggtcntgcacctcaccaccagtcccatcacaaact

SEQ ID NO: 27255 - DNA, 101 bp, rice(Oryza sativa)
  misc_feature (71): n=a or g
aaaaaaacctggatgtaattttttttaacacaaatatgccgtcaatatcactgaaccgttgcacgagaatnacgagagcgtgacaacgctggtggtctcgc

SEQ ID NO: 27256 - DNA, 101 bp, rice(Oryza sativa)
  misc_feature (71): n=t or g
acaactctactaaaactaaaaaggagagatttataattttagttagcaatggcaggaggttggagaggacnagaaatatgcctgacatgtgagacccacct

SEQ ID NO: 27257 - DNA, 101 bp, rice(Oryza sativa)
  misc_feature (71): n=a or g
tcagacggggaaagccgcgtgccgtcttcgtccagtagactggtagtaaaaggctaaggacacccataatngttatctataggttctctataagagatcca

SEQ ID NO: 27258 - DNA, 101 bp, rice(Oryza sativa)
  misc_feature (71): n=t or c
ggagagtcggggaatccttaataacgaaattgtgaccatctgtttgctcaataagtgggcttggaagttgntcaaaagggctgtaaagaagattggcctca

SEQ ID NO: 27259 - DNA, 101 bp, rice(Oryza sativa)
  misc_feature (71): n=a or g
aagtggtagacgacttactatgtgaggctgtattcgggagcgccacagaaaactatatatatgcattaacncatgattaattaaatattagctaattcctt

SEQ ID NO: 27260 - DNA, 101 bp, rice(Oryza sativa)
  misc_feature (71): n=a or g
atccctttccggtaggggtaaagagatctagagctcaccgacgaattgagcatttttatccgtcgcgttcntccgttgctgcaagcaaaccagatattagc

SEQ ID NO: 27261 - DNA, 101 bp, rice(Oryza sativa)
  misc_feature (71): n=a or g
attacttgctaattgattttcttctataataatataaaaagggggggggggaggttttccatgttttgttntcggtgataatcgtcctttaattacaaatt

SEQ ID NO: 27262 - DNA, 101 bp, rice(Oryza sativa)
  misc_feature (71): n=a or g
cggcgttaatttggtacttaacagccatcaacagcgccatactggttttgtctaggttaatcacgatgtcnactgagaaggtatggagcatgcgactaagt

SEQ ID NO: 27263 - DNA, 101 bp, rice(Oryza sativa)
  misc_feature (71): n=t or c
aacgtaaacaccggaccgctagatattcattctcgaataatctcttcaccagaagctccgaataatcgcantggaactaaaatttagctttgtaaacgcgt

SEQ ID NO: 27264 - DNA, 101 bp, rice(Oryza sativa)
  misc_feature (71): n=a or g
catacgccgcttccattcgttgtttcacagtatcaattcgtgctagtgcagttattgactctgcagatganccctcagcctgattgaagaaatcatcatca

SEQ ID NO: 27265 - DNA, 101 bp, rice(Oryza sativa)
  misc_feature (71): n=a or g
gactgaggatggtcaaagctacggtttttcctttttactgggtacttgggctgttgggctaggaacttggncttccttattgggttgggctgcatgtctga

SEQ ID NO: 27266 - DNA, 101 bp, rice(Oryza sativa)
  misc_feature (71): n=a or g
tagtaagaagagcagcacggcgcatttaggtgggcactggggagcgtctacctaacctcacttgcatggcngccatgtggtgaccgccgggagagttcggg

SEQ ID NO: 27267 - DNA, 101 bp, rice(Oryza sativa)
  misc_feature (71): n=t or c
gtgttctccgttgacacgttggtgaaggcaaagatgaataggagtagtcacgcgtaacgttgcccagaaanttgatcacccgtctacccgtgcaagtacgc

SEQ ID NO: 27268 - DNA, 101 bp, rice(Oryza sativa)
  misc_feature (71): n=t or g
caaaatctaaagaacataatatcaacatctcatgatgcccaaaggcgtgtcttgaaaaaaaataaaacaanctatggacttttgcgcatagaggctgacag

SEQ ID NO: 27269 - DNA, 101 bp, rice(Oryza sativa)
  misc_feature (71): n=t or c
tctctcgctaccattcttgttttgcttttcagagggagaaagatcgaataaaatgcgaccgcgatggcttngaatgtttgacaagttgccactgcttgctt

SEQ ID NO: 27270 - DNA, 101 bp, rice(Oryza sativa)
  misc_feature (71): n=a or g
atccctcttctcatctctgccttgctagccgtgcagagggattaaggaagggaagagagatgctgtcagcngcgacgaccaagggccccgtggcgacatcg

SEQ ID NO: 27271 - DNA, 101 bp, rice(Oryza sativa)
  misc_feature (71): n=t or g
cgtgccctgcatccacagttcagaagatcaaccaagggcaaaggatcgatttgtctgtgtgcctaaacttngtggttgattatcgagcggattatctactc

SEQ ID NO: 27272 - DNA, 101 bp, rice(Oryza sativa)
  misc_feature (71): n=a or c
aacaatgacatatccgtaatgtagtacgaaagtttcgccgcatcaatctcggagagaatcagtgaaaccgncagagcacaagtcggaaggacgaatgctgc

SEQ ID NO: 27273 - DNA, 101 bp, rice(Oryza sativa)
  misc_feature (71): n=a or g
acgtgtggcggagatgtgtgtatgtattggtcgcgcacggtaagtacgtgtcggaacggaatttggaatantgtcttggtaccctgcacgtcacaaatcac

SEQ ID NO: 27274 - DNA, 101 bp, rice(Oryza sativa)
  misc_feature (71): n=t or g
cagagctgatgcatttcatgtttgaatgccatccatagatcctataaaattgttgtttgaatggagctgangtccaaagtatgaggttttcttggcaattg

SEQ ID NO: 27275 - DNA, 101 bp, rice(Oryza sativa)
  misc_feature (71): n=a or c
acccgtgaaagttgatatcagcgcccccagctgtaacttgtcattgcaagcaaagcttagccggtacctgnacacagacgccatgaacaacgtgccatctt

SEQ ID NO: 27276 - DNA, 101 bp, rice(Oryza sativa)
  misc_feature (71): n=a or g
cagcatccaagaacacagatctcgaaggaagagaacgacataccgtcactgctactactcttcgtgatgangttctccaaccagtgcatctaccgctgtca

SEQ ID NO: 27277 - DNA, 101 bp, rice(Oryza sativa)
  misc_feature (71): n=t or c
catgcatgaatcagtttatatgacattagaaaatggccgtaggaaacagacctgatcaactgactttatgntttatgctttatgcagtttgcagttgtacc

SEQ ID NO: 27278 - DNA, 101 bp, rice(Oryza sativa)
  misc_feature (71): n=t or c
atataaccgtgatccttgatggagtctaaacagttaacaatcatattattaaccataacaacatgatttcntcttgcccattgaaacaaatatattatatg

SEQ ID NO: 27279 - DNA, 101 bp, rice(Oryza sativa)
  misc_feature (71): n=a or g
gatttcctggtgtccggacaacctgcccagtcggcgtcagagtatgcactcaagtcaacagtggaagagcngcggatgtgaagaccataatcaaccgttcc

SEQ ID NO: 27280 - DNA, 101 bp, rice(Oryza sativa)
  misc_feature (71): n=t or c
atggggtcggggccaatgcttcgttttggcttgatctatttcacaacaagtgaagtgggagattgacggtnggtttacagactgcaatcagctcgggaaaa

SEQ ID NO: 27281 - DNA, 101 bp, rice(Oryza sativa)
  misc_feature (71): n=a or g
tcttttgcgtatttccagaaaaagagaaagcgagctcagttgtaaaactgtcatttcactacctgtttatnagcatacgacgtaggcatgtatctctcttt

SEQ ID NO: 27282 - DNA, 101 bp, rice(Oryza sativa)
  misc_feature (71): n=a or g
gtcaatcgacatctgatgttgctaatatttgtgttctggacttgcatgttcgtctatgaatcgaagttctngactaaataatacttatttttaataatgga

SEQ ID NO: 27283 - DNA, 101 bp, rice(Oryza sativa)
  misc_feature (71): n=a or g
tgatattattttagaaacaaagtacaaacgcgagtgcttacaacgtgcgcgcactcacctatgtgaacacncacatgcacatacccccatgagtacttctg

SEQ ID NO: 27284 - DNA, 101 bp, rice(Oryza sativa)
  misc_feature (71): n=t or c
cgctatgcttcacttttgcgcaatggattggattggatatccctttgatatttggattgacctcgttggcntccccccccccccccaggtaccgcgccatc

SEQ ID NO: 27285 - DNA, 101 bp, rice(Oryza sativa)
  misc_feature (71): n=t or c
ggttgcgcggggcagcttttgctctgacctactctgtatgcattggcatgttttcatgtctagcgtttaancgtttattttattttattttttaaaaaaaa

SEQ ID NO: 27286 - DNA, 101 bp, rice(Oryza sativa)
  misc_feature (71): n=a or g
gcaaatactctagatgagactgtcaaatcctcccatgctccaaaggaccccttcatgtcaaaggacaaatngtaccagagttacccataatataattatta

SEQ ID NO: 27287 - DNA, 101 bp, rice(Oryza sativa)
  misc_feature (71): n=t or c
gttccaatgggatccatttagttgctcccgttaaatcattatgctgttttggcactatcacattttggttngataccctaccaaaagtttggtaatgccgt

SEQ ID NO: 27288 - DNA, 101 bp, rice(Oryza sativa)
  misc_feature (71): n=t or g
tttgacagcttacaaattcaggccatggtgctttcaatcatgaacttaagacatttgccggttggtctctnataaaaaaatatttgtcccggttggtctct

SEQ ID NO: 27289 - DNA, 101 bp, rice(Oryza sativa)
  misc_feature (71): n=a or g
ggggaagattgccgcgcaatgcaggtgaatacttctcagtttatctgtatcttcgtttcgacagttgagtngagtttattttactgatgaactgagctcac

SEQ ID NO: 27290 - DNA, 101 bp, rice(Oryza sativa)
  misc_feature (71): n=a or g
agcgtagtcctgcatgacactgcatctcatcatcatctgcatgcagcgcgaccattactccttgtctatgnaaaatgatatatacgtactctatctaatat

SEQ ID NO: 27291 - DNA, 101 bp, rice(Oryza sativa)
  misc_feature (71): n=t or c
tgacctagatacagcagtaccatatacaaaattgaagatgatggatcacacaattggactgacccagatanggcaataccatatataaaattgaagatgat

SEQ ID NO: 27292 - DNA, 101 bp, rice(Oryza sativa)
  misc_feature (71): n=t or c
cggtcaagaatagtgctttaaagaaaccaaagattacaccaacctcaaatccgactacgttttccacaaanaacatttgtggaggaaagcacatgtttttc

SEQ ID NO: 27293 - DNA, 101 bp, rice(Oryza sativa)
  misc_feature (71): n=a or g
ggcaaataacttccggtaaggtaagtaccttgatgttcaaaaggaagaacaacatttgccttgtcactgcnctccttctctgacagctcaagattgaactg

SEQ ID NO: 27294 - DNA, 101 bp, rice(Oryza sativa)
  misc_feature (71): n=a or g
agcacacacttgcatgcaactaattaactagttatctctgcagcttgctggtagaaattaagtagaaaggncgcagatcgaggatgagcagcgagaagaag

SEQ ID NO: 27295 - DNA, 101 bp, rice(Oryza sativa)
  misc_feature (71): n=t or c
ttactaggtgcaggatcactgacttttttgttgcttgaactagaattagaataactagctgggtggcccgngcaattgcgcggctagcacccatacaaaat

SEQ ID NO: 27296 - DNA, 101 bp, rice(Oryza sativa)
  misc_feature (71): n=a or c
gctaacaagtcacaagctggacgaatatatagctcccacacactaacataattgaaaacttgtatcttacncaaaccgttgtttaatagttttaaaaaata

SEQ ID NO: 27297 - DNA, 101 bp, rice(Oryza sativa)
  misc_feature (71): n=t or g
aaatgtaaatattgataataagttatattataagggctaacacacaaataagtagggattgtgtaggatcnaatcacaataactaagccaaccaaaggggg

SEQ ID NO: 27298 - DNA, 101 bp, rice(Oryza sativa)
  misc_feature (71): n=t or c
aatgaatgatcaagtgtttatctaacattaactgtgtcgactatcaacaaccggagggagtacgtgtgaanctggaccaacacaatatcgacaattaacac

SEQ ID NO: 27299 - DNA, 101 bp, rice(Oryza sativa)
  misc_feature (71): n=t or g
tggaactcgtcgtgtacctgcactggacgacagatcactccggccggggcacccagtactgcagcgtcacngccagggatagctagcagctagaccccccc

SEQ ID NO: 27300 - DNA, 101 bp, rice(Oryza sativa)
  misc_feature (71): n=t or g
acactttatacctcactttatagttgagactggagagacgcaaatgaaacactacctgtattggagggatntaaggtggacttttcctacatttggggaca

SEQ ID NO: 27301 - DNA, 101 bp, rice(Oryza sativa)
  misc_feature (71): n=t or c
caggctgggacgaaaccaactgagatcccttgcagtactgcaatagtaccacacaaatttttgaccctttnaaaaaactaattttaattttacaaataaac

SEQ ID NO: 27302 - DNA, 101 bp, rice(Oryza sativa)
  misc_feature (71): n=a or g
ggctgccgccaccacactctgagttgtcgccggtccaacctatgccattgtggcctaaagcttgtataganctcagccgttggagctcgacgccctctgcc

SEQ ID NO: 27303 - DNA, 101 bp, rice(Oryza sativa)
  misc_feature (71): n=a or g
aaccatcggggtcagccgacaccggcgaaatatataattatattgtttaggtaattaagatgacactaganattaaacaagattagtgtattttgatcccg

SEQ ID NO: 27304 - DNA, 101 bp, rice(Oryza sativa)
  misc_feature (71): n=a or g
cttcatcacaatagtattttttgggtccattttatgtatttagccttgctaaacaatggttatatagtganaaataaggttatgtggaagttgaagatgtt

SEQ ID NO: 27305 - DNA, 101 bp, rice(Oryza sativa)
  misc_feature (71): n=t or c
taggtatatagactaggcatccaaatttgaacagatgggacaatttcggtgtgaccccttgcaccagtttnatttttgaatggatgttgtaggccgatgat

SEQ ID NO: 27306 - DNA, 101 bp, rice(Oryza sativa)
  misc_feature (71): n=t or c
ttcctgtggattcccctgtcatccaactgtgtgatgatgaggaagaagactcggaggaagaccctgaacgnacccattcagtggttgagtggggtgccact

SEQ ID NO: 27307 - DNA, 101 bp, rice(Oryza sativa)
  misc_feature (71): n=t or c
atttattcaacaaattttaaagcaagacgaaagggataaacttcagggcatgacacacgtgcaccataacnaatagattctagttgagaagatggattttt

SEQ ID NO: 27308 - DNA, 101 bp, rice(Oryza sativa)
  misc_feature (71): n=t or c
ttcgtctaatataatgatcagtgcacctgaatttacacacagcttagctagatagccagacacgtacatanatacgtcgtccaaaataaagcaggagacgc

SEQ ID NO: 27309 - DNA, 101 bp, rice(Oryza sativa)
  misc_feature (71): n=a or g
aagaacctttacattttttggttgaaaatcagtggtaatttagtttgatgtttttttttcgcttacaagtnttcatggtgctgcacacagacgaagtacat

SEQ ID NO: 27310 - DNA, 101 bp, rice(Oryza sativa)
  misc_feature (71): n=t or c
attttaatattgacccgaaaataaccatctccctgattcacctctcatctgataatatgaaaaccaccccntgattgcatgtccatttaacgggcatatat

SEQ ID NO: 27311 - DNA, 101 bp, rice(Oryza sativa)
  misc_feature (71): n=t or g
tcagtggcaaattggcggtccaatcattgcactccatcaggtttgagggttccatctaattctgcgaaaanatttttattttttgtgttcctagcatttag

SEQ ID NO: 27312 - DNA, 101 bp, rice(Oryza sativa)
  misc_feature (71): n=t or c
ttaaagaaaaggttactaattctgactaggaactggtgattttctggtatgtctaggcctgtttggagagnttaagattttgagaatcagctgtttggtag

SEQ ID NO: 27313 - DNA, 101 bp, rice(Oryza sativa)
  misc_feature (71): n=t or c
ccaaaacaaaaaaaaaagatcatggacatgatccattcagaatccttaggtaggaaccgaaactgattganatgggccggctagctatccgtccgaatcgg

SEQ ID NO: 27314 - DNA, 101 bp, rice(Oryza sativa)
  misc_feature (71): n=t or c
agtggagggacagggctatctatgcagcagcatgcgtgtgtgtgggtatatatagtccatgagcagagtgngtttactgtcttacagcaagaagctagcac

SEQ ID NO: 27315 - DNA, 101 bp, rice(Oryza sativa)
  misc_feature (71): n=a or g
atgtccccttgccttcgctgccttcttcttgatttggccttcggctttctttcggttttagatctaggttngcgcgaggatgagtggatctttcttctctc

SEQ ID NO: 27316 - DNA, 101 bp, rice(Oryza sativa)
  misc_feature (71): n=a or g
atgatgtaaataatatttatagctatatgttgtctcatgttgttgtcaaggaaaataaagggaaggccacnaatcactaggataatggattagttgcacat

SEQ ID NO: 27317 - DNA, 101 bp, rice(Oryza sativa)
  misc_feature (71): n=a or g
ccatcgcccctcctgtcgctgccgccagaaaatccagcaagctctcccggccaccgttgccgtagtcattntttctcctcctcgccgtcgatgcgcaacgc

SEQ ID NO: 27318 - DNA, 101 bp, rice(Oryza sativa)
  misc_feature (71): n=t or g
aagtatttttttaaaaaaaaaatagaaggaacataaaatagttgatatagcccaacgtccccaaggcctangtgtgtctactactctactgtagcccatag

SEQ ID NO: 27319 - DNA, 101 bp, rice(Oryza sativa)
  misc_feature (71): n=a or c
atgatgtaaaacaatgtaaacagttcaatgtatgagaggaccgagaccagagatatgaattttcatgtctnttttgcctccgtctgcacattaaaacttgt

SEQ ID NO: 27320 - DNA, 101 bp, rice(Oryza sativa)
  misc_feature (71): n=t or c
ttctagatcaggtcggtctaacctcaattacatggccggtctaaccgatgattcaatgtcagtttgactgnggcttcttgtcctgtctgattgagcacagg

SEQ ID NO: 27321 - DNA, 101 bp, rice(Oryza sativa)
  misc_feature (71): n=t or c
tcttgcatttcactgatttgtttgctcctcactccctacttctctcctcctcctctcctgggctgctcacncctcactaattggttggagctcatatgcat

SEQ ID NO: 27322 - DNA, 101 bp, rice(Oryza sativa)
  misc_feature (71): n=t or c
ttccttacattgtgggcattatttcccctcttgaattgcattcgatcgagcctttaatcaccgtgggagangcctgtttcctctctgccttcaatggctgg

SEQ ID NO: 27323 - DNA, 101 bp, rice(Oryza sativa)
  misc_feature (71): n=t or c
ttcacccttgacacagtaaagaaactggaagtttggactgaggtgctgctggatacaggctaatcaaggcnggccttgatgccaacatggttgacaacgac

SEQ ID NO: 27324 - DNA, 101 bp, rice(Oryza sativa)
  misc_feature (71): n=a or g
gagctcgcctgctccgccgcttacccgcgtcgtccgttgcgatagagaggggaaggagaagaagaagaagngagaagggagagggaagaagtgaggagtga

SEQ ID NO: 27325 - DNA, 101 bp, rice(Oryza sativa)
  misc_feature (71): n=t or g
tgtgagtatatggatttgattgatgacgtcatgatgttttattccttggatattgaacttgtctttatgtnaatcataacttggtacttaattagctatat

SEQ ID NO: 27326 - DNA, 101 bp, rice(Oryza sativa)
  misc_feature (71): n=a or g
tagtggcatccatgtgctaactaacacctattcacatcttctttttgcaaggcgcacggaggagcagatcnctgcatacaagaagctgaagagggcaatgg

SEQ ID NO: 27327 - DNA, 101 bp, rice(Oryza sativa)
  misc_feature (71): n=t or c
tattaacgttgatcgtgaagcgctacactcttcaaggagcaaacatccacgccagggtaataccaaatganattagttgtttgtgaaggaataggttctta

SEQ ID NO: 27328 - DNA, 101 bp, rice(Oryza sativa)
  misc_feature (71): n=t or c
agaccttaaccttttaaggtccctttcaccgcgatcgtaattcctgtgctcatgcatatcctttctctttnggttgtcaagctccggagaacggtactctt

SEQ ID NO: 27329 - DNA, 101 bp, rice(Oryza sativa)
  misc_feature (71): n=a or c
tgagggcatagatgtaattatcccaaaaatttttcgtaacatatcatgcaaatattgtctacactagttanatcttgaaatccaaattatttagtgctgtt

SEQ ID NO: 27330 - DNA, 101 bp, rice(Oryza sativa)
  misc_feature (71): n=t or c
cagtgtggtgagttccgggacatgggtcatctcgacaaacaaatccaatatggcacatccactcactcacncacccacgatcccttcgtgggtcgacccat

SEQ ID NO: 27331 - DNA, 101 bp, rice(Oryza sativa)
  misc_feature (71): n=a or g
tttggttcatgtgctatgagaggacaagcgtatactaatatcctcttctggaaggaggaagaagaagatgncaaggtccttctcctccaagaagctgtagt

SEQ ID NO: 27332 - DNA, 101 bp, rice(Oryza sativa)
  misc_feature (71): n=a or g
ccacgaactacaaaaggtacatgctatccttccaagcaaaaggaacagaaaacctctccgattctttaganaaaaaaatcaagaaacagaaagagagaagc

SEQ ID NO: 27333 - DNA, 101 bp, rice(Oryza sativa)
  misc_feature (71): n=a or g
ggcaacaacagctcaatttgattctggtttatctggtttcgcagctgaaattgcttggaacatatggctgnagatcgatcgacgaagtccgcgagatcgac

SEQ ID NO: 27334 - DNA, 101 bp, rice(Oryza sativa)
  misc_feature (71): n=t or g
agcatgtggcaaattgcaactaggttcataacaaaaaaaaatagtgaagctatgttgataggaaatggcanatcacagttaccacgttgcttttttaattc

SEQ ID NO: 27335 - DNA, 101 bp, rice(Oryza sativa)
  misc_feature (71): n=t or c
ataatatgtaaaatattacaaacatgggcaagcaaaaaaatcaagctaatggatataaatttttgtattgnagggacaatagagaagcaagcaatgcccgc

SEQ ID NO: 27336 - DNA, 101 bp, rice(Oryza sativa)
  misc_feature (71): n=a or g
agtgcataccacggaagcaagtggcctaaacgtgagtgcctcaactgcaagcagggttgacaattccaacnaaaaccggttaaattccgtgaaattttaac

SEQ ID NO: 27337 - DNA, 101 bp, rice(Oryza sativa)
  misc_feature (71): n=a or g
ccaatgagagtcacaagtcaaagaaacaacatcgacacacaagtctcagctccgaggagatcaaactaccnaaccattcaggcagtgtttggcaaatgtcc

SEQ ID NO: 27338 - DNA, 101 bp, rice(Oryza sativa)
  misc_feature (71): n=t or g
ggagcggagccgcggcatacggtgcaccgtgcgcgtgctagaccggcctaaagtcgtaacagaggcccccnccgcttcgcccggtcagtatatgggccgtg

SEQ ID NO: 27339 - DNA, 101 bp, rice(Oryza sativa)
  misc_feature (71): n=t or c
atttttgaaagcaaccggcgcctgacgtgtagcattgttgccattagatccccatatattacactacatcngtctcaaaataaatgaacttgtgggtttcc

SEQ ID NO: 27340 - DNA, 101 bp, rice(Oryza sativa)
  misc_feature (71): n=t or c
gcgcggtggctcgacggatcgacgacaacctgatggcacgcgcaagaagaacctgtgatgtggattgcggngatggtggaaggggaagaaatcggttccag

SEQ ID NO: 27341 - DNA, 101 bp, rice(Oryza sativa)
  misc_feature (71): n=a or c
agatggtggtgtttttttcttgcagtttttcatcaccgtccattcccctgacgtaaaggcattaaggcatnagaacacagatcgtgaagaaaactagaaga

SEQ ID NO: 27342 - DNA, 101 bp, rice(Oryza sativa)
  misc_feature (71): n=a or g
aagcagcacacatcctgaagcgcatccaacggtgcagattatgggtgcagatgctccagagttccaaacgncattttcatatattctggtcatccccttgc

SEQ ID NO: 27343 - DNA, 101 bp, rice(Oryza sativa)
  misc_feature (71): n=t or c
aaggacaactttagtcaagcgcccaagcccatatgtcactgttcaggattagatattactccctccgtctnataatataagtgattttgagtttttgcttg

SEQ ID NO: 27344 - DNA, 101 bp, rice(Oryza sativa)
  misc_feature (71): n=a or g
ggtcgcatcgtcgccgctgcctacgatggggatgctgcgaaaagggaatgtggttgttgttactccctcgnttttatattataattcgtttgatctttttt

SEQ ID NO: 27345 - DNA, 101 bp, rice(Oryza sativa)
  misc_feature (71): n=t or c
caaaaaattgactgatttttccttttatcgttcggtcaaaccgagattcgctagacgggactcgatcccanaacctaaaggttgccactacacgtctctcc

SEQ ID NO: 27346 - DNA, 101 bp, rice(Oryza sativa)
  misc_feature (71): n=t or c
tttaaccatgagttggttttgagtgagaaatttggtttggattattggcgattttaggcgtcagtgcttangactaacgtgggtcaggttgcgataactgt

SEQ ID NO: 27347 - DNA, 101 bp, rice(Oryza sativa)
  misc_feature (71): n=t or c
ttgtgtgaaatggagatggacaaatattaagggagtagatttgagagctctgattgttggctgaaaacatnaacttgatttttgtaatttgtacattctat

SEQ ID NO: 27348 - DNA, 101 bp, rice(Oryza sativa)
  misc_feature (71): n=a or g
ctcatgtcctaaggcatcgtccctccaaccatttgtctattttacacgaagcgacaacgtaagtgtgagtnaggtgatctttgtaaatgggcgcgtcagtt

SEQ ID NO: 27349 - DNA, 101 bp, rice(Oryza sativa)
  misc_feature (71): n=a or g
aaacagagcaacgaacacagcctagagtgagttctttccccaacgttttcaattcacatcctcgttttccncgcgcatgtttttcaaactgctaaatggtg

SEQ ID NO: 27350 - DNA, 101 bp, rice(Oryza sativa)
  misc_feature (71): n=a or g
attttataacaaagagaatacatgcacatattagaattgaataatccactcaaaatcctttggcgccgganccccggagcagtggcggatctaggaaggga

SEQ ID NO: 27351 - DNA, 101 bp, rice(Oryza sativa)
  misc_feature (71): n=t or c
ttacaaccaaattaaattatctcctaatcacgtctactccctccgtttcagaacctatgtgttttagtttnatgctaagggggtgtttatacccagagatg

SEQ ID NO: 27352 - DNA, 101 bp, rice(Oryza sativa)
  misc_feature (71): n=a or g
atgaaaacttccatgagctggctgagaaagattctctactttagcttggcatataaaagtttacgatgcantgtattttttcaaatttagatatgctaaca

SEQ ID NO: 27353 - DNA, 101 bp, rice(Oryza sativa)
  misc_feature (71): n=t or c
gaattgtaagcccttgtttcaatgatcttttacgctatttcctcgctgcaaaaattttcatgccagctacnatggtgtgttctaacatttgaagctgttaa

SEQ ID NO: 27354 - DNA, 101 bp, rice(Oryza sativa)
  misc_feature (71): n=a or g
ggaccactcaaaatgatcgcgggaagttcgaaggaatgtttcattcaccattacatgaaaataatgggganaaagtatccactcagaccacttgctaaaat

SEQ ID NO: 27355 - DNA, 101 bp, rice(Oryza sativa)
  misc_feature (71): n=t or c
ccaaagttaataaatcagttatttgccactaaaaaagctaaattattcataatgtgtactccctacgtccnaaaaaaagacaaaccctgggtttccgtgtc

SEQ ID NO: 27356 - DNA, 101 bp, rice(Oryza sativa)
  misc_feature (71): n=a or g
ccgagaaaatgaaaaacaaggagggagcactctgaggcgcgtggattgacaatcccaatccacgcgcttcncgcgaattagcgtgtctatgaataaacttg

SEQ ID NO: 27357 - DNA, 101 bp, rice(Oryza sativa)
  misc_feature (71): n=t or c
acagaaatgctaagggacagggtcccatctctgcatccacaagcgatatccttaattccggatgctagcgncatggtggtggcaagacggcgggtgcacga

SEQ ID NO: 27358 - DNA, 101 bp, rice(Oryza sativa)
  misc_feature (71): n=a or g
acacaaagttgagcgataacccccaaaagaaataataataaaaagaagcaaatgttttcaagaactggccncccaacctcgatgctcttgacggccggctt

SEQ ID NO: 27359 - DNA, 101 bp, rice(Oryza sativa)
  misc_feature (71): n=t or g
tgctactatgctgcatatctcaaagatacaggtgcatacttggttgttgatcaggtatatgtactctctcncagattaaataatctttggcatggtggctt

SEQ ID NO: 27360 - DNA, 101 bp, rice(Oryza sativa)
  misc_feature (71): n=a or g
ccacggcacatgattttggcccagcccaggtacaacactgtccggtcgttgtcaggcccgtgctggcacancccagctgttgggccgtgcctgggcctatg

SEQ ID NO: 27361 - DNA, 101 bp, rice(Oryza sativa)
  misc_feature (71): n=a or g
ggatcctcaattctccagttctgttgctctgcacaagtgctctccagcatctcgtaaaacctagtcgtcangggtagatgaaagcaagggaacagtgcttg

SEQ ID NO: 27362 - DNA, 101 bp, rice(Oryza sativa)
  misc_feature (71): n=t or c
ttgatttgaattagtgatgcacgtattaattttaattgctaattatttttcaggtttagaatgaaaaggcngctctttttatgcataatgaatgctgttga

SEQ ID NO: 27363 - DNA, 101 bp, rice(Oryza sativa)
  misc_feature (71): n=a or g
aaccaacacctatattttttataggggccagttctacattgatgtcggttgagaagtccggcacttactgntttttctatcgataacaatctgattttcgg

SEQ ID NO: 27364 - DNA, 101 bp, rice(Oryza sativa)
  misc_feature (71): n=a or g
ttcctttttaatttgcaacttagtggatccgtacgtcaatggatacaactagctagctatactagtcgtcnatggctggccatggcccggtccctcctcga

SEQ ID NO: 27365 - DNA, 101 bp, rice(Oryza sativa)
  misc_feature (71): n=a or g
tggaattgtttgggggaattaggtgttttagttctatctgtgacagcgaaagcgaagaggagaaggggggnaatcttccataaaaggcatctacatttgtg

SEQ ID NO: 27366 - DNA, 101 bp, rice(Oryza sativa)
  misc_feature (71): n=t or c
tgattttggaatcctgaggcctgcaagtgaatcatgtaaaaaaaacataagcaaacagaatattatgcaanggtagcaaattgtggattgtattttctacc

SEQ ID NO: 27367 - DNA, 101 bp, rice(Oryza sativa)
  misc_feature (71): n=a or g
gcatcatgcatgtaatgcatagagaggtgaagaccacacgtgcttttttcacgtttccaaaaagctcgccnatactcgtatagaaaaaaagtaaagaaacg

SEQ ID NO: 27368 - DNA, 101 bp, rice(Oryza sativa)
  misc_feature (71): n=a or g
gtgtttttattatgctagctctagattttcaatgtttacatcacaagcaatcccgtactgagccaatactncaactaacatataaatgcacttaatcgaaa

SEQ ID NO: 27369 - DNA, 101 bp, rice(Oryza sativa)
  misc_feature (71): n=t or g
taaccatctactgctgccactagctacgcctcggaaagctgaggctagagcgaaggtgagaactggcgctngagtggaggctgaagctggtgcaagagcgg

SEQ ID NO: 27370 - DNA, 101 bp, rice(Oryza sativa)
  misc_feature (71): n=t or c
gggctaatagaatatggcccccatataagaatccatggcacgggagcattgacttattgggacaaacatantagtgccaccgtacctgccatgacttgctt

SEQ ID NO: 27371 - DNA, 101 bp, rice(Oryza sativa)
  misc_feature (71): n=a or g
taaattatttagcctcctttttttgaaaattgggagagaggtatggcgcacactatgacagaaatgtttanaaaacataccttgctccctactcctactga

SEQ ID NO: 27372 - DNA, 101 bp, rice(Oryza sativa)
  misc_feature (71): n=t or g
ttcacacacatagttctactatcatataccatatatgagattacatataaaacttcaccaacaaaattatntagtattattgcaaactactacataagggt

SEQ ID NO: 27373 - DNA, 101 bp, rice(Oryza sativa)
  misc_feature (71): n=a or g
tctgatcgtgcagccacagtgggcgagaatccaggtgcacaatgtgtacgagtacttcactgaggcattcnaaagccttagggaaaacgaagttcggtgga

SEQ ID NO: 27374 - DNA, 101 bp, rice(Oryza sativa)
  misc_feature (71): n=a or g
ggtcacatacacgtatatatgtacgacagtttggagtttgagtcttacattttcttggtacgtgccgatcnatcgagctgtccagcagccatggacgtact

SEQ ID NO: 27375 - DNA, 101 bp, rice(Oryza sativa)
  misc_feature (71): n=a or g
ttccaacgcacaaaagacacaaaagctatggccacacaaacatgtactagtacacagcatgcatggagccntagaagagggatataatggagatagagcag

SEQ ID NO: 27376 - DNA, 101 bp, rice(Oryza sativa)
  misc_feature (71): n=a or g
tcgcgctcacccagcattagtccggcatgagttttggctgattaccaaaaccactagcatagagaatcctnttgtgttttattattatctttgcctttatc

SEQ ID NO: 27377 - DNA, 101 bp, rice(Oryza sativa)
  misc_feature (71): n=a or g
tatttggggattgtcttcttataaccccctaaccctagctggtgcactggctttattcttttctatctgcncttccacgctctcctgtcctgtatgcgaca

SEQ ID NO: 27378 - DNA, 101 bp, rice(Oryza sativa)
  misc_feature (71): n=t or g
agctaatatgcctaattttgccaaacattattgagaaatgccatcttttgggaagcttataattatccttngattcgaagcaaaggcgaacaagttaaggg

SEQ ID NO: 27379 - DNA, 101 bp, rice(Oryza sativa)
  misc_feature (71): n=t or c
atgtaattattgatcggccttcatcctcgtgcaaacgcaatctggtagaagcaaattaaccgacattcgtnctcgtgacaaacgctatatggtagaagcaa

SEQ ID NO: 27380 - DNA, 101 bp, rice(Oryza sativa)
  misc_feature (71): n=t or c
cctgcgaggtaattcttgcccgcgagcaatgcccattactatatgacaggcaaggaacaatgcccatgcangtcgctcgcgggcgccgtgtgccgatgggc

SEQ ID NO: 27381 - DNA, 101 bp, rice(Oryza sativa)
  misc_feature (71): n=t or c
tttaaaaaagcatatgcaattaatcttggtaagtttatacgtgacaactaagtaataccattgcggaccgnagatattcgacgttgttaatgggcgactgg

SEQ ID NO: 27382 - DNA, 101 bp, rice(Oryza sativa)
  misc_feature (71): n=t or c
ccttttctaaccacctataattatgggtccctttatttacacatataaaaaggacatacaaacgtgttttnttttcaaaaaaagaacaaatttataatcca

SEQ ID NO: 27383 - DNA, 101 bp, rice(Oryza sativa)
  misc_feature (71): n=t or c
atggaatggccatggttatattgataaggcgctgcaccacagggagcacatcacggtggtcaatgcgagcntggttagttgttttccactcatcttctacc

SEQ ID NO: 27384 - DNA, 101 bp, rice(Oryza sativa)
  misc_feature (71): n=a or g
gtacaagagaatacagatgaccttaattatattaatgagaatccatcaagccggtagcacttgccatccantacaaattaaacggtgttattttttttaga

SEQ ID NO: 27385 - DNA, 101 bp, rice(Oryza sativa)
  misc_feature (71): n=t or c
tcttactgatataatcttgagtgaatttgagaagagtggagagatagcaagagcaagcaagagtggcattnggactcaagcgctaggggggtggggggatg

SEQ ID NO: 27386 - DNA, 101 bp, rice(Oryza sativa)
  misc_feature (71): n=t or c
gtagttcactatctcaccaaactcatttaggattgtgttgataaataggccaattgagctcaattgccaanagtgcccaaccagtatgaccacctcaactc

SEQ ID NO: 27387 - DNA, 101 bp, rice(Oryza sativa)
  misc_feature (71): n=t or c
gtacaaatttgacactattttccccctgtaattggtccgctgtttggaagttgcggttcacctagtcccgnacgagttagtttactacgacatccatccca

SEQ ID NO: 27388 - DNA, 101 bp, rice(Oryza sativa)
  misc_feature (71): n=a or c
ttcctatgaaattaaatagaaagttataaagcctaatcaatccgattccttgtaaaaaacaattgagcctntctctcttatttgattttgtgttttttgtg

SEQ ID NO: 27389 - DNA, 101 bp, rice(Oryza sativa)
  misc_feature (71): n=a or g
tataattcacagtaatgaactagcatgtagtctcatacaaacatagccaaaccatatgatcgagttcagcntaaaaggttaggcattgaatcatacagtca

SEQ ID NO: 27390 - DNA, 101 bp, rice(Oryza sativa)
  misc_feature (71): n=t or c
aaagctggcgcagctcgtccaggagaaggtaagttcttaaaataaatacctgcagagcattacttgtccanttaaatatattaactcgagtaaataatcaa

SEQ ID NO: 27391 - DNA, 101 bp, rice(Oryza sativa)
  misc_feature (71): n=a or g
ttataaattattgtgttacaaatgtgcacctacctactcaatattgttgtaaaatcatcccaatatgcacntggttaatcaaaccaacatattttcataaa

SEQ ID NO: 27392 - DNA, 101 bp, rice(Oryza sativa)
  misc_feature (71): n=t or c
tgaaggcccatataaacttaggccctgtgttagttggtgaatatttttttttgccacattagatgtttgancggatgtcggaaggggttttttataagaat

SEQ ID NO: 27393 - DNA, 101 bp, rice(Oryza sativa)
  misc_feature (71): n=t or g
gtcacaagcaatatgatatagttggggtgatcacaggttgcgaattgcataatgtacggtttgaaattttngggaaaaaaaagaaaatttcaaaaaaaatt

SEQ ID NO: 27394 - DNA, 101 bp, rice(Oryza sativa)
  misc_feature (71): n=t or c
gacatcggatgaattaatttgtgaaacagagcaagagagtagcaaaagctttgactctccttggcaacagnacttttttggacagtgtgcagtagttaaaa

SEQ ID NO: 27395 - DNA, 101 bp, rice(Oryza sativa)
  misc_feature (71): n=a or g
atgggggtggtggagaatctgccaccatcacctatccactgatgtaggttcatgctgtcagtgtaaccacngttgtgcttgaaattcacatgagtgaatcc

SEQ ID NO: 27396 - DNA, 101 bp, rice(Oryza sativa)
  misc_feature (71): n=t or c
atgactaatcatactaatatagagtttgattaagatgtcacatgcataatcaaagaacacgagagatgttnatgtgtaaataacctttacatatagttttt

SEQ ID NO: 27397 - DNA, 101 bp, rice(Oryza sativa)
  misc_feature (71): n=a or g
agtaggaccaatatacatgtacagtaaaacatatgcatagatattgagtgcccaaacgctaaaaattgcanacaactgagatgttgtaataagcacttacc

SEQ ID NO: 27398 - DNA, 101 bp, rice(Oryza sativa)
  misc_feature (71): n=a or g
gtctgtactctttcactcaaggaagttgatcgattcaccattgtacttcctcctgttttcaatatataatnccgttgacttttatatgttagtttgaccat

SEQ ID NO: 27399 - DNA, 101 bp, rice(Oryza sativa)
  misc_feature (71): n=a or g
aactcaaacacagatatgtcttcccaaaaacggacggacttaaaaacgactcaaacacagttgatgtaccnaaataccgacaaaaatatcttcaattttta

SEQ ID NO: 27400 - DNA, 101 bp, rice(Oryza sativa)
  misc_feature (71): n=t or c
accggcggcgaggacccatacttgccatggcaactcgctcccactagcgaggatttcaaggactgtgtggntacaagtatgccacgtatagtggcgaagcg

SEQ ID NO: 27401 - DNA, 101 bp, rice(Oryza sativa)
  misc_feature (71): n=t or c
gggcctacaaatagggcctagatgagatgacatgacagtggtcgaggagagttgcattgcgtgctgggagngagccggccagctaatacacctacctccgc

SEQ ID NO: 27402 - DNA, 101 bp, rice(Oryza sativa)
  misc_feature (71): n=a or c
tcctatagtgatttttttacttttgagcgatggatgaatggcgagcaggaagcaagttattttactgaagnagtgatttttctagtggacaattgatacat

SEQ ID NO: 27403 - DNA, 101 bp, rice(Oryza sativa)
  misc_feature (71): n=a or c
atctccgtgtcaacaagccgttgtgaactcgtgatgccgtcaagaagctgtcgataagtttggcgttcctngttgcttcctcggtttgagactttctaaca

SEQ ID NO: 27404 - DNA, 101 bp, rice(Oryza sativa)
  misc_feature (71): n=a or g
cgcccggcagggcattgctgctactgctggtagtggtggtggtccagttcttgatgacaatataccccagnaatatttttgcgaccaaaaggaaaactcgt

SEQ ID NO: 27405 - DNA, 101 bp, rice(Oryza sativa)
  misc_feature (71): n=a or g
tccctcgcctcgtcacgtggtggtaaggatctctctccctcatcgccctcgtcctcatcctttcggtgtcncccgtgcccgttgtgcggttgtcggccccg

SEQ ID NO: 27406 - DNA, 101 bp, rice(Oryza sativa)
  misc_feature (71): n=t or c
cgatatcttatctgtgcccttgtgctgtggagtgtcgagccaacatttctagcttctattttgttcttttntgcttgatgtagtgtggtcggctggtttta

SEQ ID NO: 27407 - DNA, 101 bp, rice(Oryza sativa)
  misc_feature (71): n=a or g
ttattatgcttaggaacttgggacacgaaccatgtgggtgaaggaacagccacgacaatgaacaagtggangccggcatgagcaaaggaaggattagacca

SEQ ID NO: 27408 - DNA, 101 bp, rice(Oryza sativa)
  misc_feature (71): n=a or g
gccacagccaacacgaggagacgtttgaaagtcaggcacatcgatcacagttatggcagcatataccaacntactccctccatactcgtaaaggaagtcgt

SEQ ID NO: 27409 - DNA, 101 bp, rice(Oryza sativa)
  misc_feature (71): n=t or c
gttagtaccagcttttgtatggtccctatgtttttcttaccggagagaaatatatggcgctttcctttttntttttggcacggcaagaaaattatggaggc

SEQ ID NO: 27410 - DNA, 101 bp, rice(Oryza sativa)
  misc_feature (71): n=a or g
agcaaagcagaaagaaagagctagtagcacgcttttggaaagctaagccatgcacgagcacgtcgctgccngggagggagtccccgggctcgaaagggaaa

SEQ ID NO: 27411 - DNA, 101 bp, rice(Oryza sativa)
  misc_feature (71): n=t or c
tgttggcatgtggcggatagtttgtacgcacgtataggaggaggcgcgactgcgcgagggacagaatgtgnaccgatcgacgcgtcgctttccgcccctct

SEQ ID NO: 27412 - DNA, 101 bp, rice(Oryza sativa)
  misc_feature (71): n=t or c
gggctgctttacagagaggcttgatttgcttgtatggtatggtccgcgtggaccagccattgtcacctttnaaacaaggggccatatcgtatgcaagggtc

SEQ ID NO: 27413 - DNA, 101 bp, rice(Oryza sativa)
  misc_feature (71): n=t or g
agaatcaaaagagaccttattattattattatttcctgctctatctgttcttcccgacaccctggtttagnttttagagccggtcatatatttattcttga

SEQ ID NO: 27414 - DNA, 101 bp, rice(Oryza sativa)
  misc_feature (71): n=t or c
ccactccccgtaaaaaaaacacacacaccactgccagcaactgacattgaaccaaagcaaagtatagtatnggagaataacttagttgtagtcactcactc

SEQ ID NO: 27415 - DNA, 101 bp, rice(Oryza sativa)
  misc_feature (71): n=t or c
tgtgcgttctttttatatgtgcaccattccagttgtttctacctttgattcaagcccatgtccaagttgangaggatacaactagctcaaatatgatcatg

SEQ ID NO: 27416 - DNA, 101 bp, rice(Oryza sativa)
  misc_feature (71): n=t or c
gtagtaacagataggtcatttttcgaaggaattgcaaaatgaactggagatgtttttttttggcttatacnatttcaaataccctatttagagattcagtg

SEQ ID NO: 27417 - DNA, 101 bp, rice(Oryza sativa)
  misc_feature (71): n=t or g
tgcagtgcatgttttgtccatggtgttctgtgtacttcgcatatgtatactgtgaaccatgggaacaggtnacagtaagtagcacagtaaaagtccggttc

SEQ ID NO: 27418 - DNA, 101 bp, rice(Oryza sativa)
  misc_feature (71): n=a or g
tctaaaagtttatccaacttttgttggagattcgaacggggcctgattagtgatttgttgggtatgcagcntcgagcatccggccaagccaaaacaccacg

SEQ ID NO: 27419 - DNA, 101 bp, rice(Oryza sativa)
  misc_feature (71): n=a or c
tccgcattgttgctcggtttgtgtccagtatgaatctcatagtctcaaaatctaatatccgtacggttatnaacattttactacattatgattacaagatt

SEQ ID NO: 27420 - DNA, 101 bp, rice(Oryza sativa)
  misc_feature (71): n=t or c
cgataacgaccgtcaacaatggcaccacaaagaacgtaaatgagttggaacgataagacacccaactgaanagcaccgacggcatgaatcatttcggtgac

SEQ ID NO: 27421 - DNA, 101 bp, rice(Oryza sativa)
  misc_feature (71): n=t or c
actatgctaccgaccatttttagacgaacgcatcaaagagcatgtataatgagaaaaaataattatacccnggatgaaatagcggaactctctataaaaca

SEQ ID NO: 27422 - DNA, 101 bp, rice(Oryza sativa)
  misc_feature (71): n=t or c
accacctaaggaaaccaactagctactgaagcatgatgcagaagcaatgactactggtcaactcatgacgnatctacgcgcgtcacgtgcgtcagaccatc

SEQ ID NO: 27423 - DNA, 101 bp, rice(Oryza sativa)
  misc_feature (71): n=t or c
cggctaaagatcgagactggagattgatctgattgatggccaatacagccaatacggcataacttggactnggcatgggcccagattggaataaccgtcat

SEQ ID NO: 27424 - DNA, 101 bp, rice(Oryza sativa)
  misc_feature (71): n=t or g
tgcgcggtggattgccggtgcttggtgtatatatcggcgcaaagcgaagcgattgagcgaagcgtggcganacgcgcgtgctcggtgctcctacggcgcgc

SEQ ID NO: 27425 - DNA, 101 bp, rice(Oryza sativa)
  misc_feature (71): n=a or c
ccctgcgtacccctaaaatttcacccaatcccttccatgcccctaagatttgcccattcccttctataccnctaaattttagtctcgatcccttctatacc

SEQ ID NO: 27426 - DNA, 101 bp, rice(Oryza sativa)
  misc_feature (71): n=t or c
acatatcccgtacgcacagaccaagctggacgtgggatgtggatttttttttccaaaaatagatttaattncatataatattgggttcaccagattattag

SEQ ID NO: 27427 - DNA, 101 bp, rice(Oryza sativa)
  misc_feature (71): n=t or c
atgttgtatccaaagcagatctacggaaatgcatccatctataccttattactccagttacgctgcattangctgtttctccgaagtgtttctggcgatat

SEQ ID NO: 27428 - DNA, 101 bp, rice(Oryza sativa)
  misc_feature (71): n=a or g
catctagtccatactaccatccaaagaaaatatggacattagtcgtaacacagaaaattcttcttacagtngaaatagaagtgtgcatgtaaaactcatat

SEQ ID NO: 27429 - DNA, 101 bp, rice(Oryza sativa)
  misc_feature (71): n=t or c
tttcaatttaaaatgatgaatagttataattgagactccaatctagtacaacttgtattaattctgaattncaaaagtttcgaacaatgataaaaaagata

SEQ ID NO: 27430 - DNA, 101 bp, rice(Oryza sativa)
  misc_feature (71): n=a or g
atccaaatgttagacatttagcatgaaaacatgacgaacatatataatgtctaaggctatggtattgaccntacaagatcttcaggttctgaagttttgag

SEQ ID NO: 27431 - DNA, 101 bp, rice(Oryza sativa)
  misc_feature (71): n=t or g
ctttcctccatgtgcatgctgatcaggtagtacattttattgatgtgcgcgctgttcttttcttttttttnttggctcatctaattgcaaagcatgaggct

SEQ ID NO: 27432 - DNA, 101 bp, rice(Oryza sativa)
  misc_feature (71): n=t or g
gtctggttcagaaagaatgcgatcatcctcattgcaaacctctgctttgtattataacccataaataaatnaaaaaaatatatttctttaccggaaaaaat

SEQ ID NO: 27433 - DNA, 101 bp, rice(Oryza sativa)
  misc_feature (71): n=t or c
tgcgggatttgtatgcctgagggaccatcggtgtatggcgaaggggcaccggcgaccagctgtgagacacnaatgggtgaagggagagattgttatatagt

SEQ ID NO: 27434 - DNA, 101 bp, rice(Oryza sativa)
  misc_feature (71): n=t or c
aaatattggtaagcctaatttaggcctcaaaccaaccagcccatagtgtcttttgtataaaagttttctangtaaaaattactctaaaatattagacaaat

SEQ ID NO: 27435 - DNA, 101 bp, rice(Oryza sativa)
  misc_feature (71): n=t or g
aatgacttatattgtgaaacagagaaagtactgcacttctgttattgctttgattaaagttgttgtttttngccatggctgcactacacaccacacagcca

SEQ ID NO: 27436 - DNA, 101 bp, rice(Oryza sativa)
  misc_feature (71): n=t or g
tggcggcgtccgttttttctcgtgtgtggggagccgggtggatggatggatcgcgtgctggtttggaaaanaaaacggcggggatcgcggcgagttcccgt

SEQ ID NO: 27437 - DNA, 101 bp, rice(Oryza sativa)
  misc_feature (71): n=a or g
ctacgaaaggtaatgtatataccataatactctaaatgctaatgcgctcattcgtttagcgtactcattcntgagagtagtttggaggcactggcgagagt

SEQ ID NO: 27438 - DNA, 101 bp, rice(Oryza sativa)
  misc_feature (71): n=t or g
aacaatctaattttgcagtgagattttttcactctctcttcttttattcaaccacgcaggagagctgcatntcatttcaataaggagaaaacacagtacaa

SEQ ID NO: 27439 - DNA, 101 bp, rice(Oryza sativa)
  misc_feature (71): n=t or c
ccctactaggagaccgtggtatttagggatgtagggtatggtcgatatcaaggtatatatgagtatagaanaaaaagagtaatggactaggatttttatac

SEQ ID NO: 27440 - DNA, 101 bp, rice(Oryza sativa)
  misc_feature (71): n=t or c
aaattttctagaaacccgatacgaacacatatatgtagattctactgatctattaacatgagtgcttagtntaaacatgatcaccctaatacggaatttta

SEQ ID NO: 27441 - DNA, 101 bp, rice(Oryza sativa)
  misc_feature (71): n=a or g
agacatgcagccccgcgttaggtgccaagttctgcaggtaacaaaaacctcggaaaagagggtgttatgcnccaatattgatccagagataaatggcaatg

SEQ ID NO: 27442 - DNA, 101 bp, rice(Oryza sativa)
  misc_feature (71): n=a or g
cactgtttattcctcccgtggtacaatcattatgttaacgcattacattcttcgaaccatacacgtgtacngtgcaataattattcaaaataaaaatacct

SEQ ID NO: 27443 - DNA, 101 bp, rice(Oryza sativa)
  misc_feature (71): n=a or g
ttttggctataaagataatagttaatatcccctaaaatccacggtccataaacttgtttgctatggttcanacaaagcatagggcttaaggttgttttggt

SEQ ID NO: 27444 - DNA, 101 bp, rice(Oryza sativa)
  misc_feature (71): n=a or g
tctatgacggggacagacaagagggagagatgccagtagatgcgcatctgcacgtcgtctcgcgctggccncctggccgatcctcctcctccccctccgtc

SEQ ID NO: 27445 - DNA, 101 bp, rice(Oryza sativa)
  misc_feature (71): n=a or g
gttgacaaatggcggcaaagtatagctagaaaccaaagacacccttagacacatcatatccttatattacnaatttaaatagatccaaagggctatattat

SEQ ID NO: 27446 - DNA, 101 bp, rice(Oryza sativa)
  misc_feature (71): n=a or g
catggactacatcgtggacactggcatggtcgaggatctctcagaggacttggccacgactgctgctatcnagcatgccacacacgccgggcggtcacggc

SEQ ID NO: 27447 - DNA, 101 bp, rice(Oryza sativa)
  misc_feature (71): n=t or c
acacccgctgcctggtcaggttgggtaaggatggctggcccatcgacgtcgtggttggcatcctcctcatngtcgctcccggtcatcgtgtcccatctgcc

SEQ ID NO: 27448 - DNA, 101 bp, rice(Oryza sativa)
  misc_feature (71): n=a or c
ggaactcactgccgatgggagaagaagccgcccaagcgctcgacttgtttgatcgcatgctgaagctgaangaacagggtctacaaggggaacaaatcact

SEQ ID NO: 27449 - DNA, 101 bp, rice(Oryza sativa)
  misc_feature (71): n=a or g
ccgaggaagctcatctacatggccatcggtgagttgcttctatatctgtatgtgtatgcttgctgctgctnctgctgctactgcgtcgtgatgctaagttg

SEQ ID NO: 27450 - DNA, 101 bp, rice(Oryza sativa)
  misc_feature (71): n=a or c
tatactcaattttaatttacggaaaatcacaaaagaaacaaagggggcaaacggtaaactaaactgcaacncaaaaggacacccaccattctatgatttga

SEQ ID NO: 27451 - DNA, 101 bp, rice(Oryza sativa)
  misc_feature (71): n=a or g
ttttcaagtcacatgatttttttaaaaaacagtggaattgcgtaggaatgtatatgcaatactaaggatcnagacatattttttttcttttagtgagctga

SEQ ID NO: 27452 - DNA, 101 bp, rice(Oryza sativa)
  misc_feature (71): n=a or c
aaaactaactaaaatgttaaataaaatattattaggttagtttactttgtatgattaggatagttgtgganttcacatcatatttaaggcacaacccctat

SEQ ID NO: 27453 - DNA, 101 bp, rice(Oryza sativa)
  misc_feature (71): n=a or g
ttgacttcgggcttcacattcggcgctctacttcgaccgatctggtggcttgctctgatggagattgggcnggatgtcctgacactcgcaagtccacttcg

SEQ ID NO: 27454 - DNA, 101 bp, rice(Oryza sativa)
  misc_feature (71): n=a or g
tctataatatatgactttttagtattatccatattcatctatgacgtaacattatagatgatagatgattntgggtaatgctagaaagtcttatattatga

SEQ ID NO: 27455 - DNA, 101 bp, rice(Oryza sativa)
  misc_feature (71): n=a or c
gaagtgggtggtaagctcacagccggcttaggtataggacaaaaaaataatctataagagatacagttagnccatatattaaccataaaaagataaccact

SEQ ID NO: 27456 - DNA, 101 bp, rice(Oryza sativa)
  misc_feature (71): n=t or c
acccacctgccgagttattgtaccatgggtgcaatttactcttactgtaatctccaatgaacatcaaatgncacttttgcttttcagtcgaaacatagcat

SEQ ID NO: 27457 - DNA, 101 bp, rice(Oryza sativa)
  misc_feature (71): n=t or c
tggctccgttgaaactgagccatggtgaacaagagagaagaagaaaatagggcggacaaaaatgtttcggngtgttttgtaggagtacatggcataatttt

SEQ ID NO: 27458 - DNA, 101 bp, rice(Oryza sativa)
  misc_feature (71): n=t or g
atcagatctccacgcttagtttccaatcgcgggttcttcctccttatgcatgtgctatttctgtttccccngttctgatcgcttgcgcgcactagagatcg

SEQ ID NO: 27459 - DNA, 101 bp, rice(Oryza sativa)
  misc_feature (71): n=a or g
agagcttctggtctttgattggattagcaccaaagcgcttaaccaaatagacagagtgggtaggggacagngaaggacgtcgaacaaaggacagttttagg

SEQ ID NO: 27460 - DNA, 101 bp, rice(Oryza sativa)
  misc_feature (71): n=t or c
aggacagagaggggatgagaaagaagagggaaaagaaaagtacagggttggaagtgaaagaaaaagaagangagtccttttaagttggatctgtccctata

SEQ ID NO: 27461 - DNA, 101 bp, rice(Oryza sativa)
  misc_feature (71): n=t or c
aattggcatataatttaacagtacagcatgataaaaaaaaactgaatataacttttagtgaggtttggcantggtgcttcaaccaaatgtttgggaattga

SEQ ID NO: 27462 - DNA, 101 bp, rice(Oryza sativa)
  misc_feature (71): n=a or c
acgttgattgtcatgtaacactactgacagcttcttttattacgcaagctatctttaaactttagatgtgncaaaaattgaataacttactgatcatgatt

SEQ ID NO: 27463 - DNA, 101 bp, rice(Oryza sativa)
  misc_feature (71): n=a or g
taatcacggatgcaccagtttgtttctgtagcggttttttttatacacaggataagggaagagaaggaggnctaatgtttttttaccgtagtataggatgg

SEQ ID NO: 27464 - DNA, 101 bp, rice(Oryza sativa)
  misc_feature (71): n=t or c
acagcaaactatcatcagcaaacaacaagtgtgacactcccagcgcacgacgacagactttcaactcattnagttgtccctcctctaccacctgacataaa

SEQ ID NO: 27465 - DNA, 101 bp, rice(Oryza sativa)
  misc_feature (71): n=a or g
atttagaagaaaaaatttttaatattagttgatagtcttcgtgcatgcatgtattcatagtttgagtacanagcatggcacatagagaaaagaaagagagg

SEQ ID NO: 27466 - DNA, 101 bp, rice(Oryza sativa)
  misc_feature (71): n=a or c
gatgcattgcatagtgatatctcgtgatctagcttgtataattaagtgaacgacagataaacggtatactnttgagaggagttttgttcattccatattat

SEQ ID NO: 27467 - DNA, 101 bp, rice(Oryza sativa)
  misc_feature (71): n=t or c
ttcattattttctaagaatacggcgtgtctagattccacaaatttagtgacacggtccgggcaataaaatnggtaccccttagatgtctcggggtatccga

SEQ ID NO: 27468 - DNA, 101 bp, rice(Oryza sativa)
  misc_feature (71): n=t or c
ccatgaacatacacacccacaatctaaaccgacctataagcacatatttaattaaaaactagttggatggnccgcgcaattactcggctaacacccaaaca

SEQ ID NO: 27469 - DNA, 101 bp, rice(Oryza sativa)
  misc_feature (71): n=a or g
aatttaacattagtatttggtagcattttctcaaaaattgctaatgggcgtttgctgtgatcctggtggancgatgggttttttttcttttcttttctagc

SEQ ID NO: 27470 - DNA, 101 bp, rice(Oryza sativa)
  misc_feature (71): n=a or c
ttttcattagcacgttttttaaactattaaataatgccttcttttaaaagaattattatcacatttgtcanactgttaaatgatgtattcttttttaaaaa

SEQ ID NO: 27471 - DNA, 101 bp, rice(Oryza sativa)
  misc_feature (71): n=t or c
ggctgccgaggagacaattgcatccatcagggcaaccactgctattctcaaggctacatcacctacagcanccatggcaccacctactctagcgcctacca

SEQ ID NO: 27472 - DNA, 101 bp, rice(Oryza sativa)
  misc_feature (71): n=a or g
ggtcttcaggagcatgactccatcgatgcgggacccacccattagagaagcatccgtgtttaactttgatnttgctattccattaatggatacaagtggta

SEQ ID NO: 27473 - DNA, 101 bp, rice(Oryza sativa)
  misc_feature (71): n=a or c
tttatgtcctactatattaccattatttatcgtctcttttggaagctagtggtacttgtattaaaaatatntgagtaaatttcactttagggcatcttata

SEQ ID NO: 27474 - DNA, 101 bp, rice(Oryza sativa)
  misc_feature (71): n=t or c
tacaaagcaaattgtcagacagaaaaacaaaagtgaaagactgctatgtgcttgcttacatacataaaagnactagttatggttcaatgtaagtcaaggat

SEQ ID NO: 27475 - DNA, 101 bp, rice(Oryza sativa)
  misc_feature (71): n=a or g
cctactggcttggtctttgcatgcaggggttagctaagctaagcaatagatatatgctgctttgcgtgggncacgcacgtagtcggggatgagagaatcta

SEQ ID NO: 27476 - DNA, 101 bp, rice(Oryza sativa)
  misc_feature (71): n=t or c
atggagttcaaccttcctgttcttcaagtgcaaaggtattggctgcactggatttctgttttttttaccangatagtagtacacagtagtaaaacttgatt

SEQ ID NO: 27477 - DNA, 101 bp, rice(Oryza sativa)
  misc_feature (71): n=t or c
gcctcttccgaccatggcacgcgaaaatacaatcttacccctccacccttctccaccgtgcggtacaaaancaagggctgagttagtaccggtcagtcccg

SEQ ID NO: 27478 - DNA, 101 bp, rice(Oryza sativa)
  misc_feature (71): n=t or c
attgtcgtactagctagagccacctcccaatccacatggttcgatttaggcctataaaccgacgatttagnagccactgcccctagggtcattgccactac

SEQ ID NO: 27479 - DNA, 101 bp, rice(Oryza sativa)
  misc_feature (71): n=a or g
ttccctgacggagattctacgtgcaaattaattttccccgacaagctagttgtgacggtatttttctgacnttgacacgtcaggacctattttcctgatgg

SEQ ID NO: 27480 - DNA, 101 bp, rice(Oryza sativa)
  misc_feature (71): n=a or c
tttgttattatagctgctctcaggggacagtactgcatataggggttaaaacggggtggcgcctgccagtncagcctaggggtgaaaacagtatggaaatt

SEQ ID NO: 27481 - DNA, 101 bp, rice(Oryza sativa)
  misc_feature (71): n=t or c
ataaacaatcatttttgaccatgcatttgacaagttacttgagagagggtgttcatttcatatgtgttaanccccggcgccgggtgttaccatggcacacc

SEQ ID NO: 27482 - DNA, 101 bp, rice(Oryza sativa)
  misc_feature (71): n=t or c
gcatcattcgctctctcttcatttgagggagagagacggcgcttttgccgtcctcaatctctcgttcgcgncagatttttctccggggggagcgcgacacg

SEQ ID NO: 27483 - DNA, 101 bp, rice(Oryza sativa)
  misc_feature (71): n=a or g
gcaaaacgaggttctctcttctccgtctctgtagcaactatagagcgagttgttgtccttgtccgtcaagngggaccctccctctatggtgcactgtgcct

SEQ ID NO: 27484 - DNA, 101 bp, rice(Oryza sativa)
  misc_feature (71): n=a or g
tcttttgtgcgttgtgtttacacaataatgtcgcacattggagtagtttacctacgattgcttaaataatnctaaaagacccgctgcccacccaaaagtcc

SEQ ID NO: 27485 - DNA, 101 bp, rice(Oryza sativa)
  misc_feature (71): n=t or g
gattagtcgatcacaatgtgctcagaatagaagaattttagttgcactatggccacgctaacactgtcacngtcaaaggttatattagatggtttatacat

SEQ ID NO: 27486 - DNA, 101 bp, rice(Oryza sativa)
  misc_feature (71): n=t or c
cctccgcgccaccgcttctccggatcgaggacaacaccaccttctccgtcatcctcctcaattctgattcngattctggccagcgtcctctcctgcaactg

SEQ ID NO: 27487 - DNA, 101 bp, rice(Oryza sativa)
  misc_feature (71): n=t or c
atattccactaatatctgggaccagtcgatccatgaaaaatggtcgtaccgcgccgacccactccgccagngccgcaatgagcatgacacggtagattttt

SEQ ID NO: 27488 - DNA, 101 bp, rice(Oryza sativa)
  misc_feature (71): n=t or c
gcgacgacgacaaagttggggccatgctagccgactcctcttttgcccgtgctagctgactcctcattccngccccgtcatcctcgatcacgggtgtagcg

SEQ ID NO: 27489 - DNA, 101 bp, rice(Oryza sativa)
  misc_feature (71): n=t or c
gcgactgaactcttgttcagacagcattttcaccatgatagtgtttggaactaatatgtgagctaaggccnatatgtagattaattctttacaaaatcaaa

SEQ ID NO: 27490 - DNA, 101 bp, rice(Oryza sativa)
  misc_feature (71): n=a or g
acttgtctgaaggcacaactcaaccaagggcgccagctggtctatggcatagactagtttagcaattgacngaatataaagtggataatttgttttccccc

SEQ ID NO: 27491 - DNA, 101 bp, rice(Oryza sativa)
  misc_feature (71): n=t or c
caatgaaatattgggagcagcgtcctttgcagtctgcagcacgaaatgggttggtgtcacaccttaatggnacggcggacatcagggaattagggcagcta

SEQ ID NO: 27492 - DNA, 101 bp, rice(Oryza sativa)
  misc_feature (71): n=t or c
aacgaaggaagcgaatcagctgaagcgaaggcgagcgattggtcgtcaggaagcttcagagcaacaactcngttgatttaaaattttagataaaagaatat

SEQ ID NO: 27493 - DNA, 101 bp, rice(Oryza sativa)
  misc_feature (71): n=t or c
gttttgtttgctcctgtaagataacttgaaatgtttttttgagcaagttctgtcagcccttgtaagagttncgtgttctactaataaataattgttttttt

SEQ ID NO: 27494 - DNA, 101 bp, rice(Oryza sativa)
  misc_feature (71): n=t or c
aaggaaaaaaaacgtttgttctaaagaagcttcgaaggctcaaacttcacgagccaagctgaaacgactangagcatccaccctcgttgtagttacgggcc

SEQ ID NO: 27495 - DNA, 101 bp, rice(Oryza sativa)
  misc_feature (71): n=t or c
cccccatcccccaaaattcaaaacagaaccccacacacacagcgccacctccgtcgtagcacgcgtacctncggggatagacgaagggaggagcgggcggc

SEQ ID NO: 27496 - DNA, 101 bp, rice(Oryza sativa)
  misc_feature (71): n=a or g
taattgcttcaatggtagacatggtttttggtttaacatgggacagagaataacagtagtaaattataacnttaaataatttatgtttgcatagatgaatg

SEQ ID NO: 27497 - DNA, 101 bp, rice(Oryza sativa)
  misc_feature (71): n=t or c
ttattaataaatatatatgtagtcccttagttttctgaattaaagaggggaaattctgttttctaggactntaggctaggatcgggccgaacaccaagccc

SEQ ID NO: 27498 - DNA, 101 bp, rice(Oryza sativa)
  misc_feature (71): n=t or g
tgcaattcttttgtttcctggccaaatggttgtaggaacacttgtcgatgactcccaacttgaaatttctngagattaggcgtagactatttcagatcagg

SEQ ID NO: 27499 - DNA, 101 bp, rice(Oryza sativa)
  misc_feature (71): n=a or g
gcattcatgagtctctcgacccattaccactcttagctagaggtgagtgttacttccttcgtttcacaatntaagactttctaacattgttcacattcata

SEQ ID NO: 27500 - DNA, 101 bp, rice(Oryza sativa)
  misc_feature (71): n=t or c
cgacagcgtaattcaaactcaacgtcaaaagaaggacctaatgtgaacctattccttctcctttccccttnggaataagttcacttcatgaccctcaaaag

SEQ ID NO: 27501 - DNA, 101 bp, rice(Oryza sativa)
  misc_feature (71): n=t or c
cacgttggaggcgggccagcacgagggacctatagctatggtgttgtccctgctccttcggcaagaagtcncgggagtagagtcgcagagctagcccctcc

SEQ ID NO: 27502 - DNA, 101 bp, rice(Oryza sativa)
  misc_feature (71): n=a or g
aagagtgatatcattaattggagggataagcccttgtaagttgcttacaccctttctaaactagcaatgtngtattaaacatgcacacacagctctcatgg

SEQ ID NO: 27503 - DNA, 101 bp, rice(Oryza sativa)
  misc_feature (71): n=a or g
cggcacacttaacaaataaataagctcaagttctaatgacagcataaacattgataactttggaaagtggnaatttacaaactagaaaagcctctcacctc

SEQ ID NO: 27504 - DNA, 101 bp, rice(Oryza sativa)
  misc_feature (71): n=t or c
tctcatggctactgcctaactgtactgaaagggactctttagagtgagaaaattgacattatgccatcctnaaaagtgggtttcgcccaaatgccacgctg

SEQ ID NO: 27505 - DNA, 101 bp, rice(Oryza sativa)
  misc_feature (71): n=a or c
gaaacctgtcaaacagttcaatgcaccaaacgttcataccagattaaaagaagcagatatttgctaagacntcatgaataatatagatctagtaccgacta

SEQ ID NO: 27506 - DNA, 101 bp, rice(Oryza sativa)
  misc_feature (71): n=a or g
aaaaaaaatactccagatgattgtgtaatcgatccgaattttccacaccaaaacagagggatcaatctgtntcattctcctttcgacgaaccgaagcgcga

SEQ ID NO: 27507 - DNA, 101 bp, rice(Oryza sativa)
  misc_feature (71): n=a or g
ctaggcattctcgaaattttatggtcattataaaatatcccaaggtatctcaagttacttaactagaaaangtgcccgtgatttgtaacgggaagtgtaaa

SEQ ID NO: 27508 - DNA, 101 bp, rice(Oryza sativa)
  misc_feature (71): n=a or g
cattactgcaccttttgttttctctgttcttgttctcgtttacagaggtagttatttgggtaaggcaaagngaccaagaataaggaatgtatggaagatca

SEQ ID NO: 27509 - DNA, 101 bp, rice(Oryza sativa)
  misc_feature (71): n=a or g
tgggagcgggagcggggatggtttgcaagaggaaccgccgcatgttgaaggctccactgttactgtcctcncagagcacggtgacgacatagctgtcaggc

SEQ ID NO: 27510 - DNA, 101 bp, rice(Oryza sativa)
  misc_feature (71): n=t or g
ctatggttgcacaactgtagcggccacgcgccgaaccgtgaacttttgctattgggtacctacatccttangctctgttcttttggttgagttgggaactc

SEQ ID NO: 27511 - DNA, 101 bp, rice(Oryza sativa)
  misc_feature (71): n=a or c
tgtttttaatcccgtcagtgaaaattaaaagggtggtgccaccaaaattggtttttaagtagtgatcaatnaaaaaaaaaggtgctatatatactagtcat

SEQ ID NO: 27512 - DNA, 101 bp, rice(Oryza sativa)
  misc_feature (71): n=t or c
taaatatagtaaaatacaccaaccataatttttccccctcctcttctttttccttatctccttttcctttnccccccccctaattttcttttctgtttttc

SEQ ID NO: 27513 - DNA, 101 bp, rice(Oryza sativa)
  misc_feature (71): n=a or g
gtttggcgcaaagctagcaaagcgagattgaccgagttgcctctcgttggtcggcaactccccgacacgcnctcccgtctgccggtctgcgcgcgcgagag

SEQ ID NO: 27514 - DNA, 101 bp, rice(Oryza sativa)
  misc_feature (71): n=t or c
aggcgaaaaaaccatgtttgtccgataaaaaaaaataagtccaactcctatatcaaccaaaaaaaaagtcngactcagattggtgaaaaaaattgatctgc

SEQ ID NO: 27515 - DNA, 101 bp, rice(Oryza sativa)
  misc_feature (71): n=t or g
tgtcaatatgaaccaatcgttacttttcaaatgcaacaccgttaatcgtggcaaacagtatttgtaaggcngagtttagttctaaacttttttttcaaact

SEQ ID NO: 27516 - DNA, 101 bp, rice(Oryza sativa)
  misc_feature (71): n=t or c
cgatcaacagcgcgaaggtgatattcctgaagccgaggccgcagtcgaggccgttcaaggggtcaggcaangtgtgcctcacctgcgaccgcatcctgcag

SEQ ID NO: 27517 - DNA, 101 bp, rice(Oryza sativa)
  misc_feature (71): n=t or c
acaggggccgaggcgaaccccgcgcggcagcacggagattctcttcctccctttctttctttagggtgtgnttgaggagaaggggattggagagactggga

SEQ ID NO: 27518 - DNA, 101 bp, rice(Oryza sativa)
  misc_feature (71): n=t or c
actacaattccatcgtgctgacatcccctgccacccacctcttctcagcttttatctcataggaacggtgnagtaacgcgacagtcaatgtgcagtaacat

SEQ ID NO: 27519 - DNA, 101 bp, rice(Oryza sativa)
  misc_feature (71): n=a or g
ggaggggttttaaggtcggtaaaaaaaaagggtcattatgaaagggattttctagaatagcagaggtctcnaagacttggctaaatctaggtttctttctg

SEQ ID NO: 27520 - DNA, 101 bp, rice(Oryza sativa)
  misc_feature (71): n=t or c
ttagtttcttaagttttagagcttcatggatgctggcatccccagtttgttctgtgtcgtttttgtttttnctttcctttctgtttaagattctgtatgtt

SEQ ID NO: 27521 - DNA, 101 bp, rice(Oryza sativa)
  misc_feature (71): n=a or g
cgaactccgatcttctccgaattatgttcaaattgatgttgagccgctgcagttgggatggtcctaaattncctccacaaatgcgatccttttccatttct

SEQ ID NO: 27522 - DNA, 101 bp, rice(Oryza sativa)
  misc_feature (71): n=a or c
tcctcaatcacgtcctctaacaattctcatacgcaacgtgcgtcgtgcgctttagccctctttgtttaggnttagatttattggcttagatttttaagtca

SEQ ID NO: 27523 - DNA, 101 bp, rice(Oryza sativa)
  misc_feature (71): n=t or c
cctaaacccagtgtaaaactttgtattacttccctaagtttggtaacgaaatttaggtgggaaactctccnctccggtgaataaaaaaaaaattcacatgt

SEQ ID NO: 27524 - DNA, 101 bp, rice(Oryza sativa)
  misc_feature (71): n=t or g
acaagaaagtgtagaataatcaccaccctaaactcaactagaatcattttgtcaatgaaaatgaagaatanattaaaattaatggtttataaaagttttag

SEQ ID NO: 27525 - DNA, 101 bp, rice(Oryza sativa)
  misc_feature (71): n=a or g
acctacgagatcgtgtatatgggtacctgagtagcgtgtacgtataggtagtggaccagggaggacacacntccgctgtcatccgttcgcctcgctaatct

SEQ ID NO: 27526 - DNA, 101 bp, rice(Oryza sativa)
  misc_feature (71): n=a or g
atctccctcttcctctcctcagatccgtgtgctcggctccttcctcccctcttttctccccgcttttcccntccaatcccggcggcggcggtggctcggtg

SEQ ID NO: 27527 - DNA, 101 bp, rice(Oryza sativa)
  misc_feature (71): n=t or c
atctaacatagatccctctatgttactaataactagtgctcaggacactaacataacctaacatagatccntcaattatgcatggttgatagttttactaa

SEQ ID NO: 27528 - DNA, 101 bp, rice(Oryza sativa)
  misc_feature (71): n=t or c
aattcacactaatttatcctggccacaaaataaactatcgagttacaaaggaagggtaagtgaattaatcntgaaaatttgtccaaaatcacttacaccca

SEQ ID NO: 27529 - DNA, 101 bp, rice(Oryza sativa)
  misc_feature (71): n=t or c
tattgaatttgaatttgtatgttggtgaatgccatatctcatattgatttatcatgtgattttttaacaantttttaacaactatttaaatatcatataaa

SEQ ID NO: 27530 - DNA, 101 bp, rice(Oryza sativa)
  misc_feature (71): n=t or c
tgcaatcactgataatgcagcagaaagaagcttactaattagaagtgtgcacatgagattcatctcacacnaaataaaaataaataaacatatattcaaac

SEQ ID NO: 27531 - DNA, 101 bp, rice(Oryza sativa)
  misc_feature (71): n=t or c
gaagaagaaaaatgtttttggtaataacaaagagaaaaggaaataaatgtggaagtgcgcattcgatccgngttgtgccctctcccgaatgaagcgctcta

SEQ ID NO: 27532 - DNA, 101 bp, rice(Oryza sativa)
  misc_feature (71): n=a or c
agctgcaccatataactcagtcatttataacctttggataattagaagaagggagaagaggccaaaacaanttgacggagctcgtggctcctcaccgggag

SEQ ID NO: 27533 - DNA, 101 bp, rice(Oryza sativa)
  misc_feature (71): n=t or c
gcccctctcacgcagcgtcaaataaaaaggagagttggccgggcacgcaaaccaacgtttgtcgtgcacangcacttccacacaaaaccctagcaaaccca

SEQ ID NO: 27534 - DNA, 101 bp, rice(Oryza sativa)
  misc_feature (71): n=a or g
tttcttgctattcagaatcgtcgagctgatcagtttacggtgagagatctttcccgtaacactcagatcancgaatttaaacttctttactagattatttc

SEQ ID NO: 27535 - DNA, 101 bp, rice(Oryza sativa)
  misc_feature (71): n=a or c
acccaccaccacctttgtcccgtttcttcgccgtgcagcccgtgctcaccggaacgagtgagagagagagngagcgagcgctgatttttttcttttatttt

SEQ ID NO: 27536 - DNA, 101 bp, rice(Oryza sativa)
  misc_feature (71): n=a or g
ttacacatattaagtgttctgcgatgcgagtgataatgcactaggaacacacgtgcgtcaaaatagcaatnctgataatttaatcatttttaatgcaattt

SEQ ID NO: 27537 - DNA, 101 bp, rice(Oryza sativa)
  misc_feature (71): n=t or c
gataccaagaaatagaaaaatacacacattaattgtcttcactttatccaaatacaacttcacaagctacntgtcacaccctgaagttctttcccaagcct

SEQ ID NO: 27538 - DNA, 101 bp, rice(Oryza sativa)
  misc_feature (71): n=t or c
ggacagagggagtatatatattttttctagattaatgaagttagcacgggtgtctcgttgttgacgggcanatcgtctatcactaaaataataattagtta

SEQ ID NO: 27539 - DNA, 101 bp, rice(Oryza sativa)
  misc_feature (71): n=a or g
gaagtgtttttgaaaattcaaagatcatttcagtgattaacattgacgacgggtgaggagacgcgatggcncatgtcgaaaagagctacgtccacgtacgc

SEQ ID NO: 27540 - DNA, 101 bp, rice(Oryza sativa)
  misc_feature (71): n=a or g
tttggatcgaaggaatggtcccatgaaatcctatgaaattcttaagttcaatcaacgggaatttttgaagncttctagcatgatgtttggacttcaaggaa

SEQ ID NO: 27541 - DNA, 101 bp, rice(Oryza sativa)
  misc_feature (71): n=t or c
agcaaagagaaaaaggccagggttgggtagggccacacatcacatgatcattctgtactaattactcagancatttcctgtacaaattactcagagcatct

SEQ ID NO: 27542 - DNA, 101 bp, rice(Oryza sativa)
  misc_feature (71): n=a or c
tttttcacattagtaaatgcttgatttatctcaatatttaacagcgctacgtggtccaatcgaaacccagnaaacctgtcggcttgagattagttgattga

SEQ ID NO: 27543 - DNA, 101 bp, rice(Oryza sativa)
  misc_feature (71): n=t or c
gcagatactacaatgacttacatgtttttgatttagataatttcaaggtgagtacaccatgttaatatttngtttaatactgttagtagtaacacatgaag

SEQ ID NO: 27544 - DNA, 101 bp, rice(Oryza sativa)
  misc_feature (71): n=a or g
tgatttcacatgagttcttattacttttgcgatgcatcaattcatttaaaaaagatcaacgtgtgtgtgtntacatatatatacatatacatatacatata

SEQ ID NO: 27545 - DNA, 101 bp, rice(Oryza sativa)
  misc_feature (71): n=t or c
atccaatagatgcctgctacatccgtattaaatatacgatgcatccgatttatgtaattcttttgactaancctattcatattttttttgaaatatttata

SEQ ID NO: 27546 - DNA, 101 bp, rice(Oryza sativa)
  misc_feature (71): n=t or c
acagcagtgctcaattggctatggacaaggtcgttggaatattgaggggagcagctggtcttgctgctgangccaatgcgttccgggaattcttcaactgg

SEQ ID NO: 27547 - DNA, 101 bp, rice(Oryza sativa)
  misc_feature (71): n=t or g
aaatttaatagcaaatttgaactatttaaatagggcatatattaattatatacgagccaaactaggatgtnctcatctcaatcgggcgtaaagttaagccc

SEQ ID NO: 27548 - DNA, 101 bp, rice(Oryza sativa)
  misc_feature (71): n=t or c
cgacttctctttagtcaaattattttatgtttccccgagtttattgaaaaatatattactctctcctttcnaaattgatcatcctgtaataaaatccaaaa

SEQ ID NO: 27549 - DNA, 101 bp, rice(Oryza sativa)
  misc_feature (71): n=a or c
tgcctaatcaatatctgcacctctgcttttttatctaactcatctgcctttgcacttaattcaaccttctnttttctatatgttccacttgtgctttttgc

SEQ ID NO: 27550 - DNA, 101 bp, rice(Oryza sativa)
  misc_feature (71): n=t or c
tttaacaggacttgaagtgtaaaatgtgaaaggttgagggattgaatggcagcttaagtgatgtttgttgnaattattttttccctaacatattcgttgtt

SEQ ID NO: 27551 - DNA, 101 bp, rice(Oryza sativa)
  misc_feature (71): n=t or c
tagggctcaagccctagctgcactaggcctgcctccgcccctgataaaatctatagcaaaattgtttatcnatatattataacatcataatctaagtataa

SEQ ID NO: 27552 - DNA, 101 bp, rice(Oryza sativa)
  misc_feature (71): n=t or c
tgccgtcaggggcgcttgcttgggacattcatctcttggggcctctgatgagcccctccccgcattcgtangaacggccttggggccttcctggtggcctg

SEQ ID NO: 27553 - DNA, 101 bp, rice(Oryza sativa)
  misc_feature (71): n=a or g
atttttttgcggtctttgggaaatgagaatggagtgagacgaggccaaaggacgcgagggtaggaagagcngtttctattgtaagtatagtaattaattag

SEQ ID NO: 27554 - DNA, 101 bp, rice(Oryza sativa)
  misc_feature (71): n=a or c
cacgttgctttggacccactcgtacgtgcatagtatatgtgcaatgtacgtagtaacgcacggcatgtttngctattgcccgacacggccgcgccgtgacg

SEQ ID NO: 27555 - DNA, 101 bp, rice(Oryza sativa)
  misc_feature (71): n=a or c
agctgctcgacctagtcttccccttaggatcatcactccaaaatatctgagtatgaaatatgagggaagcnatttagtctttaagagtttaaagttagaat

SEQ ID NO: 27556 - DNA, 101 bp, rice(Oryza sativa)
  misc_feature (71): n=t or c
tgcccccagttctctcctccctccgataaggaggcaggcagtaaaaaaaaatatctccctggatctggccnagtagagttcttttggtaaatcctagtact

SEQ ID NO: 27557 - DNA, 101 bp, rice(Oryza sativa)
  misc_feature (71): n=t or c
atgctcacctagagttgagaaaatatgtatatatatagttttgattcatcccaatcatttcaaagtactcnctctgtccctaaatattcgacgccgttgat

SEQ ID NO: 27558 - DNA, 101 bp, rice(Oryza sativa)
  misc_feature (71): n=a or g
agtggatcactatcacttgcttaaatcgggcgtgtacttttcagagttgcagtttgcgacggcacaaactncccgaatgcggcaatgcacacggccgaact

SEQ ID NO: 27559 - DNA, 101 bp, rice(Oryza sativa)
  misc_feature (71): n=a or g
tgaggagttggcatcccaaagagggtgcattttagtgccactccattgtttcagtgacatgtggcctaatnccaatgaacattcgggggcacaccaatctt

SEQ ID NO: 27560 - DNA, 101 bp, rice(Oryza sativa)
  misc_feature (71): n=t or c
tggcatatatgccgctacctcagcgccaacgtacctggcgctgagtttggacctgacattcctgccacgtnggctaggcgatcgtctgggctaccacgctg

SEQ ID NO: 27561 - DNA, 101 bp, rice(Oryza sativa)
  misc_feature (71): n=a or c
cagccggacaaacatggcttagcacctccttcagatgatggatctactattgatccagttgatatgataangagcccgtaaaaggggctctatgagggcgc

SEQ ID NO: 27562 - DNA, 101 bp, rice(Oryza sativa)
  misc_feature (71): n=t or c
agtttggctgtttgagtcaactttcatttatgcccatcaactataaaactgggtataaaacatccttcaantatcaaaaccaatgcaaatcaaatctctcg

SEQ ID NO: 27563 - DNA, 101 bp, rice(Oryza sativa)
  misc_feature (71): n=t or c
ctaggaaacagcacgaaaccaagcaacctatgcaacaacctcaaggtaggattatggatgtccctagttcnaggctttttacaggatgacagacccgaaat

SEQ ID NO: 27564 - DNA, 101 bp, rice(Oryza sativa)
  misc_feature (71): n=a or g
atgataggtggtaaagaagttgctgttaaaagattaagtaaagattctcagcaaggaaccgaggaattcangaatgaagttattcttatcgcaaaattgca

SEQ ID NO: 27565 - DNA, 101 bp, rice(Oryza sativa)
  misc_feature (71): n=a or g
tactactccagtctcacttttaagtgtagtcaaaagcttttttcaccatttgaccttccattttatttaanaaattataaaaaataaaaaataataataag

SEQ ID NO: 27566 - DNA, 101 bp, rice(Oryza sativa)
  misc_feature (71): n=t or c
ctgttgtgagcaatttttaccaagggcaaaaatatatgcttaaatccctagggaacataaccagccatgcnaatagtgaagttgggctgaaagcactgtgc

SEQ ID NO: 27567 - DNA, 101 bp, rice(Oryza sativa)
  misc_feature (71): n=a or g
aatcttggagttcagttccttccatagttgccaaaatactaggaggaccagagagtaaacaagccggcacngagatgctcaggtaagcaagccctagaaga

SEQ ID NO: 27568 - DNA, 101 bp, rice(Oryza sativa)
  misc_feature (71): n=a or g
ctcagtcgataatgggtaggtactggtgcctgctggtcccctccctcgatcacctatccgtcgtttacgcntgacacgatcggtctgcacgtgatttcgcg

SEQ ID NO: 27569 - DNA, 101 bp, rice(Oryza sativa)
  misc_feature (71): n=a or c
agcgcacacacatagtatacttaccgtatacgtatggcacacgtaatgaacttctcattttaaaattggtntcgatcggtcaattatggtcatccagttta

SEQ ID NO: 27570 - DNA, 101 bp, rice(Oryza sativa)
  misc_feature (71): n=a or g
cttacttactgatgctattatctatgagggtgctgatagagaactagacattgaaattatgcttcatgctngcattgcggggcatgactatgtcgacttag

SEQ ID NO: 27571 - DNA, 101 bp, rice(Oryza sativa)
  misc_feature (71): n=t or c
aaaaaaatatacttcataggtattattgaaaaggaaacatgttgtactcactcatgttctataattttacnggtcactcacataatcataaaaatgtaaaa

SEQ ID NO: 27572 - DNA, 101 bp, rice(Oryza sativa)
  misc_feature (71): n=a or c
aagggcacagtggtcgtcaacaatgtgtagtcattcaacgacgtgatgaactcgtttaatcgccgcaaagntatctttagatatgtactactccagtaccc

SEQ ID NO: 27573 - DNA, 101 bp, rice(Oryza sativa)
  misc_feature (71): n=t or c
ggcgacctgcagaatgcgctcgcttctcccctgaagaaaagcggtggcgttctcagcgacgggtgcgcctnactgaagggtcacaaattcgaacagatgtt

SEQ ID NO: 27574 - DNA, 101 bp, rice(Oryza sativa)
  misc_feature (71): n=t or g
ctctacaaccacagtaaaactgtactccaaaccaccaaaaggggatatatctttttttgcagagaagagangaagaggataccgggagacgagcaacgatg

SEQ ID NO: 27575 - DNA, 101 bp, rice(Oryza sativa)
  misc_feature (71): n=t or c
gcatgagcattgcaagctcctctttggccattcataatgctcttgcgtgatgtgtggactcgtctagccangtagggcactggctgctgtggaggagagag

SEQ ID NO: 27576 - DNA, 101 bp, rice(Oryza sativa)
  misc_feature (71): n=a or g
tgttacagatttgttcaaaagtggtgagaattgacctgttaatttccactgccgattattctacatggaantttgctgattgtgactgcattgttctatta

SEQ ID NO: 27577 - DNA, 101 bp, rice(Oryza sativa)
  misc_feature (71): n=a or g
gtgaccatctatcatccgacctttcccttaactagatgatctaaatgcataggacgtacatccactggtgnagaaatcttttttactcccggttggtaacc

SEQ ID NO: 27578 - DNA, 101 bp, rice(Oryza sativa)
  misc_feature (71): n=a or g
agtgttcctccatttagttttgcattttattcactttgttcttctgtcagtacagcatcttgtggtaaccntccatataccgcagtaaccgcaccttactg

SEQ ID NO: 27579 - DNA, 101 bp, rice(Oryza sativa)
  misc_feature (71): n=a or c
tctggtacagatctagagtgtaacaaatgaaggcccactcttgtaacaaatgagggcccactcaattttgnaggcccactcttgtaacaaataagggccca

SEQ ID NO: 27580 - DNA, 101 bp, rice(Oryza sativa)
  misc_feature (71): n=a or g
cgaagccactcgagaaatcgacgtgacgaaaagcagggagaagttgtgtgtgtgtggcagcatgtacacgnccgctgagtaagattctcccgacgcgattc

SEQ ID NO: 27581 - DNA, 101 bp, rice(Oryza sativa)
  misc_feature (71): n=t or c
tttgtgcacaatttttctcacagttatacccctttttttccggatcgcaggtaagcgacgggcggtcgagnggcgatcgcaggtcggcggcgcgcggccgc

SEQ ID NO: 27582 - DNA, 101 bp, rice(Oryza sativa)
  misc_feature (71): n=t or c
cgccgccttcctcagtagaaactgaggtttgattgattaggcccgttttcaacatgaacgagtagagtggntgatgaaattctttcccctagatgagatgc

SEQ ID NO: 27583 - DNA, 101 bp, rice(Oryza sativa)
  misc_feature (71): n=a or g
atgtcatgttcagtaggtcgtggcttctacactcaaattattgcctgcgtgtgctatacagcaaaacgacnagccaatcattcaaaatgtcaagtatttgg

SEQ ID NO: 27584 - DNA, 101 bp, rice(Oryza sativa)
  misc_feature (71): n=a or g
acagcgccgcctctccatcgagctcagcatgccggagatgagaaaggagggaggggatgaggatggaaacngagacagcgtgagagaggagacggaaaaag

SEQ ID NO: 27585 - DNA, 101 bp, rice(Oryza sativa)
  misc_feature (71): n=t or c
ctcgagctaggctcgttgacagccctaattccgagcaaccgattgccgagagcagtagccaccagagctgncttgattctgggcatgcgaccaaaatgtgg

SEQ ID NO: 27586 - DNA, 101 bp, rice(Oryza sativa)
  misc_feature (71): n=t or c
ataaataaatgcagctgtgagcccaagaaaattcatgtgcgtatagcatttgtaaagcagaaagaaggacnttggatagcactaaatagagtaggcttccc

SEQ ID NO: 27587 - DNA, 101 bp, rice(Oryza sativa)
  misc_feature (71): n=a or g
gtgctagctgccgcctgtagccagcttcgagtgcttcttgtcccacctgtccaatttctctaccgcacgcncctctctctgggctgatcaacctctcgaca

SEQ ID NO: 27588 - DNA, 101 bp, rice(Oryza sativa)
  misc_feature (71): n=t or g
tcctaatacaattaaattaattgattccaaaatcctgcaaagttcatgtgaacttgtcaggttccaaatgngccttaaattaatggtaataattaagagct

SEQ ID NO: 27589 - DNA, 101 bp, rice(Oryza sativa)
  misc_feature (71): n=t or c
accctagaaaaatcaaccgcccgccacaccaaaaaaaaacaaaatcaatcgccgccacaaattccggtagncaagcccgtccgcggaaaccgcctccacgg

SEQ ID NO: 27590 - DNA, 101 bp, rice(Oryza sativa)
  misc_feature (71): n=t or g
agccagcacttcctcttttctgaaaatggccgtcaatagccatgaggtatgcatttgcagcaacttcaggngaagtgggaacaatgattttgctgctacat

SEQ ID NO: 27591 - DNA, 101 bp, rice(Oryza sativa)
  misc_feature (71): n=a or g
ctgagacaggacaatgaatccctcaccaataccattgaaaggctcaactagactttgaggcataggaatgntcctccaagtattcccctccacatcgaccg

SEQ ID NO: 27592 - DNA, 101 bp, rice(Oryza sativa)
  misc_feature (71): n=t or c
tcgccagccattttaatcttaaagcctgaccaaagaagttcaggtccttcactccgagaccgcctttcgcnactggagagcacaccttccgccatgagact

SEQ ID NO: 27593 - DNA, 101 bp, rice(Oryza sativa)
  misc_feature (71): n=t or c
atgaagcgcggtttaaacccagctttacctcgctagtttattttgtgatgcacttcactccgcttcgctcncttgttaggtagagctgaaactatttggat

SEQ ID NO: 27594 - DNA, 101 bp, rice(Oryza sativa)
  misc_feature (71): n=a or c
aaataaaaaaaattctatttcgacccatctgccattctcctctcacttattcctcttccctctctcctctncactatgtactagatggtgcgcttgggtag

SEQ ID NO: 27595 - DNA, 101 bp, rice(Oryza sativa)
  misc_feature (71): n=t or c
tctactgcgctccatttgtttgttagaaaataaaatctctcagcaccaaagcatacggtgtttatacgttngacctccgcgacaggaaggttagcattgag

SEQ ID NO: 27596 - DNA, 101 bp, rice(Oryza sativa)
  misc_feature (71): n=a or g
ataattctcctcactttagtctagatttagggtagcctcctgactccatgccgggatgactagggtcttcncggggtggagttgacttgacgaactcgatg

SEQ ID NO: 27597 - DNA, 101 bp, rice(Oryza sativa)
  misc_feature (71): n=a or g
tgtggatgcatatagtattatgcagatgcagatatagtatcactaaaatccgacggatgtggataatctgnttgaccgtttaccgaataattcgaaactat

SEQ ID NO: 27598 - DNA, 101 bp, rice(Oryza sativa)
  misc_feature (71): n=a or g
gtaaagggtacgaagcccacaatgggcgtgcctatgctagcgcgaggtcacgggcgagaggagggaaggtngcgcggcgacaggtggtcgagggcttgagg

SEQ ID NO: 27599 - DNA, 101 bp, rice(Oryza sativa)
  misc_feature (71): n=a or g
gggcttcatcatttttctacaaataagtctactttgtttcccttgtttttatatcggaattaaattgcatntaaactgtaagataagggttaaaaaaaaat

SEQ ID NO: 27600 - DNA, 101 bp, rice(Oryza sativa)
  misc_feature (71): n=t or c
gacataattaatgaagcattagttcatacccttccgtcccaaaacaaggcaatctaagatagaatataacntatctaaaacaatgtactccctctgtccta

SEQ ID NO: 27601 - DNA, 101 bp, rice(Oryza sativa)
  misc_feature (71): n=t or g
gaggtgtagagactgacatgtgagcccaattgtaataaactcaaaatatagaggacgaatagagtggctgntggagtaaaagacaatttgacttgctaaat

SEQ ID NO: 27602 - DNA, 101 bp, rice(Oryza sativa)
  misc_feature (71): n=a or g
gatctgatacctgagtatcagttccgatacctgtacgtactggatcggatacccaagtaccgagtatgatncctatgaataccaagtctaatacctaggta

SEQ ID NO: 27603 - DNA, 101 bp, rice(Oryza sativa)
  misc_feature (71): n=a or g
cgcatgtggctcaatctgataaaaaaacgatgaggcacaccacaaaataagcatttcatcacatggaaggnagaagggacactggcgggaggatgaagaaa

SEQ ID NO: 27604 - DNA, 101 bp, rice(Oryza sativa)
  misc_feature (71): n=t or c
aggagaatatattcagtcccacttttacactggaaccaatgctagcacactagagaggaagaaagaagatntactcaaaaagcttctaggtgctatatttt

SEQ ID NO: 27605 - DNA, 101 bp, rice(Oryza sativa)
  misc_feature (71): n=t or c
tccaacatcgcctgcaagaaggccgacatcgacatgaacaagcggtgagcaaaaccttctcgcctcacgcncccccttccctgatctgggtgctagtttgt

SEQ ID NO: 27606 - DNA, 101 bp, rice(Oryza sativa)
  misc_feature (71): n=t or c
acggcgccttgttccggccggcgcaaggacgacgtctctcgagcgacgacgaaggcgacacggtcgttctngtcgttcctctccacgctaatctccggcga

SEQ ID NO: 27607 - DNA, 101 bp, rice(Oryza sativa)
  misc_feature (71): n=t or c
ttttaaaatttaaactatggagatttactcaagatcttgagatgttactcaaatcattgtaaccactgacnacatatctatttccaggagtagagatcata

SEQ ID NO: 27608 - DNA, 101 bp, rice(Oryza sativa)
  misc_feature (71): n=a or g
atcaacgcacgggtatattcctatagttctctcatttttttaggcttatctacttagaaatatatatcccncaaatataaagaagattaatggacaagaac

SEQ ID NO: 27609 - DNA, 101 bp, rice(Oryza sativa)
  misc_feature (71): n=a or g
tcagagcaaaagttcatttagccaagaacacagaagaaccatgatcagttcaaggaagcttgctcaattgngcaagaagtggcagaggatggtggcatcca

SEQ ID NO: 27610 - DNA, 101 bp, rice(Oryza sativa)
  misc_feature (71): n=a or g
caccggcaacgcacatctgaaaccggccttactcatacgagaaaacgacgtcccgagagagagagagaganatcaagcaccgattattcctaaacaagcac

SEQ ID NO: 27611 - DNA, 101 bp, rice(Oryza sativa)
  misc_feature (71): n=a or g
cttgccttttcttggattaaatgcaactaaatgtgcaatgagatctgattggggtaaagggaagttgctcnatgcatcagctcgaattgagccgacctttg

SEQ ID NO: 27612 - DNA, 101 bp, rice(Oryza sativa)
  misc_feature (71): n=a or g
cattagctatccaaaagatcatttaggttagacttgcttcactgcttaagaagcataagcatatgcagaangaaaataaaagtctatcaatgtgtctatac

SEQ ID NO: 27613 - DNA, 101 bp, rice(Oryza sativa)
  misc_feature (71): n=a or g
tcatgatgggaaaagcgaatgatcgcatcactttttggagttttggtgcacttttcgtatatctcagaatntgttgcttcactccaaatcagtttgacgtg

SEQ ID NO: 27614 - DNA, 101 bp, rice(Oryza sativa)
  misc_feature (71): n=a or g
agtgactctccaagtttagctagtgagggtgcgatttagccattcagatagcttagctaacatgatagagnggctgttgaaggggattttttctccacact

SEQ ID NO: 27615 - DNA, 101 bp, rice(Oryza sativa)
  misc_feature (71): n=a or g
gcgagatcactaaaaggcgatcagtcacgcgctcccttaccccgctcccctacccactcggtgcaaccacntggcgcacgcggagagggggagtggcggtg

SEQ ID NO: 27616 - DNA, 101 bp, rice(Oryza sativa)
  misc_feature (71): n=t or g
gatggcaagatgtgctaggcccataggaaacaaagtggcccatatagaacgtgtcacgtagcccaacattntcacggcccaaatttatatgggcctaatta

SEQ ID NO: 27617 - DNA, 101 bp, rice(Oryza sativa)
  misc_feature (71): n=a or c
tggcgattccaattttaatgctcaccaaattttgtgcatgagaaaaatattcatgttttttataaaagttntgaattctgttttcctaatgttaatattca

SEQ ID NO: 27618 - DNA, 101 bp, rice(Oryza sativa)
  misc_feature (71): n=t or c
aagatcttgttatctactggctcagatatcctcacatgcatcggctgtaccaaaagctaagcctctgctgnatgcatggtgtgatcttgatttttaattag

SEQ ID NO: 27619 - DNA, 101 bp, rice(Oryza sativa)
  misc_feature (71): n=t or g
ctagtgtgtatggtagccgcggaatgggctggccttcgggagttcgggatctttacggattggaataagtncactttaggtctctctattcgtcgctcagt

SEQ ID NO: 27620 - DNA, 101 bp, rice(Oryza sativa)
  misc_feature (71): n=a or c
ataaaatgttaaccataaacacaacatttaaaagtgtgatgaagagggcgagcgtttaaaagttgcatgtngtaatcttgaggcaatggttatacaactgt

SEQ ID NO: 27621 - DNA, 101 bp, rice(Oryza sativa)
  misc_feature (71): n=a or g
cctttcttttcctcctttttcttgattggccgtcggcccattctctcccacgcttggcctccctcttgctnggccggcccaagccgcctcctctcctccct

SEQ ID NO: 27622 - DNA, 101 bp, rice(Oryza sativa)
  misc_feature (71): n=t or c
gtggagctgaccgtgccactctgttgcacgacgggtggggggggggggtccaagtcgtcgcaatgaaaaanttggtgagcaatgctacttgatgtattggc

SEQ ID NO: 27623 - DNA, 101 bp, rice(Oryza sativa)
  misc_feature (71): n=c or g
tagttgacaagaaaactgtatcaataggcataacctttgctgacctccctttgtcatgtgaaacctcctangttagatgaattaaatgtcaaaaactcaaa

SEQ ID NO: 27624 - DNA, 101 bp, rice(Oryza sativa)
  misc_feature (71): n=a or t
gttttttcttttgatgataccatttgctttaatctgtagctgcaactgtcttgcagcttgtagtttttttnaaaaaataaaataaaataaaaagaagaaaa

SEQ ID NO: 27625 - DNA, 101 bp, rice(Oryza sativa)
  misc_feature (71): n=a or t
caactccgcaataaggtcatgttactctagagagacctagaaattattgcgcgttcacaaaaacctagaanttattactacattaataagaaaaacagaaa

SEQ ID NO: 27626 - DNA, 101 bp, rice(Oryza sativa)
  misc_feature (71): n=a or c
gagcagaaggagagaccatggacaatggcaagttttcgaccaggaaatgatgttgacacaatctttcgatnggcggcagagtatatcgtcggtgacggcac

SEQ ID NO: 27627 - DNA, 101 bp, rice(Oryza sativa)
  misc_feature (71): n=a or g
tgtccctccgcgagtgatcctatcagcaaccaaacccgtcattaccgcaccatcaacattttacgactatngatgagaagaccctccgtgagttcgccgct

SEQ ID NO: 27628 - DNA, 101 bp, rice(Oryza sativa)
  misc_feature (71): n=t or c
ggttttaggccgatctaaaattgaattcttcttatcagccgataatggcggatcacaattccgctgagcanggaccagagtcttaccgacggtgatctccg

SEQ ID NO: 27629 - DNA, 101 bp, rice(Oryza sativa)
  misc_feature (71): n=t or c
tcttcatggatgacttctcagtctatgggaagaccttcgatctctccaaaatttggacaagtccttgcagnaatgccaagaaaaggacctggtatttaatt

SEQ ID NO: 27630 - DNA, 101 bp, rice(Oryza sativa)
  misc_feature (71): n=t or g
gtcccggtccggaagttccgatcatttggaccggaagttccggacctctggcaagacaaagaggctgacangaggttccgggcaaaaagctaggaagctcc

SEQ ID NO: 27631 - DNA, 101 bp, rice(Oryza sativa)
  misc_feature (71): n=t or c
accttgtgtgttcaagattaatggggttgtccaccaaggtattggcagcctgctgccacagcaaggctcangacctaaatttgcacaactttacatatatg

SEQ ID NO: 27632 - DNA, 101 bp, rice(Oryza sativa)
  misc_feature (71): n=t or g
aggggatattgcttttccgccttctcatttctaggggattttagtgctcgaagaagcagctgatgattgtnagcgagcgagcgaggatgataggattattt

SEQ ID NO: 27633 - DNA, 101 bp, rice(Oryza sativa)
  misc_feature (71): n=t or c
gctcctcatctttactcacctgttcattattataactagtgttattattatttcaagtagataggtgtccngcgcaattgcgtggctaacacccatataaa

SEQ ID NO: 27634 - DNA, 101 bp, rice(Oryza sativa)
  misc_feature (71): n=a or g
cgcacggcaccggcttgggcgggcttggcgaaatataccggtgcttgcacagtgtgtggaaggagaacttngggctgagcgtagaattgctgggagtgggc

SEQ ID NO: 27635 - DNA, 101 bp, rice(Oryza sativa)
  misc_feature (71): n=t or c
aacctaccggccgaaggaggggccgggaggacgtttttctagttcttgaaccaatcctggcacctcccgcnatctggcttcacgtggacggctcggatttc

SEQ ID NO: 27636 - DNA, 101 bp, rice(Oryza sativa)
  misc_feature (71): n=t or g
agtagaggaggaagatgtatgtcacttacaggtgggccccatgtgccttttaatttctttttactaaatangatgctacgtcagtgaaaccgtcatctata

SEQ ID NO: 27637 - DNA, 101 bp, rice(Oryza sativa)
  misc_feature (71): n=a or g
gagcgggggaggtagtttttattatccttggaaaccggcagcccaggaccacctttccgctgtgcattcanctcagctctcgctcactggccagttgccaa

SEQ ID NO: 27638 - DNA, 101 bp, rice(Oryza sativa)
  misc_feature (71): n=t or c
gagtttttttcatggagaggaccaaaatgcccctcaccccctccctcccatctctctctcctccggagtcnggacacctctactctccccgtcttctctcc

SEQ ID NO: 27639 - DNA, 101 bp, rice(Oryza sativa)
  misc_feature (71): n=a or g
cccacctttcctcggtagcagtagaactcgtacgccgggagttcattgttgacgatctgttcttgaaatcntttgttattctgatgatttattatggagta

SEQ ID NO: 27640 - DNA, 101 bp, rice(Oryza sativa)
  misc_feature (71): n=a or g
cgccggacatgtgctcagcgccagaaagaattctggtagaggcaccgcaccactgtgcgtcccatgggtgnaccgcatgggtgcgaccgcagctggacatg

SEQ ID NO: 27641 - DNA, 101 bp, rice(Oryza sativa)
  misc_feature (71): n=t or c
acttgaaattgaacggaattatctcgtctcccggacggctggagctcaattaatgggggagaagagcaagnaagtgactggtcactggccagtagtacagc

SEQ ID NO: 27642 - DNA, 101 bp, rice(Oryza sativa)
  misc_feature (71): n=a or g
tcaataatctcaggcataccatcagcagcagaatcagctaacaattccaaaagctcttccacaatatgcanctgaacagtaggtccacacttgtgatcgcg

SEQ ID NO: 27643 - DNA, 101 bp, rice(Oryza sativa)
  misc_feature (71): n=a or g
atgttaccagatcgtgagcgactatgggactgcagtaatcttgctatatcctcatgtgcatataacctttntaatctatccttaataggcaggtagcgcaa

SEQ ID NO: 27644 - DNA, 101 bp, rice(Oryza sativa)
  misc_feature (71): n=t or g
ctgacacacctcgtcatcctcacgaagttgaaacacttccaataattcctcaaggacatgaagttggacanattttggacatttgtgacctggtccccatt

SEQ ID NO: 27645 - DNA, 101 bp, rice(Oryza sativa)
  misc_feature (71): n=t or g
agcttaccaacaagatcctttcacacagcagctcttggcagctctcagcttgaacccagaaggggtggatngatttcttctgataaatggagtgatcaagc

SEQ ID NO: 27646 - DNA, 101 bp, rice(Oryza sativa)
  misc_feature (71): n=a or c
ctgcgcacatcataaacccgaaaaatacaaaaatcagtccaacccaatccacccccattacccgtaccagnaacaggacttgactaatagcttcgaaccag

SEQ ID NO: 27647 - DNA, 101 bp, rice(Oryza sativa)
  misc_feature (71): n=t or c
atccagcttcgatggagggtcgtcatcggtacccgatgagcttcgggcttcgcaaactaatgaagcgcccnaggcgacacagcccacacaaccagaggttg

SEQ ID NO: 27648 - DNA, 101 bp, rice(Oryza sativa)
  misc_feature (71): n=t or c
cctatttgtgacttttacttgcaattctaagtggcaagaaatatacgatgcattgttgtttgaaccaggcnaggtaccaagcgaccgttctgatatgattg

SEQ ID NO: 27649 - DNA, 101 bp, rice(Oryza sativa)
  misc_feature (71): n=t or c
ggtcctggtgtggctcttcttggactaaatgcagcaaagagtccagtcatcgcttctgcttggcttactancgctgtaggtttgaagtcctttggtcactc

SEQ ID NO: 27650 - DNA, 101 bp, rice(Oryza sativa)
  misc_feature (71): n=t or g
ctcaagctgcaagacatcaagcaaaggcttaaaaatgccgacgagaggaagatccgttatgatctgagtgngattgaaaagaatggtcactctaaatcccc

SEQ ID NO: 27651 - DNA, 101 bp, rice(Oryza sativa)
  misc_feature (71): n=a or g
acccggtcccactgtggagtttacgtcgaactgtgaacgacgctgttgcccaccagtagtagaactagaancgtggctgatccggtcacggacagtgtcgc

SEQ ID NO: 27652 - DNA, 101 bp, rice(Oryza sativa)
  misc_feature (71): n=a or c
gcacaattgatgcaactattgaaggcctttatcttcccaatatcctccaatagcaaatccaagcaatgtgnagcacaaggtgtccaaaacaagtgtgggat

SEQ ID NO: 27653 - DNA, 101 bp, rice(Oryza sativa)
  misc_feature (71): n=a or c
tcacaagcttgccgagcagcacaaggaacgccagagtcgtagcacacaaggcattgttctgtgatgtgtanaagtatccgatttgatattgtttgcacctt

SEQ ID NO: 27654 - DNA, 101 bp, rice(Oryza sativa)
  misc_feature (71): n=t or c
cagtactcttcctactcaaggtgttccacgacaagggaagcagcggaatgggtttctgaatttctgtaatngcttttccagtggtgacaggtttaagaagt

SEQ ID NO: 27655 - DNA, 101 bp, rice(Oryza sativa)
  misc_feature (71): n=t or g
gaaggctccaaattcattaatttcataggttgaaatgaattacgtgataggccgccgcaagagaagacttncccatttccaattataattgatttgttata

SEQ ID NO: 27656 - DNA, 101 bp, rice(Oryza sativa)
  misc_feature (71): n=t or c
gctccagtccttcaagcaattcaccacggtggaagaaatcaacgaattagtgcaactaggggagatgctanagcaaattcagcttaacccgcaagtgcagg

SEQ ID NO: 27657 - DNA, 101 bp, rice(Oryza sativa)
  misc_feature (71): n=a or g
aagaagagccgacaggtgcttgtgcttgggattcatgcccttgatcatcgtgagaacgagagtttggtcangcactggttggctgacatcccgaagggagt

SEQ ID NO: 27658 - DNA, 101 bp, rice(Oryza sativa)
  misc_feature (71): n=a or c
gtggccctgattaatccgacgtatttctatttcgccgacacccacggagaaaggatcgattacaacacacngcaaaagggaataagagatgaggccgcggc

SEQ ID NO: 27659 - DNA, 101 bp, rice(Oryza sativa)
  misc_feature (71): n=t or g
cagagatcattttgatatggttgcatggttatgtgtaacttcaagctttgatgtaggaagaattatgcgtnaaatagtacagtgtgttacacgttcgccat

SEQ ID NO: 27660 - DNA, 101 bp, rice(Oryza sativa)
  misc_feature (71): n=t or c
ttgaccagccgagctttctcggagaaagaaaaaaaaaaggagaagggagaggcatctggttcctccttaangccgtgggactaaatccggtggagggcagg

SEQ ID NO: 27661 - DNA, 101 bp, rice(Oryza sativa)
  misc_feature (71): n=t or c
agtggatcagttcttgctgcagctggatgcagttcaaatggtgcaaatgttgttatttgggatacattggngccaccatccacttgtcaaacttctattat

SEQ ID NO: 27662 - DNA, 101 bp, rice(Oryza sativa)
  misc_feature (71): n=t or g
tataatcggaattgcaatgcaaatgcagtacctgtcgaagatcgtggacagcatgaatctgccggattggngaatagaggttctgagagtggagggaatgt

SEQ ID NO: 27663 - DNA, 101 bp, rice(Oryza sativa)
  misc_feature (71): n=a or g
aagagagttaaaaaaacccataataaaaaaagcaaaaggagactagtactagcaaggctagccagcccatngtgttcgactcgtctccatttcgcgtctcc

SEQ ID NO: 27664 - DNA, 101 bp, rice(Oryza sativa)
  misc_feature (71): n=t or c
tggctcttttgtaggaagccaacagtattttgctagtccatatcaacttcctggctcgccatctggtttcntcccgatgtctattcagcccaccacagatt

SEQ ID NO: 27665 - DNA, 101 bp, rice(Oryza sativa)
  misc_feature (71): n=t or c
gttataaagcattcaaaaccttcgatcctaacgaaccaaacacggttaggtaatgacgaaattgttatggngatagatcctgagactaaagaactactgta

SEQ ID NO: 27666 - DNA, 101 bp, rice(Oryza sativa)
  misc_feature (71): n=a or g
ttaagcttgactgaatattttcttaaattcttgaatgtttcctgcaggtctttgccatgagtgaacgcctntttgcttttcaccacaatgtcatccacata

SEQ ID NO: 27667 - DNA, 101 bp, rice(Oryza sativa)
  misc_feature (71): n=t or g
aggatcagctggcttttcctttggtcttccaacctgcctccgggttagaatcggtgattgatgtaatgccncgccttgtgatgggtcagttgatggagcag

SEQ ID NO: 27668 - DNA, 101 bp, rice(Oryza sativa)
  misc_feature (71): n=a or g
gcagcagtggcagacacagctttaaaatatatagatggggcgatatctagcaaggcgctagccctaattgnatgatggcacatcgcacacaagccataatc

SEQ ID NO: 27669 - DNA, 101 bp, rice(Oryza sativa)
  misc_feature (71): n=a or g
gcaatacactgcgagagtttgatctatccttttttcccctatgactcctttctacactagatgatgccttnttcatcggtttggatggtcaggtcctgtat

SEQ ID NO: 27670 - DNA, 101 bp, rice(Oryza sativa)
  misc_feature (71): n=t or c
gtatttctgtatggactaaaatacccataccaatcctctttcaaccatagccccaaatccccacaaatccnccaatcccagcaacccctcgacaagtatgg

SEQ ID NO: 27671 - DNA, 101 bp, rice(Oryza sativa)
  misc_feature (71): n=t or c
tgtgagagacgacggagatgacagccaattaactggggtgtttagttggtgattgcagatgaaaggtcganatatatactatgaagtttcatgtcaacgga

SEQ ID NO: 27672 - DNA, 101 bp, rice(Oryza sativa)
  misc_feature (71): n=t or c
ttttaatacacatcgacttcccttttgtaatctatttcttctttctcctctttttctctgtagcatctgtngaatcaaattgcagttccaagcttagtgca

SEQ ID NO: 27673 - DNA, 101 bp, rice(Oryza sativa)
  misc_feature (71): n=t or c
cctagatgattaaatacttccactccccttgtgacatacaaccctatttgtctgtagacctcactacaatnagaaaaacaaagagcggatgatttggaaaa

SEQ ID NO: 27674 - DNA, 101 bp, rice(Oryza sativa)
  misc_feature (71): n=t or g
gggtggctgcggtccgaccctaggatcaaggtcaggttggagcttgacgtgggaaggctcacagtcaccgncgtgtacgtccaaggcggagagctcttggt

SEQ ID NO: 27675 - DNA, 101 bp, rice(Oryza sativa)
  misc_feature (71): n=a or c
caccagacaatttgagaggcaattacttaaattgaagaaatagatggtcaccgaaaatgtgagtcaaaatntgggtacaatgtgacagcaccaagtgccaa

SEQ ID NO: 27676 - DNA, 101 bp, rice(Oryza sativa)
  misc_feature (71): n=a or g
ataggtagcggatatatttgcacttgcatcttggtactctgcagctgagaactatgatcagcctatagtcntcgtaattgatgatttagagcaatgctctg

SEQ ID NO: 27677 - DNA, 101 bp, rice(Oryza sativa)
  misc_feature (71): n=t or c
atcacgctggtggcggtagggaggtccttggctagtcattccatgagactcatgaatgccatattgttcanggtgatcattagcaccagttgcacctttgt

SEQ ID NO: 27678 - DNA, 101 bp, rice(Oryza sativa)
  misc_feature (71): n=t or c
ttgtccagtcagtactcagtagtcactcgaataaaattgactaacctctttggcaaaagtttcaggttcanttgaatcttttgaagcaagagtgcaatcag

SEQ ID NO: 27679 - DNA, 101 bp, rice(Oryza sativa)
  misc_feature (71): n=a or g
atccctgatgtgccatctaagctcaactaccttgatattgatttatgctggataagagcactggaaatacncattcaaaatctagttatctttaattacca

SEQ ID NO: 27680 - DNA, 101 bp, rice(Oryza sativa)
  misc_feature (71): n=t or c
agtcgacgaacgtgtgcttgactcgtcttggtgacggcttgatcgagaatttgatcccttcttgagcagangggtgatccgtctcttcatgactacagaca

SEQ ID NO: 27681 - DNA, 101 bp, rice(Oryza sativa)
  misc_feature (71): n=a or g
cactgttactactttccgtctttccggactcacacggtcacactgccgccccagcatatttttagaaaatnggataaacccggtctctacatcggatcgga

SEQ ID NO: 27682 - DNA, 101 bp, rice(Oryza sativa)
  misc_feature (71): n=t or c
ctcattgagatgtaccaggattggaagaagaagcaggggccggaaaatcactttgttaaagtgactggaantgatacccctcctgctgatgctcccatgga

SEQ ID NO: 27683 - DNA, 101 bp, rice(Oryza sativa)
  misc_feature (71): n=a or g
tggcttctctctttccaactacataccagccaagagatccagtaagttagttactcctagtacgcgtagantggattggattcctttctttacaggtatct

SEQ ID NO: 27684 - DNA, 101 bp, rice(Oryza sativa)
  misc_feature (71): n=a or c
tagaagaaaacccggcaaatccaatccgggaaaacgctatgccgcgagctatggattccgaggcctaaacngcggcaaaaacgtgcccaagcccaactccc

SEQ ID NO: 27685 - DNA, 101 bp, rice(Oryza sativa)
  misc_feature (71): n=a or g
ggggttgcgaattcatctcgtggcatacctcttgggtcttgcattccctccggtcactcctccctgaacantgcaactcaagtgagaaattttactaaagc

SEQ ID NO: 27686 - DNA, 101 bp, rice(Oryza sativa)
  misc_feature (71): n=t or c
cttctgcttgtaggcaccaaacaaaaccaacccaatggtgaaggtagcagccagtgcaagggtattaaccngacaaggtggttcagccagtgtgaatcttc

SEQ ID NO: 27687 - DNA, 101 bp, rice(Oryza sativa)
  misc_feature (71): n=a or g
tggattttagaaggatcttttgcaactccagccccactgataatatggcccaaataggatatatgttcctnggcaaatgcacatttactgagtttaacctt

SEQ ID NO: 27688 - DNA, 101 bp, rice(Oryza sativa)
  misc_feature (71): n=a or g
gaaaggggaaaaatggattctcctcgtcgaggcaaacgctatggcgcaaggaaatagaaagaggatcaacngaggaggagatcggccggtggtgggtgatg

SEQ ID NO: 27689 - DNA, 101 bp, rice(Oryza sativa)
  misc_feature (71): n=t or c
aagggcaccaacattagcacatgcagatattacactcagcatggtaatttcatcaggtttgacaccactcngttgcatatcatggaacaaattcagcgctt

SEQ ID NO: 27690 - DNA, 101 bp, rice(Oryza sativa)
  misc_feature (71): n=t or c
ttggatgctggaaatgatggcgaatccgaggcaatgcaagtccatgttccgattgaaggccgagcagatanacagtttacatgacctcctgagtggtaaat

SEQ ID NO: 27691 - DNA, 101 bp, rice(Oryza sativa)
  misc_feature (71): n=t or c
agagaatgtagctgtagtgaggttgtaatggtcatcagggataggtaaaaaatggagacgaatccaatggngaccaggctgggagatgaagaagctatatg

SEQ ID NO: 27692 - DNA, 101 bp, rice(Oryza sativa)
  misc_feature (71): n=t or c
aatgtggggaataaattcttcgaagtgacaaggtatcataagttcaattccactatcatttggaaacctcncaactattgcattccttctaccctgcaaga

SEQ ID NO: 27693 - DNA, 101 bp, rice(Oryza sativa)
  misc_feature (71): n=a or c
acacgattatcgtacggttatcacgtacgataaacttctcggttcttagaatcacggtatacctcgcgatnaccgtaaaatcatagggtgatcggtaaccc

SEQ ID NO: 27694 - DNA, 101 bp, rice(Oryza sativa)
  misc_feature (71): n=a or g
cgaatggataagatgcaagacagggctaccctatgttcaagatgtcgcaagcagcatcaagtatcattttnacctcaccacaggaggttaccgggcacttg

SEQ ID NO: 27695 - DNA, 101 bp, rice(Oryza sativa)
  misc_feature (71): n=a or c
atcttcataacgaatatgcttcaagagattattcagtgcagcgtgtcttaaggtattaaatggccaaaggntcaatattggttccacaactttgttaagac

SEQ ID NO: 27696 - DNA, 101 bp, rice(Oryza sativa)
  misc_feature (71): n=t or g
ccaaattggtagaaatgattcagaacatcaatgctctgatgataacgatgttgataatcacttgtagggtntatattctgggtttcctttacctgttgaag

SEQ ID NO: 27697 - DNA, 101 bp, rice(Oryza sativa)
  misc_feature (71): n=t or g
gtactctaattcagaccaacatgagatcaggaagatcactgatgagatgaatgagttactttacagggaanagatgctatggctacaacgctcccggatcg

SEQ ID NO: 27698 - DNA, 101 bp, rice(Oryza sativa)
  misc_feature (71): n=t or g
caagagttgcagttacggtggatacgcatacttcttgtttgatgattcaagcaagaaggatgttacattgntacacgtgtttaccagtgagatttgtgtcg

SEQ ID NO: 27699 - DNA, 101 bp, rice(Oryza sativa)
  misc_feature (71): n=t or g
tgacggttaccagaagttggatgctttttgttttgacctccgtactcactatagaaattagcgcggccatnaagtctgtgtagttgagctcacgcttgtac

SEQ ID NO: 27700 - DNA, 101 bp, rice(Oryza sativa)
  misc_feature (71): n=t or g
ccagacggaacccaagccattcatttgctgcataattgtggaagtacatgcgcaaacttgaattgattctntccaaattttcttggaaaaattctttgtcc

SEQ ID NO: 27701 - DNA, 101 bp, rice(Oryza sativa)
  misc_feature (71): n=t or g
gaatgaactctgaacagactgatggtcttgttattgcttcagccaatctaattaaaagcttatctgaggancgctctagtttagcttccttaagagaattc

SEQ ID NO: 27702 - DNA, 101 bp, rice(Oryza sativa)
  misc_feature (71): n=t or c
ggcctcagccaatagtatggcagctgagatgcaaccgaggattacagcaagaaccttcaggagttgctttntcagtatacaacgccaaatgaactctgaaa

SEQ ID NO: 27703 - DNA, 101 bp, rice(Oryza sativa)
  misc_feature (71): n=a or c
atcactcgaaatcttgcggaagaattgcttcggcgtttgatctgaactctctcttctgtcgatggaaacancgggaggagcggtgcgcgcatatgaagggc

SEQ ID NO: 27704 - DNA, 101 bp, rice(Oryza sativa)
  misc_feature (71): n=t or c
gccttgacagtgagaaggccatgctcaagtctttaaacttactgtctccatctctgttgttcatccccttncaattgtactcctgaatcttgcccagtgtg

SEQ ID NO: 27705 - DNA, 101 bp, rice(Oryza sativa)
  misc_feature (71): n=t or c
tggaatctcgctagtggtgtttcatggagtggaaagcataatctaatgtctcgcttccatttccacccccncaaaattttctatgcccaagttgccgctaa

SEQ ID NO: 27706 - DNA, 101 bp, rice(Oryza sativa)
  misc_feature (71): n=t or c
aggccgaactgccccgtgttaccgaggatgaggtgagccgccgtgagaaggaaccggtcgacgagctgaancggtagccatcgcagcagcgccatggcgat

SEQ ID NO: 27707 - DNA, 101 bp, rice(Oryza sativa)
  misc_feature (71): n=t or c
ccaccttgcaacgaggcagcatgaatctaatcaccaagaacgaacacgctcgcaagagtcaagactcctcntctgggcaagaaatccaggagcgcaagaac

SEQ ID NO: 27708 - DNA, 101 bp, rice(Oryza sativa)
  misc_feature (71): n=t or c
gttcttacgacatatcagaagttgtcgcttgcatgcttctacataattatgtgataccgagaggcactaantttgtcttttcattgaatgagaaactgagt

SEQ ID NO: 27709 - DNA, 101 bp, rice(Oryza sativa)
  misc_feature (71): n=t or c
taaattggttggatttggcgaccttggtggtcctccattatctgctgctgaagattattcacttcattcangacaccttgctaaagcaaattctctcagtc

SEQ ID NO: 27710 - DNA, 101 bp, rice(Oryza sativa)
  misc_feature (71): n=t or g
gaaaacatcaccaagcacctggcaatcactcaacaaacaacaaatccaagtgtacgtacgtacgtacaccntgcacggtgcacattagagcgcttaattaa

SEQ ID NO: 27711 - DNA, 101 bp, rice(Oryza sativa)
  misc_feature (71): n=t or g
cagcaatcttgtcgagtcgccgatcaggcacaagggatcatccctgatcatcttcgacgcttcatcatttncagcgctgcaaatcatccacgaaatcagag

SEQ ID NO: 27712 - DNA, 101 bp, rice(Oryza sativa)
  misc_feature (71): n=t or c
atcgagttaaatacaagcaaattgaatacttacaataccagaggaccccatggacccaagttatccttganccaaaccagaaagtccttcaaaatctgtca

SEQ ID NO: 27713 - DNA, 101 bp, rice(Oryza sativa)
  misc_feature (71): n=t or c
gtcatcatctgaactactatcactgtcactgcccttaaccttcaagtgaaactcgattaaagcactgtccnatacggagatgccacgcatggggggactaa

SEQ ID NO: 27714 - DNA, 101 bp, rice(Oryza sativa)
  misc_feature (71): n=a or g
ggaacgtctggtggctaccaaagtcaaacaacacaataccaagggcatgcaaatccagctggacaaggtcnaggttactacaactcacaagagcgcaggaa

SEQ ID NO: 27715 - DNA, 101 bp, rice(Oryza sativa)
  misc_feature (71): n=a or g
cgcgccggccggcgggcggtgggctaatattgtagggtgaaattcctcgccggagcggagattccaatccnaacgccggcgaggcgaagcgagacgacgaa

SEQ ID NO: 27716 - DNA, 101 bp, rice(Oryza sativa)
  misc_feature (71): n=t or c
gatgccactctccggtcgctctccatgataccccatgtatctgctcatccctattgccaggcctattaccngtgcgaccctctccctgtgcgctacggcga

SEQ ID NO: 27717 - DNA, 101 bp, rice(Oryza sativa)
  misc_feature (71): n=t or c
cataccctgagtgcctcgtcagatctaggcagtatcgaagggactccggtgagctcctctttgaggtggtngatgcgagatccccaaccactccacttata

SEQ ID NO: 27718 - DNA, 101 bp, rice(Oryza sativa)
  misc_feature (71): n=t or c
gaaccatttgaaccattcatcatgtacgaattaaatgtgaactcttgtcaacttcctaaaattcacatgcncagcaccgatgagaccatgcaaaccccacc

SEQ ID NO: 27719 - DNA, 101 bp, rice(Oryza sativa)
  misc_feature (71): n=t or g
acgggatggagaggaaagatttgattagcaagaacgtgacaatctacaaatcccaggcctctgcgctccancagcacgccgccccaaactgcaaggtgaat

SEQ ID NO: 27720 - DNA, 101 bp, rice(Oryza sativa)
  misc_feature (71): n=a or g
agattcggggatgttatccactcagcctaagggcattgataaatatggttcaggatcaagggctgagtgtnccccacagcaaagggtggaaaagggcataa

SEQ ID NO: 27721 - DNA, 101 bp, rice(Oryza sativa)
  misc_feature (71): n=a or g
ccgctgtccctttcttttctcctctgttggacgtccccttcttttctcctctgttgtccagatccagatcnaagcagctcggcggcctctcctctctcccc

SEQ ID NO: 27722 - DNA, 101 bp, rice(Oryza sativa)
  misc_feature (71): n=t or g
ccaggaaggcctggagctcggctgccttctttcccattttctgcttgatcgcggccattctttcatgctgntcaggtttaaaatatggaggggttctccat

SEQ ID NO: 27723 - DNA, 101 bp, rice(Oryza sativa)
  misc_feature (71): n=t or c
acatggaagaagcatggcatctgtgcctaggtttcatgctgacatctcgctgacgttggcatgatatctancagaagaaggggccaccgccgctgcaatga

SEQ ID NO: 27724 - DNA, 101 bp, rice(Oryza sativa)
  misc_feature (71): n=a or g
gaggacatcatcgatggattagagtccattttcagattttgctcgtgattgttatgggccttatggctacntcaatctgaagcagccgagtacactgtcca

SEQ ID NO: 27725 - DNA, 101 bp, rice(Oryza sativa)
  misc_feature (71): n=t or g
caaatgtttacccaagttaaagtatatgtccccttcctcttccttcctacttgcatattcaacaatttcancacggctcggaatgtacaacggatgtttct

SEQ ID NO: 27726 - DNA, 101 bp, rice(Oryza sativa)
  misc_feature (71): n=t or c
tcagcagtttccacatctcagctaaggactggaatggccaaacccaatggcaaagagaaaacgggtgacangggattgtcgtaagagttattcttttactc

SEQ ID NO: 27727 - DNA, 101 bp, rice(Oryza sativa)
  misc_feature (71): n=a or g
aaccaaatttataggcagccgaccgcgtgctagattcagagattagcaaaagatcaacgctaacaccacanaaactcgtgtataacgatggctataggaaa

SEQ ID NO: 27728 - DNA, 101 bp, rice(Oryza sativa)
  misc_feature (71): n=t or g
attcattgccttcttctgaatctcttcttcctccgaggagagcatttcttgctttggtttgtgttttcttnggtgtgtcaggcacaagtccgaccttccat

SEQ ID NO: 27729 - DNA, 101 bp, rice(Oryza sativa)
  misc_feature (71): n=t or g
tgcaggtccacaagaggttgaagaagatgatgtagatgatgcacatagtgaagtgatgggctgtatttggnattgggccccggcagtctcacgttgctcca

SEQ ID NO: 27730 - DNA, 101 bp, rice(Oryza sativa)
  misc_feature (71): n=a or c
caattcaccgtcaataatctcctgaaataaattgaagcaacattatgatttgattgcatcagattgtgtcnctagttaccttcttccccagctgatcagcc

SEQ ID NO: 27731 - DNA, 101 bp, rice(Oryza sativa)
  misc_feature (71): n=t or c
gagccctagacacaatgattcggatgttgtccatgctgtgtagtttactcatctttaccttcttcagcacngcaatacttgcagcagcacaatcaaacaag

SEQ ID NO: 27732 - DNA, 101 bp, rice(Oryza sativa)
  misc_feature (71): n=t or c
ctgagcccttcccctctcgcactagccatggtacgggggacatatactacattaattgctaaccaggatgnataattatatatatatatatatatgtatgc

SEQ ID NO: 27733 - DNA, 101 bp, rice(Oryza sativa)
  misc_feature (71): n=a or c
tcttcagaaataacatggcccaagtatgacaccttgctaaggccagactcacactagctgattctccattnaagcttgcatcaccaacctaatatgtccca

SEQ ID NO: 27734 - DNA, 101 bp, rice(Oryza sativa)
  misc_feature (71): n=t or g
cacagttgacaagccacaggacaggcttcagcatgctgatagcatagaaggaagtgtgatagatcgtgatngtgaggaagttgatgatgctgcgcaagatt

SEQ ID NO: 27735 - DNA, 101 bp, rice(Oryza sativa)
  misc_feature (71): n=t or g
ctgcaacaaaaccaattgtcttgcaagactccaacacaaggaagcggaagggaaagcttcccattggtcangtaaacatactatctacacccccatttgat

SEQ ID NO: 27736 - DNA, 101 bp, rice(Oryza sativa)
  misc_feature (71): n=t or c
ttgactgtctgctctgacagggatatcccagaaaagtttcactacttcgatgaatcctgggagctctaccnagaaattttcaaatctgaaaatgtctgtct

SEQ ID NO: 27737 - DNA, 101 bp, rice(Oryza sativa)
  misc_feature (71): n=a or c
gagagattttagttggcggtttacgaaattacgcgagcgcaaggcaagaggcgtagagcgttcagcgaatntggggacttttgggagtggtgtctctgacg

SEQ ID NO: 27738 - DNA, 101 bp, rice(Oryza sativa)
  misc_feature (71): n=t or c
taacttttggagctccacattttgagctcatcttttacaagctagcagcaaggtcataaaggaaagctagnaatcaactgactgagatctgctagaggcaa

SEQ ID NO: 27739 - DNA, 101 bp, rice(Oryza sativa)
  misc_feature (71): n=t or c
caatcctatgctcgccggcgataggattgaagtttcctgattcacaaatttccctagccttttaattcctntgccaatccgactcgaattcctccggcggc

SEQ ID NO: 27740 - DNA, 101 bp, rice(Oryza sativa)
  misc_feature (71): n=t or c
gatcgccgcttcggtcccaattaactcagcaagtgtccacacgtcgactggtagccaggttccacctcttngatctcaagattatcatcaaccaagcctca

SEQ ID NO: 27741 - DNA, 101 bp, rice(Oryza sativa)
  misc_feature (71): n=a or g
tgtgcttgtccacttgcatccctaaagaaatggatttcacattgtagtcaaagtgtttgcccctctctgcnccgaatcccgtgaactgcaatctaagtgat

SEQ ID NO: 27742 - DNA, 101 bp, rice(Oryza sativa)
  misc_feature (71): n=a or g
tagccgtctgagctgcaggaccctcccttggttggagatgtacctgctatcagcttcttcaatgattgtgnagactctaaggatcgagcatctgatgtaat

SEQ ID NO: 27743 - DNA, 101 bp, rice(Oryza sativa)
  misc_feature (71): n=t or c
gcggtggcggacctccgtcagcgccttgatctcgttctcgaagctcttcttgttcacatccggtatgtcanccgtgtcggcgacatggaagcgtttgacgg

SEQ ID NO: 27744 - DNA, 101 bp, rice(Oryza sativa)
  misc_feature (71): n=a or g
aatggggatgcaccgctgccatcgtccatgggcgcggatccccttgtgtatgccatcgaggtaggctactnccgctgccaccataggctagttggcgagga

SEQ ID NO: 27745 - DNA, 101 bp, rice(Oryza sativa)
  misc_feature (71): n=a or g
aattacctgggtagcaacatggatgagatagtcgtacacattaggcactactgttgacagggattcgaacncatttgaatagttcttatcattctttattt

SEQ ID NO: 27746 - DNA, 101 bp, rice(Oryza sativa)
  misc_feature (71): n=a or g
ttggtctgcgagaaatttggatgggattagttgcggatcttccatcagctagtggagcttaaagatactgntgtgttgtccgtactgaaatgcacttcttt

SEQ ID NO: 27747 - DNA, 101 bp, rice(Oryza sativa)
  misc_feature (71): n=t or g
taaagaccgtatcaagggcaaggggttggttattagctgggctccccagcaacgagtactatcacaccctncaatcgcttgcttcatgtcgcactgtgggt

SEQ ID NO: 27748 - DNA, 101 bp, rice(Oryza sativa)
  misc_feature (71): n=t or g
ttactggctctagcctccttgctctctcctgcacctgcactctgctatatccatgcaggtgaagcaggcancgtcgtccgtactccgaatggcacgccgcc

SEQ ID NO: 27749 - DNA, 101 bp, rice(Oryza sativa)
  misc_feature (71): n=t or c
catatgcttgcaaggtactgatgttttctccttgatgtctatcttactagagaattgggaccgccattggngtggcccttcacttagttgaagcaagaaag

SEQ ID NO: 27750 - DNA, 101 bp, rice(Oryza sativa)
  misc_feature (71): n=t or c
gcggtttatcaatggactatccacccgttggcttaatttactcctttcatggtcctggttttcaagggatnagtgggttatttggattgttcacacttgca

SEQ ID NO: 27751 - DNA, 101 bp, rice(Oryza sativa)
  misc_feature (71): n=a or g
aactggtctgcctatacctcaaggcctgcaaaaatcgtgattttcctaagcgggcaactagcccgcccgcnaagagatttttcagcgctaaaaaaaaagtg

SEQ ID NO: 27752 - DNA, 101 bp, rice(Oryza sativa)
  misc_feature (71): n=t or g
tgtgccttgccttatctcactagagaaatgagaagaaagaaatactcattctaacctgcatccatgtggcntccatggcacgttctggggaagactctgga

SEQ ID NO: 27753 - DNA, 101 bp, rice(Oryza sativa)
  misc_feature (71): n=a or c
aaaaaccaaaccaaaccaaacagaaggcgatgagaaatttttcgtcaggagtgatgagatcgaaaaatccnaatggggaaaacactggaacacaacgactg

SEQ ID NO: 27754 - DNA, 101 bp, rice(Oryza sativa)
  misc_feature (71): n=t or c
atccatggccatgcggagcttgctactaacttctttcttccgtgaagaacgtgctgaggctattcggctgnaaactgcagcggcaacctgtgggcgaggag

SEQ ID NO: 27755 - DNA, 101 bp, rice(Oryza sativa)
  misc_feature (71): n=a or g
tatatgtgtgtgcaatgcgtgcatcgatgcagcgcgtctctacgaaattgtcaggtgcctacctgacatgnctgttccagctgaagaggaggagaaggaag

SEQ ID NO: 27756 - DNA, 101 bp, rice(Oryza sativa)
  misc_feature (71): n=t or c
tttgtcccaaatttctcgcgtgaatggacaattcttgaataaatgttgcgccgtttccaagttcctgtagnagagttggcaaaagtagttattgggccatt

SEQ ID NO: 27757 - DNA, 101 bp, rice(Oryza sativa)
  misc_feature (71): n=t or c
gtatgaaagcagcacaggacagcttattaatccttctaagtgctccatgcttttcagtgacttttgcccanagcaacatcaggaggacataaaacgaatcc

SEQ ID NO: 27758 - DNA, 101 bp, rice(Oryza sativa)
  misc_feature (71): n=a or g
atggtttgcctatggcgaaaccctgaggacgcagctgaaagggttcgccatcatgtccaaaggacccactngcaagtcttcacttcaggcgaagcaggaag

SEQ ID NO: 27759 - DNA, 101 bp, rice(Oryza sativa)
  misc_feature (71): n=t or g
ttaccacaaaaacttattacacggcaccttattacacatgaccatggatgtactagcatataaccacgtcncctaaacaccgtgaattactagcccacaca

SEQ ID NO: 27760 - DNA, 101 bp, rice(Oryza sativa)
  misc_feature (71): n=a or g
gccgcatggtggcggtggctcatctcgctggctttcttggtcgatcggttgattactcagttggcatgcancaacttaactcaagcatacgctaagctata

SEQ ID NO: 27761 - DNA, 101 bp, rice(Oryza sativa)
  misc_feature (71): n=a or c
gaaaaggcgaaaatgccctccgtgacaacatccatttgctattgctactgtcatttctctgcataagcatntgacgcacgcatgaacatggcaagaaccca

SEQ ID NO: 27762 - DNA, 101 bp, rice(Oryza sativa)
  misc_feature (71): n=a or c
ggagagcagctcacacccggctatcgagtcgatcacttggtcgatgcgtgggagcccgaaggggtccttcnggcatgccctgttgagatcggtgtaatcaa

SEQ ID NO: 27763 - DNA, 101 bp, rice(Oryza sativa)
  misc_feature (71): n=a or g
agccggtgatcaaggcagggtacttctccaggaaccccgctggcttcgcttccctagcaaaaccaaatcanaaaaacaaaaatcatcaaataataaattaa

SEQ ID NO: 27764 - DNA, 101 bp, rice(Oryza sativa)
  misc_feature (71): n=a or g
tctaataaaatggatagaaatgatcagttgtgtcataaagtaaatgagaggaccgttcatagcatgtgtgntcttgtccttattatgagccaacaaaataa

SEQ ID NO: 27765 - DNA, 101 bp, rice(Oryza sativa)
  misc_feature (71): n=t or g
aaagcgcctccccgctgccgttacttcatgtggctcgtggctcatcgtcgttgctggactgcagatcgacngaggccccgaggattgccccacccggcgag

SEQ ID NO: 27766 - DNA, 101 bp, rice(Oryza sativa)
  misc_feature (71): n=t or c
tgaagctggtcgatcgtgatcccgtcgtcgcaatggcggtcggatttctgcttctgcagctgcttgttggncccacctcctgctcctcctcgcttcgacgg

SEQ ID NO: 27767 - DNA, 101 bp, rice(Oryza sativa)
  misc_feature (71): n=a or g
gatgtcttatggacgagacaccaagatctcagattctggataggcatccttgtcggctctgggtttctgcncgaaggacataactcagccgcttgaggatt

SEQ ID NO: 27768 - DNA, 101 bp, rice(Oryza sativa)
  misc_feature (71): n=a or c
tgcacaaataagcaccgaggataaaccatagtaacctcgttaacattatgagcagctttcgctgatgcctnaataaagagcagggcattctgcttggcaaa

SEQ ID NO: 27769 - DNA, 101 bp, rice(Oryza sativa)
  misc_feature (71): n=t or g
cggccgggtcccacctcctcaagatcgacgggtactcgctcaccaaggggacccccaatggctcgttcctnatctccagccagttcaccgtcggcggccac

SEQ ID NO: 27770 - DNA, 101 bp, rice(Oryza sativa)
  misc_feature (71): n=t or c
aattgcagagaatcgagcatctgattataaactgtccatacgcaatgatctgctcggtcattaccatgaantgttgcttgatttcgatgaaaactggcgat

SEQ ID NO: 27771 - DNA, 101 bp, rice(Oryza sativa)
  misc_feature (71): n=t or c
gagcttccccatgtaggacttgcagtcttcctgggggtcgagggagcagttaaagaactttgtatagtctnttgggtcgatgtcatacactaggccagggt

SEQ ID NO: 27772 - DNA, 101 bp, rice(Oryza sativa)
  misc_feature (71): n=t or c
agcagatgctcacaatgagcgcacaccaattcctatgaatacatgcataaaccctattcttatgggcaccncgaaagattgagtcaggatatgatgaagtg

SEQ ID NO: 27773 - DNA, 101 bp, rice(Oryza sativa)
  misc_feature (71): n=a or g
ggagattttgtgtgggtctattggacaatatggtcctagatacatatcagcctcttatcatgaccttcagntgccattgcttgaaaaggcaaagaagaaga

SEQ ID NO: 27774 - DNA, 101 bp, rice(Oryza sativa)
  misc_feature (71): n=a or c
caaagatctcaagtccagatatagatatgatgcttgtcagcggtagcaagaggtcctaacccacaccatgnacttgaaactaccgacgaagaatggccctg

SEQ ID NO: 27775 - DNA, 101 bp, rice(Oryza sativa)
  misc_feature (71): n=a or g
ttgtcttttttttagacggaggatatagacttgtagattgtagactagtctggtttaatgttggtcgatcncattacatttcaatccaaataacacaataa

SEQ ID NO: 27776 - DNA, 101 bp, rice(Oryza sativa)
  misc_feature (71): n=a or g
aaggagctaagcgatgaagaggactctgagaagggtgaaagtagtggtcaaaagaatggtgatgataaaanggattccaaaaagcatggtagcaatggtga

SEQ ID NO: 27777 - DNA, 101 bp, rice(Oryza sativa)
  misc_feature (71): n=t or g
atggttattgacaagacttgtcacgttgaaagcagcactgacgtaatctttaaaaacaacacaaactctcncaacctcctcaacacattccatagaacaaa

SEQ ID NO: 27778 - DNA, 101 bp, rice(Oryza sativa)
  misc_feature (71): n=a or g
cagataagcaatcagtcagtaacggaaccatcaatctatcatgcaaatatcatccacacgctggaggaacntttgctacgccttgcctctgcagctcgccc

SEQ ID NO: 27779 - DNA, 101 bp, rice(Oryza sativa)
  misc_feature (71): n=t or c
cgatgggtagctcagcagctcggcaggtgatggggtagctcggctcgttggatgaaacgagcaaagcaganaagtccagcgcgtgctacacgtgcgcacaa

SEQ ID NO: 27780 - DNA, 101 bp, rice(Oryza sativa)
  misc_feature (71): n=a or g
tggccatgtttggggattgtttgtggagtttttaacggctgatgcttcttttagaatctccagctcttctngttcctaaatagtcgaggttcttgctcaga

SEQ ID NO: 27781 - DNA, 101 bp, rice(Oryza sativa)
  misc_feature (71): n=t or c
tagatatatgcacataaataatggtggtagttattagttgagagaatctactgatcagtaccactgagttnggcacagttcaataatatgccactgacttc

SEQ ID NO: 27782 - DNA, 101 bp, rice(Oryza sativa)
  misc_feature (71): n=t or g
agggggatgttgatggggcggcggtcattgctgctaacctcaaaaaagttcgatccaatgttaaagcctgngcaaaattaaacaaggacggatgtggagtg

SEQ ID NO: 27783 - DNA, 101 bp, rice(Oryza sativa)
  misc_feature (71): n=a or c
agctcactgctacaactcagttaagataaggacaacatattataggcatgggtccaagggaacatgtcttngtggaaggaccaccacatgtcgaagatatt

SEQ ID NO: 27784 - DNA, 101 bp, rice(Oryza sativa)
  misc_feature (71): n=t or c
tgcctcattcacctctattgcttcctccttatgcaattccacatttatctccaccccttctgattcaagcntgcttgacttattagcctcaactgcttcct

SEQ ID NO: 27785 - DNA, 101 bp, rice(Oryza sativa)
  misc_feature (71): n=t or c
tgtaccgtggctctgctcagaagattattcataggagcaacatgttgagttgacggatttacggagatcancgactgggggagagatgtcatattagttcg

SEQ ID NO: 27786 - DNA, 101 bp, rice(Oryza sativa)
  misc_feature (71): n=a or c
tatcaacttatcatgtgatgatgatcgtcatcgtatatcgtatatactgggccacgagaaatattgcatantgggcccttacagatcgcattacgggggca

SEQ ID NO: 27787 - DNA, 101 bp, rice(Oryza sativa)
  misc_feature (71): n=a or g
ctctccaccgtatccgacggctccatcctcagagccgtcgtcttccctgtcagccctttcacaaatatctncgtcatcaccgtcgacatcgccggccgccg

SEQ ID NO: 27788 - DNA, 101 bp, rice(Oryza sativa)
  misc_feature (71): n=a or c
ttattagtgttttaccaaaccaccgcaaagagcatatgtgtactgtgtagtcatcatgctatctgttgttncagtattgtggggtattaagactgtgttct

SEQ ID NO: 27789 - DNA, 101 bp, rice(Oryza sativa)
  misc_feature (71): n=t or g
atccacacttcaggctatttaacaggaggtcctggtctaaaccaaggaaagtctcacgaagcatttccatngtgtctaggaagatgaacaaacaaggagat

SEQ ID NO: 27790 - DNA, 101 bp, rice(Oryza sativa)
  misc_feature (71): n=t or c
agccaccgtgatgccccgaagtcggtcaccttcaccgtgtagctatcatcgagcataatgttcagagactncacgtcgccatggatgataggccggttcgt

SEQ ID NO: 27791 - DNA, 101 bp, rice(Oryza sativa)
  misc_feature (71): n=a or g
aagttcattagtcttccagagaacttgtcgatcccaacagcaactttactgctcaaatctttccattgctncaagaaaaaattgatttggaaagccagcat

SEQ ID NO: 27792 - DNA, 101 bp, rice(Oryza sativa)
  misc_feature (71): n=a or g
gctcctgtggtagtggtcacagtttgaaacggtgaactaaactgaacaggtgaactcttcgatggctgcgncattgtgccctctgactgtggcagtttgct

SEQ ID NO: 27793 - DNA, 101 bp, rice(Oryza sativa)
  misc_feature (71): n=t or c
tccttttattgggctttctctgtaatttaagaatgtaaggtttcttccttggtacctgcagattaaaagantagaagaacttggaatcggagggccatcca

SEQ ID NO: 27794 - DNA, 101 bp, rice(Oryza sativa)
  misc_feature (71): n=t or c
acaatattatcgattataggagtgtattggaataacatcaacattgagaagggcttctcctcggcaccgangaccagcttgctgccggtgcaagaggttgc

SEQ ID NO: 27795 - DNA, 101 bp, rice(Oryza sativa)
  misc_feature (71): n=a or g
atctgtaccaccaccaaccatccatgccctgtagaccacctcttccctttcatgcgctcgcctttcaatcntttcccttcaccacgccaaaaatatcctcc

SEQ ID NO: 27796 - DNA, 101 bp, rice(Oryza sativa)
  misc_feature (71): n=a or c
cagtacgtggccatcgtgccttgcaccaaggtatatattgttgggtatttggttttctctccacgcttgtntatattggagttatatcacaagctagtgtg

SEQ ID NO: 27797 - DNA, 101 bp, rice(Oryza sativa)
  misc_feature (71): n=a or g
gagttcaaatttgaagctcttatgagtaatctttaagactccagtatctatgcgcaaaggattatgatctnaaatgcttctagttaaagtttttgccattg

SEQ ID NO: 27798 - DNA, 101 bp, rice(Oryza sativa)
  misc_feature (71): n=a or c
caactgttccattgctgagaacacaaatgcagctcatccaacagagaagagataaaaccgtcaactgaaantgaatccaccacatcaaataggcaatgtgc

SEQ ID NO: 27799 - DNA, 101 bp, rice(Oryza sativa)
  misc_feature (71): n=t or g
tggatcattaccacaaagctttggagacaaagaattgcaatacctgtcgctctctcataattctctcagtngagtaatcccggcatatctatgtgacataa

SEQ ID NO: 27800 - DNA, 101 bp, rice(Oryza sativa)
  misc_feature (71): n=a or g
accaatgtcagagaagaaataatatgtccccaaaactacttctcagtgttgcactagtcatgctgcatctngcgtctatatctgcgcagcctaacccttgg

SEQ ID NO: 27801 - DNA, 101 bp, rice(Oryza sativa)
  misc_feature (71): n=t or c
gcggtttgtaaccctttttgaaccaaggatcttccagtatttgagaaatggtgatcctctgcacaaaattnaacaatggcagaaatcaggtaaattggggt

SEQ ID NO: 27802 - DNA, 101 bp, rice(Oryza sativa)
  misc_feature (71): n=a or g
agctatataggtaaaaagaaaaccacagaaaaaatcaaggaagtgcacggtgcacctacttcaaaatcacnttgcagttatccacaaacaccgcagcttct

SEQ ID NO: 27803 - DNA, 101 bp, rice(Oryza sativa)
  misc_feature (71): n=a or g
atacaatacaataactagctaaattaaatagcttctaacatggttgtttatctttgcattccagcatgacnccatcccaccatgctgcaacacaatcaaca

SEQ ID NO: 27804 - DNA, 101 bp, rice(Oryza sativa)
  misc_feature (71): n=a or g
agtgcaggtaccgatacgaccactgatgttagaacaagagccaagtgaagtagtgaactcacgatcacaancgaagtgtcccctcaatgtgcaaggctcac

SEQ ID NO: 27805 - DNA, 101 bp, rice(Oryza sativa)
  misc_feature (71): n=a or g
cgagctgaactctgtaggattgacaggattactgtacacttctagaaaccggtaataaaagcaaagctccnacgtcaagtcttgattaattactacacttt

SEQ ID NO: 27806 - DNA, 101 bp, rice(Oryza sativa)
  misc_feature (71): n=a or c
gttcatgcagctgtggattaacatgtacacaaggccatcattagctttgtcagctttcccaacaacttatnctgatgatgaagatgtcagcacaagaaggt

SEQ ID NO: 27807 - DNA, 101 bp, rice(Oryza sativa)
  misc_feature (71): n=a or g
aaaggaaaccacatttaaccaaacgagcactgaaaggtccgagaacaaacttgcctcgatctggttcttgncgttcacgttcaggagaaccctttgcccct

SEQ ID NO: 27808 - DNA, 101 bp, rice(Oryza sativa)
  misc_feature (71): n=a or c
tcctcctctcctagtctcctcccctccccgttccccaacaagcaaccctaatccatccatggcggttaatncttcgcgcgcatagatactaatcccatccg

SEQ ID NO: 27809 - DNA, 101 bp, rice(Oryza sativa)
  misc_feature (71): n=t or g
ccggcttcccaccttcttgattcccaagccttcgtcggcgaccggttgttgaagagcgctctccagcaacnacgattctccggcgcggcggggtgtgcgaa

SEQ ID NO: 27810 - DNA, 101 bp, rice(Oryza sativa)
  misc_feature (71): n=a or g
ggagctctcatggtaaccttgacagctggtatcgtcgccactgcagaggtgaagattgaagggaacaactnttggcagccccttcagacttccagtgctga

SEQ ID NO: 27811 - DNA, 101 bp, rice(Oryza sativa)
  misc_feature (71): n=t or c
ggtaaccaaccaaccaaccaatcaaacaactgttcatcacctctttggatgccaatgccatctcctcctcngataaactccaaagcaacccagcaaacatc

SEQ ID NO: 27812 - DNA, 101 bp, rice(Oryza sativa)
  misc_feature (71): n=t or c
acatatatgtttgtaaaagtcatgacctagctctttatataatttccctctttgttgcagatgggagcctncttcatcttctcatttgtgtacctgtacca

SEQ ID NO: 27813 - DNA, 101 bp, rice(Oryza sativa)
  misc_feature (71): n=t or c
atggtactggtaaactgtacaagtgtgtgcatcaattctcttttgggtgtgcatcttgcatctagtgatanttacatctgatctcttttaggacatatgtt

SEQ ID NO: 27814 - DNA, 101 bp, rice(Oryza sativa)
  misc_feature (71): n=a or c
cgaggcggccggctgggcgcccgatccagggggtatatatggggaagcgtgccgagaactactgcacacanacacgtacggtgcgcgcgcgcgagggaggc

SEQ ID NO: 27815 - DNA, 101 bp, rice(Oryza sativa)
  misc_feature (71): n=t or c
aagaaataattaagtggcgcaccgaagaccggcgagtagatggcgaaaaggcgggcaaaggagatgtaggngaggagagcgaggcagcagccggcgaccag

SEQ ID NO: 27816 - DNA, 101 bp, rice(Oryza sativa)
  misc_feature (71): n=t or c
atatagctgcaaaacgcttcttgtttgattcgtggttcccttccctaaaaaacctccggagattgagcatngtaaacgggttcaagacgacaaccattcca

SEQ ID NO: 27817 - DNA, 101 bp, rice(Oryza sativa)
  misc_feature (71): n=a or g
tggtgggtggaggatgtggaggatggaggggagggcttacgttgagacgtgctatttagctatatgacacntagggtgccatatagtagttatatatatac

SEQ ID NO: 27818 - DNA, 101 bp, rice(Oryza sativa)
  misc_feature (71): n=a or g
ttcatgtggagtgcgtgtagaaatgggcagcacacacaagagaaaaaactgcacaccaacacacaaacatncattgccatctctttcaccctcacctaatg

SEQ ID NO: 27819 - DNA, 101 bp, rice(Oryza sativa)
  misc_feature (71): n=t or c
acgatatcacttcattcgtgagtgtgttgatggagggaaagtggttattgagtttgtccggactgaggaanagcaggcagacgctctgacaaaaggtttgc

SEQ ID NO: 27820 - DNA, 101 bp, rice(Oryza sativa)
  misc_feature (71): n=a or g
caattcattaacggcacactcaccttgattaattacggcaccatttagattacctgtgattcgctcttctnatgacggaggtgcatcgaatttgagtgtga

SEQ ID NO: 27821 - DNA, 101 bp, rice(Oryza sativa)
  misc_feature (71): n=t or c
ttaggatctcctctgccagcgtcttggttttctggtaggaagaatgtgaagaagacatcgccaaaggttcngtccaaactgagaaggagccctattcctga

SEQ ID NO: 27822 - DNA, 101 bp, rice(Oryza sativa)
  misc_feature (71): n=t or c
ctaagatatgtcttgtgctttgtccagagtatgctctgatatcgctctgatatctaggccgagtttagttncaaattttttcttcaaactttcaacttttt

SEQ ID NO: 27823 - DNA, 101 bp, rice(Oryza sativa)
  misc_feature (71): n=t or c
gtctaacctgcatcaagaacagcaatggcgaaggtgttcgccaatcacacaccgaaaatcctgcatttttnagcatcaagctggtcagttggtctaacaac

SEQ ID NO: 27824 - DNA, 101 bp, rice(Oryza sativa)
  misc_feature (71): n=t or c
caaaggtgccagtgagttgctgcctgtaaggagacatgttatgtggcaattgttattggagcagtgcaagngaaacccttggtcgcctcctaactcagttt

SEQ ID NO: 27825 - DNA, 101 bp, rice(Oryza sativa)
  misc_feature (71): n=a or g
acccatcccactttgtccccaaaccaaacacacgcttcagtgatgaggaaggatgccgatcatcagtgatnaggagtccaggatggtgaaggactccatcc

SEQ ID NO: 27826 - DNA, 101 bp, rice(Oryza sativa)
  misc_feature (71): n=t or c
gttcatgaaattcatattattgcagatcatttcggtacatgataactattgctcctcgaagactgggtcgncgttgaaggctttcaattttggcaagttct

SEQ ID NO: 27827 - DNA, 101 bp, rice(Oryza sativa)
  misc_feature (71): n=a or g
gagggctgataaaacatcaccaggcggttcctcacaggggggttgtgcagtctacaagcaaattgtacatnagaggaattgaaagaggtatgagttatgtg

SEQ ID NO: 27828 - DNA, 101 bp, rice(Oryza sativa)
  misc_feature (71): n=a or g
gttgtctcgttgatgttatcctcaagctttgtcaccaaattttctaagcgcgcttctctctacggctttancttgcaagtttttacatttgcatggctgat

SEQ ID NO: 27829 - DNA, 101 bp, rice(Oryza sativa)
  misc_feature (71): n=a or g
ccatggagcacaagtggcctccaacctggtggattatccttggttttgttagctgaagtcttcttcttccntcgcagatagaaacatacgaaaataacacc

SEQ ID NO: 27830 - DNA, 101 bp, rice(Oryza sativa)
  misc_feature (71): n=t or c
tccgccaaatacacaactactactaccccctctctctctctccgttctccttttctcctccacggcagttntatataaaattcgcggctttcaaaagcaaa

SEQ ID NO: 27831 - DNA, 101 bp, rice(Oryza sativa)
  misc_feature (71): n=t or g
agaatccagtccaaggcttgcatggagtgggaagacatctgcctctataccatgtcttatggaggtgggtnggcttactctgttggcaaggcggtgacaga

SEQ ID NO: 27832 - DNA, 101 bp, rice(Oryza sativa)
  misc_feature (71): n=a or g
tagaattttgttaaccatttattatcctgccttttaatttggaaaacttctgctgcaggttattgtaaaanaaatttaaaaggggattgtaaggcccttca

SEQ ID NO: 27833 - DNA, 101 bp, rice(Oryza sativa)
  misc_feature (71): n=a or g
ttatggtttactttcttgttagcctgaagaattgataagtcgttttctaaacgaagctgtggaaaatactncaaaaagtttagaaacatgtgggatcattg

SEQ ID NO: 27834 - DNA, 101 bp, rice(Oryza sativa)
  misc_feature (71): n=t or c
gtcctggcctcttaatttcttcccaaggaggagtcgatcgagcagaagagaagccaaaagctccaatcttngagagacgtgtgaagaacattcgatcgcca

SEQ ID NO: 27835 - DNA, 101 bp, rice(Oryza sativa)
  misc_feature (71): n=a or g
cagagcagtgcccatcacctgttcaatgaaatgtctagccgatatggggtgtccgagggagatgttcttcncgtcatgaacgaggagatgttaaccaggga

SEQ ID NO: 27836 - DNA, 101 bp, rice(Oryza sativa)
  misc_feature (71): n=a or c
tgctcaccttgttctccttcttggaggaggaagacgaagaagaagagccgaacaaatgcgcaagcttcatnatggcgatgtctttagaaatcgagagctga

SEQ ID NO: 27837 - DNA, 101 bp, rice(Oryza sativa)
  misc_feature (71): n=a or g
atcaagtgtagaactgatagcacctcataccaagcactgggcattgacgtatcctacacaacacaaataantagacgattaatcacagtcgtatcactctt

SEQ ID NO: 27838 - DNA, 101 bp, rice(Oryza sativa)
  misc_feature (71): n=a or g
ttttgacatggacgtgggctcaacggagtcaatcgatgtcaacatttcctccaccatccctatgctatctngcatctctcattacaactattcttggaatc

SEQ ID NO: 27839 - DNA, 101 bp, rice(Oryza sativa)
  misc_feature (71): n=a or g
ccaagcttacacccgatggattgccggcgactacggtgccatgaacattagcttagcacttctccacaacnccatagaggccacgatgcacatccaaataa

SEQ ID NO: 27840 - DNA, 101 bp, rice(Oryza sativa)
  misc_feature (71): n=a or c
acaatttgatcattctatccctttactgtctggagtttccccagttaacattcgcccttatagatactcanctgcccagaaggatgagattgagaggcagg

SEQ ID NO: 27841 - DNA, 101 bp, rice(Oryza sativa)
  misc_feature (71): n=t or c
cgatcattgctagctgttgaattgaacctgacccatttgtgcaatccgtggaacatcctaatccacatttntgctatcttctcgctgcgatcgccacaaat

SEQ ID NO: 27842 - DNA, 101 bp, rice(Oryza sativa)
  misc_feature (71): n=a or g
gcaataaagtatttgcaaaaaaactcacaagaagttgtggactaggagcaagtacaggactgcatcaaagntggattatgtgactaacaatctggctgagt

SEQ ID NO: 27843 - DNA, 101 bp, rice(Oryza sativa)
  misc_feature (71): n=t or g
aaactgaaggaagagataagatgaacatacatggtggaatcctgctggattactgcagttgattcggaggncactgtttcagcatcagccgtaggcatttg

SEQ ID NO: 27844 - DNA, 101 bp, rice(Oryza sativa)
  misc_feature (71): n=a or g
ctcggcgatgaattctctcatcccctgcttagaatcatgacaaattttcttaatcgcgacatcaatacccnaccccggcataactcccttgtacaccttcc

SEQ ID NO: 27845 - DNA, 101 bp, rice(Oryza sativa)
  misc_feature (71): n=t or c
gacttaatcatggagaagatgaccactagaagagaagtggccaagaacctgggtgatgaaattcttatgtnagtgatgaagcagttgaatgatttgacttc

SEQ ID NO: 27846 - DNA, 101 bp, rice(Oryza sativa)
  misc_feature (71): n=t or c
atggagctcctaattattttcttacaaaagaaatacacaccacaaccacctctaatgcctccttggaaccnaggaatttggttctatatgaatattgaacc

SEQ ID NO: 27847 - DNA, 101 bp, rice(Oryza sativa)
  misc_feature (71): n=a or g
ttgtgccacgagatcaatccttcgggcttttgttacaagccgatctatgttggactggatcggaccttcanacaattgatcaagcttggacttctcttcat

SEQ ID NO: 27848 - DNA, 101 bp, rice(Oryza sativa)
  misc_feature (71): n=t or g
agcttttacaagtccaatttgtaaatcggttcatggaccgttttccaagtacatcaatccattttgctctntaggggccgcgtcttcttttgatcttagag

SEQ ID NO: 27849 - DNA, 101 bp, rice(Oryza sativa)
  misc_feature (71): n=t or g
acggtttcacagggcttttctatcaagcttgctgggatacaatcaagtgtgatgtcttagcagccctccanaaattcttctccggcaattcgcaaaacctt

SEQ ID NO: 27850 - DNA, 101 bp, rice(Oryza sativa)
  misc_feature (71): n=a or g
agatagataaaagactaaaaagaaattacttcgattgcattccatagtcgaacagttccatcagaagatgntgtagctaactgagttgaattcggtttgaa

SEQ ID NO: 27851 - DNA, 101 bp, rice(Oryza sativa)
  misc_feature (71): n=a or g
cattgcaaaccgcgagaggagctccaccgcactgttgcctccatttatccaccatgcctcgatggatctgnaggctcgaggggcaccaccgccatcgctat

SEQ ID NO: 27852 - DNA, 101 bp, rice(Oryza sativa)
  misc_feature (71): n=a or g
gaagggcagagccacactacactcccaagaagccctcaaaaatagcaatgccagcggaagatcacagatgnccttccgagagaatggactccagaaccact

SEQ ID NO: 27853 - DNA, 101 bp, rice(Oryza sativa)
  misc_feature (71): n=a or g
tccacgctaggcttaatttgccccttgtcccaaggctatcaacagtggctcagcaacaactgcattagctncaagacctacttcaagacttcccattctca

SEQ ID NO: 27854 - DNA, 101 bp, rice(Oryza sativa)
  misc_feature (71): n=t or g
tctgctattgtacccgctctaaggtaggatgttcagattgacgtgtgtagtagaagaataaggccttgttnagattccaaaaaatttttaaccaaaaatgt

SEQ ID NO: 27855 - DNA, 101 bp, rice(Oryza sativa)
  misc_feature (71): n=a or g
ctcgctggtggaccctgatattaacgatgacttgtccggctgtgcgaagctttctgcactcaccaacatcntcgtatcctgctgctgattgaatatgatgg

SEQ ID NO: 27856 - DNA, 101 bp, rice(Oryza sativa)
  misc_feature (71): n=a or g
ccatcttgttggaaaaaaatatccacagcttccccacacgcctcacccacctctggagatccgatcatccntgcatggctgcttctcccctgcgcctcctc

SEQ ID NO: 27857 - DNA, 101 bp, rice(Oryza sativa)
  misc_feature (71): n=a or g
gggggagagagagagagaggggaggggagaaaaaagagtgccaagagagaggggtatttttttgatgaggntggacctgttaagacacccggatgcgaaaa

SEQ ID NO: 27858 - DNA, 101 bp, rice(Oryza sativa)
  misc_feature (71): n=t or c
gctctcccgtaataacgggggcagataaaacgcgtcgcggcgaggtcgccttctctccccaatctccaatnaatctgctccccctcccgccgccgccaccg

SEQ ID NO: 27859 - DNA, 101 bp, rice(Oryza sativa)
  misc_feature (71): n=t or c
caagccaaagctgccccttgttagattgatgtccagcagaagtgatcattcaagcacctccttcactcgtngccatgtgttcaagcctgcagatgatgaga

SEQ ID NO: 27860 - DNA, 101 bp, rice(Oryza sativa)
  misc_feature (71): n=a or g
tcccggcggccggagcggcgcgacttcccatctaacatattgcttccggcagccgccgccggacaccatgnctgactctccgagcccacgcctggacgagg

SEQ ID NO: 27861 - DNA, 101 bp, rice(Oryza sativa)
  misc_feature (71): n=t or c
tttcattgttaccattcgtaataacaagcaaactggcacaaatttttttatcgctggaagttattcaccantacttttaagaaatactaccgaataacaat

SEQ ID NO: 27862 - DNA, 101 bp, rice(Oryza sativa)
  misc_feature (71): n=a or c
gagatcgacgggagtcgctcattcttcgatgatttggtagaggaatttgagtggctggagaagctgcaggntctgagcattagaaactgcaaggaattgag

SEQ ID NO: 27863 - DNA, 101 bp, rice(Oryza sativa)
  misc_feature (71): n=a or g
gtaggttggtttgtttcacatacgcaatggagctcgaaacaccataaatttgacgacagttgtctcagaanatggagaagttgttaagaggggtataaata

SEQ ID NO: 27864 - DNA, 101 bp, rice(Oryza sativa)
  misc_feature (71): n=a or c
caaaacctagtagctcatatgctcatctctgcctctagatttggacccaaataccgcgacttgttgatacntaatcccctataaaagccccacctggggtg

SEQ ID NO: 27865 - DNA, 101 bp, rice(Oryza sativa)
  misc_feature (71): n=t or g
aggacaaaaacatggaatattgttagctattctatagcaaagaaaaaaagtcagcagagtttatgcgtgtnaattataatagatcaaagagagaaaactgg

SEQ ID NO: 27866 - DNA, 101 bp, rice(Oryza sativa)
  misc_feature (71): n=t or c
tgcattgaaaggggccaggagaaaggttggctgaaggaagtagttgatgccacagatcagcaaactgatgnaaatggatcacgcctatttgcagaaaattc

SEQ ID NO: 27867 - DNA, 101 bp, rice(Oryza sativa)
  misc_feature (71): n=t or c
cgacgccgagagataccaagccgctgtccgacctagacaacgactggtttctgcgctacatccagccatgnctcgagttcttccgtgcggtcgatgatgac

SEQ ID NO: 27868 - DNA, 101 bp, rice(Oryza sativa)
  misc_feature (71): n=t or c
aacccaccaccgggggcccccctaatccaaactgtttctcggcttccgctacacgcctcgccgaccaccangacgatggctgcggcgccggcgaggtcggc

SEQ ID NO: 27869 - DNA, 101 bp, rice(Oryza sativa)
  misc_feature (71): n=a or g
cacctcttcagcatggaagaggaagacatacttctcaagtcctagtgaattcagcaacccagtaactgttngcggtacttctggctgcaaaattgcataca

SEQ ID NO: 27870 - DNA, 101 bp, rice(Oryza sativa)
  misc_feature (71): n=a or g
tcatccagttttcctagattgttgtagaccattgcctttaggtagtatgcttctgccgccatttcgtggtnctacacatagtagaaaattcactcgatcag

SEQ ID NO: 27871 - DNA, 101 bp, rice(Oryza sativa)
  misc_feature (71): n=t or c
atagcataccacatatgaaactaagagagccttaagagttattaagatcggtggtatagttaatacgtacnaaatgtaataattaacatattttgtcaatc

SEQ ID NO: 27872 - DNA, 101 bp, rice(Oryza sativa)
  misc_feature (71): n=t or g
gcccatgtctcaaagagatagagttaaactctggcctgacaacactcgagtacattggtccattgataccnttagcacctcctggaatttatgtgcttaca

SEQ ID NO: 27873 - DNA, 101 bp, rice(Oryza sativa)
  misc_feature (71): n=t or c
gaagtcacgtgcatggatccagccttattccctcgctttactaacaaattctcaacccgatgggaccacantttctctgaatctgcaagttcaagagcaga

SEQ ID NO: 27874 - DNA, 101 bp, rice(Oryza sativa)
  misc_feature (71): n=t or c
ttttaggatggagtgaataagttctgaacgaattaggtatattattgtggccttctactcttaacattggnttttcttagttgaactataaaattatcgcc

SEQ ID NO: 27875 - DNA, 101 bp, rice(Oryza sativa)
  misc_feature (71): n=a or g
tgtccactcgaattcacccaatcgaggctcgtttgatttctgaaacaccataaaccctcacctaggaacgncggcaactagctcgttcttgcggcaggagt

SEQ ID NO: 27876 - DNA, 101 bp, rice(Oryza sativa)
  misc_feature (71): n=t or c
gcactgtgaagaagctgtgaagaaaggttttgctaagggccaagggatagaagtccatttcatccaatggngaagcctgaagaacgccgctggttctgccc

SEQ ID NO: 27877 - DNA, 101 bp, rice(Oryza sativa)
  misc_feature (71): n=t or c
ttataaattatttttcatttgtaaatatgtgatagggcttaagtctcgcagaatatcaggtcgcagtttgnatgtttcattcagagttgcttgacatcacc

SEQ ID NO: 27878 - DNA, 101 bp, rice(Oryza sativa)
  misc_feature (71): n=a or g
ttttgacttagtacagggacgtatagctacgaactggaggccccagtgcgaaatgcatgatagaaccctanaattttacgaattttacatgtaaattctca

SEQ ID NO: 27879 - DNA, 101 bp, rice(Oryza sativa)
  misc_feature (71): n=a or g
catgttccggtggatcagttccatgagatttatttcggccacatcttctggtctattgtgttcgattctcnccgcaaaaccttctgcaacccagtaccgca

SEQ ID NO: 27880 - DNA, 101 bp, rice(Oryza sativa)
  misc_feature (71): n=a or g
atgcaaggatgatgttgtggaaaaatgggtggctgaaggttttattgatcaaatagagggccgagacttgnagaaagttgcagggagctatttcgatgaac

SEQ ID NO: 27881 - DNA, 101 bp, rice(Oryza sativa)
  misc_feature (71): n=t or g
agacccggatgcccttgccgacccggacagcagcttctacgagatcaatggcataagggtccaccacaagntttgcacccatgaggattccagtgaccaat

SEQ ID NO: 27882 - DNA, 101 bp, rice(Oryza sativa)
  misc_feature (71): n=t or c
ctgactcttaattttaaatcaaattggtggaccaatcctttcaacaactaaatatttatctccttcccacnctcccccatgcagcgtgcgcccttccgcta

SEQ ID NO: 27883 - DNA, 101 bp, rice(Oryza sativa)
  misc_feature (71): n=t or c
gccgccgccgtctcgtcaagcttcagttcctcatccccaagccccgttgccaccgtcgaactctacgtccncgagcagctctagctccaccggcgagctcg

SEQ ID NO: 27884 - DNA, 101 bp, rice(Oryza sativa)
  misc_feature (71): n=a or c
ctaaatgctgatgtgcactacagctactatggcaattaggtcccagctgtcccaagtattctttttcagtnctgatgtattctaagacatgtaaatatgaa

SEQ ID NO: 27885 - DNA, 101 bp, rice(Oryza sativa)
  misc_feature (71): n=a or c
gatctaacttttcgtataatttgtttttttagttacaattgtatttatatttaaacagaggacggaagtantccctccgtccctaaatatttgacgccgtt

SEQ ID NO: 27886 - DNA, 101 bp, rice(Oryza sativa)
  misc_feature (71): n=t or c
aatcaaagccgatttacatcggctgtgaaaagttccaaatttttgctgctacacaaaattccttctgttangtgtacacatcaagtataccaaggaaattt

SEQ ID NO: 27887 - DNA, 101 bp, rice(Oryza sativa)
  misc_feature (71): n=t or c
tgtgcactctgctgcattcccctttggagaaggttggatcagatgtagtatagggtgtgtttatttcacgntaaaattgaaagtttggttgaaattgaaac

SEQ ID NO: 27888 - DNA, 101 bp, rice(Oryza sativa)
  misc_feature (71): n=t or g
atgtggttgatgaagtttagttgaagattcccaactgcttataagacttctcttgaactggttgctggtanttttttttttgctgctcgttgtagtagatt

SEQ ID NO: 27889 - DNA, 101 bp, rice(Oryza sativa)
  misc_feature (71): n=t or c
gaaataagaaccaagcacaaggatcatacttgagggaacgagcttgcagaataaatcacaacatcatcatngatatcatccacgataatgggacaactact

SEQ ID NO: 27890 - DNA, 101 bp, rice(Oryza sativa)
  misc_feature (71): n=t or c
cggtactacacatctaatactggattgactttttattcaacggttggagcagcttgtttccttcctcactnttggtgtcttctgctttcgtcacaaggagt

SEQ ID NO: 27891 - DNA, 101 bp, rice(Oryza sativa)
  misc_feature (71): n=t or g
agggcgcaaggaaggatgggccggcggcccaaaggagggaaaaaggtggtggttggttgaatattatactnataagcatgtaggctgcacctaggaatctt

SEQ ID NO: 27892 - DNA, 101 bp, rice(Oryza sativa)
  misc_feature (71): n=t or c
tctgagaaacaccttgaactcgaccagaatataaaacaacggcttgttggctgctaccctgtgaaaaaaanttacattcaatgaaggagtggtaccatgtc

SEQ ID NO: 27893 - DNA, 101 bp, rice(Oryza sativa)
  misc_feature (71): n=a or g
cgggttcggagaagaaaagtttgagaggaagtaaaaacaaggagaacgtcgttaaattgccaaaggtactncctatatatttgtcgataaattttcttcta

SEQ ID NO: 27894 - DNA, 101 bp, rice(Oryza sativa)
  misc_feature (71): n=t or c
gccgcagcctgcgccgtcatcatcccaccaccaccaccatctcccatgaaacccaacaccctcatcatcancaccaccaccaccgagtcgtccgcgtcgcg

SEQ ID NO: 27895 - DNA, 101 bp, rice(Oryza sativa)
  misc_feature (71): n=t or c
aagaccgacatcttcgatttcttggtggatatcatcactgatgataagatgaaggatgatggcatgggctntcaggctgcatccatggtttcgccatatac

SEQ ID NO: 27896 - DNA, 101 bp, rice(Oryza sativa)
  misc_feature (71): n=a or g
gttgtacagctcgaaggaaggtctgagaggtgtagagaagagcctcgaaaatctttcaatttctttctgtnaagagttgcatgcttcttcaggctgtgagg

SEQ ID NO: 27897 - DNA, 101 bp, rice(Oryza sativa)
  misc_feature (71): n=t or c
gtgctaaactaagtaaccctaccactaaaacaagccacgacacctatcttggtcagcctaaaaaaaattgnaaacctaagcaaaacctttctagttaggca

SEQ ID NO: 27898 - DNA, 101 bp, rice(Oryza sativa)
  misc_feature (71): n=a or g
taacttgtccttccatcctgttcccatctcgtggaccgttttctgcagaatgttcttgatttgcttattcnacatttctgcttggccattggtctgagggt

SEQ ID NO: 27899 - DNA, 101 bp, rice(Oryza sativa)
  misc_feature (71): n=t or c
cttcctctgttcctaaatactgctactcaacaccctgcactattatttccgaactatgactactactattntagcgaagtttggtgtatgttaaatataac

SEQ ID NO: 27900 - DNA, 101 bp, rice(Oryza sativa)
  misc_feature (71): n=a or g
gattgttatattgaattgacaggttaagtaacttctaactttgagggctacatcaatatgttgcagcaggntattgttggagtgaacttgaacatatcata

SEQ ID NO: 27901 - DNA, 101 bp, rice(Oryza sativa)
  misc_feature (71): n=t or c
acactgctagctaccattctgcagctacaaaaaacggccttgatcaaggccaaattaagctttgtggatanggactgcatggatgcaggcaaatagcagtg

SEQ ID NO: 27902 - DNA, 101 bp, rice(Oryza sativa)
  misc_feature (71): n=a or c
cagctggttttgagcgttttggcgcctgctgcctcttttgaagattaaactaccctcttaattactcaatntaaaactcaggtgtatgcaggaaagcgtca

SEQ ID NO: 27903 - DNA, 101 bp, rice(Oryza sativa)
  misc_feature (71): n=t or c
accggaattacaggtgatttgcttcgtactggctgctccgttttacagctaccgacctgctattttttttncatttttgtttttgtttttgtttcggtttg

SEQ ID NO: 27904 - DNA, 101 bp, rice(Oryza sativa)
  misc_feature (71): n=t or g
gttactgtttacatcccagattatcttagtacatttgcttgactccacttgcaggttctatagaaacatantaaggtacaagggttctccagcaagagcgg

SEQ ID NO: 27905 - DNA, 101 bp, rice(Oryza sativa)
  misc_feature (71): n=t or c
tcccttccaaaaaaaagggacatgctgatatttgctctctacatgccactgttgctctgtatagttgttcngtttcgatttattttcatattttttaaaaa

SEQ ID NO: 27906 - DNA, 101 bp, rice(Oryza sativa)
  misc_feature (71): n=a or g
caagatccggaagacaagattggtggggatgcacgttttgctgatgccgcggatcgatcaaaaatcaatcnaccgaggtgagaagccatactatatttttt

SEQ ID NO: 27907 - DNA, 101 bp, rice(Oryza sativa)
  misc_feature (71): n=a or c
ggcactagaaaaacaacctccgccattaacagacaagtcgtcagagcctcaaaccaagatcctgaagctanctggggctgaagttgatgacggaaatgatg

SEQ ID NO: 27908 - DNA, 101 bp, rice(Oryza sativa)
  misc_feature (71): n=a or g
gcggataactacagtacttgtgtgcttgttcgtgggctgtgtctggaagggcgcgtggaagaggggttganattgattgaagcaaggtggggagctgggtg

SEQ ID NO: 27909 - DNA, 101 bp, rice(Oryza sativa)
  misc_feature (71): n=a or g
tccttggctagctcgactgtgagattgtgcctgatgtatagtatccattggtcatttgctagtccttcttngaccgtcctacctttccttttggcatggtt

SEQ ID NO: 27910 - DNA, 101 bp, rice(Oryza sativa)
  misc_feature (71): n=a or g
gcctgcatgcatgcagcgggtgcggagatcgcttacgaggggatcccgtcgcaattcagaggacgcgcccnagtgctgcaacggctaatgtcgacactgtc

SEQ ID NO: 27911 - DNA, 101 bp, rice(Oryza sativa)
  misc_feature (71): n=a or g
ctccgagcaacaacaatggcagcatcttggcccattgctgaaaaagatacgggtctgttttgtcgcagatntgggatgtgctattgtggtgatgcacatat

SEQ ID NO: 27912 - DNA, 101 bp, rice(Oryza sativa)
  misc_feature (71): n=a or g
cgcaacacgtgagcagaagaatcctacctcgcctgacatcactaataatgatcagaaggatcaatgggatnatgaacacccagtgcttaaacagaagtgca

SEQ ID NO: 27913 - DNA, 101 bp, rice(Oryza sativa)
  misc_feature (71): n=a or c
tttacattacgtaggaatctctccctcctcctcttttctgggtcatagtcaaacagataatttaacagagnagctggagtggctacaagaatatcaggccg

SEQ ID NO: 27914 - DNA, 101 bp, rice(Oryza sativa)
  misc_feature (71): n=t or g
acaacataagtgcgtgctcacagtgatggattcacagccaggtcacccaggctcgtcgtcgaatactctantggactttttgtgtttttagctttttttta

SEQ ID NO: 27915 - DNA, 101 bp, rice(Oryza sativa)
  misc_feature (71): n=a or c
caacctgcttcgtaacacattggctggataacaagatgagtatgctctgagaatccattacatcatcagcntcatctgtgtctgaatttatattttcgccg

SEQ ID NO: 27916 - DNA, 101 bp, rice(Oryza sativa)
  misc_feature (71): n=t or c
aaggagaggagtggccgaagtccgtgtcaagcgcctccaagagcattggctcctccggcgcacttgacganggcggacgacggcgtgggagtgacggcggc

SEQ ID NO: 27917 - DNA, 101 bp, rice(Oryza sativa)
  misc_feature (71): n=t or c
tttttacttttgcccgctcaaataatggagctactgtttcccaattcttacaccctctaccttttccacanaatggatggacaaatacctacaacatgaaa

SEQ ID NO: 27918 - DNA, 101 bp, rice(Oryza sativa)
  misc_feature (71): n=a or g
aaaatgtatgaacattaactacgtataagtttctttgctgttattttagatgcatctagctgaaccattcngaagcggtaaatatgattaggatttctgtt

SEQ ID NO: 27919 - DNA, 101 bp, rice(Oryza sativa)
  misc_feature (71): n=t or c
tgcggtaaatatgcgatccaagatgtttccacccaatcgataaccatactatttagtatagtactaaaatngttccagttttattgtactcgtaacaatta

SEQ ID NO: 27920 - DNA, 101 bp, rice(Oryza sativa)
  misc_feature (71): n=t or c
gcagctctgcttgttaccgagctcaagttcacccaaccagctaactactcgcaattcgtataggtacaaanggtgcaaatatagtactgtataatactact

SEQ ID NO: 27921 - DNA, 101 bp, rice(Oryza sativa)
  misc_feature (71): n=t or c
ctcctcaaggttgccttctcttaagagatccggtttgttgtaattgcgaagcacgtagcgttgaattgcangcgactctggtaataataataataataata

SEQ ID NO: 27922 - DNA, 101 bp, rice(Oryza sativa)
  misc_feature (71): n=t or c
tcgttcttcgggcccggtaggaaagcattgattcctcctgggtttagctttcatcctttccactagcatgnatgacaaattaacaatctaaactaataatt

SEQ ID NO: 27923 - DNA, 101 bp, rice(Oryza sativa)
  misc_feature (71): n=a or g
tcagtgtcagattgttacccatgtctgaacgcatgaagggcaaaaaattctacgagatttggaagcttctnatgaaatttcgtccagatttcgttcttgtt

SEQ ID NO: 27924 - DNA, 101 bp, rice(Oryza sativa)
  misc_feature (71): n=t or g
atagtaatttgggaatagataggacatatcttaatccaaagatctcggcctgtccagatcgttggtctaanatatatctcatcttgtaatagattgctata

SEQ ID NO: 27925 - DNA, 101 bp, rice(Oryza sativa)
  misc_feature (71): n=a or g
actgggtcacgatcggagaccatggactgcggtacgccatgcagacgcacaatgtcggtgaagaaggcttnggcaaccgactcagcagtgtatggatgcgc

SEQ ID NO: 27926 - DNA, 101 bp, rice(Oryza sativa)
  misc_feature (71): n=a or g
ttgatcaaaaacatcacatcaaatgttcggacacatggaacaataaatgtgaggaaaaaacaattgcacantttgcatgtaaattgtgagacaaatccttt

SEQ ID NO: 27927 - DNA, 101 bp, rice(Oryza sativa)
  misc_feature (71): n=t or c
tggttagacatactgttaaaatacttccatccattgtccaccaacccagcatgactacatgcagtcaaaantgctagaaaagttatatgattaggcttcac

SEQ ID NO: 27928 - DNA, 101 bp, rice(Oryza sativa)
  misc_feature (71): n=t or c
catatctaccatcacaaaagattggtttcgctataataccatcacttaagtggacttcgaaaaaataccanactcaatacaaataacttcgctggaatgcc

SEQ ID NO: 27929 - DNA, 101 bp, rice(Oryza sativa)
  misc_feature (71): n=t or c
ccaagaaaaaccagaaaaggcaccgatacctcaatatttacttcaaaaggctgaccatagatgaacctcanaacatctgaactatggctggtaaggaagtg

SEQ ID NO: 27930 - DNA, 101 bp, rice(Oryza sativa)
  misc_feature (71): n=t or c
cctgcaaatgaaactaggaggatcccggggcaacccgacccctcaggtgaaaatgttaaggtgatcacgangaggggaggtaagtccctcgtgatccgcca

SEQ ID NO: 27931 - DNA, 101 bp, rice(Oryza sativa)
  misc_feature (71): n=a or g
ttcgcagggcatggttaacgcgagctacaacttgaggttggattcgcgatgctgatccaataaggaaaagntgatttgaaggaaaaaaatagtcccatgct

SEQ ID NO: 27932 - DNA, 101 bp, rice(Oryza sativa)
  misc_feature (71): n=a or g
ttgtattgtatgaaattatgtctggttccaacccatcttctgttatggaggtccagagagttgctgctttntcaatatagccagtttcataaagtccatcc

SEQ ID NO: 27933 - DNA, 101 bp, rice(Oryza sativa)
  misc_feature (71): n=a or g
gacctcatcgtcttaagtgcacagagaattaacatgcatgttaatttagatgcataagagcacccgcaatngtaaagtaaggtgctctctataaaatatgt

SEQ ID NO: 27934 - DNA, 101 bp, rice(Oryza sativa)
  misc_feature (71): n=a or g
atatagaaaaatctgaaatacggataacgaaacaaaaataatatcattgggcatattcggcagccggtcgnacttcttgttcctgtgggtacactgtaaac

SEQ ID NO: 27935 - DNA, 101 bp, rice(Oryza sativa)
  misc_feature (71): n=t or c
caagataagtgctctagacaaagctaacaccattgatgtatctgctagtgttgatcaaggagcaatatgcncaagatctgattctccatctgtggcaagct

SEQ ID NO: 27936 - DNA, 101 bp, rice(Oryza sativa)
  misc_feature (71): n=a or g
atagcccctacggatcacttaccagacaacaattgcagcagctaaggcaccatcagcttctacagcagcancagcagcagtttcagcagcaacagcaagtt

SEQ ID NO: 27937 - DNA, 101 bp, rice(Oryza sativa)
  misc_feature (71): n=a or g
attgacctgcattccattattttagttccaaggtaatttacctgcttttctagtgagggcaaactaaccanctcaaaacatgttcctcatgcaaacacaaa

SEQ ID NO: 27938 - DNA, 101 bp, rice(Oryza sativa)
  misc_feature (71): n=a or c
cgcgatgccaggcgatgcgtgtgaggtgagaccgtgagagagaaaagaaacagcgagagagagatgaagcngtgattaaaagaagagaggagaggagagga

SEQ ID NO: 27939 - DNA, 101 bp, rice(Oryza sativa)
  misc_feature (71): n=t or c
ttaccaggagatcagccagaaaatgaagaatgttgtcatcaccaagtcctcgccggagctcgtcggcctgncgaccaagccggcgccgccgccgcccggtg

SEQ ID NO: 27940 - DNA, 101 bp, rice(Oryza sativa)
  misc_feature (71): n=a or g
ttggcgagctcaaactctgcctctccaagagcctcttccatgcactggcggcctcgagctttgactaaccncctcctcctcaatgtgccggtgagctcgag

SEQ ID NO: 27941 - DNA, 101 bp, rice(Oryza sativa)
  misc_feature (71): n=a or c
ttttttttttaatcctgaaatcgccttcgcatccataaaactcttcacaacttgaaactacatcaaagatnattgctggaaggtctggccgcatatgccgc

SEQ ID NO: 27942 - DNA, 101 bp, rice(Oryza sativa)
  misc_feature (71): n=t or c
atcaggtgcgatgaagaagatgtggaaatgtctactgcatatgccaaggtattgctcacaaagattggagnggagacggccctgaggtatgcaatccacct

SEQ ID NO: 27943 - DNA, 101 bp, rice(Oryza sativa)
  misc_feature (71): n=t or c
gcatggatgcacaattatgctttgtatcaagaggtagtgtgtgtgtgaggtgcataaaggatatagatagntctctctctctctctctctctctctctata

SEQ ID NO: 27944 - DNA, 101 bp, rice(Oryza sativa)
  misc_feature (71): n=a or c
aagctgaggcagctcatgggactgtcactagacatttcaggctacatcagaagggacaggagacaagtacnaatagcattgcttctatatttgcttggact

SEQ ID NO: 27945 - DNA, 101 bp, rice(Oryza sativa)
  misc_feature (71): n=a or c
cagaaaaaagcacgtccagtaagaaaagaactgcaaactcctctggtggttcaagaggcaaaggaagaagnagcatgaatgctgcacatgtgataattgga

SEQ ID NO: 27946 - DNA, 101 bp, rice(Oryza sativa)
  misc_feature (71): n=t or g
cacggttgttttggatgcaggttggtgtttcttgggtggattctggttgcagcaacgcttttgctctgtgncaccttccttctgctacacaagtaaggcta

SEQ ID NO: 27947 - DNA, 101 bp, rice(Oryza sativa)
  misc_feature (71): n=t or c
ggacactgcaatagtgtggctgagccattactctcacctctggtttaagatatatacatatgaactcctcncaatcattgctcagttccctttcaatttgc

SEQ ID NO: 27948 - DNA, 101 bp, rice(Oryza sativa)
  misc_feature (71): n=a or g
gaattctacccttaatggcataggctctatgatcaactattcttctaacatactctgcctcttctcctganagtacgcccctccatatatacccaactcct

SEQ ID NO: 27949 - DNA, 101 bp, rice(Oryza sativa)
  misc_feature (71): n=t or c
cgatcccggcagcgtggggggagctacggttcctgaagagatttgctgtctatgagaacaatttctccggngagttcccggcgaacttcggccgcttctcg

SEQ ID NO: 27950 - DNA, 101 bp, rice(Oryza sativa)
  misc_feature (71): n=a or g
gaacaaacttttcagcacatctacttttaagtgtctcacttcataagctgccaaactataacaatctattnttccaatgcatttgcagctattttagtaaa

SEQ ID NO: 27951 - DNA, 101 bp, rice(Oryza sativa)
  misc_feature (71): n=a or g
tgtgtttttttattcattcatttttttcattataaaattcaaaggggccctaaaaccagagaagggagagngatgagaaaaaaatggagaatgtgatcggt

SEQ ID NO: 27952 - DNA, 101 bp, rice(Oryza sativa)
  misc_feature (71): n=a or c
gagaggctgccggccgtcgtggaaatgttagcgatggagcgatggcaatatgtggcatggccatgttctantggtacaagggaaaaaaaaaagaagaagaa

SEQ ID NO: 27953 - DNA, 101 bp, rice(Oryza sativa)
  misc_feature (71): n=t or g
ttctcgctccctttcgcccttaggctcttctttcgccacggattcaatggcccctcgcaaacccactaagnccgggtcaaccggtgaagacccctgcaacc

SEQ ID NO: 27954 - DNA, 101 bp, rice(Oryza sativa)
  misc_feature (71): n=a or g
aaaagcaaaacatgtttgtgaatttgaagccaattagttactcatattcatttttctggcatctacaaccntgacgatgctatcaattcttgtgaggaatt

SEQ ID NO: 27955 - DNA, 101 bp, rice(Oryza sativa)
  misc_feature (71): n=a or g
gtcaatagtcttgagggaccagggaagattaaatatctctgttaactcttggcagttgcgtattcctaganatttcagacgtggtaggagctgcccaattc

SEQ ID NO: 27956 - DNA, 101 bp, rice(Oryza sativa)
  misc_feature (71): n=t or c
agacaccatgggcggcggcgaaggcaaactggcgatgacaacgacgtcagtcaatgatgacgaagatgcgnagccgtggaggcgaataagccagtcggcgt

SEQ ID NO: 27957 - DNA, 101 bp, rice(Oryza sativa)
  misc_feature (71): n=a or c
aatcttacacagcacggcctccaggtaaggaagcgccattggagcaggatgggtggcggaggaggcgctcngggaatcgctaggcggcgggagacggggga

SEQ ID NO: 27958 - DNA, 101 bp, rice(Oryza sativa)
  misc_feature (71): n=t or c
tggatgaatcttgctattattttgtcactaaatcataccatccatgatgtgcgaaatgctgacaatggcgngtgccgcctgcaaaaccaccaccttgtctc

SEQ ID NO: 27959 - DNA, 101 bp, rice(Oryza sativa)
  misc_feature (71): n=t or c
ataagttcaaccgaaaaagtttgatgccaaattattcctcatgagaatctattaactttcggcctcttgcntttttaaggagattcggagagagaggaagg

SEQ ID NO: 27960 - DNA, 101 bp, rice(Oryza sativa)
  misc_feature (71): n=t or c
tcaagtctattgaccggaatggctgaaattgatgtcacttgatcgatctggtaccattcttctaaccaacnaggtgaaaccccgcgcattgctgcggaaat

SEQ ID NO: 27961 - DNA, 101 bp, rice(Oryza sativa)
  misc_feature (71): n=t or c
tgttggtatgctaggtgcacaactgtgctaactatttttttagcgtatcacaacgtgatgtgctaaacaangacatagtcactgggacactagtttgacta

SEQ ID NO: 27962 - DNA, 101 bp, rice(Oryza sativa)
  misc_feature (71): n=a or g
tgcttcatattcagagttaaatattacaagatagttgaaccagaatcctaccaaatttctgggttttgccnggatacaactgataatctcatggaatcatt

SEQ ID NO: 27963 - DNA, 101 bp, rice(Oryza sativa)
  misc_feature (71): n=t or c
gggacaaacaatgcatctgattagtggaccccacattaatttttattttcgtattgctgactggacacacnatctaggaaaaaaaaccctgtgattcgatg

SEQ ID NO: 27964 - DNA, 101 bp, rice(Oryza sativa)
  misc_feature (71): n=a or c
acacacacaacacaggtgcagtcactgttggatcaagaattgcccgcatttttcttcaagatcgagtttgnaggacgagacgagagcaccaccacatattc

SEQ ID NO: 27965 - DNA, 101 bp, rice(Oryza sativa)
  misc_feature (71): n=a or g
tgtttctggccgtgcggtgggggttctctgtggtggcggtgtggaacgtcttggcggttgcacggaacacngggcagttggacgggcggaggcttcaacgg

SEQ ID NO: 27966 - DNA, 101 bp, rice(Oryza sativa)
  misc_feature (71): n=a or g
gtatggagcatgtttccgtcaaggtactacatgacctgttgcatgggtaaccttgcattaggaagtgggtntgaccatgtgagatagaagcccgagtttta

SEQ ID NO: 27967 - DNA, 101 bp, rice(Oryza sativa)
  misc_feature (71): n=t or c
gatctagaagactataatgtgtgaagcgagcgacgaggtatatataagatcagtggcggatgcaggatttngaaggtgggtattcaaaaatttacagcttg

SEQ ID NO: 27968 - DNA, 101 bp, rice(Oryza sativa)
  misc_feature (71): n=t or c
acaatatccgtgaaatttactcttagattatagactaaccatgcatacggtaacaagtactccctccgtcncaaaaaaaagacaaaccctggtttccgtgc

SEQ ID NO: 27969 - DNA, 101 bp, rice(Oryza sativa)
  misc_feature (71): n=a or g
cagttgcagagattataaaatatatacgactcaatagcagcggttgttttttcacacggtgtgttgttttnatttctttactgtgacccgactgattaaaa

SEQ ID NO: 27970 - DNA, 101 bp, rice(Oryza sativa)
  misc_feature (71): n=a or g
gcagcattaggtctcattggcatcccttgaatcaatgcatatgcctcctcaagaaggccagatcttccaantaaatctaccatacaaccataatgctcaat

SEQ ID NO: 27971 - DNA, 101 bp, rice(Oryza sativa)
  misc_feature (71): n=a or g
ttcagatagaccaggcttctagatcttaaatttagaagagccatctttaccagctgaagacggcgatgctngtggtttctcagccatgggaaaatgctgtt

SEQ ID NO: 27972 - DNA, 101 bp, rice(Oryza sativa)
  misc_feature (71): n=a or g
aactttaatggacagatccaaccagtaccacctaccattgagccatgctcctcctttagacacatcaaatncctctcagaatcttgcctgttttctgaaat

SEQ ID NO: 27973 - DNA, 101 bp, rice(Oryza sativa)
  misc_feature (71): n=t or c
gcgagcttggcgggaactccttcgagtttcccgattaaaaagccaagcaaggactccacggtggtctcatnggggaacgtggggcccgcttattggattct

SEQ ID NO: 27974 - DNA, 101 bp, rice(Oryza sativa)
  misc_feature (71): n=t or c
cttaggagtattacctatggtataatttttaccaatatgtctcttttcgtgacaattgtagcaagttaggntttgacctctatgacttgtcttcttgtctt

SEQ ID NO: 27975 - DNA, 101 bp, rice(Oryza sativa)
  misc_feature (71): n=a or c
agcgacttcctccacttttaacctgattcaattcttcataaactattaatgtaggactattcccgacaccnctaataagtactagctagtagttgtatttt

SEQ ID NO: 27976 - DNA, 101 bp, rice(Oryza sativa)
  misc_feature (71): n=t or c
atggagaacttctcttttgtgcctctctcaaggatgttcccttcaaatatttacagtgtacaagagctgtnggtaagatctttgcaaatgttcctctttta

SEQ ID NO: 27977 - DNA, 101 bp, rice(Oryza sativa)
  misc_feature (71): n=a or g
acgggaaattgaacaaggaatcaacaagagattgtctaggaagcttgacaggaaatggaagcaaagcatcntggttagaccaccaccatctctaagggaga

SEQ ID NO: 27978 - DNA, 101 bp, rice(Oryza sativa)
  misc_feature (71): n=a or g
tgaagcaaattcatagatgttataagggtgctacttgaatcatatcccagaaagctgaggccaggggacanttgaggaaaaggtgatcagtgtcttccggg

SEQ ID NO: 27979 - DNA, 101 bp, rice(Oryza sativa)
  misc_feature (71): n=a or g
tgttgctaatcctgtttgtttcgatggtctgtgctaactctttagccttcagggattgctagaaggagtcngtgattcatttaccaaaaatttccacttca

SEQ ID NO: 27980 - DNA, 101 bp, rice(Oryza sativa)
  misc_feature (71): n=t or c
ctcttgatatttaataaaatcgcgcacccaatcctttgacatagttggttccatttgtgatactgctcccngtcagacatgctccattccctagaaatctg

SEQ ID NO: 27981 - DNA, 101 bp, rice(Oryza sativa)
  misc_feature (71): n=t or g
ttggggggtagcgcgtggttggggttcctgcgggttcagctcacgaatttgtactactactaggtgacttntggtttcagttttggtcgttaattcagttg

SEQ ID NO: 27982 - DNA, 101 bp, rice(Oryza sativa)
  misc_feature (71): n=a or g
tgacaccatccctgaagctgttgttcagtaccccaaactcactgtccttgatctcagctccaatcagttcngaggtcctattcctgctaatttactcactt

SEQ ID NO: 27983 - DNA, 101 bp, rice(Oryza sativa)
  misc_feature (71): n=a or g
aaaatagtgactatttttttaaaaaaggaaaatagcgatccttatttcttcctgattcatggcgcccgccncccacacgcgcgtgtattgatcagaacaga

SEQ ID NO: 27984 - DNA, 101 bp, rice(Oryza sativa)
  misc_feature (71): n=t or c
atcaggcagatatggggttttgaccgctgtaattactctgagactagtgatatcagctgttgatgtcctgnggatcagaaaaaggaagatcatatctcagc

SEQ ID NO: 27985 - DNA, 101 bp, rice(Oryza sativa)
  misc_feature (71): n=a or g
tattctatctaaaaaggtgcggcccatgtatcccccccagctcggcatagacttccgtcgtctcctcctcntgagctcgcccctgcgccgcctgcgccgat

SEQ ID NO: 27986 - DNA, 101 bp, rice(Oryza sativa)
  misc_feature (71): n=t or c
ttgcatatctttctttatatgagtaaatgcgttttagtgggaatcaactatgtagtaagataggattcatnagagaaatatttgtttgaaaatacattttc

SEQ ID NO: 27987 - DNA, 101 bp, rice(Oryza sativa)
  misc_feature (71): n=a or g
gaacaatcgtttcgtatggtcaagcttaactgtgtcaattgactttcaccaagtattgatccatatgaacncgttggcggggaatattttgaaacctgtgg

SEQ ID NO: 27988 - DNA, 101 bp, rice(Oryza sativa)
  misc_feature (71): n=t or c
gacattttcgctgaaagtgcaatgagtaaggttgaggtgtttcagggactgggaagagatcctcttggcanctgacaactcggaggagacaatctctaaat

SEQ ID NO: 27989 - DNA, 101 bp, rice(Oryza sativa)
  misc_feature (71): n=t or c
aaaaggttccctattcaagtactagatgtagaaaatattttccgtgcatatcacacccaagaaagaatcgnaacttttacgtcgaaagatatagtagaaat

SEQ ID NO: 27990 - DNA, 101 bp, rice(Oryza sativa)
  misc_feature (71): n=t or c
cacgcatggtgcatccactgttcctgctcccctccgatggccttgctcgtcatcaccgacaaactccacantgtccccatgccgactcgagggccacgagg

SEQ ID NO: 27991 - DNA, 101 bp, rice(Oryza sativa)
  misc_feature (71): n=t or c
tttttaccgccggcagtcgcctgctttattaaacctgctctaaggctaaagagagaagacgggttcgcaancaattctagctacgaatctagacatatgtg

SEQ ID NO: 27992 - DNA, 101 bp, rice(Oryza sativa)
  misc_feature (71): n=t or g
aatagaatgatttttttcatgcaaaatggacgtacctataggagagatggtataagaatggataagaacanacataaaaatctaaacaacagaaaaaacta

SEQ ID NO: 27993 - DNA, 101 bp, rice(Oryza sativa)
  misc_feature (71): n=a or c
gaggttgagttctacggccatatcatgatcgattctgtggtggcagagatggtagctgtgtgcagaaatcntccgaacaagcctagagtttacagggagga

SEQ ID NO: 27994 - DNA, 101 bp, rice(Oryza sativa)
  misc_feature (71): n=t or c
gctgcttcgtctttccgccttcgtcgctggcttcgcctccagagggataggggtagaagaggctcacccgnagcgggagggccaggttgacgacctggcca

SEQ ID NO: 27995 - DNA, 101 bp, rice(Oryza sativa)
  misc_feature (71): n=t or c
tgaggaagaaggcagaaggctataaaggctgggaagtaggagtatactagagtaagcaagagcaaaggganaaataggctggagggaaatgcagataagtg

SEQ ID NO: 27996 - DNA, 101 bp, rice(Oryza sativa)
  misc_feature (71): n=t or g
atggtaccgttcatcaaatccggtccagcagctttcaatacacaaaggaagcagaaatttcgaggcctgtntttagttccacgctaaaattgaaagtttga

SEQ ID NO: 27997 - DNA, 101 bp, rice(Oryza sativa)
  misc_feature (71): n=a or g
agagatttgcagatggcaacataatcctcgggagtattgctcttttcaaatcctaaaaagttaaaagtttngaatttttttccctctgactgaaagtttta

SEQ ID NO: 27998 - DNA, 101 bp, rice(Oryza sativa)
  misc_feature (71): n=a or c
gccccatcacctgaagcgtggaccccttaagcctgtagcacatgtaaataagaaaactacagttactttgntcaaattattgcaaaactacatatttaagg

SEQ ID NO: 27999 - DNA, 101 bp, rice(Oryza sativa)
  misc_feature (71): n=a or c
tttcaaatatcatacctgtattgctgattagcatgatggttagaatttgaatgtttgatttgttcctgcangttgggtgaagaatcattatgagctaagaa

SEQ ID NO: 28000 - DNA, 101 bp, rice(Oryza sativa)
  misc_feature (71): n=a or g
gagacacacactactgaagaaacgatcttttggatcggtgtgccaaattttacaattaatagagagaggcntggggcaaggcggccaaccggccatatata

SEQ ID NO: 28001 - DNA, 101 bp, rice(Oryza sativa)
  misc_feature (71): n=a or g
tctaaccttattacctagtgcccctaaggatccatatccaatcccactttcaactctttcagagtcttgtntttcggaagctgcatttatagatttagcaa

SEQ ID NO: 28002 - DNA, 101 bp, rice(Oryza sativa)
  misc_feature (71): n=t or c
ctatcttatcttagacaaaccccaagtttgttatatttgcaaaaggaccaaaacatgcacatccaaacagnatgcagtttaggtgggtactatagaaatgt

SEQ ID NO: 28003 - DNA, 101 bp, rice(Oryza sativa)
  misc_feature (71): n=a or g
atcccatttgccgctggaggcggtgatctcaagtccagtattgggtttttattgcttcataaaaggaaaangtacaccgaaggtccctcaacttgtcatcg

SEQ ID NO: 28004 - DNA, 101 bp, rice(Oryza sativa)
  misc_feature (71): n=t or g
aagttttaaacagattttttaattgggctgaattggtgtatgcatgtaggctaaggacccgtgtacactgnctgaaacttactagcttcaatagcttcaat

SEQ ID NO: 28005 - DNA, 101 bp, rice(Oryza sativa)
  misc_feature (71): n=t or g
aagggtagattagtaatctcctagtacatattaggggtaattttggctggaggatgatttctctgtctcantcgcttaattgcatcaggcccgacgcagga

SEQ ID NO: 28006 - DNA, 101 bp, rice(Oryza sativa)
  misc_feature (71): n=t or g
aaaaatatagacatattgaaattaagcatgaataatgggccaagacgctaaccgtccaatggaagatttanctcaacataagtttattatatgatccccac

SEQ ID NO: 28007 - DNA, 101 bp, rice(Oryza sativa)
  misc_feature (71): n=a or c
atgctgcaacaaccgtcatcttcctccagaaagagtggttatggtggttgctacagagggatttgatacancatgctgaccataaacttcattattagctt

SEQ ID NO: 28008 - DNA, 101 bp, rice(Oryza sativa)
  misc_feature (71): n=a or g
taatgtgacgccatggaacgggtttacaatggaccatgtctctggcaccaaggttggtgccaccacgttcnattcgtcaggccgccgccggagtgccgcag

SEQ ID NO: 28009 - DNA, 101 bp, rice(Oryza sativa)
  misc_feature (71): n=a or g
ctactactagcagagagcatcatagtgaggctcaagatagatgcatggatagtacatagagctaggtagcnaattatgatttcccatccccactggattca

SEQ ID NO: 28010 - DNA, 101 bp, rice(Oryza sativa)
  misc_feature (71): n=a or g
gtcgcttcgcctttcgtcctgttcctcatcggtatacttctgtacgcgtgtgctttgatgttgtaactccntagggagcatggcttcagatccgtatacga

SEQ ID NO: 28011 - DNA, 101 bp, rice(Oryza sativa)
  misc_feature (71): n=a or g
tcattttgatcgccggcaagaaagtaatttccatcaactttgctcgtattggcgtgggtagaactttgtcngttagacccgatattctatttaagttgatg

SEQ ID NO: 28012 - DNA, 101 bp, rice(Oryza sativa)
  misc_feature (71): n=t or c
cctgcgccacgcccagcagcgtcttgatccgcatatgccaagacgctctcagcggtgaggaagagaatgangggtcatgcaggtggtcgtgaagtgagccg

SEQ ID NO: 28013 - DNA, 101 bp, rice(Oryza sativa)
  misc_feature (71): n=t or c
aggatgggggccatgatggcttcagcatttggcgcgactgattctggaagactgggtaggcagattggtanatgttcaccattctcctcagggtgaaaata

SEQ ID NO: 28014 - DNA, 101 bp, rice(Oryza sativa)
  misc_feature (71): n=a or g
caatcttaatcagtatgacgtttcaccttcactcacagaagctatatcctcagttgttcttgtcacggttngtgagacatcttgggcttcagggattatcc

SEQ ID NO: 28015 - DNA, 101 bp, rice(Oryza sativa)
  misc_feature (71): n=a or c
aaaaaaaaaaactccatgaaattacctgtctggctgtcctgtcctgcccttgttgttgttggttctgaatnacagaataagcgtgttccttttgtttaatc

SEQ ID NO: 28016 - DNA, 101 bp, rice(Oryza sativa)
  misc_feature (71): n=t or g
ggtgcaaatgacccaatgaagtaccctgggtccaagaaactataaaaactagcaactaaatgtacagatgnacagatgcccctttgctagctagctgagca

SEQ ID NO: 28017 - DNA, 101 bp, rice(Oryza sativa)
  misc_feature (71): n=a or g
aggaaaacagggatagccggagttggaagagaagatgggggatagaggaaggcaagggcaatttggtctcngatagcattatagcttgtagccacggggtg

SEQ ID NO: 28018 - DNA, 101 bp, rice(Oryza sativa)
  misc_feature (71): n=t or c
tacgcgtcgattgctctcaacaccccaatcatgaatcagcccatcgagatgagtaatgtcttgacgttcancattgtttgaatggatattctcgatcacct

SEQ ID NO: 28019 - DNA, 101 bp, rice(Oryza sativa)
  misc_feature (71): n=a or g
gtcaggttaagctatatatgcaagatactactactatggattgcgtagtacttcctcggtcctaaaaaatnaaagccaacctattattagacatgacacat

SEQ ID NO: 28020 - DNA, 101 bp, rice(Oryza sativa)
  misc_feature (71): n=a or g
cgcaaagacgtacgagatgaataatccattggtaatgcaaaccatgcatgcttgcttgacggcggcagagncgaagcgttctcgcgtcgcgtgcgcgatgc

SEQ ID NO: 28021 - DNA, 101 bp, rice(Oryza sativa)
  misc_feature (71): n=t or c
tagagatagtaattaattactttcaatactatctcactgggttcctcctttctaaccgtaacaacccgacnttcaaggctgcgcagccaactcatccgata

SEQ ID NO: 28022 - DNA, 101 bp, rice(Oryza sativa)
  misc_feature (71): n=t or c
tctcgcgctacagtgatttctattagcacactagagacagtattctaacagtaatccatactgttgggtantttttactgtagtgaggtattatagcaaga

SEQ ID NO: 28023 - DNA, 101 bp, rice(Oryza sativa)
  misc_feature (71): n=t or c
aaaaacaagagtcttgtagagccgaataggattctcacgagatcctatagggaaatcatgagatgcccttncagccccagaactgcgaccaccacctctcc

SEQ ID NO: 28024 - DNA, 101 bp, rice(Oryza sativa)
  misc_feature (71): n=t or c
cctttcctcatttcaacccagtaagcaagaggtggtgattttccttgaaatttttcaaatgacactcgatnggttgcaacattgaaaatgtcaaactcctg

SEQ ID NO: 28025 - DNA, 101 bp, rice(Oryza sativa)
  misc_feature (71): n=t or c
cgcaaggggataaattcaacgtcattgtcaacaatgcaagaggagcttgagtttgttggcagtcgcgccangggggatgttctcatgcactacgtgacgag

SEQ ID NO: 28026 - DNA, 101 bp, rice(Oryza sativa)
  misc_feature (71): n=a or g
aagcaatcatacactgtaatcctaccttagatatcaccatcattagagacaatattagccgggacatctgnaatatgctaggctatatggttaagtcgcaa

SEQ ID NO: 28027 - DNA, 101 bp, rice(Oryza sativa)
  misc_feature (71): n=a or c
cacccaccacccaaaaccaaccctatatatatatctctctctcgcccccgaccactaacatcgtctcatcngccgcctcccctcgcctcgccgcgcgcttc

SEQ ID NO: 28028 - DNA, 101 bp, rice(Oryza sativa)
  misc_feature (71): n=a or g
atcgacgcaatctgtttttgttccttagaaaagatagtgaagtaccgaggaagtgaaccgaggggcatttnatgttattggcgtacgccttctcggcaacc

SEQ ID NO: 28029 - DNA, 101 bp, rice(Oryza sativa)
  misc_feature (71): n=t or c
gaagtataagaaaataaattatatcgatcgttactactcacaaggatcaggtcgagcaacagtgtcgttgncggcgctgctttcagtggtgggggaagcag

SEQ ID NO: 28030 - DNA, 101 bp, rice(Oryza sativa)
  misc_feature (71): n=a or c
ccaaatacacatgcttggaatagttcccaaaacacttcagattctagcccttccaactgtattgaatgatnaattgttttaaccatttctgcgactgctag

SEQ ID NO: 28031 - DNA, 101 bp, rice(Oryza sativa)
  misc_feature (71): n=t or c
gtagctagtatttgggacaaggtttcattgattggtcacctgaggaagcaggctggtcttcttgagccccnggtgatccggcatcagtccaaagtggatgt

SEQ ID NO: 28032 - DNA, 101 bp, rice(Oryza sativa)
  misc_feature (71): n=t or c
ataagattgatcacccacaccacacctacaccactagactctagagcactgcaaagcatgcatcctactantcatcatcctgggttagactcctcaggcct

SEQ ID NO: 28033 - DNA, 101 bp, rice(Oryza sativa)
  misc_feature (71): n=t or c
tgttatgcagatgctagaaggaagatcctatcgactacaatatccatggattggtgttgtcaatcgttccnagcaagatataaacaagagcgttgacatga

SEQ ID NO: 28034 - DNA, 101 bp, rice(Oryza sativa)
  misc_feature (71): n=a or g
cgcagtttcggatgtcctaaggttgggaatggcgatcgatggcaggttcaagtcaatcacggatccttttntcgtcgtgcagttgtcttgtgagcctagtc

SEQ ID NO: 28035 - DNA, 101 bp, rice(Oryza sativa)
  misc_feature (71): n=t or c
tcaaagttaattgctcctacttctttttgtgggcaggaaaatcattcccctttggcattaaaaataagganaatttgaaccatgccacataaattttacaa

SEQ ID NO: 28036 - DNA, 101 bp, rice(Oryza sativa)
  misc_feature (71): n=t or c
tgtaggtgtggtaggtggtcttttcatcgcagcagtgttcatattcattgcacttcttcgtagagaaaaanaaaagatgaaagaatttttcaaaaagaatg

SEQ ID NO: 28037 - DNA, 101 bp, rice(Oryza sativa)
  misc_feature (71): n=a or g
aagtcttcaccggtcatcgtccttcgtcgcctcctcttcaccaattcaccatggtgagccacggggcctcntcgccttctttcaccatcgcgccgttgttt

SEQ ID NO: 28038 - DNA, 101 bp, rice(Oryza sativa)
  misc_feature (71): n=t or g
tctgggaagaacgaggcgtcaacattaaccttgtagaacccatctgctggtggcttccatctctactcagngattgtgatttcgttaagtcttcttccttt

SEQ ID NO: 28039 - DNA, 101 bp, rice(Oryza sativa)
  misc_feature (71): n=t or c
cttgcgcggaggcaactggagtggcaacagagatggagctcgcgggaaggaggcgacaagcccgccgctanctcgaactccctccatgactcgacctcgcc

SEQ ID NO: 28040 - DNA, 101 bp, rice(Oryza sativa)
  misc_feature (71): n=t or c
ggttggcaacatctgatggttcttctgaagcagacgttacatctgttctactgattagaccctcggcaagncatcttgttgttaaacttgtccttcgaaag

SEQ ID NO: 28041 - DNA, 101 bp, rice(Oryza sativa)
  misc_feature (71): n=a or c
tactagtttgtcttttgaatgctatgattgtattactgttaggacaaatggagtaacaaacacacacacanacacacacacatattacttatttatttatg

SEQ ID NO: 28042 - DNA, 101 bp, rice(Oryza sativa)
  misc_feature (71): n=a or g
gaagacaatgggcagtttggtccaaaattttagaaagtgtgttgaaagagtaagtacactggtggagaagntgtttttactcccggttcgtaacctgtaga

SEQ ID NO: 28043 - DNA, 101 bp, rice(Oryza sativa)
  misc_feature (71): n=t or c
agtgcctacggcacaagtggatgggattgatgccaagggcactgtaaagcatcctaatcaggctcaagtcncctcggtgcaccatccaaagatacatcaca

SEQ ID NO: 28044 - DNA, 101 bp, rice(Oryza sativa)
  misc_feature (71): n=a or g
aattgcaggaacaatggaatagaagccaatctccatcagaaggaaaatctaagtgaactactattgcactngggtcgtgataaaatttacacaccggaaaa

SEQ ID NO: 28045 - DNA, 101 bp, rice(Oryza sativa)
  misc_feature (71): n=a or g
ggaaatcaaaagcgaaactttgattgagatgcaaagctacacacttggcatgtcatagcctccctttctgncaatgtttttttttccctgcatctttaaac

SEQ ID NO: 28046 - DNA, 101 bp, rice(Oryza sativa)
  misc_feature (71): n=a or c
agcacacaacctcactacgttggacaacagatttttatgggaaataattgaaagaagagctttctatttgnaaaaggaaaaacccagtgaacttgttgata

SEQ ID NO: 28047 - DNA, 101 bp, rice(Oryza sativa)
  misc_feature (71): n=t or c
tgacatgcagtttgacattaagtatgcctacttcaacttcttgaggtcattggagatcgatggtagttcgncgaaaaagacggatgctttggaagacgatc

SEQ ID NO: 28048 - DNA, 101 bp, rice(Oryza sativa)
  misc_feature (71): n=a or g
cttcataggtgcttacttattccaatgatatgtgtgatgacattgttctccttttggaccagtatgtttcnttgataaatccaaataccagtgtttactgt

SEQ ID NO: 28049 - DNA, 101 bp, rice(Oryza sativa)
  misc_feature (71): n=t or g
agctggagccaaggccaaaaaagaagccgaagctggtgggaatgtcagcggcaagcagagcacagccgggnaggggaggggcgccgtggtcctgctgcatc

SEQ ID NO: 28050 - DNA, 101 bp, rice(Oryza sativa)
  misc_feature (71): n=a or g
ctctttttctccattgccaacctccgccaacggagccctatcctcctcaattccctttcatcttggatcancagggcgaaccagatccatggcagcgctca

SEQ ID NO: 28051 - DNA, 101 bp, rice(Oryza sativa)
  misc_feature (71): n=t or c
ttcttaacaacagtcagtttaagttctgctttcattacaggatgtgaaattttacctgctttagagagagngggaaggtaagcttcccgcaaaactccggg

SEQ ID NO: 28052 - DNA, 101 bp, rice(Oryza sativa)
  misc_feature (71): n=t or g
cgcccagctgggtcaggttcgttcgttcttgatccccggatcctgaattccggggtttcttggaattcttncttgggttcgccatggatgcggggggagtg

SEQ ID NO: 28053 - DNA, 101 bp, rice(Oryza sativa)
  misc_feature (71): n=a or g
tcacacacaacactcggttaaccatattgcagtagagatcgatgggtagactccaaaatttgatgcttctntcggcggggttcttctccacgctattgctc

SEQ ID NO: 28054 - DNA, 101 bp, rice(Oryza sativa)
  misc_feature (71): n=t or c
tttaaaatattttttagagtccctgcatcatctttttgctcgtctgcatcttgtctctccttgttatttcngtagccatccctcatatcgcctctggtacc

SEQ ID NO: 28055 - DNA, 101 bp, rice(Oryza sativa)
  misc_feature (71): n=t or g
taaacacttttttttgaaattccattcatagaaaatggtgatgggagcttaaatattattgcattgagttncactgtatctaaacaaagttcaatgaaaca

SEQ ID NO: 28056 - DNA, 101 bp, rice(Oryza sativa)
  misc_feature (71): n=t or g
ttgcagcaagttaggcaggatgcgatctatactcttgcaagtgcatgcatagctgaagcccaatcagagancaagaacagaagattcccagaaataaataa

SEQ ID NO: 28057 - DNA, 101 bp, rice(Oryza sativa)
  misc_feature (71): n=t or c
ggagtgactagaaaatttgaagggacgagccgcacgattcttcactgtttacttcggctgtgtttagtttncctgccaaaaattttatatagacacatatt

SEQ ID NO: 28058 - DNA, 101 bp, rice(Oryza sativa)
  misc_feature (71): n=t or c
tattggctaaggaccggctataagcaataaaacattcgttcttctctctgctatggtactgctagcccatntctctctaattcagttgcttgcctccatgg

SEQ ID NO: 28059 - DNA, 101 bp, rice(Oryza sativa)
  misc_feature (71): n=t or c
gcagtggcattgtcgcctaggccacccgtcctcagtcattgttcaacaagtcttgagtcataataatttancttgtgttagtgagtcaaacaagcattcgg

SEQ ID NO: 28060 - DNA, 101 bp, rice(Oryza sativa)
  misc_feature (71): n=t or c
tgagacaaccattcggcctccagggacaatctcctgtgccctcaagctcaagaatcgcatgaaatccttcntaaactgccgagcataagaatccgcgacaa

SEQ ID NO: 28061 - DNA, 101 bp, rice(Oryza sativa)
  misc_feature (71): n=a or g
caactccaatccgaggagaggagatctgcattcgctttgggtggatgccaagttgcaggcagaagctgaanctaggaaatggccatacagcttccctgtat

SEQ ID NO: 28062 - DNA, 101 bp, rice(Oryza sativa)
  misc_feature (71): n=t or c
catcaacggcgagagccgctctgttaccacagcaggttgccgacgaggcagagagcgaacgccccaagaangtcgccgacgacgtgccggccggccggagg

SEQ ID NO: 28063 - DNA, 101 bp, rice(Oryza sativa)
  misc_feature (71): n=t or c
aatcgatctgaatccatggcgcggtggtgcatgagcatgatgcacatcgttcttcttctacttgtagtggngctcatgctacttaatgtatcatgtgaggc

SEQ ID NO: 28064 - DNA, 101 bp, rice(Oryza sativa)
  misc_feature (71): n=t or c
caggcagctcaatatgggcttcagaggccaagttttcagagcaatattcctctatatcaacctgggagtgntccatggggatcctctgctccaccttctgc

SEQ ID NO: 28065 - DNA, 101 bp, rice(Oryza sativa)
  misc_feature (71): n=a or g
acctggctgttatagagaagagggcagacatgatcaggaacaaatggtgatatgaaaatcaccatcgccangcaaagccagacattcataccactggattg

SEQ ID NO: 28066 - DNA, 101 bp, rice(Oryza sativa)
  misc_feature (71): n=t or c
atgattaacggtcccatttccgaggaggaagttcatgtagctctaaaacaattaccaggagacaaggcgcnaggcctagacggatttactggggccttcta

SEQ ID NO: 28067 - DNA, 101 bp, rice(Oryza sativa)
  misc_feature (71): n=t or c
cctagacacctcaagcaccccttaataataatcatcatcattatgggcttgtttagatactctaaaatganaaaagttgtaccgttttagaccattttttt

SEQ ID NO: 28068 - DNA, 101 bp, rice(Oryza sativa)
  misc_feature (71): n=a or c
ccattgcccgtaacgcattgtcgatgattattatctccggttttactttaaatagataataccgttaactnttaaacaaacgtttaaacattcagcttaaa

SEQ ID NO: 28069 - DNA, 101 bp, rice(Oryza sativa)
  misc_feature (71): n=a or g
gccgctgctggagtcgccgcttacgacaaggaatgatgaggagagaaggctgtcgaggttggattggtagntgctgttcgccgtgtatttgctgctgccgc

SEQ ID NO: 28070 - DNA, 101 bp, rice(Oryza sativa)
  misc_feature (71): n=a or c
tggcacggaacttgcaacgagttgaggtatgttgatatggaatgggaagcttctgctctgatatttagganttactaacttgtgaatacaccattgaggca

SEQ ID NO: 28071 - DNA, 101 bp, rice(Oryza sativa)
  misc_feature (71): n=t or c
aacattccagtcccatattttctttttcttcccctctacgttttccttttttttctttttctcacaccganggaaacaaataacagaagaaataggggagt

SEQ ID NO: 28072 - DNA, 101 bp, rice(Oryza sativa)
  misc_feature (71): n=t or c
caaattacagcatatatgagtcatacaaccaaatcaatctcaatcaaagattacagaatcaatttgcttcnaatctcacaaagccaaacaataacaattca

SEQ ID NO: 28073 - DNA, 101 bp, rice(Oryza sativa)
  misc_feature (71): n=t or c
tatgcatgtgagatgtgatgtgttctccggcctaattaagtatcgacgtactatatatatgcacgtacatnaagtacggccgtatttcataatttgattat

SEQ ID NO: 28074 - DNA, 101 bp, rice(Oryza sativa)
  misc_feature (71): n=a or g
cttatttgtaagggcaaaaatgcaacaacaactaagggtataaacatcctttcaccctaaaactaacaccntcaaaactaggcgtcaaaagtgagggcaaa

SEQ ID NO: 28075 - DNA, 101 bp, rice(Oryza sativa)
  misc_feature (71): n=a or g
tcttaatttgtccaaacgctattgaactatgaagatcccatattgcaagttgttcactgctgctgctccgnttttccaaccgtccctttgacgagctggat

SEQ ID NO: 28076 - DNA, 101 bp, rice(Oryza sativa)
  misc_feature (71): n=t or c
tcaaacttaccactcggccgatcctcactaactctctcccgcacatcactatttacacccaaatttgacanttaagggtcgaaataggaaaaaatccaaat

SEQ ID NO: 28077 - DNA, 101 bp, rice(Oryza sativa)
  misc_feature (71): n=a or c
cgtcggccgggagtcgcatggtgatcggtggatacgttggcacgtcttgagcagaacttggtgaagaaagngaggtctttgcgatttcacccgaatggttt

SEQ ID NO: 28078 - DNA, 101 bp, rice(Oryza sativa)
  misc_feature (71): n=t or c
ggaaccagagagcttgaaggtccttgaacatgggagatctgttcagtctgcttatttttcacctagtggcngcatggttgcaactacaaggtgatcctttt

SEQ ID NO: 28079 - DNA, 101 bp, rice(Oryza sativa)
  misc_feature (71): n=t or c
atgctacactctaatcgtcgactgttttctcatcctctaccattgccaccatattgtctcgctgtcattgngcctctgcatcagtcctggcatgacaccgt

SEQ ID NO: 28080 - DNA, 101 bp, rice(Oryza sativa)
  misc_feature (71): n=a or c
tgcaaataatccctgttgtagttttgtaaacagttcttgtcatgtgtgcattatgactgaggacaatgacntggtgatgcatttgtttaaatatatttttt

SEQ ID NO: 28081 - DNA, 101 bp, rice(Oryza sativa)
  misc_feature (71): n=a or g
ctttatattagagtacggagggagtagtaagcaattaaaagagttaaattttgcgtacgcacgcacctccnctgccttcttcaaggcaggtctgaaatcgg

SEQ ID NO: 28082 - DNA, 101 bp, rice(Oryza sativa)
  misc_feature (71): n=t or g
cgatgtgttgaaaggggacatacaactacaggatagtcgaagaatttaattgagcggtcctgtggtgccgnatgaacggaaccacggaataccgactccgt

SEQ ID NO: 28083 - DNA, 101 bp, rice(Oryza sativa)
  misc_feature (71): n=a or g
gcatttcaccatgtctaatttcaagctcagcaaatttagttcatatagagttatacttccagatgtggcgntttcgctcacttccatattataatggttaa

SEQ ID NO: 28084 - DNA, 101 bp, rice(Oryza sativa)
  misc_feature (71): n=a or g
cattgacttatgcagcactgcttcgtctcccaagaacaatgacgaggcaagaaaaggaagaacgaacaatngacatcatatatgaacttggccttgaaagg

SEQ ID NO: 28085 - DNA, 101 bp, rice(Oryza sativa)
  misc_feature (71): n=t or c
ataagtaacatgaaacgaacttaattattcctttccatcgtgcattcgcattcgtggctaaggttgtgaantgtgatatgtgaatctggagcgtccacggc

SEQ ID NO: 28086 - DNA, 101 bp, rice(Oryza sativa)
  misc_feature (71): n=a or g
cgaattaaaaagtcaccttctcgtggctccaaaaattcagaaagcgacacaaaaacctcacgattttcctnaattcctgcaaaaaaaaaaaacagatgcac

SEQ ID NO: 28087 - DNA, 101 bp, rice(Oryza sativa)
  misc_feature (71): n=a or g
tttagctggaaagatggaaatggaatacttttgggtgcttatgtttctaaccctaagaaacattcaggggnaaaaaaaagaacagatagttgtacagatga

SEQ ID NO: 28088 - DNA, 101 bp, rice(Oryza sativa)
  misc_feature (71): n=t or g
atcttctccaaccagcaccaaatcccctgaattctaacatctccaaaaggaaactccaggaaacggtgtcnaatgccttagatatatccagcttgagcaag

SEQ ID NO: 28089 - DNA, 101 bp, rice(Oryza sativa)
  misc_feature (71): n=t or c
aaatttaatatattcaaaatacaaactagcagtgatactccctcggtatttacatatatgatgttgttgantttatttggtcaaacttttgaaactttgac

SEQ ID NO: 28090 - DNA, 101 bp, rice(Oryza sativa)
  misc_feature (71): n=a or g
ttaggttggcgaagatgttgtatctgagttgggcaaggccatggagaggcagggattagatatgaaaattncagcattggtaagttaatatatattaattt

SEQ ID NO: 28091 - DNA, 101 bp, rice(Oryza sativa)
  misc_feature (71): n=a or c
taaccaagtaaagcagaaatctcactgagctgcacttttacataaacacttgctaggatatggtcacttgncaacagaactcctactcttagtcatgagaa

SEQ ID NO: 28092 - DNA, 101 bp, rice(Oryza sativa)
  misc_feature (71): n=t or c
taattaatagatacaatcgcctccttaggactctatccttacgtagcaatcaccgtaaagcacaccaactnaactcgatgacgtataccgagtcatattgt

SEQ ID NO: 28093 - DNA, 101 bp, rice(Oryza sativa)
  misc_feature (71): n=a or g
actgtaaaacatgttaaaattcacttactagatcaatgtactccatgagaccttgttgtggatttatggcngtaatgagttcgaaaagtattatgccgaaa

SEQ ID NO: 28094 - DNA, 101 bp, rice(Oryza sativa)
  misc_feature (71): n=t or c
attttgctgatgctagtgatggacgagcatgctttctctgctgctacaagatgctgcagactaactagatnatccacaccattaggtataatcagatcaga

SEQ ID NO: 28095 - DNA, 101 bp, rice(Oryza sativa)
  misc_feature (71): n=a or c
tcctgtgctgaaatattaattgcaggttggcttatttggagaaaaggatagtatctacacgcaagaaggancaaacagtgttcgatggatggatatcaaca

SEQ ID NO: 28096 - DNA, 101 bp, rice(Oryza sativa)
  misc_feature (71): n=t or c
gtgaagacagacttgagcccttgagaatgataatagaagaggccaactcactgtagaatctgcttggcaangataatcccctcctacatacactgattttg

SEQ ID NO: 28097 - DNA, 101 bp, rice(Oryza sativa)
  misc_feature (71): n=t or c
gaggcacagaggatcattatcaactagcacagtatacgtgacagcatagcaaagacaacagatcatcaaantgtttatcgattcatcgtcctgcgcgcgac

SEQ ID NO: 28098 - DNA, 101 bp, rice(Oryza sativa)
  misc_feature (71): n=t or c
ctatcaccgtttttccggtttatttcttttttccctatcttttttttcgccctttttcgtcaggccaaacnctatttttccctatttcttgcggtttttat

SEQ ID NO: 28099 - DNA, 101 bp, rice(Oryza sativa)
  misc_feature (71): n=a or g
tgatcaatgttttgagcttatttctgtattttgaatgcagctgccggtacttcagcaggtcgtccaaaganctttaagaaggttcattcatgcccttttct

SEQ ID NO: 28100 - DNA, 101 bp, rice(Oryza sativa)
  misc_feature (71): n=t or c
ctcttgatggttctgatgggtggtacaaccgtcagcatcactatctggtttgataaaatcggcacagatgngtatttctgtggtagtacattgaaagcttt

SEQ ID NO: 28101 - DNA, 101 bp, rice(Oryza sativa)
  misc_feature (71): n=t or g
cttccacgtatctgctttaatttaaacatgtagttccaagggttcaattatttgcatggatacgttgttangataagttcacaaatactctgttatcgtat

SEQ ID NO: 28102 - DNA, 101 bp, rice(Oryza sativa)
  misc_feature (71): n=a or c
aactttcaggtttgaagcgtgattcagataataccatatacacgttaggaactccacaccatgttctaatnttttcttctttagacaaacaaacacacgca

SEQ ID NO: 28103 - DNA, 101 bp, rice(Oryza sativa)
  misc_feature (71): n=a or g
caatcctgaggatatgcatgttatccagatgagtagttccggtaaaaaaaaaaaagtacctcgaggtaccngaatctcacggtaccaaattgcttccgatc

SEQ ID NO: 28104 - DNA, 101 bp, rice(Oryza sativa)
  misc_feature (71): n=t or c
cttttcattctagagatgaaatggatagatgcatttctggtagtgatccacaaggggttattatctgaagntaccactgcagttgatcatattgttgctat

SEQ ID NO: 28105 - DNA, 101 bp, rice(Oryza sativa)
  misc_feature (71): n=a or g
acacatcaaagtagtgatagaactgacactgacactatagtgaaacacagcaacacatttgaatcacgacnatgataaattggggaagataacttggttgg

SEQ ID NO: 28106 - DNA, 101 bp, rice(Oryza sativa)
  misc_feature (71): n=a or g
cttttcacagagttccgttacgggcagttacctctgtggcacatatttggttcaaatgtcatttcttgacncctaagatgggcttgcgcagtcaatccctc

SEQ ID NO: 28107 - DNA, 101 bp, rice(Oryza sativa)
  misc_feature (71): n=a or g
caacgcatcccccaatttacaaaatcgtgcaaacgaaatcccttggcagtattatactccggttttggctnacgtggcaactatgtggctcctttgactag

SEQ ID NO: 28108 - DNA, 101 bp, rice(Oryza sativa)
  misc_feature (71): n=t or g
gcaactttaggataagggatattttacgttcctctgattcagctcatgctgacaagttatgaggaacaccnatgtcacgtccggagttttcctttacttag

SEQ ID NO: 28109 - DNA, 101 bp, rice(Oryza sativa)
  misc_feature (71): n=t or c
gtggtagggcatgagtagggaatcccatcgtcatggtcttcacaagtcttaggatgaacagtgatatgttnctgtgtttcaaaaatccgttcttcaggatc

SEQ ID NO: 28110 - DNA, 101 bp, rice(Oryza sativa)
  misc_feature (71): n=a or g
atgggtcatatttcatcgtaagtttagttattttgatacggaaagagtgtacatgtaatggattgcaagtntaatatatgcatgagaatattataccatat

SEQ ID NO: 28111 - DNA, 101 bp, rice(Oryza sativa)
  misc_feature (71): n=t or c
tcaaacaaaagaaggaaccatgggaagaacccgaaacgacgagataaacctaaaaactaccaatgatttanagatatgggagtagggtcgacccctctctg

SEQ ID NO: 28112 - DNA, 101 bp, rice(Oryza sativa)
  misc_feature (71): n=t or c
gtgatgagcaactagcagatcttgcgtttcgagggttgtcagcgcctatcaaagatagattctttttccangagtttgacagcctggctcatctaatacag

SEQ ID NO: 28113 - DNA, 101 bp, rice(Oryza sativa)
  misc_feature (71): n=a or g
caattgtcagtacaggccagctccttgtttgagtgcttgtgagttgaccttgtggttgcataatgatgatnagtgcttgtgagttgaccttgtggttgcat

SEQ ID NO: 28114 - DNA, 101 bp, rice(Oryza sativa)
  misc_feature (71): n=t or c
attgcaaattctcaaaaaaaatcatcacaaattctcaaaaaataaattcttcccccgcatgttgcatggcngcatcgtcaccatcaagctcccgtcgctcc

SEQ ID NO: 28115 - DNA, 101 bp, rice(Oryza sativa)
  misc_feature (71): n=a or g
ctcatacacactttgctgctcatcgctgatcgatcacatgatgagaagaatccggacaagaataactactngtagatcatagtgcagttgcagagattggg

SEQ ID NO: 28116 - DNA, 101 bp, rice(Oryza sativa)
  misc_feature (71): n=a or g
ttttttttttcatctctaatggtcctgtgacaatagccagattctgcaactcatgaaaacctcgaattgcnaggtcctcgatttgcgcacctgttcagtta

SEQ ID NO: 28117 - DNA, 101 bp, rice(Oryza sativa)
  misc_feature (71): n=a or c
ggcgtgtgcaggcatgtgacctttttactcctacagtgcttctactgtgtactcgccgaaacggcccgaantgaaaaaactaatttcataactcgcctgta

SEQ ID NO: 28118 - DNA, 101 bp, rice(Oryza sativa)
  misc_feature (71): n=t or g
gcagcgttttctttggctgtctgcactgcacttcactgcagtggagtagaagtaggagtatgtgcaaattncatatactagagcagtgttggtagtggtcc

SEQ ID NO: 28119 - DNA, 101 bp, rice(Oryza sativa)
  misc_feature (71): n=a or g
agcaacttgatatcctcttcctcgtcaagtgactttatgtagtccagggtttcaacattgaaaggctggcntgcttggggccagtaaagccaatcaaatgt

SEQ ID NO: 28120 - DNA, 101 bp, rice(Oryza sativa)
  misc_feature (71): n=t or c
tcccttcatgtttctactatgagcaatgctccgatgctttttattgttagtattatactatcagtagaagngatcaggataaattagtaatttacaaatac

SEQ ID NO: 28121 - DNA, 101 bp, rice(Oryza sativa)
  misc_feature (71): n=t or c
acccatttactttgggactgatcggaagagggcatatctttaatatatgttttccttttgtagtgaaggtnaaaaatggtacgtgagtgatacattaccta

SEQ ID NO: 28122 - DNA, 101 bp, rice(Oryza sativa)
  misc_feature (71): n=t or c
gttgatatatttttctctcaattttctaaatatacaaaacccacggtaatccagtacgaaagtacgcccangagatcctaccaatcacgggatgagtcccc

SEQ ID NO: 28123 - DNA, 101 bp, rice(Oryza sativa)
  misc_feature (71): n=t or c
ccatcgactcaagtctcaagtctcaagtgatctttttagctagctaattaattttttttagataatactcnctccatctatttttgatagtcatatttcta

SEQ ID NO: 28124 - DNA, 101 bp, rice(Oryza sativa)
  misc_feature (71): n=a or g
gggcaccaaaaaccctgatatgaaccgaaacaccctgtgataaactcaataaagagttattcacggcatcnactagagtccttatcaataattggaaaaag

SEQ ID NO: 28125 - DNA, 101 bp, rice(Oryza sativa)
  misc_feature (71): n=a or g
acggtccgaggagaacagcttgcaggaagaaagtatgagctttaaggaacaccaagtgtgaaaggagtacntgtggttgaccaaaaacagggagaatacat

SEQ ID NO: 28126 - DNA, 101 bp, rice(Oryza sativa)
  misc_feature (71): n=t or c
acaaggatgctagtgaggtgagcagtaatgaacaaccaaatgactcgcctgtttacacccaaatttggcanctatgatcgaaataggggaaaattgccaaa

SEQ ID NO: 28127 - DNA, 101 bp, rice(Oryza sativa)
  misc_feature (71): n=t or c
gacgttgcaaccagggtttgctttacagaccgccaggaaatggcagtattaccacaaagaaatataaaccnagtctgggatatggcattatgaggatcaga

SEQ ID NO: 28128 - DNA, 101 bp, rice(Oryza sativa)
  misc_feature (71): n=a or g
ctccattcgggagcatgtggctctgggagccatggggaaacagtgcggaaggtggcgcaaaggccgggacngcgagtagcggcttcactggagtgacggtc

SEQ ID NO: 28129 - DNA, 101 bp, rice(Oryza sativa)
  misc_feature (71): n=t or g
aaattctcaattagtaccacttaattactccagtcctttcatgccaccaagtcctgtaacaatggcaaatnaattgtgtttttgtgcccccatcaccagaa

SEQ ID NO: 28130 - DNA, 101 bp, rice(Oryza sativa)
  misc_feature (71): n=a or g
acgaatccacatgaagcgagtcatatcatccacgagaagcagaaaatacttcttacccctccgtgtcgccngtgcaatgggaccacacagatcgccatgca

SEQ ID NO: 28131 - DNA, 101 bp, rice(Oryza sativa)
  misc_feature (71): n=t or c
gcctcaggagattcccgtctttcagaatagcacattctctgttcctgtaaatgatccgcaccaggtagagngaatgattgtggttatattatttactgaat

SEQ ID NO: 28132 - DNA, 101 bp, rice(Oryza sativa)
  misc_feature (71): n=a or g
gttaatgatccatgcattgatgtagatgtgctgtttcgcgatgttgatgagtgcaaatcagcagtaacctnccatgcaatcttaaatgattatgctttcca

SEQ ID NO: 28133 - DNA, 101 bp, rice(Oryza sativa)
  misc_feature (71): n=t or c
gtggaaaaaatggagagaaattgaattgtggtctaccctctcttcttctgaagatagaagcgggcaatatnaggtggaatccggtcttcattcttcacgtg

SEQ ID NO: 28134 - DNA, 101 bp, rice(Oryza sativa)
  misc_feature (71): n=a or c
tatcatgatgacggtgcttcactttgctccaaacatcacgacatattcaagtgtccgtttgataaatccanacaaacaacattgctccaattcgctgagaa

SEQ ID NO: 28135 - DNA, 101 bp, rice(Oryza sativa)
  misc_feature (71): n=t or c
gaaggggcctccggagcgtctcctgcggcaacctcaaccgatgttgttgtcgcgccaaggagccgtgaagngacgccaagcggtctgtccagtgccctcgg

SEQ ID NO: 28136 - DNA, 101 bp, rice(Oryza sativa)
  misc_feature (71): n=t or g
agaagttctggattaaatatgggtaagaagatgcaagtaacctacccacagtggacagtcatagactcacnaatgtcaaaagatttatttctctgctccag

SEQ ID NO: 28137 - DNA, 101 bp, rice(Oryza sativa)
  misc_feature (71): n=t or c
agtgaaatgagagaaatgggaacaaaccatcatttctgcctctagttcactggtatccgacgatgtaacangattaatgtcagcagaagtcttcctgatgt

SEQ ID NO: 28138 - DNA, 101 bp, rice(Oryza sativa)
  misc_feature (71): n=a or g
cactttctggacttctaaacttttaaacatacatatactgaggtacaaggaaatgaccattaatcgaggtntttcttcatcgatgaatgatcatatatcct

SEQ ID NO: 28139 - DNA, 101 bp, rice(Oryza sativa)
  misc_feature (71): n=t or g
ttgttatatcttcaaagttaccaagattgtcagacatgtataccctcacaatagcaagtgcagatccacantctaaatcttccagtgaaccagtccatttc

SEQ ID NO: 28140 - DNA, 101 bp, rice(Oryza sativa)
  misc_feature (71): n=a or g
tgttggaactgacatcgtgagagtttatgtccgccaccaattgcctttccatggcatgtagcgcattcttnttgtgcaacgtcagcgtcatatcgttttcg

SEQ ID NO: 28141 - DNA, 101 bp, rice(Oryza sativa)
  misc_feature (71): n=t or c
gattcggaaccaactccagaggatctacacccaatgaaagggcatacaatagtggttgcagagttcaaatnttcatagtagcgaatttcagattgggttaa

SEQ ID NO: 28142 - DNA, 101 bp, rice(Oryza sativa)
  misc_feature (71): n=a or g
tgagggggtgttgggcgatagcaagtcattcaaaattaggtcaagtgaagcatccagtgacacatggatcntctcgcacacaaagagatcgctaaaatata

SEQ ID NO: 28143 - DNA, 101 bp, rice(Oryza sativa)
  misc_feature (71): n=t or g
tccatatattccaaaggagtcgtaagggttttagaggaatttcgctgggattaaattatttcttgcaaaantcccacaaaatcaaagtatttcaaacagga

SEQ ID NO: 28144 - DNA, 101 bp, rice(Oryza sativa)
  misc_feature (71): n=t or g
cagatcacgtttgctttaattccagagacagtggaggcgacatttgaggttaaagtcgttgatgggtcatnggatccttccctacgcccacatttctttgc

SEQ ID NO: 28145 - DNA, 101 bp, rice(Oryza sativa)
  misc_feature (71): n=a or g
gtccacctgaacatccctgcatccaaggcatgggagatgttcaccaacaatgagaccctgggcaagatcanccccgaaatgctgtcgggcgccgagtacct

SEQ ID NO: 28146 - DNA, 101 bp, rice(Oryza sativa)
  misc_feature (71): n=a or g
aaactcttgtcctgtacagacgaaactcaaaactccatggttgttgaaaggtgtgggagatgcaaactgcnaagtgttaaaattgtgaataaagggatcaa

SEQ ID NO: 28147 - DNA, 101 bp, rice(Oryza sativa)
  misc_feature (71): n=a or g
tgcaatattgtcgtgttccctcacccaaacctagaactgtagaaattaactcaagaggcaacgggtggccnccaatcacagttagcatcacctagtaataa

SEQ ID NO: 28148 - DNA, 101 bp, rice(Oryza sativa)
  misc_feature (71): n=a or g
tatatgtaatccgtggattaattaagttggcctgcctacttagctgataaatatatgtatgtgtgtgtgtntatatatgttcatgttatttcctttcttca

SEQ ID NO: 28149 - DNA, 101 bp, rice(Oryza sativa)
  misc_feature (71): n=a or g
aaccccttcgattcaaagaaaaggagagggaaaagcgaatcgaatcaaatcaaaagaaaagggtaggaggnggtgggggaggcagtagtacgcacacttct

SEQ ID NO: 28150 - DNA, 101 bp, rice(Oryza sativa)
  misc_feature (71): n=a or g
ggagatcttaattatcgtattgacatgccggatgctgaaattcgagatttagtatctatgaagagatgggntgatctcttgaagtctgatcaggtttgaca

SEQ ID NO: 28151 - DNA, 101 bp, rice(Oryza sativa)
  misc_feature (71): n=a or c
gacgaggtggaggaggctaggcgattcaaaatattcaagtcagttgcaagattttctgatgcagccaacgntgattctgccaacgcagggcactcgacccg

SEQ ID NO: 28152 - DNA, 101 bp, rice(Oryza sativa)
  misc_feature (71): n=t or c
caagatcgccagagattccacggacggacccaaggtgagcaagctcgatccatccccatcaatgcctgctnggttcgatctcgctacttctggattgcgcc

SEQ ID NO: 28153 - DNA, 101 bp, rice(Oryza sativa)
  misc_feature (71): n=t or c
tacatagttgcttgagtatagttggtcacattttggcagctctggtggcagcttgtctacgaacagtgtgngcacaacagaaggcttgcgacgatcatgtt

SEQ ID NO: 28154 - DNA, 101 bp, rice(Oryza sativa)
  misc_feature (71): n=t or g
ttgtcatatgttaggggtggcttgtctacagttccttacacaaaaaaggctatgagcaattatagagattntgttagaagagaaagtgggaaaaatgacat

SEQ ID NO: 28155 - DNA, 101 bp, rice(Oryza sativa)
  misc_feature (71): n=a or g
ttgaaggggatatatccgccattgtagagggaatgctgacagcgagaactggactagtcatgtgcaacccntgttgagtgggcaaagaggatgcggctctt

SEQ ID NO: 28156 - DNA, 101 bp, rice(Oryza sativa)
  misc_feature (71): n=a or g
ctttctcccaacttctactagaccctcttcatctattataggatgaaattgaacatgatctgcaatatcgntatatgtttgattcctgtatgattagaaat

SEQ ID NO: 28157 - DNA, 101 bp, rice(Oryza sativa)
  misc_feature (71): n=a or g
ctgcaaaggaccctgttgaggagaccctcgtgaatgacacggccaaagataagtctgaagtgcctagagtnctcagaagccacgactccaagaaaaaggat

SEQ ID NO: 28158 - DNA, 101 bp, rice(Oryza sativa)
  misc_feature (71): n=a or c
gcaatcaataataaccgtatagttacaacgtggcttgataggacaattatgcatacatgtatatataaatnttttttaaaaaaaatataatgtactccctt

SEQ ID NO: 28159 - DNA, 101 bp, rice(Oryza sativa)
  misc_feature (71): n=t or c
atggcaactcaatgaccaaactttttgcccccaacaattcagagaaggggattgcattaacatgcatctgnacataggcttttgctttgcatctaaatatg

SEQ ID NO: 28160 - DNA, 101 bp, rice(Oryza sativa)
  misc_feature (71): n=a or g
agtactcaacaatcgttatgtcttcttctcagagcatgggtactacacaagattaaccgaaaagagcgacntctacagctacggagtagtgctacttgagc

SEQ ID NO: 28161 - DNA, 101 bp, rice(Oryza sativa)
  misc_feature (71): n=a or g
tcttgtcaaacaggttttttatggattagagtatgcacatgcattggatgatcttaaagcagtagttgcgnaattatacaaatcacattctcgcagtgttg

SEQ ID NO: 28162 - DNA, 101 bp, rice(Oryza sativa)
  misc_feature (71): n=t or c
atggtgcacgatgctcaagcgtcagccagggtgattgtccagaactacttggagcgaaggggattgactgnggctcttgccaatgaagatgactccaacga

SEQ ID NO: 28163 - DNA, 101 bp, rice(Oryza sativa)
  misc_feature (71): n=t or c
tgtaaaaatgagaataaaatattttcccttgtttctgtcaatccttgaattcatgatcttttgaacaaatnattcttatgttcaaggcactaaccaactca

SEQ ID NO: 28164 - DNA, 101 bp, rice(Oryza sativa)
  misc_feature (71): n=t or c
taaacaagatgagaattccatgaatgaatatttgatagaactgtgattattaactgacatcgttgagcttnagttcagttttttcctacctgtttgaggat

SEQ ID NO: 28165 - DNA, 101 bp, rice(Oryza sativa)
  misc_feature (71): n=t or c
tttgctgtccacgatttccagtgtcctgagcaacttttgcctgggtgtattctgtgtttccaaatttacanctgccgaactataggataaatatgtttcta

SEQ ID NO: 28166 - DNA, 101 bp, rice(Oryza sativa)
  misc_feature (71): n=t or c
ggagctggtggtggtacacgtacggtaagcacacaggctttacgagttgaatttgtgagcgtacaatcgcnaaggttgggccgagttgttgggtggtggca

SEQ ID NO: 28167 - DNA, 101 bp, rice(Oryza sativa)
  misc_feature (71): n=t or c
aaaaggcagattacgtactatgttaagaattggaagtagaactgattgcttgttgattgactaattgcatngggcccatctttttttgcaatatcaaacac

SEQ ID NO: 28168 - DNA, 101 bp, rice(Oryza sativa)
  misc_feature (71): n=a or g
caggtacaacttctttaaccattttgcttgccctgtggcctcataactagctacaaactcggcatacatcntcgatgatatgctatgacggtttgcttgga

SEQ ID NO: 28169 - DNA, 101 bp, rice(Oryza sativa)
  misc_feature (71): n=t or c
acagcctacaatccttcaaggatgataaaccgtagacatcctcttcactgatcaaatcagacaaagacaancaatccaatcagcttaataaccccaaaatt

SEQ ID NO: 28170 - DNA, 101 bp, rice(Oryza sativa)
  misc_feature (71): n=a or g
gacacggaagttgtagtggtgataggttgatccaaactcgtcggtgcttatccttatatatatctctgtcnaatccgaagtctaagttaccatgggcactt

SEQ ID NO: 28171 - DNA, 101 bp, rice(Oryza sativa)
  misc_feature (71): n=t or g
catgtgcttttttttccgggaggcaaggttgggccaaacacagctcagaacaactctaaaataaactaatnatctgtcatatttaaaacatagtacatata

SEQ ID NO: 28172 - DNA, 101 bp, rice(Oryza sativa)
  misc_feature (71): n=t or c
accaaaagcaaaaggagaaattaagaacgtggctttaactaagcacaaagattcagaaaatccttactgcnaactcaaatcttgggcgccttcttgcgacg

SEQ ID NO: 28173 - DNA, 101 bp, rice(Oryza sativa)
  misc_feature (71): n=a or c
caatcagcaatcgcacagtctccatcctcgtcactggggcaaatacttcatcaaaatcaactccttgttgntggacatatccctttgccaccaatcgagct

SEQ ID NO: 28174 - DNA, 101 bp, rice(Oryza sativa)
  misc_feature (71): n=t or c
gactctgcccgccctgccgtttagcctcatcggccttagatgatgtgttagtttatattgttgttgaaganatgtatgaaattgtgtagcttggatgaccc

SEQ ID NO: 28175 - DNA, 101 bp, rice(Oryza sativa)
  misc_feature (71): n=a or g
attgagaggtgagagggtaaggttgtcttttcgcattagcgattgttggagtcaatgcaagctagcgactngacctgttgccgccaccgttccagccccgt

SEQ ID NO: 28176 - DNA, 101 bp, rice(Oryza sativa)
  misc_feature (71): n=a or g
tgctgctggagcgcagtaagtcctagattcaaaggggaaatgacaaggccgtaaacgacttgtgccaaacngtgtcactgtttagagaaaatagaactgaa

SEQ ID NO: 28177 - DNA, 101 bp, rice(Oryza sativa)
  misc_feature (71): n=t or c
aaaggaaatggcaagtggcaagccaactatcttttccttggatgatgatggtgttgttgttcatgggaagnaattgtttgtccccgacactcaacatcttc

SEQ ID NO: 28178 - DNA, 101 bp, rice(Oryza sativa)
  misc_feature (71): n=t or c
aggaccaccgcacacagcttcctgtggataaggatatgtagggcttttgctgatccactgatgcatgaggncaagaatacagaatctaccgagtcctgggc

SEQ ID NO: 28179 - DNA, 101 bp, rice(Oryza sativa)
  misc_feature (71): n=t or c
ctctccgaggtgcattaaaaataatgaagtcctctcctccagcatcatgatccactcgatctcctctctcnctctcctctcaccctcatccaagtctgcat

SEQ ID NO: 28180 - DNA, 101 bp, rice(Oryza sativa)
  misc_feature (71): n=a or c
ggagccatattgctgtttgggttgaagtatccggaaacgcatgccatttccaatcacaggagtgatcatgncgagacagaaaacagctattggcatcgcgg

SEQ ID NO: 28181 - DNA, 101 bp, rice(Oryza sativa)
  misc_feature (71): n=t or c
tatttaatattatgaattatgtgcttgaaatcgactaccatgtttttaatttttatttagctagcctgtanctggcatgtattaagtatatttagattatt

SEQ ID NO: 28182 - DNA, 101 bp, rice(Oryza sativa)
  misc_feature (71): n=a or g
aatgccttcgaaatttcttatcatcaaatttgcaaacataagttatataccaattcttgcagcagcgtgcnggaaatcatctagttatatataattgtctt

SEQ ID NO: 28183 - DNA, 101 bp, rice(Oryza sativa)
  misc_feature (71): n=a or g
tggaagagggaaaaggtagctagctaggtcaattaatccttttcttgggcatggaggaacaagtagcagcngtgatggtggtgatggtgaacaaatccgcg

SEQ ID NO: 28184 - DNA, 101 bp, rice(Oryza sativa)
  misc_feature (71): n=t or c
gtggcgcatcctcgtatcggctgaggacgcaggaacctactgtttggacgtggccagcaacatgtggagtngagtgggcgagtggacgctacccttcttgg

SEQ ID NO: 28185 - DNA, 101 bp, rice(Oryza sativa)
  misc_feature (71): n=t or c
gcttatttaacttgtcatgatcttcgcttgtgactgcatttgttgccttttgtttctctattattgcacgnatatcctcaatttgttagtagttttagtgg

SEQ ID NO: 28186 - DNA, 101 bp, rice(Oryza sativa)
  misc_feature (71): n=a or g
gatagcaggttcataggcttacggattatggatcagcgcgagtatggttttcaagctcctaaatgatacgnttttttcaatacctttattcattaacattt

SEQ ID NO: 28187 - DNA, 101 bp, rice(Oryza sativa)
  misc_feature (71): n=t or c
ttttcaactatgtaacttgttgcgagaaagagaacttttgcgggacatcatccatagctcagtggaagaanaagttgccatgttcctccttgttgtaggcc

SEQ ID NO: 28188 - DNA, 101 bp, rice(Oryza sativa)
  misc_feature (71): n=t or c
aggtgacacacagctcaatccaaatgtctagatcagagctttcaccctagagtcattgatgcttgtacttnatgtctccgtgtggctaaagcgagcacata

SEQ ID NO: 28189 - DNA, 101 bp, rice(Oryza sativa)
  misc_feature (71): n=a or c
ttttcataggcataccacatttctgtatcgtttgggaaaccatcatagaaatgcttgaaccaatgctcaangggttcagctgataggttggagccagcaaa

SEQ ID NO: 28190 - DNA, 101 bp, rice(Oryza sativa)
  misc_feature (71): n=a or c
caattttattttgttttaaataaatcaatgggccccactgtcagtttcaccctctctacctctccctatcntatctctttccccaatccccctctctcttc

SEQ ID NO: 28191 - DNA, 101 bp, rice(Oryza sativa)
  misc_feature (71): n=t or g
aacatctgcttgctgtgccacagatttgagatcactcctgttagcattctctactaggcatccagcaaccngtcccatgaggtccctcaaatacctttgtt

SEQ ID NO: 28192 - DNA, 101 bp, rice(Oryza sativa)
  misc_feature (71): n=a or g
ccgttcgtttattgttattataggaagcccatggaggcagcttgatggcatattttggcatgaaaaatacngaggatgtgttggctagccacttctattgc

SEQ ID NO: 28193 - DNA, 101 bp, rice(Oryza sativa)
  misc_feature (71): n=a or c
actgacagtgtgcaccaatcagaccggacaatggtggccgtcagagtacttgatagaataggtgtcaaatntactagtcctatttagttacagttggactt

SEQ ID NO: 28194 - DNA, 101 bp, rice(Oryza sativa)
  misc_feature (71): n=a or c
actaggggtagtgatagatgtaccactatcaagcccttccttagtgggtatgctcacaactgatctaactntgggatttccattcacataattcacccctg

SEQ ID NO: 28195 - DNA, 101 bp, rice(Oryza sativa)
  misc_feature (71): n=t or c
attcctttatattgccgccacgccatactccgttagcactgcaatagtcgtcgagagagagaaagttcaangaccggtatattatgtcagcgaagctctcc

SEQ ID NO: 28196 - DNA, 101 bp, rice(Oryza sativa)
  misc_feature (71): n=a or g
catcctacttaaacctcaccaatgaaaaaagaaaaaaaacacaaagttttagcataccggtggagatgccncagctgaggacgcagaccttgtcgagcggc

SEQ ID NO: 28197 - DNA, 101 bp, rice(Oryza sativa)
  misc_feature (71): n=t or c
atgtttccactcagatttagaccatgcgtaccttgaacaagagctttctgcgcctctttcataagcttgtngtatatgctctgccaggagtgacaatcact

SEQ ID NO: 28198 - DNA, 101 bp, rice(Oryza sativa)
  misc_feature (71): n=t or c
gatgaaagaaggtgatgatgatgaggagatttcagctagctaaggatcacattgacgagaatggtgacgangagaattcagcatatttggaccaagaggtg

SEQ ID NO: 28199 - DNA, 101 bp, rice(Oryza sativa)
  misc_feature (71): n=t or c
acaagtatatacattagagattcgaaataattctcagaatggacttaatgtgccggatgcaagccttgtcngtgtcgcatcaacaatggacgtgatggaat

SEQ ID NO: 28200 - DNA, 101 bp, rice(Oryza sativa)
  misc_feature (71): n=t or c
cgggctggcccgaaggcacgataacctatttgcttctctatagaaaaagtctacggctcccatcggatggnctaatcagccaaagaaaaagccaaaatttg

SEQ ID NO: 28201 - DNA, 101 bp, rice(Oryza sativa)
  misc_feature (71): n=a or c
ttaagttcatgtccaaaatgatggccccaatgagaagtgctagtatagcaaaggtgacaccagtaagcccnatatgtacatactacaagaatccgtagttt

SEQ ID NO: 28202 - DNA, 101 bp, rice(Oryza sativa)
  misc_feature (71): n=a or g
cgaatacctacttcaagaatattaaagaagccggaagcatgggggcaagtttagcgctagcaatgaccaantccttgtaccctaagatcaatattgatgcc

SEQ ID NO: 28203 - DNA, 101 bp, rice(Oryza sativa)
  misc_feature (71): n=a or c
ttccccgtttggagagtgcttcttttagagtctcttaaaggcgtgcccatgtatgaggaagagcctggagnaaattccttgttattctcaatataagaact

SEQ ID NO: 28204 - DNA, 101 bp, rice(Oryza sativa)
  misc_feature (71): n=t or g
tcaaacggattcggcgcccctggaatactgaatacacacctgccgaatggaacctgaacgtctgactttgngcagtctgcatgcagagtgcgtggcctcag

SEQ ID NO: 28205 - DNA, 101 bp, rice(Oryza sativa)
  misc_feature (71): n=a or g
tgcattctgctagctgctccgtgtctccctcgttgcatggtaagctagcatgtcgccgttcaagccgatcnagcagtgctcgacggaggggcggtcgcagc

SEQ ID NO: 28206 - DNA, 101 bp, rice(Oryza sativa)
  misc_feature (71): n=a or c
aaggacgacgacggggtcgtccgatattttttttccaagaggcgaccttctgtggttatatcaatcggctncttgcaacccatcgttgtggctagtactgt

SEQ ID NO: 28207 - DNA, 101 bp, rice(Oryza sativa)
  misc_feature (71): n=t or c
ttgccccagcaaaattggggttgttaacaagcaaatctgtacctgcccagtgcctttttcgcctacaaagnaatgtattttgtttcgattacagaaatgtg

SEQ ID NO: 28208 - DNA, 101 bp, rice(Oryza sativa)
  misc_feature (71): n=a or g
tagattttaatactgcatagagtaaatatgagagacatctgaaccttgcccaaagagtgggaaggttagtntagtagagttggtataagatgaaatgagag

SEQ ID NO: 28209 - DNA, 101 bp, rice(Oryza sativa)
  misc_feature (71): n=a or c
tttaaaatctgttttcgctcttgatgtagcaacctgttgataattacaaagctgtcctcaacagctatgtnactgaaaattgtgaaattggaccaactgac

SEQ ID NO: 28210 - DNA, 101 bp, rice(Oryza sativa)
  misc_feature (71): n=a or g
ttgatatattttttttgttgttaccaagcctaatatgcaactacaggtcttgatacctcgtggataccagnccaggtaccaccaaccttagaaccatgggt

SEQ ID NO: 28211 - DNA, 101 bp, rice(Oryza sativa)
  misc_feature (71): n=a or g
tcttctcgaattgtagtatattggcacctccaccataaaatccttcctcaacattgttctcattctcatcncatcatcatcactttcaacaccaaggcaac

SEQ ID NO: 28212 - DNA, 101 bp, rice(Oryza sativa)
  misc_feature (71): n=a or g
ataatcagcttgattagttaataatcagcttgattagttaggttttacgatgacggcaacagggacagatntgacggccgccctacaagcgctgctcgacc

SEQ ID NO: 28213 - DNA, 101 bp, rice(Oryza sativa)
  misc_feature (71): n=a or g
cctgcatcatctctctgctcactcatcaaagcaattgaactcagcgtcgccttcaggatgcccaaaagacntcgggaaactcgaggtcttcaccctcatgc

SEQ ID NO: 28214 - DNA, 101 bp, rice(Oryza sativa)
  misc_feature (71): n=a or g
aaacttcaccttggaagaataagcatcctcaggattcacgttgcaccatcctggcttactcttgtttgtcntgaatacatccggatcaggtgttttccagt

SEQ ID NO: 28215 - DNA, 101 bp, rice(Oryza sativa)
  misc_feature (71): n=a or g
cgcactgctcaaaagaaagcgcaagacatgcgtagtgcagtttctgtgagtgaagatcaatgtggagtganagcaaccaagaaagcatcatacttgaggag

SEQ ID NO: 28216 - DNA, 101 bp, rice(Oryza sativa)
  misc_feature (71): n=t or c
ccatcacacaaaagcatcatctatctatctaaccagagtgataaaatggaggtgcaggtgaagaggagttnggtcgtgccgccgccgccgcgcgagacgga

SEQ ID NO: 28217 - DNA, 101 bp, rice(Oryza sativa)
  misc_feature (71): n=a or c
aggttgatcaacatgttggactggactgatggaaaccatcatacaaccgtgggaaaaaaacaaaaagaaangagaaaccgtgagctgcccgcggcgccctc

SEQ ID NO: 28218 - DNA, 101 bp, rice(Oryza sativa)
  misc_feature (71): n=t or c
acaaccagttaagtggaaagataccagcaagcttattccaacttcataaccttatccaaataaatctttcntgtaattccattgtcggtgctctgccagcc

SEQ ID NO: 28219 - DNA, 101 bp, rice(Oryza sativa)
  misc_feature (71): n=a or g
gaacgcgccagctcttgagaagataaccgtgaagtttgacccctcttacatatttgaaaccccaaaagaanccaggaataagatagattttggcatgcctg

SEQ ID NO: 28220 - DNA, 101 bp, rice(Oryza sativa)
  misc_feature (71): n=t or g
ctataattgaagtacaaggactcagaaaatagcgctgaaaggtactcatgatatccttatactctgcgttncttcaataattaatgtttgctgctgtttta

SEQ ID NO: 28221 - DNA, 101 bp, rice(Oryza sativa)
  misc_feature (71): n=a or g
tatgtaaatctgaaagccatgcatccatgaaatggtagtgcaatactacctttcatgattcctgggccatngagccatagctcccctgagaagcctggagg

SEQ ID NO: 28222 - DNA, 101 bp, rice(Oryza sativa)
  misc_feature (71): n=t or c
tgctaatttttttccaattacttaagagcttaataaatgatcgtagttgatctacacacagctagcaactnggattttggcacctaagaagctttcctctc

SEQ ID NO: 28223 - DNA, 101 bp, rice(Oryza sativa)
  misc_feature (71): n=a or c
ccatttggaaaaatgatttctgtacttaggaaaatgtatagagaggtccccaattaagctaggcaacagangacagtttttggtcggcggcttgtaaaaat

SEQ ID NO: 28224 - DNA, 101 bp, rice(Oryza sativa)
  misc_feature (71): n=t or c
catctcctcttcaaccctcaaccatgcagacgctttttcctctgtctccttccgttgaaccgttcaaaccntagaacaagaacgaagcgaagggagagaag

SEQ ID NO: 28225 - DNA, 101 bp, rice(Oryza sativa)
  misc_feature (71): n=t or c
ctagttattgaccggctccaccaatacatcagagagctacgtgggctaaagaagaatgttgaggccgtaantaagcataataaaatgttggaggaagcaaa

SEQ ID NO: 28226 - DNA, 101 bp, rice(Oryza sativa)
  misc_feature (71): n=t or c
taggattataggtcaactcagtagtcatgatatgtacaaaaggacggtgctagcagatgattcagagattnagattgaaaaatccgtaggctatacggatt

SEQ ID NO: 28227 - DNA, 101 bp, rice(Oryza sativa)
  misc_feature (71): n=a or g
tagctatactattaaacttgctctaaggatcacaaaagatctctacatatgtacaataatgtgactcaccnttaatcaacacttatcaagtttggttattg

SEQ ID NO: 28228 - DNA, 101 bp, rice(Oryza sativa)
  misc_feature (71): n=t or c
tcaaccttgacggctctgaccatcatgttgctttcgtaatccattgccggatcatatccaaatgaagcatnttcagatccacgctctggcatcaattcatc

SEQ ID NO: 28229 - DNA, 101 bp, rice(Oryza sativa)
  misc_feature (71): n=t or c
ttgtcaccaacttcgcctacaaacgccaaggcctcatcaatgactctatacttcttcccctgatgttcagntagcctcatggcaaggactagtcggctctg

SEQ ID NO: 28230 - DNA, 101 bp, rice(Oryza sativa)
  misc_feature (71): n=a or g
cgtctcgtctcccaatcaatcaattgctgatcgtctgacttatataagagggagaggagaggaggagtgtngagtgtggagtctctgataataagtgtcga

SEQ ID NO: 28231 - DNA, 101 bp, rice(Oryza sativa)
  misc_feature (71): n=a or g
tgcctatgccatggacccacaagaagctgctaagtcacttgtttctcttctagaggaagctgaaaaagtanttcctgtggaattacgtgagcaaactcctg

SEQ ID NO: 28232 - DNA, 101 bp, rice(Oryza sativa)
  misc_feature (71): n=a or g
cgcacgtgctctggtgtctcttcctacgacaatggatggctcatgggcagtaacatgaccgggacatattncgactaatttgcgagactaatcttttaaac

SEQ ID NO: 28233 - DNA, 101 bp, rice(Oryza sativa)
  misc_feature (71): n=t or g
gaatgtaatgattttatagcttcaaggcaggtctccgaacacaggtcgaggaaagggaacggccagccgcngcggcggcggagcactccgacttcggcgtc

SEQ ID NO: 28234 - DNA, 101 bp, rice(Oryza sativa)
  misc_feature (71): n=a or g
gcatgcaaaattacttactacaaattgaacacacaattaacacatgcacacctaccaagttcatagttggnaaactaaattaaactaatcacggaaacaca

SEQ ID NO: 28235 - DNA, 101 bp, rice(Oryza sativa)
  misc_feature (71): n=t or c
tgtatgacaagtaaagtgagagaaatacagtactagctagtacaccaacagaaacactaggccatctttgncatgacctcctggaggatgatcttggtgtc

SEQ ID NO: 28236 - DNA, 101 bp, rice(Oryza sativa)
  misc_feature (71): n=t or g
gggagttatttcatggaaaagctcaaaaccgatgctcattgcatcgtcaacaatgcaaacggaatttgtgncatgcaatcatgcaacagggcaagctgtat

SEQ ID NO: 28237 - DNA, 101 bp, rice(Oryza sativa)
  misc_feature (71): n=a or g
gcatgtgctcattatctgtctcctgttctttgtataatcataaagttgacccttgaatgggatcaagattnccgtctatagacgcaatgttaaatggtaca

SEQ ID NO: 28238 - DNA, 101 bp, rice(Oryza sativa)
  misc_feature (71): n=t or c
tccactagggcattgggaagtcgcacacctaaatattccatcaacttccaggctccagcaactaacaactnaaaaaaatagggaccaaattgacaattttt

SEQ ID NO: 28239 - DNA, 101 bp, rice(Oryza sativa)
  misc_feature (71): n=a or c
tgactgctatggagccagaaatctggcgtaggaatatagtaaaaccgctttttttatttggtggaaggttnggtgggatgcaatcttttaatagatttaat

SEQ ID NO: 28240 - DNA, 101 bp, rice(Oryza sativa)
  misc_feature (71): n=a or g
tctcaaatgacccgagacaatcaaatggtttgctactattcagattcgttgtgtatcacattcttatctgnattgttttttttttcttttttgatgaaggg

SEQ ID NO: 28241 - DNA, 101 bp, rice(Oryza sativa)
  misc_feature (71): n=a or c
cagcactagttttgatgggctcgtcttttctgatgagcagattcagatgtttatgacatatatactgtcanggaggtggatgatgatacaacaatggaggg

SEQ ID NO: 28242 - DNA, 101 bp, rice(Oryza sativa)
  misc_feature (71): n=t or c
agtgctggctagctagttaataatgattccactaactatatagccaatgtgctgccaccagctagctaagntcatccgatcagtaaccccaatgtaagcta

SEQ ID NO: 28243 - DNA, 101 bp, rice(Oryza sativa)
  misc_feature (71): n=t or c
gtaagagtagattagttttttttttatggaacctgcccatccaaatttaagtatggctgattaggtttttntttttatggaacctgcccattcaagtttaa

SEQ ID NO: 28244 - DNA, 101 bp, rice(Oryza sativa)
  misc_feature (71): n=a or g
gtaagcacttccaacactgttttgatactacttattccatcagttatctccaattctaatttattcccatnttaaacccaaacatacctaatttaatgagg

SEQ ID NO: 28245 - DNA, 101 bp, rice(Oryza sativa)
  misc_feature (71): n=t or c
tcttggctatgctgaactgctgcagaatcaaccatggaatgaattttatgtttttctattccctccatccnaaaatatgattttcgcggggattaaggtga

SEQ ID NO: 28246 - DNA, 101 bp, rice(Oryza sativa)
  misc_feature (71): n=a or c
aggagtagcaaccatggattcatgggaggctttgcggtgtcctcctttgttttggccaccgtcagtttggntttgactgccgatgccatgatgggcggtgg

SEQ ID NO: 28247 - DNA, 101 bp, rice(Oryza sativa)
  misc_feature (71): n=t or c
accagacgagaaatcaaaccctgtttgtttctaggtagaggtagcggcatggacagttgagtcctccaggnctacacgcacagttgagtttccagtcaaaa

SEQ ID NO: 28248 - DNA, 101 bp, rice(Oryza sativa)
  misc_feature (71): n=a or c
agctgatccaaaactgagatgacatagtatagtattgtgtttacctgggcaactgttttgcccctttctanagcaatctgtttaagtgggcagtccatgac

SEQ ID NO: 28249 - DNA, 101 bp, rice(Oryza sativa)
  misc_feature (71): n=a or g
ctccgcaggcgctcgcggtcgcggaggggatgagacgatgagcctagtactccctccacgcccacaaaacnagtcgttctgggctcttagtccgttttcac

SEQ ID NO: 28250 - DNA, 101 bp, rice(Oryza sativa)
  misc_feature (71): n=t or g
ctttttactaactaggatgccatatcaacaaaaatagatatccatgctaccatgggacccaatttaacttngttttataagttaaggggttataaaatttc

SEQ ID NO: 28251 - DNA, 101 bp, rice(Oryza sativa)
  misc_feature (71): n=a or c
ccattccccctcgacgccggcgacccctgcagaagtaacaaacaaacacgcgcgagcgtgagcaatccacncccagccacaaggaacaaaggtctcgggat

SEQ ID NO: 28252 - DNA, 101 bp, rice(Oryza sativa)
  misc_feature (71): n=t or c
tgaagatttactagtgtgtcaggaatttggccagaaagaaaatttctatccatttgaaggacactgaggcnactgagtttttctatctcggaaggtatgct

SEQ ID NO: 28253 - DNA, 101 bp, rice(Oryza sativa)
  misc_feature (71): n=t or c
cattaatagtagccatcttcaatacagtctctgcaggaagagcagttgggttcgttgtaccagtgatgtangcctcacgccctttgttaataagacaggct

SEQ ID NO: 28254 - DNA, 101 bp, rice(Oryza sativa)
  misc_feature (71): n=t or c
aattttctactctgtagagctgcctatctcatgtcccagtcttctttgcacagtcaaaatatcaggtttanctctgttcatctttttaacgtaggacaatg

SEQ ID NO: 28255 - DNA, 101 bp, rice(Oryza sativa)
  misc_feature (71): n=t or c
tctctttttttctaaaaaaaaaaacttgtagcggaagaagattttttcttcagggtggagcgcatcagaangccgtacgtaccacctacgaataataggta

SEQ ID NO: 28256 - DNA, 101 bp, rice(Oryza sativa)
  misc_feature (71): n=t or c
ccagcaacgagggatagcaaccctacttcatgtcgcctcgatctatagctcgatccagtatgaagcaggangcgcagtggcgacagggagactttgggttg

SEQ ID NO: 28257 - DNA, 101 bp, rice(Oryza sativa)
  misc_feature (71): n=t or g
ttacatgtatatagattgttcacatgtacgtatgcaaaaatgagaatgaggatcccctgtacagtttgcanttatgccactgacatgtagaccataccaaa

SEQ ID NO: 28258 - DNA, 101 bp, rice(Oryza sativa)
  misc_feature (71): n=a or c
gagtgtggcatacaacaagtacttcaaaacaacacctgcacagaaggttttatcagttctgcagtttcttncagcactcgtaatgctgtcagatgtactat

SEQ ID NO: 28259 - DNA, 101 bp, rice(Oryza sativa)
  misc_feature (71): n=a or g
tcttatctctaacacaatttaaaatatgaatgagtcctttaggtggatccttaccaaaaatatctctaagnaaactagaaaatgtcctaattaatagatac

SEQ ID NO: 28260 - DNA, 101 bp, rice(Oryza sativa)
  misc_feature (71): n=t or c
tagagagatatgacaaaacatatgcagggaacctcacatgtcaatttcttttctccttcctcacctctctntctctccttgcattcttctctgctgcggag

SEQ ID NO: 28261 - DNA, 101 bp, rice(Oryza sativa)
  misc_feature (71): n=t or g
atgtgtaacaagtgttttcttcccaactccacgaccaccgataattggtagtacaggtggaggaccaatantgttgttctccagcaagaagttaattagat

SEQ ID NO: 28262 - DNA, 101 bp, rice(Oryza sativa)
  misc_feature (71): n=a or g
aatgagatgagctcgtcggagattagattggtgatgcatccaccacagtaaggtggtgtttgaatttaggnactttaactttagtccttatatttagacac

SEQ ID NO: 28263 - DNA, 101 bp, rice(Oryza sativa)
  misc_feature (71): n=t or c
ctcataggtcaatgccgggatatactcccagccattgtaggttttaaccatgcagacacttcaaaactgcngtcaattcaacagcaaaatagggaaatgat

SEQ ID NO: 28264 - DNA, 101 bp, rice(Oryza sativa)
  misc_feature (71): n=a or c
tactatgtatgggaagatgctatggaggaattcttacgaggccgtggattggcttcattcatcaagatacnttttgcaaagcgcaccttttctgatcgggt

SEQ ID NO: 28265 - DNA, 101 bp, rice(Oryza sativa)
  misc_feature (71): n=a or c
actcatggttctaacaccacacagtaataagaagaggttctctcagctatgagccaaggacactctctctntatatataaaatagtatactctttcaattt

SEQ ID NO: 28266 - DNA, 101 bp, rice(Oryza sativa)
  misc_feature (71): n=a or g
atacactgtcatatacgcacctcagtgtgtttttgtggctgatatgatgtacatcttgatacagagctcanattcaatttcattatctttagaaaacacac

SEQ ID NO: 28267 - DNA, 101 bp, rice(Oryza sativa)
  misc_feature (71): n=t or c
aattatgaagagaaagcacaacaggagaggggattatataactgcttgcactgtttgattttattttctgncgttactaattcataatacggattgcttgg

SEQ ID NO: 28268 - DNA, 101 bp, rice(Oryza sativa)
  misc_feature (71): n=a or c
gcatcttcattcaccatcatgcatggatcccgtcactattccattggcatcatctgcatcgagcgtcaatngctgcaattttctacagttactgcaggcaa

SEQ ID NO: 28269 - DNA, 101 bp, rice(Oryza sativa)
  misc_feature (71): n=a or g
tggcatgttgttatttctgtgccatcaggtgatctggattgcttcctcctttagcttgtcctcgggggatnacctcgtccccgaggaggagttcctgatct

SEQ ID NO: 28270 - DNA, 101 bp, rice(Oryza sativa)
  misc_feature (71): n=a or c
gaccatttgtcttgttaaaaagatggctagctttgctagcttaattaaaacatgatgcccatttggtgtcntgtcaataacccctctttttctcctcccct

SEQ ID NO: 28271 - DNA, 101 bp, rice(Oryza sativa)
  misc_feature (71): n=a or g
gcctccatctggcgaaaggccagactggtgcgataggttgttgttcgtactggggtgctgtttggcttcanccatgctgctgacagctttcgcacttcttg

SEQ ID NO: 28272 - DNA, 101 bp, rice(Oryza sativa)
  misc_feature (71): n=t or c
gagaccattggcagatgagcacagcccactcatcactggagctatggatacctctattgacaattcgtggngcttgctgccttctcagacctccacatttt

SEQ ID NO: 28273 - DNA, 101 bp, rice(Oryza sativa)
  misc_feature (71): n=t or c
cctgttgttttgctcttcatgctttgctttgctttagctgtcaaacaagaatcctatcaactcatctccanccccaatttctcacatgtgctcatatcttt

SEQ ID NO: 28274 - DNA, 101 bp, rice(Oryza sativa)
  misc_feature (71): n=t or g
agatgaaatattgaagaaagatagagcggagcttctgcaagctcaggcagagctctggtgccacacttttngctatctcaaatccatagcactcaggtgcg

SEQ ID NO: 28275 - DNA, 101 bp, rice(Oryza sativa)
  misc_feature (71): n=t or c
ctctaatccgaggtggcatgaatttgctgagtcattatgttgctgaggtcccaatgagattaaatagatgngcaagcattatgttgcaacagaaactgtga

SEQ ID NO: 28276 - DNA, 101 bp, rice(Oryza sativa)
  misc_feature (71): n=t or c
cagttgagcaagaagatgagccaccctattagcttccctctttattttgcacaccttgacacttaggaganatttcatcacaccctttgcttcagaaattg

SEQ ID NO: 28277 - DNA, 101 bp, rice(Oryza sativa)
  misc_feature (71): n=a or g
gaatcggcgatggatggacgacgacggcggtctgaggaatgctccaggtgacgacggaaaacggcaaagcnacggcgacaacctcttctggccttcgggct

SEQ ID NO: 28278 - DNA, 101 bp, rice(Oryza sativa)
  misc_feature (71): n=a or c
cgaagaacgaaccgagccctgcgatgggcagcggccatttccccctggaaggcgagagaaaagccgcctanatcaagaacatcaagttattcgactccaag

SEQ ID NO: 28279 - DNA, 101 bp, rice(Oryza sativa)
  misc_feature (71): n=a or g
tcatatagtttttttttagttatttctaaatgatcatcatttgtgttcactagatgataccccgcgcgttncggcgggccattgtgggggcatagacatac

SEQ ID NO: 28280 - DNA, 101 bp, rice(Oryza sativa)
  misc_feature (71): n=t or g
tttgcagcactgtcacaagaacggcgtcatgcatcgggacctcaaacctgagaactttctgtatgccaatncatctgagaactcccctctcaaggtcatcg

SEQ ID NO: 28281 - DNA, 101 bp, rice(Oryza sativa)
  misc_feature (71): n=t or c
ttagctacacatagacacagttcattcgtttgagtcggccatctccatttcctttttccattttacttatntatacgaccatacagtatacactatacacc

SEQ ID NO: 28282 - DNA, 101 bp, rice(Oryza sativa)
  misc_feature (71): n=a or g
tgttagggtgtagggaggcgatgagccaaaggcccaaagcattaataagttagtcagtttcatagtggacngacaaatgttaagtggttcatagttgagga

SEQ ID NO: 28283 - DNA, 101 bp, rice(Oryza sativa)
  misc_feature (71): n=a or g
cacggccagagatcggcggtgggcggcggagcctgtgctcgtggtggaggtagggttacggtggtggattnggggagcggagcggcgaccacggtagccct

SEQ ID NO: 28284 - DNA, 101 bp, rice(Oryza sativa)
  misc_feature (71): n=a or g
ctcccactcctcatgaaggtagaatagggctgatccgagcccaagaataatcttgaccctgtgacaaaatngaagttagctgatcacttgagttaaatttg

SEQ ID NO: 28285 - DNA, 101 bp, rice(Oryza sativa)
  misc_feature (71): n=t or c
ttggttctagtacctaccgtgtccaaaaattctactccgtatatactcccaagctttacgctcagtaaagnaaattttgtacgcttccgagttccgagctc

SEQ ID NO: 28286 - DNA, 101 bp, rice(Oryza sativa)
  misc_feature (71): n=t or c
ttttgtggttcgggggggtggaggggggggcaattcatactgtcgtaaaagttcaggggtgtaattcgtanttttttctttataatactaagatgtgttat

SEQ ID NO: 28287 - DNA, 101 bp, rice(Oryza sativa)
  misc_feature (71): n=a or g
aaaaagacttggtcaccacctttttgttgtaatgtcgagcaattctctccttatctttgttaacttttgcnagggccctcaatcttgattgaaccaagtcc

SEQ ID NO: 28288 - DNA, 101 bp, rice(Oryza sativa)
  misc_feature (71): n=a or g
ccgggaacctggccgtggtgaggaagctcatccacctgagaaaatgtaccgccgatggatcagcggcggcngcgacggcggcgatgctgagaagagaaaac

SEQ ID NO: 28289 - DNA, 101 bp, rice(Oryza sativa)
  misc_feature (71): n=t or c
caaaaaagcagcccagtactgtgctgtaagtgtaacatcgtgagtaaccgtagtaaaatttagtcccaatngtccagccatgagagattgtgggcatcacc

SEQ ID NO: 28290 - DNA, 101 bp, rice(Oryza sativa)
  misc_feature (71): n=t or c
cacagctctaccagaagctaataaaccgcttgaaagaaatgacgaacgagtactggtacaactgctaaatnccatcttgtttcatgtaaatccaatacctg

SEQ ID NO: 28291 - DNA, 101 bp, rice(Oryza sativa)
  misc_feature (71): n=a or g
ccaagattggatatagctcgctttttggggctctgttccggaccaatggcggcgcgcgatgtgtcgtaacncaatagcgacacgtggaccgcagcggagct

SEQ ID NO: 28292 - DNA, 101 bp, rice(Oryza sativa)
  misc_feature (71): n=a or g
tattgatttgtaggaattagaagggatactcactaggcttactaaatcttcgttttgctctgcaaaatagngcccactgtttctttgccctgtcacaatct

SEQ ID NO: 28293 - DNA, 101 bp, rice(Oryza sativa)
  misc_feature (71): n=t or g
tgattaccaagatgtattatccatatcagagcaactctggaggctaggtagtgaagttgtctttaatgttnccagaaaataacctcttgcattgtgcagta

SEQ ID NO: 28294 - DNA, 101 bp, rice(Oryza sativa)
  misc_feature (71): n=a or g
gattacgaagttctccttcactagttcactgtgacttttttattttggtctctatatccttttgggctttntctcccgtcgttactcatgatgaactattg

SEQ ID NO: 28295 - DNA, 101 bp, rice(Oryza sativa)
  misc_feature (71): n=t or c
agaaacaggttttagccctaacccgtttgaggttagttgcggcctatgtaaaacccccaacaaccacctantttccttacaacctagtgcactgtttacat

SEQ ID NO: 28296 - DNA, 101 bp, rice(Oryza sativa)
  misc_feature (71): n=t or c
gtcctggctggttgggaggggacagcacatgatgaagaaaatgatggtcctgccactactgatgatcgtgnggaggcatcatctgcaagtaagccaaagaa

SEQ ID NO: 28297 - DNA, 101 bp, rice(Oryza sativa)
  misc_feature (71): n=a or g
tcttggatcagtgatgagaacttccacagtgcaacaaaggatgaaaggtaagattagagccacttctgctntcatttacacctaacacgagaataacttcc

SEQ ID NO: 28298 - DNA, 101 bp, rice(Oryza sativa)
  misc_feature (71): n=t or c
actgtatattctgtgtatatacagatatactgcagcattgcggcaagctcatcatctaatttatttactcnatttctcagcccatttaatttgcatattta

SEQ ID NO: 28299 - DNA, 101 bp, rice(Oryza sativa)
  misc_feature (71): n=a or g
ctctctcttctccttcctcctccatctctcccttctctcttttatctctcatggcgcaatcggcggtctgngcggcgacggtgggtgggagttggagcggg

SEQ ID NO: 28300 - DNA, 101 bp, rice(Oryza sativa)
  misc_feature (71): n=t or g
ttgtaaataaaacatttaagggcgaggaaaaaaatggaaccggaaaacattgaaaaaaaaagtcaagacanatggcagaaaggtttttgacaatgcaaagt

SEQ ID NO: 28301 - DNA, 101 bp, rice(Oryza sativa)
  misc_feature (71): n=t or g
gttgtcgagatcgagaggctgccgtgttcatctggtattatttgcctttggcagggacagctctagctcanggagcgattgagagagagctgtgaggagcg

SEQ ID NO: 28302 - DNA, 101 bp, rice(Oryza sativa)
  misc_feature (71): n=t or c
ggaagtcgggaggggatcgatgaagtatgaggcccaggtcgcatttgggctgctttttttttccaaacaancgttcatggtaattcatttatccttttttt

SEQ ID NO: 28303 - DNA, 101 bp, rice(Oryza sativa)
  misc_feature (71): n=a or g
aaaaagtgaaccatggggtatatgatatttgaagggatgaaaatactctcgaaatcggtaacatctcttcnaaaacaatgctagatctgttaaaattgacc

SEQ ID NO: 28304 - DNA, 101 bp, rice(Oryza sativa)
  misc_feature (71): n=a or g
gttatgtcagtctcatcagatgagactatgataaaacctgcttttggtgacttcatctcctgtattctggncagttttgagtgacattctgtgggcttctg

SEQ ID NO: 28305 - DNA, 101 bp, rice(Oryza sativa)
  misc_feature (71): n=a or c
ttaatcatatgataatatatcgctccgttttccgtgtgaagggttggggttcccggccctggaaagaacanagcctaattacttcctccgtttcacaatgt

SEQ ID NO: 28306 - DNA, 101 bp, rice(Oryza sativa)
  misc_feature (71): n=a or g
aacagcaaaatctaactatattggctactctccaatgatagatatcaaccgactacaggttagattgtganactaatgaagattatgaagcatatatgata

SEQ ID NO: 28307 - DNA, 101 bp, rice(Oryza sativa)
  misc_feature (71): n=a or g
atatgtgatgttgaacgtggtctgcatcattttggtggatataacgtagtcacagcctcacagtcccacangaaatagttgatattgtggttcaagtgcca

SEQ ID NO: 28308 - DNA, 101 bp, rice(Oryza sativa)
  misc_feature (71): n=a or c
aatgtggtatacaaagtggtctccaaatgcttggttaatcggttgaggttatgtttagatgatttagtctnagatgagcaaagtgcattcgtgctagggcg

SEQ ID NO: 28309 - DNA, 101 bp, rice(Oryza sativa)
  misc_feature (71): n=t or c
atcagatagttgttctaatataaaatcttgtccaaacatttcccggatgttaataaatcttttactcctgnagtctaggagtaatttgtttactgaaaaaa

SEQ ID NO: 28310 - DNA, 101 bp, rice(Oryza sativa)
  misc_feature (71): n=t or c
ggcgccaaatcccttctcccctctcctcgccggtgcccgtagtttagagcaacaataacgagtggtggcangacctttacactctcctcggtggcgcctcg

SEQ ID NO: 28311 - DNA, 101 bp, rice(Oryza sativa)
  misc_feature (71): n=a or c
gggattaatctatgtagctcagatatgacagcatttattgtcatctgaccgttagtcactttaaccaaaanagcctttggatcatgcctaatcctctgtcc

SEQ ID NO: 28312 - DNA, 101 bp, rice(Oryza sativa)
  misc_feature (71): n=t or c
aaaactataaggattatcattatatgccaataacatgtggcaggtggggtcataaaggtcactaacatttncaaggatggtaaatctcaatcaatcaatca

SEQ ID NO: 28313 - DNA, 101 bp, rice(Oryza sativa)
  misc_feature (71): n=t or c
ccaccaattttccacaattgtacgagcagtacacccacgtctactcccgttaaccccgtgtatagactcantgacacgccgggcccatccccgacctcctc

SEQ ID NO: 28314 - DNA, 101 bp, rice(Oryza sativa)
  misc_feature (71): n=t or c
tgatgggtgcttacctctgcgtattcggccgatggcgcggcggatagattggtggaagttgacattaccgngggtggagatctggctggggacggaatcgt

SEQ ID NO: 28315 - DNA, 101 bp, rice(Oryza sativa)
  misc_feature (71): n=a or g
caaaaatattaagaaaagtatgtgcaaatctgcaagagcatacgttcctttgacaccgttaagatgacacngaatgggggcaagcacaagcttcagttcaa

SEQ ID NO: 28316 - DNA, 101 bp, rice(Oryza sativa)
  misc_feature (71): n=a or g
accacgaacggaggttacccgtcaaacttatcgtaatcttcatctgtcttatcctcctttttccttggganaaccatgtggcactttggcttgtcgagccc

SEQ ID NO: 28317 - DNA, 101 bp, rice(Oryza sativa)
  misc_feature (71): n=a or c
tcgcctatgtccgggaccagatgagccccaaggtgatcatgaacatgttcgacgtcgaggtgttcgagcanatcgccgtcgagtaccggcacaacctaaag

SEQ ID NO: 28318 - DNA, 101 bp, rice(Oryza sativa)
  misc_feature (71): n=t or g
ccagacgagttatgaaattagtttatttattcgtgtctaaaaaccttttttaatatccggtcaaacgtccnatatgatatccaaaaattttcattccacca

SEQ ID NO: 28319 - DNA, 101 bp, rice(Oryza sativa)
  misc_feature (71): n=a or g
taggtgtttttaattattctttcaattatttacaggggtttgaggatagaaaaaaggtgtgcaccatctgngttgcacagagaaaacattcattattagaa

SEQ ID NO: 28320 - DNA, 101 bp, rice(Oryza sativa)
  misc_feature (71): n=t or c
tgtaagggatggcaggtgaactttttcctttgcatattggtccagtatgtttacaagccggtccatgttcngggccgctatttttgctagcgtcgtgtatc

SEQ ID NO: 28321 - DNA, 101 bp, rice(Oryza sativa)
  misc_feature (71): n=t or c
cccaacccaaacaatcttgaattgttttagtcttgataaacccatactgattctgatggaccaactgaacnattttgccttgcactctatttgccattgcc

SEQ ID NO: 28322 - DNA, 101 bp, rice(Oryza sativa)
  misc_feature (71): n=t or g
tgtacaagcgggcgtggaaggtggtgtaccgaagcaagcagctgctgctgaccaacttcctggagtatgtnctcgtgaggacactgctcgagaccatctac

SEQ ID NO: 28323 - DNA, 101 bp, rice(Oryza sativa)
  misc_feature (71): n=a or g
taggcaaaaccaatttatatcaagcttgatcaactgcaagcaagtcctcttgctgacccaccagtgggacnggacactagttcgcaccgcctccttcatcg

SEQ ID NO: 28324 - DNA, 101 bp, rice(Oryza sativa)
  misc_feature (71): n=t or c
caagtcgtcgtcagggtgagctgtgtgtggtgtggggttttgctgtgttcttgtgtgttctttggtggttntgaatttgcttggtttcttggaggaaaaac

SEQ ID NO: 28325 - DNA, 101 bp, rice(Oryza sativa)
  misc_feature (71): n=a or g
acaatctctcgcatggtaacgtgttaggcatggcatggtgtcatacggtggattgtgtctcgtgggtacanttgtgcatctctggtcagagtaaaaactat

SEQ ID NO: 28326 - DNA, 101 bp, rice(Oryza sativa)
  misc_feature (71): n=t or g
ccacggcggtcgtgaacatccttcttgtttggttattactgatggaattcagcataggagaggagataganagagaacatttttccgacagtcccaccggt

SEQ ID NO: 28327 - DNA, 101 bp, rice(Oryza sativa)
  misc_feature (71): n=t or c
ggttgtggcgtgcggcactgccgcagagaatttttttccgtgttactgattgtaatgcagttatttgtganatatgtgaagacccaggtcatttggcacct

SEQ ID NO: 28328 - DNA, 101 bp, rice(Oryza sativa)
  misc_feature (71): n=t or g
atagtaatggctttaatttttgtaggaaatgaaaaaaaaaacttcttctcatgttcggggaccgcctaacnatcaagctacaaagaaaacaaatcaattgt

SEQ ID NO: 28329 - DNA, 101 bp, rice(Oryza sativa)
  misc_feature (71): n=a or g
tgacatgtggggcccctaccccgcgccgcgtcgcgacatacctaaccgtattaaactagatcacctccgantcttttgttacaaaaggaccagctaccctc

SEQ ID NO: 28330 - DNA, 101 bp, rice(Oryza sativa)
  misc_feature (71): n=t or c
ttatgcacatgttaaaccagggctcccgagccaaacttcttaaaatattagccaaaactccactcatacanaattcccctcaattttctccaatcacagtt

SEQ ID NO: 28331 - DNA, 101 bp, rice(Oryza sativa)
  misc_feature (71): n=a or g
ccagggcgcctgcacttgcgcggtcattgctttgcccgtcattgctttgccatgtgtaagtctgtttggcntaatatattcaggtgggcacttcgcccccg

SEQ ID NO: 28332 - DNA, 101 bp, rice(Oryza sativa)
  misc_feature (71): n=a or g
tataggaaataaaaaggacacagtgtacatgtactagcaaagtacgcacatagcatgtggaatgtttgaanttggtatccaatcaataattatttacaaat

SEQ ID NO: 28333 - DNA, 101 bp, rice(Oryza sativa)
  misc_feature (71): n=a or g
gagcttccaaattgcaattgtataaagggcttcacaataacatcacatgaggattgggaactagaagatcnaacgggtggatgctcaagaaatactccgat

SEQ ID NO: 28334 - DNA, 101 bp, rice(Oryza sativa)
  misc_feature (71): n=t or c
tctactccctatcccattcagctaatggtacaggtacccggtacctgcatagatgtgggcataggagaaancatgtactcgtaagtggatgtggatgttaa

SEQ ID NO: 28335 - DNA, 101 bp, rice(Oryza sativa)
  misc_feature (71): n=t or c
aaaccgaagtatagataagatctatttcctcctaagacctccctatatatacagggacagagtgagatatntaaggttgatttgtactccagataagattt

SEQ ID NO: 28336 - DNA, 101 bp, rice(Oryza sativa)
  misc_feature (71): n=a or g
gtccaactaaacccattaccatccctaattaggatatcatttgtgttatataaaacgtaaaatctaaatcnagaacgctctcaatttagtcacagtgagcg

SEQ ID NO: 28337 - DNA, 101 bp, rice(Oryza sativa)
  misc_feature (71): n=a or g
caccaccttagtatttgagagtaggtggcattgggagagaaacacaccactgcattttattacctctcagntagattagtgtgggctgtgaggccaatgtt

SEQ ID NO: 28338 - DNA, 101 bp, rice(Oryza sativa)
  misc_feature (71): n=t or c
ccaacctccactgcgccgcgttgctccacctagcccgcttctaagctaaagatgtacgctagtgatggggncactggtgagaacggatcgcgggaacacgt

SEQ ID NO: 28339 - DNA, 101 bp, rice(Oryza sativa)
  misc_feature (71): n=t or g
cagccatggttcttcagaaatccgacgaatctgaaaatctcagggctgaactgaagaatctccacaaatcnatctccgagctccgcatccgctgcaacgat

SEQ ID NO: 28340 - DNA, 101 bp, rice(Oryza sativa)
  misc_feature (71): n=a or g
gcatccaagaactacactcttaacattcatgggaaaccttccaagataaattgtcaagtgggaaggcgatncagacactgaaaagcagccaataattcggc

SEQ ID NO: 28341 - DNA, 101 bp, rice(Oryza sativa)
  misc_feature (71): n=t or c
gcattcctccagatctggtacaagttgccctcacacagcacaatgttcttggcattggtaaaagcagacanggtgttgtatggcggagcgaaactggtggc

SEQ ID NO: 28342 - DNA, 101 bp, rice(Oryza sativa)
  misc_feature (71): n=a or g
aagccgttgcttggcttccttagtaactgatgactcagcaaagtgggagatcttgctaaaagacgatcccngatagggatttccatgttttttggtataat

SEQ ID NO: 28343 - DNA, 101 bp, rice(Oryza sativa)
  misc_feature (71): n=a or g
agattgctcatgggtgatggtgaagatgctcaatctgatggtaacagatcccgaatgatgcggcctaactnggaaaaagcttgttatcgttggagtgcagg

SEQ ID NO: 28344 - DNA, 101 bp, rice(Oryza sativa)
  misc_feature (71): n=a or g
taagaaaaggatattgatgcagggtacagattttcattaaataatgcataatgcacaagtcaaacactacngttgcacgatgaggacctgttcttgacatc

SEQ ID NO: 28345 - DNA, 101 bp, rice(Oryza sativa)
  misc_feature (71): n=t or c
atccatggtcgttgtgctgcagctgtaaatatgatccggaatatacgtgatcgccagaccaaatgatatgngtattctgatgcattttctgccgtgtatac

SEQ ID NO: 28346 - DNA, 101 bp, rice(Oryza sativa)
  misc_feature (71): n=t or c
ctctctctgtcatttcacatgtcatgttcagccttctgaggtctcacttacaacttattcaatcaagatanctttatctatactactataaaagacaaaat

SEQ ID NO: 28347 - DNA, 101 bp, rice(Oryza sativa)
  misc_feature (71): n=a or g
aagcgtggcacatgtgtacggtgtgggtgaagaccccgtattaattcactaccattacaatcactaatatncaggctctaaactcctattgcttacacaca

SEQ ID NO: 28348 - DNA, 101 bp, rice(Oryza sativa)
  misc_feature (71): n=a or g
ctagtttccttgaaggatagtactctcttatcataatcataaggaatgtttgttcttcatttcatgttttntcttacaacatttcaaattacatcatctta

SEQ ID NO: 28349 - DNA, 101 bp, rice(Oryza sativa)
  misc_feature (71): n=t or g
ctggacagatcaacctgtgggcactgttgtgcctccctttgtacaatgcaccaatgacttgtcctaatacnccaatcatattgtatcatgtgattgattgc

SEQ ID NO: 28350 - DNA, 101 bp, rice(Oryza sativa)
  misc_feature (71): n=t or c
ctgatatatgcgtcgtagtaaagtgggattaacatgttaatgtataaactgcacgaggtcagaggatctcnttccatttcaatttttaaggcatcgtctgg

SEQ ID NO: 28351 - DNA, 101 bp, rice(Oryza sativa)
  misc_feature (71): n=t or c
tagctggagattctatgagaagctacgaggagcaaagttagccatttacacccttaccaactgataccaantgatgaggatgttaggtctcgatcttttga

SEQ ID NO: 28352 - DNA, 101 bp, rice(Oryza sativa)
  misc_feature (71): n=t or c
agtggcggcactatgacctgggaaccatacatccaacaatcaagaaatgttgtcacagcaaggacaaagancctgcagaaaaattaaaaggcataaggttt

SEQ ID NO: 28353 - DNA, 101 bp, rice(Oryza sativa)
  misc_feature (71): n=a or g
ccaaaatgaacaaaccaaacgtcgggaaatttccaaaataggcaaaatgaagtacccttcaatttccctanatgtgtagttgggttagctaacctggaaga

SEQ ID NO: 28354 - DNA, 101 bp, rice(Oryza sativa)
  misc_feature (71): n=t or g
gaaactagcggactgcacaattttgcacaaagctagattttatagaagtttacgactcttgcttccatttncatatataaatgcctgtatttttatacaat

SEQ ID NO: 28355 - DNA, 101 bp, rice(Oryza sativa)
  misc_feature (71): n=t or c
ctcctcatgctcctctccaggaacaggatgctccatagtgttttggagtgaatcatgatccattcatgggnggatctaacatggggcatggggggttcagt

SEQ ID NO: 28356 - DNA, 101 bp, rice(Oryza sativa)
  misc_feature (71): n=t or g
tatccaaatttgatggcaatgctgatcccgcgttgtgatgaatttctgtggatggatgcagacggcggtgnccatcggcaaggagatccccaacgacatac

SEQ ID NO: 28357 - DNA, 101 bp, rice(Oryza sativa)
  misc_feature (71): n=t or c
agtttcacgtgataacatatacatgcctttgagaaaaactacggagagaacacaatgcaaactgtaatttncttaccacaccccgccccaatagatcacgc

SEQ ID NO: 28358 - DNA, 101 bp, rice(Oryza sativa)
  misc_feature (71): n=t or c
aagaaagagtagtatagatgaaaaaaaaatcttaccagcgacgtgcatgacatgcctgacaaggtggcagngggagcagtccagttggccatgccggagcg

SEQ ID NO: 28359 - DNA, 101 bp, rice(Oryza sativa)
  misc_feature (71): n=a or g
cagcagaggccttcttttctcaccgcaaattccaaatttgtcaagtccaaaattgtcccctacaccaatgncaggcagatattacactccccaaactcatc

SEQ ID NO: 28360 - DNA, 101 bp, rice(Oryza sativa)
  misc_feature (71): n=a or c
ggtaagcctgggggatagagttgctgggtatctgaggttgcaatgcattttggtggtggtaaagctgctgntgctgctgctgctgatgctggtagggatga

SEQ ID NO: 28361 - DNA, 101 bp, rice(Oryza sativa)
  misc_feature (71): n=a or c
cgcgatgtgaaattagtcttctgcaaaacccccctgaccactacttgtgtcaccgttgtattcaaatgttncttctaatatattgacatgtaaagctttta

SEQ ID NO: 28362 - DNA, 101 bp, rice(Oryza sativa)
  misc_feature (71): n=a or c
tacaagcaacaaaatgtgcttgtgattcaacagccactctaaatagggcatgagagtatgagacatgtacntgaatgggcagtccctgccaaacacaagtg

SEQ ID NO: 28363 - DNA, 101 bp, rice(Oryza sativa)
  misc_feature (71): n=a or c
atttcgaatgagtcggcatccttcagataggtcttcatcgattcataattttgttgggcgccgattgcatntgagcggttgcccaattgagggtgcattac

SEQ ID NO: 28364 - DNA, 101 bp, rice(Oryza sativa)
  misc_feature (71): n=t or c
tatttgtcttacatatgaccacttgcttctgttctttccagtgtgttgtgtgtactgacatgcctgtagcnttttggttttgtagttctctgtatttgcat

SEQ ID NO: 28365 - DNA, 101 bp, rice(Oryza sativa)
  misc_feature (71): n=a or c
acaggaaagaaagttaatcgatgctctacccttcgagagtgtttatacggggctaaaacttgttaagtacntgttacatcggatatttggacgtaatttag

SEQ ID NO: 28366 - DNA, 101 bp, rice(Oryza sativa)
  misc_feature (71): n=t or c
ttattgccatggaatgagtcgtgatgcatgcatgatatacaagtagatacaggctgtgtttagttcagcgnaaagtttggattttggttgaaattgaagat

SEQ ID NO: 28367 - DNA, 101 bp, rice(Oryza sativa)
  misc_feature (71): n=a or g
tatttccaaccaagaaacggaggcgtggcagttggttgggcaacgaatgcgaacctacttctcctagtatnctgcttttactttagccatcgccaccaccg

SEQ ID NO: 28368 - DNA, 101 bp, rice(Oryza sativa)
  misc_feature (71): n=a or g
gagctcgctggccggtcatcaatgacggccacaaattttactcttggttgattatccaaaacagggtgtgnactgtagatagactccaagcgagacagtgg

SEQ ID NO: 28369 - DNA, 101 bp, rice(Oryza sativa)
  misc_feature (71): n=t or c
caggcagccccctctccatctccttcgagtcacacaaaagaaacccgcacgcacgcattatacgtagtgtngccgccatcccgggaccacctacccgaggt

SEQ ID NO: 28370 - DNA, 101 bp, rice(Oryza sativa)
  misc_feature (71): n=t or c
cagcgcagtagaagtgaactatattgtgatggctgcatgctgggtgaaccagacgtccatgttccgtcaangaatgggcgatccggatctgtggtgctgtg

SEQ ID NO: 28371 - DNA, 101 bp, rice(Oryza sativa)
  misc_feature (71): n=t or c
acgctacgcccgtatccttcccttcatcccattgtcccaatcccgacttcttcttttctcagctgactgcntgagtactactgcttgttcctttctttctt

SEQ ID NO: 28372 - DNA, 101 bp, rice(Oryza sativa)
  misc_feature (71): n=a or g
ggcctgaagtgcttgggcagcggaagcggtgaagttgttgatgccgaggggtatggttggtgtggtcgtcngtggcgcgggctcccctggggccagcttga

SEQ ID NO: 28373 - DNA, 101 bp, rice(Oryza sativa)
  misc_feature (71): n=t or c
aaccaaagctagctccccgcccctcgccatggaactccccacgaccggaatctgaaagcagaacggtcaanaggaggggaggagctctaggaaacgggagg

SEQ ID NO: 28374 - DNA, 101 bp, rice(Oryza sativa)
  misc_feature (71): n=t or g
tgcgggccaaacaattaaacttgcatgacggcttagatataatgtttcatgagcgccgttataacgtgctncgtgcttaaagttactattccgtacacatt

SEQ ID NO: 28375 - DNA, 101 bp, rice(Oryza sativa)
  misc_feature (71): n=t or c
tcaagctcaaatcttttgggtattgtgaaagttggaagatcaggtgtagcatgtgtgtctcgaacttcagntatctgtgaagtagctcttgtttctgctct

SEQ ID NO: 28376 - DNA, 101 bp, rice(Oryza sativa)
  misc_feature (71): n=a or g
tagtgccggttatcacgcaaccccctcatctcctccaatctactgttgatactactgttcaagcctccccngaccccgattcccttgccaatggcgaatct

SEQ ID NO: 28377 - DNA, 101 bp, rice(Oryza sativa)
  misc_feature (71): n=t or c
ccctagcctagatctctatccactccagcgtgagctttgtgccagtctgagtggtggtctgcaatgacgangattgtacgatgatgacgacgctggcggtg

SEQ ID NO: 28378 - DNA, 101 bp, rice(Oryza sativa)
  misc_feature (71): n=t or c
cttcaattttatgccgtcctttccagctttcccgccgcaccgcgcggggcaccctctagttatatttgttntctgcacttctgctaggctgcttagctacc

SEQ ID NO: 28379 - DNA, 101 bp, rice(Oryza sativa)
  misc_feature (71): n=t or c
tattcaagcatttctcacagagccacactagcagattccggtctgcttcttcttcacctggtccctccagnacgcgaagatctccctctcggtctccagga

SEQ ID NO: 28380 - DNA, 101 bp, rice(Oryza sativa)
  misc_feature (71): n=t or c
agaagatctggttcaattccatctgcttgcattgcctgaatgaccttctccatatcttcaatatctctagnagcacccttggtgtctacaaggagcttata

SEQ ID NO: 28381 - DNA, 101 bp, rice(Oryza sativa)
  misc_feature (71): n=a or g
atcaactagtttgacccaaataacctcatcctttaagcaattatcgcattagaaatttgtgaaagtgagcnataaatgcattacgatttataaaagtgaca

SEQ ID NO: 28382 - DNA, 101 bp, rice(Oryza sativa)
  misc_feature (71): n=t or c
tagcagtgctcaactacatctgcattatattgttctgcatatggctgtgttcggtttaagtggttgggaanaaatctcccgtgcacggaaaacggagcggt

SEQ ID NO: 28383 - DNA, 101 bp, rice(Oryza sativa)
  misc_feature (71): n=t or c
attcgttggactcgaatatatcttatctaattctagtgttgctatattttgaggtaggatagatctcatcnagttttagattgatatattatatgatggag

SEQ ID NO: 28384 - DNA, 101 bp, rice(Oryza sativa)
  misc_feature (71): n=a or g
aaaaatcgatgctaatatggccggtcacgatcaaattaactggtacaaatgacgcacttgattcctggatncactcaaaaagccatcttaaaattgaaaat

SEQ ID NO: 28385 - DNA, 101 bp, rice(Oryza sativa)
  misc_feature (71): n=a or g
atccgtgtaagtgtgtaaccactgaactgccaaaccaccacacccattttttagctcggtttaattttttncccccaatctcaccttgcttcagtaaggaa

SEQ ID NO: 28386 - DNA, 101 bp, rice(Oryza sativa)
  misc_feature (71): n=a or g
ccttggtttctggccaactgagaggctgcttgtatagccaaggcaaggagcagctaaggcagataagaggnagagagagagagagagagagagagagagag

SEQ ID NO: 28387 - DNA, 101 bp, rice(Oryza sativa)
  misc_feature (71): n=a or c
ccattcggttgtcacatgttgtacgaaggggaagatgcaataaaaggctggtgattcatagaaaaagagtnaaaaatactccctccatttctttttcattt

SEQ ID NO: 28388 - DNA, 101 bp, rice(Oryza sativa)
  misc_feature (71): n=t or c
tcgttcaatactggtagggtggcatttccacctttccaaacatatgtgactaaaaactgttttacgctggnataatttaaagatccgctagtatgatcgcc

SEQ ID NO: 28389 - DNA, 101 bp, rice(Oryza sativa)
  misc_feature (71): n=a or g
gtccatatcaaattcaaagattgaacgaaactcatattcataatttctcttaatgtttgaatgtgctatcntttgctaatttataggggcaattgcttatt

SEQ ID NO: 28390 - DNA, 101 bp, rice(Oryza sativa)
  misc_feature (71): n=a or g
gtagacttattcctgtatgtcactaccgtctaagaccaagtccttccgtctccgttgcgagcaattttacngtccttgagaaggtaccatgaggtaccatt

SEQ ID NO: 28391 - DNA, 101 bp, rice(Oryza sativa)
  misc_feature (71): n=a or g
attctaatttcggttcgaaatttctaaaatttcagtaatttctcgcttctctccaggaagtaaatttctcncccaaattttttatttttaaaaaaattggt

SEQ ID NO: 28392 - DNA, 101 bp, rice(Oryza sativa)
  misc_feature (71): n=a or g
tgagattttgcactgcattcactggtgtaatcgttggttgtgtatgtccacttatgaatatatagaagaanttagatttctattcaatatttttttgaaaa

SEQ ID NO: 28393 - DNA, 101 bp, rice(Oryza sativa)
  misc_feature (71): n=a or g
ggtgttcatctccctcgtcgcggcgttcgtcatgctcgtcgccactctcatgcagactttctacaccgtcntgcccttctgcaataatcagtactccggac

SEQ ID NO: 28394 - DNA, 101 bp, rice(Oryza sativa)
  misc_feature (71): n=a or c
cctcctttcggtggttagcccagagcctctcccagagatcgacccagaccagcatgcagtaatcgaatccngttcgatgattcgatctactaaattcgcaa

SEQ ID NO: 28395 - DNA, 101 bp, rice(Oryza sativa)
  misc_feature (71): n=t or c
aattatgtgatacacgtacttgtcaggatacgatattgatgcatggacgaccttaatcagaacatatcgcnaaaagtcaccgttgaatcaatcaccatcag

SEQ ID NO: 28396 - DNA, 101 bp, rice(Oryza sativa)
  misc_feature (71): n=t or c
ggatgcatattatgtgaagaagatgcgtaccgtttggatcttttgaattgccacaaatttgccaggattgncatttcatggaacatttgaaaaagaagaga

SEQ ID NO: 28397 - DNA, 101 bp, rice(Oryza sativa)
  misc_feature (71): n=a or c
cgggtatttgggccaatgccactctttctcatctcatcaaccattttgaaagcatgatgaaactccaaggntctgcagtaagccccaataactgcattgca

SEQ ID NO: 28398 - DNA, 101 bp, rice(Oryza sativa)
  misc_feature (71): n=t or c
tgaacgtacaacactatattcctgtgtcatgtgaaaggaggggttgtttggttggtgactaattttgcganagctaaccttagctaaagtgtgatcatggt

SEQ ID NO: 28399 - DNA, 101 bp, rice(Oryza sativa)
  misc_feature (71): n=t or c
tcttgaaaagccaaaacatccatttcctagcctcttctccatcaatacagagagaaatattagtccaattnatatggtggaattccaaacgttgcagcccg

SEQ ID NO: 28400 - DNA, 101 bp, rice(Oryza sativa)
  misc_feature (71): n=a or g
agaccaacgaacttggacgagaagtacttgcttagagcccttacgaatcagacgtcgatccaaaatctccnctggtacaactattgatgcgtcgtcagggt

SEQ ID NO: 28401 - DNA, 101 bp, rice(Oryza sativa)
  misc_feature (71): n=a or g
aaccccgcttggcccatcgccatccatctgccggtgccgacaatcacgatagtcgaatccacctcttcctnggcccgtggctgttgaattgttgattcatc

SEQ ID NO: 28402 - DNA, 101 bp, rice(Oryza sativa)
  misc_feature (71): n=t or c
tcgttcggacatgcatgtatcttttgaacttctagtcctagagagtagactaacttcttagcttcgtatgntgtttcgaacaatttgtttccctccggaag

SEQ ID NO: 28403 - DNA, 101 bp, rice(Oryza sativa)
  misc_feature (71): n=t or c
acggaacacaaattaagggtctacttaatttgcaaggtatttatggactatattttataaacggaagacanatgactcatacaaataaaaattactctctc

SEQ ID NO: 28404 - DNA, 101 bp, rice(Oryza sativa)
  misc_feature (71): n=t or c
ctcagcttctggacaggccagcgttgacgcacattctttggagctagaagaaatgcattcacctgcttganatagcgtctcatggcccggcgctcgtagcg

SEQ ID NO: 28405 - DNA, 101 bp, rice(Oryza sativa)
  misc_feature (71): n=t or g
tatgagggccattcctttggatccatatgaagccgtatatgagttataattgcactttcgcgcgcgaaatnattgttcttcatgtatatttttttaaaaaa

SEQ ID NO: 28406 - DNA, 101 bp, rice(Oryza sativa)
  misc_feature (71): n=a or g
gggggtgtagccgcgcgatccgccgtcttcgtcagacccggcctctctttcatcgtcatcctcctcatccncatccgtgtcggcgcgtccttggtggcatg

SEQ ID NO: 28407 - DNA, 101 bp, rice(Oryza sativa)
  misc_feature (71): n=t or g
cgggagtgcctcttccacatgttgagacgcatcaggttcaaatgattcactcatcttcttgctggatatantacctttttcattttttttcatttctgggg

SEQ ID NO: 28408 - DNA, 101 bp, rice(Oryza sativa)
  misc_feature (71): n=a or g
ggcgttgagcagagcgatgacatgcatgcatgctcttcaatacaaaatcgttgcgattttggataagttcntgtacggaaaatgatagtaaacgtacgaga

SEQ ID NO: 28409 - DNA, 101 bp, rice(Oryza sativa)
  misc_feature (71): n=t or g
aaaaaaactcgtggcacacgacgaaggcgacgcacaaatctccagaactcggggggcacaagcacaacttnatatggagtcgaggacgacgcgtcgccccc

SEQ ID NO: 28410 - DNA, 101 bp, rice(Oryza sativa)
  misc_feature (71): n=t or c
gacccctccgccaacttcaccctactccgtgagtgagctctccggacgcatatgccctgttctcttctctnctcttctcttggtggcggcgtgggtgatgg

SEQ ID NO: 28411 - DNA, 101 bp, rice(Oryza sativa)
  misc_feature (71): n=a or g
attggttctgagcgacgacaaaaatgatgactctgaaaaagttggcagcaagggggtgactggaaaaccangaaggcaagctaacccaaagaagaaaacat

SEQ ID NO: 28412 - DNA, 101 bp, rice(Oryza sativa)
  misc_feature (71): n=a or c
ccttttaagttacataaatagggtaagttcagtaagttgctgcatttgtgcctgcttgactgctgaattanaaaaacagggcaaagctctggttttttaag

SEQ ID NO: 28413 - DNA, 101 bp, rice(Oryza sativa)
  misc_feature (71): n=t or c
cctctccaaactggaccttcatttggaaaagcaaagccccgatgaaagttcaaatcttcgcgtggtttctnagcagagagcggttatcaacaaaacaaaat

SEQ ID NO: 28414 - DNA, 101 bp, rice(Oryza sativa)
  misc_feature (71): n=t or c
aaaagtttgtacctggagaaggttgaagtcttgcaatttgctactagttacttgtccttttggaatcagangagaaatttaccatgggacatctacacttg

SEQ ID NO: 28415 - DNA, 101 bp, rice(Oryza sativa)
  misc_feature (71): n=t or c
taatggcattgtcctcaagtgtcaccatcagctccccgctagaaaggtggaaagtgtgagcttctggtctncatcggtccacaaaagtcgtcagtaccgcg

SEQ ID NO: 28416 - DNA, 101 bp, rice(Oryza sativa)
  misc_feature (71): n=t or c
acaatttcaacaactttatagataacctaagtcaaagactcatcttggcataatttcatcggaaatgctantgggcgagcgattgccctcgctctcccagg

SEQ ID NO: 28417 - DNA, 101 bp, rice(Oryza sativa)
  misc_feature (71): n=a or g
tgcgtcatgtagtactccgggtccaggtacccctgccacgtcacatccacacgtgtcacaccgatagaaanaaaaaaaaaaagatagtttaagcttttggc

SEQ ID NO: 28418 - DNA, 101 bp, rice(Oryza sativa)
  misc_feature (71): n=t or g
tcatccgtcaatgctagctgatgcctcggtgaaggggacggaggaagattggaggaggatgcaggatgcancagcatgcagtactggagatggagaggaat

SEQ ID NO: 28419 - DNA, 101 bp, rice(Oryza sativa)
  misc_feature (71): n=a or g
agctaccgccagtgaaaattgaagtggtctatgtaattcagccgccattgaagagtcactttcactagctnttcttagcctttcactcctcattacaatca

SEQ ID NO: 28420 - DNA, 101 bp, rice(Oryza sativa)
  misc_feature (71): n=t or c
ctgcaatcttctttgccctttgcttcatggttccgctagagtgatgcaattaaggccctgtttctttcagnttgaaattattataatctagattattgagt

SEQ ID NO: 28421 - DNA, 101 bp, rice(Oryza sativa)
  misc_feature (71): n=a or g
aaaggtagcagaaacaccatctttaacgagatagagactaaccaatctaaggaaacaaacttccagatgcnactaaacagcagaagaggaccagatcgacg

SEQ ID NO: 28422 - DNA, 101 bp, rice(Oryza sativa)
  misc_feature (71): n=t or c
ccataccaagtctatgacatgaacctagctgtgtaggctagtttcaccaccggtaatctaaccagttaagntacgcttactttgttttacatacatatttt

SEQ ID NO: 28423 - DNA, 101 bp, rice(Oryza sativa)
  misc_feature (71): n=a or g
ctaatgaaaactatcccatttccagtaatatgtgtttcaaagtgtgtgctcgttgaggagatcaagacatngttattgcaaatttttcactctctgcccct

SEQ ID NO: 28424 - DNA, 101 bp, rice(Oryza sativa)
  misc_feature (71): n=a or g
agtacggataaacatggataccccatctcattcgcaaaataagtttcatccagtaatcgtttacaaaatangtattacacaggatcgacatctcactaatg

SEQ ID NO: 28425 - DNA, 101 bp, rice(Oryza sativa)
  misc_feature (71): n=t or g
aattaggaggagtctacccatcaaacggctgataaaaaaataaatatcgaacgcctcctacagcgctcagnagtagcgcacctcgcactacatgcaaagtg

SEQ ID NO: 28426 - DNA, 101 bp, rice(Oryza sativa)
  misc_feature (71): n=a or g
ggggacgggtggctctgggctcctcagctcacttttcctgagctactccattgggggtacacaatggggcnacccggtgccctgtcccccacctccttccc

SEQ ID NO: 28427 - DNA, 101 bp, rice(Oryza sativa)
  misc_feature (71): n=a or g
acattttgcttcgtttgccatgttccatgcatgtggaggtgaggtgctctgcattgagatcaggattgcanaagagaatgtagtgttggaaggagaaacaa

SEQ ID NO: 28428 - DNA, 101 bp, rice(Oryza sativa)
  misc_feature (71): n=a or g
aaccgcttcccgagcaccatccgcgtgatcacgttcatgctcagcgtggacaggtgatccctgttgaggtncacggcgccgctgcgtcccgacgacgccgc

SEQ ID NO: 28429 - DNA, 101 bp, rice(Oryza sativa)
  misc_feature (71): n=a or c
tcatgcacggcctcaacaatcctgtttgccactcagctcaaatgccgataaaattgtattgcagagaatcnatctcaggaacgaagcgaaaactgcaactc

SEQ ID NO: 28430 - DNA, 101 bp, rice(Oryza sativa)
  misc_feature (71): n=a or c
cacctgcatttgtcaatgatgagaacccatagtttttttcaggacttgtcatgttgccaaacttagtctgnaagactatactgtcatgaacgcctacatga

SEQ ID NO: 28431 - DNA, 101 bp, rice(Oryza sativa)
  misc_feature (71): n=a or g
ccttaccacacaggcaaaccgactagggatagacacctagtaagaactatcctaaagatccatgattcccncatcactcaacctaagcagcaaaataatca

SEQ ID NO: 28432 - DNA, 101 bp, rice(Oryza sativa)
  misc_feature (71): n=a or g
cgccgtcgcgtgcaggaggtttggccggaacatgaggtacaccaccatcgccaccacaagcacgcaccccntccccgccaccacgcagctcgccacgccgc

SEQ ID NO: 28433 - DNA, 101 bp, rice(Oryza sativa)
  misc_feature (71): n=a or c
agcggaatagactcaacgctatagattgatcttactatgcggagtacagatataagcgcacccttcccttntctcctcaaccgacttatagaaacaaaatc

SEQ ID NO: 28434 - DNA, 101 bp, rice(Oryza sativa)
  misc_feature (71): n=a or g
tcgggtgcaagagacttaacggggggagggattacggattaccaagaacggacttgatcctctcgaccccngcgggcgagggcaccgcgccggcggaggca

SEQ ID NO: 28435 - DNA, 101 bp, rice(Oryza sativa)
  misc_feature (71): n=t or c
catgtttacttctgagtgcaaaggctgacatgcatataaattgtaagttgttgggtagacacagaaaagtncaggagttttccagctagcttcataagatg

SEQ ID NO: 28436 - DNA, 101 bp, rice(Oryza sativa)
  misc_feature (71): n=t or g
aaattgaaagatatacttacccatggtggaaagagaaggtgattgactcgaatgcaaagaggaaagatganctctgcccattaacaatggaggaggctgca

SEQ ID NO: 28437 - DNA, 101 bp, rice(Oryza sativa)
  misc_feature (71): n=t or c
gtgatgcccggctgtttgcgagtgcttctccgtcaacacccccactcactcttcccagttttagaaatttnagatctattaggtggattagggtttgtctt

SEQ ID NO: 28438 - DNA, 101 bp, rice(Oryza sativa)
  misc_feature (71): n=t or g
aagaagaaacaaagaggtgagcatatgattagtgagccaatgataatggtaagttaggccttttttttttnaaacacggtacaaacgctgaaacgtataaa

SEQ ID NO: 28439 - DNA, 101 bp, rice(Oryza sativa)
  misc_feature (71): n=a or g
ttagtatccatcacaaaattgcaagccatgcaacagaaaaaggatggagctgaatacgattacagaaggcntgaacaatagattgagttccactgtgtatc

SEQ ID NO: 28440 - DNA, 101 bp, rice(Oryza sativa)
  misc_feature (71): n=t or g
tagagaattagtaaataaacatagaaaatttgaaggtaggaggccagatctgggagggagggctatatctntgtctcgtcttcttcctcaaaccgttccag

SEQ ID NO: 28441 - DNA, 101 bp, rice(Oryza sativa)
  misc_feature (71): n=a or g
aagtgagcctggattgctgctgccttgtcgtaatggcgttctacccatacggttccttttttaatgtgctngatgaagttcttccttcgcctggcattaat

SEQ ID NO: 28442 - DNA, 101 bp, rice(Oryza sativa)
  misc_feature (71): n=t or c
gtaagctcgaagtagggtgtcagtgcttccttcattcccttctgcatgaacacagtcctctctggaatctntccgagaagtagtctcactataatagccca

SEQ ID NO: 28443 - DNA, 101 bp, rice(Oryza sativa)
  misc_feature (71): n=t or c
ttcttgacagattaatctaagcaaaacccgactttaaacgattgcggctattgactaatatgattagggangtcctagggttgccctagggtgcacacccc

SEQ ID NO: 28444 - DNA, 101 bp, rice(Oryza sativa)
  misc_feature (71): n=t or c
ggccttttctggaccaattcgtaaaggaataagttcactttgaccaattcagttttgcggttcaggcttangaatcagattcggtttacttttaaggaagt

SEQ ID NO: 28445 - DNA, 101 bp, rice(Oryza sativa)
  misc_feature (71): n=a or g
gagactctgtgttgattacagacacttgaatgctttaactatcaagagcaagtacccagttccaataatanaggaactgttggatgaattgtctggagcca

SEQ ID NO: 28446 - DNA, 101 bp, rice(Oryza sativa)
  misc_feature (71): n=t or g
gttgttgttattatcactgttgttcttgttgctgttgctgttgtctgtgatgttgctgctcagtgtggccncggtcgtgttgctgccggttttgttagggt

SEQ ID NO: 28447 - DNA, 101 bp, rice(Oryza sativa)
  misc_feature (71): n=t or g
tgctcggaagaccttggttatatgatcatgatgttcaaattagtggccgcaacaacaagcatgttttaatntacaaagacgagcatatctcattactaccg

SEQ ID NO: 28448 - DNA, 101 bp, rice(Oryza sativa)
  misc_feature (71): n=t or c
ctaaaatgctaaatgcatgagccatggaaactcgattcgcatttcgccagcacagttcttgtggtgaagtntgatcctacttaacacgcattcgaccatgc

SEQ ID NO: 28449 - DNA, 101 bp, rice(Oryza sativa)
  misc_feature (71): n=a or g
actgtttaatgtcgatgatgtaaaagttgtatcaccctctctcttaataaattttgggcggccaaccttcngccgtcccggcaaaaaaaagtctgggcttg

SEQ ID NO: 28450 - DNA, 101 bp, rice(Oryza sativa)
  misc_feature (71): n=t or c
tctgccacgcgcacacacgcaactagatgatctcgtacctatggggctgcatgccccagcatgactggcancgtctccatcttggcccagacactctgcag

SEQ ID NO: 28451 - DNA, 101 bp, rice(Oryza sativa)
  misc_feature (71): n=a or g
attcaattatctgaagtttgtaggggatgctatgtcagctattgctgccaattgtaatgtcccagtcagcnttaagtgcagaattggtgttgatgatcgtg

SEQ ID NO: 28452 - DNA, 101 bp, rice(Oryza sativa)
  misc_feature (71): n=t or g
aaaataaatgtttctttgtctttgctttgtgctagcaagcaaaccttaatttgattgatcgttccatatanggggtgtttagatggggctaaaacttttta

SEQ ID NO: 28453 - DNA, 101 bp, rice(Oryza sativa)
  misc_feature (71): n=t or c
atctttctatagaaatatcaaccattgacaactcaggtcaactgaaatcaccacacaaaaccaaatccaanaaatttagcttaacttatatacctcgtggt

SEQ ID NO: 28454 - DNA, 101 bp, rice(Oryza sativa)
  misc_feature (71): n=a or g
atcgttctacctttagctgattcttgcatgtaccactcatggaacttgtgcaactgtgtggagagagtctncagttgatcaggcttgacaagcagttcacc

SEQ ID NO: 28455 - DNA, 101 bp, rice(Oryza sativa)
  misc_feature (71): n=a or g
gacttgaacgccggccgctacgactactactactggcttctcgccggccttggcgccgtcaacttcgtctncttcctctggtgcggctgggcgtacggcga

SEQ ID NO: 28456 - DNA, 101 bp, rice(Oryza sativa)
  misc_feature (71): n=t or c
ccatatacatatttaggatttttttgacggagaagtagtttgtaataattattagtgggcaccaattactncctttattttttaaatagatgacgccgttg

SEQ ID NO: 28457 - DNA, 101 bp, rice(Oryza sativa)
  misc_feature (71): n=a or g
cgtgcagtttctctagttgcacaaagtagaggacttcgtaaaaatgccagtttaccacatagttgaggggngcaacccactttttccacaacagcatgcga

SEQ ID NO: 28458 - DNA, 101 bp, rice(Oryza sativa)
  misc_feature (71): n=t or g
gcgttcgtggtacggcggaggaagcgaggttgcgccctttccgaccgtttcttggctatccgccccgattngagaaagctgggtgtttcttttttctttct

SEQ ID NO: 28459 - DNA, 101 bp, rice(Oryza sativa)
  misc_feature (71): n=t or c
tgcacctaacgccatcaagaagattcagatggcagccgagactcgttgcgggtgcaagttgcgtgtgttcngcacggacaacggcggcgagttcacgtcgc

SEQ ID NO: 28460 - DNA, 101 bp, rice(Oryza sativa)
  misc_feature (71): n=a or c
ccgcgactagctgactagcgacctacgagtattcttttcttccaagctgccggtttttgtcagaaaattgnctagcgtcaagggcgggtacagacgtactc

SEQ ID NO: 28461 - DNA, 101 bp, rice(Oryza sativa)
  misc_feature (71): n=t or g
gaggccatgaactgggattagtggcaggattaggggttatagttagggttctctcctcctcagtggtggcngtgggtgggaggaggggagctttcttgggg

SEQ ID NO: 28462 - DNA, 101 bp, rice(Oryza sativa)
  misc_feature (71): n=a or g
taagaggttttgaacctaaacttaaaagacaaacttgggtgggcatagcagcaatttgttgttctttgtgnctcagtaggaatgagttagtctttaatggc

SEQ ID NO: 28463 - DNA, 101 bp, rice(Oryza sativa)
  misc_feature (71): n=t or g
tctgtaggttggtgatatcggatacggaatacccattggatctcgtatacacacgcagaacatgaatatanaacgagggttcgcgttagtggcatggattc

SEQ ID NO: 28464 - DNA, 101 bp, rice(Oryza sativa)
  misc_feature (71): n=a or g
tccaccaatcaacagtctctcaagcaccattgccgctggttgcctatgtgaggctgcgaagattaacttcngtgtcaccgccgatgtcctcttccttgagg

SEQ ID NO: 28465 - DNA, 101 bp, rice(Oryza sativa)
  misc_feature (71): n=t or c
cttttatcaggattgtgtcctgaggccaaagtcatttcatacaactagaagtgcatcactagaaaaaaaangtaacacattggtggacatcatatactcat

SEQ ID NO: 28466 - DNA, 101 bp, rice(Oryza sativa)
  misc_feature (71): n=t or c
atatatctagacatagctaggaacatatatctagacatgctcttgtctagatatatgtgttatatctctcnaaaatcccttatattatgggacggatgaat

SEQ ID NO: 28467 - DNA, 101 bp, rice(Oryza sativa)
  misc_feature (71): n=t or c
cttcgaaaagcatatgtactttgaatgtgaataatggaatgttaactcttaaaactatgacatgtgggtcncacatgtatttccctcttatatataaaacc

SEQ ID NO: 28468 - DNA, 101 bp, rice(Oryza sativa)
  misc_feature (71): n=t or c
caagcatagcacttgcccagaagggttcaagtgtaggatgtttgaaatggctagattcatcaaagccatgngtctcgatgttggcttcatcaattacataa

SEQ ID NO: 28469 - DNA, 101 bp, rice(Oryza sativa)
  misc_feature (71): n=t or g
ttatcgccccagggtgcacccagagggtagttcccgaggcacacattggaccccaagcgacactactactnctcggggcatatttgcctttaggtgcagcc

SEQ ID NO: 28470 - DNA, 101 bp, rice(Oryza sativa)
  misc_feature (71): n=a or g
taagtgtcataatgacaaggttgaatagaaaaggcacatgggaatctataatgaggatattgaagcactangcttttgtttatacaaacacgggggaagaa

SEQ ID NO: 28471 - DNA, 101 bp, rice(Oryza sativa)
  misc_feature (71): n=t or g
atacctgagctttagaatcagactggaagcttttttggtcttgcttgttaaactccttttgcttccaaccnaaagcatagggttcttttgcttcacgagta

SEQ ID NO: 28472 - DNA, 101 bp, rice(Oryza sativa)
  misc_feature (71): n=a or g
gaggaagaatgtacacgccctctctcccgcatctcgcggtcagcctcgcgctcaccacctgcccttgattnccatgccagtccgggctccagcgccacggc

SEQ ID NO: 28473 - DNA, 101 bp, rice(Oryza sativa)
  misc_feature (71): n=a or g
catatgctgcaggattactcttctgcttggacccccggggtgcggcaaaaccacactcttgaaagcacttnctggaaggctcaataaaagcctcaaggtat

SEQ ID NO: 28474 - DNA, 101 bp, rice(Oryza sativa)
  misc_feature (71): n=a or c
ctttgtgaagccatcgagaagctatcatccctccaatctctctgtgtttatgagggttactacttcataantgggacacttgagtggctgggtccttgcaa

SEQ ID NO: 28475 - DNA, 101 bp, rice(Oryza sativa)
  misc_feature (71): n=t or g
cctcatgaaggaaattattcttttccttttataactccttgtgatgttgcaggcagatgccatggtcagtnatcagtggtcagtcgactgcaggtttgcaa

SEQ ID NO: 28476 - DNA, 101 bp, rice(Oryza sativa)
  misc_feature (71): n=t or c
tggccgccgtaggagctcgcgcaccagtagcgccacgcttcagtgccgttgtcgaacctcaaggtgaccgnattgttgtcgtcggggtccagccacacact

SEQ ID NO: 28477 - DNA, 101 bp, rice(Oryza sativa)
  misc_feature (71): n=t or c
gaagacccctagcgaatgcggccccccacaggcggctaattttgccaatgcgtcagcctcttcgttttganctcggggcaagtgttcgaccgttatgctgg

SEQ ID NO: 28478 - DNA, 101 bp, rice(Oryza sativa)
  misc_feature (71): n=a or g
tttatcgtttatttatttatttttttcgcgtcgcttttctttgatgcggaagtgtgttgtgggtgtggaangtggtggtggtggtgcgtgcgagggagtga

SEQ ID NO: 28479 - DNA, 101 bp, rice(Oryza sativa)
  misc_feature (71): n=a or g
ctgcgtatgccctaggtctcaccttcttggatgggtcgtttgatgggccattcttgtcgcctgatgggccncttgggcttatcatgcttgggcaagtcggg

SEQ ID NO: 28480 - DNA, 101 bp, rice(Oryza sativa)
  misc_feature (71): n=t or g
gcatacacaaagaaataaacatgtagctgttgaacaataagatatgcttacatcagccatagttggtttcngtcttctttgagccacagaggtatctggtt

SEQ ID NO: 28481 - DNA, 101 bp, rice(Oryza sativa)
  misc_feature (71): n=a or g
ccgtcaaagctcaacaggtagaacaagccatcattcttgttgtaaagcgcatcggtatagccggtatcccntttgagcgatccattgctcgttgtccggtt

SEQ ID NO: 28482 - DNA, 101 bp, rice(Oryza sativa)
  misc_feature (71): n=t or c
acaacctcattggaagcttcgaaacatatccgtggggacacctccatgtccaaaccttggagtctctaganggttatcatgtgtgagcatggcatgtggtg

SEQ ID NO: 28483 - DNA, 101 bp, rice(Oryza sativa)
  misc_feature (71): n=t or c
agtcgtgtatcagcaaccaagctgatgttaccagtagcgatcttatttttcactcgatgaacaatgtggcnaagttctggaagtatgggagattcacctat

SEQ ID NO: 28484 - DNA, 101 bp, rice(Oryza sativa)
  misc_feature (71): n=t or g
ctctctataaacctatatatgttacatggtttcagtgtaatggaggacgtgatccccgacatgaagaagancccctgccttgacagtggggggttgtttgg

SEQ ID NO: 28485 - DNA, 101 bp, rice(Oryza sativa)
  misc_feature (71): n=t or c
tatggaacaagattgttccgttagcctttcaattcgtgacgtcaaatctgcagagaaatactccctccttncctaaatgtttgacgccgttgactttttta

SEQ ID NO: 28486 - DNA, 101 bp, rice(Oryza sativa)
  misc_feature (71): n=a or g
taattatataagtcagcatgaacagaatccttatgaaccacaatactcttgtctggagaggttaaagcctnttcatcagtagatatgctgactgccgaatc

SEQ ID NO: 28487 - DNA, 101 bp, rice(Oryza sativa)
  misc_feature (71): n=t or c
ggttagtctgcagccatggcgatgaacattctttttctgacaagaaacacgaagatagctaaccatgaggngagctcgagtggcgatggagtactcctcgt

SEQ ID NO: 28488 - DNA, 101 bp, rice(Oryza sativa)
  misc_feature (71): n=t or c
ttggtcgccgtgtcaatatataaccaggggacatttaattatttgcattatgtgtctatgacatgtgggtncagtgacaaatcgtttagaaccactcataa

SEQ ID NO: 28489 - DNA, 101 bp, rice(Oryza sativa)
  misc_feature (71): n=t or c
ggattatcttttcgctctcgtctcacctatacatgtcgtaatgggaacagaagagaagaagcatcggcaanagagcagaagcagaagcagaaggaaggacg

SEQ ID NO: 28490 - DNA, 101 bp, rice(Oryza sativa)
  misc_feature (71): n=t or g
tgctgcagcaggaccttgtgcaagccccagcttgtccgacctccctattgatctcctcctaatcatcctgnaacgactggagcttcctcatgcacttgcct

SEQ ID NO: 28491 - DNA, 101 bp, rice(Oryza sativa)
  misc_feature (71): n=t or c
atttaccccgttaatctattaaatactctagcggcggatccaagtaagtcgatcagccgtctaggtttttncattgcgtctcaaccgccaactgttgccca

SEQ ID NO: 28492 - DNA, 101 bp, rice(Oryza sativa)
  misc_feature (71): n=t or g
gtcgccccaaggtagggaacagccggatctgacaacccccattcccctccaatgtcgtggcggttagaccnaccaggaggatggaggagacaccagctccg

SEQ ID NO: 28493 - DNA, 101 bp, rice(Oryza sativa)
  misc_feature (71): n=t or g
ttgggttagccaatgcttcgagtacttctaatggaaatggcaccggatggggagagggtggtggatctatngacggggccggtggagggtccgggagtggt

SEQ ID NO: 28494 - DNA, 101 bp, rice(Oryza sativa)
  misc_feature (71): n=t or c
ctccatctatatctgatgccgattgcttctacccctcgctatctcaaccctcatcctcctaactaaggggntgtttggttttcagggacttattcacctca

SEQ ID NO: 28495 - DNA, 101 bp, rice(Oryza sativa)
  misc_feature (71): n=a or c
aaaattacttaaaagggttcatttttttaggacaaagcatggctgctgcaaaaatataggtggataggagnttgactgtttctgtttttaaaagctattgt

SEQ ID NO: 28496 - DNA, 101 bp, rice(Oryza sativa)
  misc_feature (71): n=t or c
ttgtggtggtttgatttccagtttcatccaggcatatacaaacacttgtccatgtccaaaagtgggccaanggataaggaggctgattttttttgtttctc

SEQ ID NO: 28497 - DNA, 101 bp, rice(Oryza sativa)
  misc_feature (71): n=a or g
tctctatatacctctccgtatggtattcactacactaagccattgcgcatgtttctcttggtttatctccnggtgtgtgcctcttccttgttagtttcgat

SEQ ID NO: 28498 - DNA, 101 bp, rice(Oryza sativa)
  misc_feature (71): n=t or g
taataagaagaattgtgtgtgctctgcgtcttcacgttctgaatatctcaagaaatatcctgtaaactttnttagcacgttcttatgggaccaggaaggat

SEQ ID NO: 28499 - DNA, 101 bp, rice(Oryza sativa)
  misc_feature (71): n=a or g
aaatgaactgcactcatccttatctagggctgttaggacagcggtgactagtgagtggatcttgttgcttnctcctacgttgagttactccctccgtcaat

SEQ ID NO: 28500 - DNA, 101 bp, rice(Oryza sativa)
  misc_feature (71): n=t or c
atgcatgatagaaaggtgtagctagaatatattctagatcgaattgatcctgtgcaagttcctccggcgancgatcgatcacatccagctgcgtcaacttt

SEQ ID NO: 28501 - DNA, 101 bp, rice(Oryza sativa)
  misc_feature (71): n=t or c
cctcctggacttgttctttcctccccttgtcgaatctcctcacatccagcccttccctttgttcaccttgncagactctccccttttcaccttgccagttg

SEQ ID NO: 28502 - DNA, 101 bp, rice(Oryza sativa)
  misc_feature (71): n=t or c
ttttcagttttggttttttttttttttggtggtggggggaggaaccatcctgtgctcaattaaaagtgccnatacattatccggtaggtactatgtgctcg

SEQ ID NO: 28503 - DNA, 101 bp, rice(Oryza sativa)
  misc_feature (71): n=a or c
tgacactactactacctgctatctgttacagtgagtatacatgtttgcacttacataaactcttattttgnactaatcaattaaaccaaagtagtgctttg

SEQ ID NO: 28504 - DNA, 101 bp, rice(Oryza sativa)
  misc_feature (71): n=a or g
gtgtcgaaagcaatagacggcggccgccatacggagaggggaacacacgctctgatttcggaccctacgcntaggacacgatagtagtaggctcgtggtgt

SEQ ID NO: 28505 - DNA, 101 bp, rice(Oryza sativa)
  misc_feature (71): n=a or g
atattttatagacacagatgggcccatttgtcatcgtacatgcttacaagattggatttggcattagaacnaagaggcatgtatgcaacgcagatgtcagt

SEQ ID NO: 28506 - DNA, 101 bp, rice(Oryza sativa)
  misc_feature (71): n=a or c
gtagaggttcttcaacagcggctacgtcgtcgtggtgataaaatgattgttcaagctttagttcgctggtntggtacttcgtcatccaccacttcttggga

SEQ ID NO: 28507 - DNA, 101 bp, rice(Oryza sativa)
  misc_feature (71): n=a or g
cagttaagggagaaaattgtgacgtctttctctcataggtttgtgccaacaaagaagaaccgacgacggcntatgctaaaccaggaagtcaggaattcctt

SEQ ID NO: 28508 - DNA, 101 bp, rice(Oryza sativa)
  misc_feature (71): n=a or c
ggttctccagaatgtataattccaagtttccaactcttcactcacattggtagttgatatgacctcagtantattataaccatctcaattgcagattattc

SEQ ID NO: 28509 - DNA, 101 bp, rice(Oryza sativa)
  misc_feature (71): n=t or c
ctccctgcagtagcaagttggtgacaatctcattgaaccgtgccacaacctgtaggacaaaaaacaacaanaacaataacaacaacaacaacgttaggcag

SEQ ID NO: 28510 - DNA, 101 bp, rice(Oryza sativa)
  misc_feature (71): n=a or g
tggcctctcgccgatccgattcccacacatgactaagacatgactcacatgctccctccgtaaaaaaaaangctaaaatgtgatccctcctagtattacga

SEQ ID NO: 28511 - DNA, 101 bp, rice(Oryza sativa)
  misc_feature (71): n=a or g
taaaccagatagttgctcagacattccatatatagcttcctgatctctcttaatacctgacagaccagacncggtatcattagattgctcgttttgatcag

SEQ ID NO: 28512 - DNA, 101 bp, rice(Oryza sativa)
  misc_feature (71): n=t or c
caatccgcttgcgcgcgcccaggccatataataatggatcgatggatggccgctcgactcccaaccaactncttctccatctcagtcgctcgctgatcagc

SEQ ID NO: 28513 - DNA, 101 bp, rice(Oryza sativa)
  misc_feature (71): n=t or c
tttaggatcaacgccagataaacagtttcatcggtcgtcataggatttctttgtaagcatttcgcacgaangcacgacgataacaaagaagcgattttagg

SEQ ID NO: 28514 - DNA, 101 bp, rice(Oryza sativa)
  misc_feature (71): n=t or c
gggagttatgaagattgactgggagcagaaatggctggagtatctggacaatggttttcctgttaaaattnaaggggtacagtccaaggtggatgagtgcc

SEQ ID NO: 28515 - DNA, 101 bp, rice(Oryza sativa)
  misc_feature (71): n=a or g
tacttaccgaacgttaatttagagtgcctaattggttactacttgtttcaaggtttgcgaacgcaacactncgtggtattatttttcttcttttcataatt

SEQ ID NO: 28516 - DNA, 101 bp, rice(Oryza sativa)
  misc_feature (71): n=t or c
gtgtgcttgacaggtagaactgctctgattattgcaacactttgtaaacatttaagcactgtcaagtatcntcttgatcatggtgccgacgtaaacaaagc

SEQ ID NO: 28517 - DNA, 101 bp, rice(Oryza sativa)
  misc_feature (71): n=t or c
ctggttactgattttcataatgtagtcaagcagggttcattctgtacgccatatagaatatcctgattggnctgatcatggagttccaactaatactgatg

SEQ ID NO: 28518 - DNA, 101 bp, rice(Oryza sativa)
  misc_feature (71): n=t or c
tcttcgataggcgctgcagcacacaacactttgggatttccttcaccttcacctccagatgcttcaatacngagagaatatgcttgcaagggatcccttca

SEQ ID NO: 28519 - DNA, 101 bp, rice(Oryza sativa)
  misc_feature (71): n=a or c
aaaggcagatgttttcagctatgggatgatgcttttcgagatcatatcaggaaacagaaatgcagattggnatcggcaaggtgagcaaggtgcagggacat

SEQ ID NO: 28520 - DNA, 101 bp, rice(Oryza sativa)
  misc_feature (71): n=a or g
gccttggtgaagctagtaccctcagccttcctgaaagaaattttcttattcccatccaagatttcctcctnaagcatagccactgagcaagcagcatccag

SEQ ID NO: 28521 - DNA, 101 bp, rice(Oryza sativa)
  misc_feature (71): n=a or g
aagcattcccgacaaaacaagtgtcaattatggagccattaggatagtacttagctttcagcacttgagcncacaagctatcgggtattgtcaataatctt

SEQ ID NO: 28522 - DNA, 101 bp, rice(Oryza sativa)
  misc_feature (71): n=t or g
cccagactccaaatttagcatagggacatgccgaaaaatctggtaccaaatccagtcacgcttgagtattnaaacatattttttttgcaaccacacgatgg

SEQ ID NO: 28523 - DNA, 101 bp, rice(Oryza sativa)
  misc_feature (71): n=t or c
aacattcatgcatgggaactacgatggcaaggggaatgatcttgtcagctcgccactggttttcgatgtcnatatggggcttcatttctgggaccggatca

SEQ ID NO: 28524 - DNA, 101 bp, rice(Oryza sativa)
  misc_feature (71): n=t or g
gtttggttgcattggtgtcttatgttttgttgtgctcaacgtgagaaatgcgatggcagggtacgtactgnggcagcgtgatgcccgtgactcagcactta

SEQ ID NO: 28525 - DNA, 101 bp, rice(Oryza sativa)
  misc_feature (71): n=t or c
aaaaaaaacaaattctaatcactcacttattagtcagctacctcgttaggctcgaattttccaatttgctnccatagggagtcgaacccaggacctcaggt

SEQ ID NO: 28526 - DNA, 101 bp, rice(Oryza sativa)
  misc_feature (71): n=a or c
actgtgatcttatccctaagctgatagactggaacatcgacataattgaagagaaccaacaaacactaatntcgattggaagcaaaacacatattcatcta

SEQ ID NO: 28527 - DNA, 101 bp, rice(Oryza sativa)
  misc_feature (71): n=a or g
gtttttatataggaagtgttgcccacctgcaatcctatctgctatgatcaatgttttggcagcaaaatctncggtgagctttagcgctattccctccgtcc

SEQ ID NO: 28528 - DNA, 101 bp, rice(Oryza sativa)
  misc_feature (71): n=a or c
aagatgttgaatttgtttcaaatttatacgtagaaagtttccatactcaaagatgtcatatgtgcaaaatntatgcatattgtttttggattgggccaaca

SEQ ID NO: 28529 - DNA, 101 bp, rice(Oryza sativa)
  misc_feature (71): n=a or g
agggtgtagcagtagcagttcttttacagtagtactagggggtagcagtagtagccaggtttcccaaactnccggggccggggttaccgcgccccggcggt

SEQ ID NO: 28530 - DNA, 101 bp, rice(Oryza sativa)
  misc_feature (71): n=t or g
actgaagggaaggccaaactctaaggtttatgccacctagccaatcaggagacatggtgcatggcatacantgttcaaaagagggtcattatagctttgaa

SEQ ID NO: 28531 - DNA, 101 bp, rice(Oryza sativa)
  misc_feature (71): n=a or g
cattggacaaaacaatatcaaacttagaaatggagttagcatcagcaaaggcgtcacaggaggagtctganctcaatggagcgccgctatcagaatctacg

SEQ ID NO: 28532 - DNA, 101 bp, rice(Oryza sativa)
  misc_feature (71): n=t or c
ctgataaccgggaaggacgattggcctagtgcagactgtgcggtgcgtaatgctgagagatgttttgacgngctcatcgatcggtggcttgtttatccagg

SEQ ID NO: 28533 - DNA, 101 bp, rice(Oryza sativa)
  misc_feature (71): n=a or g
tgctggagttgccggagctggtggaggctgcaactttggatctggactgagagatctggatagagaggcangggagatagttagtgggcgcggtggagggc

SEQ ID NO: 28534 - DNA, 101 bp, rice(Oryza sativa)
  misc_feature (71): n=t or g
caaaaaagatcctcgctagaggctttacaggtgcttcttggaagagaagaggggcacaatcgaataatttnactaaagtttgtgcaaattttagtaatccc

SEQ ID NO: 28535 - DNA, 101 bp, rice(Oryza sativa)
  misc_feature (71): n=a or g
cctaaattttaaaccctgaatcataatcctagacatgcactcaccgaaaacgtcggaggcaaggaggacanccttggtggaatggacggcaccagtgacat

SEQ ID NO: 28536 - DNA, 101 bp, rice(Oryza sativa)
  misc_feature (71): n=t or c
tttttaaaaaagaatcggtgggaccaacctatcagattcccacccctctcacttctctctatcctagcttnctcattccccaccttctctctccctcttct

SEQ ID NO: 28537 - DNA, 101 bp, rice(Oryza sativa)
  misc_feature (71): n=t or c
gtgcacctgcacaccggccggttcttgtttgaaaggccggtgcgtttagtacgctgcatccgcagcgtgangacagcgtgacgacaggcaaaggagacaga

SEQ ID NO: 28538 - DNA, 101 bp, rice(Oryza sativa)
  misc_feature (71): n=a or g
ggccctaaggaataagcccactttgacttccttaactatatatcggccccctccctcaactattaaaatcnatcaaatttgactcccttgacagttttaga

SEQ ID NO: 28539 - DNA, 101 bp, rice(Oryza sativa)
  misc_feature (71): n=t or c
gctcgctctaggtctggtgactgccttccagggcacgcctatcagagcatcttcgcaatggtttcgattcnctaatcctcttgatatcctagcaggtgtgg

SEQ ID NO: 28540 - DNA, 101 bp, rice(Oryza sativa)
  misc_feature (71): n=t or c
cgctctgctcggcacggtcgccaaatccgcccccaagcacattgttcccttcttctatgcttggctagatntggtcactccgcccgacacctcgctttctt

SEQ ID NO: 28541 - DNA, 101 bp, rice(Oryza sativa)
  misc_feature (71): n=a or g
agcctttattggatgaaaaaaaaaaagcaaagatacgagagaaaatagcaaaatattagctaaaaaactcnctttttttataaaataaataaagtataact

SEQ ID NO: 28542 - DNA, 101 bp, rice(Oryza sativa)
  misc_feature (71): n=t or c
acgtgagaagcaaactcactaagcacatgagccccaatctcttccatgtacatgaattgcatagaagcaangaactaagtcacgtggaagtctagcaattt

SEQ ID NO: 28543 - DNA, 101 bp, rice(Oryza sativa)
  misc_feature (71): n=t or c
acgtgggaaaatctcgatagacaacggtggaaatgccactaggattagatttggaacttgggaattaaaanagagggaatgttgtgcattaatatgatatg

SEQ ID NO: 28544 - DNA, 101 bp, rice(Oryza sativa)
  misc_feature (71): n=t or c
cactccaaattggtgaatcttcttctgcatgtcaagaacaattacaacagttggacattagtggtgagatnaactcagagactaatacaagaaatgaagtt

SEQ ID NO: 28545 - DNA, 101 bp, rice(Oryza sativa)
  misc_feature (71): n=t or c
tggagaggcctgaggtccttcatggagaattcagcttgcaaggcggaaattgtccaacgaagaagactgtnagaggaggctgtgagcacaatatcatcgac

SEQ ID NO: 28546 - DNA, 101 bp, rice(Oryza sativa)
  misc_feature (71): n=t or c
ttgttagtcgcaacattcaaatctcggtatatgaactgcctaggtcccccaatttccttaagatctaagtngtcattgctccttcttgtccacataaaaca

SEQ ID NO: 28547 - DNA, 101 bp, rice(Oryza sativa)
  misc_feature (71): n=t or c
aatatggtatatggatgcgagtctatctacctgtacatacctactcgatccacccacatcccaatttaatnatctcctaagaatattttagatcttttcaa

SEQ ID NO: 28548 - DNA, 101 bp, rice(Oryza sativa)
  misc_feature (71): n=t or c
aattggttgttgcccgatgaaacaaaagtccctcaaacaagagaatccatagcagccactgattatgagantgtctctgtaccctggtacacggagagaaa

SEQ ID NO: 28549 - DNA, 101 bp, rice(Oryza sativa)
  misc_feature (71): n=a or g
tttgcagtgggtatccttgcagaaacaggtgactgaggtgatggagaaggtgtccttgcatccattgccgnctgaggaacatttaaaacacgcaaggagag

SEQ ID NO: 28550 - DNA, 101 bp, rice(Oryza sativa)
  misc_feature (71): n=t or c
ggaggctctgctccttcttcggcggccatctcctctcctgcttcggtctcctttcgctttgcgaccttctncttcacgaccctcttcggtggcattcgctc

SEQ ID NO: 28551 - DNA, 101 bp, rice(Oryza sativa)
  misc_feature (71): n=t or c
gtccattctggatgactagcctatatgcgtggtaaggccagttgttgtgctttagtagtagcttctattgnagaggatctctacttgtaagataaaatatc

SEQ ID NO: 28552 - DNA, 101 bp, rice(Oryza sativa)
  misc_feature (71): n=a or c
ccaatggattttgcaatcaagctcgcagaaaagcatcttcctctttgcgctgccccaccgctttacctccncttcgacaataccggccctgttgcaaccac

SEQ ID NO: 28553 - DNA, 101 bp, rice(Oryza sativa)
  misc_feature (71): n=t or g
aggtgatggtgagcccacaccagcaatctcaaatggttggccagacagaagaaggtttcaaagcccttcangtcagcaatatgacacaatgcataaccggc

SEQ ID NO: 28554 - DNA, 101 bp, rice(Oryza sativa)
  misc_feature (71): n=a or g
taatgtttctctagctctcttttgtttttctgaccaaattgatcactgagggtgagtttgaggaatagggnattgaaaagattgggaagatacgcaaaacg

SEQ ID NO: 28555 - DNA, 101 bp, rice(Oryza sativa)
  misc_feature (71): n=a or g
gaaaacagggattaaagatggattccctaatagtgagtatttaatatatttttgatagtgcgtttattttntgtttaaagtatttctatactttttataag

SEQ ID NO: 28556 - DNA, 101 bp, rice(Oryza sativa)
  misc_feature (71): n=t or c
aaaaatgtgcatacctctgccagttgatcatgtttgagaaggctcttcactctgtatacctggttacttgncaaatattgatattttaagagcttgacatc

SEQ ID NO: 28557 - DNA, 101 bp, rice(Oryza sativa)
  misc_feature (71): n=a or g
aaggaacttttcgactgcatcaattgcaatccttgttttccagtacttgcgagtaagaaaaatcatcacgnccaacggtgcgaacacaaacctgcatagca

SEQ ID NO: 28558 - DNA, 101 bp, rice(Oryza sativa)
  misc_feature (71): n=t or c
gagttgaaaatttcccagcattctgacatccgcccacattctccatacattttaacaagagcatttgaaanagaggtatctaaatatagtccccattttac

SEQ ID NO: 28559 - DNA, 101 bp, rice(Oryza sativa)
  misc_feature (71): n=a or c
ttgcttttgcgaaaaagagatggcaaaaactgcgttttgtcccgagacaggcagtcagaccggtgctttanccccagtcagaccggcggtaagccttcggt

SEQ ID NO: 28560 - DNA, 101 bp, rice(Oryza sativa)
  misc_feature (71): n=t or c
aaagaaaaaatggctggccctacttgtcagcagcgttgggttgatgaaggcttcatgttaacatttgtgtnattccaagtcgaactttggaagcatgaata

SEQ ID NO: 28561 - DNA, 101 bp, rice(Oryza sativa)
  misc_feature (71): n=t or c
aggaggcattgagggctccggaggaggaaacgttcccaggcggtttcctgaggtcggtggcggttcccgangaaggaattggcgtcgaacttcggcggcgg

SEQ ID NO: 28562 - DNA, 101 bp, rice(Oryza sativa)
  misc_feature (71): n=a or g
cattgataagtaaagaaacaaaagactatactaaaagcagctaaacttgaagatgaacagaacaggagacntaatcaaatataaggacggtgaagtattta

SEQ ID NO: 28563 - DNA, 101 bp, rice(Oryza sativa)
  misc_feature (71): n=t or c
ggctgtggggatacatttttccccatccatcgagtttttattataagttttatttccgaaaacatgtacgncctccgtctccaaaataaaaacagtataga

SEQ ID NO: 28564 - DNA, 101 bp, rice(Oryza sativa)
  misc_feature (71): n=t or c
agtctttcaacgtttggaattcccttcatcatcttcttctccagcgatcaccggaaagaattttggtcaanggaaaggtatgcatgatgatcctccttttc

SEQ ID NO: 28565 - DNA, 101 bp, rice(Oryza sativa)
  misc_feature (71): n=a or g
aaaaaaaaacatgcaatcgtacgttgcacatactcacaagcaaggcagctagaaactagctagcttgaaanaaggagactggtcaataacatgagataagg

SEQ ID NO: 28566 - DNA, 101 bp, rice(Oryza sativa)
  misc_feature (71): n=a or g
tatttatatgaatacagttctattttgtatataacttggccgtgtgcatccacttccggatgcagaggccnggcactgcccattatctaaaaaaatttgta

SEQ ID NO: 28567 - DNA, 101 bp, rice(Oryza sativa)
  misc_feature (71): n=t or c
ctgtacggcagcaaagaggtggaccccttgttggtgctacagaccaaagtcataatcctgttctatggtanggtgacgatagttttagtgctggggatccc

SEQ ID NO: 28568 - DNA, 101 bp, rice(Oryza sativa)
  misc_feature (71): n=a or g
gtttagtgaaccctaaactggactcatcaggaaccgaatgcttgctgaagcctgcatggtgttcgacgcantaccggtgaggaactatgtctcatgggctg

SEQ ID NO: 28569 - DNA, 101 bp, rice(Oryza sativa)
  misc_feature (71): n=t or c
tgaacgtacacccgtgtttaaacagtttcccgtcgccaacgtctatattccctcttcctcgcgcgccttanccttcttcccgcgcctcgccagcctgggtt

SEQ ID NO: 28570 - DNA, 101 bp, rice(Oryza sativa)
  misc_feature (71): n=a or g
gtcgccgtcgggcctcgagcagatgggaccactgtttgttgggtcttgggcgtgcagatccaccatttttnggcctcgggcacacatctgtcactgcattg

SEQ ID NO: 28571 - DNA, 101 bp, rice(Oryza sativa)
  misc_feature (71): n=a or g
caacatgcactaacttccgtcaaaaacaggataggtgcctccttcgtttcaaataactaggggcaaaaatnaaaacctaaaaaacaagaataaaatcaata

SEQ ID NO: 28572 - DNA, 101 bp, rice(Oryza sativa)
  misc_feature (71): n=t or c
agatgagagggagcttgaggcatggatcgagagctaggcggctaggccacgagatcatgagctcaatcggntaccctaataaatcaaaatcaaagataact

SEQ ID NO: 28573 - DNA, 101 bp, rice(Oryza sativa)
  misc_feature (71): n=t or c
gccatccttttgccagaactgcttgcgccaggcacaaagcgcgagggaaacatcttgacagctgacctccnaatcccccttcgcaaagttagggaattcgg

SEQ ID NO: 28574 - DNA, 101 bp, rice(Oryza sativa)
  misc_feature (71): n=t or c
ccaggtgggaaatacgaagcctgggtacccattgatttccagttcattgagagagttcggtggttggagcngttcaagaactactgtgctcatcgattgcg

SEQ ID NO: 28575 - DNA, 101 bp, rice(Oryza sativa)
  misc_feature (71): n=t or c
tttatttttaaataccctttacctgtctattaccatcactacttttttcaataacgagtgacattttagtnattttttactcttcactataattttacctt

SEQ ID NO: 28576 - DNA, 101 bp, rice(Oryza sativa)
  misc_feature (71): n=a or c
aggagtcgtgccatcaaagatcattgtgatgttaacacttgctcacttagcagtgacaggtagtatttctnctccgtacttctctcggctcctaaatcttg

SEQ ID NO: 28577 - DNA, 101 bp, rice(Oryza sativa)
  misc_feature (71): n=t or c
agcataccagagatcgtcaagtgaacagccggctgtaattttccagtgtgctcatttccctgtcccagatnagctctgtgtagttcctcaatacttcgagt

SEQ ID NO: 28578 - DNA, 101 bp, rice(Oryza sativa)
  misc_feature (71): n=t or c
tgccgcacgttttgcttcgtgcaagcccaccgcagctgtgtttctatgtcttttcctatccggatcgaaanggcatcgcaatcttctgtttccaattaagc

SEQ ID NO: 28579 - DNA, 101 bp, rice(Oryza sativa)
  misc_feature (71): n=t or c
cctttttacttcctagaccggcttttgttccaatagtgaagaaacaatctttaacaccggttgaaaacccncctttagtacctgttatagcaaccgtgaca

SEQ ID NO: 28580 - DNA, 101 bp, rice(Oryza sativa)
  misc_feature (71): n=a or g
ggatggagacaaaatgcagctaccatcacagaaaacagaaataggaacaaagggtccagaagccgaggccntaaagtgtcctgggctgggctggactgtct

SEQ ID NO: 28581 - DNA, 101 bp, rice(Oryza sativa)
  misc_feature (71): n=a or g
catagtaaatactcgttacaaggttttgttctgtaaaatggtaataccctcttgcaatctgcaggaaatcngtcaggctctgctgccttctactggtacca

SEQ ID NO: 28582 - DNA, 101 bp, rice(Oryza sativa)
  misc_feature (71): n=a or g
gagagcaataaagtttgagatacatctatcctgtatgagcaacctctttccaattcgtaagaccacccttntaataggatatcgtctactttgggttttta

SEQ ID NO: 28583 - DNA, 101 bp, rice(Oryza sativa)
  misc_feature (71): n=t or c
ttgttttctggtattggtggagcagaagtagctctccacaggcttggaatctgtatgaagacagtggtctnagtcgaaatatcagaggtaaacatgacgtt

SEQ ID NO: 28584 - DNA, 101 bp, rice(Oryza sativa)
  misc_feature (71): n=a or g
tagcatgccgatggaagactacagggagacgcttccggctagcttcacaagttaagatgatgggttaaacnatctggattcgaatcctcatcctttttaat

SEQ ID NO: 28585 - DNA, 101 bp, rice(Oryza sativa)
  misc_feature (71): n=a or c
gatctgaaactgcagcttctgagttctgaactctctgctattgcctgattgtctgaacagccattgtcatntggatcatgcaggtgaagctggagtgctcc

SEQ ID NO: 28586 - DNA, 101 bp, rice(Oryza sativa)
  misc_feature (71): n=a or c
ttaattgcttaaacgtggtgtttaggtagttaatttccagtgactgcgtatcccacatatcgtttgaggtnggtgtaaaggtggtgacaaccctcaagagc

SEQ ID NO: 28587 - DNA, 101 bp, rice(Oryza sativa)
  misc_feature (71): n=a or c
cttagttaagttctacatagttgacttttctgagctgtaaaaatatacacacgatacgtacctccggttgnaaaaattacattttgtatagaagaaaattc

SEQ ID NO: 28588 - DNA, 101 bp, rice(Oryza sativa)
  misc_feature (71): n=t or c
atctttgtatgtactgtacacttggacaaatttgaataaatttgacctaactatagatccaaaagcatcgngtaatatggaatagagcaagaccaacacca

SEQ ID NO: 28589 - DNA, 101 bp, rice(Oryza sativa)
  misc_feature (71): n=t or c
ttagctatgtcagtcaggtgctcaagcttcggtgaagcaattttttgggtgacatgcatctactcgatccncatccatttccttgggggagattcccagtc

SEQ ID NO: 28590 - DNA, 101 bp, rice(Oryza sativa)
  misc_feature (71): n=t or c
tcaaccaaattttgtggaggatggaactgtcttccactgttcccagtccaaactccaaaccgaagtataanacgtttggtaaatttgtctcaagtttcaga

SEQ ID NO: 28591 - DNA, 101 bp, rice(Oryza sativa)
  misc_feature (71): n=a or g
aaactcacttcaataattggttctagagaaacgttttgtaatcctatcttgtccgtgtttccactgccacntaccttcgcaccatgatgcttgcaacacag

SEQ ID NO: 28592 - DNA, 101 bp, rice(Oryza sativa)
  misc_feature (71): n=t or c
ttgaaaattcactaatttcattgtgtacctatgtttctaaccttgctttatctgtcctacgggcccagttngacttggccccacatgtcactgacctgggc

SEQ ID NO: 28593 - DNA, 101 bp, rice(Oryza sativa)
  misc_feature (71): n=a or g
agatctggctgcttcgtgagtggtgggggtggagtcttggaggagcagcaatcgaagggaacaaggaggtngggctgtggtcatcaccgcttgggcctaca

SEQ ID NO: 28594 - DNA, 101 bp, rice(Oryza sativa)
  misc_feature (71): n=t or c
gttctgtatagaatcaaaactccactcatcattggctaattccgttactgccgatcgtcggccatagcttngttgcagatatgttcatcacaacttaacca

SEQ ID NO: 28595 - DNA, 101 bp, rice(Oryza sativa)
  misc_feature (71): n=a or g
tggactagtctcaaatagagtaaacaatacagtaatgggttgggggagaaacggagaatggaagcaaagtncggtcacatggcgctaaccatgtgacacat

SEQ ID NO: 28596 - DNA, 101 bp, rice(Oryza sativa)
  misc_feature (71): n=t or g
tttaatgctctgcctgtaattgctggaaattgtattccatctactgcttctttcctggttcgagagatgtnattgatgcgattcggtgcaaagatgtttcc

SEQ ID NO: 28597 - DNA, 101 bp, rice(Oryza sativa)
  misc_feature (71): n=a or c
tgagaacaatgtcttattattgtgtggagcgaatttcacacttcatcatgcagttgacattgaaccaaagngaaagatagcatcggattgtaactgcactg

SEQ ID NO: 28598 - DNA, 101 bp, rice(Oryza sativa)
  misc_feature (71): n=t or c
gggtcgaggggaagcaaaggtttttatcagtgtaaagtggaggatggtagtagcatgggaagtgatggccngtcctggagaaaggagaaatctgtgagtaa

SEQ ID NO: 28599 - DNA, 101 bp, rice(Oryza sativa)
  misc_feature (71): n=a or c
gttgaagtctgtgcagatagtgaattgctaaattggcttccagacagcaaagtagactgagaggagactgnattggatttgccctggcctgcaaacggact

SEQ ID NO: 28600 - DNA, 101 bp, rice(Oryza sativa)
  misc_feature (71): n=t or g
ctctctccatcaatagaatttgtgtcggtccgccagcagtagctaatggatggcaaaaatcatcgttgttncggtgaataggtcacaagaggaggggcctt

SEQ ID NO: 28601 - DNA, 101 bp, rice(Oryza sativa)
  misc_feature (71): n=a or g
cgatgattaatttgcatcagatcatgataccataatgcgtagtagtaattagcagtactccctccattctnaaatataaggcgcaaccactctcaacctaa

SEQ ID NO: 28602 - DNA, 101 bp, rice(Oryza sativa)
  misc_feature (71): n=a or g
catagccccgagggcttgattcgtcacgccgacgactcccctcatggcatagatggccatatggcccaagncccacggcccggcccgaagcccgcaatttt

SEQ ID NO: 28603 - DNA, 101 bp, rice(Oryza sativa)
  misc_feature (71): n=a or c
acgcgcgattcctacggatcgcgatccacaatcagcgggaaaaaaaaaaaaagctcgcgccgccccccctngccacgactcatcctcctcgtcgcgaatcc

SEQ ID NO: 28604 - DNA, 101 bp, rice(Oryza sativa)
  misc_feature (71): n=a or g
catctggaataccgtccatctcttctcccactcccatacatcagaaaatattgtcctgcgtagataagatntattctttgccttcgccgatgaggagtcca

SEQ ID NO: 28605 - DNA, 101 bp, rice(Oryza sativa)
  misc_feature (71): n=t or c
agcaggaattataaacttaaaaaagtgacttataatatgattataaaacttagggaaactcccaccatccnattttaagtgtagttatacgtttctgtgta

SEQ ID NO: 28606 - DNA, 101 bp, rice(Oryza sativa)
  misc_feature (71): n=a or c
ccattcatgagatggaagaagagaggcagaaccattgaagacatacgcacatgatagaattgcagagaaantcgtcccgcccaggcaccccggcgcccagc

SEQ ID NO: 28607 - DNA, 101 bp, rice(Oryza sativa)
  misc_feature (71): n=t or c
ccgaagggcgacgagatcgggatgacggtggcggcaactttacggcgaataccggcggagaaggggtgganggccttcggcttggcgctgcaatgcccacg

SEQ ID NO: 28608 - DNA, 101 bp, rice(Oryza sativa)
  misc_feature (71): n=a or g
cagattgtaccgaaggaaggcactttgaccatgctaactcaggcaagcaagttggtcatgcacatacctcnggtacaagaaccttgtgcctttgaaggcat

SEQ ID NO: 28609 - DNA, 101 bp, rice(Oryza sativa)
  misc_feature (71): n=a or c
ttttctttgcaacgtcttcattgcgtgttgtcaccaagacttttattttgccttttgtatttagcataagnttcaactcatttaaatgaaaatcatttgtt

SEQ ID NO: 28610 - DNA, 101 bp, rice(Oryza sativa)
  misc_feature (71): n=a or g
tcactactagttaatggttcattatcactttcagatacttggagtagagcctcacgtatctttgcacattnaaatctaatagcttttacactttcaacacg

SEQ ID NO: 28611 - DNA, 101 bp, rice(Oryza sativa)
  misc_feature (71): n=t or g
ctccagcattcatgctgctctgcttcaacaaaacttgctggttcttcggtggcaagcaaacactgatcacngtagtcgaaatccaaaacaggctcagttgt

SEQ ID NO: 28612 - DNA, 101 bp, rice(Oryza sativa)
  misc_feature (71): n=a or g
gagagggtacagtctacagatagactgtagtgtgtgcatgtgtgatgataataatggagtgctcatcggtngttggttcattacatgtcgatgtctctagg

SEQ ID NO: 28613 - DNA, 101 bp, rice(Oryza sativa)
  misc_feature (71): n=a or g
cacccgctgcaccatcgtcggcaccaggtcaattagttaatcatctgttgttggtgagagaacaaccacancatagtggacagaatgtgaatcggctaacg

SEQ ID NO: 28614 - DNA, 101 bp, rice(Oryza sativa)
  misc_feature (71): n=t or c
gatgtgttggggcctatatttgtcccgaacattgagactgtaaggtaactaaggtaatactgtgacgctanctttcccaaaatcaagtactttacagagtg

SEQ ID NO: 28615 - DNA, 101 bp, rice(Oryza sativa)
  misc_feature (71): n=t or c
atgaccaattcttccctctacccccagggtcacggtaaaattgatggtgtacatcaaatctataccattanttatcgtagtcatcgtcaaagttatatcgg

SEQ ID NO: 28616 - DNA, 101 bp, rice(Oryza sativa)
  misc_feature (71): n=t or g
accaccttacaaaatggtgacattttagccaacgtatctactttccaagaatgatctgttgtggcaccagntatcttaactgtgtatagaagcttgcactc

SEQ ID NO: 28617 - DNA, 101 bp, rice(Oryza sativa)
  misc_feature (71): n=t or g
cagcagtggcagagaggcatcgcccttgttctgcgtcgtcaacaggtaccagagcatcggcattccacttncacgtcagctttctggcgatggctctcgcg

SEQ ID NO: 28618 - DNA, 101 bp, rice(Oryza sativa)
  misc_feature (71): n=a or g
gtaatctgtttaatctgcggtacattggcttaagacgcaccaacgtatgtaagctcccagaatgcattganaatctctctaatctgcaaactttagatatc

SEQ ID NO: 28619 - DNA, 101 bp, rice(Oryza sativa)
  misc_feature (71): n=a or g
aattactgacatcgctatcacgaaacctatcaaatttatccatcttccctatttcatatctgagtatagtntaagagaagtggtataaaacgcaatcagaa

SEQ ID NO: 28620 - DNA, 101 bp, rice(Oryza sativa)
  misc_feature (71): n=a or g
cggcaacgctgtatcattgtcctagatcgatgcccttatccactgttttggccagtttcaaaaaaaaaagnaaaaaaaaacactgtgtggcccctccacgt

SEQ ID NO: 28621 - DNA, 101 bp, rice(Oryza sativa)
  misc_feature (71): n=a or g
tgttttcaatctttacatgacaatcagccatgctcatgaaactcttctggtaggtgaatcttatttgcttnctacaaaggagaccgtgacaatccaaacac

SEQ ID NO: 28622 - DNA, 101 bp, rice(Oryza sativa)
  misc_feature (71): n=t or c
aattgtgggctcaaccactataggatatcatacaggagtagtcttcatggtggggtgatcatcatctgaanttaatcttttgatctgaccaccgtagtttg

SEQ ID NO: 28623 - DNA, 101 bp, rice(Oryza sativa)
  misc_feature (71): n=t or c
gaaccgccgataaatgacttcctacgggatgacatgctactatatgtaacagattccaatgcatggtatgnaaatactgtgaatttcatgtttgcaggatt

SEQ ID NO: 28624 - DNA, 101 bp, rice(Oryza sativa)
  misc_feature (71): n=a or g
atgattgtacggttgaaaccagcacttccccctgataacatttatggtatgcagtatgctgtttcttttcnagatttttctttgcaattcacagatgtagt

SEQ ID NO: 28625 - DNA, 101 bp, rice(Oryza sativa)
  misc_feature (71): n=t or c
tgctgctctggccgcggagatcgagtgcgtcaccgatggcaaatcagagaagatcgccaaccctgctttcnaggagtggtttacctctgaccaacaggtct

SEQ ID NO: 28626 - DNA, 101 bp, rice(Oryza sativa)
  misc_feature (71): n=t or c
atcctcatgcaatgcaagtcagctttatggttagttgattttatgatttagagtagaagttcgttcgtggnttgcgtgctatttaaatagttataaaaaat

SEQ ID NO: 28627 - DNA, 101 bp, rice(Oryza sativa)
  misc_feature (71): n=t or c
accatttgatctgtcttatgattcgtgctagagattactataaatgtgcccatactaactagttgaaaccncacgcgttgctacgggactttgtatcaata

SEQ ID NO: 28628 - DNA, 101 bp, rice(Oryza sativa)
  misc_feature (71): n=a or g
aagacaaaaactatcaaataacttgagtaaggtctgatattacctcaggaaagctccacaagatgccccangtaatgaacaaccttccagtaatttgtgga

SEQ ID NO: 28629 - DNA, 101 bp, rice(Oryza sativa)
  misc_feature (71): n=t or g
atctcacacaaggaagaacttgcacttctcatgacactggagcaagggaaacctatgaaagaggctcttgntgaggtactttctaaaatactgcgctgata

SEQ ID NO: 28630 - DNA, 101 bp, rice(Oryza sativa)
  misc_feature (71): n=t or c
tccaagcataaacaaagcgagcaaaaagctaggcaaggggatcagatcagcttctaacctgcctgagaggntgagagccttccagaggccgcgtcagctac

SEQ ID NO: 28631 - DNA, 101 bp, rice(Oryza sativa)
  misc_feature (71): n=t or c
gaacccaagacagacacgcgttgatgggccatgaagaacctggaaatagcaatgtatcctctctttttttntctctttttttatactacgagattagtttt

SEQ ID NO: 28632 - DNA, 101 bp, rice(Oryza sativa)
  misc_feature (71): n=a or g
agatgggcagcaattttgaggtcaagacacatttatctttcttgattaatggtgtgggccgggttggacantgcacatacacatactactgcgtactctct

SEQ ID NO: 28633 - DNA, 101 bp, rice(Oryza sativa)
  misc_feature (71): n=a or c
cacctgtgaggaagatgtatctacatcaaatgtggatgaggaagcagctgatgaagaggttttgccatttnagctttggttgactgatgataaagctaata

SEQ ID NO: 28634 - DNA, 101 bp, rice(Oryza sativa)
  misc_feature (71): n=t or c
tgaaggggcgtacttgatgccatggttctaggcctggagaaggccgcgttgatgcccagcagcatgtaccngagatccttggcagtggtggaggaagaggg

SEQ ID NO: 28635 - DNA, 101 bp, rice(Oryza sativa)
  misc_feature (71): n=t or c
acgaaagtaactcctcttgaagcgtaatagctctcataaaactcagcaattttcggtgtaaaaagacgacncactgcattcagaacacaaaacacacatca

SEQ ID NO: 28636 - DNA, 101 bp, rice(Oryza sativa)
  misc_feature (71): n=t or c
tgaggtcaagcagtagctggcaaagcgcagccagccacacagaaattgacagcatcacacaagtatttagnatcacaaaattgacagccacatagtattta

SEQ ID NO: 28637 - DNA, 101 bp, rice(Oryza sativa)
  misc_feature (71): n=t or c
cttaaacctatccaggggctgggtacctaccatccctcagattcccggaacagtactggtagttcacatangtatgaaccatctgcacctccccaggagga

SEQ ID NO: 28638 - DNA, 101 bp, rice(Oryza sativa)
  misc_feature (71): n=a or g
atggcttccacgtctcctgagattttgcggcggagttccttgccagtctggccaggagcatccacaagccngagaatcacaaccatcgaagcatgcactgt

SEQ ID NO: 28639 - DNA, 101 bp, rice(Oryza sativa)
  misc_feature (71): n=a or g
aaagaagggttcaaaggatgaggagtagggaacatttttaggagatcgaacaggaaattagtcatcggctnaagaagacaaaaccaaggcaggagtagcga

SEQ ID NO: 28640 - DNA, 101 bp, rice(Oryza sativa)
  misc_feature (71): n=a or c
ttgttgatataatacagaaaactaaataaattgtctctacatcggcgtcaactatagaggaactcaaagangtttcagtgtcatatggccatgaagtaaaa

SEQ ID NO: 28641 - DNA, 101 bp, rice(Oryza sativa)
  misc_feature (71): n=a or g
acagtcacactgccttaagctcagctcgaaccagaatgacaaaatgtgcaagaaatcgctatggtcagcgnacctccaggtacggccttgatgggctgggc

SEQ ID NO: 28642 - DNA, 101 bp, rice(Oryza sativa)
  misc_feature (71): n=a or g
aggccaaaattgagatcgcaaatactactaggaagtaattccatcgtttacaagaagtatcctagactaanggggtgtttggaaactagggactaaacttt

SEQ ID NO: 28643 - DNA, 101 bp, rice(Oryza sativa)
  misc_feature (71): n=a or g
tctgcccttgcagacgccttggtgtactactatcctattgctggtcgcctcacagagcttccagagggtangctggtggtagactgcactgcggaaggagt

SEQ ID NO: 28644 - DNA, 101 bp, rice(Oryza sativa)
  misc_feature (71): n=t or g
gggcatttgaacagcctgtctatgcagggccatcacttacatatggcaagaacaatgctctccctgcaatnctgaatcttgcaaacaacgagcttaccggt

SEQ ID NO: 28645 - DNA, 101 bp, rice(Oryza sativa)
  misc_feature (71): n=t or c
cagtagcgaaagtttgagtactagaaggctagaagctaagggttaacacatgatttgatgggaaaatatgnagtgaaaacttggaaactaccgttggatcg

SEQ ID NO: 28646 - DNA, 101 bp, rice(Oryza sativa)
  misc_feature (71): n=a or g
ctcaccggcgacgggaaaacatgttttggcggggttccggcggtgaaaaacagcaaccgaggtgctcctcngcgctacgaagcgagtgacgaaggcggcgc

SEQ ID NO: 28647 - DNA, 101 bp, rice(Oryza sativa)
  misc_feature (71): n=t or c
caattattgattcatagctttaccgtgtagatataatgctgctacggaaatgagagatacgacgtggaganggacatacatcgactttattagaacagcgc

SEQ ID NO: 28648 - DNA, 101 bp, rice(Oryza sativa)
  misc_feature (71): n=a or g
acgagccgcggggtaaagctcggcgaaatggtacagaagaaaagtgtgaaacgcgaggtgcccaagaccancgttgacgacggcgaccggcgtgtgtttca

SEQ ID NO: 28649 - DNA, 101 bp, rice(Oryza sativa)
  misc_feature (71): n=a or g
agcattttcgcatgcggctggtcattcgccagtgaaaaaactatattttcactggctattacttgcaggcngccagcaccgtcatcagtgaaaaccttgtt

SEQ ID NO: 28650 - DNA, 101 bp, rice(Oryza sativa)
  misc_feature (71): n=t or c
cggactcgattccaacacattggtcaaacagactggagaaagaggggaaaaaggaaaataagaagattgcntatcatcaggtatgctgcttccccctcccc

SEQ ID NO: 28651 - DNA, 101 bp, rice(Oryza sativa)
  misc_feature (71): n=t or c
gattttatgaaaaagatggcatagagttcaccgactgatagacacacgtagcacctgtttgggagagcttntgacaatagcagtttctcccaaaattagaa

SEQ ID NO: 28652 - DNA, 101 bp, rice(Oryza sativa)
  misc_feature (71): n=t or c
tccgcaagatggaaaatgttcttggtgatgcgttggtacctaggttagcacaatgagagctcgtctctcangaggatcagcccctactgctccaattatgg

SEQ ID NO: 28653 - DNA, 101 bp, rice(Oryza sativa)
  misc_feature (71): n=a or g
tcaagttctcttgaaaatctatacattggtggcaataggatcactggacacataccaccaatgattgggcnattaactagattaacattgctaaacatgac

SEQ ID NO: 28654 - DNA, 101 bp, rice(Oryza sativa)
  misc_feature (71): n=a or c
acctccctgtacccatggaccagatcgacgattacgtcgccaagatttttagggagataaaccagattgangatcagttcatgaagcatagagacgggatc

SEQ ID NO: 28655 - DNA, 101 bp, rice(Oryza sativa)
  misc_feature (71): n=t or c
tttagtaagggtggaaccaacttacaaggcatcattcctccaatcataccactccaggttaacccttttanacgaagcgaggatgaaagtgtaactggagt

SEQ ID NO: 28656 - DNA, 101 bp, rice(Oryza sativa)
  misc_feature (71): n=t or g
agtggcgactggtctgcagatggcttaatatgtgacatggtactttctaggcggcgacagcgtatggcttnctacgggcagctgtaggcagatccattgcc

SEQ ID NO: 28657 - DNA, 101 bp, rice(Oryza sativa)
  misc_feature (71): n=a or g
tcttgtgcctcactcactttcattactggagagatatgcatcatcagtggaagcttatagggagaggagtncaagaagagggtcaagaaagctgtgggaag

SEQ ID NO: 28658 - DNA, 101 bp, rice(Oryza sativa)
  misc_feature (71): n=t or c
tccgcataaccgagaagcaatgctctgaccaattttatgcaaattattacattccgaatcagctgggcgcntctgcccaaatgcacagtccttgaagaaat

SEQ ID NO: 28659 - DNA, 101 bp, rice(Oryza sativa)
  misc_feature (71): n=t or c
acatacgtaagcattttccccttatatttctgggtggagtggaagcaggggccacgatgacttgtcgttanttcctaattaagcaggtaatgcaagctttc

SEQ ID NO: 28660 - DNA, 101 bp, rice(Oryza sativa)
  misc_feature (71): n=a or g
gcacactaaattactaattcacttgaaagctttttgcttgctgccgatactatcttgatatccatgacatntttcatacttcttatgcacatgcttagcta

SEQ ID NO: 28661 - DNA, 101 bp, rice(Oryza sativa)
  misc_feature (71): n=t or g
aattagtgagaaacaagagtttacactaagctaatggatggcatgagcgggagcaagctgttattactacnaactcttggctaacgtttttgtatccccta

SEQ ID NO: 28662 - DNA, 101 bp, rice(Oryza sativa)
  misc_feature (71): n=t or c
gtggaccacctcagctaccttctcctagaagaaggaaccaatgaccaaatttgtactcaacaactgatggntcttgtgcctccaaggttgccacccgagct

SEQ ID NO: 28663 - DNA, 101 bp, rice(Oryza sativa)
  misc_feature (71): n=t or c
tatatatctcgcaccaggctgttcatatttgctccttaccttctcactaaattcagacgaaaattcagagntgtaaaagaagaagaaaaattcagagttca

SEQ ID NO: 28664 - DNA, 101 bp, rice(Oryza sativa)
  misc_feature (71): n=a or g
ctttgtcatcttttattctaccactcattactctgattctattagttttgtacttcctccgttttaccatntaagtcattctaacatttcccacattcata

SEQ ID NO: 28665 - DNA, 101 bp, rice(Oryza sativa)
  misc_feature (71): n=a or g
ttctatcaggaaatcagattagtggagtgctaccagcaatgatgaacgaaaaaatggtagccgaagtaatngatttcagtaacaaccttctggaaggtcaa

SEQ ID NO: 28666 - DNA, 101 bp, rice(Oryza sativa)
  misc_feature (71): n=a or g
gcgtgtaggtgacccggcgtcttaaccttgcgcgatatatgcatatagcccctgtttagttaatttcaacntaaaaattttacaccctatcacatcgaacg

SEQ ID NO: 28667 - DNA, 101 bp, rice(Oryza sativa)
  misc_feature (71): n=t or g
accttgggttggcatgaaagtgccttgtgatgatactgatagacggttgttccaagcagcaaccacaaacntattgggagatggtaaaaaaatgaatttct

SEQ ID NO: 28668 - DNA, 101 bp, rice(Oryza sativa)
  misc_feature (71): n=t or g
ggtttagcccagaaatcaaaacttcagctaaaccttacgcatccatgggcctcgttggttatagcctgtgngcatcaacatggggtgtttgatgggccgga

SEQ ID NO: 28669 - DNA, 101 bp, rice(Oryza sativa)
  misc_feature (71): n=t or c
aaaccttccatacagaggctcctagatgaattcttcagccacactgctcagctcgaaagaataaatagagngttcatagtcctcatccacaagactgggaa

SEQ ID NO: 28670 - DNA, 101 bp, rice(Oryza sativa)
  misc_feature (71): n=t or c
agagtttattatagaaccacgctcgatcgtcatcgttgcgcaattttatttagcactgtctttttctttcngaacacatcctctcacatatgaagatgata

SEQ ID NO: 28671 - DNA, 101 bp, rice(Oryza sativa)
  misc_feature (71): n=a or c
tactcgactctcatcatctcgtgtcatcacacattgtgccatcaattgttacactacatccgattgaaatntctactattataaaaattgaagatattttt

SEQ ID NO: 28672 - DNA, 101 bp, rice(Oryza sativa)
  misc_feature (71): n=t or c
cgagttagtcaacgacactccactactcttatgtgtcagccgtaactcaaaaagtttccagtttcccttgngaaaatgttgcaccggctatcagcattttt

SEQ ID NO: 28673 - DNA, 101 bp, rice(Oryza sativa)
  misc_feature (71): n=a or c
aaacagaagagtaaccagtgaactaaaagcaatcacaaacctcgtcttctctagccttcctccgcttttcngcctcctcgaaggcctccttttcagcctac

SEQ ID NO: 28674 - DNA, 101 bp, rice(Oryza sativa)
  misc_feature (71): n=a or g
agaatgcccccatttccattactagaaacgagaagactacaaggttgaggtttaggtacagagcattcccngacaagctatcagaatagctggttttgtcg

SEQ ID NO: 28675 - DNA, 101 bp, rice(Oryza sativa)
  misc_feature (71): n=t or c
ttctgctgctacaaaggagtacatgtatcaggacaagccatgcatttccaaagtactaattaaatactctntctgtctacttttgatcactatattttatc

SEQ ID NO: 28676 - DNA, 101 bp, rice(Oryza sativa)
  misc_feature (71): n=t or c
tctagaattggtggtatgcgatggtggcacactttacgagaggagaatgatatggaagctggtgtaagaangtaggctacttgattccgtggcaattagct

SEQ ID NO: 28677 - DNA, 101 bp, rice(Oryza sativa)
  misc_feature (71): n=a or g
tccccatctccctccagaccatccatatggcggttatccatcccatagtcatccataccaggagatagttngcgggcatcgaccgacctacgggaaggacc

SEQ ID NO: 28678 - DNA, 101 bp, rice(Oryza sativa)
  misc_feature (71): n=t or c
ttttgtgctaaaaagcaagttgatttgattagattattgtgatctactaatcttgtatacttccgtcccantaaataaggtgcggtcaaacttgatacctt

SEQ ID NO: 28679 - DNA, 101 bp, rice(Oryza sativa)
  misc_feature (71): n=a or g
tcggcggcctccctctccaccaccactacgaaaccggtcattcgtaacgaattaattgtagatcttatctntgttgatggatgatctgctcactaattagt

SEQ ID NO: 28680 - DNA, 101 bp, rice(Oryza sativa)
  misc_feature (71): n=a or g
tacacgcaaaatacctccactagccctcaccactagttatcatacctttagttcatttttaccactttacnaaagtaaagctgcgatcactttcgataata

SEQ ID NO: 28681 - DNA, 101 bp, rice(Oryza sativa)
  misc_feature (71): n=t or c
ggtttagaggaaaggaagccacacgttctttctggctacttcattggattattagtacaatatattggctnccatcggatggcctaatcagccaaagaaaa

SEQ ID NO: 28682 - DNA, 101 bp, rice(Oryza sativa)
  misc_feature (71): n=t or g
taatactcccgctttcaatgaacatggccatattatgcttgacaatcaataaaaaattcatctttaattgnattttaatactggtagtattgtacgttggc

SEQ ID NO: 28683 - DNA, 101 bp, rice(Oryza sativa)
  misc_feature (71): n=t or g
ggcatttagacctgcttatctttttgttaactttgtatcagtatcagccactccgtaccacggtaccaacngctaaaccatgtgccattagcagtaagatt

SEQ ID NO: 28684 - DNA, 101 bp, rice(Oryza sativa)
  misc_feature (71): n=a or g
aaaattgcagctctgcctgatactctaccgtccatgtttatgctgattactgtccactgtcttacagtttntctacagacaatttgaaaagagaacatcat

SEQ ID NO: 28685 - DNA, 101 bp, rice(Oryza sativa)
  misc_feature (71): n=t or c
atcttgaggttattataggatggtgttttcagtggaaccatttcttgggtcagtacactgccggggaactnatttttagtcccggtttacaacccctttag

SEQ ID NO: 28686 - DNA, 101 bp, rice(Oryza sativa)
  misc_feature (71): n=t or c
gagcgggtggtttctacgtgctgttttttgatgtgctgacgatgtggtgcgtgatggattgctattgtggnggcgcacatacgataagcggcggaatcagg

SEQ ID NO: 28687 - DNA, 101 bp, rice(Oryza sativa)
  misc_feature (71): n=a or g
acatcatcctcccaacctcttctctatccttgacttcgctgcacctcatctcccaaccttttatctatctncgactccaccgatgacctgaagtctgtggg

SEQ ID NO: 28688 - DNA, 101 bp, rice(Oryza sativa)
  misc_feature (71): n=a or g
agctgataagtataaacataagcgaaaagataaggctgttagtactcctcccataatatagcaccttttgnctataaatttgaatacacaattattcatat

SEQ ID NO: 28689 - DNA, 101 bp, rice(Oryza sativa)
  misc_feature (71): n=a or g
ggtttggtatgagctttgcctgtgctgaattagtgattagtggtggtgaattggtggtgatttgcagtgcnagctctgatcgagatcaagaacctgctcga

SEQ ID NO: 28690 - DNA, 101 bp, rice(Oryza sativa)
  misc_feature (71): n=t or g
tcgtgtcacccactgccaagtgctactgtcgatgtttctaccttctcgcttaataacaatcacgatttctntattaagtaaatactctctctatcccatag

SEQ ID NO: 28691 - DNA, 101 bp, rice(Oryza sativa)
  misc_feature (71): n=a or g
agttactaaattttaatatggtagcaaactggtaatgataggatgtcgactgtgtttagtctgttatcctnttaaaatttggtaaggttgaaagttgcaat

SEQ ID NO: 28692 - DNA, 101 bp, rice(Oryza sativa)
  misc_feature (71): n=a or c
cacaccttgtccttccttgccaagcacattgggacctttgtcttcatcatgtaccttatgaacaagccaanaatatagtttctctttcaccaatttctcaa

SEQ ID NO: 28693 - DNA, 101 bp, rice(Oryza sativa)
  misc_feature (71): n=a or c
cgtattggaaacacagaaacaaaaatatactaccacgatttcatattaagctttgatttttttcaagccanatttttaggtttgatgaaatttatagaaaa

SEQ ID NO: 28694 - DNA, 101 bp, rice(Oryza sativa)
  misc_feature (71): n=t or c
atatgcaatttaaactttatgagtcttcaataatctaaacagggcaaaataggaaacaaacataactctgnaaataaaaatactgtgcaaaagcgacagat

SEQ ID NO: 28695 - DNA, 101 bp, rice(Oryza sativa)
  misc_feature (71): n=a or g
accatggccgacctcgccgttggcagccacaaccatgaacagaagcagagcggccaatgctgctttccacnccatgttcttaccttctttccttacgtgcg

SEQ ID NO: 28696 - DNA, 101 bp, rice(Oryza sativa)
  misc_feature (71): n=t or c
ggatgtttgaaagttaccgttgttgttttacttttattacaggaggatgcgcggctccaacctgtggatanaaaggatgaagattccgacaaagagttcgg

SEQ ID NO: 28697 - DNA, 101 bp, rice(Oryza sativa)
  misc_feature (71): n=a or g
ggagtggcagggtggcagctcgatgatgacccaaggggtgatcatggcgctcggagacatcatcgttgtcngctcagggaaacctgggctaagctttttcc

SEQ ID NO: 28698 - DNA, 101 bp, rice(Oryza sativa)
  misc_feature (71): n=a or g
tgttccatgcagaggaaagtgcatcgttggaatataggagagagttacctcttttgttcatgctgaattgncacgcttgaagttgagtcgcatatggcatt

SEQ ID NO: 28699 - DNA, 101 bp, rice(Oryza sativa)
  misc_feature (71): n=t or c
gagcgagcagcaaccccccatttttgttcccatcccaagatttagtgatcggacgtacttactactagccncgccatgtatgaatgaatcagtctccttct

SEQ ID NO: 28700 - DNA, 101 bp, rice(Oryza sativa)
  misc_feature (71): n=a or g
aaatttaagccaggctcagttcctgatagacctccaagacgaaatgacacagtctatgcaactcactgaancatctactgcagaatgggccaaagatcctc

SEQ ID NO: 28701 - DNA, 101 bp, rice(Oryza sativa)
  misc_feature (71): n=t or c
acagaaataaccgatacagtaggaatcggctttgttgtttttttctttttttatgtgaacagaagtagatnggcttggatagcctgatctttgttttagca

SEQ ID NO: 28702 - DNA, 101 bp, rice(Oryza sativa)
  misc_feature (71): n=a or g
cagaaaagtgtgcatcatctggatcccgtacagttgattcttggacaagtcagagtttatagaatctatcncaaagttgctgaggttgatcctctttggag

SEQ ID NO: 28703 - DNA, 101 bp, rice(Oryza sativa)
  misc_feature (71): n=t or c
ctgatcagaagtatggctgtctctcttgcaaacttggttggtcagtttgtcacatcaggtgctgcacatangtactacctccgttcaaaaaaaaaaaagtc

SEQ ID NO: 28704 - DNA, 101 bp, rice(Oryza sativa)
  misc_feature (71): n=a or g
atagcatatgcataatgcatttgcaattttgcatgcgatgacctgtaactccagatgcgatgaacagatcngggccttggtccctgcactgcacctctgct

SEQ ID NO: 28705 - DNA, 101 bp, rice(Oryza sativa)
  misc_feature (71): n=a or g
atcttatctaacttctgtaatgtactgaaatccccagttttatgttgagaatggggagttgtcatgccagntgtaccaacgctctgctgatatggggctcg

SEQ ID NO: 28706 - DNA, 101 bp, rice(Oryza sativa)
  misc_feature (71): n=a or c
tccaagaaagtcgcgacatttggaccgggaggaagaggacagtattagtacagcagagggacattatcacnataccgtgcctcatcggtgaggcgaagata

SEQ ID NO: 28707 - DNA, 101 bp, rice(Oryza sativa)
  misc_feature (71): n=t or c
ggcttatattgtgtgtaatctatcccattcaacctaacacagcataaaatctgctcaggcaattcttcagntttatttccctacataacaagcaaaaggaa

SEQ ID NO: 28708 - DNA, 101 bp, rice(Oryza sativa)
  misc_feature (71): n=a or g
ggtaagggttgcctagcttggcgacgcacgcattatgcacatgtccatgcatggggagtggattttcatanctcgaggggaaggataaccctcaactaact

SEQ ID NO: 28709 - DNA, 101 bp, rice(Oryza sativa)
  misc_feature (71): n=t or c
gccgcgcgcttcctcgcttcgacgaagtttcgcgctccttagcttagggacaagtcgccaagtgaggtccnaggcgcatgctccacgtagaccaaaagctg

SEQ ID NO: 28710 - DNA, 101 bp, rice(Oryza sativa)
  misc_feature (71): n=t or c
cctcgccgtttcaccaaccaaacccaaaaacccaaaccaaacgcgcgacgcctcagctttctcctgctccncctgccactcaccaacccaacgcaaagcat

SEQ ID NO: 28711 - DNA, 101 bp, rice(Oryza sativa)
  misc_feature (71): n=a or g
gagaagaagccgccccgcaacgacaggaagaggaagaggaataagggcgcgagcgggaggacgtacgaggngacgcgcgccaggtacccgctgctcgtcga

SEQ ID NO: 28712 - DNA, 101 bp, rice(Oryza sativa)
  misc_feature (71): n=t or c
atccatcgctgatgcgcttgcactagcgtcatcaccgtatagcattattgtctactcagttttcatattanaagacgttgtgatgtttcaagtttgatcaa

SEQ ID NO: 28713 - DNA, 101 bp, rice(Oryza sativa)
  misc_feature (71): n=t or c
tttggtctcttgtagccctggaacttaacaccttccatagcctcttcctgaagtaatgcgactgagcaggntgaatccaaatcttgtggcctttgaaccaa

SEQ ID NO: 28714 - DNA, 101 bp, rice(Oryza sativa)
  misc_feature (71): n=a or g
tatgacaacatagcattatatgccacactatcaacaactttgctggcataaactgtcaagtttctgcttcngttttgaatttcaatctgcacaaattaaaa

SEQ ID NO: 28715 - DNA, 101 bp, rice(Oryza sativa)
  misc_feature (71): n=t or g
ttgatcgttgatgcttgcgtacgtgcacgtgtgtcatgcagttctgtcgaagatggaggaggaggacatgntcgccggcgaggacgcggagttcctgaacc

SEQ ID NO: 28716 - DNA, 101 bp, rice(Oryza sativa)
  misc_feature (71): n=t or c
cattcaatacgcgtatactttctaagaggaagcaacataaaacattattttcacttgaagtctacagaatngaaagacactttcaataaataaagtcttag

SEQ ID NO: 28717 - DNA, 101 bp, rice(Oryza sativa)
  misc_feature (71): n=t or c
cttggcgaggaagaagatgactctaggtcgtcgccaccggcggcaccaaccgatgtcgacgtttgatgttnggaccaaacccgggccagatcgtcgcaggt

SEQ ID NO: 28718 - DNA, 101 bp, rice(Oryza sativa)
  misc_feature (71): n=t or c
ttattaggtttgcctaggctcaatatccgccactgaatctggatagaacctatgtcgagatttatggttanagaatgtgttaaatcggttcagtttagtta

SEQ ID NO: 28719 - DNA, 101 bp, rice(Oryza sativa)
  misc_feature (71): n=a or c
tctgcaactgaccacctagaacgtcatgtggatcatccgaggggcacttgtcagatggattcattgggttnatatggcagaagcactcaggccatgagttt

SEQ ID NO: 28720 - DNA, 101 bp, rice(Oryza sativa)
  misc_feature (71): n=t or c
cataggggtagagtgtgcatatacgttcatagtggtgagcgtgcgcgcattgtgggtgcctacatttgaantgtgtttctaattaaaaaaagtaggcaatc

SEQ ID NO: 28721 - DNA, 101 bp, rice(Oryza sativa)
  misc_feature (71): n=t or c
ggtcaaacccctgctgactcccatttccaaacacattaggccgatgagtgcccatactagtgtcaaacacncaaccattcattacagccgctgcatcctga

SEQ ID NO: 28722 - DNA, 101 bp, rice(Oryza sativa)
  misc_feature (71): n=a or c
cctgcacccaatgcattccagctgcacatctgacgagctgaaagatacgcaaaaaaagaaagaaaaaaaancccagaagattaacaactattgccgctgtc

SEQ ID NO: 28723 - DNA, 101 bp, rice(Oryza sativa)
  misc_feature (71): n=a or g
atacatatatgacaccaccaataagctgcaaaacagacttaatatttttgaccatgctgacagtgctgtanatgtccctgaccctgctattgtacaagagc

SEQ ID NO: 28724 - DNA, 101 bp, rice(Oryza sativa)
  misc_feature (71): n=t or g
agggtagtacgtgccatagttaagatctccttctatggactgctgttcgtagttagttgacaccggcacgncgtcggccggctgcagcacgccggcgaccg

SEQ ID NO: 28725 - DNA, 101 bp, rice(Oryza sativa)
  misc_feature (71): n=t or c
gggcggctctcgttgtcgtagtacacgttcatggagaacgtggtgttgaacgacaccacgcgggtactagnactactgccattgccggctgcggcggcggc

SEQ ID NO: 28726 - DNA, 101 bp, rice(Oryza sativa)
  misc_feature (71): n=a or c
gctgtatcctttcttgggcctactttttggagattttgttgggccttaggtctaatgaactcagcacctcngttcataggcttgggcttctatctccctgt

SEQ ID NO: 28727 - DNA, 101 bp, rice(Oryza sativa)
  misc_feature (71): n=t or c
ttagcaagaacccacggatcatccttgtgtcctagtttgctacgatccacaaccatcaggccgtagtcatngatggatacgcctgttgtgtctctgaccca

SEQ ID NO: 28728 - DNA, 101 bp, rice(Oryza sativa)
  misc_feature (71): n=a or g
tttaccgtgatattttgatttcacaaactcaccacacttctcagggtgcagcccgtcggtgcaattgcagncgaatcgcaggccgtcgccatatgtgcatt

SEQ ID NO: 28729 - DNA, 101 bp, rice(Oryza sativa)
  misc_feature (71): n=a or g
cttgctcacaccttgcatctccatatgtgcagcacaagattttttttcttctggtgttctgaagtatacanccgcaagaagctgagcagcgttcccctgtt

SEQ ID NO: 28730 - DNA, 101 bp, rice(Oryza sativa)
  misc_feature (71): n=a or g
gcttcagtctgggtgatgaactgcttactaaccagtgtttgaccgaggaagcggccgatacgggtgaactngaagtgtgtgagcgagagctggctgggatc

SEQ ID NO: 28731 - DNA, 101 bp, rice(Oryza sativa)
  misc_feature (71): n=t or g
tccctggacctttgcgcttaacctcggaacaaagaaaatcgagaagttgactaccggtgtcgactgcaatnggtggagaaactttgtgggatatgagatgg

SEQ ID NO: 28732 - DNA, 101 bp, rice(Oryza sativa)
  misc_feature (71): n=t or c
cactgctactcacctcactccacttcactatcccagtgggaagagcatatgaagcctcgttcttttctggntaagataacgatcgcgcttttaaaacggtt

SEQ ID NO: 28733 - DNA, 101 bp, rice(Oryza sativa)
  misc_feature (71): n=t or c
tatagggcacatgcctataatgggatccacacccatgggtattaaggtggatctatgctatgctatgcttnttttttttttttttaatttgaggtacctga

SEQ ID NO: 28734 - DNA, 101 bp, rice(Oryza sativa)
  misc_feature (71): n=a or g
aggtggacaaaaatgtcaggcttggctcgaaagttaaacaagtctatctaagggtgcaaacggataacccntaaacctatatataatagtacaaacaagcg

SEQ ID NO: 28735 - DNA, 101 bp, rice(Oryza sativa)
  misc_feature (71): n=t or c
caatttgcgcaactggcattacaaatgtctacattggccttcacacataccatgagagaaccacaaagagngtgaagctttggaccggcctccttactttc

SEQ ID NO: 28736 - DNA, 101 bp, rice(Oryza sativa)
  misc_feature (71): n=a or g
actgaactccgcctgcatggaacttgcaagcacagtcatcatagacctctgataatttctaccgacagcantctcctgttactaatctggaaattttgagc

SEQ ID NO: 28737 - DNA, 101 bp, rice(Oryza sativa)
  misc_feature (71): n=a or g
taggctgatctcgcactgtatttttccattgcttatccatcatcaatttgtggcatcttcgacaccttctntgaggacgatatcgatgttccatacttggt

SEQ ID NO: 28738 - DNA, 101 bp, rice(Oryza sativa)
  misc_feature (71): n=t or g
ttttggccttatgacattttacctgaactgatttccctgtttttcttaaacctgcagacaagacaggcttnaactgcagatcaaataaatgaagcaactta

SEQ ID NO: 28739 - DNA, 101 bp, rice(Oryza sativa)
  misc_feature (71): n=a or g
cagccccaatgtcgagcccaatctcgctgttgatgtggttgttacgtgtgccaccacttctatgacctctnttgatctggtatctgctgaggacgcaatcg

SEQ ID NO: 28740 - DNA, 101 bp, rice(Oryza sativa)
  misc_feature (71): n=t or c
gttgaccatgtttagtgtatctgtgtcatcataagaactcaaagtattggatcaatacttgataagattgngtcttccaaaaatttgagaacaattcttac

SEQ ID NO: 28741 - DNA, 101 bp, rice(Oryza sativa)
  misc_feature (71): n=t or c
gttggctgggtattatcgcaaatttgtgcgccattatggaatcttgagcaaacctctgaccaatttacttngaaagggacagatgtttctgtcgacaccaa

SEQ ID NO: 28742 - DNA, 101 bp, rice(Oryza sativa)
  misc_feature (71): n=t or c
gaaacacacgaaactagcttagttagaacctgattaagccattgtttagctccattccaacggcgtacgtngaacgataaaaattctgattggtagacaga

SEQ ID NO: 28743 - DNA, 101 bp, rice(Oryza sativa)
  misc_feature (71): n=a or g
tgagcatttaaagcccaaggatgtccatggaaatgctcaatttaattctgaaagcttcagtggaaaccaanatacagatgaccttcacctctcccagaaag

SEQ ID NO: 28744 - DNA, 101 bp, rice(Oryza sativa)
  misc_feature (71): n=a or c
ggaggtcgccggcaaacttaggcgttgtcatcataaagggaggtgcaaagcggtgccaaaccaagcacccnttgccaccactagatccctcttctctcttg

SEQ ID NO: 28745 - DNA, 101 bp, rice(Oryza sativa)
  misc_feature (71): n=a or c
caaggagaagatacaagctgaaggtagacaatttatttttaaggaagtgcattacgaggagtgtgcaaagnaaattaatgaaaagtatcacacaaaattca

SEQ ID NO: 28746 - DNA, 101 bp, rice(Oryza sativa)
  misc_feature (71): n=t or c
ttggagtgcggtttagagcttttaggttctcaggaaattaaatggggcaaccttcatttggtctttggggnttttaaaataggagattattattggagtgc

SEQ ID NO: 28747 - DNA, 101 bp, rice(Oryza sativa)
  misc_feature (71): n=a or g
ccatagtaatcagtatagatgatggccacatcggggtgaagcttgcgcaagttttccaattcatctataanaagtttgttgtggtattgcgagaactcatt

SEQ ID NO: 28748 - DNA, 101 bp, rice(Oryza sativa)
  misc_feature (71): n=t or c
tgctttgacatataatcacaaaaaaagggatttgagaagcaaaattacatacttctgctggcacctgcctngcctctaccatatcagccttgttaccagca

SEQ ID NO: 28749 - DNA, 101 bp, rice(Oryza sativa)
  misc_feature (71): n=t or c
ttcagccaggtattcgacggtgaattcaatggccggggttgcagaggaaccctcagagctgtgccaatccnagctggcagcctcgttgaacaccacgtcac

SEQ ID NO: 28750 - DNA, 101 bp, rice(Oryza sativa)
  misc_feature (71): n=a or g
ttcattgttcgttcatggcgcgcatgtctctggccactggcaaggaacattaatttacgaataaacatcgngatcatatataggattggaagttacaagaa

SEQ ID NO: 28751 - DNA, 101 bp, rice(Oryza sativa)
  misc_feature (71): n=a or g
atctatatctatacctataataatcgggcaatttttaaaaattggacactttctacaagcacattaattanaaagatttagccattgattatttagatcgt

SEQ ID NO: 28752 - DNA, 101 bp, rice(Oryza sativa)
  misc_feature (71): n=a or g
taattgggataccccagcaatctagcaagccggtgtcttagctggacctattattatgttaaaaggggggnaaacacaacttgtcagctgctggtttccat

SEQ ID NO: 28753 - DNA, 101 bp, rice(Oryza sativa)
  misc_feature (71): n=a or g
cactgaatttgggaaatgtggtgatcctggatgttttgattgcggtgctaataaggtcattgattgtgacngttgtgtgcttcttcaaggtttatcaggca

SEQ ID NO: 28754 - DNA, 101 bp, rice(Oryza sativa)
  misc_feature (71): n=t or c
cctaccagaactttccgtggtcttcgaggcggttccgtttcaaccactgtcgcggcctctttccccattcngtttcccccaaactatctcctcgtgaatcc

SEQ ID NO: 28755 - DNA, 101 bp, rice(Oryza sativa)
  misc_feature (71): n=t or c
ttgtatctgacaggtgttgcaagaacaacacaaccccactctttcctttttaagtttccaaatactccctncatttctaaatatttgacaccgttgacttt

SEQ ID NO: 28756 - DNA, 101 bp, rice(Oryza sativa)
  misc_feature (71): n=a or g
aggacatgtacactataagccacggtagaagtagcctcatgtagaccataccgtctaaggacacacatagnaaactctacccccaatagaggatactctca

SEQ ID NO: 28757 - DNA, 101 bp, rice(Oryza sativa)
  misc_feature (71): n=a or g
actggcacggcaaggatgggaggttatcaagtagtcaagccgacatgtcagcaaaccggaaagggcaaacntcgtgacacggcgtccacgcctctgtggca

SEQ ID NO: 28758 - DNA, 101 bp, rice(Oryza sativa)
  misc_feature (71): n=t or c
aagacaattaggctggtagtcagaaagaataagagatcagaaagagacgcgatcggtggcaaaaggcttangattggtccattcgggaaaaacgagactgg

SEQ ID NO: 28759 - DNA, 101 bp, rice(Oryza sativa)
  misc_feature (71): n=t or c
atcgtcgtcgtggtgttgtttcgttgatgctgtcgcaccaacatcgccttgatttccttgcgttggctcancgccggggtctagcctcacctccgccatct

SEQ ID NO: 28760 - DNA, 101 bp, rice(Oryza sativa)
  misc_feature (71): n=a or g
aaatggattttcgctagtggtcctgaaccctccaccccttgttaaaattccgcaggtggatttctcatatnaccgtcaaggaaaaccctttttctagtagt

SEQ ID NO: 28761 - DNA, 101 bp, rice(Oryza sativa)
  misc_feature (71): n=t or c
ttttttaggtattagcgttatgttcgccctgttgatgcaatgcatttttccccttccaagattgtagaacnagtggaagcattccataacattagccttta

SEQ ID NO: 28762 - DNA, 101 bp, rice(Oryza sativa)
  misc_feature (71): n=a or c
cccacccgagcaaaaacggataggaatgtgggccgaaatgcatgttagcccacagacaaatcgaagcccanggtggaatgttgcgtgggccagcccatcta

SEQ ID NO: 28763 - DNA, 101 bp, rice(Oryza sativa)
  misc_feature (71): n=t or g
tgtacgggttgctcgagtcggccaggcccggtcctttcaatttagtggcctgaagcaaagctagaaaaatnggccctttaatacaactataataatataac

SEQ ID NO: 28764 - DNA, 101 bp, rice(Oryza sativa)
  misc_feature (71): n=a or g
gtcttgaagtctgtcctatcgtccctttacactattctaacaaagcctccgaaaaacctaaggggatttcngctaggaacgcccagagctgataaggcttt

SEQ ID NO: 28765 - DNA, 101 bp, rice(Oryza sativa)
  misc_feature (71): n=a or g
ccaatcaacaggcgaaagatatcattggctaatcggctaatctgaagctaacaacagggaaagaaaagtcngggcttaaccccgcaaagaaattgagaagc

SEQ ID NO: 28766 - DNA, 101 bp, rice(Oryza sativa)
  misc_feature (71): n=a or g
tggctctgttgcgcccgagcttagtgagggcagggacttggtagagtcagacatcatttattttgatcacnaaaaggatgctgctaatctcacacaagttc

SEQ ID NO: 28767 - DNA, 101 bp, rice(Oryza sativa)
  misc_feature (71): n=t or c
accaaccacgtggactcttgtgtctaggcaaaatcacttgaggatgtgttcggctgtcctatttcaactangatacagccatgttgtacagtaatttgtgt

SEQ ID NO: 28768 - DNA, 101 bp, rice(Oryza sativa)
  misc_feature (71): n=a or g
ttcgcggtcgatcgcccttccttctgccagaagtgctttcttcaagcacgcaaagcagccgacacgtcttnagagctcattgaccaattccctttggcaag

SEQ ID NO: 28769 - DNA, 101 bp, rice(Oryza sativa)
  misc_feature (71): n=a or g
attgaatcgaaaaactagtctttttttttcaaaaaaacaaaaactggagttatccgttggtctttcacatnggctgtgtttagatcagaggggtaaagttt

SEQ ID NO: 28770 - DNA, 101 bp, rice(Oryza sativa)
  misc_feature (71): n=a or g
agtgagtaccctattaaccattcttctgatgtggaaccccaagcaaattcagctcctggaaatagtgccantgcgaagccacgtacaagggctcgccgtgg

SEQ ID NO: 28771 - DNA, 101 bp, rice(Oryza sativa)
  misc_feature (71): n=t or c
cctctatcattgcattgccggacattgttgcaccaccacttcattcatcatcttcttcctctctaataatnaattgtcgctacatgtaccggcggccggcc

SEQ ID NO: 28772 - DNA, 101 bp, rice(Oryza sativa)
  misc_feature (71): n=a or g
atgaagtacatgcgaccctctggtgtggtgcagtcctcaatgaagaactcacacaggtacccatcacgaancatcctcaggattgtgtggtagatgggatc

SEQ ID NO: 28773 - DNA, 101 bp, rice(Oryza sativa)
  misc_feature (71): n=t or c
tgtttataaatgctcgctctatgcaaacgaacctctatagctatccgtagttaattccgtgcatcataccnctattccggtatgacttgctgagtacagtg

SEQ ID NO: 28774 - DNA, 101 bp, rice(Oryza sativa)
  misc_feature (71): n=t or c
tattttataatataaaacggagaaagtactgtaaaatagagaaaaatctccatggaacgacgtttagcaanccgatcggtcggatattattactcccattc

SEQ ID NO: 28775 - DNA, 101 bp, rice(Oryza sativa)
  misc_feature (71): n=a or c
aggatatatcttctacagcagttggtattgaaggcctttctgtcaccgctgagagcgatgatgaatatganagtggaaatgatgatcaccctaccttatct

SEQ ID NO: 28776 - DNA, 101 bp, rice(Oryza sativa)
  misc_feature (71): n=t or c
cacagatatgaccgaaaaaggactatgggagggacaattgggacaaacatcctaaggcccggtttagttcnttttttttttttccaaaaacgttacattga

SEQ ID NO: 28777 - DNA, 101 bp, rice(Oryza sativa)
  misc_feature (71): n=a or g
gcagctcgttttaacagttaattcatcttagctgttaccgtttgtactcctgcaggtgacaaaggatgctnggtttgagctaccgcagccaggcgagtatg

SEQ ID NO: 28778 - DNA, 101 bp, rice(Oryza sativa)
  misc_feature (71): n=t or c
atgtggaaggtggtggaaatcgctctgctatgcacgaaacctcttcctgctcaaaggccatcaatgactanggtggttgttcagatgaaggagagtctggc

SEQ ID NO: 28779 - DNA, 101 bp, rice(Oryza sativa)
  misc_feature (71): n=t or c
cgctgctgagtcgcgcgaggagataaggctcgctcggctctcgttctgtctgctctctcttgttctttctngtctcctctcgatctttctcgttctctcgc

SEQ ID NO: 28780 - DNA, 101 bp, rice(Oryza sativa)
  misc_feature (71): n=t or c
atgacgcatgcaaagacatcaggttgcagccaaaagacaacatgtaaagccacatgcattctaattaatcnctgggttaacctttttatctgaaacaaata

SEQ ID NO: 28781 - DNA, 101 bp, rice(Oryza sativa)
  misc_feature (71): n=t or c
ccgaggatgccggtggcagtgtacctgcagccgttcgcggcttccaccatgaagtactacggcgacagcangacctccgttgggtcggaggttgttggtta

SEQ ID NO: 28782 - DNA, 101 bp, rice(Oryza sativa)
  misc_feature (71): n=a or g
atacaagccaccctgcccaacaaagtccagaaacttcacgacattcaattgcaagtcctgtaggtttagangcaactcaggaatttcagcctgaaatgcag

SEQ ID NO: 28783 - DNA, 101 bp, rice(Oryza sativa)
  misc_feature (71): n=a or g
gaggaagtggtggcgaacgctgacttgtggcttggctacatctaggatgaagagatctgaagctgaagcanctgcaatgctgatgaggtttggaattgcca

SEQ ID NO: 28784 - DNA, 101 bp, rice(Oryza sativa)
  misc_feature (71): n=a or c
agccatgctgccacctgtacctgcaccgcatggaggacgaccgggcatagttggaaatatcggcagagagntgacaacaccgccagacagccacgctcccg

SEQ ID NO: 28785 - DNA, 101 bp, rice(Oryza sativa)
  misc_feature (71): n=t or c
cttgttggccgattagctctttgatcattagtttatctatcttgtttcatttgcaggatcaaactgactgncacgtctgaacctgataatttaggacctgc

SEQ ID NO: 28786 - DNA, 101 bp, rice(Oryza sativa)
  misc_feature (71): n=a or g
actgagtcccaaattcttcttgtcaatctgcaatggatcagaaggtgaactacatattctggtgtagctcngcatagtgggcagaaccattggttgggcca

SEQ ID NO: 28787 - DNA, 101 bp, rice(Oryza sativa)
  misc_feature (71): n=t or g
agtgggaaggctagggctggcagattgcacatggcacatcgaaacaactatgtttttcttgcttggtgttnaatggcatggtttgctagttggcgtgtcat

SEQ ID NO: 28788 - DNA, 101 bp, rice(Oryza sativa)
  misc_feature (71): n=a or c
attgtcacatataaaatgtgttttgcgctttgtattatatgtaaagtcatcatatatatgtagactggaangtttagtaaataaaggataatatatataca

SEQ ID NO: 28789 - DNA, 101 bp, rice(Oryza sativa)
  misc_feature (71): n=t or g
gaggttctgaaactccattggaattgtgccggtgaggttgttgatggacagatcaatcctcctgatgacgntgagctcgccgagctccggtgggatgcttc

SEQ ID NO: 28790 - DNA, 101 bp, rice(Oryza sativa)
  misc_feature (71): n=t or c
aacagttcacttttctaaactcgagttgataataatactggaacgggcggttccagtaaatatgttagctngatctcgattacttcttcatgtagcatggg

SEQ ID NO: 28791 - DNA, 101 bp, rice(Oryza sativa)
  misc_feature (71): n=a or g
cgttgtgacggtttatataaaaaagaagatgtgccatttttaaaaagaaagcaagatcgaaccttacaatncacagttaattaggaaaaactgagcgaaaa

SEQ ID NO: 28792 - DNA, 101 bp, rice(Oryza sativa)
  misc_feature (71): n=a or g
aatttggaatatgatggacaaaacagtcaaagtcgtagcaacaagtttacagaactaaactcctttcagcngaatctcggggacgggattctctttaaggg

SEQ ID NO: 28793 - DNA, 101 bp, rice(Oryza sativa)
  misc_feature (71): n=a or g
actcctccagtaacgagaaaagttgtccttaccagaatattcatccaaccagtagtaggaatgaaccttcntacccagcttatgaaccaaccaatctgcac

SEQ ID NO: 28794 - DNA, 101 bp, rice(Oryza sativa)
  misc_feature (71): n=a or g
gaaaacagcatgcggatgccgagtgcatgcagtattctaaatggcgtattttgacatctcatcggttcccngtgcctcccaagcccaactagatatattga

SEQ ID NO: 28795 - DNA, 101 bp, rice(Oryza sativa)
  misc_feature (71): n=a or g
ctgcctgttggtctaggtggcataatgcttttctgacgcgtgtacgatgctatgcaacccgcctatacacngttgtgcatggctcatgcagcatcatgggc

SEQ ID NO: 28796 - DNA, 101 bp, rice(Oryza sativa)
  misc_feature (71): n=t or c
tcaaggagatcgtggctctcgtgcgtgtcattggactgctgctgctgcgtacgtactacttcctccttttnatattataagattttttttagtattgtcca

SEQ ID NO: 28797 - DNA, 101 bp, rice(Oryza sativa)
  misc_feature (71): n=a or c
tgcttgcctttttgccctgcaaggcaagaggcagccatctctctgcatatctactcatttgtctctctctntctctctctctgtttcttttggtatcatgc

SEQ ID NO: 28798 - DNA, 101 bp, rice(Oryza sativa)
  misc_feature (71): n=a or g
catggttttctctgtgttctaggagtagttcgcaatagattctctaactagttttgttttgtccattttanattgatgccaaaatatgttctacaattttt

SEQ ID NO: 28799 - DNA, 101 bp, rice(Oryza sativa)
  misc_feature (71): n=t or c
tacagcatccaaggtaggtaactaaccaggttgcatccacttcaagggctccacaaagaggcaggtacatncgggttccttctcatccacatgatactttt

SEQ ID NO: 28800 - DNA, 101 bp, rice(Oryza sativa)
  misc_feature (71): n=a or g
tttttctgcagcaagtcatggttctcaagacctaccctcgaactcaagtgaagctgaaaaaatgcaagggntatcgtcttcttgcagcatttctgaagatg

SEQ ID NO: 28801 - DNA, 101 bp, rice(Oryza sativa)
  misc_feature (71): n=t or c
gcgtgcgggcaccacatgtacattcatgaccttttgtattagatttttctcgttattcgcgtgcacgcttnctaaactattaaatgttgtgtttttttaaa

SEQ ID NO: 28802 - DNA, 101 bp, rice(Oryza sativa)
  misc_feature (71): n=t or c
gtggaaggttttattgttttgtatactgaagatcaccattggtgataggtcataaccccaaatgatgactngaatctatctttctaggcattcaaccaaac

SEQ ID NO: 28803 - DNA, 101 bp, rice(Oryza sativa)
  misc_feature (71): n=t or c
ggtagacgtgggggatgatggacgcaacaaacatgattttttccacattcgtgttgatctccctgtcaagngtcctctgaaatcacagatagctataagga

SEQ ID NO: 28804 - DNA, 101 bp, rice(Oryza sativa)
  misc_feature (71): n=a or g
tgcctgaggctagcgcatcccaagatagacctcaaagaggttctgactcctggagctaccaatgacgtgcncaagggcgtgatggaggaagtcggcgacct

SEQ ID NO: 28805 - DNA, 101 bp, rice(Oryza sativa)
  misc_feature (71): n=a or g
aaatgcagccgccgaactagtaacttcaagcaacgggctccaaggacataccggagaagacgaagacgacnacgaagaagcaaccggtggccatggacgcg

SEQ ID NO: 28806 - DNA, 101 bp, rice(Oryza sativa)
  misc_feature (71): n=a or c
aaatgaagactgttcggtgaaagatgcgcgttgacgccaccgacgtagaagctcgagttttcatcaatctntgtataaacaaaagtcaaaatttgctagaa

SEQ ID NO: 28807 - DNA, 101 bp, rice(Oryza sativa)
  misc_feature (71): n=t or c
acacccatttgtggttcaaaaccataataatgtaggtcgtgtgagagagcaaaacacgaggaattcacggngagcgtgaaatccaacactaaaattggact

SEQ ID NO: 28808 - DNA, 101 bp, rice(Oryza sativa)
  misc_feature (71): n=t or c
agtcttgtgtgaggtcgtggaggaaccattgaatcttgatgcactgggtctatttgatagagtacagtggntgtgtcaggagcatcatgagcccctgtgtc

SEQ ID NO: 28809 - DNA, 101 bp, rice(Oryza sativa)
  misc_feature (71): n=t or c
cacgctagcctgtttgaccaaataattctgtcacgccagatgtagctggcgttgccaaataactctgtcangacacgcgctctaccaagccaccgtggttg

SEQ ID NO: 28810 - DNA, 101 bp, rice(Oryza sativa)
  misc_feature (71): n=a or g
cttatttaaccagagttcaaacaatcaattaagtgttgagatggttaatctatcccgagcctcatcggttnacctaataagtcaaaacaaaagccaaaatt

SEQ ID NO: 28811 - DNA, 101 bp, rice(Oryza sativa)
  misc_feature (71): n=a or g
cccccctcaccaagagcctggaaattgaggtcgccgtcaagaagcccaccgcttcatcacctccgatagcngcgccgcggtgaggcaagccggaggccgct

SEQ ID NO: 28812 - DNA, 101 bp, rice(Oryza sativa)
  misc_feature (71): n=t or c
ggatgatgatgcatgaaacggattgatttgggaaggtgtgagctgtggagtgtacgttttatctgcctgcntgcctggccctgagagcttctcatggagtt

SEQ ID NO: 28813 - DNA, 101 bp, rice(Oryza sativa)
  misc_feature (71): n=a or g
gacacatgtggtttgggcgccatcgcaatcttttcgcccaggtactttattttctttgacaatatatcatnttgttcatgtgaaatctttggatcatcttg

SEQ ID NO: 28814 - DNA, 101 bp, rice(Oryza sativa)
  misc_feature (71): n=a or g
gccgaaaccgtgcgaccagtcaggatccaggctcaaagtgttaagtttcaacggggcgaagccccacggcnaagacaccgaagccacatggcgaagacaat

SEQ ID NO: 28815 - DNA, 101 bp, rice(Oryza sativa)
  misc_feature (71): n=t or g
aggtcgtccactcgtccaacttggtcaaggaaaatcaaatccttcgtcaggactcaggacccacctgtcantgacggcgcgcgcccgcgagtcacggcgtc

SEQ ID NO: 28816 - DNA, 101 bp, rice(Oryza sativa)
  misc_feature (71): n=a or g
aaccaaacctgtccaataaaaagggcgaaaaaacaaaaaaccgggcgaaaaaaccaattctatccgatccngaaaaaaccgggtgaaaaaaaaaacctaaa

SEQ ID NO: 28817 - DNA, 101 bp, rice(Oryza sativa)
  misc_feature (71): n=t or c
caacttcaaccaactacgctgtcgttgccacccaaaaccaccaaacccaaaactccatttgatttgacctnaggaggccaaattgacaccactggcactcc

SEQ ID NO: 28818 - DNA, 101 bp, rice(Oryza sativa)
  misc_feature (71): n=a or g
tgatgctaagcctccaatatttattgaccctcgtatcttgggactgtacgagaaggtcaccaatcttgttngtgttgacaaggccagtgaagatctaatca

SEQ ID NO: 28819 - DNA, 101 bp, rice(Oryza sativa)
  misc_feature (71): n=a or c
attcctatcaattaacaggcaaagaaacaggatcattccaagaacagctcaaatcctgtctgtgatccatncttttccttgcgtgatggtgcttgtcatat

SEQ ID NO: 28820 - DNA, 101 bp, rice(Oryza sativa)
  misc_feature (71): n=a or c
aaaaaatgtagtgaggtcctgataatgcaatgagaggcaagcctgactagtgaagagtggaagaagcatcntcgtagaagtctgtgtcatcaggaagcact

SEQ ID NO: 28821 - DNA, 101 bp, rice(Oryza sativa)
  misc_feature (71): n=t or c
aacgatactgaggaaaaataaaataattctcactgtttcaaaatataagattttttcttgctcatcgtggnatttaaattatataacttcaaccaatgttt

SEQ ID NO: 28822 - DNA, 101 bp, rice(Oryza sativa)
  misc_feature (71): n=a or g
tcgcacatcaccatctattaaaatcaccagcccaagcgacgtcagcagttcatacaaaccatcgtgggttngatcaaggttagcttgccaagaaaaaaaaa

SEQ ID NO: 28823 - DNA, 101 bp, rice(Oryza sativa)
  misc_feature (71): n=t or g
gatgaattggaattatgttaccatgctaaagacaaagtgttgtgtgcaaaaagacttcgtaactggtactnacaatggagctcaccatgccaatgtgaagg

SEQ ID NO: 28824 - DNA, 101 bp, rice(Oryza sativa)
  misc_feature (71): n=t or c
aacatcatacccccccaaaaaataccatgtgcattcaatgagaacatacctggaaagctcaaagcaaggcnagtgcaacaaccagctattccagcattaac

SEQ ID NO: 28825 - DNA, 101 bp, rice(Oryza sativa)
  misc_feature (71): n=t or g
gtctgttctgaaggtgttaccagatgggtgctgcagaggacagctgagctaaacaaggttcttgaactggnctctggggtcaagacaagtcatttagtgag

SEQ ID NO: 28826 - DNA, 101 bp, rice(Oryza sativa)
  misc_feature (71): n=a or c
ttatcacatcatattaagaaggatcttactaaagcttgtgcagaaaaagtgacggcaattattatgtatgngattggaaatagaaatttctctatgcttat

SEQ ID NO: 28827 - DNA, 101 bp, rice(Oryza sativa)
  misc_feature (71): n=a or g
tgaataaattttatcaaaccgtaccaatattttaccgtactctacagtaagcacagttaccggtggttagnaaaaccctaggtttggctcgtgccatttaa

SEQ ID NO: 28828 - DNA, 101 bp, rice(Oryza sativa)
  misc_feature (71): n=t or c
ggggagagaggaggatggaacagtgagactggcaatttgtccaatttatataaattagagcagtgaatccnaaccctttaatttagatgtaacggtcactt

SEQ ID NO: 28829 - DNA, 101 bp, rice(Oryza sativa)
  misc_feature (71): n=t or c
gtccttagtaccaaaaaatatattcagtaaacaagaaaagatgaaaagaggaggacctgaccttgtctcgntcaagttcaatgtcagtcttataaattggc

SEQ ID NO: 28830 - DNA, 101 bp, rice(Oryza sativa)
  misc_feature (71): n=a or g
aattagccatgagctaatctttcaaacagggcccagatgtatggctagaattaatgcgacacggggacagngagctaattaaacaacagttcttaggccct

SEQ ID NO: 28831 - DNA, 101 bp, rice(Oryza sativa)
  misc_feature (71): n=t or c
atgtgaatttctgttaattttcagatcagcagtaacgataagctcttggtggaagcagtgaaagatgagcnccctgccattgaaatcctatttctgcggtt

SEQ ID NO: 28832 - DNA, 101 bp, rice(Oryza sativa)
  misc_feature (71): n=t or c
tgggtcctacgcaacctatatacatctaaggtgacagtttgctcgaacttgtgatgcttgcgctcgttggnaacctcgtgcattcaactcaatatgatatt

SEQ ID NO: 28833 - DNA, 101 bp, rice(Oryza sativa)
  misc_feature (71): n=a or c
ttttaatgaacctggtttcgaaagttatgctaatacacctcgggcagagaagaagtctatagcttataatnaggagacttttctgttgtcctgcaaaacaa

SEQ ID NO: 28834 - DNA, 101 bp, rice(Oryza sativa)
  misc_feature (71): n=t or c
gataagccatatgcagagggcttgctttgtgcctggaagctccttttcaattgcttccttgaggtacatantttcatccgtcaatattgtcagcggagcct

SEQ ID NO: 28835 - DNA, 101 bp, rice(Oryza sativa)
  misc_feature (71): n=a or c
ctgctgtcgacgtaccagttggtgtcaacgctgtaggagcttgatgcagcaacgttggcgttcttctcttntccagtgaaggagtgatcgaagcatttcca

SEQ ID NO: 28836 - DNA, 101 bp, rice(Oryza sativa)
  misc_feature (71): n=a or g
gtaattacagaggagggaggaaggcttaggatcagcagcagttatggattcccatccttggaacgtatccnaatcggtggggaaagttgcaggcttgagtt

SEQ ID NO: 28837 - DNA, 101 bp, rice(Oryza sativa)
  misc_feature (71): n=a or g
cccgatgttcttcccgatcggcaactgggcaacggggttcttcgtcgtgttctcgctgctcgccggcgtcntcggcatcgcctccggcctcgtcgggttca

SEQ ID NO: 28838 - DNA, 101 bp, rice(Oryza sativa)
  misc_feature (71): n=t or c
taaagggatctgacaacctgcagagcatatacagaaaactgatgtatcatggggatgttgtgaatgtcganaatatgaacagacgtcacccaagtgtgata

SEQ ID NO: 28839 - DNA, 101 bp, rice(Oryza sativa)
  misc_feature (71): n=t or c
atttactactcctttttctatatgtcttgtttataagcttaatttcgagtacttgcaatctagatgtgctncgataatatccacagtttgtcttatttata

SEQ ID NO: 28840 - DNA, 101 bp, rice(Oryza sativa)
  misc_feature (71): n=a or g
atccgctgccctagtcactagggagaagaggaggtcaccagtggtccatgatgaagtcttgctagcacccntcatcgttactgccgatctcgtgacggtta

SEQ ID NO: 28841 - DNA, 101 bp, rice(Oryza sativa)
  misc_feature (71): n=t or c
ttttgttggttggtcatctcaagacacctgcctgtgataacattgttttggaaataaatgaactggtgctnacaaccatcgcagcggaatgcggagagccg

SEQ ID NO: 28842 - DNA, 101 bp, rice(Oryza sativa)
  misc_feature (71): n=a or g
agcatgggctgcagtaccccaattaggtacaattgtccggagactaacttgtaccttgcagctctgagctntaattgtttcgcctttgcttcgttgtctgg

SEQ ID NO: 28843 - DNA, 101 bp, rice(Oryza sativa)
  misc_feature (71): n=t or c
tttgttaattctaattggcaattagggaagaggattttgggtcttgtgctgattgatgtgtcacacactgntgaaaatatttcggaacatattctttctgt

SEQ ID NO: 28844 - DNA, 101 bp, rice(Oryza sativa)
  misc_feature (71): n=a or g
cgccaaccgtggacgaggagctctgccaaattgcctgttctcatagttcaacaaaatagagtacaattctncgacggtaacaggttctactcttgtcacca

SEQ ID NO: 28845 - DNA, 101 bp, rice(Oryza sativa)
  misc_feature (71): n=t or c
tgtaatggaatactttggatctaaactcggccatgggatgcatcagtaactgttactgttgctactatatnacttgatattcactttcattttggtgctca

SEQ ID NO: 28846 - DNA, 101 bp, rice(Oryza sativa)
  misc_feature (71): n=a or c
gcatattccgaccttacttattgcagataaaatggaatagctactagccactattgcatatactcgccaantaaacacacagccctaaaaatgattcggcc

SEQ ID NO: 28847 - DNA, 101 bp, rice(Oryza sativa)
  misc_feature (71): n=t or c
acaaggccgactggcagcgtagatggtgagcacgatggcgatggactttccctcacttcagcgcaaatccnggggttctagggtttgtggggagcgtgtgt

SEQ ID NO: 28848 - DNA, 101 bp, rice(Oryza sativa)
  misc_feature (71): n=a or g
atatgatgggatggagagagtatatgattttgtgcaaatatatacctgggttgtctgcaacgaagcggatnacggcccagccgccggtggggacggcgacg

SEQ ID NO: 28849 - DNA, 101 bp, rice(Oryza sativa)
  misc_feature (71): n=a or c
tatgccaagtcaggtatggaagctgaagaagtgtgcagagaggtaaactaaatcactcatcctagttgatnttgatgcactgccatgccatgttctgcctc

SEQ ID NO: 28850 - DNA, 101 bp, rice(Oryza sativa)
  misc_feature (71): n=t or c
cctcaatgcgatattgaacgaaagccctttcgatcccgtcctgaacactgatcttgatcaatgggcagaangactacgggaatcagtggctaacttcaata

SEQ ID NO: 28851 - DNA, 101 bp, rice(Oryza sativa)
  misc_feature (71): n=t or c
gccggcaaccaaacagtctcttactctcttttatgctgggttggaggaattgaaccacctgtgagtaggtngagtagccaccactagaacggtggtcatgt

SEQ ID NO: 28852 - DNA, 101 bp, rice(Oryza sativa)
  misc_feature (71): n=a or g
tcatggataccctctccgtgtcgtagttccaggtgtgattggtgctcgttcagtcaaatggttggacaganttgacataattgaggaagagtgtcaggtat

SEQ ID NO: 28853 - DNA, 101 bp, rice(Oryza sativa)
  misc_feature (71): n=t or c
tcttaacttttaaaaccaatacaaataaaatcctaaggtggtttagacaacaattttagctgacgtgacgnctacgtagcacttaaaacagaaaaaaccat

SEQ ID NO: 28854 - DNA, 101 bp, rice(Oryza sativa)
  misc_feature (71): n=t or c
atcagactccagagatgaaaaaggcccaggaataattcgagtatggattggttgtaacggctttgcacacngccaatcatcttatttcttgcaatcatgta

SEQ ID NO: 28855 - DNA, 101 bp, rice(Oryza sativa)
  misc_feature (71): n=t or g
cggattaatctaatcggctccgaggttatttggtcgtcaccgaatccatgtgaacgtttgccgtgtgtacngaagatcatcatcagggagcagcggccgac

SEQ ID NO: 28856 - DNA, 101 bp, rice(Oryza sativa)
  misc_feature (71): n=t or g
cactaaagatattagcttggttgcattatggcagtcattacaaactcggaggttcttctttatctggattnttgtgccaggggctgtgcgaatgagcccaa

SEQ ID NO: 28857 - DNA, 101 bp, rice(Oryza sativa)
  misc_feature (71): n=t or c
tcagtgatttatgtggaacttctgtgatttgctttgacggatatgtgttggatgaattgatttgtgattcnttcatctgtgatttgtgtgaaacttctatg

SEQ ID NO: 28858 - DNA, 101 bp, rice(Oryza sativa)
  misc_feature (71): n=a or g
aagctgcctgcagagaggccttcgaggaagcaggcgtcaagggcgttctaagtgtaggtgacccctctctnatgtgtcatttatgtttaaataattgcaaa

SEQ ID NO: 28859 - DNA, 101 bp, rice(Oryza sativa)
  misc_feature (71): n=t or g
cgccgagatccgcatcggacaatgggtgatgcactttgatggttctttgaacctttaaggcaccggggccngagtcatgctgacttcgccaagcggggatg

SEQ ID NO: 28860 - DNA, 101 bp, rice(Oryza sativa)
  misc_feature (71): n=t or c
ctacaaccacacgatcatcctgactgatcagctagagagctagaaggagaacttgaaggccatgtcgtgcntgtacacctggccgggcctgaccgtcatgg

SEQ ID NO: 28861 - DNA, 101 bp, rice(Oryza sativa)
  misc_feature (71): n=a or c
ggattagttcttcctgcgtgtcttcggagacgactttgttgcgggaagggggattagggtttttggtctgntgattatgtgcctggtgttgaaattgaaat

SEQ ID NO: 28862 - DNA, 101 bp, rice(Oryza sativa)
  misc_feature (71): n=a or c
agctgatgaataggccagtcccgagaaactgccaagctcagaactgtgcggacggtggctggcttgacaancggactgatggtctcgtcgatgtcaatgtt

SEQ ID NO: 28863 - DNA, 101 bp, rice(Oryza sativa)
  misc_feature (71): n=a or g
aagcagagcagccgcaatcgaaagaattcattcgttaattaacatgtagtgagggggcgcgggtggacctntcgcggatctggagctggtcgaccatggcc

SEQ ID NO: 28864 - DNA, 101 bp, rice(Oryza sativa)
  misc_feature (71): n=a or c
cattagatatcagctgtaagggtgatgtggaagaacaccacccctactattaacattttaagtactctatntgtttcatattataaggtgttttgattttt

SEQ ID NO: 28865 - DNA, 101 bp, rice(Oryza sativa)
  misc_feature (71): n=a or g
cgctgccgacgtgtcagctcctagcatgtccttgagcgcttctaccatgacaagtgtacggttcagcaacngcttcgtgcctccgtactcacttgcattgt

SEQ ID NO: 28866 - DNA, 101 bp, rice(Oryza sativa)
  misc_feature (71): n=t or c
tccctcgtacagcagagggcatcctgcttcttgctccttccaaccatcgcgacccagcttcatcaacttgncatacttgtcactggttgtcctgcattctg

SEQ ID NO: 28867 - DNA, 101 bp, rice(Oryza sativa)
  misc_feature (71): n=a or g
cttgaggagaggtaactgccccagtggtggtaatttctgacatgccttcatattgaatagcttgatatgtngaagagatttcaggtatggttccctccaag

SEQ ID NO: 28868 - DNA, 101 bp, rice(Oryza sativa)
  misc_feature (71): n=t or c
tgctgtcagatacaggacaatatgtagctgaatatatacacataggcagtgtttagttcattcaaacttcnaaaaattccatcacatcaaatgtttggacg

SEQ ID NO: 28869 - DNA, 101 bp, rice(Oryza sativa)
  misc_feature (71): n=t or g
cgtcgagttatgttagaatctgcttgtcatgtttattacacatttgtgatgtgattgtaagttgtaacagnagtccttaagtgattacacaagtatgatgg

SEQ ID NO: 28870 - DNA, 101 bp, rice(Oryza sativa)
  misc_feature (71): n=a or c
ttgtgcttctactactttcattccttgtccgtgagaagtgtgcaggtcagattgatacctgtttgagtcancagtgattgactattgctggagcagctatg

SEQ ID NO: 28871 - DNA, 101 bp, rice(Oryza sativa)
  misc_feature (71): n=t or g
gttccaatttctcaggagaatctatgggtgcatcttctgccttactgtctggaatttctttggaatcaggnaaactttgattaggaagtgtaattatatag

SEQ ID NO: 28872 - DNA, 101 bp, rice(Oryza sativa)
  misc_feature (71): n=t or c
acaaacgtgtagaagggtcacttcaatatcaacaatattcagcttccacagtgagctcatcatcaggtctntgttcatcctcatctgcagatcgacatccc

SEQ ID NO: 28873 - DNA, 101 bp, rice(Oryza sativa)
  misc_feature (71): n=t or g
tacttgaaaaaaaaatctctcgttccacgtactacaccttccaaccaaaccaactgcgcgatcgaagtgcnaacccggtcgtcggtcgcggaggcgcactt

SEQ ID NO: 28874 - DNA, 101 bp, rice(Oryza sativa)
  misc_feature (71): n=t or g
ctacgtgcaccatggggcaaagccgcgaaggcaacgaatccaaatatatgaggctcaggttccaatcttanctacgcgaactagtacaaagatgatctgca

SEQ ID NO: 28875 - DNA, 101 bp, rice(Oryza sativa)
  misc_feature (71): n=a or c
tgctagttcaatccacaacaaaagcacagcagtatgaatggcgctttggtcctgcaaacatgaaatggttntgcttatgttggacgatataatgcacataa

SEQ ID NO: 28876 - DNA, 101 bp, rice(Oryza sativa)
  misc_feature (71): n=t or c
acggccctgtcccactcgtggtgtgaccgtatgagatgtagcatttggtatagctaaggtcgtgtctagtncatcctcaactaccccaaattttcaacttt

SEQ ID NO: 28877 - DNA, 101 bp, rice(Oryza sativa)
  misc_feature (71): n=a or g
tgcattggctctgtgtgcggggaaggctgggtccaactaaccttgaccatatccttgaaacccggaatgcntgtccaaaagttctcaaatctaaaggtgcg

SEQ ID NO: 28878 - DNA, 101 bp, rice(Oryza sativa)
  misc_feature (71): n=a or g
tgtagtggtgtaccagtccaagacgttgattgcttcatcgatcgtatcaaaacatgcgtcatatacagtgncggagccaataattgatcacgcctaggacc

SEQ ID NO: 28879 - DNA, 101 bp, rice(Oryza sativa)
  misc_feature (71): n=t or c
ttttaggatgaaagtagtatttttttttgtccttggaatttcgaaagaaaactgagccatcctaaggaaancacaatgtggtgaaatagtggataaagtat

SEQ ID NO: 28880 - DNA, 101 bp, rice(Oryza sativa)
  misc_feature (71): n=a or g
aaacggaaaacagctcattcctttattgtcacatccattttgatcacgataatcgcgctacgatggggaanagaaattttctccgaatagagtaaaataag

SEQ ID NO: 28881 - DNA, 101 bp, rice(Oryza sativa)
  misc_feature (71): n=t or g
ggcaccgtcgcaagaagaatgcggaggaagaaccgaaaagacgggggtagtgaagtcatttgtcacacagncttgctgagttggcaagcaagagtggctaa

SEQ ID NO: 28882 - DNA, 101 bp, rice(Oryza sativa)
  misc_feature (71): n=a or g
aagcgaattatacaagttaacatgttagatttgtacttataacttatgtatgtgaagagagataggggagngtgaacaaagcgagctacaaatttatagcc

SEQ ID NO: 28883 - DNA, 101 bp, rice(Oryza sativa)
  misc_feature (71): n=t or g
ggcgacatcgatttgattcgattgggagggatcgatgttgttcttgcaggaacctgatgacgacgtcggcngacgaggggcaattcctgaacctgctgctg

SEQ ID NO: 28884 - DNA, 101 bp, rice(Oryza sativa)
  misc_feature (71): n=a or g
ggcacggcccaatccagtttatatgggctactctatacctgtatcatcgacacggccgttcagcccaagcnaccgagagcccgtgagctgaggactagttt

SEQ ID NO: 28885 - DNA, 101 bp, rice(Oryza sativa)
  misc_feature (71): n=t or c
aacaaacatttgcccggtgtccggtgatgacaacgacgacgatgattgatcgatggtttctgaatccgtgngcacgcacgcgtccacgtacgcaccccgca

SEQ ID NO: 28886 - DNA, 101 bp, rice(Oryza sativa)
  misc_feature (71): n=t or c
ctctccgtcacggactattgccacaagctcaagatcatggcagaaaacttggcgatgtgggtgaacttgtngctgatctccaacttgtcatcaccaccatc

SEQ ID NO: 28887 - DNA, 101 bp, rice(Oryza sativa)
  misc_feature (71): n=t or c
gtcctagaataaaattatttgtcacccatctcacacgtactgttaccgaattaaaaagacggaaaacctcnacttctacaaatcacaatgtaattatccct

SEQ ID NO: 28888 - DNA, 101 bp, rice(Oryza sativa)
  misc_feature (71): n=a or g
tgggtttcacaatgcatcgtcgtccactacacgtgatggaatccttccaacccctgtggatcgcaatacancatgttcttcaaagctgtttcatacaaagt

SEQ ID NO: 28889 - DNA, 101 bp, rice(Oryza sativa)
  misc_feature (71): n=t or c
tctcgccgccccgccggatctcgcaccaaaaatatcctcagaaacaaacgccgccgcttcccctccctccnggctaccacagcaaccccaacaagcccacc

SEQ ID NO: 28890 - DNA, 101 bp, rice(Oryza sativa)
  misc_feature (71): n=t or c
tgagcccaaggctgtggtctagactaacgagcaaaacagcgaaaaccccaagcgccaccgcttcactcccngtcggcgaccagccgactttccccaatgcc

SEQ ID NO: 28891 - DNA, 101 bp, rice(Oryza sativa)
  misc_feature (71): n=t or c
cagcatcacaattccggtgcattttaggacaaccagagcaagaatagcaaaaggaactagatcaaagtatngaacaaacgtaacatacatgcactgaaaca

SEQ ID NO: 28892 - DNA, 101 bp, rice(Oryza sativa)
  misc_feature (71): n=a or g
tcgctgattcatcgctcgttagttgggtgggacaatcgcgtcgtggtgtaattagggtttagaaaatcgtncagtaatctttttacttgtttttaaaatga

SEQ ID NO: 28893 - DNA, 101 bp, rice(Oryza sativa)
  misc_feature (71): n=t or c
agagccagaggcctgaagaggccagtgcagaatcctacgagagaagattgtgctacactgtgctaccgtanccatgtgtagcggcaatttagaaatggctg

SEQ ID NO: 28894 - DNA, 101 bp, rice(Oryza sativa)
  misc_feature (71): n=a or g
gatcgacggagaggagtgccattaggcgcatcttccgcaatgtgttctcgtgctttggtcgcagccattcntcgaattctcaggcctcgtcttcgcattcg

SEQ ID NO: 28895 - DNA, 101 bp, rice(Oryza sativa)
  misc_feature (71): n=t or c
gcttaacttagttacttttttttttgactccgcacattataatttggtcccgcacattgtcccgtgaaacngtggtttgtttcttatagtaactgttttac

SEQ ID NO: 28896 - DNA, 101 bp, rice(Oryza sativa)
  misc_feature (71): n=a or g
taatagccattgcaactgcgacgtcaggtatagcagtgttgattttgcccggaggacgtactgcgcactcnagattcaaaatccctattaaaattgctcac

SEQ ID NO: 28897 - DNA, 101 bp, rice(Oryza sativa)
  misc_feature (71): n=a or g
cctttctttctctttgtgttttcttacgagggctctcccctacaactctatataaatcaacgtgtaaaagnaaaatcagaatttttcgtgagcactgcgga

SEQ ID NO: 28898 - DNA, 101 bp, rice(Oryza sativa)
  misc_feature (71): n=a or g
ggctactccgagacctgaagcagtaaaggtgaaaaatgttaaatagtggccacggagactgttccattccntcgctagcagaccacagaaaatcctcctca

SEQ ID NO: 28899 - DNA, 101 bp, rice(Oryza sativa)
  misc_feature (71): n=a or c
gagagctttagaatacaggggattatctttgagttcagctctgccaattccttgaacatgtgccatgcctncatctgatttcatacttcttgacattatct

SEQ ID NO: 28900 - DNA, 101 bp, rice(Oryza sativa)
  misc_feature (71): n=a or g
tcaagagcgacctcctcgccacatggccgagctccagcgtcatggctactggtccatcgtgccgaaccttngtaccacgccgacctggccatctatgccac

SEQ ID NO: 28901 - DNA, 101 bp, rice(Oryza sativa)
  misc_feature (71): n=a or c
tctgagctacaaaaggatcaagtttcgatggagtattctgcacatagccagtatcctatagcaatcaaatntggctgtttctcatgggatagctctgaaaa

SEQ ID NO: 28902 - DNA, 101 bp, rice(Oryza sativa)
  misc_feature (71): n=a or g
tttggtggcctctctaagctctgttctttaagcttagcaagttgttctagccttcaacgattgccagattntattggtgagttgtgtagtttagagtactt

SEQ ID NO: 28903 - DNA, 101 bp, rice(Oryza sativa)
  misc_feature (71): n=t or g
ccacctcccgtcccgcgcgctgcacatcgtcggccccgacaagaaggtgaagctgagcttcctgtacccgncgtgcgtggggcggaacatggatgaggtgg

SEQ ID NO: 28904 - DNA, 101 bp, rice(Oryza sativa)
  misc_feature (71): n=a or g
ggttcatttcgatctgtgcacggctcgcacggggcatgcagcttaactacgacaaaaaggcaaaaaacttnaataattaggctgtgatgggcagaagtaga

SEQ ID NO: 28905 - DNA, 101 bp, rice(Oryza sativa)
  misc_feature (71): n=a or g
ttgatgtcctcatactctctgttattttaggtcattccaactatggcgagaaagtgtctgttgatcagganggagcaaacaattctactctttcaccatat

SEQ ID NO: 28906 - DNA, 101 bp, rice(Oryza sativa)
  misc_feature (71): n=a or c
gtctgaaaccaaccgggtgcccgtggaagaaatggatcgtaacgtacttcgcgttcccctgtttcgctctncatcgcagccaccgatgggagatatcacga

SEQ ID NO: 28907 - DNA, 101 bp, rice(Oryza sativa)
  misc_feature (71): n=t or g
ttgaagagaagattgttgtacaagagactcctgaagttatcagaactgatgggaaagatgctgaattgaanaggagaaagtttcagagaaataagcaggta

SEQ ID NO: 28908 - DNA, 101 bp, rice(Oryza sativa)
  misc_feature (71): n=a or c
cccagtgaaatccagataccagaccaaaaatatatatatattttgccctgtacatccagttaccatccaanaagttctaaatttgaattttggtctgaatt

SEQ ID NO: 28909 - DNA, 101 bp, rice(Oryza sativa)
  misc_feature (71): n=t or c
agcaatcatgttggcaaagccataaattatcaaagctcaaggtctttgggaacaatttatagagaaaattncctttgtacccctgaaagatcacccaatcc

SEQ ID NO: 28910 - DNA, 101 bp, rice(Oryza sativa)
  misc_feature (71): n=t or c
atcctaggagcatctttgctctcctcttgacatgtggcatgatgaagcatcgaaagagcatatttcacctncttgtgccatgtgtccatgcttatgacggt

SEQ ID NO: 28911 - DNA, 101 bp, rice(Oryza sativa)
  misc_feature (71): n=a or g
aatccacttgtactctgctctacacccttcctgatcttgaattgagacaaaacagattgaccagtactaanccttcatttactgactaaatcaacctctca

SEQ ID NO: 28912 - DNA, 101 bp, rice(Oryza sativa)
  misc_feature (71): n=a or c
tcaccagccagcgaagctcactcactatcacacctgaccccagcccacaacagttatagcacaagatactnattgagtctggcgagactactccacaacca

SEQ ID NO: 28913 - DNA, 101 bp, rice(Oryza sativa)
  misc_feature (71): n=t or g
ccggttgttggttgcaatgaaatactcctatttggaaaccatgatcgcactaatttattacaactaaaggntggccatttaagattttgtacatggagata

SEQ ID NO: 28914 - DNA, 101 bp, rice(Oryza sativa)
  misc_feature (71): n=a or g
attaaagactagaagaatttaatcctattgaacgggctataaaaaatttaatcctagcgggtacgactccntctgggtaatcgtggatcgactcacgaaat

SEQ ID NO: 28915 - DNA, 101 bp, rice(Oryza sativa)
  misc_feature (71): n=a or g
tctccgtctcatctctccctgcgtgcggcggtgtgtgtatgtggccaacccaataaatacccgcgaaaggnttgaggcgttgagccgcgagctacgactca

SEQ ID NO: 28916 - DNA, 101 bp, rice(Oryza sativa)
  misc_feature (71): n=a or g
taacgtgtccatcagatgtacgaggaattcccatgccaagcagcttgctcgtggtggtgagctcactaccnttgtgtggatcctcgctgaacacgctcgca

SEQ ID NO: 28917 - DNA, 101 bp, rice(Oryza sativa)
  misc_feature (71): n=t or c
accactgtgtatccttttccctttacaagcaatgaatttttctacttagtgtgaagcccgttatgcccccnttttctctctctttcctttggcttgtcctg

SEQ ID NO: 28918 - DNA, 101 bp, rice(Oryza sativa)
  misc_feature (71): n=a or g
gctgagaaatgacctgaaatgcatgccaactatatatggtcagatcgggaaggagctaaccagttgttgcntttgtaatagtacacacaagcaaaatcata

SEQ ID NO: 28919 - DNA, 101 bp, rice(Oryza sativa)
  misc_feature (71): n=a or g
gatctatatttttatcttggataatccaaagctgcatcagcttgagttgcaaggatcagagattgcacgcnttgatttgatccaatatttgaagaaacctc

SEQ ID NO: 28920 - DNA, 101 bp, rice(Oryza sativa)
  misc_feature (71): n=t or c
atttgaagtgaacaattgtcctggctaggcttttcggaaatggaaaggccatccacttttagaccaacaancattctatttgagtgatgagtgaactgttc

SEQ ID NO: 28921 - DNA, 101 bp, rice(Oryza sativa)
  misc_feature (71): n=t or c
ttatccgtttcgcgattatttttctaggttggtattagtgcgctgttatatgatctgagggatgttgctgnaacaatttgttgtaaacttgtaagtttgga

SEQ ID NO: 28922 - DNA, 101 bp, rice(Oryza sativa)
  misc_feature (71): n=t or c
tctgttctccccgattctgatcgcttgcgcctctgtgccagacaatctcccctgtgctgctctctgttctncctagtgctgtccttgttcttcccctgtgt

SEQ ID NO: 28923 - DNA, 101 bp, rice(Oryza sativa)
  misc_feature (71): n=t or c
gttctgcatgtgggcagatttgcagtgcttcggttttacgatgtttcggggctataaatgttaatttctgngaaagtgtatagctaggaagttgtagataa

SEQ ID NO: 28924 - DNA, 101 bp, rice(Oryza sativa)
  misc_feature (71): n=t or c
cctgaacatgtcataggtgctcaattcgctgaaaccttgtgcttcttcatggtttcgaagaacttagtcangtacctcacgagtgcgctgcacgaaagcaa

SEQ ID NO: 28925 - DNA, 101 bp, rice(Oryza sativa)
  misc_feature (71): n=t or c
gatcctctcttctgctttctctgataggctagtgtcactgtcatattcttcagtttcgctccctgattctncagatagaccaatgtcatgactcatgttgg

SEQ ID NO: 28926 - DNA, 101 bp, rice(Oryza sativa)
  misc_feature (71): n=t or g
catgttcctttcctaagctgagttttgttctggttggactggcccccacttcctatagctagcttgctccngtggtcagttttttggtaggtccagccctg

SEQ ID NO: 28927 - DNA, 101 bp, rice(Oryza sativa)
  misc_feature (71): n=t or g
gttgttcttcaaagcgttgatgcagaacttgttgtttataagttgttgccaaaccaccttaagggtgtgtntgcaagagcaagtttccaacgctaccctct

SEQ ID NO: 28928 - DNA, 101 bp, rice(Oryza sativa)
  misc_feature (71): n=t or c
aaaaagtacaggatgatcaagaagcatcctaattccggtggctaaagaatcgacaatggatatatacctgngatggagttaaacacctgaggcgccatatt

SEQ ID NO: 28929 - DNA, 101 bp, rice(Oryza sativa)
  misc_feature (71): n=t or g
atgtcacacaattgcgttgagacctgctaatcgtatcactgcagctctccctcctgttaaagatgaaccanaaccgattacaaggcaggtggtgaacaacg

SEQ ID NO: 28930 - DNA, 101 bp, rice(Oryza sativa)
  misc_feature (71): n=a or g
agccaacttagtgagtgtactgatttccagaggcacatgtcctataaggtggttgtcggagaggtcaaggnaccataaacttttaagatgccttagggcat

SEQ ID NO: 28931 - DNA, 101 bp, rice(Oryza sativa)
  misc_feature (71): n=t or g
tgatttcgaagcatcattaatactaggagtagtaataagtcatcggagcgagtaacagaagaacagggaanagtagaagacgatggcttcaaagtccctgc

SEQ ID NO: 28932 - DNA, 101 bp, rice(Oryza sativa)
  misc_feature (71): n=t or c
tcgtcagatcaggaaaggtaactctgtgaaagctcaagttttaattcggtggtctggagatgttacagganaggaaacttgagaggatcaagttgagttgt

SEQ ID NO: 28933 - DNA, 101 bp, rice(Oryza sativa)
  misc_feature (71): n=a or g
aaaggtatgggcattctctagaaggaaggagcgttcaacgtgtttgtcagttgacaccgtctcaatatgcnggctttattcccaggggtcccagctgtcat

SEQ ID NO: 28934 - DNA, 101 bp, rice(Oryza sativa)
  misc_feature (71): n=a or c
tttggacgcttgaaagctcctttttgtgtaagaaaatatgtctgcgtcataccttttctttgtcttgcttntttaattttcttcttgataaatataggtcg

SEQ ID NO: 28935 - DNA, 101 bp, rice(Oryza sativa)
  misc_feature (71): n=a or g
agtttttgcttggatgtgccggacttgtgggtttgtccctaccgccgagcttttcgccactttattcactncatgcgcttcgaccaaagatgtgcagacac

SEQ ID NO: 28936 - DNA, 101 bp, rice(Oryza sativa)
  misc_feature (71): n=t or g
gcaccgcgacatcaagccggacaacatcctcgtcgtgaacggcggcgggctcaagctgtgcgacttcgggncggccacgccggtgaagccgccggggaagc

SEQ ID NO: 28937 - DNA, 101 bp, rice(Oryza sativa)
  misc_feature (71): n=t or c
ccttgaggaataaatgtcccccttgtagtgattgcagcttcagtccaatcctgaataggacccaaagtctntttgtgagtgatcttccagcgtgcattttg

SEQ ID NO: 28938 - DNA, 101 bp, rice(Oryza sativa)
  misc_feature (71): n=a or g
tggcgtaggcgaccgacgttgcctctcctacttttccccttttcatttttttgttctttttcttcgaccanataaaaaccagatgaagacgggagaaagaa

SEQ ID NO: 28939 - DNA, 101 bp, rice(Oryza sativa)
  misc_feature (71): n=a or c
acacatcgcacgcatcattctgaatttcttttttttttttgccccctcctcctgatgagtgagtgatgccnggccaccagaacaaagcaggaggagtcacc

SEQ ID NO: 28940 - DNA, 101 bp, rice(Oryza sativa)
  misc_feature (71): n=a or g
tactatacatacctgatcaagagcagatgcaaaaacatctaagacatggccttgactgaccaattgtttgncaaggccatcgtaaaatttgacagctttct

SEQ ID NO: 28941 - DNA, 101 bp, rice(Oryza sativa)
  misc_feature (71): n=a or g
ctagtttgccaactacgtgttagagtcacttgtcactatgaggtccgtacgagcttcctctatcctatctncgctctcgagtcttctttctcctcccctct

SEQ ID NO: 28942 - DNA, 101 bp, rice(Oryza sativa)
  misc_feature (71): n=t or c
ggtgtccgccgcacctccgctgattcgacctctactgcgcctctgctcttgctcactggcttcctcgcctnaacctcttgtcatctgcagcttaagtccac

SEQ ID NO: 28943 - DNA, 101 bp, rice(Oryza sativa)
  misc_feature (71): n=a or g
gcatggacgttgcgaccctcgagtaggaatgtaaacgaatcaacccacgaactcatttagtgatgaatatnattatgaataatcgttgactcgtggattat

SEQ ID NO: 28944 - DNA, 101 bp, rice(Oryza sativa)
  misc_feature (71): n=a or g
gctagcttcactcgggctaccatcgtcaagagcatcgtggatgtctctcccattgccccttctcctctgcntgctggctagccccgcctcacatctggctt

SEQ ID NO: 28945 - DNA, 101 bp, rice(Oryza sativa)
  misc_feature (71): n=t or c
gccaatctagctagctatagcaatcggtactttgtactacctgcgttgatcaatggcggcttgttcatatngatgttattttgttaaagatatcaaaattg

SEQ ID NO: 28946 - DNA, 101 bp, rice(Oryza sativa)
  misc_feature (71): n=a or g
ggatatcttttcggtaaagcattccagttgattcctttaaaggggtatgatattgttttgggggcagactngatatatgagcacagtccaattaatttgga

SEQ ID NO: 28947 - DNA, 101 bp, rice(Oryza sativa)
  misc_feature (71): n=t or c
ccaaaactccagaaccggagagcgccttctgcaaatgaatggtagcaaagcctgagatagcgtatgccatngagcctgctaagtacatcgagggcgccctg

SEQ ID NO: 28948 - DNA, 101 bp, rice(Oryza sativa)
  misc_feature (71): n=a or g
agtttccttgggccgactcgtaggttactaaagcggattgagctggggcgtaactggggttgtacgttagnggtccctcgtcttgtcaccgaattataaaa

SEQ ID NO: 28949 - DNA, 101 bp, rice(Oryza sativa)
  misc_feature (71): n=t or c
taacacttctctacagcacaaaattctggccaatttacactcctcggcagtgggtggccattctggtattnaggtaacctaccagcgtgttcaacatttgt

SEQ ID NO: 28950 - DNA, 101 bp, rice(Oryza sativa)
  misc_feature (71): n=a or g
ctgactcaggaatcttgcatgggacaaagtattgagttgatgccagattcagagaagacactagatctganagaagaactctcatcgttaattgagatgcc

SEQ ID NO: 28951 - DNA, 101 bp, rice(Oryza sativa)
  misc_feature (71): n=t or c
aaaatattactgttgaatctgttttctacactagtatagagtttttttttggtttgtttttgtatggttcngaccatttgtattgtgtcaaagttttgaat

SEQ ID NO: 28952 - DNA, 101 bp, rice(Oryza sativa)
  misc_feature (71): n=t or c
ccaacccggatcacccgctcaatctgctcctcatcgaaatcacccttcagcctctcgtctgccatatcggngactgatttcctgtggcggaacgagtcctg

SEQ ID NO: 28953 - DNA, 101 bp, rice(Oryza sativa)
  misc_feature (71): n=t or c
ttgcaatccttccctcttgcattgagcaatcaagttttggtctctcccctttttgcaacgagttgttttgngataggtgtaagttgtagctaatgctcata

SEQ ID NO: 28954 - DNA, 101 bp, rice(Oryza sativa)
  misc_feature (71): n=a or g
aagcaggcttgtggcaccaggctagctagggttttggtttttcaatttcgagatttttattttttttttcnaaattttatttttgcatacggctcgcataa

SEQ ID NO: 28955 - DNA, 101 bp, rice(Oryza sativa)
  misc_feature (71): n=a or g
gagctaaatttgcttgacgtttcctttggagaagatgatgatgttgagaatggaggaactgttggttctangagtaaacttttcctggatatgcaagcttt

SEQ ID NO: 28956 - DNA, 101 bp, rice(Oryza sativa)
  misc_feature (71): n=a or g
tggtccaagctcacacgtaaataatacccggcggggagggagcaatcagcaatagaaaaagatcagcatanagagagagagagagagagagagagagagag

SEQ ID NO: 28957 - DNA, 101 bp, rice(Oryza sativa)
  misc_feature (71): n=a or g
ccatgggtggcaacatcatgcggacagtaacagagccgtacttgtcggcaaccttgcacgacacggtgtgnggctttcttgatattgtttccctagtagcc

SEQ ID NO: 28958 - DNA, 101 bp, rice(Oryza sativa)
  misc_feature (71): n=t or c
tttatttttcttggtttttcatttatagtttccttcggtgttccctaccagaacaagagaaggatcctaangatgcgagtctactgcgctgctgatgaagg

SEQ ID NO: 28959 - DNA, 101 bp, rice(Oryza sativa)
  misc_feature (71): n=t or c
acaagcacaatttcaagccttcttgcaataactcaatcaaccccaaaacaatttaccaagaacttcgcctntggccctggccgagggaagcccaagtcagg

SEQ ID NO: 28960 - DNA, 101 bp, rice(Oryza sativa)
  misc_feature (71): n=a or g
tttgctttgtgtgcaagagaatgccgcagatcgacccactatgtcagaggttgttgcgatgctaaccagcnagagtatgaccctacctgagcctaagtacc

SEQ ID NO: 28961 - DNA, 101 bp, rice(Oryza sativa)
  misc_feature (71): n=t or c
taggttacgcatcctaatcagtttctctccaagtaaactgctggttaggttctgtgccgttttctgcatgnatcttaatcagtgcacgtcatgcagatcat

SEQ ID NO: 28962 - DNA, 101 bp, rice(Oryza sativa)
  misc_feature (71): n=a or g
agcgggggtttagcatgctgcatcaccgagtatggtgttgattagttagatctcagcgtcatcggacatgntgttgaggttgtgctcaatttttgaaatac

SEQ ID NO: 28963 - DNA, 101 bp, rice(Oryza sativa)
  misc_feature (71): n=a or c
ctgacaaaacatcttatctggagcaacgagtcatatagtagtcaattgtattgcttccactcctcgagcgntccggtgagctcagcgcctcagccatttca

SEQ ID NO: 28964 - DNA, 101 bp, rice(Oryza sativa)
  misc_feature (71): n=a or g
acctgtgcccatgcccacaagcctgatctttggcctcctgtccttgttgttatacatgtcgtatccacgancgaagctccaactttcaataaatctatgcc

SEQ ID NO: 28965 - DNA, 101 bp, rice(Oryza sativa)
  misc_feature (71): n=t or c
attcaacggcgaactccgatccatgaaattcattgttgagtccgacaaagctcacatcaaatctacagctnaacaacaaatctctaacttgtgtcattctc

SEQ ID NO: 28966 - DNA, 101 bp, rice(Oryza sativa)
  misc_feature (71): n=t or g
gttgaaagagagaccagtgggtgagatcgagagttgcatactggcatgatgcaagccattgaatgttagtnacatgcaccgatgcacaactactgttctca

SEQ ID NO: 28967 - DNA, 101 bp, rice(Oryza sativa)
  misc_feature (71): n=t or c
cggactacatcggccgcgttggggagccgtgtgaagattgcagcgagcacgtcatccgtgagggacgcccnaccccgacctgtgtcgtactccctgaagcc

SEQ ID NO: 28968 - DNA, 101 bp, rice(Oryza sativa)
  misc_feature (71): n=a or c
attatgcatactagtagtactaattgtgattatatatggagtatttaattaagcatgaactaagaactcanttaattaattataatctctagttagtacaa

SEQ ID NO: 28969 - DNA, 101 bp, rice(Oryza sativa)
  misc_feature (71): n=a or g
acgtcgcttcacttggagcaatgagcgtgagtcgcccacgcttgttaagctcgaccgcgttctcttctccncggattgggaggagcttttcccctcttgcc

SEQ ID NO: 28970 - DNA, 101 bp, rice(Oryza sativa)
  misc_feature (71): n=a or g
aacagcaggctctgctaaaaaaaaaggagctcatataacctttagcacatattcacaatttcataaactcngtaaaatttacagtggcctgtaaagtagca

SEQ ID NO: 28971 - DNA, 101 bp, rice(Oryza sativa)
  misc_feature (71): n=a or g
ctgtaaataatctcgcaggggaaaatttactgccttagtacaaacaatccctgtgtttctgtatattttcngaaacttccgaaaaaaaattcggaacttcc

SEQ ID NO: 28972 - DNA, 101 bp, rice(Oryza sativa)
  misc_feature (71): n=a or g
atgtgcaagaatcttcacttgctttactattcccataccttaccgtacggaatcaggatataatccctccnttttttaatagataacgccattgacttttt

SEQ ID NO: 28973 - DNA, 101 bp, rice(Oryza sativa)
  misc_feature (71): n=t or g
atctgcctcttcgacctactgaaagacaagaagaaatatgtgatggatgtccatatcattcgcagaaaatnaaatcaatatggttctctcagccatttctg

SEQ ID NO: 28974 - DNA, 101 bp, rice(Oryza sativa)
  misc_feature (71): n=a or c
ctgtgtttaaaataaactgaaaactggtagatgctcaccttttttatgtggttttcatgttgcagctgggnctgtggttttcatgttctattatatatcaa

SEQ ID NO: 28975 - DNA, 101 bp, rice(Oryza sativa)
  misc_feature (71): n=t or c
ttcatcttgtagcatggtgggatcaattaaattgtaggaatttttggcgaattctccagcaacaagttcangcaggcttgtgccatcactaaaaatttcat

SEQ ID NO: 28976 - DNA, 101 bp, rice(Oryza sativa)
  misc_feature (71): n=t or c
tacactatagtgtgtcccagcaaatgaacacaaattaattatctacgtaggcacagaagtggttctctagntgtgcaaatgtcaaccaattcgttttccta

SEQ ID NO: 28977 - DNA, 101 bp, rice(Oryza sativa)
  misc_feature (71): n=a or c
ctaactgacgactgacgactgacgcccatatgcttatctatgtacattcatcagtcgggtgtgttttaacntggacattgtattcacgaatcttaaaatga

SEQ ID NO: 28978 - DNA, 101 bp, rice(Oryza sativa)
  misc_feature (71): n=t or c
ttctcctcaattaagggagcgtacggcgtaccagcatcaactgcgacaagaaagggagttggaataagttnaccggaggtccctcaacttaacagcgagat

SEQ ID NO: 28979 - DNA, 101 bp, rice(Oryza sativa)
  misc_feature (71): n=a or g
ggacccactggtctgcatggagtatctgtagtactagggagtagtagtaggtgtggactaagtgtagtatntttgaccggttgtgccgcccgtacatatgc

SEQ ID NO: 28980 - DNA, 101 bp, rice(Oryza sativa)
  misc_feature (71): n=a or g
tctccgtccccttccacctgcccatcagtcaatctggcctattattacctcatcaaaccctaatcaacagnaggctacaacctcaattcaaggtgttagct

SEQ ID NO: 28981 - DNA, 101 bp, rice(Oryza sativa)
  misc_feature (71): n=t or c
tgtaagataatgttgcacgtgtgaagtggtatgtgtgcatatggtttgccgagtcagctgtcacatcaaanaaaaccgaagttaatattgtctaatgatcc

SEQ ID NO: 28982 - DNA, 101 bp, rice(Oryza sativa)
  misc_feature (71): n=a or g
gcgcgcgcagtgaaaatgacaagtgtggcagtgaaaagggaaaagagggagagaatatatagcccacccangcaatggttcgcctacccaccagtaataaa

SEQ ID NO: 28983 - DNA, 101 bp, rice(Oryza sativa)
  misc_feature (71): n=a or g
ttgatttcactacatttttttcagatttgttagtgactaccggtttgatgtatccaaattggagccagttnttgccaaggtttgttcatatagttactgtt

SEQ ID NO: 28984 - DNA, 101 bp, rice(Oryza sativa)
  misc_feature (71): n=t or g
ggatatgcagcgcatcgtatactccaacatattttgcctcaaaaccagataaccggatctacctggcttcntgtctcttctatacgtggcgagcttaggta

SEQ ID NO: 28985 - DNA, 101 bp, rice(Oryza sativa)
  misc_feature (71): n=t or c
tttcaatgagcctcactacggtgctctttgctggtagtagaaagtaatatgaaaaagtacgaattaccctncccctcgggaactattgcggtagtacgatt

SEQ ID NO: 28986 - DNA, 101 bp, rice(Oryza sativa)
  misc_feature (71): n=t or c
tgggggaatattaccatattccatagaggcttaattgccaatgtgtttgttatatgagcaattttatattncttgaggaggtactattttttaatttagta

SEQ ID NO: 28987 - DNA, 101 bp, rice(Oryza sativa)
  misc_feature (71): n=t or c
gcagattgcagtaggtaggttggtgatattgcaagatctggacacagtgaacaaccgagtgtatgtatgtncatggttgaaaatttgcgttcctttgagca

SEQ ID NO: 28988 - DNA, 101 bp, rice(Oryza sativa)
  misc_feature (71): n=a or c
aatcatcagagggacctaatcttccatgacctgagctttggcggcagctgcgcgagcatggtgttcgtcgncgccacgctcctcgtgctggtcaccagctt

SEQ ID NO: 28989 - DNA, 101 bp, rice(Oryza sativa)
  misc_feature (71): n=a or g
agttaactgtgttacataatcaaggacattattgcctttgatgagtcaccatccgtacggtaaacaacganccctgatctgcatatgggtaatacttgttc

SEQ ID NO: 28990 - DNA, 101 bp, rice(Oryza sativa)
  misc_feature (71): n=t or c
agttcaaaaattttctttttcttggcgtataaacctgaaaaatcatgtcgggggaattactttggcccganatcctttcctctggaacagaaatattatat

SEQ ID NO: 28991 - DNA, 101 bp, rice(Oryza sativa)
  misc_feature (71): n=a or g
ggaaggggggatgtaccagggttttgatctagaaagcccccattccttcggatgaaggggatcccagtctngcgctaacaacaccaatttctttggtcgcg

SEQ ID NO: 28992 - DNA, 101 bp, rice(Oryza sativa)
  misc_feature (71): n=a or g
tcggattgcatggctattattttcctattgaacaggcgttcaacaagagcttggaactcatgaaatttttnaacaacttcagacttatgcttaatcaaata

SEQ ID NO: 28993 - DNA, 101 bp, rice(Oryza sativa)
  misc_feature (71): n=a or g
ttgttcactttcgcagccgattaaaatcctgatgataatcctgtcctgcaaagtgcaaactatattctgcntactatgcgtgagtcgcttcgcttctcttt

SEQ ID NO: 28994 - DNA, 101 bp, rice(Oryza sativa)
  misc_feature (71): n=a or g
tgccagatatgcgcccatttttgaacaattctcatacgtctatttttgaatcatcctatagtttctaaggncaacaacaatgtatatggcaaaagtagtct

SEQ ID NO: 28995 - DNA, 101 bp, rice(Oryza sativa)
  misc_feature (71): n=t or c
tatgttcagctagctgtcatactaggtggccttgctccccagcaagttaccagttgcagctatttcttgtntgtacatgatgtaacgaatgattctactca

SEQ ID NO: 28996 - DNA, 101 bp, rice(Oryza sativa)
  misc_feature (71): n=t or c
acctgtccatgagaagaagaagaaaacaaaagagatttgacggttttgattcgtgcgtgcgaacgttctgngtgcgcgcgtttaaaggtgttcgacgagat

SEQ ID NO: 28997 - DNA, 101 bp, rice(Oryza sativa)
  misc_feature (71): n=t or c
cgccgcctctttgagaaaacttctcgggaggtgggggctcaaatggactgcttaacggcccacgccacggngtcggatggaaaggtggcgcagctggagac

SEQ ID NO: 28998 - DNA, 101 bp, rice(Oryza sativa)
  misc_feature (71): n=t or c
ctgcaggcgaaggctatcgacagtttggtgaccgacaggcctggctactgtaacaccatcaaccttgtacntatcgcgcagctcactcacctccttgatgt

SEQ ID NO: 28999 - DNA, 101 bp, rice(Oryza sativa)
  misc_feature (71): n=a or g
taatataatttttgaactcaagtgtagccacgaccactctagatttttgcacgatattttactaagaatcntcaaaattacatacatctagagcattttga

SEQ ID NO: 29000 - DNA, 101 bp, rice(Oryza sativa)
  misc_feature (71): n=t or c
ctgtagaatctattgtgcatgctcatctttggataaaggttccatgtagggtactgtttcacatgaagttnacagaaaactaagcattttctgtgttttta

SEQ ID NO: 29001 - DNA, 101 bp, rice(Oryza sativa)
  misc_feature (71): n=t or c
gccacttcatcacgtcggctaccgtttcttcgtgtctctcctaaatccaagacatatgcgagatgatgtcnttcccaaccaacgcggctcgctgccatggc

SEQ ID NO: 29002 - DNA, 101 bp, rice(Oryza sativa)
  misc_feature (71): n=t or c
ctgaactgccatgtcgtgcacaacttgaaccaagagcttaaaatgggtgacgtggtcgaactgatcccttnggctcaatgcaatcctggagctggaggtta

SEQ ID NO: 29003 - DNA, 101 bp, rice(Oryza sativa)
  misc_feature (71): n=a or g
tgggggtaaaacagcaattggcttcgaaattggggtacagatgcaattgccacaataaaatattatccacntatggcagtgttcgtttctaaaaaaaataa

SEQ ID NO: 29004 - DNA, 101 bp, rice(Oryza sativa)
  misc_feature (71): n=t or c
gtatttttgtggctggatagagtaatgaaggggtgaaataatgatccctactccattgctaatcttgtctncctcctcaaaaaaaaaacaacctaatatca

SEQ ID NO: 29005 - DNA, 101 bp, rice(Oryza sativa)
  misc_feature (71): n=t or c
caagttttttgttgacagttatccacttcatgaagctttcaggtgtattcacgttgggctcttgtgtgttnaagatcatccgaatgatagaccatcgatgt

SEQ ID NO: 29006 - DNA, 101 bp, rice(Oryza sativa)
  misc_feature (71): n=a or g
cagatgggaactcccagagcccagcgagcaggccctcttctggcctcttgatcaatagaaagagattatcnttgatttgaacaacacaaacagcagcaaaa

SEQ ID NO: 29007 - DNA, 101 bp, rice(Oryza sativa)
  misc_feature (71): n=a or g
gccgagccttgttgctatggcatcccagattttccttgtgatcgggcattcataaaagaggtggtgtgccntctcgaggtttctgaagcagagctgacaga

SEQ ID NO: 29008 - DNA, 101 bp, rice(Oryza sativa)
  misc_feature (71): n=a or g
tctgttttaattttatagcccccctattgcccacatgacataaactcagataggtcagtacaagattctantcaagtagctatttttttctcttaaaaaac

SEQ ID NO: 29009 - DNA, 101 bp, rice(Oryza sativa)
  misc_feature (71): n=t or g
gtcactcacatagggtaaaaaaaaaagtgcagctacaacagagaagaacatcgttttcaacagaagacgcnagtggggaaccttgttcactactgtttcat

SEQ ID NO: 29010 - DNA, 101 bp, rice(Oryza sativa)
  misc_feature (71): n=t or c
ccatgatcagccggagaaccaagccaaggttgtcaaggatgctgttgcaaaggcgctcacatacttctacncggtggctggtcgaatccgtgagctccccg

SEQ ID NO: 29011 - DNA, 101 bp, rice(Oryza sativa)
  misc_feature (71): n=a or g
aggtcttggttgtggatactcaccatgggaaagaggggaagagatgcgtgctagggttttcgtcggagacncctcgccgccgagaaggagtgaggagaggg

SEQ ID NO: 29012 - DNA, 101 bp, rice(Oryza sativa)
  misc_feature (71): n=t or c
ccgcgctcctcgcgcggcgacggtagccagttgacggatgcctcgttggtgcatttcgtcgagcacgttcngggcacctcccccgacggtgaggacagcca

SEQ ID NO: 29013 - DNA, 101 bp, rice(Oryza sativa)
  misc_feature (71): n=t or g
aatatgcacaagtaaagcatacaaattatgtcaattagccaaattccggcctactaaagctcttctaaaanaaacatttgcaactgaggaatttctccttc

SEQ ID NO: 29014 - DNA, 101 bp, rice(Oryza sativa)
  misc_feature (71): n=a or c
ccccaagaatagtcctccgctggagtttgaggcagtattgcctctaaggtgttgacgggaacctccttctncttgggaacctccttctccttgaatccagt

SEQ ID NO: 29015 - DNA, 101 bp, rice(Oryza sativa)
  misc_feature (71): n=t or c
tctcaactttcccagtctcccatatcttgtttttcgtgtacaagcctccaaaactatcagtagacggtacnattttttgcgaaaattttctctagaaaagt

SEQ ID NO: 29016 - DNA, 101 bp, rice(Oryza sativa)
  misc_feature (71): n=a or g
aatttgtaaacgaacagcagcacgatttccgcagcaagtatccacagtagaataccaagcaggcgaggcgncggcggcggcggcggcggagcccaacgacg

SEQ ID NO: 29017 - DNA, 101 bp, rice(Oryza sativa)
  misc_feature (71): n=a or g
ggcgagcaattgttgtgcaatgaatgcttcgtcttgtctcgtgaatgtgtaggcataatagttaaacacgnacatgggtgatcttggaatgtgagtgtgca

SEQ ID NO: 29018 - DNA, 101 bp, rice(Oryza sativa)
  misc_feature (71): n=a or g
gaaaaatctgagcagatctgaggagctagatcagaacagatcaagcaggcaggagcaatcggatgacaaantctctactaataatgtccgaaagtagatta

SEQ ID NO: 29019 - DNA, 101 bp, rice(Oryza sativa)
  misc_feature (71): n=a or g
gccttgtcttggttctcctcgaggcatcgacggacagcggcgtcgatactcatcatcgatactcctctcanataggttgtgcatgcggtctctagatgttt

SEQ ID NO: 29020 - DNA, 101 bp, rice(Oryza sativa)
  misc_feature (71): n=t or c
ctgagtcacgaccatctatgtcgtgactaagatcttttttttttttttgagagattaaggtttcgagaaanagctggtgagaatatatatggaaaagctgg

SEQ ID NO: 29021 - DNA, 101 bp, rice(Oryza sativa)
  misc_feature (71): n=t or g
ccctcccgttccgggacttgtactcgttgacgaactgcaggagggagaccagggtgtccttggggtcacgncacacgtagacgaccttgcagcccgacggc

SEQ ID NO: 29022 - DNA, 101 bp, rice(Oryza sativa)
  misc_feature (71): n=a or g
cctcacgaggatgcacataccataacgaacgcaccatagcctttgactagggatgcaagcagacaaacccntgaaccagcttataggtaaaactaataggt

SEQ ID NO: 29023 - DNA, 101 bp, rice(Oryza sativa)
  misc_feature (71): n=t or c
tgtgaaaaattttgacagggatttaaacaggtcctaaagataaaaatattgccaactacggttcgatgtgnaatctaggtaataaaatctacagagtagca

SEQ ID NO: 29024 - DNA, 101 bp, rice(Oryza sativa)
  misc_feature (71): n=t or c
tcgcccgacgaaacaatatccatctccagtccaagggttcgatgacctttcctccaacggctagcatattntctttgctttgggtatgcctagtgaaacac

SEQ ID NO: 29025 - DNA, 101 bp, rice(Oryza sativa)
  misc_feature (71): n=a or g
gtgtccgtgtgccaatcgtgcgccaccgctgacgcacactacgacactcgccaccaacagacgcattgtgnccgcgtcagccacacgccacagcgcagctc

SEQ ID NO: 29026 - DNA, 101 bp, rice(Oryza sativa)
  misc_feature (71): n=t or c
ccacatgctggagatggatgtataataatcgggattaattgcgatgcctttgcgttgcaaatattgtgtgngcttgctccatcccgttcgctttgtccgct

SEQ ID NO: 29027 - DNA, 101 bp, rice(Oryza sativa)
  misc_feature (71): n=t or c
tcaggtactgatttatcacattgtggaatgattggacaatttctctataacaagtacttctggtaacaatnagttcatgcacagtggtttgagaccaactc

SEQ ID NO: 29028 - DNA, 101 bp, rice(Oryza sativa)
  misc_feature (71): n=t or c
acatgcaccatgagttttcaaaaaaattaccatgcaatctctgtcaaacaatatcggttcggtatgtgcantatcaaactttcattgtttgaaaggatgtt

SEQ ID NO: 29029 - DNA, 101 bp, rice(Oryza sativa)
  misc_feature (71): n=a or g
gtgagtagttttcatctatatagatattcaaggaattgatggccacggcccacgggatgctcgatcttctntcaggtgaagataactatcgatttggcaga

SEQ ID NO: 29030 - DNA, 101 bp, rice(Oryza sativa)
  misc_feature (71): n=t or g
acgtaccctcggccaagccgccatagctaattagaccatcaatcacattaatgccgaattcgtactcttgntgctagctgtagcaatgtcgcagctcctcc

SEQ ID NO: 29031 - DNA, 101 bp, rice(Oryza sativa)
  misc_feature (71): n=t or g
atgtaacggttcaaggtggtaaataagtgattcagaggtacaccttccagctaagccagcatctcgcgttnttattattatgcgactacctctgttgttaa

SEQ ID NO: 29032 - DNA, 101 bp, rice(Oryza sativa)
  misc_feature (71): n=a or g
aaaatcctcgtcagcctatctcaccagtctatgtccacgtagatatagtagttcgcttactctttacgccntgctgcttccgcccctcggccccgccaggg

SEQ ID NO: 29033 - DNA, 101 bp, rice(Oryza sativa)
  misc_feature (71): n=a or g
tcgagagtagctaggtagggcgatcgatggatggatgagtttgggcgggtgaaagggttgggggaggaagnagggtgtcgcctctctctctctctccaaag

SEQ ID NO: 29034 - DNA, 101 bp, rice(Oryza sativa)
  misc_feature (71): n=a or g
gtgaaggttaattttttatggtctttgcatttagtacaacgtgataatcaacaatttcaggatgactcacntaaagaattgttgctttcagtgtttttagt

SEQ ID NO: 29035 - DNA, 101 bp, rice(Oryza sativa)
  misc_feature (71): n=a or g
caggatagggactgcacgaggaccatggactttctatgcagctcaacgcatgcattctcatgaggtggttngactttgttgaacaatactataggaagaca

SEQ ID NO: 29036 - DNA, 101 bp, rice(Oryza sativa)
  misc_feature (71): n=t or c
ggttttgacaagtcttagcttagatcaccgcaataatctttaagggatgactccctatgttaaccgatccngcctcagatccgcgctcgtcaccaccggca

SEQ ID NO: 29037 - DNA, 101 bp, rice(Oryza sativa)
  misc_feature (71): n=a or g
cccaaacaaagagcatagctctgatccagcattatttatcttgaggtacctataccaccgatctaaatccngccgttcatctatcgggggtaggataggga

SEQ ID NO: 29038 - DNA, 101 bp, rice(Oryza sativa)
  misc_feature (71): n=t or g
agggagaggggcgggcaaagggatcaaaggaaccaacgttgcagaaattttgaaccgaaatatagaacgcntccatatgatccatgtcatggtgatcatca

SEQ ID NO: 29039 - DNA, 101 bp, rice(Oryza sativa)
  misc_feature (71): n=t or g
ccacagctgtgagggcaaagaatggaatttcgtttcgcccatacatttggatcataccaatctgcaagcancgattccatgatgcccctcctacacacatc

SEQ ID NO: 29040 - DNA, 101 bp, rice(Oryza sativa)
  misc_feature (71): n=t or c
catggtcttgttaaggagtataaatggaaaccataattcgacttttgccagaattgagaattggtaacaancatttgatttttttttatgaattattcgta

SEQ ID NO: 29041 - DNA, 101 bp, rice(Oryza sativa)
  misc_feature (71): n=t or c
tgtatgctttgcgcttgccacataagtttgcaagcagttgaactgccttcttggatcccaagagggccacnacatcttagtagaaggaaaggcttcagata

SEQ ID NO: 29042 - DNA, 101 bp, rice(Oryza sativa)
  misc_feature (71): n=a or g
tgatggtgagtcctaggtaattcaaggggtaagattgcttttaggatcctcccgcaaaatcaacgcttcanacgcgcgccatctccccttttggctccctc

SEQ ID NO: 29043 - DNA, 101 bp, rice(Oryza sativa)
  misc_feature (71): n=a or g
ttctttcccggctggaaattgcagtcatgaaggcttcttcctcgagtcctgtcatgatcgcgcactcgacnaaagagctttacaagcggcattgcccttct

SEQ ID NO: 29044 - DNA, 101 bp, rice(Oryza sativa)
  misc_feature (71): n=t or c
ctcccattcctcatgaagatagtataaaccagacgcaatgcccttgataattagaaacctctgagcccaantgaggacgggcatgttgttgtgaccatata

SEQ ID NO: 29045 - DNA, 101 bp, rice(Oryza sativa)
  misc_feature (71): n=a or g
tgagattgtgatatttgagccgctttcgcacgacaatcttaaggaggtcgtcaaaattcagatgaagagtntcgttaccagtgtggctcacaagggcgtat

SEQ ID NO: 29046 - DNA, 101 bp, rice(Oryza sativa)
  misc_feature (71): n=t or c
ctgtttagaacttagtaaagttttttttctcaaaacacataaggcggatccaaatcttagttttccaaaangagatattcagaaatgcagaacaatacaac

SEQ ID NO: 29047 - DNA, 101 bp, rice(Oryza sativa)
  misc_feature (71): n=a or g
acctcaaatttgtccttgaggagcagaggaagcagagaatcaggccataacagaagctccttgctttgggncgaaattaagggtgcaaggcaggatgctgc

SEQ ID NO: 29048 - DNA, 101 bp, rice(Oryza sativa)
  misc_feature (71): n=a or g
gttccatgagacacatagaagttttacacaagtggtttgtgcaccgtgcacccgagctggttattattatnagtgatcacttgtaccatgtaggataaata

SEQ ID NO: 29049 - DNA, 101 bp, rice(Oryza sativa)
  misc_feature (71): n=a or g
tgctgtctcctccaccatggttcccaccaccccgtatcctaccacctagatggcagccatagacacgggcnacggggccagccccatctctgcgctcctcg

SEQ ID NO: 29050 - DNA, 101 bp, rice(Oryza sativa)
  misc_feature (71): n=a or c
tctgacatctcaacactcctctgatcagcatgggctgtactactgactttgtgattttcatgtgtcatggnagggtcaaggttctgaaatggaatcccctc

SEQ ID NO: 29051 - DNA, 101 bp, rice(Oryza sativa)
  misc_feature (71): n=a or g
ttgatttgtatgtgagaggctttttaccgtccttgagggaagacgataccaaatcctagccgttgatttcncgtcccacctggtacagtgttcccaacgag

SEQ ID NO: 29052 - DNA, 101 bp, rice(Oryza sativa)
  misc_feature (71): n=a or g
tttcttaaaatctgcaagcttttggcgacggaggtgacatttcatgttctcctcaatgtgccaactacacnatctatgatcagtattgggcataacctttg

SEQ ID NO: 29053 - DNA, 101 bp, rice(Oryza sativa)
  misc_feature (71): n=a or g
aaaccgacaccaatatgtaatcaacgagcaaaaaaacataagccggctcgagctcgagccgactctagccnattaactcccacatgaacaaagaaacaaat

SEQ ID NO: 29054 - DNA, 101 bp, rice(Oryza sativa)
  misc_feature (71): n=a or g
ttgcttgaattatttcagattcttcagacactctctgttcaagctactggttcatcaccagctgaacttantagcagcggagtttcaagagctatgatcaa

SEQ ID NO: 29055 - DNA, 101 bp, rice(Oryza sativa)
  misc_feature (71): n=a or c
gtaggcgagcgagcaaacgacacggcacgacagtacggcaccaaaccccaaccccaacaccggtcgcgctngcgtcgcaccgccccggcagccaagagaga

SEQ ID NO: 29056 - DNA, 101 bp, rice(Oryza sativa)
  misc_feature (71): n=a or g
caactattaggtgttctcaaaggtactggttcaaaggtgttggtttaggaaccagcacctttaaggctccnggaaccaaaaaaaagcggcttgatgcatcg

SEQ ID NO: 29057 - DNA, 101 bp, rice(Oryza sativa)
  misc_feature (71): n=a or g
gatagtgagaaatgatcggggtgagtttatgggtgcgaacaggattttcttcggggaagtgttaagtgcanctcatgctgaagcgttggcttgcctcgaag

SEQ ID NO: 29058 - DNA, 101 bp, rice(Oryza sativa)
  misc_feature (71): n=t or c
gtcctctagtgatttcctttcatattcttttttttctagatgcaggtacggcgtacaaccgaacactctgnttcttctagtctcagtaattccagcagcat

SEQ ID NO: 29059 - DNA, 101 bp, rice(Oryza sativa)
  misc_feature (71): n=a or c
aaaaatacccaaataccatgtatacttatttactctttgtggatacaaatgtcgggtttctgtccattatnaaacaaacaattccatgttgtttagataac

SEQ ID NO: 29060 - DNA, 101 bp, rice(Oryza sativa)
  misc_feature (71): n=t or c
aatttctccacacccaaattcagattgctcgaaattattagaggattggtagggaaatcatactcttgacnggagtcgggatcagggtggtaaccatcccc

SEQ ID NO: 29061 - DNA, 101 bp, rice(Oryza sativa)
  misc_feature (71): n=a or g
caaagaaaagatctcatcaagctcaagcagcaacagtacacacaattgagctagcttgatcgtcctaattnaggatgggaatccaggaaatcgtcaagatc

SEQ ID NO: 29062 - DNA, 101 bp, rice(Oryza sativa)
  misc_feature (71): n=a or g
aaagagaaggagaagtaaagaagataaacaaggaaaatttttatgtgggtccaattttttagtcaagatgntgccacgtcacgtccgtgtggcatgccaca

SEQ ID NO: 29063 - DNA, 101 bp, rice(Oryza sativa)
  misc_feature (71): n=t or c
tcattccagtgcgctggcatctctgatccaatcaataaagatttcacttctttccccacatccagccccantgtctcccaaaaattcttgtaaaacaaggc

SEQ ID NO: 29064 - DNA, 101 bp, rice(Oryza sativa)
  misc_feature (71): n=t or c
ccggcattactgccctgccgcaagtccgcaacgtgatacactggtgcaaaaaggctctgagcatgatctcnaacttttaaatttaactttagatattaatt

SEQ ID NO: 29065 - DNA, 101 bp, rice(Oryza sativa)
  misc_feature (71): n=t or c
aatccaaattcgaaaattttgaaccatgatgttgaatggtaatgatcattgagaaacacccgggggtcttncggctagctccacaaggtggtgggctaaac

SEQ ID NO: 29066 - DNA, 101 bp, rice(Oryza sativa)
  misc_feature (71): n=t or c
cggaccttcagttcgatcgtgactttccgattgttttcgagctgatcgaagaaggagctgtcgctcgcgtnctgcaaccagatcacatattcggtgtgccc

SEQ ID NO: 29067 - DNA, 101 bp, rice(Oryza sativa)
  misc_feature (71): n=t or c
caccgatttaatggaatgtgcacgttatgttaattttgcgttatcccaacaagttaactatcatgaccttnaggcccacaacatgaccattataccttcac

SEQ ID NO: 29068 - DNA, 101 bp, rice(Oryza sativa)
  misc_feature (71): n=t or c
gtaccaaccttagtgaaagttctcatccgttgtgtttgattattccacaaaccttggcttggcattccggnatcagtaacagcaacgtcacttgaacatcc

SEQ ID NO: 29069 - DNA, 101 bp, rice(Oryza sativa)
  misc_feature (71): n=a or c
ggagctctcaacactactgcttgaaaagtagagaacgatacaaaaacgaggataatgtgcgagctgtctcntaattctcactgctggactcctcatctctc

SEQ ID NO: 29070 - DNA, 101 bp, rice(Oryza sativa)
  misc_feature (71): n=t or c
tctcctactctcaaaaccatcagcatttcatctttctatgcaaactgggatggttttcgataacatggcanctacatggatgaatagtgatgatattaaca

SEQ ID NO: 29071 - DNA, 101 bp, rice(Oryza sativa)
  misc_feature (71): n=t or c
tcagccacatccttcattgtcggccttatttccatgctaaggcacctcagtgccaacctcccgatgttttnaagaaccacgatatcttttttggctgtaat

SEQ ID NO: 29072 - DNA, 101 bp, rice(Oryza sativa)
  misc_feature (71): n=a or g
aactgtgctaggcacatttatgccaattggaaaaggcatttccatgacaagaaattccagaagaagttctngaaatgtgcaaaggctcgttgcaggatgtt

SEQ ID NO: 29073 - DNA, 101 bp, rice(Oryza sativa)
  misc_feature (71): n=t or c
ggatttgtcacacaattacttgtctggaggaataccacaagaagttggcaatcttattaatcttaacaaanttagcatctcaaacaataggttgtctggta

SEQ ID NO: 29074 - DNA, 101 bp, rice(Oryza sativa)
  misc_feature (71): n=t or c
agaacctttggccctcccatgccacatctccatcactcccaacagccgctaccatccaaaatcccttcaangcatggctaccgcacaagtgccaatcgcca

SEQ ID NO: 29075 - DNA, 101 bp, rice(Oryza sativa)
  misc_feature (71): n=t or c
ctaactaaactagctctcaaaagctatacaaaagcgatacaaagcaatacttggaagactcacgctccccntctatttatacatgaggtaggcagcctaaa

SEQ ID NO: 29076 - DNA, 101 bp, rice(Oryza sativa)
  misc_feature (71): n=t or g
ttgagagagctataagcatgagcaatgataagtattctttggaagagggtacattggccaggcgtcggcanttcgttgtagcaatggaggaccagatttct

SEQ ID NO: 29077 - DNA, 101 bp, rice(Oryza sativa)
  misc_feature (71): n=t or c
ggcgatgatggaaatcggcgttgaggcggtgttttggaagatttttgtgtttcgtttgcaccaaatttccnaggaaaccaagatcaccaatattcgcaaag

SEQ ID NO: 29078 - DNA, 101 bp, rice(Oryza sativa)
  misc_feature (71): n=t or c
ttgtaacctttgtgtcgacggatccatgacaagaggtggaggataacttgtagagtgaagctgaggatgantagtatttgaatttgccactctttccagag

SEQ ID NO: 29079 - DNA, 101 bp, rice(Oryza sativa)
  misc_feature (71): n=a or g
gcttaaaagtctctctccaagccttttacaagatgagtcggatcgaacactaccgttctgcatgaaacccnattttccagtgaggtaacgtgttgaaacta

SEQ ID NO: 29080 - DNA, 101 bp, rice(Oryza sativa)
  misc_feature (71): n=t or g
aattgatgcatttctgtatgctttagtcaaaggtggattttttgatatggcaatgcaagtgattgagaaancacaagagttgaaaatatttttggataagt

SEQ ID NO: 29081 - DNA, 101 bp, rice(Oryza sativa)
  misc_feature (71): n=a or g
tgaacgccagttatcacgaacagtgggtgaccgcgagatcacacgataggatgagattgagggtgaaaacncatcgttttccgcgtgcacgtttctcaaac

SEQ ID NO: 29082 - DNA, 101 bp, rice(Oryza sativa)
  misc_feature (71): n=t or c
tgaacaacaaataagatgcccgtgtatatgtgggggtttcttttccgatttatattctgaaaatatcctcnattttatattttgtccttacattggttgaa

SEQ ID NO: 29083 - DNA, 101 bp, rice(Oryza sativa)
  misc_feature (71): n=t or g
cggaaatgagcagcacattcctaatctcaaataatcgtgttgaatagcggtagagctgcctgcatcgtggntagaactacggatatgtggtgtatatgaga

SEQ ID NO: 29084 - DNA, 101 bp, rice(Oryza sativa)
  misc_feature (71): n=t or c
gaagtgaggcattgtaagggcatcattactacttgctctcttcgttccaaaatacatactccctttgtccnaaaaaaaggcaaaccctaggtttacgtgtc

SEQ ID NO: 29085 - DNA, 101 bp, rice(Oryza sativa)
  misc_feature (71): n=a or g
gtagtaagtgggaccttcgaacggctctggtgtccttagccttgcaaattgttgacatcgtgtgggtaaanctggacagtctctgcagaggtgaattaaat

SEQ ID NO: 29086 - DNA, 101 bp, rice(Oryza sativa)
  misc_feature (71): n=a or g
ggcctacaaattgtaagccacacttgtagcaaagttagacaaatgattgagtctatgacatgtggggtaanatgataagaaagtgtggcttgccataacta

SEQ ID NO: 29087 - DNA, 101 bp, rice(Oryza sativa)
  misc_feature (71): n=a or g
atgatctggctaactaccggttattagccagatcgtggtgccatttaccccgggggtggtatgttttaatnttttggcctatgtatatgtatgtttcactg

SEQ ID NO: 29088 - DNA, 101 bp, rice(Oryza sativa)
  misc_feature (71): n=a or g
aactcatgggccatcccgcgaaatatccttggatgtatggctcactgtccaggcatgataacgaggtgccntagcatctgtcctacctactcccactgcgc

SEQ ID NO: 29089 - DNA, 101 bp, rice(Oryza sativa)
  misc_feature (71): n=t or g
tcggaggaagactttgttaatttgtcccattgtattggtacatgttgttggcaaactattgtggtccctcnagcagtggcggagccagaaatcgcataaga

SEQ ID NO: 29090 - DNA, 101 bp, rice(Oryza sativa)
  misc_feature (71): n=t or c
agtacgaataatcgacaaacatgcttcatatgctagttatgcaaatcctcacaatcttgtaggtcgagcancctcagtagggtgaactcggatagtttatc

SEQ ID NO: 29091 - DNA, 101 bp, rice(Oryza sativa)
  misc_feature (71): n=a or g
ttgaaggccagcaatgcagcgaggtcggtgtcgctgccgttactcttgctggcgatcggacctagagaggnagcacaaggcacagtactggacgaagcgat

SEQ ID NO: 29092 - DNA, 101 bp, rice(Oryza sativa)
  misc_feature (71): n=t or c
gccatggattgtatgtaataattttcttcataattgctctaggtttcaaatgtgggccaacctggcaatgntttgggaaatgctggtagacagccagcata

SEQ ID NO: 29093 - DNA, 101 bp, rice(Oryza sativa)
  misc_feature (71): n=a or g
ccaacacgacgaccaccaccacatttgtcccaacacaccaccaccacactcaagatcaatgtcgcgatccncggcggcgaccgccgccgtggtggtggccg

SEQ ID NO: 29094 - DNA, 101 bp, rice(Oryza sativa)
  misc_feature (71): n=a or c
aaggaaaatatcttgataagtcttgcaaacatcatccgtgccttggcatactgtggttcatagaaaacacnaagtgaccagaagtagcactccactgggcg

SEQ ID NO: 29095 - DNA, 101 bp, rice(Oryza sativa)
  misc_feature (71): n=t or c
tatgctcaaattaatcactcactagtgatagtgattaatgtacgtagcgctcgctaaaacgaagcccaacnaacttttcaaccatccagcacgtcccctgg

SEQ ID NO: 29096 - DNA, 101 bp, rice(Oryza sativa)
  misc_feature (71): n=a or c
gtgatggaccaagtgttcaggaatcacttggtttactgtatgctgtactggccgattgtcaggtgttcttnaccttgccgatgcatgctgcaaattctgat

SEQ ID NO: 29097 - DNA, 101 bp, rice(Oryza sativa)
  misc_feature (71): n=a or g
caagattctcctggatgcaataaatagccaccttgggggtaaaacacattcctaaatcatgaatcttcacnaacacaatccacatatgctggattcaaaaa

SEQ ID NO: 29098 - DNA, 101 bp, rice(Oryza sativa)
  misc_feature (71): n=a or g
ttgcagcaaacaatagagaaaagaagctaattaaaacttactgaagcacttggtcagagcctcgacaggcngggcgacgccgcaggtggccggaagagaca

SEQ ID NO: 29099 - DNA, 101 bp, rice(Oryza sativa)
  misc_feature (71): n=t or c
acgaagctaccattcaacctacgatccaccaagctgattacccatgtccgatcaccaatcttcaacccttncctgatcttccacaccaactgtctcatcgc

SEQ ID NO: 29100 - DNA, 101 bp, rice(Oryza sativa)
  misc_feature (71): n=a or g
actgcaatatttatcaagattgccttcagttttaccagttttatcaagattgaacaaatggccaagcagcncaaactgcatgagaatttgtgcatccttat

SEQ ID NO: 29101 - DNA, 101 bp, rice(Oryza sativa)
  misc_feature (71): n=t or c
gggactggcccactagactaagaccggcctagagtttgttgggcctttctgggctgggttgaatggatcanccgaataaaattatagaaaggaataagttc

SEQ ID NO: 29102 - DNA, 101 bp, rice(Oryza sativa)
  misc_feature (71): n=a or g
agtggtgatgccaaatgtgagccttgaaaggattaatatgtttcttgaagagttcaccaagagcagaatcncattgcatcaagataaatgtgttgctggag

SEQ ID NO: 29103 - DNA, 101 bp, rice(Oryza sativa)
  misc_feature (71): n=a or g
atatatatatgtacgtctcagtctgtgtgtgccgggtagttattcccaattaagtgcgtttagttttaccngtaatttgtatggtgtgtactcgtgtgttc

SEQ ID NO: 29104 - DNA, 101 bp, rice(Oryza sativa)
  misc_feature (71): n=a or g
cattagagttaaaaacataatgtgggtccatttgtcatccacacacacacaaagaaaatgtgggcccactnacacatgggacccacttgtcatcctatcct

SEQ ID NO: 29105 - DNA, 101 bp, rice(Oryza sativa)
  misc_feature (71): n=a or g
tccccgtctctgagagaattggtgtaatctgatctgatctggagcaatttggtcagaatctgctgcaaagnctgaacactgaatccattttcttctaaaat

SEQ ID NO: 29106 - DNA, 101 bp, rice(Oryza sativa)
  misc_feature (71): n=t or c
tataatggtcttgtggggtgcctcctggtgttatgcgataaaaaacgacaatagtcccagtggaactactnggcattcacttatgaatgctcactgctaaa

SEQ ID NO: 29107 - DNA, 101 bp, rice(Oryza sativa)
  misc_feature (71): n=t or c
ccaattaaccctttcaggaacgcttgggacgtatcggcgaggtatcttttttttatttaactgaaaatcgngaaaatctgggatacgtatcgaagtgtatc

SEQ ID NO: 29108 - DNA, 101 bp, rice(Oryza sativa)
  misc_feature (71): n=t or c
cattgcagaattgagaattggctgttggagaaagagacgccttctatttcggagagaaattaaccggacancagaggtatggttgtgctgactcgatcgat

SEQ ID NO: 29109 - DNA, 101 bp, rice(Oryza sativa)
  misc_feature (71): n=t or c
gggacaatgttttcagtatcgacttcagatgataattgattggttcccggaggttttggatgcttggtccncggagggttttgagatttggcccccggagg

SEQ ID NO: 29110 - DNA, 101 bp, rice(Oryza sativa)
  misc_feature (71): n=a or g
tgcagcaaaagaacaatcagttgttgctgaaggctcggggctaatctgaaccttctgctgattaagagacntaatgtgatcatcgtcacaatcatctacag

SEQ ID NO: 29111 - DNA, 101 bp, rice(Oryza sativa)
  misc_feature (71): n=t or g
aatgcttctggaagagagaatgagccacgtaacttgattgaaaactctgtcactcttagggcctgtttagntaggaaaagaaaatttttagatgttacatc

SEQ ID NO: 29112 - DNA, 101 bp, rice(Oryza sativa)
  misc_feature (71): n=t or c
gatcttttcttcttcatagatggtcaattttcacgagatctaatggaggaaaagcgtgtggctggtacctntcgttgccgttgaggcgcgcgccgaagaag

SEQ ID NO: 29113 - DNA, 101 bp, rice(Oryza sativa)
  misc_feature (71): n=a or g
cgagcgagagctgctctgcccgcccactcacgcagaaagttcaaacagagacaagaagagcaacaacacgnggagggggaagaatctgtcgcctcccgctc

SEQ ID NO: 29114 - DNA, 101 bp, rice(Oryza sativa)
  misc_feature (71): n=t or c
gttggcccatttatttgcttggtccggtccaaccgagccggtttaatggccggtttagtctaaacccgccnggttcagccggttcaatccgagtcgagggc

SEQ ID NO: 29115 - DNA, 101 bp, rice(Oryza sativa)
  misc_feature (71): n=t or c
cctgtttgtgatgggtgggaggaagattggagttgctgtggacttctcgtcatgcagcaaagcagctctgngatgggcatcaaccaatcttaccaggagcg

SEQ ID NO: 29116 - DNA, 101 bp, rice(Oryza sativa)
  misc_feature (71): n=a or g
aatctttgcagcaattgctcgggttggaagaggaagaagaatgttataaatgtttttatctttagccccgnttggtgctaccaaccgaactaaagaactaa

SEQ ID NO: 29117 - DNA, 101 bp, rice(Oryza sativa)
  misc_feature (71): n=t or c
tccgccagttttctccatggcttgtgttttcttcaccccgcagtgatcaaaggaattcacagcgcggcggnacatgtaaccaagggggaaaaataccagaa

SEQ ID NO: 29118 - DNA, 101 bp, rice(Oryza sativa)
  misc_feature (71): n=a or c
aaaagttgttagacataaaccagggcgaggaagaattcaagcatgaactgagtgtgattggcaggatctancacatgaatctagtgagggtttggggattc

SEQ ID NO: 29119 - DNA, 101 bp, rice(Oryza sativa)
  misc_feature (71): n=a or c
ttgtgagagtgatccctaacccaccatccctctgaaacctcagtaggatgctaaggagctcttcatccctntcggcgccgtcgccgtcgccgtcgtcgacg

SEQ ID NO: 29120 - DNA, 101 bp, rice(Oryza sativa)
  misc_feature (71): n=a or g
tgttcttgggctcctgccttgaattggggtcaaattgggatgcttctgggtgctttgaggatggaggagangaagggattgatggggagggagagggatca

SEQ ID NO: 29121 - DNA, 101 bp, rice(Oryza sativa)
  misc_feature (71): n=t or g
atgtaaagtagttatggtattggttgtgctactaacaagaaacaagtgacgagaaaacttatactgtgcgngagactaaatattggggcgaggggattagt

SEQ ID NO: 29122 - DNA, 101 bp, rice(Oryza sativa)
  misc_feature (71): n=t or g
ggacctttcccagctggtgtgttgctgcattcgtatctaggatctgcagaaatggtgtccagccttgaaantttaggctgttacttttcgttgtccggctt

SEQ ID NO: 29123 - DNA, 101 bp, rice(Oryza sativa)
  misc_feature (71): n=a or g
gctgactcaaaaaaaatctggtcaacagcatggatcttcaatttattaattggccatcataaggcactttngtacagccatacggagtaccaactatatat

SEQ ID NO: 29124 - DNA, 101 bp, rice(Oryza sativa)
  misc_feature (71): n=t or c
agttgttggtgggggaaagaagagtgggtatgtgggcttctttcgctttttgtttttgtgttggtgacganaggggggagagcagagcggtttggtaaggc

SEQ ID NO: 29125 - DNA, 101 bp, rice(Oryza sativa)
  misc_feature (71): n=t or c
tcaacctactctgtgcacttacatggcatgccacatcaacacctatgtgtcagtggaacctacatagctanatgtcattcacattataaaatataaagtta

SEQ ID NO: 29126 - DNA, 101 bp, rice(Oryza sativa)
  misc_feature (71): n=t or c
tcagttgtcacaggccttatgacccacaacatcaagagtcacctctaggtacctcctgccatgttgcaagntttttatcaggtattttgataattctctct

SEQ ID NO: 29127 - DNA, 101 bp, rice(Oryza sativa)
  misc_feature (71): n=a or g
ccttaagcaatgtacacagttgggactgaaaattcataagtcagattctactcttgttagtggattttctnatacagattgggcaggtagccttgatgaca

SEQ ID NO: 29128 - DNA, 101 bp, rice(Oryza sativa)
  misc_feature (71): n=a or g
tcctcgatgttctgctaccgcctacaccgttgtagtagaattccacagcagggtaatgggctggtgtggcnaagctgaaagcattcgcggtgagggtgccc

SEQ ID NO: 29129 - DNA, 101 bp, rice(Oryza sativa)
  misc_feature (71): n=a or g
ttatcgatactaatttactcagattatctcctcttatgaagaaagtagtggggaaattctcgtacatcctncagattctgaagttggacggcgtgacgaga

SEQ ID NO: 29130 - DNA, 101 bp, rice(Oryza sativa)
  misc_feature (71): n=a or c
gggacacatttcattgacgggagttcagttgaagattcggatccacaatttgcacagctcaaggatgaagnactggtatctgctacttctaacgcaacatg

SEQ ID NO: 29131 - DNA, 101 bp, rice(Oryza sativa)
  misc_feature (71): n=t or c
ttttttcaaccacaggcaaccgaaggacatgctaatctccttttggcatttcatcaaccgtgacaagtcgngtgatgtgtcatcatcatacgtgtgggagt

SEQ ID NO: 29132 - DNA, 101 bp, rice(Oryza sativa)
  misc_feature (71): n=t or c
gctctcaagaaagttcctttgcctgttgtccatattggcagtgagatgctctaggaagtcattaaagctgntttctttgtacttttgtggattttcctcgt

SEQ ID NO: 29133 - DNA, 101 bp, rice(Oryza sativa)
  misc_feature (71): n=a or g
gcggttttgtgaaccctggtcagcagtcagcactcagcatgatcagcacgcaaaagctgaacagaatatantactacctccgtcccaaaataagtgcagtc

SEQ ID NO: 29134 - DNA, 101 bp, rice(Oryza sativa)
  misc_feature (71): n=a or c
tcattctctgttggtaatagtttgccttgttatttgtatgttgcaggatggtaatagggtcgctgcagagnacaccaagggcacagaacctgcggctgatg

SEQ ID NO: 29135 - DNA, 101 bp, rice(Oryza sativa)
  misc_feature (71): n=a or g
atgttgttgatgataatagattttttttttggcggatggatggaatagccaaagaggatatcataacgggngatttattgtattgttccttccatgcaaaa

SEQ ID NO: 29136 - DNA, 101 bp, rice(Oryza sativa)
  misc_feature (71): n=t or c
aattcaggaattgaggatgatgagtaatggccacagcaacagcagcaagagccttgaaaggtttatatctnggagggctctgcagatggggagctctgctc

SEQ ID NO: 29137 - DNA, 101 bp, rice(Oryza sativa)
  misc_feature (71): n=t or c
gactccgagtccactatatggttggtctgatcggtgacatgtagccagtcaaactaccaaagtctaactcngagtccgatttatcagttctcgagtcttat

SEQ ID NO: 29138 - DNA, 101 bp, rice(Oryza sativa)
  misc_feature (71): n=a or g
ctcccacatggctcattggggaccagcttgtcttagtaccgagtgaggttgtggccatctattgtcgtccntcattcgagtggggtgtttcccttggaggt

SEQ ID NO: 29139 - DNA, 101 bp, rice(Oryza sativa)
  misc_feature (71): n=a or g
tgcgtcgagggcaccacatggtgcaacaaaagagaagcatagcagtgcggtagagtagacaacatgatatngaggagacgacgatacatgcaagcacagct

SEQ ID NO: 29140 - DNA, 101 bp, rice(Oryza sativa)
  misc_feature (71): n=a or g
cttctatgtgaataggattttcttgccaggaataactatccaatgaaacagttagttcagaggaactctgntggtgactcgtcaccaacaaagtctgggga

SEQ ID NO: 29141 - DNA, 101 bp, rice(Oryza sativa)
  misc_feature (71): n=t or c
cggttccctccttagaatactagcactagacaagagcgcgcattattctaggtaaagtgtacagcatttgnaaatatgcaattaagaaaattctgccattt

SEQ ID NO: 29142 - DNA, 101 bp, rice(Oryza sativa)
  misc_feature (71): n=t or c
tgccagccatcacatttaaaaggaactgtcctttatttaagagctcctctgtctgtgtttatgcatctacnatgttatttttttttaaaaaaaaaactgtt

SEQ ID NO: 29143 - DNA, 101 bp, rice(Oryza sativa)
  misc_feature (71): n=a or g
attgggtcaatattgggtctataagtcaaggcattaatcacaggttatgttgtacatctagcgaacaaatntttatttggttcgattgaagatttcagtat

SEQ ID NO: 29144 - DNA, 101 bp, rice(Oryza sativa)
  misc_feature (71): n=a or g
caatccccgacaaggataaataggttgtgtcactactacatggaggcaaatagagatcagcactgtagatnccgaaagtggtatagccggcaactatagtg

SEQ ID NO: 29145 - DNA, 101 bp, rice(Oryza sativa)
  misc_feature (71): n=a or g
attttgttctgttgcagtctcaagaggttggagtctcagaccacttgatgttcacaatgcctttcttcatngagtcttagaagaagaggtctacatgaaac

SEQ ID NO: 29146 - DNA, 101 bp, rice(Oryza sativa)
  misc_feature (71): n=t or g
actcagaagttaagttgtaatcgctatcatccaatcaataggtaatagagacagaatccctactccagttntcatcactgtatcagaaacgaacgtgcagc

SEQ ID NO: 29147 - DNA, 101 bp, rice(Oryza sativa)
  misc_feature (71): n=a or g
ctgtctgttagtggtgacctgcactctgccaacgaaactactatcccgaatttagagccacctgaaatacntgctgaacaagagaaagataatgcaaccat

SEQ ID NO: 29148 - DNA, 101 bp, rice(Oryza sativa)
  misc_feature (71): n=a or c
agatggtttctccaccagtgtagtgccaatttgtcctattgttgtcacggtttccaaacccacgatcgagntagaaaatacatgccaaatgagtttatttg

SEQ ID NO: 29149 - DNA, 101 bp, rice(Oryza sativa)
  misc_feature (71): n=a or g
atcgctagcttctctttcaattctcacacactttatcattactttgcagatacaggtgttgcttccaaacngtacatgcgatgtagggtatttacaacatt

SEQ ID NO: 29150 - DNA, 101 bp, rice(Oryza sativa)
  misc_feature (71): n=t or c
aagcatgatcctttgtattattgcttttcctggaagtcgttccactatgtatgttggaccgcctatgcatnactcgggtgattttttaaaaaaaatcaacc

SEQ ID NO: 29151 - DNA, 101 bp, rice(Oryza sativa)
  misc_feature (71): n=t or c
attaagcagggtgtcttcatttgtcgggcgagaccgactgcttgggactatgtttgggaagcttaagattncgggaagtagttggttaatagccagcttct

SEQ ID NO: 29152 - DNA, 101 bp, rice(Oryza sativa)
  misc_feature (71): n=a or g
attttggctttaacttttttaagttaatcgataggggtctgaatagtgaacctagctagttggctgaaacntactacctccgtcccataaaaaaccaattt

SEQ ID NO: 29153 - DNA, 101 bp, rice(Oryza sativa)
  misc_feature (71): n=t or c
aaaaaaaactacattgaaaacatcaaaatcaactttaaaaccagggaaaaccatgaggccctaaggcattngatcgagcagaggaattttgtgaaaattca

SEQ ID NO: 29154 - DNA, 101 bp, rice(Oryza sativa)
  misc_feature (71): n=a or g
ttgaatatattacaatataaaactaaaatcggtagaattgcctctgtatacctattgtgcattgcgtgccnagattccataaatccgtatatacttaatta

SEQ ID NO: 29155 - DNA, 101 bp, rice(Oryza sativa)
  misc_feature (71): n=t or c
gtttgtggataggtggtatttgtattaaggaacctacagtggtatttatcacaatcggtcgttaaacgtgncgtaggctctccggaccttccattataatt

SEQ ID NO: 29156 - DNA, 101 bp, rice(Oryza sativa)
  misc_feature (71): n=t or c
tagagatagagagatcagtttcagtatgggcatgtttgtgctccttaattgcttgctctatgtgagtcttngccagtatcagtcctggtagttgtagcatc

SEQ ID NO: 29157 - DNA, 101 bp, rice(Oryza sativa)
  misc_feature (71): n=a or g
ggaacacacatgctcgtcgtctccccatgcatgtcgctgctctgctaggagtagataatctaattagatanacgtactactatttttttttgttgggagta

SEQ ID NO: 29158 - DNA, 101 bp, rice(Oryza sativa)
  misc_feature (71): n=a or c
accatgttctttgttctaatgcgtggcccgtgtgttttatgatcagtgtggattcgagcaagtcaaatgangaactgcagagcaagggtcaggtgttcgtt

SEQ ID NO: 29159 - DNA, 101 bp, rice(Oryza sativa)
  misc_feature (71): n=a or g
ggtttcagttgtaggagtttgttatggtcttcgagatggagcagcaacatgtatcaaataagatggaaacntattatatgtacacgagctttccgtacaat

SEQ ID NO: 29160 - DNA, 101 bp, rice(Oryza sativa)
  misc_feature (71): n=t or c
atcattatgtgtagaagatgcaagggaattggacacaacaagacaacttgtgcaaagagaaatacaggcantactcaggcttcgtcaagtgcacaatctag

SEQ ID NO: 29161 - DNA, 101 bp, rice(Oryza sativa)
  misc_feature (71): n=t or c
tgagtgagtgatccgacaccaacaaattgaagccgtacctagttagccacggccatcaagcgaactgatcngatcgagctgagagagcagcacagccactg

SEQ ID NO: 29162 - DNA, 101 bp, rice(Oryza sativa)
  misc_feature (71): n=a or g
tcttcctgaaccaacgtgttgagtctttagggtaccgtgtgaaagtgctccggtctacatagacgattccnaattttgaagtgaacccgagccgccactcg

SEQ ID NO: 29163 - DNA, 101 bp, rice(Oryza sativa)
  misc_feature (71): n=a or g
gtgggtctgcatctcacgcaaacttgatgtccatcgtcatacacgggagattatcgagtccgcagaaaatngacagtgcccacgtgtggacaatcttgaca

SEQ ID NO: 29164 - DNA, 101 bp, rice(Oryza sativa)
  misc_feature (71): n=a or g
gggacactacagtccccaatatttcgtgaccatgggaaatttctcaagtatctggccataagctggtgccntcttcaggaagattctctactcctcctagc

SEQ ID NO: 29165 - DNA, 101 bp, rice(Oryza sativa)
  misc_feature (71): n=a or c
ctccatgacacaagattaggccctataaaaacagcaaaacctccggtggatcgccgatcatccaaacatcntgcccaatctgcatcagagaaagcactaac

SEQ ID NO: 29166 - DNA, 101 bp, rice(Oryza sativa)
  misc_feature (71): n=a or g
tttacaaataaaacctgaccttgaggaattttcataccctggaggttgcctcatatacacttccccttctngtactccatgcaagaaggcattctgaacat

SEQ ID NO: 29167 - DNA, 101 bp, rice(Oryza sativa)
  misc_feature (71): n=a or g
tgatgtcgcatcagttctaatgagtgtatcactaactacgtcttatgtagaatataatgcgcctcctccanttgagcttacgcctcctgctcccactcatg

SEQ ID NO: 29168 - DNA, 101 bp, rice(Oryza sativa)
  misc_feature (71): n=t or c
aatgaaagcaatagaggaaagtacactaaggtgaaattaaaaaaaaggatactccttttgcccagcaccangaaaagctggatccaaatccttcatagaaa

SEQ ID NO: 29169 - DNA, 101 bp, rice(Oryza sativa)
  misc_feature (71): n=t or c
ctccttctcattgatgcaaaaccgaatgtttccggctcctacatcaacgctggcttcagcatttccttgtntgattccatgtcaagcaccacaaaatccac

SEQ ID NO: 29170 - DNA, 101 bp, rice(Oryza sativa)
  misc_feature (71): n=t or c
aatttttttggaaattagcaacgaaaacagagcccgcaaaaatattgcctaaatcaagagttctaaattgnagatacactttttagagatattttaaaagt

SEQ ID NO: 29171 - DNA, 101 bp, rice(Oryza sativa)
  misc_feature (71): n=a or c
aaatgcctgtacgtttcaacggtaaagtcatgtggtctagcttctatagtgtgaattgacccttgatttcnataacagcagggctaatgcctttcatcaaa

SEQ ID NO: 29172 - DNA, 101 bp, rice(Oryza sativa)
  misc_feature (71): n=t or c
aaagatcgatctagcttggcgagcgtgaggtggtgaggtacgtttacgtacgtacgtatactcagcatggncgggtacaccgaaattttggacaccaacca

SEQ ID NO: 29173 - DNA, 101 bp, rice(Oryza sativa)
  misc_feature (71): n=a or g
gagggattaacctcaatagtagagctgtagaggactggttattagccattcacatgcggaaatgctcttcngctggagatggggcagcgatcgatcccccc

SEQ ID NO: 29174 - DNA, 101 bp, rice(Oryza sativa)
  misc_feature (71): n=a or c
tcatggtgcaggccatctcttcctcaaccatctccatcatctcagcaagacaagttgatttgcagccattnaagtgctccatcgttgaaggttggctgctc

SEQ ID NO: 29175 - DNA, 101 bp, rice(Oryza sativa)
  misc_feature (71): n=a or g
gtttaagtgactcattgaggtctaaaggacctccgaccgggttgtttggcttacatggcttacgcggagcnctacctcctcctccgctccgtcgacggccg

SEQ ID NO: 29176 - DNA, 101 bp, rice(Oryza sativa)
  misc_feature (71): n=a or g
gggtcatccaaagagactaacaatgagagtgatagttcttcacaagacgcatcacctgttaagccactcantgactgtagcagtgagaatgataaagatga

SEQ ID NO: 29177 - DNA, 101 bp, rice(Oryza sativa)
  misc_feature (71): n=t or c
ctttttgagtgtttgctacacttgagccctctaatccgctcgttaccatgccaacaacatctaagcttgantgccgccttctggtaaccgagaaggctgat

SEQ ID NO: 29178 - DNA, 101 bp, rice(Oryza sativa)
  misc_feature (71): n=a or g
agggtgggagagcagagggagataggaggtgaggcaagacaatgttcgagctcatcattgtcctcgagggnaatgtggtgcttggctcagtgacgatggag

SEQ ID NO: 29179 - DNA, 101 bp, rice(Oryza sativa)
  misc_feature (71): n=a or g
ttcatcatgctccatgattgttctccgaactgattccctgctgtcttgtttggatttctccattggctctnccaagatgtggtgtaaatccttttgccaat

SEQ ID NO: 29180 - DNA, 101 bp, rice(Oryza sativa)
  misc_feature (71): n=a or g
gcccagtgtcgccattgctatgccttgcgagcattcctctaccacgcgttggtcacgtagatctagcctcnaagctactggatctagcatcaccagcgcta

SEQ ID NO: 29181 - DNA, 101 bp, rice(Oryza sativa)
  misc_feature (71): n=t or c
cactcattccatgcattccagcaaacatatttttcaggatgcatatgagtgaggagaagagggataacaangcatcttgaaaagaaatgagtaaaagcact

SEQ ID NO: 29182 - DNA, 101 bp, rice(Oryza sativa)
  misc_feature (71): n=t or c
tgtgtgactattatgggagtggtctgctagaccactgcggtttgttgcagacccacctggattctggagancaccctatatcagtgttatgaaagtaagtg

SEQ ID NO: 29183 - DNA, 101 bp, rice(Oryza sativa)
  misc_feature (71): n=a or g
gcaggaattaatgaagatgaaggccgctcttttgatgatactagtggtggccgtttctttcaatttgtgcncttgcaatattccagggaacatggaagaag

SEQ ID NO: 29184 - DNA, 101 bp, rice(Oryza sativa)
  misc_feature (71): n=a or c
tcttaccaaacaaatggtgttggcgctttaaagcaatcacctcatatgcaattccaacaatcgtacaactntggagttaggttcctaaagagggataccct

SEQ ID NO: 29185 - DNA, 101 bp, rice(Oryza sativa)
  misc_feature (71): n=a or g
cttttgttcttgttttgatattcttactccactatatagcactttgaacatgaacatattcttcagattantttatattaattgtccagtacaaagacaca

SEQ ID NO: 29186 - DNA, 101 bp, rice(Oryza sativa)
  misc_feature (71): n=t or c
gttgatgatcttggtttccaaaggatgaacatatagaggcatttctgtattcataggtccttttcacgacntctctgtaaatgagttcaacttcgacacac

SEQ ID NO: 29187 - DNA, 101 bp, rice(Oryza sativa)
  misc_feature (71): n=t or c
gaacatcatgcactcccgataagctcattgatcagcatgttcatgttcatgttcatcgggactaatcgtgntttcgatgtttatcccaatttcacccctca

SEQ ID NO: 29188 - DNA, 101 bp, rice(Oryza sativa)
  misc_feature (71): n=t or c
gctgtttcctgcgctgatattctcggggtcgtctcttttccaaaggaatgctctacaaaaacgatcaatgngtttaataaccaacttaggtgtttgggttc

SEQ ID NO: 29189 - DNA, 101 bp, rice(Oryza sativa)
  misc_feature (71): n=t or c
agaaaatcaacagttaaattaaccggctataataggctagtaaaacaatagctagttaatctagtagtaantaatcatctaattaacaatgctatcaataa

SEQ ID NO: 29190 - DNA, 101 bp, rice(Oryza sativa)
  misc_feature (71): n=a or g
gctcaagattatgtataaaaaatgcaatgcatctgctgctctgcatcccacttgattgggggaggagctgnccggagatcttgacggaggtggggttcgac

SEQ ID NO: 29191 - DNA, 101 bp, rice(Oryza sativa)
  misc_feature (71): n=a or g
tttttctgacagaaatagaattgtgttatgtggaaatacgaactctacgtttttggcgtacgattcacacnataagatatatattttacagtccataaaaa

SEQ ID NO: 29192 - DNA, 101 bp, rice(Oryza sativa)
  misc_feature (71): n=t or g
gcttagctttgacctgtcatgtgttacctgtatcccgttaattactattacctccatcacatattacttgncactttaagtttttttaaaaaaaatttaat

SEQ ID NO: 29193 - DNA, 101 bp, rice(Oryza sativa)
  misc_feature (71): n=t or c
tttttttttgaaagcaaggtccattttgttagtggcacaatgagggaatgccgaggattatgaacagaatnccacgagaatggaagatatttatgactagt

SEQ ID NO: 29194 - DNA, 101 bp, rice(Oryza sativa)
  misc_feature (71): n=a or c
tgaccacatgcactgatttgatggacggaagatgataggaccaagtaaagcactctccaaaggaccaacantggcctcagtgattgctgcatcacttaatg

SEQ ID NO: 29195 - DNA, 101 bp, rice(Oryza sativa)
  misc_feature (71): n=a or c
ggtttatctaactttgcttagtttgtttttacttgttagcatgctgttggctctagattatatcatatatntatatattgatgcttccataatacttttct

SEQ ID NO: 29196 - DNA, 101 bp, rice(Oryza sativa)
  misc_feature (71): n=a or g
cattgatgaaagctcattagggattagacataaaacagatctccagcacaagtgatgttctggcaaattcntgcatacttgagcacatagagatagaggtc

SEQ ID NO: 29197 - DNA, 101 bp, rice(Oryza sativa)
  misc_feature (71): n=t or c
tgatagcatcgtaactttttatcttgggaagactggcctccaaggattatcgtcgacccatgtaagagtgncttttttcaaggtagtttttagcttacaaa

SEQ ID NO: 29198 - DNA, 101 bp, rice(Oryza sativa)
  misc_feature (71): n=t or c
ggccacgcacagcgtcgacgccgagctgtatcatgcgtacgacgtcgtcttggtggcgttcctcctgtggntgctcggcgtggcgctcgcgacgctgtcgc

SEQ ID NO: 29199 - DNA, 101 bp, rice(Oryza sativa)
  misc_feature (71): n=t or c
ccagttagccacgacccatatattgtgtcttcctaaaggagttctcatccgacctgtggtatcgcagaaanctcatctccaccttccatcgccatagccag

SEQ ID NO: 29200 - DNA, 101 bp, rice(Oryza sativa)
  misc_feature (71): n=a or g
ataacgtgactagcgacaagtgaatctggcaatctgaacttaatgcattgttagagtgcctaggccatgcnggcaccgataacgagttagcgtgcatgatg

SEQ ID NO: 29201 - DNA, 101 bp, rice(Oryza sativa)
  misc_feature (71): n=t or g
acatcagtgtgattataagcttttctgtgactttggtggaacaggccgatggctacaaaggacaagtacgnaagtaatcctcgcagcatcgaaccgcaaaa

SEQ ID NO: 29202 - DNA, 101 bp, rice(Oryza sativa)
  misc_feature (71): n=t or c
acctcattgatgaagtcctctgcatcatccttcgtgtcctccagcatcttcactgctatctcactgccatnagacaagctgcctttataaactgtaccata

SEQ ID NO: 29203 - DNA, 101 bp, rice(Oryza sativa)
  misc_feature (71): n=t or c
ctgtgcattccataattccatttcctttctcggtgcagcacgcacaaaaccatcatcgatcaatgtctcangtttaaacagattgtccgtcttttcttatc

SEQ ID NO: 29204 - DNA, 101 bp, rice(Oryza sativa)
  misc_feature (71): n=a or g
ttataagctaataggtccaaaataggcctttattcttttgagtccaaaataggagagattcttaggccctntttagttacaggggtgaaaggttttggcgt

SEQ ID NO: 29205 - DNA, 101 bp, rice(Oryza sativa)
  misc_feature (71): n=t or c
tataatttgatagaggaactaagtgattgactaggaattagtgtttcttaagggcgtggtacaactaggantgctgcaacagcacttttgcagtacagaac

SEQ ID NO: 29206 - DNA, 101 bp, rice(Oryza sativa)
  misc_feature (71): n=a or g
catttggtaattctccccccaccataaactacaagcacttaaattaaaacttaccacctctatggacaatnctagaaagtcttatatatgaatgtggacaa

SEQ ID NO: 29207 - DNA, 101 bp, rice(Oryza sativa)
  misc_feature (71): n=t or c
agtaaagttacctttgcattctttgaacgagtttcctccttttccttgtctaattccacagtgccaccgcngtcaacctgtgtgtaaggatatggttaatt

SEQ ID NO: 29208 - DNA, 101 bp, rice(Oryza sativa)
  misc_feature (71): n=a or c
ttgtgattcgaggagcactaattcgcctcgtgaatattctacgggctggatccacttatactacaacactnctgttcctacaccctgatgtctatggcgtt

SEQ ID NO: 29209 - DNA, 101 bp, rice(Oryza sativa)
  misc_feature (71): n=a or g
tgtgttgagagcgctgatgtaatgatgctaggtgtgtcaggtgatgtaattttcgaatggaattagcgcanctgccggcgatggacacggatgcagttatg

SEQ ID NO: 29210 - DNA, 101 bp, rice(Oryza sativa)
  misc_feature (71): n=a or g
ctaggctggtgtcttctgattcctgttttgatggtagagagcattatatcaatgtttcaaagaacaaaaanaatgcaatctacaatatttattcacatagt

SEQ ID NO: 29211 - DNA, 101 bp, rice(Oryza sativa)
  misc_feature (71): n=a or c
taacagtgcattcgacggctattactgccctcaaattatgatacacccttgcttcaaaaataaatcagtgntagttaaactagtagtgggaaagagtaaca

SEQ ID NO: 29212 - DNA, 101 bp, rice(Oryza sativa)
  misc_feature (71): n=t or c
aaaaacattttcggcttgtgcacaatgtgcagacaccttagttgctcatacacacgtcatccaaatgatanggttttggtaaaaactttcgatatatatca

SEQ ID NO: 29213 - DNA, 101 bp, rice(Oryza sativa)
  misc_feature (71): n=t or c
ggaattcaggtatctaatgcaacaagagccaagggagcaaccttacctgtcatagccaccaccaccggctnggcgtccatagcctctctcaggcatccggt

SEQ ID NO: 29214 - DNA, 101 bp, rice(Oryza sativa)
  misc_feature (71): n=t or c
gtgactaaaactaattgaaactgtgacaaacaacagtaacgtgataaattcgtgtggacaaattcgtactncctccgtttcaggttataagatgttttgac

SEQ ID NO: 29215 - DNA, 101 bp, rice(Oryza sativa)
  misc_feature (71): n=t or g
gccaaaagagtcaatattgagcgcacagcagtaccagctactttttacatagaagaaaataaagagcgacnacaagtaatcaataaccaaccaggccctta

SEQ ID NO: 29216 - DNA, 101 bp, rice(Oryza sativa)
  misc_feature (71): n=a or g
tcctatttatatgtactataagtgaattcacgagccgactctcttacatccttcttacttaggtttgagtngattacttatttttcatccactcgaacctt

SEQ ID NO: 29217 - DNA, 101 bp, rice(Oryza sativa)
  misc_feature (71): n=t or c
tacaattagtatatatactagtactccgtattaattaagaactaacttgtgcatccgtcgttgccggtaanatagggattgccggcgtatccctcggagca

SEQ ID NO: 29218 - DNA, 101 bp, rice(Oryza sativa)
  misc_feature (71): n=a or g
atctccgccgccgccgcctcgcacctcctagggttggagctcgttttgttcaatttcttcttccggtcaanacgctactggattccccccttcttcttctt

SEQ ID NO: 29219 - DNA, 101 bp, rice(Oryza sativa)
  misc_feature (71): n=t or g
gtttgagaagaggatgagtgctaggggttatctccttgacagcacagcatttggcattgtcatgtcttgtnctctgaaatgcctggaggtgagtgatctat

SEQ ID NO: 29220 - DNA, 101 bp, rice(Oryza sativa)
  misc_feature (71): n=a or g
tgaattgtgcatcaagatcagcttgtgcttgaatgatttcaatcaattcctggaacgactctcgaggagcngaatccccaaatatactgagactccgcagg

SEQ ID NO: 29221 - DNA, 101 bp, rice(Oryza sativa)
  misc_feature (71): n=a or g
gatccacatactctacttgattctgcaacaacaacaatcctcatcgatagctcacgcttacagggttcatnaaagtccttaagctcgcaggataaagccat

SEQ ID NO: 29222 - DNA, 101 bp, rice(Oryza sativa)
  misc_feature (71): n=t or c
tttgggaaaatgtggattattacaaatacctgaaggggaggtgggccatccagccatttgcaaaaataggnttttggccatttgcaaaatcatttatgtag

SEQ ID NO: 29223 - DNA, 101 bp, rice(Oryza sativa)
  misc_feature (71): n=t or c
tcacttgaaaaaatggctggagccagaaaagcttgcccagagtcaaaaatcttggaaagctggagatgagncaaaaatagctgcaggtctgtcataatttt

SEQ ID NO: 29224 - DNA, 101 bp, rice(Oryza sativa)
  misc_feature (71): n=t or c
gtgacatgttgttctcgtcatcttcccctcacctcgtcatcccgattctcaccttcctttttgtccacctngccaccgccatcattagagtccgtgggcgg

SEQ ID NO: 29225 - DNA, 101 bp, rice(Oryza sativa)
  misc_feature (71): n=t or c
atgatgttgtctgggtcaatatcatttgctttgatatcaaccatgatgaaaaccttgtcgaagtcggtccnaccaggcgtgccaaaagcgtgttgatgcaa

SEQ ID NO: 29226 - DNA, 101 bp, rice(Oryza sativa)
  misc_feature (71): n=a or g
gcggttagaacacggaatcagatcaaacgagaaaagcaattaaggctaagttctttagttgagttttccanctcacattgattttgattaggatctactcc

SEQ ID NO: 29227 - DNA, 101 bp, rice(Oryza sativa)
  misc_feature (71): n=t or g
acaaaagatggattccttttatctcttcagcatatcccacatggcaaaaataaagcagcagatagtactgnccctccagtttttcttcaacatggtctttt

SEQ ID NO: 29228 - DNA, 101 bp, rice(Oryza sativa)
  misc_feature (71): n=t or c
gtgcctcaggcttctgatgaggaattccagtatcatcatcttcgcaggaagtgtcgggtacaaatctgaanggaatacttcgctcctgcaagaacatggtg

SEQ ID NO: 29229 - DNA, 101 bp, rice(Oryza sativa)
  misc_feature (71): n=t or c
tccttgttgcagctgcagctgttgcagggatagctgtactccattgcttgtaagttgttttaacttgctcntctcctctcctctgagctgctgctgttgct

SEQ ID NO: 29230 - DNA, 101 bp, rice(Oryza sativa)
  misc_feature (71): n=a or g
ggtagttttggctcctcagaaattggtgacgtattgtgaatgccctcagcctacaggcgccggcgtctgcncatcccgccgcaaataccgccatgccggat

SEQ ID NO: 29231 - DNA, 101 bp, rice(Oryza sativa)
  misc_feature (71): n=a or c
gacagcaatcttctgcaggactgtgacaaagattgtggtactaaccacaatgataatgcacatgaagatgntgcttctagcaggctgatcactgaccttct

SEQ ID NO: 29232 - DNA, 101 bp, rice(Oryza sativa)
  misc_feature (71): n=t or c
ctatcttctggattagattcctcagaaacagaaatgttgctttcctggggaattgattcagttttagtgcnttcggtttcctttatttcttctgctgactc

SEQ ID NO: 29233 - DNA, 101 bp, rice(Oryza sativa)
  misc_feature (71): n=t or c
gtcttataatatgaaaaaggggaagtatgtcgcaaacaccacatagcatcaatatatgtcgcagagttaangttgcaggtgcggtacgcctcaccaaaaca

SEQ ID NO: 29234 - DNA, 101 bp, rice(Oryza sativa)
  misc_feature (71): n=t or c
agcttctagactcgggggcaagaagttccccgtgaggctctggtcaccctactgctcaggtgctactagtnagaccggtcaccctacccgatcaggccggt

SEQ ID NO: 29235 - DNA, 101 bp, rice(Oryza sativa)
  misc_feature (71): n=a or g
tttagatatttatgcaaataaataaacatactaggcataaccaaagcatttttttttctgatagtatcacnagatactctattcgctattttttctaaaac

SEQ ID NO: 29236 - DNA, 101 bp, rice(Oryza sativa)
  misc_feature (71): n=t or c
agtttttagttgcacgctgcagatcaatatatcgaaatgcagtaataccaatgctgccttgatcattttcngctccgcgagcaaacagtttcccttttctc

SEQ ID NO: 29237 - DNA, 101 bp, rice(Oryza sativa)
  misc_feature (71): n=t or c
gtgtgtgtatgaacttcattagccactagcccaatacttgcaggtgagtcaagtcttccttggtctttctntctctctctgttttttttttttggctgctt

SEQ ID NO: 29238 - DNA, 101 bp, rice(Oryza sativa)
  misc_feature (71): n=a or g
attcacagtgagaagtaacttaatgcatcataagaaaatatagtgcattggaaaaagcgaaacactgcttnagggcaaaaaatgcataaaaaaaggtggat

SEQ ID NO: 29239 - DNA, 101 bp, rice(Oryza sativa)
  misc_feature (71): n=a or g
aagtttcagcaaagtgactcttctagctacatgaatcacaatagattgctttattctagggggccctttgncctgcgacgacaccaaataggtgaacagtg

SEQ ID NO: 29240 - DNA, 101 bp, rice(Oryza sativa)
  misc_feature (71): n=a or c
acgacgaagggctacacttgttaagttagatcgctacttttgcaacgagacttgggacttggccttccccnaccatgtccttcacgccctacccacagggc

SEQ ID NO: 29241 - DNA, 101 bp, rice(Oryza sativa)
  misc_feature (71): n=a or c
gctcgttaaatctgtgcttacgtcgcagccgatttacctcctaactgctctaaaaattacgaaggaatctntggagcagatagacaaacagcgaagacgct

SEQ ID NO: 29242 - DNA, 101 bp, rice(Oryza sativa)
  misc_feature (71): n=t or c
tgacttgtgcaggtcaattggtctcaattctttggagttacaattttggctgttacttttgtcggagtcgngaacgctgagtgtcgaaacatgatttcggc

SEQ ID NO: 29243 - DNA, 101 bp, rice(Oryza sativa)
  misc_feature (71): n=a or g
taatttcaatatgtctaatggtccatcggagaacctggctggaaaaatgaatgatcaagcacaatctgtcnagctcacagtagataatacttctttggcaa

SEQ ID NO: 29244 - DNA, 101 bp, rice(Oryza sativa)
  misc_feature (71): n=t or c
atgggcaatgtcatcatacataaacaccacaatgttctcctccttcactcctcccttctgcagaatctggnacgcatggcacacatcggcctgcaatgcac

SEQ ID NO: 29245 - DNA, 101 bp, rice(Oryza sativa)
  misc_feature (71): n=a or g
ctaatgcccaacatgtctgtcagcacctgttgaatgtactgcaggccaaacaacttgtagagggcggagtntatcacccaacaagggcctgggagcaactg

SEQ ID NO: 29246 - DNA, 101 bp, rice(Oryza sativa)
  misc_feature (71): n=a or g
tgacgaagacatgaagcgcacaatagccaaggcctggtctgatgcaaggtctgggaagaccgccgattcantgaggggattaccttgagtttgcccgaagc

SEQ ID NO: 29247 - DNA, 101 bp, rice(Oryza sativa)
  misc_feature (71): n=a or g
tgcgtggttggttggcagtattgttgagactgcaacatcgacagagcgatctatcataagctcagcttagnctgtgttcgtttggacgttttcccagcgcg

SEQ ID NO: 29248 - DNA, 101 bp, rice(Oryza sativa)
  misc_feature (71): n=t or g
ttataagtatatctggagcccatccaagtcaagatcagcaaggatataaactttgactggcaagcaataantaagtttaaaaactgcacctcttgttgcca

SEQ ID NO: 29249 - DNA, 101 bp, rice(Oryza sativa)
  misc_feature (71): n=t or g
tgggtttgggggctagagaattagagttttcagtgggaggtagaatggatgatgggattaggctgatgcantctcttcatggatgcctttggctgttgctt

SEQ ID NO: 29250 - DNA, 101 bp, rice(Oryza sativa)
  misc_feature (71): n=t or c
aactgcctaagctcagggcttttatgacgtgtacagtgtgaagctaagtgcacttgaggcgaaggaaagantgtctgttcaacgtgcaatacagcaatact

SEQ ID NO: 29251 - DNA, 101 bp, rice(Oryza sativa)
  misc_feature (71): n=a or g
cgtcttcttcttccatctttcttgctagctagatgcttctcttgtcgatctctagctaatatatatatacnattaagcttgtgtttaattgatttggtttg

SEQ ID NO: 29252 - DNA, 101 bp, rice(Oryza sativa)
  misc_feature (71): n=t or c
gatcctgtcatggatgagttctatcgcagttgtgaatttccctctgctcctgatagtgaacctgagactgnttcttctgcaaagcccttttgctcaacacc

SEQ ID NO: 29253 - DNA, 101 bp, rice(Oryza sativa)
  misc_feature (71): n=t or c
ttgagggacgcattatatctagtattgtaatttcatggcatgacttaatctggatgacaagttgagggacncaaaatgaacttattcttccacatatgaca

SEQ ID NO: 29254 - DNA, 101 bp, rice(Oryza sativa)
  misc_feature (71): n=a or c
ggctccacacaatccttggtggatttccttcaccacttcttcgcctccggctattgatatgcaccgaagcnaatgttcactgctaaaaaaaggagacaaca

SEQ ID NO: 29255 - DNA, 101 bp, rice(Oryza sativa)
  misc_feature (71): n=t or c
tgtggcatatatgccacatcaatgccatataggattctagaggggttgtatcgatctgggaccttaatggnacactttgacaagttctgggacctatataa

SEQ ID NO: 29256 - DNA, 101 bp, rice(Oryza sativa)
  misc_feature (71): n=a or c
aaagatgagggttcgctcttatactccccttccaaattcctcctaaaaccccccatgtcgattcaaccaancaatagatttaaaagttgccacccttcaaa

SEQ ID NO: 29257 - DNA, 101 bp, rice(Oryza sativa)
  misc_feature (71): n=a or g
attaccttaaactcataatgtccattatgagttttaaaagcagttttcggctcttctccagctgccattcnaatttgatgataaccggagcgtaagtccaa

SEQ ID NO: 29258 - DNA, 101 bp, rice(Oryza sativa)
  misc_feature (71): n=t or g
tcaggttgatatatttgctcagcttcagaatgcaagtgaagcatttagaacctatatcagagatgggctanctcaggtttgctatttcaatcctggaggtg

SEQ ID NO: 29259 - DNA, 101 bp, rice(Oryza sativa)
  misc_feature (71): n=t or c
agaacttggagatttagaacaggatatggaccaagaatactttatcttctccgactaagactcttaacacnttctatttcgggaagataattttcttcttt

SEQ ID NO: 29260 - DNA, 101 bp, rice(Oryza sativa)
  misc_feature (71): n=a or g
agggtctggtgttctccagccttctccacctgcatcccttatcaatgatgcaactttagggacaaatcccncatctggtggtgcacttgcttcaaattctt

SEQ ID NO: 29261 - DNA, 101 bp, rice(Oryza sativa)
  misc_feature (71): n=a or g
cttatccaaaatatcaaatattatataacaggaggagggagtagcagccgtcggttaatttactaccaacngcccaacttgtcgagagtcgacagtccaac

SEQ ID NO: 29262 - DNA, 101 bp, rice(Oryza sativa)
  misc_feature (71): n=a or g
tgacacatcttcgccgcaataatcttcctcctcttctcctgttgttactggcgttgtcttctcacaggccnccccaccgcctccctgcacaagctccgaga

SEQ ID NO: 29263 - DNA, 101 bp, rice(Oryza sativa)
  misc_feature (71): n=t or c
gaattaaccggccaaaaaagcacggaagaaatggcgatcttttctactcctccgtctgcaattctgcaaancctccatgaggtaattaattgcagattacg

SEQ ID NO: 29264 - DNA, 101 bp, rice(Oryza sativa)
  misc_feature (71): n=a or g
gcaggacttttgaggctgtcttcgttgatttgggtttggaacccatatcctgctcactggaaatggagcgntccattagcgcgggattaattaagcgatag

SEQ ID NO: 29265 - DNA, 101 bp, rice(Oryza sativa)
  misc_feature (71): n=a or g
atcctggccttcactactatcatcatggtaatctacagctgcatcatcagcctcctctgtgcgatcctctnctccgatgatgcttgcgatggggaggtgat

SEQ ID NO: 29266 - DNA, 101 bp, rice(Oryza sativa)
  misc_feature (71): n=t or c
agatgatgatctcacgtgtgttttgtgcaatgcgaattgtagagagacaaggctacacctcttcttcttangtcctttcagcatcaggtgttggcaatacc

SEQ ID NO: 29267 - DNA, 101 bp, rice(Oryza sativa)
  misc_feature (71): n=a or g
agtcatgggaatacatccaacttttctgtatcactagctactactgacctcagaagtagtttcaatcctcngacttctgtttctcatctagcgtatcaaac

SEQ ID NO: 29268 - DNA, 101 bp, rice(Oryza sativa)
  misc_feature (71): n=t or c
aagtctaaggacagaaaccaagcagtcttgaacaatacttcgtgttatgcttgcatctgttatatctttantttttgcttcttcatgtagccagattgttc

SEQ ID NO: 29269 - DNA, 101 bp, rice(Oryza sativa)
  misc_feature (71): n=t or c
ttgtgctgcgctgcggcgagcgatgtgcactacatctctctccaccttgggctcagaattggcaagaaccnggagggcgagagcagccctgacggcgactg

SEQ ID NO: 29270 - DNA, 101 bp, rice(Oryza sativa)
  misc_feature (71): n=a or g
gaaaagctaaaatttagtatcaaattgaattaggactatgaagcattgcattataggaggaactgtatccngtggagaattgcaacaataaaaagttattt

SEQ ID NO: 29271 - DNA, 101 bp, rice(Oryza sativa)
  misc_feature (71): n=t or c
caaatgactccactttctcatctggtgctatattgatgttagtccatttagctcccacactgcgaggtcgntccatgcatgacttcttgtcatgagtcatg

SEQ ID NO: 29272 - DNA, 101 bp, rice(Oryza sativa)
  misc_feature (71): n=t or c
taaggggtcctagatgcactttcacaaagccaaaccccaacaatgggcaccgcgctcatctctattcacgnccttgtggttggaggggagagggtgagaga

SEQ ID NO: 29273 - DNA, 101 bp, rice(Oryza sativa)
  misc_feature (71): n=a or g
catcagctcatagcgatagccttggctgcagagtgtgcaaacaccatcctttgtgtggtcctttgttttantaaaccctggagaaacatccatatagtgca

SEQ ID NO: 29274 - DNA, 101 bp, rice(Oryza sativa)
  misc_feature (71): n=a or g
atcttcaggagagacagctgtgttaattctgccaacagaagattttctcctcatatcaaagcactcaaccncaccatcctcaccaccacaagcaatgagcc

SEQ ID NO: 29275 - DNA, 101 bp, rice(Oryza sativa)
  misc_feature (71): n=a or c
aagattcaagaagtagcaaagtgtgcattctgaagggcagtcgtgatgatatattgatatgaagtgtcctncgatgcttttagtgagaattggatcttcag

SEQ ID NO: 29276 - DNA, 101 bp, rice(Oryza sativa)
  misc_feature (71): n=a or g
tggctttgctcctttgaagcacttctggcaggaacgataccaccaagagttctcgttgcagatttttcttntagttacactggttataaatcgaagcctct

SEQ ID NO: 29277 - DNA, 101 bp, rice(Oryza sativa)
  misc_feature (71): n=t or c
tcagtaaatgggcaagccgctatcggtgtgcaatcgccgcccgcctttttaattgacaaccatccccaganttgaagctgattactctggtaacaaaaaat

SEQ ID NO: 29278 - DNA, 101 bp, rice(Oryza sativa)
  misc_feature (71): n=a or g
ccatactattgggctgaggatccaccaggagatacacttgccaaaaagtgggccaaatgggccagtcaagngttcgaccgaaccctgagctccactgttga

SEQ ID NO: 29279 - DNA, 101 bp, rice(Oryza sativa)
  misc_feature (71): n=a or g
acttattcctatattcattgaccggtgatctttgatggatcatgttacaagataccaaatgatcaatatcntggtggagaacatgttagtgaataaatcca

SEQ ID NO: 29280 - DNA, 101 bp, rice(Oryza sativa)
  misc_feature (71): n=t or g
gtcaagttgccccgctcattttcctgaacttcagagggaggaaattgcttgaatcggcgttcctcttcttnccaaaactgctaggtgtgacaccagtcggt

SEQ ID NO: 29281 - DNA, 101 bp, rice(Oryza sativa)
  misc_feature (71): n=t or c
ggagtgcatgccaaaacagtggcgttcgcgtagaagcaatcgacacaactgagcaaaagagcacatactanggattcatagaagaaatctgcgaactagac

SEQ ID NO: 29282 - DNA, 101 bp, rice(Oryza sativa)
  misc_feature (71): n=t or c
cggtttgggttgggttggtgctgtgttgatatttctttggaaaaagtaccaatttgcccccgaactattgnggtcgatcgaattaccccctgaatccgaaa

SEQ ID NO: 29283 - DNA, 101 bp, rice(Oryza sativa)
  misc_feature (71): n=t or c
agatcagatgacttgacaaactcaatgattgctgcaacagcttcttcctttgcatcaccgattgcatcagngtcatcggccgatccatcgaaggtggcaag

SEQ ID NO: 29284 - DNA, 101 bp, rice(Oryza sativa)
  misc_feature (71): n=t or c
ttgggttaattagattaatccttacagcaagtaccatactggctactaggctactaccccatgttgatctngactgaatccatttattcataggctcgtat

SEQ ID NO: 29285 - DNA, 101 bp, rice(Oryza sativa)
  misc_feature (71): n=t or c
ccttctcgaccacctacttgactacatcggaattcaacaacacctatgatggccgggcgcctatggtgctngattgggccatccggagcgccaacagttgt

SEQ ID NO: 29286 - DNA, 101 bp, rice(Oryza sativa)
  misc_feature (71): n=a or g
ttgagaggtaccaacttgatctttctcgagatctcatcatctctttcccagaaataccatctgatggaacngaatctgaatgctcactatcacagtcagaa

SEQ ID NO: 29287 - DNA, 101 bp, rice(Oryza sativa)
  misc_feature (71): n=t or c
gaaatagtagtataaaattaaccacatacgtaggtaccagcagagcaaatctttaattaatcgtggcatanactactcacaatatatccagtacagtcttt

SEQ ID NO: 29288 - DNA, 101 bp, rice(Oryza sativa)
  misc_feature (71): n=a or c
gtactatctctctactcttaggctgagacatgctttaaaaaattcacaatgtatagggtcggcaccatgancttctctctgatacacctttcaatttaaca

SEQ ID NO: 29289 - DNA, 101 bp, rice(Oryza sativa)
  misc_feature (71): n=a or g
ctgttgagaagaagttgtgtcatttgctttctaaagcttttgattcccaccatccttcacaccttcatcanacatctaatgtcaagtaagcgtctgctgtt

SEQ ID NO: 29290 - DNA, 101 bp, rice(Oryza sativa)
  misc_feature (71): n=t or g
gcatccaccataatggagaatacatctccgctgtactcggatttcatccttttaaagacatcgtcttcttncacgatacaaatttaagagttgttgcatat

SEQ ID NO: 29291 - DNA, 101 bp, rice(Oryza sativa)
  misc_feature (71): n=a or c
gatgaaaaggagggacgaggagggtaacagctatagctacctcccagttgccgtccagatcggcttgctangctatccaaggcagcagagccgcgaggagg

SEQ ID NO: 29292 - DNA, 101 bp, rice(Oryza sativa)
  misc_feature (71): n=t or c
tggaagagaagacaacgacgacgacaagtcgaggtgagaactttttgcttctgcaaactgtgtcagagtanacgtgtcatgcgtgcattgcagtgtactat

SEQ ID NO: 29293 - DNA, 101 bp, rice(Oryza sativa)
  misc_feature (71): n=a or g
agcagcaattgtagtactagtttagttgggcgcgcgacacttgtaggaggagccgtcgtggaggtggaggncgcagcgctcgccgtcggtgggcgcgcaca

SEQ ID NO: 29294 - DNA, 101 bp, rice(Oryza sativa)
  misc_feature (71): n=a or c
tttcttgtgctcaacagcaatatgtaggaagttccttcctttgctgtcaagcatttcatcacaatctgggnagtatcttgatagttcatagatcagttgac

SEQ ID NO: 29295 - DNA, 101 bp, rice(Oryza sativa)
  misc_feature (71): n=a or g
cgtcacgctcgttctctctctctgtctcgctgggctgtggctgccgtcagcaatgcggcgccattactganctctggccaccccgcatcaggaaggatggg

SEQ ID NO: 29296 - DNA, 101 bp, rice(Oryza sativa)
  misc_feature (71): n=t or g
tgtgctgtcggaaatgttcagagctcatacagatacattggacaagtgggttaattagggcaagtactatnggcatccaagcacaattttctaaataccac

SEQ ID NO: 29297 - DNA, 101 bp, rice(Oryza sativa)
  misc_feature (71): n=t or g
tgccatgtttgaaaatttagcatcatcaggtccaattaacccaaattctagaatcaggcaaatggttcacngaagacagcagagtgaacccaatggcgtgc

SEQ ID NO: 29298 - DNA, 101 bp, rice(Oryza sativa)
  misc_feature (71): n=a or g
atcgtttggttgaattttcttttgccgagctctgtggggaagtcaaagtggggcaataaattccgctttanttgtggtgtcgggaggtggggcccacatgt

SEQ ID NO: 29299 - DNA, 101 bp, rice(Oryza sativa)
  misc_feature (71): n=t or c
tttccaaaagaaaatgaaaataacagattacacctggtacaatggaaaacaaacatattatctctgtcgcncattatcatggttcttctaggtatcataag

SEQ ID NO: 29300 - DNA, 101 bp, rice(Oryza sativa)
  misc_feature (71): n=t or c
cgccgccaaagctcatgccggcctgctgcgtggagctccctatgaacatcaccgacctgtacatcgccgcngattccctttccggccatcgcctccagcta

SEQ ID NO: 29301 - DNA, 101 bp, rice(Oryza sativa)
  misc_feature (71): n=t or c
tgctgattggggctatgacatggcagaagctaacgatgaagcgaaatcagattcagaggcagagctacatnttactgttgttctatgtacagataagaagg

SEQ ID NO: 29302 - DNA, 101 bp, rice(Oryza sativa)
  misc_feature (71): n=a or g
ctagaagttaggaccttatgtagaattttaattagtgcacaagtttgtactgttatgtattatgtgaagtnaagacatggatgttcaatggtaacttatgt

SEQ ID NO: 29303 - DNA, 101 bp, rice(Oryza sativa)
  misc_feature (71): n=a or g
acccttttatacgaagcgaggatgaaattgtaagtggagaggtatctgtaagtgggccagcccgtcggatngactggctacacggttctggagggagggct

SEQ ID NO: 29304 - DNA, 101 bp, rice(Oryza sativa)
  misc_feature (71): n=a or g
tggtttccaaaaatttcaggttagagagaatctcacagcttttctgactgactcccaagtacctctggagntcttggtcttctctgccatctccttaggtt

SEQ ID NO: 29305 - DNA, 101 bp, rice(Oryza sativa)
  misc_feature (71): n=t or c
ccaactcccaagccacgagcaaaatgagcgagcgaactactttctttggtacaccttcggcggttgctagnactatccgcaaggcatgtaccggcgtagat

SEQ ID NO: 29306 - DNA, 101 bp, rice(Oryza sativa)
  misc_feature (71): n=t or c
atcgtcgctctcgcgcgtggggagttggaaccagtcctgcagcatataccacatcgccatgactatcagcntgtgcctcttcctccgccgcatcgtcttgt

SEQ ID NO: 29307 - DNA, 101 bp, rice(Oryza sativa)
  misc_feature (71): n=t or g
gtccaactctgagcaaagaaagcacaatctatccaccccgtatggctaatcccatttctgactctagcatngaggcagacaccgtgcagcaagcaagctta

SEQ ID NO: 29308 - DNA, 101 bp, rice(Oryza sativa)
  misc_feature (71): n=t or c
ggcttgggtgcagcacaatcaggaagtctgtgaggcacaagattatttgatgggatgcttctcgaatccanctcttctcttaccacgttgagaagcttgcc

SEQ ID NO: 29309 - DNA, 101 bp, rice(Oryza sativa)
  misc_feature (71): n=a or c
aaacaggaagcttgtgaaattagtcgaacagtttggactaaggaagtggtctcacattgctcaaattcttnctggaagagttggcaaacagtgcagagaaa

SEQ ID NO: 29310 - DNA, 101 bp, rice(Oryza sativa)
  misc_feature (71): n=a or g
cttgtacacctcgtatggaaggtgggataaatctcaaaccatcaggagatggatgcaggaacagggactcntgaaactgcctggatgcagctccgtggggc

SEQ ID NO: 29311 - DNA, 101 bp, rice(Oryza sativa)
  misc_feature (71): n=t or g
gatgctttgtgttctgaggtttttcggatggttctccatgtggtacgatgcacaacgtgatcaacaacagncccttgatcattcctggcctttgtttcctg

SEQ ID NO: 29312 - DNA, 101 bp, rice(Oryza sativa)
  misc_feature (71): n=t or c
aatttgattgtttgacgacaaagagaacattgctttggaccggaaggagagcacccccataatgataaaanactaaaacagggaaatgcgtgtacagtctc

SEQ ID NO: 29313 - DNA, 101 bp, rice(Oryza sativa)
  misc_feature (71): n=t or g
ccgaataggcccataatagtacacaacatgtcatgtcgacgttgaattatgtaatataaactctaacatcnctacctcaaccaacaacaatatattaatcg

SEQ ID NO: 29314 - DNA, 101 bp, rice(Oryza sativa)
  misc_feature (71): n=a or c
ttttgggaaaaaaattttagggaactaaaaggggcctaagataaaacgatctggtacccccttctaagagnataggggtaccaagtacctactgtagatat

SEQ ID NO: 29315 - DNA, 101 bp, rice(Oryza sativa)
  misc_feature (71): n=t or c
tagtgttaagattggagcttcgactaacctggttagtaaacgcatggatgatttagagaagcaggaacccngttcacctgcctcaagttcgtcaggctctg

SEQ ID NO: 29316 - DNA, 101 bp, rice(Oryza sativa)
  misc_feature (71): n=t or c
atagcaaactatagtttagctacaaccacatgcgaagaagataggagaaaggagagagaaaatcgtactanagatttatattcagctatagtataagtata

SEQ ID NO: 29317 - DNA, 101 bp, rice(Oryza sativa)
  misc_feature (71): n=t or c
tatgataaccccaacctggagagtatcacttccctcaacaagttacagaagctcgtcattgacggctgccngaagatgaggatattggagggggttcctga

SEQ ID NO: 29318 - DNA, 101 bp, rice(Oryza sativa)
  misc_feature (71): n=a or g
aagccttcgtagcctacaaataccaaattcccaaactctccgtgtctcggcccaaaccgagctcaaactcnagcgagcatccatggtcaccttcctaacca

SEQ ID NO: 29319 - DNA, 101 bp, rice(Oryza sativa)
  misc_feature (71): n=t or c
cactacgtgttccggtcaaatgctttgctagccccttttcatctccttacaacatactcctatatttgttnagggcatgttcactttgatgtcattttcag

SEQ ID NO: 29320 - DNA, 101 bp, rice(Oryza sativa)
  misc_feature (71): n=t or c
tacgcgcacaatggcttcactcggggacctcatcctgcacaacttccaagaaaaaggttcatgtcgcgggngtgctacgatgccaggatatactcgaccac

SEQ ID NO: 29321 - DNA, 101 bp, rice(Oryza sativa)
  misc_feature (71): n=t or c
ataaccaacatcatgtcttggatgcttgccttgagctcagaaaagttctgttgcatagccttgcagaggtnaagcaagacgagagagcactcgagctcttg

SEQ ID NO: 29322 - DNA, 101 bp, rice(Oryza sativa)
  misc_feature (71): n=t or c
ttcttttttagaaagattggagaggccttccccaatctccattaacgccatgacactggtttccacaaaanttgcagacatgaagaaacatttaaggccaa

SEQ ID NO: 29323 - DNA, 101 bp, rice(Oryza sativa)
  misc_feature (71): n=a or g
ggtagagatccatatcagcaccacttagaggagttggaaaacttgaagcaaactggtagtgtagaggaatntcataataagtttgaggagttgatgcattt

SEQ ID NO: 29324 - DNA, 101 bp, rice(Oryza sativa)
  misc_feature (71): n=a or c
ctcaaaatataactaataatcaataaatggaagtagctagctagattacctttataacagtggcatcaatntgcaggccatgacaggttggtttgaggtaa

SEQ ID NO: 29325 - DNA, 101 bp, rice(Oryza sativa)
  misc_feature (71): n=t or c
tttcaaaaggaccaaaatgtgaaaaatccagttggtattagtactaactagttcgagcagtccgatgaatngtagtgtacagtacatattttaagtactac

SEQ ID NO: 29326 - DNA, 101 bp, rice(Oryza sativa)
  misc_feature (71): n=t or c
tatgatagccccagtgctcatccaagacagtacaacagttccactcaaccgaataccaaagcaccatttgntcctgccaggagagaattgcctgccctaga

SEQ ID NO: 29327 - DNA, 101 bp, rice(Oryza sativa)
  misc_feature (71): n=t or g
cttgattgatttctggctgtaactgattacaactatatatgcaaggtatgcatctgagagcatcgctgcancatgcgactgggcgtacaaggacgtgacag

SEQ ID NO: 29328 - DNA, 101 bp, rice(Oryza sativa)
  misc_feature (71): n=a or g
tcgatgcaactccctccaaatgctactggatgatgagtctttgttggatgacaacaatgaatttatttttnagacggttcaaatagtgtacgatcagaaca

SEQ ID NO: 29329 - DNA, 101 bp, rice(Oryza sativa)
  misc_feature (71): n=t or g
ggtgttcacagaagcggcgttgtttgtggtgtggttgcttgcactttgcacttcaggtgactttgctttantactgcaggttgttacatccttgccaggag

SEQ ID NO: 29330 - DNA, 101 bp, rice(Oryza sativa)
  misc_feature (71): n=t or c
ccacctagtccgtgattcagtatgcacaatagggtttatttatcagggaatcgaacggatatctcattagncaaaaccagggggcggatgatccaacttgg

SEQ ID NO: 29331 - DNA, 101 bp, rice(Oryza sativa)
  misc_feature (71): n=t or c
ttctagataataagataatggatcattagatagcaagatattacactcctccatcccataatataaagtgngcacatatttttagattcaacttttaaaac

SEQ ID NO: 29332 - DNA, 101 bp, rice(Oryza sativa)
  misc_feature (71): n=t or g
ataaatcgaactaataaaacctttgatgtgacccgtggttatgaagggtttttaaggaaaccattgttgtncttatatgaactcatgaaaatatgttgtat

SEQ ID NO: 29333 - DNA, 101 bp, rice(Oryza sativa)
  misc_feature (71): n=a or g
agtcaaatgcctggcgactttccggctaccgattactaacactgtatcacaatttgtcctctcatcacttncatgtcatttaaaccgttataaaaaattta

SEQ ID NO: 29334 - DNA, 101 bp, rice(Oryza sativa)
  misc_feature (71): n=t or g
atccatcatcaccaccacttcgctttcccagggaggaggagatcaatcggcaagccaaaaaacaaaaaaanatttcttttcttttcttttcctcctgttgc

SEQ ID NO: 29335 - DNA, 101 bp, rice(Oryza sativa)
  misc_feature (71): n=a or c
ggcctcttagtcgttgtcgaccatggtgtagcccttctcgtggcgatggccaatggttccggatcatggtntggcactggacaagcttgtcctggcgggca

SEQ ID NO: 29336 - DNA, 101 bp, rice(Oryza sativa)
  misc_feature (71): n=t or c
gttgaaagtttttagccgaaagtttttagcctggagggttagtgcattacctatgatcaggacacaagccntgctcagccttggtgtcaccaccatgatcg

SEQ ID NO: 29337 - DNA, 101 bp, rice(Oryza sativa)
  misc_feature (71): n=a or c
gtaaagagatgagtttactgttctactgcttcatccagatgtaacaagtacagtgtagtttttagtgcatntctggtagagtagatgcttcagtggccttc

SEQ ID NO: 29338 - DNA, 101 bp, rice(Oryza sativa)
  misc_feature (71): n=a or c
ttcatgattatttcaccggacaactcccatttctgtacgaactgtacaccgatcaaagttcaagaaacccnaaaaaaaaagagaaaaaatactgtacatta

SEQ ID NO: 29339 - DNA, 101 bp, rice(Oryza sativa)
  misc_feature (71): n=a or c
gtcagtgtgtgttgaggattgttgtggaggattgttgtcaagaagaatggaggaagctgacagatgagtangaaattaagaccagggaaagtcattgagaa

SEQ ID NO: 29340 - DNA, 101 bp, rice(Oryza sativa)
  misc_feature (71): n=a or c
tttgtgtgtccaatattaattgctagtggactcgactagacgtgaggcccatttgttggcaagtttcttcncttgtctctctcttgtgagacgaatctttt

SEQ ID NO: 29341 - DNA, 101 bp, rice(Oryza sativa)
  misc_feature (71): n=t or g
gaagagtggctggcaacattccggcgaataacaagacagtgattttctcagtgagatgtacctttgacttncgagaggcaatgccctccaaatccacaaca

SEQ ID NO: 29342 - DNA, 101 bp, rice(Oryza sativa)
  misc_feature (71): n=t or c
aaattgaaatagcataccatgtctacggccttcagtcggcgacgaaggtatttttgaacgcaagaagcaangcctttgtctatttaatttagtcaattcag

SEQ ID NO: 29343 - DNA, 101 bp, rice(Oryza sativa)
  misc_feature (71): n=a or g
gtagcatccttcatttgtcataaaataagttttattttcaaattaattattgcataggagtttgtgcaaantagaatataattatattgagagtagataaa

SEQ ID NO: 29344 - DNA, 101 bp, rice(Oryza sativa)
  misc_feature (71): n=a or g
aaaagttatataaatatcaatagatctagacgagaactggaaaagccaaaacattttagatggaacggagngaccgagggagtaggaaagagccaaggact

SEQ ID NO: 29345 - DNA, 101 bp, rice(Oryza sativa)
  misc_feature (71): n=a or g
ctcagacaaacagagatggcttgttttccttcaactatctgccatgcatgtatgtctctaggatcataganatcaaaaggatgctcaccggagaggaagga

SEQ ID NO: 29346 - DNA, 101 bp, rice(Oryza sativa)
  misc_feature (71): n=a or g
gggcttaaattaaacaatgacgtacacgatcgatgcgtatgtatatgcgcctccgtcatttaacttaacanaaaacacgaagaggaattaattaagaaata

SEQ ID NO: 29347 - DNA, 101 bp, rice(Oryza sativa)
  misc_feature (71): n=t or g
aagagtccccacgaagagcgcagcggggcaatccagcaatcgtgaggagttggggtatagttcacacgaanaagatgaagttgtagctccccatcgtggtg

SEQ ID NO: 29348 - DNA, 101 bp, rice(Oryza sativa)
  misc_feature (71): n=a or c
ttctgcagtctgcacggctttcttctagctgtcggaagggtgaagtcttgcaacagatgccatacctaccnggaaagcaaagtgtcgaaacatgaattcgg

SEQ ID NO: 29349 - DNA, 101 bp, rice(Oryza sativa)
  misc_feature (71): n=t or c
ctggaggtgggtaggagcacgggtgagggatggcggcggttttttttttcgtccagaggattttcgcaggngggtgactgagccgcctgcgatacaggcgg

SEQ ID NO: 29350 - DNA, 101 bp, rice(Oryza sativa)
  misc_feature (71): n=a or c
agtagccatttaacacccttcagcaaaagtaatggcattattccatagccgatgtcctaaaaaaccattcntaatcttagcccacccaagtctctaggttc

SEQ ID NO: 29351 - DNA, 101 bp, rice(Oryza sativa)
  misc_feature (71): n=a or g
tgcttttctctcagcttgcactctagttgacacatcagagagaaagatggctgaattgttcgcatccatgngcgtgaaatgggcacttgacaagctctcgt

SEQ ID NO: 29352 - DNA, 101 bp, rice(Oryza sativa)
  misc_feature (71): n=a or g
ttaagaacagtattcgcggtcaaacctcgagttttaaattggtagaatgcgcgtagccgtatgcaagccanaaaagaaccagatccgggacgcctcggtat

SEQ ID NO: 29353 - DNA, 101 bp, rice(Oryza sativa)
  misc_feature (71): n=a or g
agcaagcttcaactatcttgttcaagaaaacaagagtgcacataaacaaggatataagtaagacattaagnaaaaaaaaagtaattctaatccaaaaggag

SEQ ID NO: 29354 - DNA, 101 bp, rice(Oryza sativa)
  misc_feature (71): n=a or c
tttcaacactcgttgcactgtacatattacattctaaagtgatgaggtatatattgtcgacgtttgatgtntcgactacggtatttggatagtatggggat

SEQ ID NO: 29355 - DNA, 101 bp, rice(Oryza sativa)
  misc_feature (71): n=t or g
aagattttgtagggccattctgcttctattttggggagtctaatttttgtgctcgttgcttcacttcggtntacatgaactgctgaactcctttcttgcat

SEQ ID NO: 29356 - DNA, 101 bp, rice(Oryza sativa)
  misc_feature (71): n=a or c
taaagtttgttgtttaattatgtgcgagttatttaatagtgattttgacagctctagatttgaaggtaagnagcacagttcattgacagcgtataaggtac

SEQ ID NO: 29357 - DNA, 101 bp, rice(Oryza sativa)
  misc_feature (71): n=a or g
cttgtatatagaggggcagtatgagacatctatgacgggcttgtatttgagattagatctatgatgaatanaggacttcatcccacacatgtgtacattgt

SEQ ID NO: 29358 - DNA, 101 bp, rice(Oryza sativa)
  misc_feature (71): n=a or g
agccctcttctaccaaacacattgggagtttattgaggaggagatttgcagtgcggttcgtagcttccttnctagggatttgattccggagggcttatgtg

SEQ ID NO: 29359 - DNA, 101 bp, rice(Oryza sativa)
  misc_feature (71): n=t or c
tgcgctttattagttgagaaatggttgagggtgagagagtagttaagggtaagttggtggataggacaagncttgttccggccaactaaatcaagtggcca

SEQ ID NO: 29360 - DNA, 101 bp, rice(Oryza sativa)
  misc_feature (71): n=a or g
tgatgttgttgcttgtgtattttcttagctctccaaacaactacttaaaaagagttatggtacagtgcccnaataatgagattaatgattgtcccattgca

SEQ ID NO: 29361 - DNA, 101 bp, rice(Oryza sativa)
  misc_feature (71): n=a or c
cttgggatttcttttgttctaacaggtttctagctttagcacgaatgcaaatcatgtgaaaggaagtaaanatataggatgttcagaggagtttaaacgtt

SEQ ID NO: 29362 - DNA, 101 bp, rice(Oryza sativa)
  misc_feature (71): n=a or g
tatgttgctgccatcaggaacaggaatatgaagctccctgagaacccagacgagctgtacgagatcagcangagcaaagctccccctgacacggacttcat

SEQ ID NO: 29363 - DNA, 101 bp, rice(Oryza sativa)
  misc_feature (71): n=t or c
acgcaataacctagatggtgctgttttgaaattgagaggtttcttgttcaagaggatcctatgcggtgaancagagaaaaagaacagcagggaaatcaaaa

SEQ ID NO: 29364 - DNA, 101 bp, rice(Oryza sativa)
  misc_feature (71): n=a or g
cttgatcatttcttaaaaaaaaagcgaagccaagagatggcgatggccccccgctccctatttccctgtgntgaattcacctgttaggaggcgagattgtt

SEQ ID NO: 29365 - DNA, 101 bp, rice(Oryza sativa)
  misc_feature (71): n=t or g
gtacatttgagtttttggcgttttgaaattttggggcatggagtaggacccaacaaaattttctggagccnccactttcgatccatgtccggaactcgcaa

SEQ ID NO: 29366 - DNA, 101 bp, rice(Oryza sativa)
  misc_feature (71): n=t or c
aatcaacgttaccttggctcatcttggagcacccaaatctgtaagaccactgctttcatcttcctataacntctcagatgttcttagagatcaatcataca

SEQ ID NO: 29367 - DNA, 101 bp, rice(Oryza sativa)
  misc_feature (71): n=a or g
cggcaagtaattgcctctgaaaaatggggccgattgggctccttttgggtttggccaaaccatgggttcanccgaacccttgccggctctttttgccccga

SEQ ID NO: 29368 - DNA, 101 bp, rice(Oryza sativa)
  misc_feature (71): n=a or g
aaaataatggtatacttcattgatcttgctgttctcccaggctttttcttcttgaatccatttcataaatnttggttcaatcaagccatcaatcaacgtag

SEQ ID NO: 29369 - DNA, 101 bp, rice(Oryza sativa)
  misc_feature (71): n=a or g
atcaagagccaatgccctttgtgcggcagcatcagtctgaacaagaaaaatcggtcaggtttaaattaccntttaaggaaaaatggcaaaaagcatgttgc

SEQ ID NO: 29370 - DNA, 101 bp, rice(Oryza sativa)
  misc_feature (71): n=t or c
ccactgaaaaagaaaagaaaaaaaaagaggaaaagcagcgagcgagagaccgggggacggaaatggtcgtngccgtcgcctcaccttcgtcggcgccgggg

SEQ ID NO: 29371 - DNA, 101 bp, rice(Oryza sativa)
  misc_feature (71): n=t or c
aagctatctgaacgggaggatttttcagggtaacagaaaaacaaaaatttccggtttctatctcagatttngaactaaatttgaagttgaaccaaaaaaaa

SEQ ID NO: 29372 - DNA, 101 bp, rice(Oryza sativa)
  misc_feature (71): n=t or c
gatacgagagcatgggcacatcgtgcctcgaattatcccatgattgtatctgtgaattgcgatcaggagcnggccttcaagatccaacgtctgaaacaatt

SEQ ID NO: 29373 - DNA, 101 bp, rice(Oryza sativa)
  misc_feature (71): n=a or g
taataaatatgaggtatacctagttccttctatccacccagggagcggatcatggtaaatgctggatacantacttgggcgaataatcacaaccggaagtt

SEQ ID NO: 29374 - DNA, 101 bp, rice(Oryza sativa)
  misc_feature (71): n=t or c
aacagggtcgagaaacatggtacgctacttacaagatgggaacgaaaatgacctcgtgttcctgggacggngttcccggattgaggatcgctgccaccgac

SEQ ID NO: 29375 - DNA, 101 bp, rice(Oryza sativa)
  misc_feature (71): n=t or c
tccaactgaatttattattgttatgatgataaaaaaaaactatacctagtctgtgatgcggatttgggcangagtggttgatcttcgcgggctgtgaatgg

SEQ ID NO: 29376 - DNA, 101 bp, rice(Oryza sativa)
  misc_feature (71): n=t or c
cattttagccatttaattattagtaccctattctccttcttgttaatgttctcctcctacttgttttctcnttctattgatatagggcatggtagtttttt

SEQ ID NO: 29377 - DNA, 101 bp, rice(Oryza sativa)
  misc_feature (71): n=t or g
agtgtgtgttattcaacctagaatagagtagcatgccttccatttcccagtgtgtgttttagatgctggantgcctttgacatcaactgatccattgcctg

SEQ ID NO: 29378 - DNA, 101 bp, rice(Oryza sativa)
  misc_feature (71): n=t or c
aagggtagattaaagggacgagagcaaacttattttgggacaaagcgtagatgctaagttatttttggganagagagtactgtctattttgttgtgacttg

SEQ ID NO: 29379 - DNA, 101 bp, rice(Oryza sativa)
  misc_feature (71): n=a or c
tattgcaaaaaaaaaaagtcttcgacataaaacccaagaagtagatgaccaagagagaggtagggaacatntaattttggacccactaatagacattatgc

SEQ ID NO: 29380 - DNA, 101 bp, rice(Oryza sativa)
  misc_feature (71): n=a or g
gtcgatcccaacgccacggctgacagctacaatcccagggggcacgctgagatcgttgccagccacaccgncgacgaggtctacaccagcggcagtgccag

SEQ ID NO: 29381 - DNA, 101 bp, rice(Oryza sativa)
  misc_feature (71): n=t or c
acctgcaccccccgaacaatacttctccaagaatatgagatgcccggactttctctaacctccataagctncccatctgggaaatatttggcctttaacac

SEQ ID NO: 29382 - DNA, 101 bp, rice(Oryza sativa)
  misc_feature (71): n=t or c
gtgcagagggaatgagagatgggagagacgaagaagataaggataagtgtgggacttatcccacactccanactccacatgcactcaggctcaccattgaa

SEQ ID NO: 29383 - DNA, 101 bp, rice(Oryza sativa)
  misc_feature (71): n=t or c
tttagctagctcagtttgtttgtatcgatgggcttagtaattagccggatattgctcctgcgagatggggnaaagtatcgacctgggatccgcccaaagtg

SEQ ID NO: 29384 - DNA, 101 bp, rice(Oryza sativa)
  misc_feature (71): n=t or c
ttccactccccatctgcagttctaaagccccaagctccaagggatatatccctgcttctcagcttcctctntgcctcacctcttggcaaggtgacggtggc

SEQ ID NO: 29385 - DNA, 101 bp, rice(Oryza sativa)
  misc_feature (71): n=t or g
ggggaggcctagctacaagagaaaattgtttttatagtgatgcaatcctcgccaagtccgaaatgcctttngctgggaaactgttttgatctctcgagaaa

SEQ ID NO: 29386 - DNA, 101 bp, rice(Oryza sativa)
  misc_feature (71): n=t or c
aatatgttagaggtgaaatattaatcccaactagaatggggaatatgtcaggaaaatacacttaccaaganaggtatacttcctgcaagaacatgatatat

SEQ ID NO: 29387 - DNA, 101 bp, rice(Oryza sativa)
  misc_feature (71): n=t or c
ccaaggtctccaatctccttttcttcctcttctgtgagctgggttgcagaaggttggccttttgcagagantgaatcaatatcactgatgtattttgcaga

SEQ ID NO: 29388 - DNA, 101 bp, rice(Oryza sativa)
  misc_feature (71): n=a or g
agaggcgtcgttggaggaggaagggaggcacaatggccgaggaggattaaagatgcggcgatcagaggagnaggaggaagggaggtgtggcagttagagaa

SEQ ID NO: 29389 - DNA, 101 bp, rice(Oryza sativa)
  misc_feature (71): n=a or g
gaaacgtctacgagtccatatgccgtattttgattatgatgcgatggaggatgagatgaaggagcatcacnatgaggatgaggatgatgacgaatatgaag

SEQ ID NO: 29390 - DNA, 101 bp, rice(Oryza sativa)
  misc_feature (71): n=a or c
atttgtcccaacctttccacggccttcaattatagtgaccccagaattctttagcatgtttgtctgaaccnccaccaagcgctgcaactctaaattcttgt

SEQ ID NO: 29391 - DNA, 101 bp, rice(Oryza sativa)
  misc_feature (71): n=a or c
tgattcaccatctcctgtattgctgtttttcttatcttctgcgataacatggtctgatgcttcatcttcancaactgtagtctccaaaactgcctctgcat

SEQ ID NO: 29392 - DNA, 101 bp, rice(Oryza sativa)
  misc_feature (71): n=a or g
gaaaaaaaaagataacgcatgcacgtgatttatctttcattcagtaggacggcagcacggtgtgttccatncgaaaattggaagtttaacttaaaattgaa

SEQ ID NO: 29393 - DNA, 101 bp, rice(Oryza sativa)
  misc_feature (71): n=t or c
acattaaaatacagtgggagggagtattgaataggtctgctacctatatttcatgctcgcatactctctcnggtttcattttaattaacgttttggacaat

SEQ ID NO: 29394 - DNA, 101 bp, rice(Oryza sativa)
  misc_feature (71): n=a or g
atccaaaactgtgctgagaaattagagcccgttcttcgtactttcttgtcttcgtgcattttcaacaaggntgtgccagctaatgaaaccaggaaacaaca

SEQ ID NO: 29395 - DNA, 101 bp, rice(Oryza sativa)
  misc_feature (71): n=a or g
gcatgccatcttgatttgcctaatatcctcctaatcgcttccttggcttcttcaagtgtttctacgctgtnatgcagctcaaaggctatcctctggatgtt

SEQ ID NO: 29396 - DNA, 101 bp, rice(Oryza sativa)
  misc_feature (71): n=t or g
tggaaggaaagatggccagtcaaggatggattgcagataggttgtctgattggttaaagaagaatccccanagaggccccaaggatgcaaaggaaaagttg

SEQ ID NO: 29397 - DNA, 101 bp, rice(Oryza sativa)
  misc_feature (71): n=a or g
gagcttcccaggttcacacaatctagagccagcatcaccactgtatactagtggtatcaaagaagcagctntgttccgacctgagtagagggaggtgccga

SEQ ID NO: 29398 - DNA, 101 bp, rice(Oryza sativa)
  misc_feature (71): n=t or c
ctaagtataacattttcatatgtagctaagaacaagagcaaggtaatacccatatgaaccagttgcaacanggagtccatccccactaagacaacactcaa

SEQ ID NO: 29399 - DNA, 101 bp, rice(Oryza sativa)
  misc_feature (71): n=t or c
atatatttatccatttaaccccacacgcgctatgtactttgcgctctctctctcctctacatgacattatnacttttttttttgtatttaccgatagatga

SEQ ID NO: 29400 - DNA, 101 bp, rice(Oryza sativa)
  misc_feature (71): n=t or c
ggacatgtgggtgttggcgagagggtttgatggataagtatgggtgttggttgcctgttagaataggtgcnggatttatataaacctaggacctataataa

SEQ ID NO: 29401 - DNA, 101 bp, rice(Oryza sativa)
  misc_feature (71): n=a or g
caacatttccttccgatgtttatagaggtaaaagttataaccgtcatattccgtttcgttcagcaccgccnacgttcaaagcttctcattctagtgagtag

SEQ ID NO: 29402 - DNA, 101 bp, rice(Oryza sativa)
  misc_feature (71): n=a or c
ttcccctttccttttgtttgctcaatcggattttgttcatcaaaatagaacctcacttttacatgcacacnatttcgattgctcctatcaatatttaattc

SEQ ID NO: 29403 - DNA, 101 bp, rice(Oryza sativa)
  misc_feature (71): n=t or c
tgaacttattccatcaagaggctacaaaagtactactagtagatggaccaggataaagggcccatccaaanaatccgggccgttccggcctcaggacataa

SEQ ID NO: 29404 - DNA, 101 bp, rice(Oryza sativa)
  misc_feature (71): n=a or g
tgacgacgcggcagaagaggaatacaagaaaaaacaacggaggctcaccgggatgggcgcggcggcggagncggggaagcgtgcggcgccgaagtcggccg

SEQ ID NO: 29405 - DNA, 101 bp, rice(Oryza sativa)
  misc_feature (71): n=t or g
ttccatatagaaatatagatgagatgtacatataaaacccatgaatgattgataagttcttttttttaagnagtagtaagataggagtatcataaaagaaa

SEQ ID NO: 29406 - DNA, 101 bp, rice(Oryza sativa)
  misc_feature (71): n=t or c
agtgtggactcaagtgatgttgaaaaccctgggaacaacctgtatgttactggcttatctgctcgtgtganagatcgagatctggagaaacacttttctgc

SEQ ID NO: 29407 - DNA, 101 bp, rice(Oryza sativa)
  misc_feature (71): n=a or c
tgggctcttttgttccccagtctctatcaacccatctccattctcgaggtttttagttctatctcgaattntgaatgttccttttttattctgattttttt

SEQ ID NO: 29408 - DNA, 101 bp, rice(Oryza sativa)
  misc_feature (71): n=t or c
tggattgtacgagacaacccacctattatcgagaggatggcctctaaccactctactcttaccgtcattangtctcctatacaatgggtatgaatccttgc

SEQ ID NO: 29409 - DNA, 101 bp, rice(Oryza sativa)
  misc_feature (71): n=t or c
tagctggaattcttaaagaacgttgctaatgtgacaagatatgtcatatgtcactctaccaacatgcgagnttaaattaaatttctacaggttgtaatttg

SEQ ID NO: 29410 - DNA, 101 bp, rice(Oryza sativa)
  misc_feature (71): n=t or c
ggcatgagctgtcgtggaaaattctgagtaaaaacgcacacatttttacagggcaaaaacagtacatgtgncagaatgcaggtgcaatacacagcgatgaa

SEQ ID NO: 29411 - DNA, 101 bp, rice(Oryza sativa)
  misc_feature (71): n=t or c
cgtcgtcccgtttgccgacgatcgccatggcggcatcttcttcaacttggatctcgccgtgattgacaggnatgacacccaacgccaagttgttgaacgtg

SEQ ID NO: 29412 - DNA, 101 bp, rice(Oryza sativa)
  misc_feature (71): n=t or g
tttttcaatttcacattggccctatacaatggcacgtcgtgtacatgtgcatgccatttggcatagcctanacggtccacaccctctatcataatggcact

SEQ ID NO: 29413 - DNA, 101 bp, rice(Oryza sativa)
  misc_feature (71): n=t or c
taatgcaatttcctgtaatatgaacatcgtgattatgctgtacaaacttgttagattgttcatatatgctntgtccatttcgttccatcctgacgatcata

SEQ ID NO: 29414 - DNA, 101 bp, rice(Oryza sativa)
  misc_feature (71): n=a or g
atctctatgtaaagatttttggtgtaaacaactaaactagaaattaatggccatgacaacagtgaagtggnagacatcacaacagctgttcttttctcttt

SEQ ID NO: 29415 - DNA, 101 bp, rice(Oryza sativa)
  misc_feature (71): n=a or c
attttctttttctgaatactgacacatcagtggaaccagccatcataataccattgaatctaatttaaccngattttatgtatccggtatcgcgtttaggg

SEQ ID NO: 29416 - DNA, 101 bp, rice(Oryza sativa)
  misc_feature (71): n=a or g
aaatcgatatgatggtaacgtgtgcagaggaaggagacgaggccatacaaggagcgattctctatccggtncaggcccattgtgccgatcacgtccagctc

SEQ ID NO: 29417 - DNA, 101 bp, rice(Oryza sativa)
  misc_feature (71): n=a or g
agacatgattgctgctctgtattaatgcatggccgaattcatcagccaggaaagtgggttctaatccctcnatacgatgttccctcgcgtacatttttctt

SEQ ID NO: 29418 - DNA, 101 bp, rice(Oryza sativa)
  misc_feature (71): n=t or c
acggagcattgagccgaaagagccttcacaaataaacgaaacaagttatgagaagaaatcaaaggtgttgntgagataagcgcaaagtaggcccaagtgca

SEQ ID NO: 29419 - DNA, 101 bp, rice(Oryza sativa)
  misc_feature (71): n=t or c
ccaacgctgccacatctgcgagattcttcaatccagtgccacgtttactcctgggcccactaaattagtcngcgtgaccaactttggtcacacgttcttcg

SEQ ID NO: 29420 - DNA, 101 bp, rice(Oryza sativa)
  misc_feature (71): n=t or c
ccaccgcaggtggagggggaggaatgccaacgactgcctgcacctatgcttgccggggcccatcaacatgnggaacgacgtgctgctccggcggctcgccg

SEQ ID NO: 29421 - DNA, 101 bp, rice(Oryza sativa)
  misc_feature (71): n=a or c
agttttgttgggaccaacatggcgagaaaccgcgaattaaacctgtaatttgattacgtgcatgcagaagnaactccggccgccgttctgtgaggacgacg

SEQ ID NO: 29422 - DNA, 101 bp, rice(Oryza sativa)
  misc_feature (71): n=a or g
atcaaatccagcggagccgccaaaaacccggtccaacagcgaacaaccgcgcaaagagccaaagcaaacantcaaaaagcacagaccaaaacccggtcgac

SEQ ID NO: 29423 - DNA, 101 bp, rice(Oryza sativa)
  misc_feature (71): n=t or g
ttaagttttgctctctttgtgtttgtgtttgggtgcgccatggctggctggtttatataaagaaaggatgnctggggccgggcgacctatcttgcaacagc

SEQ ID NO: 29424 - DNA, 101 bp, rice(Oryza sativa)
  misc_feature (71): n=a or g
atcagattcagatatcttcatgtcttcagagtctcgctttgtgaaaagcaattgctttatgacatataaangcgctttgtacctttagcacagacgacgct

SEQ ID NO: 29425 - DNA, 101 bp, rice(Oryza sativa)
  misc_feature (71): n=t or c
cgtggttgacctgctgccggcggcgaaccgtcgcaagtgtttcatgcgttccaagttgtcattactccttngtactctctccgtcctataaaagacgaatc

SEQ ID NO: 29426 - DNA, 101 bp, rice(Oryza sativa)
  misc_feature (71): n=a or g
ggtgatttaatttacgttttgaacttaatttaattaatccgaatggtattcgtgcgtgcaggagcgacgcngctggagggcacgtcgaacaccgcgctgtt

SEQ ID NO: 29427 - DNA, 101 bp, rice(Oryza sativa)
  misc_feature (71): n=a or g
caaattatgtgattttttgtgtaacatgtggatttcttaaacctcgctgaaggaagccagcaagtaaatcnacaagttacccataagacttgtgatagcaa

SEQ ID NO: 29428 - DNA, 101 bp, rice(Oryza sativa)
  misc_feature (71): n=t or c
tattccctgatgtcataccctaggtaaaccttgtcattattaacttgaatgattgtcagccattcattacntgactaatcttttgttcttgttttgcagac

SEQ ID NO: 29429 - DNA, 101 bp, rice(Oryza sativa)
  misc_feature (71): n=a or g
gctgcataggggatacaacattgtatgcagtaggtctaatttgaagtaacgcagctgcatgcaaaacagcntgtccccaacatgtagttggtaggttgcta

SEQ ID NO: 29430 - DNA, 101 bp, rice(Oryza sativa)
  misc_feature (71): n=a or c
aaacttagcacaaatgcagctgaaatcttcattaggtaagtctgtcataaccacatactttctcggcctcnattcttgtcttgtttggtttgttgcagcaa

SEQ ID NO: 29431 - DNA, 101 bp, rice(Oryza sativa)
  misc_feature (71): n=t or c
gccgctgcacggagggtggaattaggtgggactactaactacaaggaccgcatcacaagacaacacggcangcattaatctcctctacgaaatgtaagtcc

SEQ ID NO: 29432 - DNA, 101 bp, rice(Oryza sativa)
  misc_feature (71): n=t or c
gcatccaaatacagtgctgtgtccaatgtgcattgccctacaagcaatgtccatgctttgacgagagaganggtatacactgaaaggatgctatctctgca

SEQ ID NO: 29433 - DNA, 101 bp, rice(Oryza sativa)
  misc_feature (71): n=a or g
gttaaagcagaataatattatccttgttatttgctatcctcctcactttttaggtagtacaagaagagtanatcattatcaaaatatcaattccgtagtaa

SEQ ID NO: 29434 - DNA, 101 bp, rice(Oryza sativa)
  misc_feature (71): n=t or g
tattgcaggaacgtatgttatctgacaatgcacttgtggaatttcaggaggagcagaaaagagcacaagcngtgttacaggaaggccagaagcgtccatca

SEQ ID NO: 29435 - DNA, 101 bp, rice(Oryza sativa)
  misc_feature (71): n=t or c
ctagtacgctgtatggggcctgactattaggcagtggacttaagaaggggttgtcttgggtttgatgcacngatttgctgcgtctttgcttcttttttata

SEQ ID NO: 29436 - DNA, 101 bp, rice(Oryza sativa)
  misc_feature (71): n=a or g
tccttgctcagctgtgtgatatttgtccggcagcaagagagcaagtatgcaacgaaatctagtgatttaancacccgataccttccattcgtactattcat

SEQ ID NO: 29437 - DNA, 101 bp, rice(Oryza sativa)
  misc_feature (71): n=a or g
agggatgagtgggactcagatgacaagtggtttttttaacgattccccaccgctgaaggactccgatgatngggacaacaaggacgatggcaataatgata

SEQ ID NO: 29438 - DNA, 101 bp, rice(Oryza sativa)
  misc_feature (71): n=t or c
agttgtaactcgtttagcaaatgataaaatgttattctattattagaaaaggttacgagtgagccgacaangaaaacaaactggtttacgcccaaaaccaa

SEQ ID NO: 29439 - DNA, 101 bp, rice(Oryza sativa)
  misc_feature (71): n=t or c
atggttttttgttttacgtacccagttaattaatgtctttggatagaatgcttcgacttgaggttgtgttnagttcacgttaaaattgaaagtttggttga

SEQ ID NO: 29440 - DNA, 101 bp, rice(Oryza sativa)
  misc_feature (71): n=a or c
gtggcctcaccgaactctcgccaccgcttgggacctctacctactctactcggatttctcagcctcactcntcctcgggggaatcttcctcagctgcggca

SEQ ID NO: 29441 - DNA, 101 bp, rice(Oryza sativa)
  misc_feature (71): n=t or c
gctgggcaggaccggccaactatggcggatgttgtgaccacactgacggagagcttgcaactggagatgtngtggtcgtcgccgcactccatgagatccag

SEQ ID NO: 29442 - DNA, 101 bp, rice(Oryza sativa)
  misc_feature (71): n=t or c
cacaatggaggaggttgcagatgattacctgaaccagttagtgcaacgtagcctgttgcatgtcgtactgnacaacgagtttggacgtgccaagctatgcc

SEQ ID NO: 29443 - DNA, 101 bp, rice(Oryza sativa)
  misc_feature (71): n=t or g
aataaatataccatagaggagttcatgtcaaaacaacgcatcaacaatggaatttttgtttggattattgnaagataaagatagaactagtagtttgctca

SEQ ID NO: 29444 - DNA, 101 bp, rice(Oryza sativa)
  misc_feature (71): n=t or c
agtgatgggtggggcccacacgggggagaaaaagaataggaatcctagtcagccgtggggcccacgagaangatggccacccattagagcacccacaatgg

SEQ ID NO: 29445 - DNA, 101 bp, rice(Oryza sativa)
  misc_feature (71): n=a or g
tctcagcctcggcgattttattgtacacgtcggagcaaaataacaacaggtaatcataaccaatagcactnaaatatctgctgaaaggacacccgatggaa

SEQ ID NO: 29446 - DNA, 101 bp, rice(Oryza sativa)
  misc_feature (71): n=a or g
gttagcccacgagcacaccagcaccccgttggtgcatactttctttgtcctaaaaatcaacatattattgnaagtgatatttcttaatacagtgaatctgg

SEQ ID NO: 29447 - DNA, 101 bp, rice(Oryza sativa)
  misc_feature (71): n=t or g
caggtagagctagaactgtcagtttcacacaggatcattcactttctctccagcagctcaacaaaggctcnccaaatcacatcaacaagaatgcttattgt

SEQ ID NO: 29448 - DNA, 101 bp, rice(Oryza sativa)
  misc_feature (71): n=t or g
cttgggttgtgctagtggcagtgcttgcgcaggtagtggtggcgccgtcagaatttgtggtggtggtgctngtggcgatggcggtgatgaccatggagatg

SEQ ID NO: 29449 - DNA, 101 bp, rice(Oryza sativa)
  misc_feature (71): n=a or g
taggacttcacaacccatgccagtgctaattgatcaccaagcatgcgggaagcctccatatacttcaagtngtatgcctcaaggacttctttgaagaattc

SEQ ID NO: 29450 - DNA, 101 bp, rice(Oryza sativa)
  misc_feature (71): n=a or g
cttacaaaagtgaattgctagctactgctacttaattacacagtacattaaagtgactgaactgtgccatnccattatgcatagaacttggactccattgc

SEQ ID NO: 29451 - DNA, 101 bp, rice(Oryza sativa)
  misc_feature (71): n=t or c
actgatggaagaagagatggccagtggaacgcagatcttgaaggaaacacaaaggaacatatttgggatangttctgatgatttgaagtctgtgaacctgc

SEQ ID NO: 29452 - DNA, 101 bp, rice(Oryza sativa)
  misc_feature (71): n=t or g
gtttcttaatcaaaagatgtggccgctgttacaacccctgtaacctttggattctgattccaattccaganattgcaacggggcattgtcttcgatgtcag

SEQ ID NO: 29453 - DNA, 101 bp, rice(Oryza sativa)
  misc_feature (71): n=a or g
tattgaggatgacctaatcaagtgtctaccagcctagcagtgtaaagctctcgcttgtgatcgatggctantgacagtcgacttccttgaatacgaactcg

SEQ ID NO: 29454 - DNA, 101 bp, rice(Oryza sativa)
  misc_feature (71): n=t or c
aatctatgcgccgtccaccaggagatgacatactccctccaacaaacacttcaatcagctacctgacagancagtactgctcaaaacaaactctgctagtg

SEQ ID NO: 29455 - DNA, 101 bp, rice(Oryza sativa)
  misc_feature (71): n=a or g
ttcccgaaattgaacttcattttcagggatatatattggtgatgccatggttattcattttacaagagcanctggacatgaaattgggacaggaacattct

SEQ ID NO: 29456 - DNA, 101 bp, rice(Oryza sativa)
  misc_feature (71): n=a or g
atgcttgttcgcccatatcttccctatgctataattttcccccaccacatcggttgcttgatttcgcttgncgaagtagaagaagaagaaggaggaggttg

SEQ ID NO: 29457 - DNA, 101 bp, rice(Oryza sativa)
  misc_feature (71): n=a or g
tcctcccaaaatagtgccctctggtagcaactttattgactcgttattatctcccctaaattaatcacatnttaatcaccaaagtactggagtactttact

SEQ ID NO: 29458 - DNA, 101 bp, rice(Oryza sativa)
  misc_feature (71): n=t or c
cgtgactagataaaattatcactcccgctatgtgtaacgtgtcagtattgttttaccatatcagctagacnggcgtgatcaaaagattcatattctggaaa

SEQ ID NO: 29459 - DNA, 101 bp, rice(Oryza sativa)
  misc_feature (71): n=a or g
gttaatctcctcataatcccaggaccccaatcagcagccataaagcttgcattatcactcccaaggaaatnccccgagctatcaagaactccaaatgttgt

SEQ ID NO: 29460 - DNA, 101 bp, rice(Oryza sativa)
  misc_feature (71): n=a or c
cataaatacaggtttcctgatgatcagtacgatcgttattggtatgcgtgggaattaactggaaatgaccnttattcaaacatttctacccaatcagccat

SEQ ID NO: 29461 - DNA, 101 bp, rice(Oryza sativa)
  misc_feature (71): n=t or c
gtcgtcgttcttcacaggaaacctcgtcgtcgttcttccatacagtctcatatgtgcaccaatgtgtgacngcgggtgtgagtcccgtatgtgctcgtgtg

SEQ ID NO: 29462 - DNA, 101 bp, rice(Oryza sativa)
  misc_feature (71): n=a or g
tcattatcacgaagactcattgcacacttgtcgcattcttctaggagtttagatagggaaagctttctacnaaaccttttcttgaaaacattgttcatacc

SEQ ID NO: 29463 - DNA, 101 bp, rice(Oryza sativa)
  misc_feature (71): n=t or c
atactgtactacctcactgggctaacaagaggggggagcaacatcgcctacttcgtcgtcaccctctacangtgcatcgtgttggtcgagagcataatgat

SEQ ID NO: 29464 - DNA, 101 bp, rice(Oryza sativa)
  misc_feature (71): n=t or c
ggggtgtgacatcacatgatgaagcaatggcatccagacaggtggcatctccttttgtctcttatgatacnatggatcccatgttgctcgaagctgatctt

SEQ ID NO: 29465 - DNA, 101 bp, rice(Oryza sativa)
  misc_feature (71): n=t or c
ctctcttactaattcagggtcgggaatcatcactcttggcactggaccaaaccaaatgaatgacagtttanctgcatttatgtgatatccgtagattatat

SEQ ID NO: 29466 - DNA, 101 bp, rice(Oryza sativa)
  misc_feature (71): n=t or c
gtacgcattaattttggacgtgacaaatctgtagtcctttgacttgtaaatacattagggctgtgtttagnttttaaaattagggagacgtttagagaaag

SEQ ID NO: 29467 - DNA, 101 bp, rice(Oryza sativa)
  misc_feature (71): n=a or g
attcaactatgaaggaagtaacaaaccttggcacagcaatctctagccttcttccagtcaatctcactgtntggtatgttgtacaactcctctcttatttc

SEQ ID NO: 29468 - DNA, 101 bp, rice(Oryza sativa)
  misc_feature (71): n=a or c
atcttattcacctccaagctcttcaggttctcgaagctgcacagcctcacaatatctgtcaccagtccagnttcttcctcggtcgatgagaacggctggcc

SEQ ID NO: 29469 - DNA, 101 bp, rice(Oryza sativa)
  misc_feature (71): n=t or c
tctctttaaataatttatttttcttcacagactttccaagaatgtctcctttctgctggtgctggaattanattggttgattcagtggtaacgagtttttt

SEQ ID NO: 29470 - DNA, 101 bp, rice(Oryza sativa)
  misc_feature (71): n=t or g
gattccatccaagtgctaataacaagtgggtgaaacatcattcgttacatgtcctaaatcattcattacanagatatatggtgttttaaaaaaaaagaaaa

SEQ ID NO: 29471 - DNA, 101 bp, rice(Oryza sativa)
  misc_feature (71): n=t or g
tagtactgtctactgatgcaggcaagggtatagatgctgcagtgacaagggtgctcaataatggagttgancatagagagtgcatgaggcatttgtacaag

SEQ ID NO: 29472 - DNA, 101 bp, rice(Oryza sativa)
  misc_feature (71): n=a or g
tggcaaatggagtgagtaattgagtggttttgctgcatgattaagcagccggcgaatggtttgatctctgnaggtgacgcatgctcgaatggatgatcctt

SEQ ID NO: 29473 - DNA, 101 bp, rice(Oryza sativa)
  misc_feature (71): n=a or g
cggtcacagctagtgggggcacgtttgatcatgcctgtgaagaagctactctcatgatgatggcaagactncgagacctgcacgacaacgaccttcgtagc

SEQ ID NO: 29474 - DNA, 101 bp, rice(Oryza sativa)
  misc_feature (71): n=a or c
atatggtaagtatcatctatcgccctctcaattggtggagtttctgattgattttggtttggggaagcatntatcctatggataggctcaatatcaatagg

SEQ ID NO: 29475 - DNA, 101 bp, rice(Oryza sativa)
  misc_feature (71): n=t or g
cttgagcttgagagcatacatttctatctttgatatctcacagtttgcaatacgcaagtatagcagtcggnacagtgcacaatcaaccttcagttcatcat

SEQ ID NO: 29476 - DNA, 101 bp, rice(Oryza sativa)
  misc_feature (71): n=a or g
gcaaggaagatgatgccgaactcttttcctcctcgagaacgtcgcgttaatatgggctctgaagcaaccgngaagaaggaggtggcactgtccatatctag

SEQ ID NO: 29477 - DNA, 101 bp, rice(Oryza sativa)
  misc_feature (71): n=a or g
attgatcatactctaatgtctctttttctcgttatatgtgtcgaaaaaagcctcatccaaacgcagattcnaactgacacttagtccaaatttagtatttc

SEQ ID NO: 29478 - DNA, 101 bp, rice(Oryza sativa)
  misc_feature (71): n=t or c
ataggtatgtcgtgcgccatgccatccacggatggcacccacaacatcaagcctaatacctagggtaacanagatgatacctacacgtataaaccttggta

SEQ ID NO: 29479 - DNA, 101 bp, rice(Oryza sativa)
  misc_feature (71): n=t or c
gctgtacaactagagatatacaagtatacaaccatatatcaattaaagggaaacatgtttatatatattgnagctatttacaaccattgattaaattcagt

SEQ ID NO: 29480 - DNA, 101 bp, rice(Oryza sativa)
  misc_feature (71): n=a or g
ttcacaactacaccaaggagggtgggggcttgagttttggtattacagtctttggaatgcagtctcagaancagatagatcatcaggggttttgtgcacat

SEQ ID NO: 29481 - DNA, 101 bp, rice(Oryza sativa)
  misc_feature (71): n=a or g
tcagcgttcaagacgggatcgaaagggatttcgttcagtatcgcattgagggttctgatatggtgggccgncgtcagtgtaaccgattgatccgccgttcc

SEQ ID NO: 29482 - DNA, 101 bp, rice(Oryza sativa)
  misc_feature (71): n=t or c
cattcaaaagctatgactaaagcgatgcatattaaaaggatgcaatcacaaggtcacaacaattggagagncaattgcacccagtcaaacgtgcgccaaaa

SEQ ID NO: 29483 - DNA, 101 bp, rice(Oryza sativa)
  misc_feature (71): n=a or c
gggctgtccaactattaccaaggaaaatcccaatcattcacatcgatatctgatgctacatgtgttcaggnccttgcaaagaaaattacctacaataagag

SEQ ID NO: 29484 - DNA, 101 bp, rice(Oryza sativa)
  misc_feature (71): n=a or c
gcctttacgttgaggcccaacatcctaacattatgggtgttggagctgaccatatggctgaaaaaattaanatgataataggcccaattaagaaccaaacc

SEQ ID NO: 29485 - DNA, 101 bp, rice(Oryza sativa)
  misc_feature (71): n=a or g
ttccattttgccacacaatcccaacaggacagatcccggagttgctcagactttgaggattaaaatactanctttgtaatttctcacatcattatttttcc

SEQ ID NO: 29486 - DNA, 101 bp, rice(Oryza sativa)
  misc_feature (71): n=a or g
aacatttacctctgcctgggcttgatctgcctcttctctagctttttccatctcattcctagcaaatacancattcaactttgcatgttccaactttttag

SEQ ID NO: 29487 - DNA, 101 bp, rice(Oryza sativa)
  misc_feature (71): n=t or g
ggagtagtaactgaatttcagttttgcctggcaattttgatatgtaagtactcctgtcaggtgtcaacaanctatgctcttcttctgaatttttttgactg

SEQ ID NO: 29488 - DNA, 101 bp, rice(Oryza sativa)
  misc_feature (71): n=t or c
atgttctatcttaccaggtatctgcagaacaaccaatttactggatcaatcaatgtccttgctaatcttcncctggataatttgtaagcaaatcattttga

SEQ ID NO: 29489 - DNA, 101 bp, rice(Oryza sativa)
  misc_feature (71): n=t or c
tgatgtagtggtatggttccaattttcctaaattatggtggcacttaaccgatatcgcgaatagtagtggnattttttaatatggtatatttacaatggca

SEQ ID NO: 29490 - DNA, 101 bp, rice(Oryza sativa)
  misc_feature (71): n=a or g
ttccgtatgagaaaaaagtgtgcgttgggaacaaagttacgctaaatagcagttatggtacttcccgttcnaaaatataaggcacaactatccttaatgca

SEQ ID NO: 29491 - DNA, 101 bp, rice(Oryza sativa)
  misc_feature (71): n=a or g
ctggcagaggggcaagattcccttttttgtgcctccaccacagcaaggtgaagatagtccatctgaaacanctgaacctgtggagaaatccgatgaggaag

SEQ ID NO: 29492 - DNA, 101 bp, rice(Oryza sativa)
  misc_feature (71): n=a or g
gtgctagcccggcacggcccaagtcccagctctactgccgtccgtcaggccgtagagcgtagtgctggccnaacgggcggccggccgagcacggcacgggc

SEQ ID NO: 29493 - DNA, 101 bp, rice(Oryza sativa)
  misc_feature (71): n=a or c
cagctattcttacgggggagtccaagaagagaaacattttgttggtgtccttccgatttttatgggggaancgaatcttttttgttttgtttttgcaaaca

SEQ ID NO: 29494 - DNA, 101 bp, rice(Oryza sativa)
  misc_feature (71): n=a or g
ttgtgggtagttgattctctatgctgcaatcacatgactggtataaagggacttctatctgatacaagacncgaggtacagtcatttgttacccccagagg

SEQ ID NO: 29495 - DNA, 101 bp, rice(Oryza sativa)
  misc_feature (71): n=t or c
cggttggggacgacgctggcggaggagcttgagcccatcttgatgccacgggacatcgtcgtcgcaccacngggaaggggtgggaggcaaagtggagagga

SEQ ID NO: 29496 - DNA, 101 bp, rice(Oryza sativa)
  misc_feature (71): n=a or g
cttggagcccttttaacaaatatataactggaggcgcactttgctaacctttaataagcatcactactagngaaaccatctattatcggttgcccaaaacc

SEQ ID NO: 29497 - DNA, 101 bp, rice(Oryza sativa)
  misc_feature (71): n=t or c
atcccagtgaactttcttactagccgatacgcgttagtaccagatagtccagctcttatcagtagtaggtntttctagagatggccaagacttgaaggtat

SEQ ID NO: 29498 - DNA, 101 bp, rice(Oryza sativa)
  misc_feature (71): n=t or c
ccgatagcgggatgcagaggtaggtgaaaggaaagtcaaagatagagcagggaaatagctctgaaccaacnccatgtcctcggccgaacgacagatcgggg

SEQ ID NO: 29499 - DNA, 101 bp, rice(Oryza sativa)
  misc_feature (71): n=a or g
ctgtgccttccaccctcggatgacatgcagaccatcataatcccagtccatcctaccagcaatctcagtgncaatgttcatcagcctcttcgacttccaaa

SEQ ID NO: 29500 - DNA, 101 bp, rice(Oryza sativa)
  misc_feature (71): n=a or g
acaacctgaatcttctcttcatcggtagatacaccatttggactaacaatatgtcccaagtatgctagccnttgttgagcaaaagagcatttgctgctttt

SEQ ID NO: 29501 - DNA, 101 bp, rice(Oryza sativa)
  misc_feature (71): n=a or g
tgctagccagctagttgatacttgatattacctgggaaactctaaactatggaggagacaatcctttattntttacatgttatctaaataattatgaaaaa

SEQ ID NO: 29502 - DNA, 101 bp, rice(Oryza sativa)
  misc_feature (71): n=a or g
agtttttttccttcaaccattcaggaaatttgcatttatgttcctttgagatccaagtcgccgcccttctngggttccaggctcttatctcgttcatgtgt

SEQ ID NO: 29503 - DNA, 101 bp, rice(Oryza sativa)
  misc_feature (71): n=a or g
gttcatatacctgaagcacccagcaaatatatgttccaactggcttacttttactttgttaagctaggagntttttttttttcaggatttctgaacaaaca

SEQ ID NO: 29504 - DNA, 101 bp, rice(Oryza sativa)
  misc_feature (71): n=t or c
aggctgctatgtgggcccaggtcgatgtattctaggtgggagtctgagggatgggtaagaaactgggtgtngattgatttttggacgattttcagattaat

SEQ ID NO: 29505 - DNA, 101 bp, rice(Oryza sativa)
  misc_feature (71): n=a or c
ggcggcgaggctttctcctcccttcaccggccctcatctcctcctccgtccatcggcgatttaggagcctnatctccacaatgtggtagcgcgctcgtgct

SEQ ID NO: 29506 - DNA, 101 bp, rice(Oryza sativa)
  misc_feature (71): n=t or c
gtcgtcaccgtgaagacggaggttgctaacgaccccctaaaggcgaaggctgaagtcctccaccgattcgncgggcttgaatcgcatggactcaaacgtct

SEQ ID NO: 29507 - DNA, 101 bp, rice(Oryza sativa)
  misc_feature (71): n=t or c
taacatgctatttttcataaaatgaaggtataatggtaccaaggttgtcatcattttctacctccctgcanggattttaaagcaaactgaacggctcaaaa

SEQ ID NO: 29508 - DNA, 101 bp, rice(Oryza sativa)
  misc_feature (71): n=t or g
aataattactataaaagttgtaaattttagcactcaatgcacttttattaaaacttggaaagttttttttntgtgtgtgtgtgtgtgtgaaaactgagcat

SEQ ID NO: 29509 - DNA, 101 bp, rice(Oryza sativa)
  misc_feature (71): n=a or c
aatttccacagggtcttgcaaggtcaagaatttaggggttctaggtcccatggtgttgtatgctctgaatnacctggtgtaccaaactttcaatctcctga

SEQ ID NO: 29510 - DNA, 101 bp, rice(Oryza sativa)
  misc_feature (71): n=t or c
gtatacatagttggaggtgaaaaatatccggttttgtagatcggggataattcagatgaccgcaaaagttnaggggggtaattcgtactttttttccttac

SEQ ID NO: 29511 - DNA, 101 bp, rice(Oryza sativa)
  misc_feature (71): n=t or c
aggccttgatcttggcaccaacacttacaagattgttcggtccttcgaccgatccatcgatttcaatcagngggctcacgatgctgccgggatggaggtgt

SEQ ID NO: 29512 - DNA, 101 bp, rice(Oryza sativa)
  misc_feature (71): n=a or g
gtccatctacagaagaagaagaaaagaacacacacacacaaaagaatcgtaacccggcaacctgacggtgnggggcccaccccgcacggaaaaatcgaggt

SEQ ID NO: 29513 - DNA, 101 bp, rice(Oryza sativa)
  misc_feature (71): n=a or g
caagccatatggtgtggaggaaagaacagtattatcagcagataacccatcagactttccttgagcagccncaataagattccttcttgcttgagcagctg

SEQ ID NO: 29514 - DNA, 101 bp, rice(Oryza sativa)
  misc_feature (71): n=t or c
ctgagctccacaagatcaccatctcatacaaacctgaccagacaggtcctcgagacctcattgaagtcatngagtcagctgcctctggtgatcttactgta

SEQ ID NO: 29515 - DNA, 101 bp, rice(Oryza sativa)
  misc_feature (71): n=a or g
agaactttggccaccaccggcactcccaccacgactcatcttgattgttgatgaagtgaagctgagcaganatttaaggcaaaaatattaaaactcaaatt

SEQ ID NO: 29516 - DNA, 101 bp, rice(Oryza sativa)
  misc_feature (71): n=t or c
aaattaacgggggcttctggatcagggcagagtttaacgaatggcaacgtgcgacaggaagttttgggcgntgatatatgctgacggtgctaggagtgact

SEQ ID NO: 29517 - DNA, 101 bp, rice(Oryza sativa)
  misc_feature (71): n=a or c
cgttgtcctggcaccagttgctcacaagactgccttgcttatctgcctcatgtgttccgttgggttattgnacgggcatacgtcaatgaagacacagatcc

SEQ ID NO: 29518 - DNA, 101 bp, rice(Oryza sativa)
  misc_feature (71): n=a or g
cgcagccggtaggaccgccgccattgcgctgcttctcgcgcttgccttcgcgtcgagcttcattagcgccnccgatggcgcgaggagtgcccgccaccacc

SEQ ID NO: 29519 - DNA, 101 bp, rice(Oryza sativa)
  misc_feature (71): n=t or g
agaaatggcttattatgaacaattgtccacggtgcccttattgcacttaaacacgattcatcagtttttantggccacatgctttaactccattcaatctt

SEQ ID NO: 29520 - DNA, 101 bp, rice(Oryza sativa)
  misc_feature (71): n=a or c
tgccataacagctagttcgaatgcatactaaatcacatttggtgatgaaatgggcatgctttaaaatactnctacctccgtttttcaatagatgacgccgt

SEQ ID NO: 29521 - DNA, 101 bp, rice(Oryza sativa)
  misc_feature (71): n=a or c
catctcagccagggcgtaccactcacatgtaagtgaagctgtgccacctcgccgaggaattcctcggtcanggcaggcgcgcgagggacgagcggcggcgt

SEQ ID NO: 29522 - DNA, 101 bp, rice(Oryza sativa)
  misc_feature (71): n=a or g
agagaccatggacgacatgatgatcacctgctccaacccctccaaggtgttcgaccaccattccatggacnacatgagctgcaccgacgcggtgagcgccg

SEQ ID NO: 29523 - DNA, 101 bp, rice(Oryza sativa)
  misc_feature (71): n=t or g
gctcagctcccaccaatggcggccgcttcagggagtgagaagatgcgggtgttctttacctcgccaagaanctggacgtcggcgttggggtagctccagca

SEQ ID NO: 29524 - DNA, 101 bp, rice(Oryza sativa)
  misc_feature (71): n=a or g
acgatcagttttaagggtacagagacgattgccaatcaacacatactagcaattaatcttcagagtccccngggtaacataacatcttctaccctataatt

SEQ ID NO: 29525 - DNA, 101 bp, rice(Oryza sativa)
  misc_feature (71): n=a or c
agcattgggagcttgtttgcagccattaatttgctcctcttctttttcagcgagcagtgcttcgtggagtnattaaacgtgtcggcatactgtgctcttgt

SEQ ID NO: 29526 - DNA, 101 bp, rice(Oryza sativa)
  misc_feature (71): n=a or g
gcaatgtgtttttaaactatgcatatgcattgtggcaagatgtatgcatattgtacgtgacgtcttaatcnatgcggattaaactattcttgatcttgatg

SEQ ID NO: 29527 - DNA, 101 bp, rice(Oryza sativa)
  misc_feature (71): n=t or c
gcgatatactcgtaataataatctagtgtgtgtgcatgattccaagtgctatggataaggcgatgcatttngaagaaaaaaaatgagaggaagagacatcc

SEQ ID NO: 29528 - DNA, 101 bp, rice(Oryza sativa)
  misc_feature (71): n=a or c
agaagaagaagaaaaagaatcgtcagagtaactctcatactactactccagtagatggcatttgttttttnctgtgaccattgtccataaaaaagttcatg

SEQ ID NO: 29529 - DNA, 101 bp, rice(Oryza sativa)
  misc_feature (71): n=t or g
acagattaatagcacaagaaattaatttacctgagtttgtctgtcagactatgtgcagagctagacagggntgatggcgtcgtcggcatggtcgccgctgg

SEQ ID NO: 29530 - DNA, 101 bp, rice(Oryza sativa)
  misc_feature (71): n=t or c
ctgagatttgcccaattgcacaccttcaacagttcaactaatgtattcagtatttcagtacatgcaccaantgaatcaataaatattggaatctcaaacta

SEQ ID NO: 29531 - DNA, 101 bp, rice(Oryza sativa)
  misc_feature (71): n=a or g
aataactgctaacacgtactctttcctatgcaaaaaattaatcaacggtttcctcctaaaggagctgacanaaaaaactaatacaacacatatcggagtaa

SEQ ID NO: 29532 - DNA, 101 bp, rice(Oryza sativa)
  misc_feature (71): n=t or c
cgtaagatcgctctcacaccccctaatgcacgtagacggaaatgaaatactacattcacactccctaatanacgatctaaagaggcggaactagtggcaca

SEQ ID NO: 29533 - DNA, 101 bp, rice(Oryza sativa)
  misc_feature (71): n=t or g
ctcaagattcaagaaccttgtcatcttcagtatacgtagcgcttggtatagccggaagtgcgctagtagcngctttctccggcgaactgcgaagccgacga

SEQ ID NO: 29534 - DNA, 101 bp, rice(Oryza sativa)
  misc_feature (71): n=a or c
attgcttaattttaataatcttcttccttatatatatccggcttcacgattttttaagtccttcgcacagnatatctggtttttagaaggacccctatgta

SEQ ID NO: 29535 - DNA, 101 bp, rice(Oryza sativa)
  misc_feature (71): n=t or c
atactcacctattatgcaaactgaatagatttcctctatagcctagcgattgtggcctcttcttctgcttngcatcgcagtggcagtgaacttcgccttgt

SEQ ID NO: 29536 - DNA, 101 bp, rice(Oryza sativa)
  misc_feature (71): n=t or c
acatcaattccagcaaatgacacaaagttgaagctatttgcagcacttgaaatcagacaacagccttcatnagttgattgcttttcttgatcagtcgatgc

SEQ ID NO: 29537 - DNA, 101 bp, rice(Oryza sativa)
  misc_feature (71): n=a or g
actcctacttcagtacccatgcataataaagttattgcagcaccagcatcagctccttcatcaaactctcntgatgttgttctcagtgatccagccataca

SEQ ID NO: 29538 - DNA, 101 bp, rice(Oryza sativa)
  misc_feature (71): n=a or c
atatataatcatagattatttaaagatagtaacatatcacttaaaagccttatgaataagtcacatacttntcgactaaaattacattatctattataagg

SEQ ID NO: 29539 - DNA, 101 bp, rice(Oryza sativa)
  misc_feature (71): n=t or c
ctaatgttgagacggatattgttcagtggaaagatggcaatccttgtacttccctatgtgtcaatatgtgntgaaaaggttctgccatattttactaagct

SEQ ID NO: 29540 - DNA, 101 bp, rice(Oryza sativa)
  misc_feature (71): n=t or c
gtcaccttttgtcctatttgcagttatgatagccaaattctcctcccagtcatccaacatgccattaggantaggctgtgtgacaaaacaatgaattataa

SEQ ID NO: 29541 - DNA, 101 bp, rice(Oryza sativa)
  misc_feature (71): n=a or g
ggtcgagccttccaggaatcaaggagtcaaggataggaagtcgagatgagcacaacggacagacttatggngttaggcaacaaccactagggctaagagca

SEQ ID NO: 29542 - DNA, 101 bp, rice(Oryza sativa)
  misc_feature (71): n=a or c
caaccacatggagcactacaagtggaagcttacttatgaacatgaacaggcgcctaatgttctccctagtnaacgtatccatatccacaacatcgcggtcg

SEQ ID NO: 29543 - DNA, 101 bp, rice(Oryza sativa)
  misc_feature (71): n=a or g
taaatatataggttctaccacaagtaatctaatcaatgaagctactattaattcgtcccgtacaaaggctntgtttagttggatctaaagtttggattttg

SEQ ID NO: 29544 - DNA, 101 bp, rice(Oryza sativa)
  misc_feature (71): n=t or c
agatggcgggtcaatagtaccagagctatctgaatcaacagaaatggtaccctttctgtactttttaccgngactcctgatcctctctcggacattggaag

SEQ ID NO: 29545 - DNA, 101 bp, rice(Oryza sativa)
  misc_feature (71): n=a or g
cggttcctgctccggcgacctcacctctttctcctcaagctccaattaccccttcttcaccagccatgacnaccggcgtcttgccgacaagcggtggcccg

SEQ ID NO: 29546 - DNA, 101 bp, rice(Oryza sativa)
  misc_feature (71): n=t or g
tctttttttctctctcttttttctttcttctctgtcttttcttttttttctcggtgcgtcttttttttttnttttttaagcacctttctgtcttctctctc

SEQ ID NO: 29547 - DNA, 101 bp, rice(Oryza sativa)
  misc_feature (71): n=a or g
atatataaaaatgaagaaaacaaatacatacacgttcacatctagggggacgtatccggcgaaaaccatcnaataagtaaaaacccgtgaaaaccatatct

SEQ ID NO: 29548 - DNA, 101 bp, rice(Oryza sativa)
  misc_feature (71): n=t or c
tcaccatagcgtgatgccagcctcctatcaccattccaaacaccaaacagatggtgaccaattaatccaanggatgccgcaacagcaactgaattgccaat

SEQ ID NO: 29549 - DNA, 101 bp, rice(Oryza sativa)
  misc_feature (71): n=t or c
catctggaggagagcaataggaaagtgtcaatcaaggtcagccaaaaatttcctgaggaaagaaggtttcntatcatcagtccatgttactgaaggtaatt

SEQ ID NO: 29550 - DNA, 101 bp, rice(Oryza sativa)
  misc_feature (71): n=a or g
gattttttttctttttctccactgacatgtgaggccaacttattccacgactgcgagtgctccggcgatgnccggcgccacctcgccgtggccgacgccgg

SEQ ID NO: 29551 - DNA, 101 bp, rice(Oryza sativa)
  misc_feature (71): n=a or g
aaacaaataagttttttttgtcttttttaaagctataaaagccacttttacaccgttaagtcaaaagttangttagataagttttatttggcttatttgaa

SEQ ID NO: 29552 - DNA, 101 bp, rice(Oryza sativa)
  misc_feature (71): n=t or c
cataaacttaacaagtagattctattcatttgatcacctccaaaaaaaaaatggactattgacgaagtacnttggtgtgttagcattgtttttcttcaact

SEQ ID NO: 29553 - DNA, 101 bp, rice(Oryza sativa)
  misc_feature (71): n=a or g
ggatagggaggcaatggatctttagtacgagtagctttcttaacaaaaatgaacttaatttaaagtgcacnagtatgtatgtatatatatgtatgtatttg

SEQ ID NO: 29554 - DNA, 101 bp, rice(Oryza sativa)
  misc_feature (71): n=a or c
taatttatatatactcatgaatatctgtgcaattgtacgtacgtgcatgcattgcagcttgaatattgcgnctttctaatcccttgcggtacaaacacaaa

SEQ ID NO: 29555 - DNA, 101 bp, rice(Oryza sativa)
  misc_feature (71): n=a or c
tctgtcctttgtctgacgactgtgaagaatgaagacaagttggagttcagcaaaatcttggaggccattanggtaagtatctaatgagcttgtgctcatcc

SEQ ID NO: 29556 - DNA, 101 bp, rice(Oryza sativa)
  misc_feature (71): n=a or c
tgtgccaaggtaatttgtacaagatatctggttttgactctcgattgaagggcatcactggttgcccctgnaaaatgcatgaactctttatccctaaagga

SEQ ID NO: 29557 - DNA, 101 bp, rice(Oryza sativa)
  misc_feature (71): n=t or c
gcataagccacacgtaaaacattgtacggaacatttttcccttactcttaggggctatatttttttcaccnctatatatattcaatgaaatagcacaatct

SEQ ID NO: 29558 - DNA, 101 bp, rice(Oryza sativa)
  misc_feature (71): n=a or g
acgttttttttgggaaaaaaggaagaagagagaagagcagcgcaaagtctaattgggctttgtcggttggncctagttatggagattgaaagataggctag

SEQ ID NO: 29559 - DNA, 101 bp, rice(Oryza sativa)
  misc_feature (71): n=t or g
tccggtctgacattcagacccctgggctcgccaatgttgctgcaaccgtaatgaacttccatggtttcgangctcctgctgactacgaaccaaccctcatt

SEQ ID NO: 29560 - DNA, 101 bp, rice(Oryza sativa)
  misc_feature (71): n=t or c
agtctgaacatgatttattcccagtgtgcttatatgttcacatgctgcttttgttttaaccttcctgaagntccaaaggaaggagagaacatacttttata

SEQ ID NO: 29561 - DNA, 101 bp, rice(Oryza sativa)
  misc_feature (71): n=t or g
ggattttgtgtagtagtgtaggtccatgacgaaagggattgctatttactattactatcagtagttgcagnccttgtcatgatcctcatggaattattagt

SEQ ID NO: 29562 - DNA, 101 bp, rice(Oryza sativa)
  misc_feature (71): n=a or g
tggcggattgttgaaatggaggaaagaccggcgtgcagcgaggtgtggtgatgctggtggtgcaaatagcncggcacggggatgacaggagcagtggtggt

SEQ ID NO: 29563 - DNA, 101 bp, rice(Oryza sativa)
  misc_feature (71): n=t or c
aaagaaatgaacaaatcagacattactaacaccctcaacaaaacagacatcgctaacaccctccaccgcgngcggccctccgcaccgcccgcccactgcgc

SEQ ID NO: 29564 - DNA, 101 bp, rice(Oryza sativa)
  misc_feature (71): n=t or g
ctaatccaagtatccaacggcttggagtgatgggcctgttaatattaatttttgtgaaatcaaaggctagnttttttttctcagattttttctaatttatt

SEQ ID NO: 29565 - DNA, 101 bp, rice(Oryza sativa)
  misc_feature (71): n=t or g
cattcctctgggtggtgaggtcgagcgaggggcacaagttatctgaagagcttcgtggaaagtgcaagganaaggggttaattgtgtcctggtgtccccag

SEQ ID NO: 29566 - DNA, 101 bp, rice(Oryza sativa)
  misc_feature (71): n=t or c
tctgttaataaatcattattgtttataatcagctgttaagcaaccgtgagacaaccattcactgtccattnaagtagtcaatttgctgcgaaagggtatat

SEQ ID NO: 29567 - DNA, 101 bp, rice(Oryza sativa)
  misc_feature (71): n=a or g
ccaactatgactattagttagtagcagcggttggggaagcagaatcactctcggtcagcgcttctcaattntcaagccgtttgcaccctcagaaaccacct

SEQ ID NO: 29568 - DNA, 101 bp, rice(Oryza sativa)
  misc_feature (71): n=t or c
gaaaacacccgattaattactctcatgagttaaactcctgagaaacctctcattaagctacgctggtcgtngtcatcggtcttcgcttcacgttctcccat

SEQ ID NO: 29569 - DNA, 101 bp, rice(Oryza sativa)
  misc_feature (71): n=a or c
atattgttatagtatctttgctatgcttacttttgcattaatctgctgcagccagggattccaagttttcnccaacgaatcagttacacaagggaccaact

SEQ ID NO: 29570 - DNA, 101 bp, rice(Oryza sativa)
  misc_feature (71): n=a or g
aagcgaactgacggagataatcgtttggactttcaagctcgggaatgaacggagctggggcggaggagcanagttccaggaagacaggtcaggagctgcgc

SEQ ID NO: 29571 - DNA, 101 bp, rice(Oryza sativa)
  misc_feature (71): n=a or g
gaatgccatcttaagaccattttgtccttaggcttcttcttcctcccatcaatgtaggaaaaactcgcccntggccatcgcaagctatggccgctaacagc

SEQ ID NO: 29572 - DNA, 101 bp, rice(Oryza sativa)
  misc_feature (71): n=t or c
cgttttaggaaaagaacggaaatagaacccgcgaacaaaaacagacacgacttgtcttgcaaaatggaacngcggacagagaggtgagtgaattgggcacg

SEQ ID NO: 29573 - DNA, 101 bp, rice(Oryza sativa)
  misc_feature (71): n=t or c
ctcaaaacatgcctcctatatattggtaaatatccagaggactatgagatcgggagggatgaactagttanggagtggatagctgaaggtattatgggtaa

SEQ ID NO: 29574 - DNA, 101 bp, rice(Oryza sativa)
  misc_feature (71): n=t or c
tggtatagagcaatcctcagaaaacgttcattgttttctaccttccccaggattcttgaaaccttatttgngtgcaaatttataatctgcatatttatggg

SEQ ID NO: 29575 - DNA, 101 bp, rice(Oryza sativa)
  misc_feature (71): n=t or c
ggagggagtattcgtttttaaagtaacagggctgcatgttttactcaaataaatattccctctgtccaaanaagttaaatttctactcttaaaatttgacc

SEQ ID NO: 29576 - DNA, 101 bp, rice(Oryza sativa)
  misc_feature (71): n=t or g
cacgcttatgtggacgggaatcttcgagctgacgaggtgaggccaaccactatctcaccacactgtaaatngcctaagtatagattttaacaatgtgtagc

SEQ ID NO: 29577 - DNA, 101 bp, rice(Oryza sativa)
  misc_feature (71): n=a or g
tttctttactaattctcttcatataattcagggtgttgtcgctgcttgtgaaattgtgaactgcaacagtntagaggtccaatgtgaggtagatgagatct

SEQ ID NO: 29578 - DNA, 101 bp, rice(Oryza sativa)
  misc_feature (71): n=t or c
gagatgtcggcaatcagggatctctgtttggtggaatggataattactggggatttcaacctcatcactgnggccgcggacaagaataacttgagaatcaa

SEQ ID NO: 29579 - DNA, 101 bp, rice(Oryza sativa)
  misc_feature (71): n=a or c
ggtaaaaggtacatcgactagggataagctggaaaaacaattcagctaaccatatagaaaatcagaagacnaatgtatccaacccactcaaatacttttgt

SEQ ID NO: 29580 - DNA, 101 bp, rice(Oryza sativa)
  misc_feature (71): n=t or g
aaggttgtcggaaccgttcgcgtgactgtccaatagcgaacattcatatactagaccctcttggtgtgtantgtcaagtataaccagatctaacgcttggg

SEQ ID NO: 29581 - DNA, 101 bp, rice(Oryza sativa)
  misc_feature (71): n=a or g
aggaggaggtggggattgggaggatgcagcagcggttgtgcgtgtggaaggagacagtgcgccctgtcacngtgacgggcgtagggagaggaagaggagga

SEQ ID NO: 29582 - DNA, 101 bp, rice(Oryza sativa)
  misc_feature (71): n=t or g
tgttcttgtaattacatgctactttttttttgactcagcaatgccaatgcaaactctcgacaaaaccaatnctgtgaaagctgttcattctgaagataatg

SEQ ID NO: 29583 - DNA, 101 bp, rice(Oryza sativa)
  misc_feature (71): n=t or c
tctggagaaggccaaagaatatttcaagctccatgcagtgtaccagtgccaacagatggatcactgtatgngatgactctggtgggtgtgttgattgtccc

SEQ ID NO: 29584 - DNA, 101 bp, rice(Oryza sativa)
  misc_feature (71): n=t or g
tacagtaatgatttatttcgtttcatgtatcaccaaatatatgggccgaactattaggtctaactcggggncttctagttagcgcacctgcgccggtaatg

SEQ ID NO: 29585 - DNA, 101 bp, rice(Oryza sativa)
  misc_feature (71): n=t or c
caatttgcgtacatatccatgagggcattctcaagcaacatactggagcacatccttcttctcttgataanttcatggatccgttttcccagtgaaagggc

SEQ ID NO: 29586 - DNA, 101 bp, rice(Oryza sativa)
  misc_feature (71): n=a or c
accgagggctcaccggttcgacttctggtccagtgctaataactatgatagagagaattgcttaaggcagntagttgtattactaaaatgtcccattttta

SEQ ID NO: 29587 - DNA, 101 bp, rice(Oryza sativa)
  misc_feature (71): n=a or g
ctaatttccccttctctgttaattcagctacatcatcggtagccgcatttgttgttttttcgttcatcatngccacagcactctatctttcactgaagtca

SEQ ID NO: 29588 - DNA, 101 bp, rice(Oryza sativa)
  misc_feature (71): n=t or c
acaagcagagtcctgcctatcaaacatggtatcatgagccgataatcagtttgattccacatacaggtaantcataattaatgcaaatgtcagaagcaaga

SEQ ID NO: 29589 - DNA, 101 bp, rice(Oryza sativa)
  misc_feature (71): n=a or g
tggatctctaagtcccatatggcacccccaaacagctctacaatctattgttatatctaccaaccgtattncagggaagctacctgccaacttcagcgcaa

SEQ ID NO: 29590 - DNA, 101 bp, rice(Oryza sativa)
  misc_feature (71): n=t or c
gagtaggcttttggtgtctggtctgcagtttcttttaatgctcttctattaagtacatggcaaaccatctnagaaatgagtgtactagaattcatacaacc

SEQ ID NO: 29591 - DNA, 101 bp, rice(Oryza sativa)
  misc_feature (71): n=t or c
tgtacgttaatgggccagaaagtgcacttgcaagttgcaacccataggttgcacacggcccacctatggcnaaatggaaaaagtatatttaaggtctctca

SEQ ID NO: 29592 - DNA, 101 bp, rice(Oryza sativa)
  misc_feature (71): n=a or g
ggaggtggagaagttgaagaaatcgttttcaattcctctgtaagagctctttttttttgtcaccttctccnccaaatgaacgagaaaataaagcagcccaa

SEQ ID NO: 29593 - DNA, 101 bp, rice(Oryza sativa)
  misc_feature (71): n=t or c
tcagcaagaacccacggatcatccttgtgtcctagcatgctacgatccacaaccatcaggccgtagtcatngatgaatacgcctgttctgttctctgatcc

SEQ ID NO: 29594 - DNA, 101 bp, rice(Oryza sativa)
  misc_feature (71): n=a or g
tgggcaggcggaacagctagcatccagcgagagagaagagaaaaaccccggaaaacgctggaaacggaggnggggggggtcggggaggtggtggtgcagcg

SEQ ID NO: 29595 - DNA, 101 bp, rice(Oryza sativa)
  misc_feature (71): n=a or c
aaatcaacatccattcctgggagctccaggtttgacaagtccggcatttctgcgtcattcgatgcatttgntggttcctcatgcctagcactagcagcaga

SEQ ID NO: 29596 - DNA, 101 bp, rice(Oryza sativa)
  misc_feature (71): n=a or c
agcgtcagggacacgttgttgatggaccacctgtagcgcccgtccatgaggttctgcgtgttgagcaggangatctgccggtcggcggccgccggcggcgg

SEQ ID NO: 29597 - DNA, 101 bp, rice(Oryza sativa)
  misc_feature (71): n=t or c
atctctacacgatagcttaattatatatatttgccgtgacaaagcgtgagtcagtaattagaagggcaacnaattcaacagtgtttcgtaaaaaaaactta

SEQ ID NO: 29598 - DNA, 101 bp, rice(Oryza sativa)
  misc_feature (71): n=t or c
aggacctttatgtcggtgatcacaatcttgttccttcaccactcctctctcccctctctctggtggtaaancggaggcaaatgagagggtgcctgatccac

SEQ ID NO: 29599 - DNA, 101 bp, rice(Oryza sativa)
  misc_feature (71): n=a or c
atcattcacataaacattgatcaaagaaatcattcacagaacattgccaccgggccgccagatccgacggngggagggcgccgctgccaggccaccaccgc

SEQ ID NO: 29600 - DNA, 101 bp, rice(Oryza sativa)
  misc_feature (71): n=t or c
gctgtctacaatgcattgattaactagtcaggagtattagtcaacactttaataaatatgatcaagtctgnggttgatggtacaattgctgaacatcaagc

SEQ ID NO: 29601 - DNA, 101 bp, rice(Oryza sativa)
  misc_feature (71): n=a or g
tcgtgtcgtcgtcgatgctgggccagcagcgagctagccgatgcaagagaggagatgggaggagggatgtnggtggggcctacggttggccagtgattttt

SEQ ID NO: 29602 - DNA, 101 bp, rice(Oryza sativa)
  misc_feature (71): n=a or c
cagccaacacccctgtctccgtaataggcacatgatcatctatagattttggtagtgattgtttcatgggnaaagaatgattaccacctgacgaagaatta

SEQ ID NO: 29603 - DNA, 101 bp, rice(Oryza sativa)
  misc_feature (71): n=t or c
gctcatgtggtagaagctaacagtagcatctgtaactgaattactacctctctggtaactgtagccatgantgccaatctcttgagggaggtaatcatgcc

SEQ ID NO: 29604 - DNA, 101 bp, rice(Oryza sativa)
  misc_feature (71): n=a or g
tcaaaggccctctattctcaataagatgacaactgaaatggagaatcctcagatttctcaggaaacttctnagaaagtcattcattcagtggaaagcaatg

SEQ ID NO: 29605 - DNA, 101 bp, rice(Oryza sativa)
  misc_feature (71): n=t or c
ttggcacataatagtctccctgtaaggatgaatatcaaataaaggggaattgatgcagacacgctatgccnggtatgcaagcgttttgatgaggatggcgg

SEQ ID NO: 29606 - DNA, 101 bp, rice(Oryza sativa)
  misc_feature (71): n=a or c
agacattgataaaaatagcgtccgaaagtggatgctctttccaacggcgtccttactaattttctaattcntgccttctatttattacttgtttaattttg

SEQ ID NO: 29607 - DNA, 101 bp, rice(Oryza sativa)
  misc_feature (71): n=a or g
taactactaggagtgctgcttaattattatagggatggcaatggaattgatcgaatgtgccatgaaattanaagggccaacgcgagcgccgcgagagcggc

SEQ ID NO: 29608 - DNA, 101 bp, rice(Oryza sativa)
  misc_feature (71): n=a or g
catatgagaaaaggttggaaattctatgcctagagtggaggtataccataggtccttgtagaacaaagccntctttccaccaaaatgagcatttctgaaat

SEQ ID NO: 29609 - DNA, 101 bp, rice(Oryza sativa)
  misc_feature (71): n=t or c
attggataagacatacttcaccttgcatcccctcttcactaacccctattattctctccctatatttcccnctcaacaccaccctattaggcaacccatcc

SEQ ID NO: 29610 - DNA, 101 bp, rice(Oryza sativa)
  misc_feature (71): n=a or c
cactagaagagaacaaatatgccactgctagcttgttgtatgtgtgagtttcctcctgtgcaatgaccagnagctggaatatactggtttgttacatgtgt

SEQ ID NO: 29611 - DNA, 101 bp, rice(Oryza sativa)
  misc_feature (71): n=a or c
tttcgttgtaaaggtgtggccctccactgtagttggatagttgagctataggaatgctttcttggtcgttnctcctcgtagtacaatttatccaatctttt

SEQ ID NO: 29612 - DNA, 101 bp, rice(Oryza sativa)
  misc_feature (71): n=t or c
tcctacaaaataagctatcttacaaatattggaagcgctatatatctaacactatcaagcatggtgtcctnctgaggctaagcaatagaatttttgcatga

SEQ ID NO: 29613 - DNA, 101 bp, rice(Oryza sativa)
  misc_feature (71): n=t or c
cctacttggaagcatgatacaactaagctgatccatctaattctccatgcaattgcccttgtattcggtgnggttgggatatactgcgctttcaaatttca

SEQ ID NO: 29614 - DNA, 101 bp, rice(Oryza sativa)
  misc_feature (71): n=a or g
taatcgtccgtgtattgtgccagtgtgccactcctttgaagattaatgtagtactagaaaacatgctcatncgttgcacgggtaaaatatttttggattac

SEQ ID NO: 29615 - DNA, 101 bp, rice(Oryza sativa)
  misc_feature (71): n=a or g
tacattttttgtgtgtaaaaacaattgtacagaattttagatgaaaaatatggcagcttgtcccttgttcnaatggggccttacgtaaccatcattttgct

SEQ ID NO: 29616 - DNA, 101 bp, rice(Oryza sativa)
  misc_feature (71): n=t or g
atagatgaacgaccagaaatgagagaagtagccgaacaactggtgatgcttaaaatggcttggaagcagcncaaaggaaacatataagttgtcactttcaa

SEQ ID NO: 29617 - DNA, 101 bp, rice(Oryza sativa)
  misc_feature (71): n=t or c
tgtgccgaatttctaactatctgatttgcctactattagatgtgctctggagatgatattgatggagacangagggttgaagcaacacaacacagggatat

SEQ ID NO: 29618 - DNA, 101 bp, rice(Oryza sativa)
  misc_feature (71): n=t or c
gggtgttcttggagagtttcttgtggtgattctggctgtgggatttgtgcaggaagtaacaggatggcgangatggtggtggaggctccggcgcgtccggg

SEQ ID NO: 29619 - DNA, 101 bp, rice(Oryza sativa)
  misc_feature (71): n=a or c
gcttcactacaatgagatgatggaagcatgccctaaaccagttgagtggattgaagacttccacaaacacntgtgggctagaagtgaattctctactgcta

SEQ ID NO: 29620 - DNA, 101 bp, rice(Oryza sativa)
  misc_feature (71): n=t or c
gaataatatttctatctctccatcacgatccatttgaaacgttctccctccgtctaaaatacaataacttntgtctacgtatccgaacctagtgtatatct

SEQ ID NO: 29621 - DNA, 101 bp, rice(Oryza sativa)
  misc_feature (71): n=t or c
tttcttatctaaaaaaggatgcccatgattgctagaagctacaattgaactatggaagtcccaaccctcgnaaaagtaactttgttttaatagtacaaaga

SEQ ID NO: 29622 - DNA, 101 bp, rice(Oryza sativa)
  misc_feature (71): n=a or g
catattgatccactgtgcagccttcagcagagtccgacgttagaatggtgcttagcgcttctgcaaatgancacgcgagaatgtgaccacatcagaagagg

SEQ ID NO: 29623 - DNA, 101 bp, rice(Oryza sativa)
  misc_feature (71): n=a or g
tggataagatatgatcttagtacaataaaatcgggatatacctgtctgttcacattcattgtaataggatntcgtatccaactaaaatctcttatattatg

SEQ ID NO: 29624 - DNA, 101 bp, rice(Oryza sativa)
  misc_feature (71): n=a or g
catggtatgaaactacgtcacaacaagaagaggcttcatattatttggtcacacgacaatataagcagggnacaggcaaactagcgacgatgacaacacag

SEQ ID NO: 29625 - DNA, 101 bp, rice(Oryza sativa)
  misc_feature (71): n=a or g
gagaagagacaagagacaagaaaagttatagatttatagttggctgcaacacaagctctaataactatgtnagagatggatggattaggtattaatgatgc

SEQ ID NO: 29626 - DNA, 101 bp, rice(Oryza sativa)
  misc_feature (71): n=t or c
gcgttatggactcatctatgtcaaataagtaggcgcatggctgattagttccctccattactagccaatgntgtatccacggctcttgctgaagttacagg

SEQ ID NO: 29627 - DNA, 101 bp, rice(Oryza sativa)
  misc_feature (71): n=t or g
ttccacggggactgcaggggatatcctatccatgtcatccttggtgactttaagtgtcaagggtactcttntttttttttttatcaaagggctttagccct

SEQ ID NO: 29628 - DNA, 101 bp, rice(Oryza sativa)
  misc_feature (71): n=a or c
agcagtaccgatcctggatgttagcggatgctattgttgaaacccgttttgattttcggtaaaaacaattnccgtaatactttaattatcccatgtttatc

SEQ ID NO: 29629 - DNA, 101 bp, rice(Oryza sativa)
  misc_feature (71): n=a or c
ctcatctgtctaactctcattaattagcacaccgattgcctgctttaccttcatattctatggaggccatnagtgctgttaggaaaccattggacttgggc

SEQ ID NO: 29630 - DNA, 101 bp, rice(Oryza sativa)
  misc_feature (71): n=a or g
tgtaggtacaaaaagtaatggagatagtagctcagacagtgagtacctacctggtgattcatcttcttctngtgatgatgaagaggctgacgaaattgaga

SEQ ID NO: 29631 - DNA, 101 bp, rice(Oryza sativa)
  misc_feature (71): n=a or g
atgtgagtatagtggttacatggacaatctcgcgacaaatggagtgaactatctgcatatccgagagatgngatagtaaccgattttataggaacgaaata

SEQ ID NO: 29632 - DNA, 101 bp, rice(Oryza sativa)
  misc_feature (71): n=t or c
tggataaagggatagagggaaagctggctggacttattagctaggtcgaggtctacatgtgggtttttttncccgtgaaagtaattttaatttcaattatt

SEQ ID NO: 29633 - DNA, 101 bp, rice(Oryza sativa)
  misc_feature (71): n=t or c
ttctgcacctagtgtacgcattttggcaaggccagtttggtagtttggaccacctctccgaacgtaaatgntcatccgtgcagccttcaatttggattcct

SEQ ID NO: 29634 - DNA, 101 bp, rice(Oryza sativa)
  misc_feature (71): n=a or g
tgtataattgttggaatgaagccatcatatatatcgatcctaagctatagctgcagattaattattgaatngctagctctacttgtttttgagaggcggct

SEQ ID NO: 29635 - DNA, 101 bp, rice(Oryza sativa)
  misc_feature (71): n=a or g
gacggacatggctggagcctgccgtgctgctgggtttcagcgagttgcgagggattcgccctgattgcgantgagacagagagagagatgaattggaaggg

SEQ ID NO: 29636 - DNA, 101 bp, rice(Oryza sativa)
  misc_feature (71): n=a or c
tacctccagctcgacctcatccgaggacgactccgccaagctttcagttctcagtgcttagagttgtagtngttgttgtgtgtcagacctgttgtatcgat

SEQ ID NO: 29637 - DNA, 101 bp, rice(Oryza sativa)
  misc_feature (71): n=a or g
atcctgcattttgaaatggagcgaatattatcaatcaccttgtcaataatcaacagtaaggtagtgcttgnctatgtgttactagtacaacgctgcttgat

SEQ ID NO: 29638 - DNA, 101 bp, rice(Oryza sativa)
  misc_feature (71): n=a or c
tcggtgcagtactgcggaacgcggaaggagaagtaatttttgcagcgtctggatttgtggatcgctacggnagtgcgctggaagctgaactcctctcttgc

SEQ ID NO: 29639 - DNA, 101 bp, rice(Oryza sativa)
  misc_feature (71): n=t or c
caaaaatagtgcgtgtactaaataagagaggggaacgtcaaatttagctttcctctctcctcacgtcctancgtaaccgccgcagctcctgcccccatccg

SEQ ID NO: 29640 - DNA, 101 bp, rice(Oryza sativa)
  misc_feature (71): n=t or c
aggaggcaaaggcatccaaatattactcttcatcctaaaattaagtgcatccatgggtatccgtgttcaangttgaccatccatcttattagaaaaattta

SEQ ID NO: 29641 - DNA, 101 bp, rice(Oryza sativa)
  misc_feature (71): n=a or g
tttcagacgcgctacaggcgtgcttttgacaccctgttcctgctggtaagctggttaatatggaaagaacncaatgctagagtctttgatcaaaagagcaa

SEQ ID NO: 29642 - DNA, 101 bp, rice(Oryza sativa)
  misc_feature (71): n=a or g
ggggtgggatgttttgttgggaatgcactcctagctatgtactttaaatgtgggaacatggaggatgctcngaatgcattcgaggaaatggaagagaggga

SEQ ID NO: 29643 - DNA, 101 bp, rice(Oryza sativa)
  misc_feature (71): n=a or g
tgatttgagtttttcatggttgtctttgcaggtgtctcttctcatttggattgtgaaggtcagttctgtgnattggaaaacctgttagatgccaaggtatg

SEQ ID NO: 29644 - DNA, 101 bp, rice(Oryza sativa)
  misc_feature (71): n=t or c
agtaatcttttggagttctcaggagagaggggccgcattgtataaacatcatcagcacttgatgcaacttnaaatatacgggttgttgtgattactctact

SEQ ID NO: 29645 - DNA, 101 bp, rice(Oryza sativa)
  misc_feature (71): n=t or c
ccctcggttgatcatgatactgcactctttttcatacaacaatataagtatttatagattggtatgtactncctccgtaaaaaaacaactctggagctgtc

SEQ ID NO: 29646 - DNA, 101 bp, rice(Oryza sativa)
  misc_feature (71): n=a or c
acttttgtctagagaatgcgttcagtttgtgcagttcggtttgtgtatataagtacacactactaaaaaanaccctcataaagaatggctcatatgtgtcg

SEQ ID NO: 29647 - DNA, 101 bp, rice(Oryza sativa)
  misc_feature (71): n=t or c
ctgtgcagctcctctatgcttataccaccgaagttaggcctctcttcatgcaacatcatatccgcatagtnattgtcagcagtcagcagctccatagcatg

SEQ ID NO: 29648 - DNA, 101 bp, rice(Oryza sativa)
  misc_feature (71): n=t or c
aaagtttttatattttgatatcgagtcagtacgtcttattgccaaatgattgatactggtgttttgccatnatcaccaccactatcacataaaaccatgat

SEQ ID NO: 29649 - DNA, 101 bp, rice(Oryza sativa)
  misc_feature (71): n=t or c
gtcgccgggagagaggatcgggagagagaaggataaagtgtgagggttagggttagggttttctcccgtcngcatcttcagcggcgcagaggcgatccaag

SEQ ID NO: 29650 - DNA, 101 bp, rice(Oryza sativa)
  misc_feature (71): n=t or g
tagggatctccaaagatggcttcttcaggaagggaggaaccggtgactggagcaatcacatgtcaccaganatggcagcgaggctggacaagatcgttaag

SEQ ID NO: 29651 - DNA, 101 bp, rice(Oryza sativa)
  misc_feature (71): n=a or c
gtcgtcgagccgcggtcatctcctcccttcatgcgttcccttgtctactcaggatgccggcttcattcctntaagtttcatcccatttggtgcagcggatc

SEQ ID NO: 29652 - DNA, 101 bp, rice(Oryza sativa)
  misc_feature (71): n=t or c
atcagcttcctcagagtctccttccaagtgaaatgatttccttttacgtgcattcctcatgttttcattgnatgttttccactttgagacttctcggcata

SEQ ID NO: 29653 - DNA, 101 bp, rice(Oryza sativa)
  misc_feature (71): n=a or g
atcttgcaaagaagctgtggagggcttgtcaaatagattaaataaataggtgtatcgaatagatgaataancaggtgtatcgaatagatgcacctaatagg

SEQ ID NO: 29654 - DNA, 101 bp, rice(Oryza sativa)
  misc_feature (71): n=t or c
atcaggcaagccacatacagatagactaggaggcaccactcgccccgacactgcttgtccaggcaactgcnatctatcatccaccacgctatcgccataga

SEQ ID NO: 29655 - DNA, 101 bp, rice(Oryza sativa)
  misc_feature (71): n=t or g
ccatcaaatatgtgcacatgtgctcttcagtggtagcatagggtatagattatttgactgtacgattggangggacaactcctcttttttatattactata

SEQ ID NO: 29656 - DNA, 101 bp, rice(Oryza sativa)
  misc_feature (71): n=t or c
gttagccagagtggtggaccaagtgaaggatctgaagaggaaagcaagtgagatcacacaaagaacacctntccctccagagaccaacgaagtctccatcg

SEQ ID NO: 29657 - DNA, 101 bp, rice(Oryza sativa)
  misc_feature (71): n=t or c
gaccaaacagtgcaaagttccgtagcctgataatgatgccatgttaaaattctcacttctcatgtggagtntctcttcggagctggagctggaggccctgg

SEQ ID NO: 29658 - DNA, 101 bp, rice(Oryza sativa)
  misc_feature (71): n=t or g
tgaatcctctcttcggccaagctatttcagaaaagctgacgaagaacaatttctcgctatggaagacgcanattctcccagtgatttgcggcgcacgtatg

SEQ ID NO: 29659 - DNA, 101 bp, rice(Oryza sativa)
  misc_feature (71): n=a or g
ggttcaaaacttcattgcaaaggacgacttggagaaatcgggacatgtccaaaacaattgcttcgctatcngggtccatgtggtaatcaccaaggaagtgc

SEQ ID NO: 29660 - DNA, 101 bp, rice(Oryza sativa)
  misc_feature (71): n=a or g
atgcctcaggagcacagttccagccacagaggcaagatcatatagagaagtggaatgctcaggacatcatnaaatggcgagatactacatcaaaatatctt

SEQ ID NO: 29661 - DNA, 101 bp, rice(Oryza sativa)
  misc_feature (71): n=a or c
acaatgacttacattgtgaaacggatgaagtatagtcaatcctgtgccttcgatgtcaaccaagtcctganccagtgaacctgaactgaactccatgggat

SEQ ID NO: 29662 - DNA, 101 bp, rice(Oryza sativa)
  misc_feature (71): n=a or g
atgctgaacacccacggtagagcaaggaacggaagcaaggcagcgaaggcctcgtcaaacagctagacttntagggctttggagacattgcaggagtccat

SEQ ID NO: 29663 - DNA, 101 bp, rice(Oryza sativa)
  misc_feature (71): n=a or g
gccttctttatgtgttgtagatggattacactatgctaagggatgtgacacaggaatcacaccgttggcangtccgagtgcgggtcactcgcttctcgcag

SEQ ID NO: 29664 - DNA, 101 bp, rice(Oryza sativa)
  misc_feature (71): n=t or c
tgttcttgagccatcgacttatcaggaggcaatagctctgccttagtggcaattggctatgtaaggggaanttgatacactagagcatactagcacatggg

SEQ ID NO: 29665 - DNA, 101 bp, rice(Oryza sativa)
  misc_feature (71): n=a or g
cgcctttccaccggtgaaggtatagtagcccttgtacttgctgacaaactcgcctgatggccttgttcttncggcaaactcgtaatctacagtaacactag

SEQ ID NO: 29666 - DNA, 101 bp, rice(Oryza sativa)
  misc_feature (71): n=t or c
gcgcccactattcgagatggtcctcgcctcgcaaacaacgataccaagtactgagcatgcacttggcatgnagaccaccgccagtggcatagatttccacc

SEQ ID NO: 29667 - DNA, 101 bp, rice(Oryza sativa)
  misc_feature (71): n=a or g
cctactgatcatattcatatgtgtcatgcaaccttctgctctattgaataaaatagatagtactccctccnttttacaatgtaagtcattctagcatttcc

SEQ ID NO: 29668 - DNA, 101 bp, rice(Oryza sativa)
  misc_feature (71): n=t or c
gacaattagagtcaaagcatgtctagccacatcatccctacttacactaccaaaatggattactattccangtgcgacaacgctaaaaagtatgtgtaagg

SEQ ID NO: 29669 - DNA, 101 bp, rice(Oryza sativa)
  misc_feature (71): n=t or c
catggctgcacttattttgggacggaggtaatactacttccgtcttattttaagcgcagttgtagatttcngtatccaatgtttgaccatccgtcttattt

SEQ ID NO: 29670 - DNA, 101 bp, rice(Oryza sativa)
  misc_feature (71): n=a or c
gaattagcagttgtaacattggtacaatgcatttctctcagttaaaaatggttttatggttactggttagnagaaattgatcttttatactgaaaaaatca

SEQ ID NO: 29671 - DNA, 101 bp, rice(Oryza sativa)
  misc_feature (71): n=a or g
gcatttttatggacagagagaccgtagaaaattggaacattttatatctgaactgccttagtcgcctggcngaaatctgcatgtttagttgataagactta

SEQ ID NO: 29672 - DNA, 101 bp, rice(Oryza sativa)
  misc_feature (71): n=a or c
ggaaatggaccatgtatggatgcatggatttcatttatttcctccattgctttcgccaccgccatcagatnacgtcacgcgttatttccatgcacgctgca

SEQ ID NO: 29673 - DNA, 101 bp, rice(Oryza sativa)
  misc_feature (71): n=t or c
tttcaaaaagcgactaagctaaccacctagaggtaagtatacctacgaaaatggtcatcattttcgaagcnagttgctcagccataagggcgatagcagtg

SEQ ID NO: 29674 - DNA, 101 bp, rice(Oryza sativa)
  misc_feature (71): n=a or g
gatgtcaatgttcttcttgagcacctcaaggatgttttcggcttcctctttgcccagatcgcccccagcangacaagctttgtgggatcggcgtcgtcgat

SEQ ID NO: 29675 - DNA, 101 bp, rice(Oryza sativa)
  misc_feature (71): n=t or c
aaatgaagcatattcatatcagtaattcgtcgagtcagaccccaatgcaaaagtgtctgaagttagtttanacatataataattcaatcttgtagtttgat

SEQ ID NO: 29676 - DNA, 101 bp, rice(Oryza sativa)
  misc_feature (71): n=a or g
cattgcactgtattgctataggccagagtttgggttcattttgaaacagcagtcatgggataatttaaccnacaataaacaaagttagctggtaattctac

SEQ ID NO: 29677 - DNA, 101 bp, rice(Oryza sativa)
  misc_feature (71): n=t or c
tagtacatacaaggaaacacgattttacttgtgctagcaatttgcagaagtgtacttactgaagagtgctngatctaggcttccattttcaaggtactcat

SEQ ID NO: 29678 - DNA, 101 bp, rice(Oryza sativa)
  misc_feature (71): n=t or c
ggggctcagataagtacactgctaagaaattctataagttaaattattcttcattgcaaccccccagaccnatgatttggctatggaaaacaaaatgtgtc

SEQ ID NO: 29679 - DNA, 101 bp, rice(Oryza sativa)
  misc_feature (71): n=a or g
gtcaaacttgccaacgggagggccttgaacaagagggatcttggtgatcttgacgtcgcagagatatagantcttctagaatgcgactttgtttatatacc

SEQ ID NO: 29680 - DNA, 101 bp, rice(Oryza sativa)
  misc_feature (71): n=a or c
ccgccggccgtggggtggaggtggtacggctgcgggtggatggggaagccgcgtgggtcatgcatgttttngtcgtggtatggatccatagatggtgcgct

SEQ ID NO: 29681 - DNA, 101 bp, rice(Oryza sativa)
  misc_feature (71): n=t or c
gttatcttagacgctaaatcctattttgatgagttgcatagtattttccctgggaagaatgtgctggacantgaaggtcacaatggaggaagaagaacaga

SEQ ID NO: 29682 - DNA, 101 bp, rice(Oryza sativa)
  misc_feature (71): n=a or g
gatattgttattgtcacatgcttgggtctcgaagaggtcagtcctatagattttaatggaacacctgcctntcctgatggtagtcctcttctagctgctgg

SEQ ID NO: 29683 - DNA, 101 bp, rice(Oryza sativa)
  misc_feature (71): n=a or g
ttcctatggtggtttttcaatcgtctaatatatatttgggaatcttgaatttggtacatagtttgtttgtntcgattggtttttttatagatctatttatc

SEQ ID NO: 29684 - DNA, 101 bp, rice(Oryza sativa)
  misc_feature (71): n=t or c
taagcacataagtttcaatataagaaatctaaccggtttagtttaatatgcatgtttgcacagtccggctnacgaacactaaataattaattaattacaat

SEQ ID NO: 29685 - DNA, 101 bp, rice(Oryza sativa)
  misc_feature (71): n=t or c
ccgcgcacattgaccatttgccagaagattcctctcatggaagcatcggtgtaatcatcatctaccacacngctgtcctcgtcggcgtccgtcctgccggt

SEQ ID NO: 29686 - DNA, 101 bp, rice(Oryza sativa)
  misc_feature (71): n=a or c
aagctaaaagttttcaaatcaatgtttaaagttttaaatctggactttgagagttttcaaatctacattgnaagttttcaaatcttgacttgcaagttttt

SEQ ID NO: 29687 - DNA, 101 bp, rice(Oryza sativa)
  misc_feature (71): n=t or c
ccatgcccattagcattttccgatacccaacgataaaatcacgtcgaaggaaaccactttgtcttcttcgncgcaacagctgctcgttccccatttcatgc

SEQ ID NO: 29688 - DNA, 101 bp, rice(Oryza sativa)
  misc_feature (71): n=t or c
acagccagcggcttggagacattgaggctttcgggaaaaggtcatcgatatagaaacccaaaggctgggcngagaacgcgggacggcatgggtgtagccca

SEQ ID NO: 29689 - DNA, 101 bp, rice(Oryza sativa)
  misc_feature (71): n=t or c
gtcgtcgtaattttagccgccacctcatcctccatgtttccctccttcccatgtcatcaatctgaccaaantcgtgtaggcctcgttttatagtgggattt

SEQ ID NO: 29690 - DNA, 101 bp, rice(Oryza sativa)
  misc_feature (71): n=t or c
ttgtgtccagagggcacagatcggctagttccaagccaattgcacaggttttagctcattgactgacaaancaatgtttggataactgagatgggagatgg

SEQ ID NO: 29691 - DNA, 101 bp, rice(Oryza sativa)
  misc_feature (71): n=t or c
gacaagcctccaagagacctacgagaatttcagctagggacgcccatagtggataaggtcttgtcagactntgagagccgaacgaccatgtaagacctggt

SEQ ID NO: 29692 - DNA, 101 bp, rice(Oryza sativa)
  misc_feature (71): n=t or c
gcaagcatttaaaaatataccactccatctgtctaaatttaattttgcaagtctcttacaagctataggangtatgcaaatcgtcgcaaatatcaatcttg

SEQ ID NO: 29693 - DNA, 101 bp, rice(Oryza sativa)
  misc_feature (71): n=a or g
gattgaatggtgggaaaagaggacatcccagcaggacaagagacaaacaaagggattgcgatcgctacacntgcttctctgttgggaagtatggtgtgaaa

SEQ ID NO: 29694 - DNA, 101 bp, rice(Oryza sativa)
  misc_feature (71): n=a or g
attttacgtgcccttgaaccatttttggtgcgtttgatggatgcagacgctggtgctgaacacggtgaacnacggggtggtgagcgggatcacgctgctga

SEQ ID NO: 29695 - DNA, 101 bp, rice(Oryza sativa)
  misc_feature (71): n=t or c
acaatgtttttgttacggttgttgcatccattcaatatcgagcaatggaggacaaagcaagcgatgcatantacaagctgagcaacccaaaatcccaaatc

SEQ ID NO: 29696 - DNA, 101 bp, rice(Oryza sativa)
  misc_feature (71): n=a or g
atattttttttaataataccatggccctaattttaaacttctaaaactctttttaatctgctacagattgntagctaaagttagaacatactaggagaaat

SEQ ID NO: 29697 - DNA, 101 bp, rice(Oryza sativa)
  misc_feature (71): n=t or g
tataactcgtggaggaaaaagattggagaagcatactgaatttgagaactactagggtagtattaacgaangcaagaatggcccatttgtgagtagtactg

SEQ ID NO: 29698 - DNA, 101 bp, rice(Oryza sativa)
  misc_feature (71): n=a or g
aatttgttcgtatttacgactaattattcttttagtggttgatgacgtaccccttgatggtgaggtgtacncggtgactttgtcaatccaaggatatgcag

SEQ ID NO: 29699 - DNA, 101 bp, rice(Oryza sativa)
  misc_feature (71): n=t or c
aatctagggagcaatttttgcatgtgggagaagttatgcctcgcctacaatctaaaggggggtcttgttcnaaaaagtagtaaaatatatatttgtgtatt

SEQ ID NO: 29700 - DNA, 101 bp, rice(Oryza sativa)
  misc_feature (71): n=a or g
ctcaatgcatcgactcgatgaattgagccgatttttttttctcatggacgcctcaaaggtgccagttttgnaactagcacctttgaccctgggtaatcagt

SEQ ID NO: 29701 - DNA, 101 bp, rice(Oryza sativa)
  misc_feature (71): n=a or c
caccaacttgtaagcactttgaatagagaagagacctgacttttcataatgccacgcaagaaaatcctgtntgatattgaggcagtttaattttgagaatt

SEQ ID NO: 29702 - DNA, 101 bp, rice(Oryza sativa)
  misc_feature (71): n=t or c
tcatctcgtttctccggtagagttgcttggacaaaacggcggatattgcgggtgccgaagaggcgctgcgngttgaggagccgtaccttctcgtccccatg

SEQ ID NO: 29703 - DNA, 101 bp, rice(Oryza sativa)
  misc_feature (71): n=a or g
caaaccaaacaactcatctcacaggctgcctggcgaagcaaatgtcttcaaacttaaaggctagcttcagncacgagttttcatcacgcatgtgtcaagtc

SEQ ID NO: 29704 - DNA, 101 bp, rice(Oryza sativa)
  misc_feature (71): n=t or c
gtcgcagcatcactctcctatacagcagcatccacagcagcctcaggatcagtcccctctgactcaacatntggcacctcatccccatcatcatcatcatc

SEQ ID NO: 29705 - DNA, 101 bp, rice(Oryza sativa)
  misc_feature (71): n=a or g
aagtcgaatcctatctttgtttatgtagccaccatattgagatcctcctagtaaccacagatcaatctcgnggacccggacacacggcatatcctcgacgt

SEQ ID NO: 29706 - DNA, 101 bp, rice(Oryza sativa)
  misc_feature (71): n=a or g
ttctatcagactttaaatattggtactctgtacaagtatgctgcgtattatcaatttgctctcctgtcagntcatccttattgatcttttttgttggcctt

SEQ ID NO: 29707 - DNA, 101 bp, rice(Oryza sativa)
  misc_feature (71): n=a or g
tactggtggaaacacaagatacatgagaaacttacggtgattagctgacgagaatctaatatattgacgtncaatccttttgcgtgttcgcgaaaaaaaaa

SEQ ID NO: 29708 - DNA, 101 bp, rice(Oryza sativa)
  misc_feature (71): n=a or c
gcttggctacctggactgctcaattctgttcagaccatcagcctagttaccatagacttgatgagaaaaantaattttctatgtcacaccatgccccaaaa

SEQ ID NO: 29709 - DNA, 101 bp, rice(Oryza sativa)
  misc_feature (71): n=a or g
gctcaggactcgtctgtgtccgaatatgttgaaaaatttgatggcatcatgcatcagttattggcttacancagttccctgcctctgaattactttgtgac

SEQ ID NO: 29710 - DNA, 101 bp, rice(Oryza sativa)
  misc_feature (71): n=t or c
ctatgtcggccttcttctccagctcaagaagcttggacttggccttctcaagtttggccttcttcttgtcnagctcagggccaatgtattggctcaaatca

SEQ ID NO: 29711 - DNA, 101 bp, rice(Oryza sativa)
  misc_feature (71): n=a or g
cacggcattctttagccacaccgtcaccctgcgacatcaatccttggcggcatacgaacaggaattgatcngcctcatcctcgtcatccgctaatggagac

SEQ ID NO: 29712 - DNA, 101 bp, rice(Oryza sativa)
  misc_feature (71): n=a or g
cccatcaggacctggggttttgtcaccaggcattttcctcaagacaccatcaatctctttggttagaattngtgcacacagagtagaaaggtcccccttat

SEQ ID NO: 29713 - DNA, 101 bp, rice(Oryza sativa)
  misc_feature (71): n=a or g
gcctcattctcccacgacgcttccgatgctgccttcccttcccaatgtatgagcacttcccagacgccacncgcgattctgccacggactgccttcacagg

SEQ ID NO: 29714 - DNA, 101 bp, rice(Oryza sativa)
  misc_feature (71): n=a or g
aatttctccttggggggcaagctttgaatttgcctatgctgttaaacatcatgtgactaataatcaggctnaatatgaggtagttttaaaagggttacaat

SEQ ID NO: 29715 - DNA, 101 bp, rice(Oryza sativa)
  misc_feature (71): n=t or c
tacgactaacaagcacatgataggggtcaagaactgttaagtgatactcagagggggataaatacccttgntgcttcaaggaaatggaaagcggcctcatc

SEQ ID NO: 29716 - DNA, 101 bp, rice(Oryza sativa)
  misc_feature (71): n=t or g
tcattttcaatgcaaccacttcatccttcattgcctgacaatatttttcagcagcttctacttccttctcnaaactgaatatagatgaactagaagcttga

SEQ ID NO: 29717 - DNA, 101 bp, rice(Oryza sativa)
  misc_feature (71): n=a or g
cgctataattatgttagatacgggaggagtgaccaattgaccataatcaatacatgagaagctaggtttcngctaaatctcgttaactaatattgtgcctt

SEQ ID NO: 29718 - DNA, 101 bp, rice(Oryza sativa)
  misc_feature (71): n=a or c
gataatacagaagctaattttgactcaggcattcttggtcggactccctgtaaaacatctataaaaaggtnagacacatccaaatattcacaggagcaaga

SEQ ID NO: 29719 - DNA, 101 bp, rice(Oryza sativa)
  misc_feature (71): n=a or g
tagatctccaggaatgaacattgacgtatatttgcagccactgatcgatgagcttaaacagctgtggattnaaggagttgaaacatgggatgccaaggtga

SEQ ID NO: 29720 - DNA, 101 bp, rice(Oryza sativa)
  misc_feature (71): n=a or g
tctcatctctgtgcgccagttcactactgacaacaattgtgctgttgaatttgaccctgctggttgttctntgaaggatctggagtcccagaaggtgatca

SEQ ID NO: 29721 - DNA, 101 bp, rice(Oryza sativa)
  misc_feature (71): n=a or c
gacgaggagaggcaggagctaatggaggatgacgagggagatgagcaggaggagcaccatcaccacggggnaaagctgcgcaccacggctgaagcgccgcc

SEQ ID NO: 29722 - DNA, 101 bp, rice(Oryza sativa)
  misc_feature (71): n=t or c
ggtaggtcctataattaagaggcaaaaccaaccccttctactttgaacacgaccggttcaattagatacangatctactttgaacacaattaaccaattga

SEQ ID NO: 29723 - DNA, 101 bp, rice(Oryza sativa)
  misc_feature (71): n=t or c
agatttgcacacttctcaacagaattgaggaacacaacacagaaacaaggggaaatggtcattacactggngttccaaatacccattggagaatcacatct

SEQ ID NO: 29724 - DNA, 101 bp, rice(Oryza sativa)
  misc_feature (71): n=t or c
gatatggccagtattgtgacaggagtagtagaggtgagggttagggcacgttgcctgatggtgaccttcangcccacactcgaagcattttatcctcacct

SEQ ID NO: 29725 - DNA, 101 bp, rice(Oryza sativa)
  misc_feature (71): n=t or c
tcaggtcagaggaacaatgcgttgcaatctgcctctgagtgaagttggtctgccatagcgtagatttcctnaatttgcgaggcaaaattatctggccagct

SEQ ID NO: 29726 - DNA, 101 bp, rice(Oryza sativa)
  misc_feature (71): n=t or c
cggggcatcaagaatatagaaatcgccagtgggtactaattgaaatgcaagcttcagcctttatccgatanactagcaaacaaatcagccaaggagaatca

SEQ ID NO: 29727 - DNA, 101 bp, rice(Oryza sativa)
  misc_feature (71): n=t or c
tgtgtccattcgtagaggctaaatcggctggagttcttccagaaggaaattcagaagtaggatctgtcaangcacctgctgcagctccatttgctataagg

SEQ ID NO: 29728 - DNA, 101 bp, rice(Oryza sativa)
  misc_feature (71): n=t or c
gctttagaccacgcagcggaccttcgggagatgttcgacaacctgaggagagcatgcatcaaattaaaccncgagaagtgcaccttcggcgcaacgagagg

SEQ ID NO: 29729 - DNA, 101 bp, rice(Oryza sativa)
  misc_feature (71): n=t or c
aaaaccccagaactttggattatgatgattcgcgaaataccttttcgattcgaactggaagtggccaatcnacaaatgcgagtatcagccaaggtgatgtt

SEQ ID NO: 29730 - DNA, 101 bp, rice(Oryza sativa)
  misc_feature (71): n=a or g
caagcttgacagttcagacccgcatttcatgacacaaaacctgttatacaatgggtaccccaacatcccanaggctccacccctatgtgtttggtatgacg

SEQ ID NO: 29731 - DNA, 101 bp, rice(Oryza sativa)
  misc_feature (71): n=t or c
tcaatattcaattccagcatgctcttgactaatggtttaggtgtctgttttggaacttgtgctcctctagnagcttgattggcctctgttctatgccccct

SEQ ID NO: 29732 - DNA, 101 bp, rice(Oryza sativa)
  misc_feature (71): n=a or c
cttgcagataccagcagcagtcttgcgtgttgtgttcgcaggcctcgcactgtcacaccttatggcactanataagaacaacaaagaagacgaagagacta

SEQ ID NO: 29733 - DNA, 101 bp, rice(Oryza sativa)
  misc_feature (71): n=a or g
aaccggttaaattccatcattgtctatggttgtatatatgtcgcacatccttacatcattgtctatgggtntaatacggacatttaactatttgtcatttt

SEQ ID NO: 29734 - DNA, 101 bp, rice(Oryza sativa)
  misc_feature (71): n=a or g
aggagtagaaactagtggagatctgctcgttgttcaccaccaccagatttggctatcggtggttggatccncccaaaaggcggttcggggtgttcagatcc

SEQ ID NO: 29735 - DNA, 101 bp, rice(Oryza sativa)
  misc_feature (71): n=a or g
tagaagaagaagttcaaccaactgctccaactattccagtaaatttcttataactaacatatgcagatcgnctatgcctatttgatctctaactctcttca

SEQ ID NO: 29736 - DNA, 101 bp, rice(Oryza sativa)
  misc_feature (71): n=t or g
actgattgattcgatatgtgactatgtgagaggtgacagccatgtccttttacgctgaataggttgatgantcgtgataatatcattcgatggtaaaaata

SEQ ID NO: 29737 - DNA, 101 bp, rice(Oryza sativa)
  misc_feature (71): n=a or g
gaaatgccatacagaagaaagattgttccctgtggactggtcacagattttgaatgtctaagagttctagntttgagcaacactgacattgtagaggtacc

SEQ ID NO: 29738 - DNA, 101 bp, rice(Oryza sativa)
  misc_feature (71): n=t or c
tgcactatttccacggtatcccgtggggtagcagccctctttttattttgcaaaaaaaaaagtttctatanaagagttcttaaagaatcatattaatccat

SEQ ID NO: 29739 - DNA, 101 bp, rice(Oryza sativa)
  misc_feature (71): n=a or g
ggatgggcggcagtgtaggcttcgtctggggtacatcaactcgtcggtgctagataacaaaagatattttngtagctgcagctttaataatggtgcatgat

SEQ ID NO: 29740 - DNA, 101 bp, rice(Oryza sativa)
  misc_feature (71): n=a or g
tttatggtatttgctaaaatttgaagtgtttttttttttggaacaatccttcgggcctagtaaataaaccngactgggctgatggttgaacccgaaaaaac

SEQ ID NO: 29741 - DNA, 101 bp, rice(Oryza sativa)
  misc_feature (71): n=a or g
agggggagctagccaagagcaccaatccaatccaagaggggtcaggtcgatcagtagcctgttcaggctcncagaagtttttggaaagctgtacaagctag

SEQ ID NO: 29742 - DNA, 101 bp, rice(Oryza sativa)
  misc_feature (71): n=a or g
tcgagatccatcgccgttggaagatcgccggagaacaaaacgagatggacaagctagggtttttctgcggnagcggagaagaccaagggcgtgtgagggct

SEQ ID NO: 29743 - DNA, 101 bp, rice(Oryza sativa)
  misc_feature (71): n=t or g
tcagtatttctttgttgtgcaagcaagtgaaactagttcatgcctaaaagttcatcacatatatggtaaanttgaatctgtataattaactagttaatacc

SEQ ID NO: 29744 - DNA, 101 bp, rice(Oryza sativa)
  misc_feature (71): n=a or g
gtaagaactccgataaacgttacatggtttggcctgattcctaggcttctcatcctcgaaaataaatcaantgcttcctttgcataaccaaattgggcata

SEQ ID NO: 29745 - DNA, 101 bp, rice(Oryza sativa)
  misc_feature (71): n=t or g
cgcccaagagcagttactccccgccgttcctctccacttctacctacactgtcatggcttgatggacgtgnacgagccggaccacaccggcgtcgttgccg

SEQ ID NO: 29746 - DNA, 101 bp, rice(Oryza sativa)
  misc_feature (71): n=t or c
agacaaattcactgggctaaaacaaagggtataaataaacagtaaattactactaacactagtatcggcgntcttgtctgcctcagcagctctcctgagct

SEQ ID NO: 29747 - DNA, 101 bp, rice(Oryza sativa)
  misc_feature (71): n=t or c
gctgctttaggtgcgtctgctgctgttggagatgctcggagcgctggcgctcgtttctactgccttcatcngaaaatatatttaagagcttttgcctatga

SEQ ID NO: 29748 - DNA, 101 bp, rice(Oryza sativa)
  misc_feature (71): n=t or c
tttttctttttccctccaatagttggggaaccaccagatccagtaaaaaggagcctagatctagcgtgttngctctccatcgtgtcggttcctgcctcttc

SEQ ID NO: 29749 - DNA, 101 bp, rice(Oryza sativa)
  misc_feature (71): n=a or g
tatttggccatttggctcaaacttgtgtgtctattcggcccgacatgtggctaagagcaagttttataatngagatgactactacgtccaatttagccgta

SEQ ID NO: 29750 - DNA, 101 bp, rice(Oryza sativa)
  misc_feature (71): n=t or c
attcaacctgcagctgcctaagacagtttcaagccaagcgtacttcgattaattcagttgaaaacctaacnggatcgatctcggcagcctcctaactactc

SEQ ID NO: 29751 - DNA, 101 bp, rice(Oryza sativa)
  misc_feature (71): n=a or c
ttttgctgtccttaggactcgaagtctatagctaagaggctgtgaccaatttcgtattttccatttgaacntatgctacgatgtttgctggaaaccctatg

SEQ ID NO: 29752 - DNA, 101 bp, rice(Oryza sativa)
  misc_feature (71): n=a or g
gtgctaactatacttttttttgggtggtggttctgaacttttcagattgttgatccctaccttgcttcctntgttgtggatgatccaaattttgaagccac

SEQ ID NO: 29753 - DNA, 101 bp, rice(Oryza sativa)
  misc_feature (71): n=a or g
tgatccacatttgatgatcgctcttcaggtgctgcctgccggaatcaacatgtcgagtttccttaagttcngcctctctttaatctccattgctctcagta

SEQ ID NO: 29754 - DNA, 101 bp, rice(Oryza sativa)
  misc_feature (71): n=a or g
attgccatacaaatttacaaacaacgggcatacgtaaaaactcggtgggatactgtgatggcacatgctcngcaatatattggattttatgctgattcact

SEQ ID NO: 29755 - DNA, 101 bp, rice(Oryza sativa)
  misc_feature (71): n=t or g
tctgtgtgtgagagagagatatgtatatatacgtgaaatatatggttacgtacccctcctttggacctccntgaggtgcagcccatgatcacctcctccag

SEQ ID NO: 29756 - DNA, 101 bp, rice(Oryza sativa)
  misc_feature (71): n=t or c
gacccggcggatgttcgtggagtggaaggccaagtacgacaaggcctacgcctccatcgccgaggaggagngccggtacgcggtgttcagggagacccgcc

SEQ ID NO: 29757 - DNA, 101 bp, rice(Oryza sativa)
  misc_feature (71): n=t or c
agtgtttggttaggagggagggggaatgtttgaagatgatggaagtttgaggggtgaggagttttaagagngaactctcgtcttttcaatatttgggtaga

SEQ ID NO: 29758 - DNA, 101 bp, rice(Oryza sativa)
  misc_feature (71): n=t or c
ttgcttggcattttgtcttaactactttttattatttaaaggggtttggctttgaatccactatctggacnacttccaaaggagcttgggaacctcaccaa

SEQ ID NO: 29759 - DNA, 101 bp, rice(Oryza sativa)
  misc_feature (71): n=t or c
aagaaaacgcgaccgacaatatggtcctggtagagaaagagagagagacgccaacggcgacctccggtggngaacatgaccagatgagtatgtcaaaacgt

SEQ ID NO: 29760 - DNA, 101 bp, rice(Oryza sativa)
  misc_feature (71): n=a or g
ccttggtcgacgacctcgccggagtcgggccgcggcccggtcgcctcggccttttttttctcttttttttnatgttttttttgcccccttcccgtgtctct

SEQ ID NO: 29761 - DNA, 101 bp, rice(Oryza sativa)
  misc_feature (71): n=a or g
gagcccggccggcctcctgctgcccctgccggtgccccagggcgtttggaccgacatcgctctagatttcntcgaggcgctaccacgagtgcgcggcaagt

SEQ ID NO: 29762 - DNA, 101 bp, rice(Oryza sativa)
  misc_feature (71): n=t or c
caaaaccataagcctgctgatcctaatgcgcgttgaagggaccaaagattgaatttcatcaccatcgccgnagcacggcattcctatcaccaccgccgcag

SEQ ID NO: 29763 - DNA, 101 bp, rice(Oryza sativa)
  misc_feature (71): n=t or c
ccagcttgtgcggcagagttggtatcggatttatgctctgcttcacagctgcagtgctgctacgtacgcanggacggggtaagttgtgagctctactgttt

SEQ ID NO: 29764 - DNA, 101 bp, rice(Oryza sativa)
  misc_feature (71): n=a or g
agtaactccttcccaaacaccacctcagtgcttatcctttttcccttccccaactccatgcacaaatcttngagcgaatccaatgatccaaaaatcgacat

SEQ ID NO: 29765 - DNA, 101 bp, rice(Oryza sativa)
  misc_feature (71): n=t or g
tcgcgccctccacaccattccatccgttttttttgttctaacggtggtaacggcacagccaaatgacttanttgcccttagacttgaaaggaagggttgga

SEQ ID NO: 29766 - DNA, 101 bp, rice(Oryza sativa)
  misc_feature (71): n=a or g
cacatgaacaaactgatggatgaataaactccccgcaaaaaaaaagatggatgaataaatttctatctctntcttatgatatgaaacggagaaagtatata

SEQ ID NO: 29767 - DNA, 101 bp, rice(Oryza sativa)
  misc_feature (71): n=a or g
gacacgacgaattgggcaaaaattcacaagtctgcaacaaggatcaggagaggaggtcgccagccgaactntgggctggttgggccagccccaggttcggg

SEQ ID NO: 29768 - DNA, 101 bp, rice(Oryza sativa)
  misc_feature (71): n=a or g
atagcttctacatcaagtttattggggataagcgtattagtccttgcagtcttcctagtttacaagaaacntaagtgcttgctcccctggcaaagatcaac

SEQ ID NO: 29769 - DNA, 101 bp, rice(Oryza sativa)
  misc_feature (71): n=t or c
gtcggggacgacgatcggccgaatgtcagtcgaatagagtcttcagcagcggccagggagaatgtggcggnggtcggccaggaggaggtggcgccggcccg

SEQ ID NO: 29770 - DNA, 101 bp, rice(Oryza sativa)
  misc_feature (71): n=a or g
ctctgcccgttggcgataagcatctccatcgtcagtgagtaggttggcctgttgattgaccggaagagagnagtgtaacccccatccatggcggcacggtc

SEQ ID NO: 29771 - DNA, 101 bp, rice(Oryza sativa)
  misc_feature (71): n=a or g
gaggtgaatcctccaaatccttcattgactccagaaaattccaggtctcggcatgcccaaataattaaccnctttagagaacggaggagattatatggaat

SEQ ID NO: 29772 - DNA, 101 bp, rice(Oryza sativa)
  misc_feature (71): n=t or c
atgaagcaatatagaaatttcatgaaaacaacctgaaaccatctccctcccaaagtctgctgggtcaaacngcccaatcaccaccggtctgaccggcggca

SEQ ID NO: 29773 - DNA, 101 bp, rice(Oryza sativa)
  misc_feature (71): n=a or g
aggagaagaggatgaggtaggtgagtggtttttaatgtgagggatattgggtacgagctgggttttttctngcggttctgtttattggccaccaggaaaaa

SEQ ID NO: 29774 - DNA, 101 bp, rice(Oryza sativa)
  misc_feature (71): n=a or g
gtcttgaaagccagtcggaccgtcgtcttcatcatccatcttttttgaagtgctttgctccccgtctgtcngcttccttcctttcttggcatattgctctg

SEQ ID NO: 29775 - DNA, 101 bp, rice(Oryza sativa)
  misc_feature (71): n=a or c
ggcggcaggtctaactccaaactacaccatgtcctctattgtttccacaactttctatgccatatggcacnttttctctggatttctaataccaaaaacag

SEQ ID NO: 29776 - DNA, 101 bp, rice(Oryza sativa)
  misc_feature (71): n=a or g
cctgaaccattcccactgaagtatgttgcactagggaatgaagattgtgctccattcaagctgatataccnaggtaaattttgcataataaacaaatagta

SEQ ID NO: 29777 - DNA, 101 bp, rice(Oryza sativa)
  misc_feature (71): n=t or c
tgccagcggcatagccgaagccaaactacacctcagtatgagctgcagcgccaagaagtgcgaaagttgcnagcggcatggccgaagccaaactgcacctc

SEQ ID NO: 29778 - DNA, 101 bp, rice(Oryza sativa)
  misc_feature (71): n=t or c
atctcggaggagcaacattccgtacgctcacaggctgtaagaagacacatagcaagaactcccaaacatangcaaattagagtagtcaggaggttgaacac

SEQ ID NO: 29779 - DNA, 101 bp, rice(Oryza sativa)
  misc_feature (71): n=t or c
aaagccgaagcagatttggaagaagtttgttattctcagaaacagaatgcgcgtcagctaccgtttgcatnagctgataccaaatcagatagggagaaacc

SEQ ID NO: 29780 - DNA, 101 bp, rice(Oryza sativa)
  misc_feature (71): n=a or g
gagaactacactgtggagcatgtatcctttcaggggcttaggactaaccaacaaccaatactcggcaagtncggtatctacactgctatcatcctaacagg

SEQ ID NO: 29781 - DNA, 101 bp, rice(Oryza sativa)
  misc_feature (71): n=a or g
tcgtcaccactagtcctcgctgttgttgcctctcgcctgcaagcatcatctgcttctcctctaactcgccnccaccatctctcatcggaccatcgcagctc

SEQ ID NO: 29782 - DNA, 101 bp, rice(Oryza sativa)
  misc_feature (71): n=a or g
tgtgactaacaaagtatagcctacaattttttggcaaagtggaggtgtgatctaaacagcctcatactctntccattttaaaattatttggcaaaccttag

SEQ ID NO: 29783 - DNA, 101 bp, rice(Oryza sativa)
  misc_feature (71): n=t or c
agggtttttttaattttggaaaaaagaatttagtttttggtgtttctaccaaggctgccttgatattttangttcgatcctacaatgtgagagttagattt

SEQ ID NO: 29784 - DNA, 101 bp, rice(Oryza sativa)
  misc_feature (71): n=a or g
tgtcgtgggaatttattattaaaaagggattaaattgtggtgtgtttgtgcaatgcagtgtaccatggaangagctcctctaacttaaagttagaggagcc

SEQ ID NO: 29785 - DNA, 101 bp, rice(Oryza sativa)
  misc_feature (71): n=a or g
ctgcaatttgaagtgaaagtgtgaaactcacctatcccataacttaaagttaagttcagctacaaacaggnttctagtcattgctacaccacaaatatatg

SEQ ID NO: 29786 - DNA, 101 bp, rice(Oryza sativa)
  misc_feature (71): n=t or c
tacacaacaaagtaatcaattaggggtaggaacggtgcaaacaactctgaagaagggcaatataaatgttntgtacaaatatatacctgtagtctggtacg

SEQ ID NO: 29787 - DNA, 101 bp, rice(Oryza sativa)
  misc_feature (71): n=t or c
gagctgcgagaggagggccacgaatcccttctcgtggtctgtcgcctccaggcgacggatttggacggaanagccggtctccgcgacggcggcggcggtgg

SEQ ID NO: 29788 - DNA, 101 bp, rice(Oryza sativa)
  misc_feature (71): n=t or g
tttctttcttgatgaacagttgagatcgctcgctttggaaagactagcaaatttgttatatgcccacctantgacgaaatgacaaggcaaaaaaaatgtta

SEQ ID NO: 29789 - DNA, 101 bp, rice(Oryza sativa)
  misc_feature (71): n=t or c
ggagagtaaacagatagtcaacaaactaactgtgagcattgtagaggctacaattaagacgaacatcgcanttcagggatgataggagatacagcactact

SEQ ID NO: 29790 - DNA, 101 bp, rice(Oryza sativa)
  misc_feature (71): n=a or g
gaaagactggtgactttggatccaaggcccatcatacattgaatcagttgtaatgagacatcatggattgnaatcaactatgaattgaatgaaagagcaag

SEQ ID NO: 29791 - DNA, 101 bp, rice(Oryza sativa)
  misc_feature (71): n=a or g
aaggacagctcaggaagaggaggatttggataagcttctcgctgagcttggtgagggcccaacgccagcanaaaaggagaaggaggttctgccccaggcgc

SEQ ID NO: 29792 - DNA, 101 bp, rice(Oryza sativa)
  misc_feature (71): n=a or g
gataagctcagaagaatggcttcctaatggaccaacatatatttcctcccctccttggttcagtagaaaangctgtagttcatttagggtacattacacgg

SEQ ID NO: 29793 - DNA, 101 bp, rice(Oryza sativa)
  misc_feature (71): n=t or c
ctcttatcccatgcggtggaaattgaggtggcaaagaaaaggttgcacccacggttaaattccgtggtaantcagggattcgcgatgtcaataatcatggt

SEQ ID NO: 29794 - DNA, 101 bp, rice(Oryza sativa)
  misc_feature (71): n=t or c
atgccaccttacaaattaaaaggggccacacaaattgaagcaaagacattggtgtgtaaaagtatcttggntgtgtgccagttgacggaggccgaagatgt

SEQ ID NO: 29795 - DNA, 101 bp, rice(Oryza sativa)
  misc_feature (71): n=a or g
taaataataagcaggtaacctgttgatgacgcctaaacagttggtgcttggtgcctggtaaagaggaggangaagaagaagaaagaagaggaaggggacac

SEQ ID NO: 29796 - DNA, 101 bp, rice(Oryza sativa)
  misc_feature (71): n=t or c
atgtgttagtgttatcctctctgtggtaccctttaagggaatgtgtcccatggatagtttcagcaaatgcnataagtagtatttgagtgaatagcttaaag

SEQ ID NO: 29797 - DNA, 101 bp, rice(Oryza sativa)
  misc_feature (71): n=a or g
catgttgcagtactgcacacgcgacggctccaaggacgtctggtacgaccttgccaagaagatacatgtcnagtggcgcaagaaagacaacacctactccg

SEQ ID NO: 29798 - DNA, 101 bp, rice(Oryza sativa)
  misc_feature (71): n=t or g
tcctcagatttcagattccggatactctattggtttctttatgcctgacccgcagaactgtttattttttnatgcttgcgttgccctgtgccctactcgct

SEQ ID NO: 29799 - DNA, 101 bp, rice(Oryza sativa)
  misc_feature (71): n=t or c
tcaataatcacaaggttgcaatttggcttgaaaaaatgtgtcctccggataatatttgcagcatgtggtanagggattaatctgaagctaccaacctctcc

SEQ ID NO: 29800 - DNA, 101 bp, rice(Oryza sativa)
  misc_feature (71): n=a or g
tgataccgccatctgtctgatgatcacttccatgcgtaccgcttcctcacgcgctacatatgtagatagantttaagagtggaatcgcctgtgtaattagt

SEQ ID NO: 29801 - DNA, 101 bp, rice(Oryza sativa)
  misc_feature (71): n=t or c
tttcacctactgattcttggaatataaagctcacctaacctaaacatatcctattatgatctctgaagacngaagctctcaagaacaacagaggctgtgtt

SEQ ID NO: 29802 - DNA, 101 bp, rice(Oryza sativa)
  misc_feature (71): n=t or c
taggcactagcaattgaactacagagattcttttctacgtggtgctccttttcaaatctgttgcatttgtncactgatgtattgctctttttctttcctgt

SEQ ID NO: 29803 - DNA, 101 bp, rice(Oryza sativa)
  misc_feature (71): n=t or c
ctgtcgcgagttcgccgttgttgctgaagaaaaagccgaggtgtagcacgacatgagattggagaaggagncgaggcgcagcgcgacgcgagatcagagga

SEQ ID NO: 29804 - DNA, 101 bp, rice(Oryza sativa)
  misc_feature (71): n=t or c
aatgtggtgtgtggttggtgctctgtctcctcttgttattgggatgttacctatgaataatagaaacggcnttggtgccgtttctgcaataatatattgta

SEQ ID NO: 29805 - DNA, 101 bp, rice(Oryza sativa)
  misc_feature (71): n=a or c
ctatggcttcagaagcagacacagatggaagaagaaagttgttttctttggtaccctaccacggacaccgngcccccgggcctgagctggcttgaccatgg

SEQ ID NO: 29806 - DNA, 101 bp, rice(Oryza sativa)
  misc_feature (71): n=t or c
ctgtaattgtggatacagttcttgaggagtttcctcatgcttatctttgttgtgctgagcaggcatttctntgacatacgaaaatcagtcggcaatgaaga

SEQ ID NO: 29807 - DNA, 101 bp, rice(Oryza sativa)
  misc_feature (71): n=t or c
gtaccggacattgacttccagccccactcttcaatcagagatgagaagattgcgcatagaatgctgataancgactatttgctgctggttcactgcttggt

SEQ ID NO: 29808 - DNA, 101 bp, rice(Oryza sativa)
  misc_feature (71): n=t or c
cttgcgacatgtgaaattttcctaagtgttgtctggaagttccgaatgtcaggaacttccggacctcttcnagttcaaaaatgtgagtaacggctagatgt

SEQ ID NO: 29809 - DNA, 101 bp, rice(Oryza sativa)
  misc_feature (71): n=a or c
agcaatgcaagttcccagaagagtggcgcatgaggtcagttagaaaataccttcagtacacccggaagaantgcgtgcgggaccctgctcctcttgctgag

SEQ ID NO: 29810 - DNA, 101 bp, rice(Oryza sativa)
  misc_feature (71): n=a or c
tccagggtgacaagtatggcttcactgaaaagatacatattgtagcatgccgtggtaagttctacttcaanagcttcttcaccgagatcagcgtgctcgag

SEQ ID NO: 29811 - DNA, 101 bp, rice(Oryza sativa)
  misc_feature (71): n=t or g
ttgatccaaaaggaaataggagcacatgtgatttgaaatgtcacagtaaatcccagtgaaaaaagcctaangaagtgagctatgctcatgctgcttttact

SEQ ID NO: 29812 - DNA, 101 bp, rice(Oryza sativa)
  misc_feature (71): n=t or g
cgtgcatatattccttggcgatattccacgctagctaactcgatcttttctctcttaattttctggcgatnatcaaaattcagcgcatctgatggcgtcgg

SEQ ID NO: 29813 - DNA, 101 bp, rice(Oryza sativa)
  misc_feature (71): n=t or c
cacgagctcccccattgccgcccctttctcttcctccttccttccacctcaccccaaccccaaccccaacnctggccccgtcccgcgcgtacggaggaggg

SEQ ID NO: 29814 - DNA, 101 bp, rice(Oryza sativa)
  misc_feature (71): n=t or c
caacattactcaggcctcacgtgcacgtacctatgcaaggttactctccattgtagatgtctgtaaatcgntggtaaacgaaccagcaagctagaatttca

SEQ ID NO: 29815 - DNA, 101 bp, rice(Oryza sativa)
  misc_feature (71): n=a or c
gaaaagatgaatggggcttcaggagccgagctcaaggtttgtttagtctttactttcatctgttataaaanattgtactgtgtatttgtctcacacgagtg

SEQ ID NO: 29816 - DNA, 101 bp, rice(Oryza sativa)
  misc_feature (71): n=a or g
ggactgcaaagatggacaaatatcgatctccaaatgaaagaatggggaacctgcactaatgtggaagaatngtggtacaagatctctcgcataccaaatgt

SEQ ID NO: 29817 - DNA, 101 bp, rice(Oryza sativa)
  misc_feature (71): n=a or g
aaaacattttttctgcacaagaacccttataagttgcaggtggactgtaaataaacctgcctccagctcgngaggggcggatctagagcctggtggaggag

SEQ ID NO: 29818 - DNA, 101 bp, rice(Oryza sativa)
  misc_feature (71): n=a or g
gtggttaaacacgcgaaccatattgatttagggtgtgtttggttgaatgaacgagtattgataggagatgnccgtctgattttctgtggtgtttggttaga

SEQ ID NO: 29819 - DNA, 101 bp, rice(Oryza sativa)
  misc_feature (71): n=a or g
cttttcgatcccaagggagcgagctcgaattccttcacatcacgggcgccgctacaccggcgcgaaggtcntcgtcgtcgtcgactcgccggatagaatgc

SEQ ID NO: 29820 - DNA, 101 bp, rice(Oryza sativa)
  misc_feature (71): n=a or g
ctgtacttgacaatgccttgagtaggtaaagctgcagagcaactgcaattgtcacatttggtacatttagnggtccctaatattaggatcttaattatatt

SEQ ID NO: 29821 - DNA, 101 bp, rice(Oryza sativa)
  misc_feature (71): n=t or g
aaaattgtgaaaaatctacgcttcaacattggggaatcaggggttttctctctttattcaacaatgatganagagagaaagagagtgagtttgtgtcctgc

SEQ ID NO: 29822 - DNA, 101 bp, rice(Oryza sativa)
  misc_feature (71): n=t or c
tcatttttaaaattttgcacaatatgcatggagtttgtgctcatgtatgctcctcattttgtgttatatgnttactatactgtttgcatgatcttttgtaa

SEQ ID NO: 29823 - DNA, 101 bp, rice(Oryza sativa)
  misc_feature (71): n=a or g
catttaaacgatggattccaagatagttgtcttcgatggactgaggaccccgcaagccaagttccaatacntcattgacactctcaataaggcacttgtga

SEQ ID NO: 29824 - DNA, 101 bp, rice(Oryza sativa)
  misc_feature (71): n=a or g
atggatgattcccgttatccagaaaactcggcgagctaatccatccgcaggtacatcggaacagccgcacncggccatggcggcgctggagtatgcgctat

SEQ ID NO: 29825 - DNA, 101 bp, rice(Oryza sativa)
  misc_feature (71): n=t or c
catttgcctggtatgaactatgttcgatacgagacagggtcagacttaagagcattgcttaatagtcctgntgcgaaacgtacgatgctgactgagtggtt

SEQ ID NO: 29826 - DNA, 101 bp, rice(Oryza sativa)
  misc_feature (71): n=t or c
ggagaatgtatatagctagcactcagcattttccttgttctctctcctccacgaaagtactccctccgccnctaaatatttgacgtcgttaacttttttaa

SEQ ID NO: 29827 - DNA, 101 bp, rice(Oryza sativa)
  misc_feature (71): n=a or g
ataaagaataaagccatggtgttgaatgatactaaattgctatgtttgattaagacaactatctgagtggnaaaatggtgtcgttatttaaatatgcttgt

SEQ ID NO: 29828 - DNA, 101 bp, rice(Oryza sativa)
  misc_feature (71): n=a or c
taatacatgtttactgtaacacatatactctggtatttggtgcggtggtatgtttgttcaagaaaaagggntatgctacgagcctattgagtctatgactg

SEQ ID NO: 29829 - DNA, 101 bp, rice(Oryza sativa)
  misc_feature (71): n=a or g
caatggtttggcaagaaacaatgcagctatttacagtggtttgggtcttgatatttcttcaccttcatccntagaggatagccctgatggctgtgggagcc

SEQ ID NO: 29830 - DNA, 101 bp, rice(Oryza sativa)
  misc_feature (71): n=a or c
atctaacaaatcacacaagaaagctgcagttttaagttcaagcagctaccatcaaaatcttgcgaattagngcacacagataaaagcatattgaaggtact

SEQ ID NO: 29831 - DNA, 101 bp, rice(Oryza sativa)
  misc_feature (71): n=t or c
gccatactagctaatttatacttataatttggtccgcctttgtgctaaattatgttttcacaacaaaatgntagcttacatatagttcttatctcatgtat

SEQ ID NO: 29832 - DNA, 101 bp, rice(Oryza sativa)
  misc_feature (71): n=a or g
gccttatctgctgttattggtgaagctcagatgctaatgtttccttctacactattgcctgaaaaatatcnaagtatgcatcttgtcttatctctcttcta

SEQ ID NO: 29833 - DNA, 101 bp, rice(Oryza sativa)
  misc_feature (71): n=t or c
acataataagtctattttgcatccctcaattctttgggatgtgtatatatggctgaaaaaaaagccttttncgtattcctcttttctttggaccttgcctt

SEQ ID NO: 29834 - DNA, 101 bp, rice(Oryza sativa)
  misc_feature (71): n=t or c
gtcacttggaggattcaaccactgaagagtcgtgttcacccagtctgggaatatttaggaaaggatgaccngaccagggagagcaatgagttgattgacaa

SEQ ID NO: 29835 - DNA, 101 bp, rice(Oryza sativa)
  misc_feature (71): n=a or g
caaagggggccttagtggttgtagtgatctgagtagtagcgcaaaatctcgagttcaaattgggttgtttnatgggctaagttcctaatttaaaatggctg

SEQ ID NO: 29836 - DNA, 101 bp, rice(Oryza sativa)
  misc_feature (71): n=t or c
aatctccttgagtggcatgggagaactacgcaggaccggtgcactcttttggcatgaatagtttgaggggnttccataatcttcaaaaagatcaccctcaa

SEQ ID NO: 29837 - DNA, 101 bp, rice(Oryza sativa)
  misc_feature (71): n=t or c
tgctaaggtttactattattagagagagaatcatctaatcaatcactaattaagtacagatattacagagntagcacagagtgaaaatagccggcctagcc

SEQ ID NO: 29838 - DNA, 101 bp, rice(Oryza sativa)
  misc_feature (71): n=a or g
gggtcgctgtacgcgctggtgtttctcgtcacgggctgcagctgtatctactcctgcatctaccgctccangctgcggtcccagtacggcctgcaggagac

SEQ ID NO: 29839 - DNA, 101 bp, rice(Oryza sativa)
  misc_feature (71): n=t or c
ctcctctcccttccaaaatgcattttttatgacgtggcacacgtccattgacacattgtaacggtcacatngagtgatgaaggataaccggtcattttgca

SEQ ID NO: 29840 - DNA, 101 bp, rice(Oryza sativa)
  misc_feature (71): n=t or g
atcccgtaatccgccggcgtcttctcgatgtcgaccttcctgccacagtacgtgacgtcgaattcgccgcnctcatcgtcagtgggcaccatggcgaagta

SEQ ID NO: 29841 - DNA, 101 bp, rice(Oryza sativa)
  misc_feature (71): n=a or g
tggagatagtattctattaggacgattatgcacaactatatatttttctagtgcacatttactaaataccntttatgaatttaaggctttccaaaatgaaa

SEQ ID NO: 29842 - DNA, 101 bp, rice(Oryza sativa)
  misc_feature (71): n=t or c
gtaacggaggaacggagaaagtagctttgcttacgtgaacagtcatcagtgttcttctgttcttctctctntttttttctttttcttcctcctctcactct

SEQ ID NO: 29843 - DNA, 101 bp, rice(Oryza sativa)
  misc_feature (71): n=t or c
gttcctccaaatattcacttttaagatgttcaggaagtaaacaaaaagtcgccatgtactacaacaaaatntgtattttttttaaaacaacagtcctatat

SEQ ID NO: 29844 - DNA, 101 bp, rice(Oryza sativa)
  misc_feature (71): n=t or g
gttatgtaatgtgttaaattattgtgccacaagaaggagcgaaattacatgatcttcaacaacttatgcanagttaggatgcacacagctaaacatattca

SEQ ID NO: 29845 - DNA, 101 bp, rice(Oryza sativa)
  misc_feature (71): n=a or g
catgctccggatctagacaaaccgtattgttgttgggtattttttttttcaggcctgccaaacgttggccnaccaatttcattaagattgggagaaaacaa

SEQ ID NO: 29846 - DNA, 101 bp, rice(Oryza sativa)
  misc_feature (71): n=t or g
ttttgcactaaaattgtatacatctagtcataaacaagaactaccttctagtatactctcatgttctcatnttctcattttcatagagcgatcaattggca

SEQ ID NO: 29847 - DNA, 101 bp, rice(Oryza sativa)
  misc_feature (71): n=a or c
tttacgtagggcagcgtccaaaccactaagccaactcaagtttttgaagggaaatcacggttacatgctanttacaccgtaactacaattaggcctgtttc

SEQ ID NO: 29848 - DNA, 101 bp, rice(Oryza sativa)
  misc_feature (71): n=a or g
ggcaggggagaagagatgtgaaggcgcttggtggtgaagacgggcataggccggggaagataggagacgcncggcacaaccggtgcccggtaggggagagc

SEQ ID NO: 29849 - DNA, 101 bp, rice(Oryza sativa)
  misc_feature (71): n=a or g
agtcaatactccatgggtatgttagaagtgccatttatatttgagcagcttttatacccggttagacgacncaaaatggacttttttttttccaaaatgag

SEQ ID NO: 29850 - DNA, 101 bp, rice(Oryza sativa)
  misc_feature (71): n=t or c
taccgctagcaactaaaggccaatgaaaatgaaccatctttacaggcggaacttcaccacagttaggttangctgattgttagggaaaatgatttttgatc

SEQ ID NO: 29851 - DNA, 101 bp, rice(Oryza sativa)
  misc_feature (71): n=a or g
attaacctttggtttggaaggagcattgccacctgctgtattctgataagcatgcatattccgaaagagtngtggtggagcaatgccagaagcctgcaaaa

SEQ ID NO: 29852 - DNA, 101 bp, rice(Oryza sativa)
  misc_feature (71): n=a or g
actccacatgcattatatagctccgcgtaaaactgaatgaggcaatcttgtagttacctaattatgaaaangtataaatgcgtgattagaactatatctca

SEQ ID NO: 29853 - DNA, 101 bp, rice(Oryza sativa)
  misc_feature (71): n=t or c
gatccaatctgatcgatcccgatatatatctctctctcgatcttctcggccactaccttctcatcgttgcngccgccaccgacgaaggggtggctgctgca

SEQ ID NO: 29854 - DNA, 101 bp, rice(Oryza sativa)
  misc_feature (71): n=t or c
ctttgagttctcagactccaactcctgggacttggtaactacatcatggactttctccgcttgatcttccngtgctaggtgcagctgcctgacacattcct

SEQ ID NO: 29855 - DNA, 101 bp, rice(Oryza sativa)
  misc_feature (71): n=a or c
aggcactgtgcttttctgatgctagagatacatgctaggatatactccactgttctctcactgtgaattanaggcttgagatcagataacattattgaact

SEQ ID NO: 29856 - DNA, 101 bp, rice(Oryza sativa)
  misc_feature (71): n=t or c
tcgacatggagctgcaactgtgttgttctctcggaccgcagctttgccactttcgtcgtctctatcgccanctacgcatcgacacccacgtcatccgcact

SEQ ID NO: 29857 - DNA, 101 bp, rice(Oryza sativa)
  misc_feature (71): n=t or c
taaacatgatcacctcttgcttatgcggaaactaattgatcactgtcctgagatttttttttgaacgactngcacgagacggtgcgaagttctattgatag

SEQ ID NO: 29858 - DNA, 101 bp, rice(Oryza sativa)
  misc_feature (71): n=a or g
gggttagagaacgaccccagtacccctgtggtcgtcctcttcctctttttatagctttctccaccgccaanaataattgggttttgtttagatcaaagtat

SEQ ID NO: 29859 - DNA, 101 bp, rice(Oryza sativa)
  misc_feature (71): n=a or g
tatctccccctcgacgccgtcctccaccagcttccccgtctctgcatcaacaacgacaatctcgacatccngcgcctcggtcaaaagtgacggctgcggca

SEQ ID NO: 29860 - DNA, 101 bp, rice(Oryza sativa)
  misc_feature (71): n=a or g
atcatgctctttggccacgtttggatccaccccaccattgacaatcttctccttatctttttggtctgcancttcaataatatatggctccaactgcatac

SEQ ID NO: 29861 - DNA, 101 bp, rice(Oryza sativa)
  misc_feature (71): n=a or g
aggatgagggttataaatctgtaatgctcctatagtttcttctgtacataatcagccgttgccaagatttnagttttaaaacttatttaaagttgatttga

SEQ ID NO: 29862 - DNA, 101 bp, rice(Oryza sativa)
  misc_feature (71): n=t or c
tcactacaaaacatacttggagtatctatcaaaaacagtgaaacacccttgcaacaattacatttctaaanatcatcaacacaaaccagaccttgttcaac

SEQ ID NO: 29863 - DNA, 101 bp, rice(Oryza sativa)
  misc_feature (71): n=a or g
atgtatggataggacgtggtgggccttctttgtatcttattcatttatgttattttgtaatttttgccatncaaaatattgataacttgttaatattttat

SEQ ID NO: 29864 - DNA, 101 bp, rice(Oryza sativa)
  misc_feature (71): n=t or c
tgaactatctttcttaatcaacagattgttgtttggagatatctccatactttggatggtccagatgtacngtcaacaaaaaatgcattggtttgggttgt

SEQ ID NO: 29865 - DNA, 101 bp, rice(Oryza sativa)
  misc_feature (71): n=a or c
ttaccactcaaatgatattttaccatttgaatggtattttaccatcgggacacttatgaaaacttaagacntccttttctttggtgtttaggccgagcagg

SEQ ID NO: 29866 - DNA, 101 bp, rice(Oryza sativa)
  misc_feature (71): n=a or g
tattggcagataatggcaattgaagcaaatcagctcatattagcaattgaagtaaaccaaaaaaagggggnaaaatccgatattggcagataatggcaatt

SEQ ID NO: 29867 - DNA, 101 bp, rice(Oryza sativa)
  misc_feature (71): n=a or g
ctgacggccctttaaataaaggctgtcagaggtgatggtaggtcacaggtagttagaagctgtcacaggtnatctacctgtgatggccccaaaagtaaagg

SEQ ID NO: 29868 - DNA, 101 bp, rice(Oryza sativa)
  misc_feature (71): n=a or c
ccgcctgttcgagagagagaggacgcttaggagagagagggaagagatatgacaagtgggctcaaggagtntttttgctgattggattgccacgttagcgc

SEQ ID NO: 29869 - DNA, 101 bp, rice(Oryza sativa)
  misc_feature (71): n=a or g
ggagcaatcggcacacgaggcaggccatgcagcaatgtggaggtcttagggggcattgtagccgataactngaggtgttagtccaccaccgttggcaggag

SEQ ID NO: 29870 - DNA, 101 bp, rice(Oryza sativa)
  misc_feature (71): n=t or c
atcaacgatgaaggaaaaaggtggacgacgctgaaatagaaaacaaacgaatttcggaacgggaaggccangtcggactttaaacagtaggacaaacatac

SEQ ID NO: 29871 - DNA, 101 bp, rice(Oryza sativa)
  misc_feature (71): n=a or g
ctgacgttgtggtttattttacataatctaagctaacatccttttatgtaaaattttgaagcacgaagctngccacttcttgatagcgtatttgcttgggg

SEQ ID NO: 29872 - DNA, 101 bp, rice(Oryza sativa)
  misc_feature (71): n=t or c
tcacccaaccggagacactgcacaagatcaaccatcctgatctaccactctcctactacaccggtgttctnggtgagtcaattcttgtgcatggacggaca

SEQ ID NO: 29873 - DNA, 101 bp, rice(Oryza sativa)
  misc_feature (71): n=a or c
tcagcatcattgttgtgcgaactgaacgtactcctcttgctacaaatatagaccaaacacttgggactctnaaaagtacacaccaccaatgttgattgttt

SEQ ID NO: 29874 - DNA, 101 bp, rice(Oryza sativa)
  misc_feature (71): n=t or c
ttattcttaacattaagctactaacagatgatggtggggttacactcgtgtaatcccactatatggacaangtcttaagtcgctttggttgcagtgattgc

SEQ ID NO: 29875 - DNA, 101 bp, rice(Oryza sativa)
  misc_feature (71): n=a or g
tcgatcggctaacggttgctgcagagaatgacggacgaccgctcgactacgccaccaatgtattgggacgncgtggcaagcacctcgtcaagctcccatcc

SEQ ID NO: 29876 - DNA, 101 bp, rice(Oryza sativa)
  misc_feature (71): n=t or c
caccagtataagtctattatctctagctatgcacgtagacaagtcttccattcatgattatgcacctgaangaactatttttgtgagggaggtaatatttg

SEQ ID NO: 29877 - DNA, 101 bp, rice(Oryza sativa)
  misc_feature (71): n=a or c
gatcgatttttactctccacaacctcaatatataagtacgaatatgcatcgtttgttgatatatatatctntatatatatgtccctctctatggcatgcca

SEQ ID NO: 29878 - DNA, 101 bp, rice(Oryza sativa)
  misc_feature (71): n=a or c
cgtattgattattatcgactgtgactatttagcctccttataccttatccccaccccctgaggtgttgaanactagtgcaaggtggccgtctgatcaatgg

SEQ ID NO: 29879 - DNA, 101 bp, rice(Oryza sativa)
  misc_feature (71): n=a or g
gtagccgctcggttgctcggtgctgggactggaacccgtccactcagctttgtggggagcaatggtgtcgntggccggtctgcctcggggagctgccatgc

SEQ ID NO: 29880 - DNA, 101 bp, rice(Oryza sativa)
  misc_feature (71): n=a or g
ggggaggagaagtgagatgagagctcagcttgaggaaaaaaaagaaagaacaagcagtgaagatgaaaggngaggaagaagaaggggttatctctgccccc

SEQ ID NO: 29881 - DNA, 101 bp, rice(Oryza sativa)
  misc_feature (71): n=t or c
gtctcatgctgccatcatcggattcatggccggcgccgccatcaccattgctcttcagcagcttaaaggcntccttggaattgcaaacttcaccaagaaga

SEQ ID NO: 29882 - DNA, 101 bp, rice(Oryza sativa)
  misc_feature (71): n=t or c
ttaatcgtcatggcacggcctaggaggacgaggtaatgtgcaacaccacaagcgattgggagaggttcctnggtgacagcagaagacactttgtggtggtg

SEQ ID NO: 29883 - DNA, 101 bp, rice(Oryza sativa)
  misc_feature (71): n=t or c
atatgttcagagttcagtcactggcactcgacagagctgatgcatcaattcatggcagatgataatcttgncagatggatcagtcagggttttttttcacc

SEQ ID NO: 29884 - DNA, 101 bp, rice(Oryza sativa)
  misc_feature (71): n=t or c
tgctgttgtgttcgttccactttgatcacgtcgccgacataccttggttatggctggtacgaaaaagtaantagaagtttgaagaaattgaaatgatgtga

SEQ ID NO: 29885 - DNA, 101 bp, rice(Oryza sativa)
  misc_feature (71): n=a or g
gatattcatatacaggcattgatacaaacttctacacagtagctagtgttgctgaatatagcttggtcgtntactccctccgtcccaaattaagtacaata

SEQ ID NO: 29886 - DNA, 101 bp, rice(Oryza sativa)
  misc_feature (71): n=t or c
tgattgcagaaaattgaagtcatgactcatgactgacaggcacctttaatttctagatatggacatcgaanggataaggtattactaatagattaaacata

SEQ ID NO: 29887 - DNA, 101 bp, rice(Oryza sativa)
  misc_feature (71): n=t or c
tcaagattattacagactagtagctcatttctatgctggatgtgttgatttggagatcctaaatagctctnttataacccgggttccaaagaaaagctccc

SEQ ID NO: 29888 - DNA, 101 bp, rice(Oryza sativa)
  misc_feature (71): n=a or g
ccaggtggtactgaaactaatccagctgtccaacttgagggggtaggacccggaatgagcgagagagaacnaccccatcgcgcgagccctatcttcttcct

SEQ ID NO: 29889 - DNA, 101 bp, rice(Oryza sativa)
  misc_feature (71): n=a or g
tcaggttttccagttgcaagtgaataatggtatacccatagagagttggtttagcgacgactctgatgagncattacctcagctgattccgttcctggaga

SEQ ID NO: 29890 - DNA, 101 bp, rice(Oryza sativa)
  misc_feature (71): n=a or g
tcccggttcaaattacgtgcatgggaatttctgttcgaatcaagggaaacgtctagaattcgtccttttgntttaaggtccctaggctttcaccaaagaac

SEQ ID NO: 29891 - DNA, 101 bp, rice(Oryza sativa)
  misc_feature (71): n=a or c
gcatgtgaaggagggaaaaattgcggattaggagtgcgctgtaaaaagtggaagtataggggctttttcgnaaaatgccacccacttaaccaaaccctaga

SEQ ID NO: 29892 - DNA, 101 bp, rice(Oryza sativa)
  misc_feature (71): n=a or g
gtatgaccaaggcatcgacttctcaggtgcttggcatgtctgaaacatgaacaccgcattgcttgtcgtcnatccaaacagccaactgtggacatcccaga

SEQ ID NO: 29893 - DNA, 101 bp, rice(Oryza sativa)
  misc_feature (71): n=a or c
attcatgcaactgtttatattaaaattcaaccctagattcccacgtcggtaaacagcggttagtgaaagtnagtgaaaataaaaagaaaagaatccaccgc

SEQ ID NO: 29894 - DNA, 101 bp, rice(Oryza sativa)
  misc_feature (71): n=a or g
atattaatttgcagattatatccatgcaaaatttaggagatgctggagttataggcaatgctcaagcggcngaattgtatgggcttaacatagtagaatgc

SEQ ID NO: 29895 - DNA, 101 bp, rice(Oryza sativa)
  misc_feature (71): n=t or g
ttagactaattttcgttagtttatgacaatccagaattgcagcttttttgggtcaaacgctgcgagcctgngaatgtggtgctcgtatagtataataatct

SEQ ID NO: 29896 - DNA, 101 bp, rice(Oryza sativa)
  misc_feature (71): n=t or c
cgtcagcgtcaacggcttcaacaggtgcggctgaaaacttcacttttagctttggttggctcaacctccanctcgtggaggccccatttgggtccgcacat

SEQ ID NO: 29897 - DNA, 101 bp, rice(Oryza sativa)
  misc_feature (71): n=a or g
aagtagctaggatctagctatttttgccccaatagataatttagcagctatatatagttcactttagcctnctattagctgtttgagaaggtcagtacgtg

SEQ ID NO: 29898 - DNA, 101 bp, rice(Oryza sativa)
  misc_feature (71): n=a or c
tgcatcgctgcattacttcattgcagtgcagactgcagatgctgattcctttgatcctttccctctggtgnagtagtctggtagtacaacaggagtacagg

SEQ ID NO: 29899 - DNA, 101 bp, rice(Oryza sativa)
  misc_feature (71): n=t or c
ccaactaggactaaagatgtttttgggacttgaacttttttttgaagcaatactaaaaacatctttagttncgattattaatctatccgagatatttgtgt

SEQ ID NO: 29900 - DNA, 101 bp, rice(Oryza sativa)
  misc_feature (71): n=a or g
taacaaaaaattgattgtccatataaatatatagcccctaggagagaagagcatcgaatcataagccatanccacaagtcacatcgaatatcaatcaggag

SEQ ID NO: 29901 - DNA, 101 bp, rice(Oryza sativa)
  misc_feature (71): n=t or c
ctgatttcgcggttaaacgacgtgaatgaaactcggaccaaaagtgcactgtttccactcaacaatactcnctcagtttcacaatgtaagtcattttagca

SEQ ID NO: 29902 - DNA, 101 bp, rice(Oryza sativa)
  misc_feature (71): n=t or g
ttctacggtatgtatttgatgctgacaacctggttacaagattagttttgcatgagaaatatggcctgttngggggagctcaagattttaagaagcagctg

SEQ ID NO: 29903 - DNA, 101 bp, rice(Oryza sativa)
  misc_feature (71): n=t or c
aatagtacttctacagctaaagaaagattaatgtggctgtatgagatgcagttggccctatcatatagtgnatcttaatttgttgatatgcaagtttacct

SEQ ID NO: 29904 - DNA, 101 bp, rice(Oryza sativa)
  misc_feature (71): n=t or c
agacgatccatttgcacattatccacatcatcacataacgcttctgcctataaataggagcagcaccttanattcaagaatcacctctcaacacacaacta

SEQ ID NO: 29905 - DNA, 101 bp, rice(Oryza sativa)
  misc_feature (71): n=a or g
gctgtcgtctattgaagactgtcctaggtgcagcaatgttacagaaatttcaaaccgatcgcataatagangcaatccgctaaggcaagcaagggttcctg

SEQ ID NO: 29906 - DNA, 101 bp, rice(Oryza sativa)
  misc_feature (71): n=t or c
agcaggtgataaactgataacgagatagtaacaaggcatggatgaagcttcatttaagactgtatagtacnttcgccacacacaaccgtcgttcaagcaag

SEQ ID NO: 29907 - DNA, 101 bp, rice(Oryza sativa)
  misc_feature (71): n=t or g
ggtttactagttcagatgttgttgcttgactagattagattatgatgatcctgtcaaacgtgaatctgcanttcgctgtttaagtggtctgcatttcgctg

SEQ ID NO: 29908 - DNA, 101 bp, rice(Oryza sativa)
  misc_feature (71): n=a or g
gaggcttcgccccaacgaacttgatgtctcgggcttgagccctcactggttacatggttttggcaggtttngtcgaagggcctcatgtcgtaccgccaaca

SEQ ID NO: 29909 - DNA, 101 bp, rice(Oryza sativa)
  misc_feature (71): n=t or c
ttcgcatgcatacgtcttaacctaaccatctacgaaaataggcctatgcaggcggctgactacccgcccanaaaaatttctatgatctttattagtgacag

SEQ ID NO: 29910 - DNA, 101 bp, rice(Oryza sativa)
  misc_feature (71): n=t or c
tttgtatgcagatcatcaagacatagttgacgctattgacttatatgatgtggcaattattggttcagatnctttgcgtactgttgtgaaaccaagtaaaa

SEQ ID NO: 29911 - DNA, 101 bp, rice(Oryza sativa)
  misc_feature (71): n=a or g
ctcctttgcccaacaacatttggactacttaggtcacgtcattggaattcatggggtatcaactgatccanagaaggttatggctgtacaacattggccca

SEQ ID NO: 29912 - DNA, 101 bp, rice(Oryza sativa)
  misc_feature (71): n=a or c
tcgtcaagaacacgctaaaccgcttccccctctcatacacataaaagatgccataatgcttcagaagcagnctcatcaacttctgcggcataacaaactca

SEQ ID NO: 29913 - DNA, 101 bp, rice(Oryza sativa)
  misc_feature (71): n=t or c
ggtctcaaccaaaggcaaagagatggcaacctctgttcctgtgtataacaagccgccatctctatagtatncaaacctttttgtttctttcctttctagaa

SEQ ID NO: 29914 - DNA, 101 bp, rice(Oryza sativa)
  misc_feature (71): n=t or c
tagatggtagttgaatcattgtattgctagttccaaattagttgggatttagcaaatttttgcctgatgcntggaatactggtaacatccatatggtctgc

SEQ ID NO: 29915 - DNA, 101 bp, rice(Oryza sativa)
  misc_feature (71): n=a or g
ctgctttttcagttatactttttaaatgagaaagacgaatggtcacggtttaaaatgaatagtgccaattntcagttatttggaaatggatggagtataat

SEQ ID NO: 29916 - DNA, 101 bp, rice(Oryza sativa)
  misc_feature (71): n=t or c
ggcaacagcagaaggccacaggacatggctggtagcagtaggaggacttgcgacacgtagtcacagtcganggcggtgcatggccaatggtaagagatcag

SEQ ID NO: 29917 - DNA, 101 bp, rice(Oryza sativa)
  misc_feature (71): n=a or g
ttttcctccacctccccttttcctgtcctcgacgacaatggatgagagcagccatcgtggccgcagaagcngcaaggaggtgcccccggtgggagggcttc

SEQ ID NO: 29918 - DNA, 101 bp, rice(Oryza sativa)
  misc_feature (71): n=a or g
tggccttcttcttaagagccagagccgatggatcaattgctttttggccttggtcttccttttcctgccancatcggctggttctctcatatgcccttgaa

SEQ ID NO: 29919 - DNA, 101 bp, rice(Oryza sativa)
  misc_feature (71): n=t or c
ggttggaaggtcggtaactaccgggaaccaagtttatccacctttatggaatcataaggagcctacatgtngaatgtcgagatgggaggctagcaaaggcg

SEQ ID NO: 29920 - DNA, 101 bp, rice(Oryza sativa)
  misc_feature (71): n=a or g
gttcgaagaaaaagtttgaaactaaacaaggccttagtagctcgggtttgatagtgtcactggcttcaccnttgagtgtaaatcgagtcacttaacgttgc

SEQ ID NO: 29921 - DNA, 101 bp, rice(Oryza sativa)
  misc_feature (71): n=a or g
tctttagcaattcctcattttccaaacgctgatggtctatattatcgatcaaggatttttccttaagtgcnagattttccccctgctccttgtattttatg

SEQ ID NO: 29922 - DNA, 101 bp, rice(Oryza sativa)
  misc_feature (71): n=a or c
gggtgtgttgtactgattccatggggttcgaattcgcatgatcgatgattctgcctgcggaataacttcanccctaccgtcccttcaactttacaccgagt

SEQ ID NO: 29923 - DNA, 101 bp, rice(Oryza sativa)
  misc_feature (71): n=a or g
tcagtgctgatgagagcaaaggactacgtgaacgtcctcaaggcgaggatagctgagctggaggagaagancaggaagctatctgaatcacagcagctgca

SEQ ID NO: 29924 - DNA, 101 bp, rice(Oryza sativa)
  misc_feature (71): n=t or c
aaatttgtgaataagaaacttcaagcggcacctatcctccaatctgggatcttatacgacaatcttgccanaacagtcctcaatagcaccaactcgtgctt

SEQ ID NO: 29925 - DNA, 101 bp, rice(Oryza sativa)
  misc_feature (71): n=t or g
ctcttcgagatacggcccaaagcacaaccactgtgctagcttatgcacttcttgctcagtagtatttccangaaatcatctttttgagtttatcttttaca

SEQ ID NO: 29926 - DNA, 101 bp, rice(Oryza sativa)
  misc_feature (71): n=a or g
cacggctagtcaatccatttggctcattttccatcagaccatcgatcaatcgatgagacccaacaccaaanttcgttgtccaccatttgccatattttaag

SEQ ID NO: 29927 - DNA, 101 bp, rice(Oryza sativa)
  misc_feature (71): n=a or g
aataatttgcaatgtattaagttttatcgattggttacaacaagtgttgtattgttgagtaggttgagatngctgaggtgcattgtcaagttgagatggcc

SEQ ID NO: 29928 - DNA, 101 bp, rice(Oryza sativa)
  misc_feature (71): n=a or g
ccactgtaaataagtggaggaatccatcttttcctccctttggcagcgcaaatttcaccttgttaacttcnatggttattctgcagtggttaagtactgtt

SEQ ID NO: 29929 - DNA, 101 bp, rice(Oryza sativa)
  misc_feature (71): n=t or c
ccaccatggtagtgagatggatgaccatgactacgttggtgattctaaggatgatctagaccagcgacganttcgcttcaaccgccgtggtatagctcatc

SEQ ID NO: 29930 - DNA, 101 bp, rice(Oryza sativa)
  misc_feature (71): n=t or g
gtccgaaccggaatgtttcagactggtggatgcaaatccttttgatcactcagctatatcagccaaaaganaacatatatgccatgcccgggggtcatctg

SEQ ID NO: 29931 - DNA, 101 bp, rice(Oryza sativa)
  misc_feature (71): n=t or c
tcatcgattctctccgctgcccacgacgccacacctgccccatccctatgccaaactcgcctcatcatacngccacgctgttccatacttgcgcctcccca

SEQ ID NO: 29932 - DNA, 101 bp, rice(Oryza sativa)
  misc_feature (71): n=a or g
gctacttaatttatgttagtgtaccacaaaacagtggtttttcatgtattttgtgcccttgttatcactcntgtaatactgatcaaagttgaaacttctct

SEQ ID NO: 29933 - DNA, 101 bp, rice(Oryza sativa)
  misc_feature (71): n=a or g
gatagagggaggaagaagtaaagagagagtgacaagtaggactgattgtcaggttggagagtgcaatggcnagtctattgtagtgaaagacatatttaatt

SEQ ID NO: 29934 - DNA, 101 bp, rice(Oryza sativa)
  misc_feature (71): n=a or g
atactcgtatctaaataattaggctatatctttagcttcacccctcttacagttaaagtccaatcaaaatntttcaactccatctaaaaggagagtgaatc

SEQ ID NO: 29935 - DNA, 101 bp, rice(Oryza sativa)
  misc_feature (71): n=t or g
agatttgactccatattggtcttagactccagtgccctggttcttcttcaaagttcctttttttttgcaanaatgttaagaagtttgacaagttccatagc

SEQ ID NO: 29936 - DNA, 101 bp, rice(Oryza sativa)
  misc_feature (71): n=a or g
agcgagagctgatgagcaatcgcaatgcatgatatatcgaggagatatactgtcacgcctagaaattcacnggtaatttcggaactaatttgtgcattaaa

SEQ ID NO: 29937 - DNA, 101 bp, rice(Oryza sativa)
  misc_feature (71): n=a or c
cttacacaaactcttacatgcataaccccttgatagaaacatttacgagggttttttccccttcttcaacntattcaggttatttggtcttcatagggtag

SEQ ID NO: 29938 - DNA, 101 bp, rice(Oryza sativa)
  misc_feature (71): n=t or c
ataatcttagggttcatcgcataccatattgacaacgctgaggtttcaagcttaggattgggaagaagccnagagagcagcacaactaattcaaatgacca

SEQ ID NO: 29939 - DNA, 101 bp, rice(Oryza sativa)
  misc_feature (71): n=t or g
cggcctggggattttgcaagctcacgctactactcacataacattcggcagtacagtgttaggtgtcaatntggtcagtatattcaggtgaccatctacta

SEQ ID NO: 29940 - DNA, 101 bp, rice(Oryza sativa)
  misc_feature (71): n=a or g
tcatcgaaaatgattcgggtagaggaccgcttttctatgaaatccgttgatgggttttcaagtagctcgcnaggaccgccacctccaacctcttcttttgc

SEQ ID NO: 29941 - DNA, 101 bp, rice(Oryza sativa)
  misc_feature (71): n=a or c
agcatctttgaatattgggccagcaaatccatcccaaagccgttaaatctaaatcctggaaaattcgctcncatggagaatatggaaactatagtgctact

SEQ ID NO: 29942 - DNA, 101 bp, rice(Oryza sativa)
  misc_feature (71): n=a or g
cccgtccgcgaccccccagcctccgccgcacgacattcccgtctcaccatagccttctactcgacctcccntgggcggaaggagggggaaggggaggagat

SEQ ID NO: 29943 - DNA, 101 bp, rice(Oryza sativa)
  misc_feature (71): n=t or c
acagaaactaatcaattgagttacttgacctcgctctctcgatattttatgggcctgttcagattgtagcnaaaatggtaatattgtcaaaattttggtaa

SEQ ID NO: 29944 - DNA, 101 bp, rice(Oryza sativa)
  misc_feature (71): n=a or g
tccaatcgcttcttcatcatcatttcagcacacaaacggaactccaagaactaactttcaaccgagcacanggcagatcaaatcatttttggtgtaaacgt

SEQ ID NO: 29945 - DNA, 101 bp, rice(Oryza sativa)
  misc_feature (71): n=t or c
gcgttgggaggatagggatgagacttaaaaagatgtttttttttctcttctcccatgctcacgctcagctnggcttggctccaatgaagcgttagtttttt

SEQ ID NO: 29946 - DNA, 101 bp, rice(Oryza sativa)
  misc_feature (71): n=t or c
tttaatgtgatggaattttgaagggaactaaacactgcctatacataacctcccttcaattgttacaactngaaagatttttcacacagtattcacgcttc

SEQ ID NO: 29947 - DNA, 101 bp, rice(Oryza sativa)
  misc_feature (71): n=t or g
gcgggtggtacattggtacgtactcggtcagttgcatatggtgaaggatttgactgaaggtatcctgtgtnttcatgtgcctagcctcgttataaatggaa

SEQ ID NO: 29948 - DNA, 101 bp, rice(Oryza sativa)
  misc_feature (71): n=t or c
taggctattacgcaagacagagcccaactccattgaaacggagcggcctaaatcaaagccctaggctctcncaggttcttctttttccccccaacacgata

SEQ ID NO: 29949 - DNA, 101 bp, rice(Oryza sativa)
  misc_feature (71): n=t or c
aatgagtcggttttaacagttgagagagcctatatacttggtttcgtggttaggaatgcaaataagattcncagttttatcatattataagtcactttgac

SEQ ID NO: 29950 - DNA, 101 bp, rice(Oryza sativa)
  misc_feature (71): n=t or c
cgagggactctatttacaccaacattagaaattggggaatgttttatatcggttttgtagctaagggacangaatgaaagttgattcatagttaagaaaca

SEQ ID NO: 29951 - DNA, 101 bp, rice(Oryza sativa)
  misc_feature (71): n=a or g
gaaaacagaaattacctcggtctttgaatccggtttaggctcctggtaggacacatttggaaccgttggantttcaatgtcatccaaattcctatcactcc

SEQ ID NO: 29952 - DNA, 101 bp, rice(Oryza sativa)
  misc_feature (71): n=t or c
gccagtgggtggtggatgtcaatacgccgccctaccgtgtcccggctatgcggcggacaacaagatgagtngtcgcccttgctggccatcggcgtaggtct

SEQ ID NO: 29953 - DNA, 101 bp, rice(Oryza sativa)
  misc_feature (71): n=t or c
ggaaatcaaagactaagcaagagtggcgtgttaagagcacggtcgtagcagccgatgaggttgaagccganaaagcaaaaaggttgcttaagggtaaggct

SEQ ID NO: 29954 - DNA, 101 bp, rice(Oryza sativa)
  misc_feature (71): n=a or g
ttttgattctacaattcgtgtttgggatctggatgctggcaccatcctttctgtgatgcatcatcatgttnccccagttaaacaaatcatgttaccgccag

SEQ ID NO: 29955 - DNA, 101 bp, rice(Oryza sativa)
  misc_feature (71): n=t or c
gatcaaagttcaagagagttttttattcacatcatcattagattgcgcatgtgtccttagaagaggccgcntttagtttgttctaccttcctctaggtgtg

SEQ ID NO: 29956 - DNA, 101 bp, rice(Oryza sativa)
  misc_feature (71): n=t or g
agtctatgttcgttgataggattgatcttttttttttggacggaaagcaatagctcttgcaacgtgcgtgngcgtgggcgtggcggacaaacagtggccgt

SEQ ID NO: 29957 - DNA, 101 bp, rice(Oryza sativa)
  misc_feature (71): n=a or g
gggaagaaagatagtacaagtacctcgtgataaagatactaatcactccgtacccatagaagtcgtttagnataatttttaagtcaaactttaaaaatata

SEQ ID NO: 29958 - DNA, 101 bp, rice(Oryza sativa)
  misc_feature (71): n=t or c
accgcgccgcccctcctctctaccgccgagtgctacaacctacctccggccagatccaaaggggaggagcngacgtcacccgccgctgccgctggggaaag

SEQ ID NO: 29959 - DNA, 101 bp, rice(Oryza sativa)
  misc_feature (71): n=t or c
tggatctattgcccgtctctaacttggtctgctcgctcaacatcgtcgacctcttgttggcgctcatgcanggcaaccaacttgtctcgttttgagccatg

SEQ ID NO: 29960 - DNA, 101 bp, rice(Oryza sativa)
  misc_feature (71): n=t or g
tacccctccgtcccaaaaaacttaacctagaaagggaggttgagtttttttaaagaaaaaacggagggagnaccaataaaggataggatccgcacgaaggc

SEQ ID NO: 29961 - DNA, 101 bp, rice(Oryza sativa)
  misc_feature (71): n=t or c
agacctaaaaggataagtcaggctagagggcacatatgttaattactccttaccaactctctacttttttngagaaaaaacaatgagctatatagcaatta

SEQ ID NO: 29962 - DNA, 101 bp, rice(Oryza sativa)
  misc_feature (71): n=t or c
ctccttattaattcagttcatttggaccaaacaggaacaaatcaaaaaagaagtcagtttcctttcccccntctctgagcgcgtcacaactacgccaactt

SEQ ID NO: 29963 - DNA, 101 bp, rice(Oryza sativa)
  misc_feature (71): n=t or g
tatagagagctacagaaagaaagatggccctaagctaaaatggaaaaactaaaaaaagagccagggcaganatgccacttagggtgtgtttttaacgccaa

SEQ ID NO: 29964 - DNA, 101 bp, rice(Oryza sativa)
  misc_feature (71): n=a or g
ataatttggataatatttgaatattatatatttttaataatattgtaaacgtgcgcacagtcatctttatnaacgcacaacatgcacattgtaccctctta

SEQ ID NO: 29965 - DNA, 101 bp, rice(Oryza sativa)
  misc_feature (71): n=t or c
tggtagccaaggcggtcgagtagtagcaagtcggctgacgttttccttgccttcttggcttgtctcttgtngatcgcatcaccacgctcctccacacgatg

SEQ ID NO: 29966 - DNA, 101 bp, rice(Oryza sativa)
  misc_feature (71): n=t or g
catttatctatctataataactctattaattgagcaccacgagggaactaaccgaaaatatgtaggagtanttgatgactaaccctgctgcaactaagctt

SEQ ID NO: 29967 - DNA, 101 bp, rice(Oryza sativa)
  misc_feature (71): n=t or c
acccactgattccatttttgcactcagttgatagcgagcacaaccgcagcaccatcgtgtactcccacgcngacctggcaccaccatgacctaacaagcgc

SEQ ID NO: 29968 - DNA, 101 bp, rice(Oryza sativa)
  misc_feature (71): n=t or c
tagtccaacacctcctcctcccaagttgcctcgatctatctacaacaccgaccaccaaacattatctgttntgaaacaccgaccaccaaacaccgacctcc

SEQ ID NO: 29969 - DNA, 101 bp, rice(Oryza sativa)
  misc_feature (71): n=a or g
taattttgttttcatttaatttgcttcgtttttatcactattttttcatctcctttgcaggtgctggactnttcattagtgttcatctcacagttctgacc

SEQ ID NO: 29970 - DNA, 101 bp, rice(Oryza sativa)
  misc_feature (71): n=a or g
tcctcctcctcctccttgcagcagcaccagcggcaacaacagctccacgttctgccgcaatcgctccaccntcgacctacaaaatacacgcacaaatagct

SEQ ID NO: 29971 - DNA, 101 bp, rice(Oryza sativa)
  misc_feature (71): n=t or c
ctttggatgatcatattatgaatatattgaatgcctgtaatgataatgagacatcttcaaaattgtggcantgtcgtttaggccacatttctaaggggaga

SEQ ID NO: 29972 - DNA, 101 bp, rice(Oryza sativa)
  misc_feature (71): n=t or c
tactaatggatttaagagcaaacatctcctgggtacaggactttacggccaggtgtataaaggagtttttnggaagtctagattggaggtagccgtgaaga

SEQ ID NO: 29973 - DNA, 101 bp, rice(Oryza sativa)
  misc_feature (71): n=a or g
aacgacaacttaagttgacaacttggcaataacggtccgaaatgaaatttgacgagaatgtagctcagacnccctatttgcgaatgctgtacagatgacaa

SEQ ID NO: 29974 - DNA, 101 bp, rice(Oryza sativa)
  misc_feature (71): n=a or c
caagaggcatagagttaaatcagcgattatacttttttttccccttacgtgagctgcagccactgtgatanactgatacttaacggggcgttttggtttga

SEQ ID NO: 29975 - DNA, 101 bp, rice(Oryza sativa)
  misc_feature (71): n=a or g
acacatccaaatccatagcaagccagagagaagattgcaaaatgcaatccagaccatcttcgcaaccaacnccaaaactattaacaccagatagatgcttt

SEQ ID NO: 29976 - DNA, 101 bp, rice(Oryza sativa)
  misc_feature (71): n=t or c
attagttcccgatatcgagtatttgtactctaatgtataatgacttggcaaggcagccatcgttgtcgttnaaagtcgctgcaagcctcggcagttttaaa

SEQ ID NO: 29977 - DNA, 101 bp, rice(Oryza sativa)
  misc_feature (71): n=t or c
gctttgaaaggcaaatgagtgcagtttcccaaagtttgttgggttggtattcacaggatcattattttgangtcgtcacgaatgttgtgggtttggctgct

SEQ ID NO: 29978 - DNA, 101 bp, rice(Oryza sativa)
  misc_feature (71): n=a or g
tagtagctagccgtcgtcgtcaagcacaagcgaaaccgcacgtaaacgcgatcaaagttaactacatatgnctaggcgtgccagcattattgttgcggccg

SEQ ID NO: 29979 - DNA, 101 bp, rice(Oryza sativa)
  misc_feature (71): n=a or g
ttacctggttagtaagttcttctgtttcctcttctgcctcgtccttatcaagtgtttcatctatagcatcngacatcatttcaagctgcatgtaaaaatag

SEQ ID NO: 29980 - DNA, 101 bp, rice(Oryza sativa)
  misc_feature (71): n=a or g
tcgctattaatttgagggacctcggtgaccttattccaacccagaagctgctggcctaggcccaggttgcnttcggtagtaaccgcttcccaatgatggtt

SEQ ID NO: 29981 - DNA, 101 bp, rice(Oryza sativa)
  misc_feature (71): n=a or g
gagaaaagaattgaagaaaaaaatggcggaatcatttcattcatttgtctgcgacgacggatgaggagtcncttctgtcagaaaaacctggcgatgttagg

SEQ ID NO: 29982 - DNA, 101 bp, rice(Oryza sativa)
  misc_feature (71): n=a or g
gtgggaacgatgtgaccaccgtgaccgagtggccatggaagtaatgagataacttccttacagtgatcaanatagcgtacaacaacttctgaacctgagga

SEQ ID NO: 29983 - DNA, 101 bp, rice(Oryza sativa)
  misc_feature (71): n=a or g
atgtttgtatattgagctttataattaatgggttacaactctataagataggattagatgcgatagtcacntcttctataaaacttgtcataaaaagaaca

SEQ ID NO: 29984 - DNA, 101 bp, rice(Oryza sativa)
  misc_feature (71): n=t or c
cacctcaaccggtcaacatgtattctttaatagctaccaatttaagttgtgatcctttcacataaattttnaaggtggtattaatctattaacattaattg

SEQ ID NO: 29985 - DNA, 101 bp, rice(Oryza sativa)
  misc_feature (71): n=a or c
cagcctgcagaacgccgttccccagaggaccttcagcgacttcggagatgacgtctacttcgtcgccgacnaacggggctacgagtccgtcgtccactacc

SEQ ID NO: 29986 - DNA, 101 bp, rice(Oryza sativa)
  misc_feature (71): n=a or g
tactacacaaaaccaaattaatgctgatggcgaaagcgtcatgaatgaatggataaactctggttgagcantggggcccacgcctcagcgagtggagctcc

SEQ ID NO: 29987 - DNA, 101 bp, rice(Oryza sativa)
  misc_feature (71): n=t or c
tttagtatagataagttggttatatatcttggggtggaacctgtttccttgggtggtttaagtctttgatnagtatttgtgcttgtatttatggcaaatat

SEQ ID NO: 29988 - DNA, 101 bp, rice(Oryza sativa)
  misc_feature (71): n=t or g
tgcatggttgtaggcaactgatgggtgaggagctttctggcctaggtgttagagacctacaaggtttaganaataggcttgaaataagtctacgtaatatc

SEQ ID NO: 29989 - DNA, 101 bp, rice(Oryza sativa)
  misc_feature (71): n=a or g
aactttacacccctggatctaaacatccccttagatcatgaaacgatgaaaatttagtccactaccggagngggagcacttccctcagctgttctttcctc

SEQ ID NO: 29990 - DNA, 101 bp, rice(Oryza sativa)
  misc_feature (71): n=a or g
agttgaatgcatggactctatggcaatcatggtgcaacatagcggcgacgattacttgacagcagccatgngctcgtcgccgccgcggccgcagatgaagc

SEQ ID NO: 29991 - DNA, 101 bp, rice(Oryza sativa)
  misc_feature (71): n=t or c
tcaccggactcaaccaatgattgccatgaaagtcatcgtcaaatctgaggaacactaacaacatccctgcngaccaaagtctaacagatagtcggtgctca

SEQ ID NO: 29992 - DNA, 101 bp, rice(Oryza sativa)
  misc_feature (71): n=t or c
gatacctccatgcttctggtatcttgcacatctccgaatgaactcatttgtgtcttcatacattgtaggcnaaaagaatccactctgtcagatctttgcct

SEQ ID NO: 29993 - DNA, 101 bp, rice(Oryza sativa)
  misc_feature (71): n=a or g
gacctaccacgttagcaaaattactttccaaaccacctaaggtgtcaatttgcactgttttttaaattgtnggaggtgttataagcggttttgtggttgag

SEQ ID NO: 29994 - DNA, 101 bp, rice(Oryza sativa)
  misc_feature (71): n=t or c
gtgacgatctcgagcaccagaactccaaagtactccggcacgatgaagcccaagcgggtttcatggttttntgtgactttgttaacgctacgtatacatca

SEQ ID NO: 29995 - DNA, 101 bp, rice(Oryza sativa)
  misc_feature (71): n=t or c
cggccaaagcctattttttcatgcggttggacttggacctcccttctaccaaaaaggtttgcgaaaatagngatttttccatgcgggtggtgcacccgcac

SEQ ID NO: 29996 - DNA, 101 bp, rice(Oryza sativa)
  misc_feature (71): n=a or g
aattcttcttcagccaatgaagaatggtttcacttggaacagatattttgtctgtttgtgcgtttaacacnttacgtgcagttatgaaacaagatgtttac

SEQ ID NO: 29997 - DNA, 101 bp, rice(Oryza sativa)
  misc_feature (71): n=a or g
ggggtcggagaatttgttgccgaaccctaccacctagtgattaggaatcacaattcatgatattataactngactaccacctcatcgatcgatctataccc

SEQ ID NO: 29998 - DNA, 101 bp, rice(Oryza sativa)
  misc_feature (71): n=a or g
gattttctcatcgtcacttaattccagatgagatggaagaactggcaaatcatgattagtagtatcctccngcgttgatgccttcaaaactggggaaaatg

SEQ ID NO: 29999 - DNA, 101 bp, rice(Oryza sativa)
  misc_feature (71): n=a or g
tcatagatagccaaatcttcaaagtggcaaaaaaattaaatacccaaaacccccctccgttaaacccgaanaaaaaaaaccgcaccaccagcgtggcgccg

SEQ ID NO: 30000 - DNA, 101 bp, rice(Oryza sativa)
  misc_feature (71): n=t or c
aagctggacggatccttctagaaaggacaaaaggtctattttgagtccctcaactatatagaaacccaacngctctcgcctccctcgcgtttcttccccct

SEQ ID NO: 30001 - DNA, 101 bp, rice(Oryza sativa)
  misc_feature (71): n=a or g
tactgaatatagaaatggtactgcatattgaacccgcggttattccagttgtgctgttattcacacgcganaaaactttatcattcttaatccctttgtca

SEQ ID NO: 30002 - DNA, 101 bp, rice(Oryza sativa)
  misc_feature (71): n=a or g
gatggcaaaaaccagacggtgaaaacaaaggtgtccatcagtaatagcataataagccagctatcaaggcngaaacaccagtcagcggcggacgaggcggc

SEQ ID NO: 30003 - DNA, 101 bp, rice(Oryza sativa)
  misc_feature (71): n=a or g
agaacaagaaggaatctgttgttaacatcgttggcaggtactgctaataccaagcaataatgcaactactntgcaagcttttgttttttaaaaatagtttg

SEQ ID NO: 30004 - DNA, 101 bp, rice(Oryza sativa)
  misc_feature (71): n=a or g
tgaatcagtgatcagttatgtactcgttcttgatcttgttgagtgcttctgtttcagaaggatggtgttcnagtttgcaagagatggagaaactaatccat

SEQ ID NO: 30005 - DNA, 101 bp, rice(Oryza sativa)
  misc_feature (71): n=t or c
atgtgttttcttgctcactccgatcgagttgatatatagcttcagacttctgatgatctcattgacgtgtngggctaaggatcatcgagaaagaaaggaag

SEQ ID NO: 30006 - DNA, 101 bp, rice(Oryza sativa)
  misc_feature (71): n=t or c
cagcacgaagcgagcaagatggcaaggggaagatgacgaagaagatgaccagatcaacgggctccccgacngccttgagctccggcgatcgcgcgtgccgt

SEQ ID NO: 30007 - DNA, 101 bp, rice(Oryza sativa)
  misc_feature (71): n=a or g
ccaggtcccttgagaagaagacgctggtaaaatctagtacaccggctaagaaacaagagaagacggctcanaagaagccgccacctgttgacggtcgttag

SEQ ID NO: 30008 - DNA, 101 bp, rice(Oryza sativa)
  misc_feature (71): n=t or c
agcatcggagctggcggccaaccctctcccacgggttgaaactggtacgatagttcgagaatgccggaaanacttcccatctagcgtccgatcacggaaga

SEQ ID NO: 30009 - DNA, 101 bp, rice(Oryza sativa)
  misc_feature (71): n=t or g
ttctacatgatatatacatatatagcttttgtgtaattttaattcccaatccgcaccgcgttccgtatccnataatatatgtgcataatattttatgcagc

SEQ ID NO: 30010 - DNA, 101 bp, rice(Oryza sativa)
  misc_feature (71): n=a or g
aacctaattaactattctagcccatagatattattaattcagcctatctcttctctacattataaaaattnaagatgtttttgccatcgattacgtacgtc

SEQ ID NO: 30011 - DNA, 101 bp, rice(Oryza sativa)
  misc_feature (71): n=t or g
aggaaggagaaagaaaggataacaaatcggtttttggaggaagttttgcagattagatcagtcggttggtntgtcggttggtttgtttccttctcggttgg

SEQ ID NO: 30012 - DNA, 101 bp, rice(Oryza sativa)
  misc_feature (71): n=a or g
cctgttcgggtacatagatcctctttttgtaccatagaacacctttttcatcggtggaaaactcctgtgcncgtcctgcagctaggcgtgccttcacttct

SEQ ID NO: 30013 - DNA, 101 bp, rice(Oryza sativa)
  misc_feature (71): n=t or c
aatggggcttgatgtccgcggcggacttcctcgttgctggccgagtgtttttcccttccttcggtttcccnccttctttggccggacccttttctggtcgt

SEQ ID NO: 30014 - DNA, 101 bp, rice(Oryza sativa)
  misc_feature (71): n=a or c
caagctagcaaaaaaagattaaaactgtctccctggaagacattaatctttcagtataaacaaagcactgnagttttaatctttcagtataaaaagattaa

SEQ ID NO: 30015 - DNA, 101 bp, rice(Oryza sativa)
  misc_feature (71): n=a or g
cacgggttgttgagagtctggaatgacacgggttgtagttgtgtcggttgacccaccatacctaataagtngatccgccccttcacggtttgttttacatg

SEQ ID NO: 30016 - DNA, 101 bp, rice(Oryza sativa)
  misc_feature (71): n=t or c
ctccttgattatttcctctgatgtagcttctcgttcctagcaaatctcataatgcaagcacttcttccggnaggccttgtcttgttccgaggagaacctta

SEQ ID NO: 30017 - DNA, 101 bp, rice(Oryza sativa)
  misc_feature (71): n=a or g
gtctgaatcctcttccacaactatggttttcttcttgtcccctgccttttccaaaacccccatgcttgacncagcttcttctttccttggtttcttattcc

SEQ ID NO: 30018 - DNA, 101 bp, rice(Oryza sativa)
  misc_feature (71): n=a or g
agcaagtggtcaaattgttgggatcactttcaggagaaggctgggcagaaggcagagtgcaggcactgcangaagcagctcagcttcaagaatggcacctc

SEQ ID NO: 30019 - DNA, 101 bp, rice(Oryza sativa)
  misc_feature (71): n=a or g
ttccatcggtttctgccgctggcccggtgtcacttgcagcaagacgaacacatctcgtgtcgttgcgctanacctcggatcatctggcctcaatggccaaa

SEQ ID NO: 30020 - DNA, 101 bp, rice(Oryza sativa)
  misc_feature (71): n=t or g
aggaccggctcgatcgatcaccgttgtgttgccatcacacacacgcagacacgctttttgttagtatctgngttgaagagggctgggttgcatgtctactc

SEQ ID NO: 30021 - DNA, 101 bp, rice(Oryza sativa)
  misc_feature (71): n=a or g
tggatttgctgcatagaattaccgaaatggagttgctgtcaactccaaagctgacactgtacttttgtatnttgctgttgtatagaaaacttcacttattg

SEQ ID NO: 30022 - DNA, 101 bp, rice(Oryza sativa)
  misc_feature (71): n=t or c
aggtaacggagtcgaagaagacgaccagcgtggacgacagaagcggaaacgagtgacggcgccggaagcanggggggcggcggcggcgaccgtcgccacct

SEQ ID NO: 30023 - DNA, 101 bp, rice(Oryza sativa)
  misc_feature (71): n=a or g
ctcagagctgcttcgttgtgtaagggagtaagagctagtttaacagtgagaactaacatgtattagagctnacatgtacaatggattagctataaggttgc

SEQ ID NO: 30024 - DNA, 101 bp, rice(Oryza sativa)
  misc_feature (71): n=t or g
gaaatgattcttttctcattctttcccacttatcctagaattagtatgtatgggaatattgagcgcttctnctttgtatcactctacccttgaattgaatt

SEQ ID NO: 30025 - DNA, 101 bp, rice(Oryza sativa)
  misc_feature (71): n=t or c
atgttaatcatatttcttgatatttctcttttccgtccagctaattagctaaaatctttcatcgtgtgccntatcggtgatatgggcccgggggtacatag

SEQ ID NO: 30026 - DNA, 101 bp, rice(Oryza sativa)
  misc_feature (71): n=t or c
aaccccttgacattttaggagttgctctatgtagtcacagggaggtgcaataatatggtggggatgtggcntttaagtgtagggatatgctgtaacatact

SEQ ID NO: 30027 - DNA, 101 bp, rice(Oryza sativa)
  misc_feature (71): n=a or g
ataatttaattgttgtatatcgtatctaattctacaccacacaatcttcgcatgacaatccccttgttagnttaatatcaactacaacttgctaaactaat

SEQ ID NO: 30028 - DNA, 101 bp, rice(Oryza sativa)
  misc_feature (71): n=a or g
cgcgcaaatgcgcaaatctgcaattttccgttggtcaccccaacttttcatccgccatgtccgatgtagcnacagcctctgtccgttacagcttacaaagc

SEQ ID NO: 30029 - DNA, 101 bp, rice(Oryza sativa)
  misc_feature (71): n=a or g
gcattcgtacacggtataaaatagtgttcccgcgtgttgtgggacgcacggtatggtacataatattcccntgcgcttttgtctattcctcaccggaaatg

SEQ ID NO: 30030 - DNA, 101 bp, rice(Oryza sativa)
  misc_feature (71): n=a or g
cagcaatacaacactatcaatattgcacttatctctgatgaatgtggaacatccacttacagtgcggtacngaaatgatgtgacgtgtcgtccatcaacgt

SEQ ID NO: 30031 - DNA, 101 bp, rice(Oryza sativa)
  misc_feature (71): n=a or g
gttcttgttcgtggcaatcgataagttcacaaagtggatcgaagcagagaccacacaagaaatcaaatccnataatgccatcaaattcataaagggaactt

SEQ ID NO: 30032 - DNA, 101 bp, rice(Oryza sativa)
  misc_feature (71): n=a or g
tcactggagcgccgccgctgccatcaacccgagtcgcgccgctgctttaacctcaccgctatcgccatccntcgtcgtgtcgtgcaccggtgagttcccct

SEQ ID NO: 30033 - DNA, 101 bp, rice(Oryza sativa)
  misc_feature (71): n=t or g
acacaataacatagacgcatggtcatggtctcgtcgtctattgagttgtgcgagcttagttgtgtactgtntggtcatggcgatcacgtaggcatgcagcc

SEQ ID NO: 30034 - DNA, 101 bp, rice(Oryza sativa)
  misc_feature (71): n=a or c
atacccaaaacagcttgtttcttgacgggagggagttaaacctacaaaattcattccccacaaaaaaaaancctacaaaattcaccattatttgaagcccc

SEQ ID NO: 30035 - DNA, 101 bp, rice(Oryza sativa)
  misc_feature (71): n=a or g
tcgtgagagatgaaaaatccatctccacaagtctatattagtggaggagtttttttaataatagaatacantattaacctttaatcaagaagctacagcca

SEQ ID NO: 30036 - DNA, 101 bp, rice(Oryza sativa)
  misc_feature (71): n=a or g
taaatatgtcttaacatatcggttgtcacatactcctatatgatagctcaatcctaaggtatcaatgatgnaaatattgaacatctgaccttattgatttt

SEQ ID NO: 30037 - DNA, 101 bp, rice(Oryza sativa)
  misc_feature (71): n=a or c
actctgaaacaactattaattacaagctaacaactcagtaattgaggccgtatcactttttgacagcacgnggaaaaataacctaaatacgcagttggatt

SEQ ID NO: 30038 - DNA, 101 bp, rice(Oryza sativa)
  misc_feature (71): n=t or c
cgccgtcccgctcctcgccagatccggcggctcgggaactagctcctccatgttcctctcagcatctctcnggcacagcggcgggtcggcggctccccgcg

SEQ ID NO: 30039 - DNA, 101 bp, rice(Oryza sativa)
  misc_feature (71): n=a or g
caccgttgcccgctgtagagagaaagtgagtgatgaaagagtgaatgacagagagaaagtgaggataaggntgaggaggtgagagatggagagagaggatg

SEQ ID NO: 30040 - DNA, 101 bp, rice(Oryza sativa)
  misc_feature (71): n=t or c
caaagaaccagcattacccacaaaattagcacatggagcaagtagtattagcttgtaccactagtacaccnctactgcacaggacatcggagcggaacagg

SEQ ID NO: 30041 - DNA, 101 bp, rice(Oryza sativa)
  misc_feature (71): n=t or c
tctaaaattcattttttcttcattctaaaaaaaaaatacacagacaaggctgtggtcctgtggagtgggtntttgacgacaagagttcgtaatcacacgtt

SEQ ID NO: 30042 - DNA, 101 bp, rice(Oryza sativa)
  misc_feature (71): n=t or c
aagcctaaaaatctatcgtcgcgggtcaaatagcaaaacctagcgtggaataatgtatgacatcggggggnctagaaggtgagtgagtgggtaggcacctc

SEQ ID NO: 30043 - DNA, 101 bp, rice(Oryza sativa)
  misc_feature (71): n=a or g
tggggctatcgttataccccgagttttatgatcgagggagatgaatgagatctgaccattagttaagggantcagagtgaacttattcctctatcagcagg

SEQ ID NO: 30044 - DNA, 101 bp, rice(Oryza sativa)
  misc_feature (71): n=a or g
gaccctaacctaaaacccaaattcatatcttttaatccattagagttaaggtgtcgctgttaccgtaccanagaagatgtccataatccgcgtgcgcacac

SEQ ID NO: 30045 - DNA, 101 bp, rice(Oryza sativa)
  misc_feature (71): n=t or g
taccgatagcgattggatttaacaagaatgtaccaaccaagatcgaagcagtcggcggctcggcgtcgtgngggctgcccatggcgggggcctcccggccg

SEQ ID NO: 30046 - DNA, 101 bp, rice(Oryza sativa)
  misc_feature (71): n=a or g
aaaattgtatatcattggttcagtaccgggactactaagggacaagttttataacagggatagttgccatntctaattttatccatgtagcataagaggtg

SEQ ID NO: 30047 - DNA, 101 bp, rice(Oryza sativa)
  misc_feature (71): n=t or g
cttaatgttgggtttgaatcccattcttaacggtaacagcagacatgacgcgtctttcaatttgtagtaantagtaactaataccagagtatccgatatca

SEQ ID NO: 30048 - DNA, 101 bp, rice(Oryza sativa)
  misc_feature (71): n=a or g
cgcgtgttgcagtggaacgcgtttcttctggaactttcgcggcctcgagtgttcaaatttgcaagaacatnctatatgccacgcgtgtaaagattattccg

SEQ ID NO: 30049 - DNA, 101 bp, rice(Oryza sativa)
  misc_feature (71): n=t or c
ggagcatctcttgcacattcggtgctgttccctttcggccctattgatcatatggaataatggagctacanatacatatagatagatagatatagtcatga

SEQ ID NO: 30050 - DNA, 101 bp, rice(Oryza sativa)
  misc_feature (71): n=a or g
agttatgcgaggctgtaaggagggcatttgatgagtcatggccttcattgaagccttggagctgcatttancattttaatatactggagagttgagcctcg

SEQ ID NO: 30051 - DNA, 101 bp, rice(Oryza sativa)
  misc_feature (71): n=a or g
aaaccacaattctgttttacaggacatatatcacttatgctcaggtaaggccataaagaatctgacataangatggctgaaggttttagattaccatgatg

SEQ ID NO: 30052 - DNA, 101 bp, rice(Oryza sativa)
  misc_feature (71): n=t or c
gagattatcgtggacagaaaaagtccatgtcgaatctaatctccgattggtttgtgccctaatgattccangtttggcgttaccggcgactaaacaaatcg

SEQ ID NO: 30053 - DNA, 101 bp, rice(Oryza sativa)
  misc_feature (71): n=a or g
agtcttaccgtctactattatacctgctctaagacgacggaaggaataacgcggaggaacgacaataagancaggtacaatagcatgctataagccagcta

SEQ ID NO: 30054 - DNA, 101 bp, rice(Oryza sativa)
  misc_feature (71): n=t or c
aaaagtagaaactcatatgttttggacttcctaccggattgttgacatgcaattcttatttagaacaactngtagtgattcatgtttgaaagtactttgac

SEQ ID NO: 30055 - DNA, 101 bp, rice(Oryza sativa)
  misc_feature (71): n=t or c
aaacatttatcggctcctgaaacttcggccatggtggtgcgcagatcagcaggtatccagatgcaatgatntaaatgatgcatcgcgcgtgcgcccgcgcg

SEQ ID NO: 30056 - DNA, 101 bp, rice(Oryza sativa)
  misc_feature (71): n=t or c
gccaaactatcaatacccaataaacgggggcaaattatttgtggacatctatacccctacaattttctcgngacgctggcttggcccacaaattaacattg

SEQ ID NO: 30057 - DNA, 101 bp, rice(Oryza sativa)
  misc_feature (71): n=t or g
ggggaagtagaggaagaaggtgaggtggccacttacatggggcctcacaaagttattttattttcttcatnatgacttggatgtcacggtagtaaaaccag

SEQ ID NO: 30058 - DNA, 101 bp, rice(Oryza sativa)
  misc_feature (71): n=a or g
tgagcctacatataggcccatcacaggtaacctcttatctgcgatgggtgttaagtttacacccgtcacanataatatacctcacttgtgatgtgttaatt

SEQ ID NO: 30059 - DNA, 101 bp, rice(Oryza sativa)
  misc_feature (71): n=t or c
cagaatgtggtattaacagcaaatcatgttgaattggtactagtaaaagtgtgaaacaatttttcaagcanaataatcgaactgtatatgtgaccaaactg

SEQ ID NO: 30060 - DNA, 101 bp, rice(Oryza sativa)
  misc_feature (71): n=t or c
atccatcataaccacatgctataccacattaaagtccaacctgagttggccctgtttgagaccaacttgcnaaacgatctcatttccagttgagttgcagt

SEQ ID NO: 30061 - DNA, 101 bp, rice(Oryza sativa)
  misc_feature (71): n=t or g
tttaaagacctttaacagcagagaaagtgacatgcaacagggtatttctaagttagcagcagtaacaagtnactaatggaactagagcgagttggaaaata

SEQ ID NO: 30062 - DNA, 101 bp, rice(Oryza sativa)
  misc_feature (71): n=a or g
aacaacaccaactaaattaattgacctaacatccagtcctatgggaacaacagcagcaactatggcaacancagcaaatggatcaatttttcacatgggct

SEQ ID NO: 30063 - DNA, 101 bp, rice(Oryza sativa)
  misc_feature (71): n=t or c
gagaatagatagtataagcttggcaccataatgcaatagtggatgaataataagaggaaacttatgaattngattgcatgcctcatatatcttttgaaata

SEQ ID NO: 30064 - DNA, 101 bp, rice(Oryza sativa)
  misc_feature (71): n=t or g
catagtcatagaagcctttttttaaggtgatgacgaggataccacactctagtccgagtgtaataccttanaattaaatttgaaaatatattttttattta

SEQ ID NO: 30065 - DNA, 101 bp, rice(Oryza sativa)
  misc_feature (71): n=t or c
ttctggttctatgaatacaattcgtaaattacttggccgcatgctgacacacgctagcataatttaaaagnggtacagcactgcagtaattctgagggcct

SEQ ID NO: 30066 - DNA, 101 bp, rice(Oryza sativa)
  misc_feature (71): n=t or c
tgcatttacaagaaaattaagatgttggaagaaccctccattgaaatcctttcgtcttcttgcaacaatgncattaatatcagtgggattctcgcggagct

SEQ ID NO: 30067 - DNA, 101 bp, rice(Oryza sativa)
  misc_feature (71): n=t or c
caatatccaattttaaagtttatggatgaaatttagacctttgtgaaagctcagaaatgtaaaatagaccnttttttttaaaaaaaagctacagagtatat

SEQ ID NO: 30068 - DNA, 101 bp, rice(Oryza sativa)
  misc_feature (71): n=a or g
agtcggagggcaagatgcaggtaagcactaaaacagtcccatatcggctagggtgtgccgtaggaccacantaaaattaggtggacttacgctgcgaggac

SEQ ID NO: 30069 - DNA, 101 bp, rice(Oryza sativa)
  misc_feature (71): n=a or g
gcatattcatgtattttcctcagcacggcctggcgttccaaataagtaattaagcagcgaacactccaatnaactgtttttactgcaccattggccaggat

SEQ ID NO: 30070 - DNA, 101 bp, rice(Oryza sativa)
  misc_feature (71): n=a or g
ttgtgacaccaaacacacctaatattactttcttgccacttctcaggtggtaccgtttattgggtttgcantcgcaatgttcatgttttactctctagttc

SEQ ID NO: 30071 - DNA, 101 bp, rice(Oryza sativa)
  misc_feature (71): n=t or g
ctccatgtcacgaaaatctatgtaaaattctagagtccgtttggttggagagagtgattgggaatttaganggatgaggttattaattattttatttggtg

SEQ ID NO: 30072 - DNA, 101 bp, rice(Oryza sativa)
  misc_feature (71): n=a or g
ttggtccggctttaccctcgcatgcagttttccctattcccatcattatcatgaccttcccgcccatcggncaaggtcacaccactttccttatctaagca

SEQ ID NO: 30073 - DNA, 101 bp, rice(Oryza sativa)
  misc_feature (71): n=t or c
ccaataaacagcaaaaacattttaagataaaaatacatatcagttcaagtgggctgtgcttgtacctaagngtatctggtcaaacccaagaaacaaaattt

SEQ ID NO: 30074 - DNA, 101 bp, rice(Oryza sativa)
  misc_feature (71): n=t or g
gagaagctgtcggctcatgaaggagaaaagttaggagtaaatgattcaagtcagtatcgtagtattgttgnagctttacaatacttgacacttacaagacc

SEQ ID NO: 30075 - DNA, 101 bp, rice(Oryza sativa)
  misc_feature (71): n=a or g
gttgtgatacttcatattattatttgcatgccttagggattaaccgagttcctttgaatgccgaccaacgntttagggagttggccttttaacaactactc

SEQ ID NO: 30076 - DNA, 101 bp, rice(Oryza sativa)
  misc_feature (71): n=t or c
cttgcgaagctgaggtgcaggttgcttatgttggggacattagcaaggaagtgacttaacctgaaaacctnctgatatcccgcgcttacattgttgaggct

SEQ ID NO: 30077 - DNA, 101 bp, rice(Oryza sativa)
  misc_feature (71): n=a or g
cccggtggcgaacgtggcgaaggtgatcttcttcctggtggctggtagagcatcgagcgggccacggtgcncgccgccgccgccgccgccgttctccagcg

SEQ ID NO: 30078 - DNA, 101 bp, rice(Oryza sativa)
  misc_feature (71): n=a or g
gagaattcaaattggaaatagtaaaatttgatcgaaatttgactgaaaaagttatactattggggctcgtnatccagcactcaattgaaaaggtgaacccc

SEQ ID NO: 30079 - DNA, 101 bp, rice(Oryza sativa)
  misc_feature (71): n=a or g
tcactgcaccacggtaccctcgacctcaattgtatcccttgcggcgatacaatgttccaccaccaccaacntacgaccatacatcgccgtagcttggacga

SEQ ID NO: 30080 - DNA, 101 bp, rice(Oryza sativa)
  misc_feature (71): n=t or g
cagagtatatctctttcacggttatactactgccttcgctttcaccagttgaaggtgttctgaactttctnatcgagttgcgtgtaatttgtttcacaggg

SEQ ID NO: 30081 - DNA, 101 bp, rice(Oryza sativa)
  misc_feature (71): n=a or g
ctagctcatttagtggtatttgacttcagctctatttcctgggattcaagtgcggctcgttacataacacnatgtaagcatttcttgattgatttgctcgt

SEQ ID NO: 30082 - DNA, 101 bp, rice(Oryza sativa)
  misc_feature (71): n=t or c
actctggtggaatctgaacaaaagtccaaagactacttgactatccggagactaattgtgcctaatcactntctcttgctatatatatggctatgaaacat

SEQ ID NO: 30083 - DNA, 101 bp, rice(Oryza sativa)
  misc_feature (71): n=t or c
atgtattgtgtttaaatcttgcaggtttgcgtccaaaaacttctattgccgaaaaacttggaattgtgtgngtccttccattgttgttatctggtattttg

SEQ ID NO: 30084 - DNA, 101 bp, rice(Oryza sativa)
  misc_feature (71): n=t or g
aaagcaagaaacgattccgctgttgctgcttcacacacaatcgaacgaatgggacgtgctatttcacgctncaaatcggacgcgggcgggcgagaggacgg

SEQ ID NO: 30085 - DNA, 101 bp, rice(Oryza sativa)
  misc_feature (71): n=t or c
ttttattatattcagaggaattggagaaagaaacaactatgaaagtatagttttaccccatgaacccaatngagcctcactcccatgctaggatccacctg

SEQ ID NO: 30086 - DNA, 101 bp, rice(Oryza sativa)
  misc_feature (71): n=t or c
atgctgcttccagccttcaaggccaactgggggccacccatcatgtttatgtatgcacgtacgtataatgnatgtctgccttcctgcatttgccgagaggg

SEQ ID NO: 30087 - DNA, 101 bp, rice(Oryza sativa)
  misc_feature (71): n=t or c
ttagatggcaaagctttgactggaattgcatgagcataaaatcataaacaagaatagaatacaattcacantaattaaatcaaaaccatcggtcaaataag

SEQ ID NO: 30088 - DNA, 101 bp, rice(Oryza sativa)
  misc_feature (71): n=a or g
gtggacgctgcagtaggaatacaatcgctttgtttggtcagtttggtgttgcaaaaactgaaaaaaaaaanagagagagagagaaagaaaggaaaagagga

SEQ ID NO: 30089 - DNA, 101 bp, rice(Oryza sativa)
  misc_feature (71): n=a or g
tctccttgatgttccctgagccagagtcccaccgttgtttggggttcaatgctagacaacaaactttggcnactctggtttgtggcagatggtaacaccga

SEQ ID NO: 30090 - DNA, 101 bp, rice(Oryza sativa)
  misc_feature (71): n=t or c
ctccaacttagtgcaaacgaggcctgtcggctgtgttgaccccggtttagctgacgttgcacctacgtggnagtttgatccgaaaaaaaataaatgagcaa

SEQ ID NO: 30091 - DNA, 101 bp, rice(Oryza sativa)
  misc_feature (71): n=t or g
caagcgggcagcggccaatccaaccacggcgaaggaggcttgacccgatgaaagctcccatctcccatgcngtaaacgccgatgtccctcgcgcactctgg

SEQ ID NO: 30092 - DNA, 101 bp, rice(Oryza sativa)
  misc_feature (71): n=t or c
gttgttggcccggtaaaaccgagttaggttttacactagccgcatgccaaatgtcaatccacagccaacgntccattgctccaccacctagccaacctccg

SEQ ID NO: 30093 - DNA, 101 bp, rice(Oryza sativa)
  misc_feature (71): n=t or c
tttattttcaatttctttgataacgggatgccacatcaacacacgtggaccagttgaccaaccacgtgagnagaaaccgtttcaaaactactaaaggtgtt

SEQ ID NO: 30094 - DNA, 101 bp, rice(Oryza sativa)
  misc_feature (71): n=a or c
gtcctaggtcaatgcaagcagcatcagcagtagtagtgctcaggtgcttcgtaaggtatactctctccgtnaaaaaaagacaaaccctgttttttgtccaa

SEQ ID NO: 30095 - DNA, 101 bp, rice(Oryza sativa)
  misc_feature (71): n=a or g
tgatgtcgtttgcctgaggtagagcacttgggtgctaagatccgaagtcgagagggaaatagcccagatcntacgctaaggtccctaagcaatcacttagt

SEQ ID NO: 30096 - DNA, 101 bp, rice(Oryza sativa)
  misc_feature (71): n=t or c
ttgctctatgtcaaaacaacaaatgataattttgtcgttgacagcagaactgaccaacaggggacatctancattcacttctttcgttcaattgaaagcac

SEQ ID NO: 30097 - DNA, 101 bp, rice(Oryza sativa)
  misc_feature (71): n=a or c
atatattaaagcatgataattcataccgaactagtgctatattaatagggaccttggactgttggtcctgnctgcctgagtgcgcccagggttttggccgc

SEQ ID NO: 30098 - DNA, 101 bp, rice(Oryza sativa)
  misc_feature (71): n=t or c
tagctgtagagccgtagaggtagcagctaactaggtggccagccagccagcgagacagacagcggcgcggnatgcagaggaggcagggcagagctagagag

SEQ ID NO: 30099 - DNA, 101 bp, rice(Oryza sativa)
  misc_feature (71): n=t or g
tttttgtcttcatgacccctacacgcgttatagttcggtctcaccacgtcagcccatcttcaagacgccgncccacgaagcaacggagaaggtcgctgctg

SEQ ID NO: 30100 - DNA, 101 bp, rice(Oryza sativa)
  misc_feature (71): n=a or c
cattacttggactacgatggttacaggactgactcagaacggtttgcagttggaggctcttgatgttttcnggagaatgagggcagagggtgttggcattg

SEQ ID NO: 30101 - DNA, 101 bp, rice(Oryza sativa)
  misc_feature (71): n=t or c
atggattccaaatcctgaattgtacaccccaaaagactgaactaacttgaatactccctctgaattatatnataagttgctttgccttttttttttaccct

SEQ ID NO: 30102 - DNA, 101 bp, rice(Oryza sativa)
  misc_feature (71): n=a or g
gctatttgagggagggctaaaaaattacccatggatctaaatcgggccatagtcggaaggtaaaagcaatnaataggttaggtaacatatacactaatatg

SEQ ID NO: 30103 - DNA, 101 bp, rice(Oryza sativa)
  misc_feature (71): n=a or c
aaatcttgcatatttttttactaactcattattgacatcttcttttgaataggtgtgtccgaggaatcganataatgagacttagaaaaatgtaaaattaa

SEQ ID NO: 30104 - DNA, 101 bp, rice(Oryza sativa)
  misc_feature (71): n=t or c
ccggaccagtatagcacaggctggtacctaatacctgatacctggtacacctagtacctgatacctagtanctggtacctggtacctgatacctgatacct

SEQ ID NO: 30105 - DNA, 101 bp, rice(Oryza sativa)
  misc_feature (71): n=t or g
tatcatgaaattgccattagtgttgcactagatatttactggccaaagaagcagcgatatgcttttttttnattgtttcaatgtagcagtatattttcaag

SEQ ID NO: 30106 - DNA, 101 bp, rice(Oryza sativa)
  misc_feature (71): n=a or c
ttgggccgttgttataccgggacacggcccagaaaatacggccggttcagattcaggggacattctgtagngttgggccgagacgatccaggtatccagcc

SEQ ID NO: 30107 - DNA, 101 bp, rice(Oryza sativa)
  misc_feature (71): n=a or g
gtcgtcgtcgtcgtcgtcgtcatcgcttggatgtaccaaactcaagctgtagagacaaacgatatcgatcnggccggtgaaacttggtttttagacgaagg

SEQ ID NO: 30108 - DNA, 101 bp, rice(Oryza sativa)
  misc_feature (71): n=a or g
gactattccactgtttatatatagtagcaaactcgtcagcaattcaggctgatatgatctcatttcacacncttacgacatttcctcaaggaagagtctgt

SEQ ID NO: 30109 - DNA, 101 bp, rice(Oryza sativa)
  misc_feature (71): n=t or c
aacagaagaacgaagcacttccttgatgctggatatctcattcgccaagttaattctcctggcaaagtttnctttgcttaactgacgcaccttattgcgat

SEQ ID NO: 30110 - DNA, 101 bp, rice(Oryza sativa)
  misc_feature (71): n=a or g
ctgtgaaggggagtttgaggatttgacacctcttaatatggtgttttttgaggatttgtctatgagacgtnaatttgaggtgtgtttagttcttgaaaaaa

SEQ ID NO: 30111 - DNA, 101 bp, rice(Oryza sativa)
  misc_feature (71): n=a or g
acggagttcttgagcaagttgatggacaagttcgaggaatacgcccggggagaagaggaaaacatgcggcngagagtggccaggggcatgccccgctgccc

SEQ ID NO: 30112 - DNA, 101 bp, rice(Oryza sativa)
  misc_feature (71): n=a or c
agtcctgatagagagaatttggaaattccatgaagctaaaatactgagggcctgtttattagatcgatccntggcaaaattttacaccctaccatcgaatg

SEQ ID NO: 30113 - DNA, 101 bp, rice(Oryza sativa)
  misc_feature (71): n=a or g
ctgaaacctgttgccaacactgaattccccggtaagctcattgcctgataaatcgaggtatgccaaagatnagcctgcatatccactgctaaagtttagcc

SEQ ID NO: 30114 - DNA, 101 bp, rice(Oryza sativa)
  misc_feature (71): n=t or c
aatccgattacaataataataactcgatcggtgcagtactgcagccttcagccatgggaaacgtcttctcngggatcagcgtggtgatcctcgtcatcgta

SEQ ID NO: 30115 - DNA, 101 bp, rice(Oryza sativa)
  misc_feature (71): n=t or g
actgtgaaaagcagacgcgttactgcatacatattagccgtcgtgttaatatgctgttccagtgaaacgangactaaaaaagaggtaaatctcaatcttta

SEQ ID NO: 30116 - DNA, 101 bp, rice(Oryza sativa)
  misc_feature (71): n=a or g
atagactacaattcctgcactgttgctattagtcacatgttgaagccaattatcttattctgttcccaatngatgtttaattgctctcaacaatatataac

SEQ ID NO: 30117 - DNA, 101 bp, rice(Oryza sativa)
  misc_feature (71): n=a or g
cgccctagctagagcttaggcatgagagagacattctctgcgtctacttgtttaggtgtactttaattttngaaagacgtacgtggcgacaggcttgttta

SEQ ID NO: 30118 - DNA, 101 bp, rice(Oryza sativa)
  misc_feature (71): n=t or g
aaatcacccggcagtagagagatgtttggaggctcgtcaaatgatgtcctgtggatcgacttcgcggacanatacgatctataccatctggatgccctcga

SEQ ID NO: 30119 - DNA, 101 bp, rice(Oryza sativa)
  misc_feature (71): n=t or c
acctagtcctactgcttcgagatgaaggcgtgcaccgtggcggcgcctgtcgatgatgcctccaccttgcngaccacacccaagtagtcgttcaagtcatg

SEQ ID NO: 30120 - DNA, 101 bp, rice(Oryza sativa)
  misc_feature (71): n=a or g
agtggccttgtgggtgagccgctaggagtaccgatcgtctaacagctaggaaaactaaactctccaaaagnctcaaaatttgccaatctaaccagttaaag

SEQ ID NO: 30121 - DNA, 101 bp, rice(Oryza sativa)
  misc_feature (71): n=a or g
aatttggatcaggatttaatattgaatctgcgtggatttgcagtccgcatgatcccatagtaaaaaaaccngaccggaggtcgatctgctctggtcatcgg

SEQ ID NO: 30122 - DNA, 101 bp, rice(Oryza sativa)
  misc_feature (71): n=t or c
tgcggctgacctggagccagccttacattcttcagcttgttttctctgccggcatcggtggtcttcttttnggatatgatacaggtactgttacatggcat

SEQ ID NO: 30123 - DNA, 101 bp, rice(Oryza sativa)
  misc_feature (71): n=a or c
cacatgttgattatattgctgcatcgaggataaagtgcgatagtttcatttttcttttattggcatgcaantctacttattttgcttgtgcctttctgtta

SEQ ID NO: 30124 - DNA, 101 bp, rice(Oryza sativa)
  misc_feature (71): n=t or c
cccactaccttgtcttgtaagcccatcagtagagcatgtatccaacacattactcaatccaaagatcaacnaccgatcggacgcaatcttcggtgatcagg

SEQ ID NO: 30125 - DNA, 101 bp, rice(Oryza sativa)
  misc_feature (71): n=a or g
ttctagtgttggtgggcatttggttgcctcttgtttggttcgctcacttgcttgattatgcctaatagccnttgtaatgatggtggtcactagcatgagtc

SEQ ID NO: 30126 - DNA, 101 bp, rice(Oryza sativa)
  misc_feature (71): n=a or g
cttcagtaataaaagatggcacaaagtacaatctctaggccctctttacgtagacttatagggtcatttanatcggtgccaaaatgaaccttaccaaaatt

SEQ ID NO: 30127 - DNA, 101 bp, rice(Oryza sativa)
  misc_feature (71): n=a or g
atctacgtcggcatgtccagatccaggcgccaagtttaagtgtctaactgccatgtggtaccagtactacntattagtaacatcaacgtgtacgtcgaaga

SEQ ID NO: 30128 - DNA, 101 bp, rice(Oryza sativa)
  misc_feature (71): n=t or c
tcttctaccttacatttcttcacaaattctcggggccgtcgccgcctccttcgccgtcaaaggtctgtatnatccggtgaaccccgggattgtcaccgtgc

SEQ ID NO: 30129 - DNA, 101 bp, rice(Oryza sativa)
  misc_feature (71): n=t or c
cacacttactctgaaatggctttgagctccttcaagtggaccctctgcagaatgttaaaatctagttttgngagatccaaaagaattggaatatgcccttc

SEQ ID NO: 30130 - DNA, 101 bp, rice(Oryza sativa)
  misc_feature (71): n=a or g
gtccagccgtcgtgcaggtcgttacggtgtacatagtacaggtagcttccgtgtgcatgtggcatttgctncttacattgtggtcactatgttcggatggg

SEQ ID NO: 30131 - DNA, 101 bp, rice(Oryza sativa)
  misc_feature (71): n=t or c
gaccataagccggagtgggtcatctacaatgagtatgttttgaccaccagaaatttcatccgcacggtcanggatatccgtggtgattggttagtcattat

SEQ ID NO: 30132 - DNA, 101 bp, rice(Oryza sativa)
  misc_feature (71): n=a or c
tgtgtcagaagagcagattaactcatcaagtcatcgctcatttcagtaaaattttctgcaaattcctgctnttttcccttcttctcctggactagaaattg

SEQ ID NO: 30133 - DNA, 101 bp, rice(Oryza sativa)
  misc_feature (71): n=t or c
cacataatcacaaaataatcgtcaaagaagaacaacaaaactacattagaaaacttctctcgcctgccgcnggatccgccctcggccatcgccatcgcggc

SEQ ID NO: 30134 - DNA, 101 bp, rice(Oryza sativa)
  misc_feature (71): n=a or g
ggcccgattgagatgactttaaagcccgtcaccgatgattcatatcggtatcgggcttttgttgatgcccnttagagataacttttacttaggtcattttt

SEQ ID NO: 30135 - DNA, 101 bp, rice(Oryza sativa)
  misc_feature (71): n=t or c
ggagcacctccccaagctcaaaacggtaggccaccaccacctcctcgattccaaattcaatgccttttttntctcctccgaattttgccttgcataagggc

SEQ ID NO: 30136 - DNA, 101 bp, rice(Oryza sativa)
  misc_feature (71): n=t or c
aatcttatctacactgtttccaatacagtttctcttgcatgttctacctacgaaacaacaaaaacaaaacnacatgtatcgtatgagctattttaattctc

SEQ ID NO: 30137 - DNA, 101 bp, rice(Oryza sativa)
  misc_feature (71): n=a or g
tcagtgtgagtgatttgatgccacttgttgttcttgtttgactaagtgaactcttgcatcaggtgttgacnggaaaccgttttaaacactcgttggacatt

SEQ ID NO: 30138 - DNA, 101 bp, rice(Oryza sativa)
  misc_feature (71): n=t or c
cttctcattatagcatcaaaattgggcattcttcacttctcattgtagcatcaagaatttgttgcaagttncaaccgacaaaacaaagctaaactacaggc

SEQ ID NO: 30139 - DNA, 101 bp, rice(Oryza sativa)
  misc_feature (71): n=a or g
taagcaagataacatcgtgtgaggtcaaaacattccgactacgcgctaaagaaaaccagagaggcctaccnacggattaggcgccttccgacgggtcccga

SEQ ID NO: 30140 - DNA, 101 bp, rice(Oryza sativa)
  misc_feature (71): n=a or g
aggacatcgtgcaggagctaccgagctagcatttgatctttctaattccaatggatgaactgaatggccgntgcaattaatattggatcggtatcaggctt

SEQ ID NO: 30141 - DNA, 101 bp, rice(Oryza sativa)
  misc_feature (71): n=t or c
gaattggaggagtacaaaggacggattggcctcacttttcatgggacatatctgcatccaatggcatttanctaagcaccatacttatgctagtaaataat

SEQ ID NO: 30142 - DNA, 101 bp, rice(Oryza sativa)
  misc_feature (71): n=t or g
caacaacttgtggactcagtacataatcagttgcctgcctggaaggggaggctcttggctatgtcgggaangctaaccttggtgcaatccgtcccctccac

SEQ ID NO: 30143 - DNA, 101 bp, rice(Oryza sativa)
  misc_feature (71): n=a or g
ggagggagatgatagttttagttcctagatttgcatccatttttattcatcgatcgccaacaagttcttgncgagaagatgattttgatttgcttgcttcc

SEQ ID NO: 30144 - DNA, 101 bp, rice(Oryza sativa)
  misc_feature (71): n=a or g
aacgcgaaaagcacactttcccatttaaatggcgacctgctttaaattccatcacgaaaaatggccacagnccacaaaaagaactgaagcttttcgcagtt

SEQ ID NO: 30145 - DNA, 101 bp, rice(Oryza sativa)
  misc_feature (71): n=t or g
tggcgcgaacgcagtcacgcgcacgcatgcatgcgtattaaatcggagtcggtcttttgctttcctataancgtttccttttttattctagacgcgttgat

SEQ ID NO: 30146 - DNA, 101 bp, rice(Oryza sativa)
  misc_feature (71): n=a or g
acttgatctcaaggcggtttggataacagtttcggctaacatggctatttttttaccgaatcctcgtcccntgtagcgttgatgtggcacttacaatcata

SEQ ID NO: 30147 - DNA, 101 bp, rice(Oryza sativa)
  misc_feature (71): n=t or g
aagttgatcagctgcatgcactgtgtgtgcatggcaatgtggggttcgcacacaactagataggtagatcnagtatgggttcatcggtttcatggatgcat

SEQ ID NO: 30148 - DNA, 101 bp, rice(Oryza sativa)
  misc_feature (71): n=a or c
aaatatccccaaaattcagaggcaacagcatactcatcaaggtcccaggcatttcaccaaaacaggcttgnatgctcatcaaggtcccaggcatttcatca

SEQ ID NO: 30149 - DNA, 101 bp, rice(Oryza sativa)
  misc_feature (71): n=a or c
ttcaagattattcttagaccttttgttcaccggatggttcatcctggaggggaattcattttggaagaagnaaatgtcattacaaatgcaacaataaatga

SEQ ID NO: 30150 - DNA, 101 bp, rice(Oryza sativa)
  misc_feature (71): n=t or c
atgcagcaaggattgagatccgataaagttgcagtaacaactgcaactttagagcaagtatagtagtaggntataagccggctaaatgctgaggtggagga

SEQ ID NO: 30151 - DNA, 101 bp, rice(Oryza sativa)
  misc_feature (71): n=a or g
ccgcgagcgtttcgtgcattgattccaagaagatccaagcttatcgcggaaaagaaagaaagaaagaaagnaagaggagatgaaatgcttcaagcagcagc

SEQ ID NO: 30152 - DNA, 101 bp, rice(Oryza sativa)
  misc_feature (71): n=t or c
ccctcgcataaaatcagtatgtaatcactctctgctccatcagaattcagatctctctcctgcactacagntagatccaccatagtaggagcaaggatata

SEQ ID NO: 30153 - DNA, 101 bp, rice(Oryza sativa)
  misc_feature (71): n=t or c
tttgcaggagataccgacgatggcatgacctacgtgctcaatggctgcaaaaatctcaagaagctggaaancagggacagtccttttggtgacagcgcgct

SEQ ID NO: 30154 - DNA, 101 bp, rice(Oryza sativa)
  misc_feature (71): n=t or c
aactgagctagagctactgtcagtacatgtatttttctggcatcagcttaattgaattactaggtgattcnccgcgcttggctacgggaattactaaacaa

SEQ ID NO: 30155 - DNA, 101 bp, rice(Oryza sativa)
  misc_feature (71): n=a or c
ttcagctgtatgcatgcttcccaaaaggttgcatttcttagctacaactctagttaggagctagcgtggcntgtgatattttgatatcatatacttcctcc

SEQ ID NO: 30156 - DNA, 101 bp, rice(Oryza sativa)
  misc_feature (71): n=t or c
tggcggatccaggaattttttttaagcctgggtaagcctaacaatgaacaaaagtacatatatattggggnaattgcttatttgacctcgttttgaattgt

SEQ ID NO: 30157 - DNA, 101 bp, rice(Oryza sativa)
  misc_feature (71): n=t or c
tttaaaaaaatgttctctttgttcccaaataaattacttgttagatccatagcaacgcacggatggtactnctagtgtaacgttaaccggtcagccataat

SEQ ID NO: 30158 - DNA, 101 bp, rice(Oryza sativa)
  misc_feature (71): n=t or c
gaatctccttgtagtttcttgttgtgtgcaagaagtaagagaggaattagcttggtagccatgacaaagangcagccgcaactagtggagtcggagccggt

SEQ ID NO: 30159 - DNA, 101 bp, rice(Oryza sativa)
  misc_feature (71): n=a or g
ttttctttctcctcctcttcttgttcttcttcttgttgttccactcttattgttcatcatcctcctcctcntagctgaccaaatctctgctgtgacagcaa

SEQ ID NO: 30160 - DNA, 101 bp, rice(Oryza sativa)
  misc_feature (71): n=t or c
agagtggaccggcggcgggcatgctctgagcaaggagcaggcagaaatagcatagcagcggcaactgaagnagtgcaggtgccgacggcctcgatctgggt

SEQ ID NO: 30161 - DNA, 101 bp, rice(Oryza sativa)
  misc_feature (71): n=t or g
attcgaggcaaaccttgtgttacattcttataaaacatagcttttataggtctcatcacttctcttcacanagcagtattgtaacctagatgagctaaggt

SEQ ID NO: 30162 - DNA, 101 bp, rice(Oryza sativa)
  misc_feature (71): n=t or g
ggattctttatagttcattatcgctgtgcacataggacatacaaaaaatagtataccgcttctatataagnaatatacaaagtaatcatttccattttgta

SEQ ID NO: 30163 - DNA, 101 bp, rice(Oryza sativa)
  misc_feature (71): n=t or c
agatgtatatatgcttgctcggcacacatataaaagctccaggagcggacataaatttgcaccattcctgnatgcccattcatatcctgttaccagtgttg

SEQ ID NO: 30164 - DNA, 101 bp, rice(Oryza sativa)
  misc_feature (71): n=t or c
aagtctgaaaggagctagcagggtatcacaactacttatctctgctttcccagcttacctagctcattttngggatgcacgttattcaaactgctaaacgg

SEQ ID NO: 30165 - DNA, 101 bp, rice(Oryza sativa)
  misc_feature (71): n=t or g
gtggggatcatttaaaagatacacttcttgttttggagtacattatcaaaaacagggatgatgcacatttngtttagattatttgttttggtggtatgata

SEQ ID NO: 30166 - DNA, 101 bp, rice(Oryza sativa)
  misc_feature (71): n=t or c
atgtctcatggccttatatgtgtgtgagacatcctaattagttataatatatcgttgaagacttgattcanatgtactagacaagtttatgcactagaata

SEQ ID NO: 30167 - DNA, 101 bp, rice(Oryza sativa)
  misc_feature (71): n=a or g
aggagtagtggattgtgcaaggcgtactgtcaccgtgtaccggaagcctgatcaaccggttgttttctttncgcacccgactcccaccggcagctcagtac

SEQ ID NO: 30168 - DNA, 101 bp, rice(Oryza sativa)
  misc_feature (71): n=t or g
tcaaacggtaaaatgtgatttttttttactttgaatgtgtcgatagaaaaaccgtactattaaggacgatnttgccttgatgtctaggaataagtttggtg

SEQ ID NO: 30169 - DNA, 101 bp, rice(Oryza sativa)
  misc_feature (71): n=t or c
ggcctgccgcggctgcgttaccacccctactcgtggacaaaggtggcgaacatcctgttcgtcgactcgcngatgggcgccggcttctccttctcccggga

SEQ ID NO: 30170 - DNA, 101 bp, rice(Oryza sativa)
  misc_feature (71): n=t or c
atagtccactccaacaataaactacatgagatgttcttctttctggaaaaaaaatactactactttcatcncatattagttgtcgctttgagtttttgttt

SEQ ID NO: 30171 - DNA, 101 bp, rice(Oryza sativa)
  misc_feature (71): n=a or g
tacctaaagtttctgttttttttcaattgtgtgtacgtacgtagatttttcggtataagcggtttcactcntatggacatgattttccggtatatacggct

SEQ ID NO: 30172 - DNA, 101 bp, rice(Oryza sativa)
  misc_feature (71): n=a or g
actccatacacaaaattctaattgattttcatcctcggaccaccaaccaaccaaactgggaagaccaattnttttgtggccttaggaggaattattcaaat

SEQ ID NO: 30173 - DNA, 101 bp, rice(Oryza sativa)
  misc_feature (71): n=a or g
tatataatggttggcccaattggcatggaattgaggaaatggaataagatcatatggatgttgtgttctcngctaacattagagccggaataataaaactc

SEQ ID NO: 30174 - DNA, 101 bp, rice(Oryza sativa)
  misc_feature (71): n=a or g
cagctctaaggcaagctgtacatactgaaggcaaacagatatttttagcaggaaaagagtttggagttgcntttttaaccgtcgtagtagttcctagcttc

SEQ ID NO: 30175 - DNA, 101 bp, rice(Oryza sativa)
  misc_feature (71): n=t or c
gcctccatggtcgatccttggtggctgaggtgcctctttttgtaagtatagtagaagaggaaattaactanatgtcgaaacaagatttcggcaatactaca

SEQ ID NO: 30176 - DNA, 101 bp, rice(Oryza sativa)
  misc_feature (71): n=a or g
gtgtatatataaaatagttccattatatgtgtatggacaaaaaaacactggtccagtaactagatccatangtatgtctgtgtcattcagatggagctcta

SEQ ID NO: 30177 - DNA, 101 bp, rice(Oryza sativa)
  misc_feature (71): n=a or g
ttctcctatgtgtgtaaaaatgaccgttcgtccctttttctagggcaaggggattcgatctctagaaccgngtgagatgaatagaagatgttcttcagatc

SEQ ID NO: 30178 - DNA, 101 bp, rice(Oryza sativa)
  misc_feature (71): n=t or c
ctgatatcaaagtgtcatactacacttctttgttgcttgatatcaaagtggtgccccgatgactatttatncttgcttcgtccctgctcgattgtaaaagt

SEQ ID NO: 30179 - DNA, 101 bp, rice(Oryza sativa)
  misc_feature (71): n=t or c
ggattgcacatcatggcctaatataacatactctttcggttgatcttttataggtgtactagtagcatgtncgtgctaacgctacggtagcatttagtaac

SEQ ID NO: 30180 - DNA, 101 bp, rice(Oryza sativa)
  misc_feature (71): n=t or g
acgtttttttctcgctgtgcactgtgctgaaatgttgttacatctgcgtgttgtgctcactgttttgcgtntgcgtttttggtcgcgtgcaggaggggcgt

SEQ ID NO: 30181 - DNA, 101 bp, rice(Oryza sativa)
  misc_feature (71): n=a or g
cgctgcccaggatctccgtgtcgctgaacccactggtcccgatgtagagctccgagtagctgaagatcctngggctcccgcccgcgcctccgccgagcttc

SEQ ID NO: 30182 - DNA, 101 bp, rice(Oryza sativa)
  misc_feature (71): n=a or g
gttacccccacacatattccttgcctcctagtgctcagacatgtatgaggttttggaactcttttcacctngaaaccagtcaagcaattcacaagttagaa

SEQ ID NO: 30183 - DNA, 101 bp, rice(Oryza sativa)
  misc_feature (71): n=a or g
agttgaaagcaagcctgccagagttggacaaacatacttatcaaagcctcaaaggtcgttcaaagtgtggnctcaaaccacacacactaacttaatttgcc

SEQ ID NO: 30184 - DNA, 101 bp, rice(Oryza sativa)
  misc_feature (71): n=t or c
ttgagtttcttacccttcctctaccttgttagaattatacaaccgctgctacagagtagttcaatggggtngtataattctaagaaaaagtggagacacaa

SEQ ID NO: 30185 - DNA, 101 bp, rice(Oryza sativa)
  misc_feature (71): n=a or c
ctttcagcttgatgtcaaaaaaacactcctttcagcttcgatgtttcaatgataagagcttcagagaacanttccagctttatccctgacaaaacaagaat

SEQ ID NO: 30186 - DNA, 101 bp, rice(Oryza sativa)
  misc_feature (71): n=t or c
ggctggtctgaccgggccatttggccggtctgaccacggttctcacgttggtcttgccgggccatctagcnggtctgaccgccgacctcatgtcggtctga

SEQ ID NO: 30187 - DNA, 101 bp, rice(Oryza sativa)
  misc_feature (71): n=a or g
ttcgcttccggcgtctttctatcgccatgatcatcaagccgaacgtggatgttgatggcgtgcttgaggcncggctcatccttcttcgcaaggttgcgcat

SEQ ID NO: 30188 - DNA, 101 bp, rice(Oryza sativa)
  misc_feature (71): n=a or g
gattgtaatgcacttcatccttcgcattacagcccatgagcctaagagtgatctcctcatcaccatgttcntctaatctctcttttgcatatcaaaaagct

SEQ ID NO: 30189 - DNA, 101 bp, rice(Oryza sativa)
  misc_feature (71): n=t or c
tcttactgtgtttatcttatggtttttgccaagtcgctctgcatgacctgtcaaagtgtcaagtattatanattatgatatttttccgacgaaggtaagac

SEQ ID NO: 30190 - DNA, 101 bp, rice(Oryza sativa)
  misc_feature (71): n=t or c
ttgtatctaggtccttagcaacaatgtattccatatactaggctgttcaaacatgagaccaagatgagttngactaagaagatattagtgctaattttgct

SEQ ID NO: 30191 - DNA, 101 bp, rice(Oryza sativa)
  misc_feature (71): n=a or g
gtatatattcgcacaaattcacctgaccaacagtccagggactaacattgcttctttaagctgccatctancggcggtgcaagcataagatatgtatttta

SEQ ID NO: 30192 - DNA, 101 bp, rice(Oryza sativa)
  misc_feature (71): n=t or c
ggttggtgaacgggttaaatcagaagttctgggtgttttaaatgggggggaacatgccacagggatggaangacacggtgatagtgctaatcccgaaggtc

SEQ ID NO: 30193 - DNA, 101 bp, rice(Oryza sativa)
  misc_feature (71): n=t or c
tcacacctttcatacgcacacaatattttagagtctgtgttgtgttacagctaactacaagtccgcttttnttctctctcttctcttttcttctctacata

SEQ ID NO: 30194 - DNA, 101 bp, rice(Oryza sativa)
  misc_feature (71): n=t or c
cgcttcccgccacccctcctcacgtcgctgacgctgagaaccgccatcgcccctccccgtatagctgacgntgagagctgccgccgccccatccctgtgcc

SEQ ID NO: 30195 - DNA, 101 bp, rice(Oryza sativa)
  misc_feature (71): n=a or g
attgctccgacctcaccgtctctcttctttctccccaatccctatagctctcgcttcgtcaaattctccgncgtttccagttcaaaaataaaaaataaaaa

SEQ ID NO: 30196 - DNA, 101 bp, rice(Oryza sativa)
  misc_feature (71): n=t or c
ccctcggcccagccctttcgccccccttgcaaagtctactttgcatccctcttccggactcctctcacccnccctcgccgataggtgggacccacggcccc

SEQ ID NO: 30197 - DNA, 101 bp, rice(Oryza sativa)
  misc_feature (71): n=t or c
atgcacctgatcgaagatgaaaatatcactactacaaaaagcattaaagctatttttgcgtgcggttgacncgcctgtctgcccaaaagtatatacgaaaa

SEQ ID NO: 30198 - DNA, 101 bp, rice(Oryza sativa)
  misc_feature (71): n=a or g
ggtgtattgagaagacttgtccacgtatcaatctagcacaaattgctttgcaaagtaaccatgtttggagnctaaaaaaaattaaccttacatcaactggg

SEQ ID NO: 30199 - DNA, 101 bp, rice(Oryza sativa)
  misc_feature (71): n=a or c
cagatcagcgaaagcaacatatggctctgtataatgaaaggaaaaggctttcaaagcttgacgtttgcttnagaataaaaaaaaatgactgatgtcatatg

SEQ ID NO: 30200 - DNA, 101 bp, rice(Oryza sativa)
  misc_feature (71): n=t or g
tctaagaagcagagcaaggggactcactcacacttgtacctctaggcgttgccaagccagacaggcaaagngcatcattgtttggcttatacttatattta

SEQ ID NO: 30201 - DNA, 101 bp, rice(Oryza sativa)
  misc_feature (71): n=a or g
catttgttcggttcagatttcagtgttgttctatgtcatgtccagttttcagtgcatcctgttggctgcantagctttgctggttgaaacgagtccatgaa

SEQ ID NO: 30202 - DNA, 101 bp, rice(Oryza sativa)
  misc_feature (71): n=a or g
gcttagactagttcctgcatagttagttttcagttagttttttttttcagttagctgcattttcagatcgntgacctatcttgattctgttgtgggatggc

SEQ ID NO: 30203 - DNA, 101 bp, rice(Oryza sativa)
  misc_feature (71): n=a or g
tccctcctctcctcgctcgcgctttcgtctacaatctagagatcaactcaaatgggaaaactccttcgccnccgttgtcaccatcgccgaggcgctccccc

SEQ ID NO: 30204 - DNA, 101 bp, rice(Oryza sativa)
  misc_feature (71): n=a or g
atctttggggatagggagaaaaaaaggagggacacatgaaagggagattagaagattcctggccctgtttntttccatgggctaatgtttagctcttacct

SEQ ID NO: 30205 - DNA, 101 bp, rice(Oryza sativa)
  misc_feature (71): n=a or g
tgagggcaggatggtggaggcaaggatgctgtttgatgagatgttgcaggctggagttgaagtgaatacantcacgttcaatgttttgattgatggttatg

SEQ ID NO: 30206 - DNA, 101 bp, rice(Oryza sativa)
  misc_feature (71): n=t or c
tgtgtttttggcgtcaccgttaccaacaatccttttgtccaattaggtggtatatgtcgtcgttttctacntatatgtgttgagttgtgatccaaattcat

SEQ ID NO: 30207 - DNA, 101 bp, rice(Oryza sativa)
  misc_feature (71): n=a or g
aactcttcctctcaattcaaaggaaaaggtagcttgtgcaggaaaatggttcacaatttgtttttcgtctnactgttgaaactagttcaactccctccgtt

SEQ ID NO: 30208 - DNA, 101 bp, rice(Oryza sativa)
  misc_feature (71): n=t or c
gtcctgtcgattgttatcgagaacgaccaagtgtgcatgacaatgttgacaaagaaaacgcggatgacagngtgaattcatttgagttgaagtcggtggct

SEQ ID NO: 30209 - DNA, 101 bp, rice(Oryza sativa)
  misc_feature (71): n=t or c
agcgctacaacaggtataaatcactattctacccagactctattcatgtgaacccatagtacctatatgtnaggaccaaagtgataaacttcataaacttc

SEQ ID NO: 30210 - DNA, 101 bp, rice(Oryza sativa)
  misc_feature (71): n=a or g
gcaacaaaacagcaaagggtcttggaaggaagaaagcggagtacaaactgaaagaaccagttgccagtgcnattcctgcagagttaccttagtttctggat

SEQ ID NO: 30211 - DNA, 101 bp, rice(Oryza sativa)
  misc_feature (71): n=a or g
aaacatatacatctatcatttctataagtataacttgcatttatccgtacatcccgcagcaaatcttgggntataaactagttaattagatagagatatcc

SEQ ID NO: 30212 - DNA, 101 bp, rice(Oryza sativa)
  misc_feature (71): n=a or c
tccaattaaccaccgttcttctttctcttgactcattggagtattccaatttatttctctgtctttatttnttttttttcttcttttactgcgattttttt

SEQ ID NO: 30213 - DNA, 101 bp, rice(Oryza sativa)
  misc_feature (71): n=a or g
cctccagaataggtttcttattgaagtggcatgagctcgccgtcgtgtacatgatgttgttgttggggcanactgtcgaataccaagttggcgctgaagta

SEQ ID NO: 30214 - DNA, 101 bp, rice(Oryza sativa)
  misc_feature (71): n=t or c
aaatgattagcatgacaaatgttagcccggaccctggactttaaaattcagtaatcattcaggcatccttnggaacacatagattttttttttgggaatac

SEQ ID NO: 30215 - DNA, 101 bp, rice(Oryza sativa)
  misc_feature (71): n=a or g
ggctcgttcttgtgaaaagataaatgcgcgctcggttcgtggtacctaagtactgaggggcaagaccgtcnccccgagggagccgcccagcgggactggcc

SEQ ID NO: 30216 - DNA, 101 bp, rice(Oryza sativa)
  misc_feature (71): n=a or c
ttcaccaaaaacattagttatcttaccagttttcagttttcagctcaatgagtcctctgttgtggactaanctgatggagtgcctttttattcccataata

SEQ ID NO: 30217 - DNA, 101 bp, rice(Oryza sativa)
  misc_feature (71): n=a or g
agctactaccctattattgagctcaaatttagcaggggtggtggctcggctgtccattattcttaatatcntaaactgtggtttgtaataacttttctttg

SEQ ID NO: 30218 - DNA, 101 bp, rice(Oryza sativa)
  misc_feature (71): n=t or c
gagcaactgagattggcacggcaactcgcacattttcatcatgtgccaccagagacgtttatctactaggntgctgttgtataatcaggtacatgctgagt

SEQ ID NO: 30219 - DNA, 101 bp, rice(Oryza sativa)
  misc_feature (71): n=t or c
acacccacataacccaatattattcagatgtggccagtcaccgcagaagaagtcagctgaaagcacacagntgtatacacatagcttctcaagggacattt

SEQ ID NO: 30220 - DNA, 101 bp, rice(Oryza sativa)
  misc_feature (71): n=a or g
ggcagagaatatcctgcctttggccatgactagcaaatcctgggaaagttgacctaaaatctggagggggnaaaaagatcattcacatttaaaatatatat

SEQ ID NO: 30221 - DNA, 101 bp, rice(Oryza sativa)
  misc_feature (71): n=a or g
atgtagtagtaatactgtacaacgtagtggtagcaggagccggaagggtgtagaacaatagccagtcaatncaacctgagtgcaagaagaaagtacacgag

SEQ ID NO: 30222 - DNA, 101 bp, rice(Oryza sativa)
  misc_feature (71): n=a or g
tcttgtcggtcgtgttcccgttgttttgtctttgttgccaaacgccaccatttatggatgagtcacatctngagcacgttcggccaccttcctcgccgccg

SEQ ID NO: 30223 - DNA, 101 bp, rice(Oryza sativa)
  misc_feature (71): n=a or g
tcactttgtgataatcgatcttcgtaggtcatcggaccctgcccatcagtcgtcactacttaggcagtccntcgaggctgaaatacgcaaatcttctatta

SEQ ID NO: 30224 - DNA, 101 bp, rice(Oryza sativa)
  misc_feature (71): n=a or g
ttaaaaaacacggagggagtagaatggattagttagttggcattgtcatcttacacctcttggtcagggtnttccatcaccatgatgggttcttttggcac

SEQ ID NO: 30225 - DNA, 101 bp, rice(Oryza sativa)
  misc_feature (71): n=a or c
gacttatttactctgagatccagttgagttacatcgtcgaagagcttataagttataagcaatgctcatangtttaatagccaactctacttggaacattt

SEQ ID NO: 30226 - DNA, 101 bp, rice(Oryza sativa)
  misc_feature (71): n=t or c
ggtcccactgtcatcttctcccatcatatattttttatccctccccacaatctctctcttatctccttccnacacctatccccttttcttgccctcacctt

SEQ ID NO: 30227 - DNA, 101 bp, rice(Oryza sativa)
  misc_feature (71): n=a or c
tcaatgatttctgaggatcaagaaatccctggaccaacgtccttgtcacccgggtttggatgttgtgatangcatgaccaaacctacaaaaagaaatgttt

SEQ ID NO: 30228 - DNA, 101 bp, rice(Oryza sativa)
  misc_feature (71): n=a or g
attcgaaaggaattcaaaagagagaggggaaaagaggaaacttggtagcatgggttcaaggatggagtttnattggactttgcatcttggagttgaaaggg

SEQ ID NO: 30229 - DNA, 101 bp, rice(Oryza sativa)
  misc_feature (71): n=a or g
aaattactaatagttcctgcaaaagaaagcaagggctctctcaatcaaagctgctgtttgcatttacttcnactttggtcgattaggcaggagagtgttca

SEQ ID NO: 30230 - DNA, 101 bp, rice(Oryza sativa)
  misc_feature (71): n=a or g
ttagctctcatcactcacctctcgtctcgccagcaagtcagcagggaaaatcaccattggcctcttcggcnacgaggtccccgccggtgcgtcccggttct

SEQ ID NO: 30231 - DNA, 101 bp, rice(Oryza sativa)
  misc_feature (71): n=a or c
caagatcatccttcatacaaatatttgggggggggtcaaacctgattgaaaccgttcatacccaatcatcntaataatatatcacttctacctatttattt

SEQ ID NO: 30232 - DNA, 101 bp, rice(Oryza sativa)
  misc_feature (71): n=t or c
cctcgccgacaactcatgggtgagggacattcgtggtgctgtcacggtccactgtcatttctcagttcgtngcgctctgggacgtggtgcttcctgttcag

SEQ ID NO: 30233 - DNA, 101 bp, rice(Oryza sativa)
  misc_feature (71): n=a or g
aaaaggagaaaaagatcatgcatatgatgcattgaacctacagaaagctagcaatctactccctccatctnaaaaaaagacaacctcctagtacaatgtct

SEQ ID NO: 30234 - DNA, 101 bp, rice(Oryza sativa)
  misc_feature (71): n=a or c
cgccccctccgcgcggaagagagggtggttgagattcgtacatcttccatttccctttcgggtcgtcggcngaatcttccccgggcccacggcttgggccg

SEQ ID NO: 30235 - DNA, 101 bp, rice(Oryza sativa)
  misc_feature (71): n=a or g
gctgtgaggtcagctgaccccacagtttatgcataggtccgccactactctattcttggtaagttttggtnctaataatatttttggtagatagatatgca

SEQ ID NO: 30236 - DNA, 101 bp, rice(Oryza sativa)
  misc_feature (71): n=t or c
ctttgcattcaccttcccgctttgattataggtggtgattgctgcagaggttcgatctcgttctgcctgcngaactcatgggtggtagaccctgagtagct

SEQ ID NO: 30237 - DNA, 101 bp, rice(Oryza sativa)
  misc_feature (71): n=t or c
gttctaatagtgttgttcacatatcgtaaatcgactttcccataaatttacaatcgtacagaaagctgtgnctgatcaataatatttattactgcatacgt

SEQ ID NO: 30238 - DNA, 101 bp, rice(Oryza sativa)
  misc_feature (71): n=a or g
attaatctagataaagtgcttgggtatgatgaatccattttcagtgaatctaaagtagtgaaaaaaaactnaagtttttcaccaccacattacgccacgtc

SEQ ID NO: 30239 - DNA, 101 bp, rice(Oryza sativa)
  misc_feature (71): n=a or g
tcgtgcgcctcgagcgcgtcgaacgtgttgagtatgagccccgacgagagcttcaccgccgccacggcgcnggccagcagctcgcacatcagctcgtggcc

SEQ ID NO: 30240 - DNA, 101 bp, rice(Oryza sativa)
  misc_feature (71): n=t or c
gataaggattgattgcctctggagatctgggtctgctggtttgtcatggtctatagcacttgcaattaaanactacttcgacacagcactctgcaataaaa

SEQ ID NO: 30241 - DNA, 101 bp, rice(Oryza sativa)
  misc_feature (71): n=a or g
gcatcgcctgtgcgccagccatgggagaggtgaagattacgagagggggagaggggtgagaggtgaatttngggtagttcagtggcatttttgtgtaaata

SEQ ID NO: 30242 - DNA, 101 bp, rice(Oryza sativa)
  misc_feature (71): n=a or g
gcgcgaaattgcatgcgtatcacaagattattcagtagaaatgcttccaagaatgaatgatcaagagatcngagagggtagatggatctctctctcttctt

SEQ ID NO: 30243 - DNA, 101 bp, rice(Oryza sativa)
  misc_feature (71): n=a or g
caaaaaaaaaaaactcaccagctttcgtccgccaatgatctaaaaggaacactactagcagaatgagtaanttaccctaaatcacgcaattggtaatgcca

SEQ ID NO: 30244 - DNA, 101 bp, rice(Oryza sativa)
  misc_feature (71): n=a or g
actgtgagtggcaaaaatatttgaatcaacgactataggatcaattgtttttctccaacatctcatattcnctgtaactttatgagtttgtcagggatgag

SEQ ID NO: 30245 - DNA, 101 bp, rice(Oryza sativa)
  misc_feature (71): n=a or g
ttagccacattgcttcacttaactcaacacattgcaagtagtagccatgtacacttgtgcggtgctaacgncatgatctattgatgaatccagttgcatat

SEQ ID NO: 30246 - DNA, 101 bp, rice(Oryza sativa)
  misc_feature (71): n=a or g
cagtcttcgaatatgctcatagaggtagggtttgcatacgtactttcatgggggtgagcgcacatacgttntgagtttctacgttgtgctgtataattttt

SEQ ID NO: 30247 - DNA, 101 bp, rice(Oryza sativa)
  misc_feature (71): n=a or g
aatcgtctggtgtgctgcaagtagggatggcaatggagacctgataattgattcctcgtagtgaactcacntattagagaatggggatggttggtatgaca

SEQ ID NO: 30248 - DNA, 101 bp, rice(Oryza sativa)
  misc_feature (71): n=t or c
ccgataagaccaggacacgtgaaagatcgtgctactccatatacgtatggctggtttggttggttgagaanaccttttctttttccttcaaataattttaa

SEQ ID NO: 30249 - DNA, 101 bp, rice(Oryza sativa)
  misc_feature (71): n=t or c
gccaacaacgaatggaatagtaccagtccacatgggtggagctagaacgaaataaaagaggtgtcatccanatgctttactctatttcaatcgagtttact

SEQ ID NO: 30250 - DNA, 101 bp, rice(Oryza sativa)
  misc_feature (71): n=a or g
aggtgcactgcaacagcaaaccaaagaaacatatgtaaccacaagtctgccacacgcttcgacagcatccnaacttgatccatagcatttcctccagcagc

SEQ ID NO: 30251 - DNA, 101 bp, rice(Oryza sativa)
  misc_feature (71): n=t or c
gatgttgatgtaagaagtggtttgtaggtgagatgataaggatgcaatgtgtggagagtaaggttcgctanggccgtaggatctccacttctctctcactg

SEQ ID NO: 30252 - DNA, 101 bp, rice(Oryza sativa)
  misc_feature (71): n=t or c
ggaaatacccgccccgttttcacccctatttgcgtgtgagaaataagaaatatttcccactaaagcagtgntctccactgaccacgtagcagcaatcttaa

SEQ ID NO: 30253 - DNA, 101 bp, rice(Oryza sativa)
  misc_feature (71): n=a or g
ttacatatgctatctccatatctatagaaacagtgctttcccccagtgcatgttcaacgtccataaggatnacttgtctgtacttctctatgtaggatgat

SEQ ID NO: 30254 - DNA, 101 bp, rice(Oryza sativa)
  misc_feature (71): n=t or c
taggtaggtaggccgtgcacatatgttgctttagtccaccatcccttttgtgtgcatccgtgtatatgatnaattgtgtatgtcaaaacttttgggtatgc

SEQ ID NO: 30255 - DNA, 101 bp, rice(Oryza sativa)
  misc_feature (71): n=a or c
aggaaagcatacagtgaaaggactgatactgcgaaattgaaggaccattgttttcaggagatggaacaggnactaaagtattagctgatattggtggtgca

SEQ ID NO: 30256 - DNA, 101 bp, rice(Oryza sativa)
  misc_feature (71): n=a or g
ggattactgcatcgggctgggagtcaaaatatacttcgcttcggtttcccatcctcaaagcaacgaacaantcgagagggcaaacagcatagtactacaag

SEQ ID NO: 30257 - DNA, 101 bp, rice(Oryza sativa)
  misc_feature (71): n=t or c
tgggagacaattctggagaacgccagatccagcgtggatgacagtaaagtggaaacccaatcaaggtgtanttagttccaaatttttttttccaaattttc

SEQ ID NO: 30258 - DNA, 101 bp, rice(Oryza sativa)
  misc_feature (71): n=t or c
ctagttcactacgttgttcatgtgcatgcattgttccaaagatgctgaatactgactagcgagtacagtgngacttgcagcactaatcaagtatctaactg

SEQ ID NO: 30259 - DNA, 101 bp, rice(Oryza sativa)
  misc_feature (71): n=t or c
tcatcaggttcctctatttgcagctagtagtagtctatttaacacgccagtagccacccatttctttctcncgtgcggctgtcttgtgtttctcaaacttt

SEQ ID NO: 30260 - DNA, 101 bp, rice(Oryza sativa)
  misc_feature (71): n=t or c
agaaatattccaaacatacaatttgagaaggtcattgggaactgtaatggtaggtgcataatgtcgaacangttttctattatgtttacgctttgacacaa

SEQ ID NO: 30261 - DNA, 101 bp, rice(Oryza sativa)
  misc_feature (71): n=t or c
tcaagttttttccatttaattttcactgtgccttattatctagactgctgtagtgccatgttcctaagatnttctgatctatttaatactaaaaatggaca

SEQ ID NO: 30262 - DNA, 101 bp, rice(Oryza sativa)
  misc_feature (71): n=a or c
gtggtattaaatcaaccagtacaacattttgtggcccacatggacctcagcaccactactacaagcgacanatgtattagggttttacaagtagcagtcta

SEQ ID NO: 30263 - DNA, 101 bp, rice(Oryza sativa)
  misc_feature (71): n=t or g
gatgacaaaacaatgaaatatataatttcaagttactcagcctattgctaaacctctccatccggaattgnatcctctgacttcggccttccttaacatta

SEQ ID NO: 30264 - DNA, 101 bp, rice(Oryza sativa)
  misc_feature (71): n=t or c
tcctgtcatacagtttaacattgtacaacagatcatcaaattgacttttgtactcatccactgtacccgtntgctttaactcgaacatggcattagcttta

SEQ ID NO: 30265 - DNA, 101 bp, rice(Oryza sativa)
  misc_feature (71): n=t or g
cgtgaggtggagggatcggaacatggatgccaataaatcgctagggtcaactgctgctggctgcctgcctngaatatactccttagttccatattttgagt

SEQ ID NO: 30266 - DNA, 101 bp, rice(Oryza sativa)
  misc_feature (71): n=t or c
atttcacgttcaagaagacttaatcttaagaatcctcaagatagtctgcttggtcaaatccctcgacgcanacgagatgaacttatggatgtgagatgctg

SEQ ID NO: 30267 - DNA, 101 bp, rice(Oryza sativa)
  misc_feature (71): n=a or g
gttaactagctttgttaggttctagttataacagatctgatttttctttctgcaaattcagtgcaaacgtntcaacataagattttttttttctgacaaca

SEQ ID NO: 30268 - DNA, 101 bp, rice(Oryza sativa)
  misc_feature (71): n=a or g
ttgccttacactgaaggtcaatagtcgatagaaagttcgcataacaagtgggcgtataggattaggggtgnaatcgagccgagccgagccaaaccgagccg

SEQ ID NO: 30269 - DNA, 101 bp, rice(Oryza sativa)
  misc_feature (71): n=t or c
ttcaggatgtttatcgcataggaaccctcatggaacttgtgcgagagctttctctttcctttgctgatganggaaagcgtgtgaaggtgcctatctttgcc

SEQ ID NO: 30270 - DNA, 101 bp, rice(Oryza sativa)
  misc_feature (71): n=a or c
gtacagcatgaagactgaaaaattcatgcttcagcaggaagctttctctaacttctccacaccaagaaccncgtgtatgatcccaggttatgcctggttct

SEQ ID NO: 30271 - DNA, 101 bp, rice(Oryza sativa)
  misc_feature (71): n=t or g
cactagtcctcaacacactaaacggtctgtccaacaagttcatccatcttcggtatctaatccctatgcancatggttctcgacgtttgccgggttctgct

SEQ ID NO: 30272 - DNA, 101 bp, rice(Oryza sativa)
  misc_feature (71): n=a or g
gtaccgaaatctggagatacaaagactcttatcgatgcattaagcattgcttgttccttgaaaggcgacgngcgccttttggttgctgaggtattttcctt

SEQ ID NO: 30273 - DNA, 101 bp, rice(Oryza sativa)
  misc_feature (71): n=a or g
ctaaccaatgcgcacttctggtcgaagttctagtttagtgatgtctaatgtgaccttcatcacaacagacngttcaagtaacctcctaggtttccatctga

SEQ ID NO: 30274 - DNA, 101 bp, rice(Oryza sativa)
  misc_feature (71): n=t or g
tgttgatgtagcctcctaaatcaaagtggaagtagaggttgcagacgcaccttgaaccacctctcatattntctgtgtagaagaacaattggcatcgctag

SEQ ID NO: 30275 - DNA, 101 bp, rice(Oryza sativa)
  misc_feature (71): n=t or c
tcgacaccactgccaatgatgcacgagggagagatgaagattgtgtcgatagaaccaccattattgccccntcatcgccgttgccgacccaccgccactga

SEQ ID NO: 30276 - DNA, 101 bp, rice(Oryza sativa)
  misc_feature (71): n=t or c
gccgaaaaaacgaaagccgaaggagaaaaactgtcgcagatccgtagcagtatcatttcattctcacaatncacaaaaatcccatcaacttatcttgattg

SEQ ID NO: 30277 - DNA, 101 bp, rice(Oryza sativa)
  misc_feature (71): n=a or g
taacagaattagtctacgtaatcaccggattcaaagtttcatcccctaatcttatggatgcgacttacctnttccgacttcctattcccttccatgtttcc

SEQ ID NO: 30278 - DNA, 101 bp, rice(Oryza sativa)
  misc_feature (71): n=t or c
caaccgtgtcgaaacattgaaaaaccgcaaaaaataaaaagaaaaaccgcaaaaaccgaccggttttcgtnggctttgtgtgaaccctaggtgtggcttgt

SEQ ID NO: 30279 - DNA, 101 bp, rice(Oryza sativa)
  misc_feature (71): n=a or g
cgggaagtgtgcacgccaaggaatttcttctccttatcttctccgaatgaacacttaggctgtgtttgagngagataggattgggaagatcgggaagagac

SEQ ID NO: 30280 - DNA, 101 bp, rice(Oryza sativa)
  misc_feature (71): n=a or g
taccacaattcatttctgggccatataaatgttggatgcctgtaggtgtagacgtaaaacacgaggcatgngagatctgcttaactccagtacaggtccaa

SEQ ID NO: 30281 - DNA, 101 bp, rice(Oryza sativa)
  misc_feature (71): n=a or c
atccaatccaataaaaatatacaaccaagttggccggccaacaaatttgtcaacacagctcactgaccccnaaaaaaaaaaatccttgttgacaagaaaaa

SEQ ID NO: 30282 - DNA, 101 bp, rice(Oryza sativa)
  misc_feature (71): n=t or g
tttcttttgaaggaaaggtgaaaactttgacattttcaatggtaaacaatgtatccgtcgttagcgatgtntccgtaataacttcatcaatctcaaagata

SEQ ID NO: 30283 - DNA, 101 bp, rice(Oryza sativa)
  misc_feature (71): n=t or c
tcttaaagaagttactcacacgaaccaatactgcactaacatattctggcaatgtctttcgtactgctagnggaagcaagtgttgtaagaggatatggttg

SEQ ID NO: 30284 - DNA, 101 bp, rice(Oryza sativa)
  misc_feature (71): n=a or g
cgtactaaaagagagaaaggttggagcccgtcgttttccaggatggacaaatggtgtactgcgacgtggcntcggccgattgggctgtcggcgcctccacg

SEQ ID NO: 30285 - DNA, 101 bp, rice(Oryza sativa)
  misc_feature (71): n=a or g
caccaagaatctgtatgatttacctcgaggctccatagtgacaaatgcagatcgatcttctccccgcgatnatggaaggaagtaatcggatgagctagctc

SEQ ID NO: 30286 - DNA, 101 bp, rice(Oryza sativa)
  misc_feature (71): n=t or g
gactatcacgaaatgtgatagacaatgcatagaaggagatggtttgagaccatgtgttgcgtttgaacatnttattcacattgctagcgagaatgaagagc

SEQ ID NO: 30287 - DNA, 101 bp, rice(Oryza sativa)
  misc_feature (71): n=t or c
atgtaagtcagaactaggcaacaactaatggtggcgcagcaagattacattgacctgtcttttgccgtttnggggcgaatttgcagtgcccgtcggagtat

SEQ ID NO: 30288 - DNA, 101 bp, rice(Oryza sativa)
  misc_feature (71): n=t or c
ttaattaatatctctatctagctattcatttcatcggtgttgggtggattccgcgggtgagatctcgcctnccgactccgcggatctcatgctcggtaggt

SEQ ID NO: 30289 - DNA, 101 bp, rice(Oryza sativa)
  misc_feature (71): n=a or g
attaaaaaacagaagtaatacatggcaaactcatttgctcacaacagacacatactcaatctatgtgatcncacgctctatccctgtaagccccgcacttt

SEQ ID NO: 30290 - DNA, 101 bp, rice(Oryza sativa)
  misc_feature (71): n=a or c
attcagcttgttattctaccaacagttatagccgaattaatgacaattcaccgagcatgcatgtaactccncaaaatttcaccgagcattactcattcttc

SEQ ID NO: 30291 - DNA, 101 bp, rice(Oryza sativa)
  misc_feature (71): n=t or c
atcaaagctagcttagccatgaactccccgtagccataatcgaaagataattgagccatagtcctgagtantgagttttggatatgaacaacccgtagttt

SEQ ID NO: 30292 - DNA, 101 bp, rice(Oryza sativa)
  misc_feature (71): n=t or c
tgaaaatgacgttgtacacatacacatccatatacagtttccggccaaaaaattactaacaccgttttgantaatctatgtgtatatcctgatactggccg

SEQ ID NO: 30293 - DNA, 101 bp, rice(Oryza sativa)
  misc_feature (71): n=a or c
aaacagagatcgcgatcgtgcgttgctagcaaggaaccacgaataaatttgcaatatttagcggtgatatngatgcttaagagaaaggtaaagctggaatt

SEQ ID NO: 30294 - DNA, 101 bp, rice(Oryza sativa)
  misc_feature (71): n=a or g
aaatttagggcactgttcacccaactggagacctttctctcctccactcattgtctcttatcgttgacctnttgacctaatactatcccttctttctagaa

SEQ ID NO: 30295 - DNA, 101 bp, rice(Oryza sativa)
  misc_feature (71): n=t or c
tggtccgcctgggttccggtcccacaagtcagcgaaacaaagtgattcaaatcgaatagtagtagtaccantgtaccagcttataataaaagttagtatta

SEQ ID NO: 30296 - DNA, 101 bp, rice(Oryza sativa)
  misc_feature (71): n=t or c
tgtttgttagatgcgtaagcaagcttgccgtaattgtggcgtgttgataaaagtgcggctaagaaatagtnaagtgtaatatagttaagctttcaattgaa

SEQ ID NO: 30297 - DNA, 101 bp, rice(Oryza sativa)
  misc_feature (71): n=a or g
ataccacataattaatttgtcctgggctcttggcccacgttacctagttcttctactatacagatagtccnatttggctccctcaactggtagtccaattt

SEQ ID NO: 30298 - DNA, 101 bp, rice(Oryza sativa)
  misc_feature (71): n=a or g
gtatgctcattataaagaatagacttctcatgccccaatgatgacacatcctctgaactctaatatgtctnagtaacacactcatcaatcacatcaatggt

SEQ ID NO: 30299 - DNA, 101 bp, rice(Oryza sativa)
  misc_feature (71): n=t or c
atgtactcccttcatccaagccctattccttttatctcaccaggaccaataagtaattaactcattcccancatatgacaaaactaatgaacatacaacca

SEQ ID NO: 30300 - DNA, 101 bp, rice(Oryza sativa)
  misc_feature (71): n=t or g
actaagcatatcaaagaattgcatccttcaactcgttaacataacctggggcatgggggaatttttttttngggggaacaaattatacactactgttatta

SEQ ID NO: 30301 - DNA, 101 bp, rice(Oryza sativa)
  misc_feature (71): n=t or c
tcttctttgtatatcccgtgtattcttccatattatcctccagggccacctacgcttgcataagctaagcntgccctgtgtaagattgtttgaagtaacat

SEQ ID NO: 30302 - DNA, 101 bp, rice(Oryza sativa)
  misc_feature (71): n=t or c
gtaacatttaaatattgatactcacaagagtactgtgtgaaaaagctgtaggtcaactaacaccacaactnatacctggcactccctgaatagcattagaa

SEQ ID NO: 30303 - DNA, 101 bp, rice(Oryza sativa)
  misc_feature (71): n=t or c
ttaacaaccaagtaatgcttattttgctcggtcggtacgggaagtaacaaccgcttagccgtgttaacctnttttgcgcctgcttgcaaattaaaccaaac

SEQ ID NO: 30304 - DNA, 101 bp, rice(Oryza sativa)
  misc_feature (71): n=t or g
gagcgcaacgcaaaacgcaatgccacattgctactctcctctctatctgctgcatctctcatcacggttcnatcggtttcgattcctttggatgcccactc

SEQ ID NO: 30305 - DNA, 101 bp, rice(Oryza sativa)
  misc_feature (71): n=a or g
acatgaacatggaaatagtggtcacaacattcatcacctactgtttcaggcttaggtaaaccttgggcagntaggctctaatctgatcctctatttctctt

SEQ ID NO: 30306 - DNA, 101 bp, rice(Oryza sativa)
  misc_feature (71): n=t or c
aattatcgataccatattcgtatccgcatccgcatgcaactatccgcatactgccggatatctaaaaaccnttaccatatcctcacttcggacggattcgg

SEQ ID NO: 30307 - DNA, 101 bp, rice(Oryza sativa)
  misc_feature (71): n=a or c
gccaactctttatctgatttagcaagtcaaactagttcctcgctccaatagactctccatttgtacttttnatcctgagtctatgacaatggaacccacat

SEQ ID NO: 30308 - DNA, 101 bp, rice(Oryza sativa)
  misc_feature (71): n=t or c
ttccattagacatgccaatcagcttcagtttcattgttgatctgaatagccgaatcactggtggagaaacnatctttggtcggttggccaaattccacaat

SEQ ID NO: 30309 - DNA, 101 bp, rice(Oryza sativa)
  misc_feature (71): n=t or c
aaaaagataagcagggatatcactactatgttaatctgaagtacaaagaggacaatggacattaccactangtcaatctgaagtatggagatgataataag

SEQ ID NO: 30310 - DNA, 101 bp, rice(Oryza sativa)
  misc_feature (71): n=t or c
cgttggtggccctgctagcgcatgtcgccgaaactgttgatttgagggtggcgctaacgtagaggaaagangaataggatggctagtcatgcactgcttac

SEQ ID NO: 30311 - DNA, 101 bp, rice(Oryza sativa)
  misc_feature (71): n=a or g
atggcttgtggataggaataatgaagcagatgtatatacatgaaccgtagctcgaccatccgcgtgactgntcaaacaagcggactggtgaacctagagtt

SEQ ID NO: 30312 - DNA, 101 bp, rice(Oryza sativa)
  misc_feature (71): n=a or g
tggacttatttcccacacgagctctagtttctctttttcagcccaaaaagggttattccttcgcagcagcntggtagtggccttggtgatttctgatgtgg

SEQ ID NO: 30313 - DNA, 101 bp, rice(Oryza sativa)
  misc_feature (71): n=t or c
ggcccagatgaatagctgggtcgatgcctcgatgtcgcgagtgagctcaatgatctcactactacacaaangatttttctgtatgagaccccataattttt

SEQ ID NO: 30314 - DNA, 101 bp, rice(Oryza sativa)
  misc_feature (71): n=a or g
attatggtttaaaacctaagtaagtactccttaacactgcaactagctgtccgccagtcggcattatattncaggagtacgtgcaagcttactcattacgt

SEQ ID NO: 30315 - DNA, 101 bp, rice(Oryza sativa)
  misc_feature (71): n=a or g
gggtctcttataaaaaaatagctgaatttcagcggtataacatgaacacgaaatgaacagtactctctccntttcacaatataaatcattctagcatttcc

SEQ ID NO: 30316 - DNA, 101 bp, rice(Oryza sativa)
  misc_feature (71): n=a or g
tttggagtttcttgtgtcatgcctgagattgtctggcacgagcacaattgctaaaactctcgtagatgacngtagggctttgagctatcgcacccccgaga

SEQ ID NO: 30317 - DNA, 101 bp, rice(Oryza sativa)
  misc_feature (71): n=a or g
ggtcgagattgacccacgtcgtccaaggattcgtccacgattcagaagacgttgaaccttatccgtttctncaacgctacgctgtgtttctctggtttggg

SEQ ID NO: 30318 - DNA, 101 bp, rice(Oryza sativa)
  misc_feature (71): n=a or g
aactgaattttccgtgttcttatgcagctcgcccactctcaagaggctttggctcgagtcgtgctcattgntgaccagcaatggactcgcccagatgatcg

SEQ ID NO: 30319 - DNA, 101 bp, rice(Oryza sativa)
  misc_feature (71): n=t or g
aaattcccgtagcaatgagcggggtttcacctagttattctgacactagcacactcctcctatccttcatnctctaccagctgcagatcgcgctcctctaa

SEQ ID NO: 30320 - DNA, 101 bp, rice(Oryza sativa)
  misc_feature (71): n=a or g
cctgatttaataatgcactagaaatcaggtcatgtggaaaatttgaataaacctggatttgactatccccngtaaaaggaggagatccggtaacaagttga

SEQ ID NO: 30321 - DNA, 101 bp, rice(Oryza sativa)
  misc_feature (71): n=t or c
accaacatgcaactttgcaaactctttcagcctcttcaagtctaaaatcaccatgtaactttgggtcaacnaaactttgcacatctccctcatgaagcttg

SEQ ID NO: 30322 - DNA, 101 bp, rice(Oryza sativa)
  misc_feature (71): n=a or g
aaaggaacggcgaaaaaaagtgcgaatagagaaaattaaaaagcgccaaaagaataaaagaaaaaggcccncaggaggggtccagctagcgcacgccagtg

SEQ ID NO: 30323 - DNA, 101 bp, rice(Oryza sativa)
  misc_feature (71): n=a or g
ttgtcgttgatgcaaggcgaggcggtttgtgatgcgattcgaaggtgaatggaattttttttatgccatcntcctcacgccacctttgacgccccgaccgt

SEQ ID NO: 30324 - DNA, 101 bp, rice(Oryza sativa)
  misc_feature (71): n=t or c
ttaagcaaagatttataaaaatatcaaaaattggttgtattgtatgactagtcagtattagggatgaaaanagagcagatagttcccgtccgctccggaga

SEQ ID NO: 30325 - DNA, 101 bp, rice(Oryza sativa)
  misc_feature (71): n=t or g
tgatttaaaaatatatccctattgagcctattttttacaataaggtatttgaggacgacataactcgtagnaaaaaaattactatatagagagcacatatt

SEQ ID NO: 30326 - DNA, 101 bp, rice(Oryza sativa)
  misc_feature (71): n=a or g
taaaaggatggggaagtattcaggttcttgtaatgaagacctatgctgtggtgttttagcaatgtttgatntgtgtgctacctgtgtttgactggttgtgt

SEQ ID NO: 30327 - DNA, 101 bp, rice(Oryza sativa)
  misc_feature (71): n=a or g
atagctttgctgccttccatggaccccaatcataaaccaattacgtcaccacgtgtgacgagtgatcatcnatcacttctcatcttaattatattagcaat

SEQ ID NO: 30328 - DNA, 101 bp, rice(Oryza sativa)
  misc_feature (71): n=a or g
cagattgggaggagatggggaattttttttttagggttcttggctagaacatccaccaccaggaaggtcgntcggttcccgtccggaggtcagctacctgg

SEQ ID NO: 30329 - DNA, 101 bp, rice(Oryza sativa)
  misc_feature (71): n=t or c
ctactttagctctcgtgcagtatgccttcttgtattgccgattagtagcatcgacaccatggctgagatangagggagccttctcatgtaactggatgtat

SEQ ID NO: 30330 - DNA, 101 bp, rice(Oryza sativa)
  misc_feature (71): n=a or g
gagctagagagacaaaggggagagagccccggggaagaagaagaagcagcagctagggcgccaagatgcanatcttcgtgaagaccctgactgggaagacc

SEQ ID NO: 30331 - DNA, 101 bp, rice(Oryza sativa)
  misc_feature (71): n=t or c
gccaatattctggtcttgtcctgcaatgacatcaaccggaactcaattggggactggataattggacaganatgaggaataccaactcatcaatttcattt

SEQ ID NO: 30332 - DNA, 101 bp, rice(Oryza sativa)
  misc_feature (71): n=t or c
tcctcacggtgtgggcttggcgggaggcctccatggagagggagtgatagatggcttccaacggtgagggngtggcaggaggactccacgaaggcgcagag

SEQ ID NO: 30333 - DNA, 101 bp, rice(Oryza sativa)
  misc_feature (71): n=t or c
agttgataattagtgttaccatcctgtttttctctgattttttttaaggctaccttggtgatttacacatngcccctttgtgccctcggctcctcgtgctc

SEQ ID NO: 30334 - DNA, 101 bp, rice(Oryza sativa)
  misc_feature (71): n=t or g
agattgcgggggaagaaaggggaattgggccacctaaaactcagcttttccaaggggtgtgtttagatgcnggtaaaactttctatttgctgtcacgtcgg

SEQ ID NO: 30335 - DNA, 101 bp, rice(Oryza sativa)
  misc_feature (71): n=a or g
gtccgaaaatatagcaatcttggatcagatggggctcaacctatgcactatgaatctggacagaagacatntccaaattcatagtactaggttgagtcaag

SEQ ID NO: 30336 - DNA, 101 bp, rice(Oryza sativa)
  misc_feature (71): n=a or c
attgcacgatttaatgtagctagattgtggatttggacttttcctgttgctcactctccatctcataaaanaaactacttgattttaccaaattacgtact

SEQ ID NO: 30337 - DNA, 101 bp, rice(Oryza sativa)
  misc_feature (71): n=t or c
acacattgcgagggtgagtgtcccttggccaccactcctacacctagagttcctcttccaccccttgcctngtcgtcgtcctcacgactcgtgagagggcg

SEQ ID NO: 30338 - DNA, 101 bp, rice(Oryza sativa)
  misc_feature (71): n=t or c
gatggtcggtgatgaacccatctcaataaaggcgatggtgatgatcagcggtagaccctgacgacggcgangggctagatctgaatttgttttagaaaaaa

SEQ ID NO: 30339 - DNA, 101 bp, rice(Oryza sativa)
  misc_feature (71): n=a or g
tagcaaaaaccagcaacaccgcatccctcaactcatcctgcaaatgccatatgactgaatgcttaaagcantgattgaaaagaatttgtatatgtatgtaa

SEQ ID NO: 30340 - DNA, 101 bp, rice(Oryza sativa)
  misc_feature (71): n=t or c
tgccaaaatccttcaaaaaatgaaaaattcagggatttgcacctggaggctgcacatagttttagaatcancaattcaccatgagcagtaaaaatacatag

SEQ ID NO: 30341 - DNA, 101 bp, rice(Oryza sativa)
  misc_feature (71): n=t or c
gcaatcctcacactcctgttgttgcaggtttattaattagctactgctagcatcaacctcatactcgaganagtgcctcactttgatcacttagcatgcca

SEQ ID NO: 30342 - DNA, 101 bp, rice(Oryza sativa)
  misc_feature (71): n=t or c
tatttgggaaatttctgtgcatgacatggatcgatcgtcaggacacgacgagtcaacgacgtgcatattcnctccgtactcataaaaaaaacgtttaggac

SEQ ID NO: 30343 - DNA, 101 bp, rice(Oryza sativa)
  misc_feature (71): n=a or g
acggagagagaatgaaaagaaccaaccgtatgccagtccatattgtccctctcctttccctcctgcatctntcagtgatggagaaactaactttagtcggt

SEQ ID NO: 30344 - DNA, 101 bp, rice(Oryza sativa)
  misc_feature (71): n=t or c
tgctgagatgctggcccagggcatcattcgtcccagcacatccccgttctcgtcgctagtcctactcctcngcaagcatgacggttcttggcgcttctgca

SEQ ID NO: 30345 - DNA, 101 bp, rice(Oryza sativa)
  misc_feature (71): n=t or c
ctcatagtgcagtcaggcaatcaagcagactatgacagtgatgacgagtacattgccccaaggtcttcaanccggcagccgttggtgaacaagcaacctgt

SEQ ID NO: 30346 - DNA, 101 bp, rice(Oryza sativa)
  misc_feature (71): n=t or c
gaaaagtattggctggtcggctcctagattgtgtcagagaaactcatcaccagttagctagattgttgatnatatggatgctactaccactggtggagaaa

SEQ ID NO: 30347 - DNA, 101 bp, rice(Oryza sativa)
  misc_feature (71): n=a or g
tagaattggcgacgtaatcaaactcgatatgagggttttgttttgattcgattagatcgcgtacatggcanatttgcacggatatgggacacagctatgga

SEQ ID NO: 30348 - DNA, 101 bp, rice(Oryza sativa)
  misc_feature (71): n=a or g
tcaatgcatcaagccggtttctttggctcgtgtacgtatcaaaggtatcgtttttgaaccgacatgacatngggtcatcagtgtcatcatcttggtgccag

SEQ ID NO: 30349 - DNA, 101 bp, rice(Oryza sativa)
  misc_feature (71): n=t or c
tttctcgtagtaaatgccgcgtggtggtgtttatgcaaaaaaaaagtcctcgtgtttggacggaatagcgngcacgtcctcccaccgactaacatcatgtt

SEQ ID NO: 30350 - DNA, 101 bp, rice(Oryza sativa)
  misc_feature (71): n=a or c
tgggatatattagagtttatgcatgtctatcatacaattctaacaggtaaagtctttatgagaccctggancgtattttcaagttgcaaacaagttttatg

SEQ ID NO: 30351 - DNA, 101 bp, rice(Oryza sativa)
  misc_feature (71): n=a or g
cttttatgtatgtatatataaagtactccctccgttctttagtatatgggattttagtatatgggattttnatattttgcttacattgtttgaccattcgt

SEQ ID NO: 30352 - DNA, 101 bp, rice(Oryza sativa)
  misc_feature (71): n=t or c
accattcttctcttcctttctctctgccttcctttctctcttccttcccctccccctagtgctcatctctntgtggtggtggtgaagtcgcaggtggtcgc

SEQ ID NO: 30353 - DNA, 101 bp, rice(Oryza sativa)
  misc_feature (71): n=a or g
caaacccaactctaaatgatgacagctattgaataaatatatgatttggggcgtcctaagtttgccctagngcaaacacccccttgggattagcctacgac

SEQ ID NO: 30354 - DNA, 101 bp, rice(Oryza sativa)
  misc_feature (71): n=t or c
atcagctgcatgatatataaagttgttgattgactagtaaatcctggatggctcgatcgatcgttggtctncctcctccctcctcgatccgatcctgatga

SEQ ID NO: 30355 - DNA, 101 bp, rice(Oryza sativa)
  misc_feature (71): n=t or g
ctagctctagatcagagctgccagaacagaagaaacaccaacacacatatattagaccttactcaccttangcacacgtgcagaaacaaaagcaataatac

SEQ ID NO: 30356 - DNA, 101 bp, rice(Oryza sativa)
  misc_feature (71): n=a or g
gcgttctcgtgtagccatcttgtgtatcgaatagctatagctctccagcagattgatcagtgacgacgacnacgatggcggcaatggcggcggcggcggcg

SEQ ID NO: 30357 - DNA, 101 bp, rice(Oryza sativa)
  misc_feature (71): n=a or g
ccgttgcattgtcaaacatgccagtggttgaagagaaggtcaatggccttatcaaagctgtctattttcangaaacaccaataatgtcaacatacctagtg

SEQ ID NO: 30358 - DNA, 101 bp, rice(Oryza sativa)
  misc_feature (71): n=t or g
tcttgaacttgatccaataaatctggatatatttcgagtcattcgtagctattgggattataaatcctggntgaaagtggctccgatagccatcgaccaat

SEQ ID NO: 30359 - DNA, 101 bp, rice(Oryza sativa)
  misc_feature (71): n=a or c
ggttcacgccgaatagaagagccgagtccacaccgaaaaggggagagctagttctctaatctcagaggcgnagcttaccctgtacttcctccgtaaaaaaa

SEQ ID NO: 30360 - DNA, 101 bp, rice(Oryza sativa)
  misc_feature (71): n=a or g
cacataccatcaatctggtgctcaatcctgataactatagtgcaagctttgaccgcttcactcaagctccncactcacacacatgagttctgtcggtccgc

SEQ ID NO: 30361 - DNA, 101 bp, rice(Oryza sativa)
  misc_feature (71): n=a or g
ccgaaaaaaatgggaaccaggggctcagccgatccgatccagtttaaaaattggagtgcaatcaacccggnaaaaatcggttgaatcgccggtttttggaa

SEQ ID NO: 30362 - DNA, 101 bp, rice(Oryza sativa)
  misc_feature (71): n=t or c
acgtgtttataatacctccatacttgaagatcacctgattctgacagaacaatatacttggtattattgangagtgaattcttggtgtctaggacgacccg

SEQ ID NO: 30363 - DNA, 101 bp, rice(Oryza sativa)
  misc_feature (71): n=t or c
tcatcattgcagctgctcgattagggaaggagattcaaatgggtttggttaggctgaggtgttaattaatnaactgaggctgcaagttgggttgagtgtag

SEQ ID NO: 30364 - DNA, 101 bp, rice(Oryza sativa)
  misc_feature (71): n=t or g
accattgctagattgacactctgatctgatcaccgttgcccccaaactgtacatcattcttctttcctctncattgtttttttgttgtacataatacatac

SEQ ID NO: 30365 - DNA, 101 bp, rice(Oryza sativa)
  misc_feature (71): n=t or c
atccgcgccatcgacaccgctaagaactccaacgccatgcgcaccctcaccagcgccgtccatgccctcgnctggcgctccggcgtcggcagcggcggtgg

SEQ ID NO: 30366 - DNA, 101 bp, rice(Oryza sativa)
  misc_feature (71): n=a or g
cctcgagcttttttttttttgacaacctcgaggctcgcgtgctcttcatatagcgaaaatgttgcaagaanatatcaggtcggctccggcagcgtgcgacg

SEQ ID NO: 30367 - DNA, 101 bp, rice(Oryza sativa)
  misc_feature (71): n=t or c
tatttgtttgatataaattttattttcttataataaaacttacccggagcatttcgttcttaccagcaatnggcagacccacaacaaatcgaccgtgatga

SEQ ID NO: 30368 - DNA, 101 bp, rice(Oryza sativa)
  misc_feature (71): n=t or c
catgtcaaacctgcgcaccaactcctactctataaaggaaaaactcgtggtcgtcttcctcctcgagccantccacaaaattcggcaaaatccagtgctcc

SEQ ID NO: 30369 - DNA, 101 bp, rice(Oryza sativa)
  misc_feature (71): n=t or c
ggtcgttgtcaaaccttaagtacttgtgtggtcgtattcctatatattccacacatcctccggtagttttntttatgtagatgtttaatttaaatttgtac

SEQ ID NO: 30370 - DNA, 101 bp, rice(Oryza sativa)
  misc_feature (71): n=t or c
gaagatactcgagtatctccgcctttatctttttttcttactttaaacctggcttagtaattccactgttntaattttaaacaaatatgacactttctcct

SEQ ID NO: 30371 - DNA, 101 bp, rice(Oryza sativa)
  misc_feature (71): n=t or c
tatactgttggagaaacggtttttactcctggttatagcaacaggacgagtaaatcggaactacagaaaanttgtactaaagttacatagcaaataaaata

SEQ ID NO: 30372 - DNA, 101 bp, rice(Oryza sativa)
  misc_feature (71): n=t or g
tgcatgccaaacaattgcattgataagtcaagatccaaaccaaatggcaataaggaatcccacaattctcncaagatatcatatgcgcatgcagcgagaaa

SEQ ID NO: 30373 - DNA, 101 bp, rice(Oryza sativa)
  misc_feature (71): n=t or c
ataccattaatttgaatatcagaatgtaaaggccactgcatcctgaaaggtacgctatcattgaatagganacaccaaacctgcatgaaaataaagaatgc

SEQ ID NO: 30374 - DNA, 101 bp, rice(Oryza sativa)
  misc_feature (71): n=a or g
ccaccgtcgccgtcaagcacatcgtcgccgctgtcctcgacaagcatagcgacgtcaacgaacgatggccnggacttcctcctcatccaacgcgtcaaccg

SEQ ID NO: 30375 - DNA, 101 bp, rice(Oryza sativa)
  misc_feature (71): n=a or c
ctagtgaacaaactaaaagctccatagtaccagctacgaacaaggtttgtatttcaaagaacaaaaataancgaaatgagtatagctcaactggttgaatt

SEQ ID NO: 30376 - DNA, 101 bp, rice(Oryza sativa)
  misc_feature (71): n=a or g
tgacttaaattagatgtggtatttacatctactacaaaacttgtcctaagtactgcacatgaaccaacccngggtattgaagtaataaaatttattgtttt

SEQ ID NO: 30377 - DNA, 101 bp, rice(Oryza sativa)
  misc_feature (71): n=a or c
gagaacaagaatatgggcatcttttcaacaggtacatgtagaataatttggtggatgctgattcttttatnggtgatttgcggaaaaagtcttattaatcg

SEQ ID NO: 30378 - DNA, 101 bp, rice(Oryza sativa)
  misc_feature (71): n=t or c
atggattgcaatcagtgttttgttagcaaaggtataaattgtggtcttccaacatccattcctttgtcttntggggaaaactcaattcatcccttaaggga

SEQ ID NO: 30379 - DNA, 101 bp, rice(Oryza sativa)
  misc_feature (71): n=t or c
tcaggacgcagacctccagcaggggctagaagaaatgcaaggtaaagaacactagcacatcaaggaatttngatgaggagaatgatcagtaccatgattat

SEQ ID NO: 30380 - DNA, 101 bp, rice(Oryza sativa)
  misc_feature (71): n=a or c
gctgacaaataaacaatgttcagttaggcttagagggagcagagaaaatggcatgcaccaacaacctatantgtcatttggtgaattttattttatttttt

SEQ ID NO: 30381 - DNA, 101 bp, rice(Oryza sativa)
  misc_feature (71): n=a or g
tttttaaaggccacgtgccatgcgtgtaccttccttttctttcactcactcgctcttggatgtaatattgnactattcgtcttatgcaaaacaatcatata

SEQ ID NO: 30382 - DNA, 101 bp, rice(Oryza sativa)
  misc_feature (71): n=t or c
tacattctaagagtccaccccggtctctgtaaagaatgcacacagcaaaaaaaacaggatctaagaagacnttctcatcacaaaacagaaaccagtcgcta

SEQ ID NO: 30383 - DNA, 101 bp, rice(Oryza sativa)
  misc_feature (71): n=t or c
caatcaagtgatattggtaacatcagtggtaatggtgttgatgatgctgttttgaatgatgaattgctaantgaggaagacattgaacaatttttagaaga

SEQ ID NO: 30384 - DNA, 101 bp, rice(Oryza sativa)
  misc_feature (71): n=t or c
cgaagttcagtagaaatagtgttttgtaccttcagaattacactactacaaatgcaaaggttaagtagaanacatcaagaaccattgaattgttaatttga

SEQ ID NO: 30385 - DNA, 101 bp, rice(Oryza sativa)
  misc_feature (71): n=a or g
cattcttcagctcaacaagaagacaggagagacattggcatttctcaaagtacagctgctgatgcgatatncttactctggcctcacaagatgatagagct

SEQ ID NO: 30386 - DNA, 101 bp, rice(Oryza sativa)
  misc_feature (71): n=a or g
tcttgtcatcacccatcagtgcaacacctggtttgtaaccggatgctctgataccacttgtcagaatcacnccggagagaggacgtaaaccacgtcccggc

SEQ ID NO: 30387 - DNA, 101 bp, rice(Oryza sativa)
  misc_feature (71): n=t or c
ttgtccatttgggatcgtaatcgttgttcgaatgccttcttgtcaacatggatcagtacattaaccaaaantggtcagagatgaagccggtgagagagcat

SEQ ID NO: 30388 - DNA, 101 bp, rice(Oryza sativa)
  misc_feature (71): n=a or g
atgatcaattttttagactaaactcaggtccaagtctcccaagtccactaaagacttgactaataagtccntccacaatttctttctgtcagtttccttga

SEQ ID NO: 30389 - DNA, 101 bp, rice(Oryza sativa)
  misc_feature (71): n=t or c
acggcgacccttgcttcgcctcctcatacatggaccagagcatctcacatcacagatcgatcttttttttnctccggcgattaattaaagatccaatcaac

SEQ ID NO: 30390 - DNA, 101 bp, rice(Oryza sativa)
  misc_feature (71): n=t or c
caccaaacgaatccgatccgatgaagacaccacaaggatatcacaataatagggaacctccaatacaacgncttcaagaaggctgcgacatcttgaatatc

SEQ ID NO: 30391 - DNA, 101 bp, rice(Oryza sativa)
  misc_feature (71): n=a or g
aggtcctatatattccatcccatagtgtaaagggctcctctcacttttcatcactatgtccaatccccttntactatagttgcatgcctgaatggccccct

SEQ ID NO: 30392 - DNA, 101 bp, rice(Oryza sativa)
  misc_feature (71): n=t or c
gtttggtgcgtgtagaaatgaaatggaaggagagaaagacagcgagagagagtgtgtgctttgggcgtctnggcgcggccggcttcggagagagcggggcc

SEQ ID NO: 30393 - DNA, 101 bp, rice(Oryza sativa)
  misc_feature (71): n=t or c
cgaggcaatcaagtagcccttttttaagcttttcccccatctttataaaccagccatctgcactagacccnagcactcatctgtctcttttaggccttcac

SEQ ID NO: 30394 - DNA, 101 bp, rice(Oryza sativa)
  misc_feature (71): n=t or g
tgctgccagtcgaatggcttgagtttgagacctctaaagctcgtagactctaatttagtgattgcttcatnccacgaattatattggtgttgtgatttata

SEQ ID NO: 30395 - DNA, 101 bp, rice(Oryza sativa)
  misc_feature (71): n=t or c
acggttaattatggggaaccgctgaaacccaataaacataaaaaagcatgggacgtaactacacaactaanaacaacaacaacagcggagcccaaaagcag

SEQ ID NO: 30396 - DNA, 101 bp, rice(Oryza sativa)
  misc_feature (71): n=t or c
tatatatatactgcaagatgtggattttaatgcttcggtttcaggggaaagtgaaatcatcccgatatccnctcgtttcgtgcatatcacctaaatagtca

SEQ ID NO: 30397 - DNA, 101 bp, rice(Oryza sativa)
  misc_feature (71): n=t or c
aaaaggctataatgatgatgggagtgaacctcccatcccactattgcttttgttgtttttacaacttatanatccagatattatgaaatagtctaatattc

SEQ ID NO: 30398 - DNA, 101 bp, rice(Oryza sativa)
  misc_feature (71): n=t or c
tctatactaattaatacactcatagcaatatttgtgagtattaatactcatagtcatagtcatgcatccangactctatcatactaatataatattattaa

SEQ ID NO: 30399 - DNA, 101 bp, rice(Oryza sativa)
  misc_feature (71): n=a or g
tcaggacagattgtcgtaaggaactcagcacggattaggggtactcctccgtaattaggggtggcttctcnaagcaccaggagagcatcagatagagtgta

SEQ ID NO: 30400 - DNA, 101 bp, rice(Oryza sativa)
  misc_feature (71): n=t or c
gcttaattatttattatgtcagctatatattgtacacttagtactagtgtactacgtgatattatactccnccgtccctgtatatttgacgccgttgattt

SEQ ID NO: 30401 - DNA, 101 bp, rice(Oryza sativa)
  misc_feature (71): n=t or g
tagttttaatagaaataggtagacaattttttgaggaggggaatgaggtgtgtgtgcaagagaggacatangagcgtttgagaaatactcagggtttctca

SEQ ID NO: 30402 - DNA, 101 bp, rice(Oryza sativa)
  misc_feature (71): n=a or c
tagtaatggaaccagtaaatcagatcaaacctgcaaaatgaagaccagcctttttgcatgcaatagcagtnatcatcatgtgtgaactatcaagagagtgc

SEQ ID NO: 30403 - DNA, 101 bp, rice(Oryza sativa)
  misc_feature (71): n=a or g
atattcatgttttgcctacttgcccgttggctatgtgactctcattgtctagactactacccttcacactngttaaattggtcagaattttgctttgcttt

SEQ ID NO: 30404 - DNA, 101 bp, rice(Oryza sativa)
  misc_feature (71): n=a or g
caaggaaggaaagacagtagtttggatttactccggtatatatacaacgcgtgttcgatccaatcaccacncggtccacaccgcatttggattggagttgg

SEQ ID NO: 30405 - DNA, 101 bp, rice(Oryza sativa)
  misc_feature (71): n=a or g
cagagagaacgcatttcagagttcattttgccatcaccctgaatggcataagacaggaccagcaacttctnggaggatacagagaggaacttacgaggcca

SEQ ID NO: 30406 - DNA, 101 bp, rice(Oryza sativa)
  misc_feature (71): n=t or c
ggagccccatgtgttctattgtcctatcagtcaataggtaattatttcttactacacgatatgtccttttnaaacaaaatgaaccaaaatgatgtaatgct

SEQ ID NO: 30407 - DNA, 101 bp, rice(Oryza sativa)
  misc_feature (71): n=t or c
gtctctctctctacatggagcattgaacgtgttacagcgaaaatccgaaaaataaacagcctcatcttttngcttatcgcttatgtttatacttatcggcc

SEQ ID NO: 30408 - DNA, 101 bp, rice(Oryza sativa)
  misc_feature (71): n=a or c
ggcttattctctcaaacaatttgttgcaaaacagataaccctctgaaggttacccatttgtcctctccaangcgacatgtacccgttggcatttccctttc

SEQ ID NO: 30409 - DNA, 101 bp, rice(Oryza sativa)
  misc_feature (71): n=a or g
gtagtcctctctaagttgaactcacattgtaacataaggattattgtgtatatccagtggattttcctacntaatcttacatagagttgtgtttatttcac

SEQ ID NO: 30410 - DNA, 101 bp, rice(Oryza sativa)
  misc_feature (71): n=a or g
ctcgtgcactggcatcaagacgtagtacgaggtttcggtttcgacggggcgtctcggattattggcgggcncggcggcggacggcggctgcgctggcctgc

SEQ ID NO: 30411 - DNA, 101 bp, rice(Oryza sativa)
  misc_feature (71): n=t or g
gagtgatttttgcaacggttacaaccatgatgctaggagatgggacagctgctagtttctggcattcacgntggcctgaaaggctaacgcgcgaacgtgcg

SEQ ID NO: 30412 - DNA, 101 bp, rice(Oryza sativa)
  misc_feature (71): n=t or c
caggtgctattagagcctcaacccccactgcacaggtacgtgtacatgttatccaatggaggggacatggngcaacaccgtagcaccaaggggagatgggt

SEQ ID NO: 30413 - DNA, 101 bp, rice(Oryza sativa)
  misc_feature (71): n=a or g
gtctcttccacataagacaaactatccaaagcatgaacccaaccttttttcagtttcttacggagaactcngagatcatcacgttcagtagtaacagtgta

SEQ ID NO: 30414 - DNA, 101 bp, rice(Oryza sativa)
  misc_feature (71): n=a or g
gaatttgctggattacgctttgagctactggaggaccccttgagagagattttgtatcagattgctgttantttgtatcaatgctgctgctatgtttcttc

SEQ ID NO: 30415 - DNA, 101 bp, rice(Oryza sativa)
  misc_feature (71): n=t or c
ctttgacgaaacctagaaaagatcaacgtgtggtactactatgacaataaaagatcctttattagactgantgtgcaatagtaattcgaaaaaaaaaagat

SEQ ID NO: 30416 - DNA, 101 bp, rice(Oryza sativa)
  misc_feature (71): n=t or g
gtattgctgtgcagtctcggtggctgagccaattggtgcattgttattgtcagaggtatgccatatgatgnttttacgtgtatcttatattctgataagtt

SEQ ID NO: 30417 - DNA, 101 bp, rice(Oryza sativa)
  misc_feature (71): n=t or c
ctacaaagacttcacttttagccattgatgattgacaaattagtggcaagaatgaaagaccagagtgtacnttatcaataagataatgttctgcttcaaaa

SEQ ID NO: 30418 - DNA, 101 bp, rice(Oryza sativa)
  misc_feature (71): n=t or c
ctaaatcttccatccaatgcgatacgtgaaaaaatggcaccacctttactcccaaattcctgaattgcganaattgctccagcaaaatccccaaaatgatt

SEQ ID NO: 30419 - DNA, 101 bp, rice(Oryza sativa)
  misc_feature (71): n=a or g
ttacatttatctttcgctccaacaaactctaaaataccctctccaatctaacaacagatctcatatgtcancctgtatctcttccttactctccttctatg

SEQ ID NO: 30420 - DNA, 101 bp, rice(Oryza sativa)
  misc_feature (71): n=a or c
actgaagaacgagtgaccaaaattggacacaagaacttaagggacatatggcagtagcaaacgtggcacanaatatttgttgaggatcgataaggctgaat

SEQ ID NO: 30421 - DNA, 101 bp, rice(Oryza sativa)
  misc_feature (71): n=a or c
cttggtgcgcaacttattgatccaagtagaacttcctttccttctcccaactaaatttccccctcgatgtnggagtcagagaacacacggttcatggatct

SEQ ID NO: 30422 - DNA, 101 bp, rice(Oryza sativa)
  misc_feature (71): n=t or g
ctcccataggtagtccaagataggtaaacggccttttgcctattgagcaaccaaaagttcctgctaaaaanatcatgcaagatttatggaaattgattttc

SEQ ID NO: 30423 - DNA, 101 bp, rice(Oryza sativa)
  misc_feature (71): n=a or g
aagatttactcgttgagttagtagatgggacacgtatattatggtctttctccttatcactcgtgttaccnatgataagaaacatgcgatacacacgggtc

SEQ ID NO: 30424 - DNA, 101 bp, rice(Oryza sativa)
  misc_feature (71): n=t or g
atcgcgaagtggccgagatggctgtgtcattcgttggcgtggaaacgcagcatgcacgcaatagtggatanatgcacgttctggttgttagcttgcatgta

SEQ ID NO: 30425 - DNA, 101 bp, rice(Oryza sativa)
  misc_feature (71): n=t or c
ttggatcactaccaatggtcacaatcccattatgtgatcctaccgggctactttccatatgatccaccaanagtaagaaaaaaatctacggggtgtttggt

SEQ ID NO: 30426 - DNA, 101 bp, rice(Oryza sativa)
  misc_feature (71): n=t or c
gcgagtccaacacccactcggccaccctcccctgatacctgtatgaagttagcttattacgatccctttcnatcttaaaataaatcaatcactggctaaga

SEQ ID NO: 30427 - DNA, 101 bp, rice(Oryza sativa)
  misc_feature (71): n=t or c
acttgaagttcatcttagcgacaagtgactactatatcgaggaaaactaatatgagctatggtatttcccnggttctaaaagtttggggtgaaaaatatct

SEQ ID NO: 30428 - DNA, 101 bp, rice(Oryza sativa)
  misc_feature (71): n=t or c
ctctttaccagtttcgccgtccagtactcacttttcagttccagctttgaacagctttgctttgctagctngcgtatccgattccggcttgccaattgcga

SEQ ID NO: 30429 - DNA, 101 bp, rice(Oryza sativa)
  misc_feature (71): n=t or c
acagagcaatcgcgcgggaccagtgcagtcccactggattgatcacacgttgtgctatactccctccgttncgttttatttgacaccgttgactttttagc

SEQ ID NO: 30430 - DNA, 101 bp, rice(Oryza sativa)
  misc_feature (71): n=t or c
gtagtaactgaaatgagcaggaaatatcaatggatagaggtacagtagttgcattccccatgagctggtgngtgcctgctggtatacaaactcagcatggt

SEQ ID NO: 30431 - DNA, 101 bp, rice(Oryza sativa)
  misc_feature (71): n=t or c
tgtactattaactgcatgagtcccaagacatttcagatataatgcaaggtgtatatggttgtgtttagttnagcgcaaagtttagattttggttaaaatta

SEQ ID NO: 30432 - DNA, 101 bp, rice(Oryza sativa)
  misc_feature (71): n=t or c
agacttgacaggataaaattgagcaggacaggttccatgtagctaagaaacatacggggtaaattgagcantaacaacttttttacattggcaatctagaa

SEQ ID NO: 30433 - DNA, 101 bp, rice(Oryza sativa)
  misc_feature (71): n=t or c
ggcgtagagggatgcacgatgtcgaatagaacgatcattgaggggaagaaaaccacccgagtcagaggctntgcggagcatcgcattgagcacatccatga

SEQ ID NO: 30434 - DNA, 101 bp, rice(Oryza sativa)
  misc_feature (71): n=a or c
cgaccatccactccactgtgggcgaatggagaggcgaagaagacgctacgacgttgcaagcggcataggcncgcccaactatctgaggcagcgccgcgagg

SEQ ID NO: 30435 - DNA, 101 bp, rice(Oryza sativa)
  misc_feature (71): n=a or g
cgacattccgcggaggaagaggagaggacggagacgagggagccaacgagcttgagctcgctatcccatcnacagtaaggtagctgtggcaggaggcggtt

SEQ ID NO: 30436 - DNA, 101 bp, rice(Oryza sativa)
  misc_feature (71): n=t or c
gccagcgagtgcgactgctgactgcttgacggcgacgtccttgtctcgctgtccgtcctcgccacggtcancgtgatgggctccgtcatgtcgggggtggc

SEQ ID NO: 30437 - DNA, 101 bp, rice(Oryza sativa)
  misc_feature (71): n=t or c
agcaccgaggggggagagaggagcgatctcccccatctctgccagttagtttcttaatgatttggattttngagttttgtggatgggtataatgacgttat

SEQ ID NO: 30438 - DNA, 101 bp, rice(Oryza sativa)
  misc_feature (71): n=a or c
tcaaaatattagggtttcttttgctgatcagtaacatgattaatttcgctatctcccggacatgtgtctangaataatacaagttatttaatttcaaagtc

SEQ ID NO: 30439 - DNA, 101 bp, rice(Oryza sativa)
  misc_feature (71): n=a or c
aaagcattcatgttcctagcaaattcaaggcgtcgccagctatggctcctcgccttgtcatcatcctcttnctcctcgccgtggttgcctcggcggcagtt

SEQ ID NO: 30440 - DNA, 101 bp, rice(Oryza sativa)
  misc_feature (71): n=t or c
cctgcccaaggaccatatagcaaagggttttgatcccaactaaaacacttctctactattcttagacacgncattgccatgaagtcacgtcacctctcctc

SEQ ID NO: 30441 - DNA, 101 bp, rice(Oryza sativa)
  misc_feature (71): n=t or g
ctctcaaaagaaatccctttcaaacaaccctctacatctggctacaaatgtagtactagatgtggttgtgnttgtgtttctcctttcactacaagagaaca

SEQ ID NO: 30442 - DNA, 101 bp, rice(Oryza sativa)
  misc_feature (71): n=t or c
atacatgagctgtaaaatattatcacgagtaaaaatgactaatggggcccggaccgatgcgtgaatgacanaaattctgtgtcagtagggttgttttacaa

SEQ ID NO: 30443 - DNA, 101 bp, rice(Oryza sativa)
  misc_feature (71): n=a or c
aaactagctaccacttgctgtgtagtcacatcctttatcataacattactttttggacgtgactacacagntagtggtctaaaccagctaccactccatct

SEQ ID NO: 30444 - DNA, 101 bp, rice(Oryza sativa)
  misc_feature (71): n=t or c
ccatagtccaccactggtgggaatcgcttgcaacatgtcaagacagcaagatgcacccaagcacaggagtngatccctaatctttctaatctctttgagaa

SEQ ID NO: 30445 - DNA, 101 bp, rice(Oryza sativa)
  misc_feature (71): n=a or g
tgaactaaacacagcctaaacgctgctgtaaactacagccatttttagtactgctacagccgtaaccgctntagcaagaataggtactgaacacaccctat

SEQ ID NO: 30446 - DNA, 101 bp, rice(Oryza sativa)
  misc_feature (71): n=t or c
cataacttggaatttctcataagacccgctttgagcaaccaaaacatcggcatcatccatgtctagtcgangattatgttgtcgtcccccttccatatatc

SEQ ID NO: 30447 - DNA, 101 bp, rice(Oryza sativa)
  misc_feature (71): n=a or c
aaaattgccacaataacatttgtatcactcttacaaaatatgactatttccttccagctggccaagtcaanctgacacaaccatagtacttacttcttaag

SEQ ID NO: 30448 - DNA, 101 bp, rice(Oryza sativa)
  misc_feature (71): n=a or g
ggtcaaatcggccgcgaacaccccaacaacaacagcaagaaatccgaattggaatcaagcgacagacagancccagaaagccgaatccaactccttcccaa

SEQ ID NO: 30449 - DNA, 101 bp, rice(Oryza sativa)
  misc_feature (71): n=t or c
ggaattgtgctcttgtgggacaaatgtttcattttcccccttcacatttgaattggcccatgcaaccaggntaatacaacttggcatctacctagcctgtc

SEQ ID NO: 30450 - DNA, 101 bp, rice(Oryza sativa)
  misc_feature (71): n=t or c
gtggctgctgagtccatatgtccaagaaaagagaaaaatactagtgctatttcaatcgggaactaattganataataaattgtactcctattagtttctac

SEQ ID NO: 30451 - DNA, 101 bp, rice(Oryza sativa)
  misc_feature (71): n=a or g
gtttaatttgctagtggataccctaacttcttggttcgtagctaccggacaccacatgtattatctttttntttctcgctattttggagagagaaactcta

SEQ ID NO: 30452 - DNA, 101 bp, rice(Oryza sativa)
  misc_feature (71): n=a or g
actaatttgtatttaaagtaggtggccagagagtttttctacctcgtacacggatggcgatctagtcttcnaatagagatccttgatcaagttataattta

SEQ ID NO: 30453 - DNA, 101 bp, rice(Oryza sativa)
  misc_feature (71): n=t or c
tagtttatctaatagcagcactacatacatctcattctcatgggctacgtacatggacgttggtacagcanaaaagataaggaacactaggtggagcactg

SEQ ID NO: 30454 - DNA, 101 bp, rice(Oryza sativa)
  misc_feature (71): n=t or c
ttgtgacaaagaattgagtgtaatgtacgtgggttacatcagactttgtgttctcttggagttctcctgcngtcctacttttattcttaattcatgcatcg

SEQ ID NO: 30455 - DNA, 101 bp, rice(Oryza sativa)
  misc_feature (71): n=t or c
tacaaggaagtttgcatgattaaacagcagatcactcagggtgcttaggtccttccaataaactagaaaantaatcagttttcagatatattagcgcatac

SEQ ID NO: 30456 - DNA, 101 bp, rice(Oryza sativa)
  misc_feature (71): n=t or c
gtggcctccttcctcgaaacccaccacctcaccaccacacgtgccccatttcatcccatctcctcttcttnccgcagccgccgactccgctttgactcatc

SEQ ID NO: 30457 - DNA, 101 bp, rice(Oryza sativa)
  misc_feature (71): n=a or g
gtaccacgggaggaataaacagtgaatgttccgatcactttcacgcaaaaagaggacggaagtttgtttgnttaaataggtaagttttagaccaataataa

SEQ ID NO: 30458 - DNA, 101 bp, rice(Oryza sativa)
  misc_feature (71): n=t or c
gacttttcagccatcgaatgtgcatggtctgtgctaatggtggagagaaaaaaaaaggatgtgcatggtcngtgctagtggcggagagaaaaaaattgcac

SEQ ID NO: 30459 - DNA, 101 bp, rice(Oryza sativa)
  misc_feature (71): n=a or g
tacggtagaattttgtccaacttgtactcgtgaaaataaaaggttgaactaaaattaaacataactcctcnttctgtccaagaatacaaatactctatcga

SEQ ID NO: 30460 - DNA, 101 bp, rice(Oryza sativa)
  misc_feature (71): n=a or g
ttgtatgtttttttctcccttcttttgcagaacagctatcgctaaaatcttcagctactcaaacagtatangacctatttaggggaaagggatcctctgac

SEQ ID NO: 30461 - DNA, 101 bp, rice(Oryza sativa)
  misc_feature (71): n=t or c
ttttttttttgtgacggtatgtatatggattgattttgatgcaatacgatggggactcctagctagcgcgngctcgctgctagcgtgcactcgtcccctat

SEQ ID NO: 30462 - DNA, 101 bp, rice(Oryza sativa)
  misc_feature (71): n=a or g
tccttggagagcttctccatcgcgttgatgaacttcctcagatgcctgatgtattcagggtacgtctccangttgcagtggccgccacctttcacccataa

SEQ ID NO: 30463 - DNA, 101 bp, rice(Oryza sativa)
  misc_feature (71): n=t or g
gctccggtgttggaaaaccagtatgctggccaggtagcaggtaacccaaggtctcaaaaccattatgccanccagacaccagcctgcccacagagcactgt

SEQ ID NO: 30464 - DNA, 101 bp, rice(Oryza sativa)
  misc_feature (71): n=a or g
tcaggttacttgtagtttctgagaaaagttaatgacagcacgaatgccttagcaagattttcaaccagctncctcttccatgagaaaaggcaacctgatga

SEQ ID NO: 30465 - DNA, 101 bp, rice(Oryza sativa)
  misc_feature (71): n=t or c
aaatgatatcggaaaaactcgatggggaacatgataactttagagtttatacatgcggttgattagataantgacaatagtttttagtagagtcatctgtg

SEQ ID NO: 30466 - DNA, 101 bp, rice(Oryza sativa)
  misc_feature (71): n=a or g
gcgaggagaaacatcattattagtacagatgtaaatcaagcttaggtgataggtactgagaaatgtggagnagaatggtgtgtggctaacatgggacatgc

SEQ ID NO: 30467 - DNA, 101 bp, rice(Oryza sativa)
  misc_feature (71): n=a or g
aaaatttacactatcataaaatatatcctaacagcagcatgtcacattctccaccttccctaaatccttgngagcaaactttcggttacagaatgcttttt

SEQ ID NO: 30468 - DNA, 101 bp, rice(Oryza sativa)
  misc_feature (71): n=a or g
aactaatttgggatgaaaatagtacattagtttctaccaggggcggagacagccaaattaaaaagacgccngggtcaatgtaaactagtatttgcaatacc

SEQ ID NO: 30469 - DNA, 101 bp, rice(Oryza sativa)
  misc_feature (71): n=a or g
tccaaattttggccaatcaaagtttcttcttgaactccaactttcacctcaaattaattaatctctgtctntttttcacactcaacttgatttggaaagaa

SEQ ID NO: 30470 - DNA, 101 bp, rice(Oryza sativa)
  misc_feature (71): n=t or c
tgacagaaaaaaactgaaattgtcagggtgtgcaatgggtgtttttacacagtttacatgcttcgaaaacncggtataagtgaaacagggttttctgacga

SEQ ID NO: 30471 - DNA, 101 bp, rice(Oryza sativa)
  misc_feature (71): n=a or g
cctttcttgcagttttgctagctgctagcacctagcacacaagataaacccaatcagctacactctatctntctatctatctatctatctatctatctatc

SEQ ID NO: 30472 - DNA, 101 bp, rice(Oryza sativa)
  misc_feature (71): n=t or c
catttaaactcatggcttcacttcatacaaaaggttctgacttcacctatccgtgcatgcatgacgagtcnagccaatatcacaccacggcccatgtcctc

SEQ ID NO: 30473 - DNA, 101 bp, rice(Oryza sativa)
  misc_feature (71): n=a or c
aataagtggtgggacccgtgtatttgcaaaggtttgcatgtcttaccaagaatccggttttctttggcccnaaagaaactgtgagtggtcccttctcccat

SEQ ID NO: 30474 - DNA, 101 bp, rice(Oryza sativa)
  misc_feature (71): n=t or g
acctagtgattacaagagtctcggtagcaccaaggtcctaggttcgactcccatgagagcgaatttttcangatttaacggctttgtgttttcagtggtag

SEQ ID NO: 30475 - DNA, 101 bp, rice(Oryza sativa)
  misc_feature (71): n=a or g
agctgttggtaagccacccaggcatctaccaggctccaaattcttttcatgtatctgtagctgacaacganatgtagaaccgttttgccttctctacggca

SEQ ID NO: 30476 - DNA, 101 bp, rice(Oryza sativa)
  misc_feature (71): n=a or g
acatggatgatccagtagtaattttttctttgacctaggtgctgcaccaggagtattgcttccttgatctnaggatggtgttgatgaagatgaccttttcc

SEQ ID NO: 30477 - DNA, 101 bp, rice(Oryza sativa)
  misc_feature (71): n=t or g
ggatcgagctggggtgcatgacgtaagcgtgaatgacaccaagtgatgcaaatttctgttgttaattcaangtgtgtgtttagttcctgaaaaaagttgga

SEQ ID NO: 30478 - DNA, 101 bp, rice(Oryza sativa)
  misc_feature (71): n=t or c
caagtctgggccagattgagttaacaatgagaatctggcccaggctacaccgagagagtccttctcattcngtcggaaagagaggatgtctaatcgaaaat

SEQ ID NO: 30479 - DNA, 101 bp, rice(Oryza sativa)
  misc_feature (71): n=t or c
gtctgttacacccaaagtgggtatacacagccaatgagctatctgtgtatctattgcgctcgatctatctntacctattacacatagagttgaagtgagag

SEQ ID NO: 30480 - DNA, 101 bp, rice(Oryza sativa)
  misc_feature (71): n=t or c
gcgcgctagttcacgtcaatcccacgtgaatgccatgagcggcaagggggtaagcggacaagcgagctatnagaggccctcgcgtcgcgctacccgccgct

SEQ ID NO: 30481 - DNA, 101 bp, rice(Oryza sativa)
  misc_feature (71): n=t or c
atgtaatgtattccaataaatctggttaaaacttttccggaaacaatgttgtatactactccctccatttnaaattgatctacatattttataggtacacc

SEQ ID NO: 30482 - DNA, 101 bp, rice(Oryza sativa)
  misc_feature (71): n=t or c
tcactgttttttttttggtactgttctttactccagtcagcatggagtgatcagcgatgctcactttgatnaagacatttcatcaacgtctgtctctaacg

SEQ ID NO: 30483 - DNA, 101 bp, rice(Oryza sativa)
  misc_feature (71): n=t or g
aaaaaacagaaagagaatatcgagtggataaaaaccctcaactagttttggtgatgggaggatcgagaaanattcgactggatttgatgggaggatcgact

SEQ ID NO: 30484 - DNA, 101 bp, rice(Oryza sativa)
  misc_feature (71): n=t or c
ctgctgtcagtgtataactcgcaaaattcgcgaaatggtcaagctgatcgaagtacacatggtatgtttcngccatcacacttttctttttttttaaataa

SEQ ID NO: 30485 - DNA, 101 bp, rice(Oryza sativa)
  misc_feature (71): n=a or g
ccccacccaggactttaggctgtcacttgtgctatcatgtgtagctaaaaatttgacccgtttgcacagtnatatgggattcatatgcgaaatttattttt

SEQ ID NO: 30486 - DNA, 101 bp, rice(Oryza sativa)
  misc_feature (71): n=t or g
ttctggttattgttgcaggcaaaggaaagagattgagaggttttgagaaggggcccagttcatcgagattntggcaatggtggtactccaagccaaaaaaa

SEQ ID NO: 30487 - DNA, 101 bp, rice(Oryza sativa)
  misc_feature (71): n=a or g
aggctgtgacaatgacacggggggtcgatgacatatgggctaggatggaaaaacatcaaattcccaatctnagagtagcaaatcatcaattttgggatgag

SEQ ID NO: 30488 - DNA, 101 bp, rice(Oryza sativa)
  misc_feature (71): n=t or c
ctctgctgcagaattatttgcagcatgacaggtgaagttctaggcatctagctgcaagtcgtattcccttngtctaaaaaaaaaaatctagaacttaatat

SEQ ID NO: 30489 - DNA, 101 bp, rice(Oryza sativa)
  misc_feature (71): n=t or c
tgccatgggctccggcccggtagcttagatggtgactaggctggaaataaaaagttgtgactagcacgctnggctcgttttttaaaatggaataagttcac

SEQ ID NO: 30490 - DNA, 101 bp, rice(Oryza sativa)
  misc_feature (71): n=a or g
ataaaatggatataaataactttaggccattcgtatagcatgtggaatagaccagaaattactttaggtcnttcatatcatggtaagaaagaggatgttgg

SEQ ID NO: 30491 - DNA, 101 bp, rice(Oryza sativa)
  misc_feature (71): n=a or g
tagcttccaaagccgtcatgcattggttaagccttaactaagcctaacgacatatgtcaatcacgatcatnacttgactgagagaatgttgttgcttcaag

SEQ ID NO: 30492 - DNA, 101 bp, rice(Oryza sativa)
  misc_feature (71): n=a or g
agccgccgctttcgcccaacaggccacgatgtcgatggcaataaccacctcacaagccaacgccaatctcnaagctcaagccgaagttgacatgggggcca

SEQ ID NO: 30493 - DNA, 101 bp, rice(Oryza sativa)
  misc_feature (71): n=a or g
ctgacaaacgaatagtgcatccaagttatctatcttcatttgaacttaatccgggccttaatcaggggtgnaggcaggcctagggcagctagggcttgagc

SEQ ID NO: 30494 - DNA, 101 bp, rice(Oryza sativa)
  misc_feature (71): n=a or g
aacatttaaattttgcaatggtgaaagttaaaattgtgcgcttcaagagtaaggttgtgttcggtagtttnagttgggaattaatatggcgtacgtaaaac

SEQ ID NO: 30495 - DNA, 101 bp, rice(Oryza sativa)
  misc_feature (71): n=t or c
gcctgcatctgcatccttacatatgcatcgaccgcggcatcttttggtccatccaacggatgggcttcgtntcctgaatcttggacggacggacggatggt

SEQ ID NO: 30496 - DNA, 101 bp, rice(Oryza sativa)
  misc_feature (71): n=a or g
acacagggttgagttgcgtgtcatgatctgaactcaaagtattagcgatctcactacaacgaagaaattgncattctatataggccagtgtatcattaaat

SEQ ID NO: 30497 - DNA, 101 bp, rice(Oryza sativa)
  misc_feature (71): n=t or c
tggcagctcaggcggcgttggatgtcgtagacgtacgtacgtattctcgccttgttggctttttgtctcgntcatgcgtggcggtgtacgtagaggacaag

SEQ ID NO: 30498 - DNA, 101 bp, rice(Oryza sativa)
  misc_feature (71): n=t or c
ttactcgcgtgttttcctccgtaacaacattgatgtgccaatttggagggttttttttcctccgtaacaanattgtttgaagtctgaaggaattttttttt

SEQ ID NO: 30499 - DNA, 101 bp, rice(Oryza sativa)
  misc_feature (71): n=t or c
cggagggagtaagtgactaatataagagttatgttaccgtaggccaataactgaagcaagcaaaggctcanatctcgcccgaaatttcggtgttttgcaaa

SEQ ID NO: 30500 - DNA, 101 bp, rice(Oryza sativa)
  misc_feature (71): n=t or c
agaaatggaggtcaataatagagatgacaataagccgatcactgatggcagtgcctgtactagaccttggntctattccattgcgcaattcgctgcaggta

SEQ ID NO: 30501 - DNA, 101 bp, rice(Oryza sativa)
  misc_feature (71): n=t or c
agatcaatctctttgtaattgctatggccgattagattctaatcctagacccaaaccttacacaatcaatngaatcactgttttattttacttttcagcta

SEQ ID NO: 30502 - DNA, 101 bp, rice(Oryza sativa)
  misc_feature (71): n=a or c
aaaacaaaccacacaaacacaatgatcgatgaacaatgcgggcacatgatctcacctaacaactactgagnttaaaaacgaataaattgatgaggaataga

SEQ ID NO: 30503 - DNA, 101 bp, rice(Oryza sativa)
  misc_feature (71): n=t or c
gcatataattccaatcaacatggtagggttcaatggtagggataaaattgaagatatttgaatcgatgcangataaataaatccgtcgaacgatcgtagat

SEQ ID NO: 30504 - DNA, 101 bp, rice(Oryza sativa)
  misc_feature (71): n=t or c
tatgcccttctatctcatggaactacagtccttccaatcaggagctgatctatagggcagtcatgaaaacntgggatgcatgataaagattgttagaacac

SEQ ID NO: 30505 - DNA, 101 bp, rice(Oryza sativa)
  misc_feature (71): n=t or c
tgtctagtataactctctacctgttgatcacacggacggctcagattgaaggattgatttctactccctcngttttagattataagtcgttttgatttttt

SEQ ID NO: 30506 - DNA, 101 bp, rice(Oryza sativa)
  misc_feature (71): n=t or c
gacgatccaatagttagttggtcctttgcttcggcgggcaagaattaagaggcccaactctgaagatgtantggcagacctgaacttactacttcgagcat

SEQ ID NO: 30507 - DNA, 101 bp, rice(Oryza sativa)
  misc_feature (71): n=a or g
ccccaaacacgtaaattaaaaactcgaaaaagggccatgtaaatctaggatgtcgccgtgtaaatctaggnccataccgaatactccctcattttctaaat

SEQ ID NO: 30508 - DNA, 101 bp, rice(Oryza sativa)
  misc_feature (71): n=t or c
agaaagaagcactgaaaatgaccaaatgagaaggcttaattgatcggtcagttcaaagcgcgttaacaagngatcctattcgatttgttgtcccttctacg

SEQ ID NO: 30509 - DNA, 101 bp, rice(Oryza sativa)
  misc_feature (71): n=a or g
aaattgtttgtttctgctaacaagtggtacggaaccaggtaaacatacttggtttcaacgcaaaaaaaaanaactacggtcacgaccaaggtttataatcc

SEQ ID NO: 30510 - DNA, 101 bp, rice(Oryza sativa)
  misc_feature (71): n=t or c
ctgttggacgccgctaggctgctccccttcctcaccgagaaagccaactccacccctctctattctagacnggatctagatgctccctccaccaccaattt

SEQ ID NO: 30511 - DNA, 101 bp, rice(Oryza sativa)
  misc_feature (71): n=a or g
ctgtggttttgggcatgaattttctccttatctctgcccgagctgctttatccccatggtagatcacaccngtcatagatggaacaaacctgaaagcaagc

SEQ ID NO: 30512 - DNA, 101 bp, rice(Oryza sativa)
  misc_feature (71): n=a or g
tatcgtcagatgtctccttgttcaaatataactagagaggtatgattcgagtaatatttgtagtgttcgantaggaatctgtttttattttcttatcgcaa

SEQ ID NO: 30513 - DNA, 101 bp, rice(Oryza sativa)
  misc_feature (71): n=t or c
aggttctgaggacttgtcttatggaggctacagtaagctgaatgtccgccatgattcagagtctgagaacngcatctcggatgatgatgaagatgaagatg

SEQ ID NO: 30514 - DNA, 101 bp, rice(Oryza sativa)
  misc_feature (71): n=t or c
gtgtcattttgttagggttgggttttggacgatctctgtagtcccttcgttagtctagcggtggctggtcnggtgctagtcttctcttagatccgtgtgtt

SEQ ID NO: 30515 - DNA, 101 bp, rice(Oryza sativa)
  misc_feature (71): n=a or g
tccacaccccatcgtccttctcgctctgttcccccatttcttctctcccacttgatattccctaaccacanctccaaggttgcgaccgccgccaaagatga

SEQ ID NO: 30516 - DNA, 101 bp, rice(Oryza sativa)
  misc_feature (71): n=t or c
tcattaaatctatgacttgccccgagcttaatgtatatccatatattatactcgttacgaggctggcctanattattataggtgggcgaggcatcaataga

SEQ ID NO: 30517 - DNA, 101 bp, rice(Oryza sativa)
  misc_feature (71): n=t or c
cagcgcaccagcgcggctccggatcgaccttggcggccggcctcgacatcaagctcatctcactctctgcngtctccctctcctcccccatgtcttcctct

SEQ ID NO: 30518 - DNA, 101 bp, rice(Oryza sativa)
  misc_feature (71): n=a or g
ctccttgcattctagtactcctactggacattaaaatggctcatttggaacacagggaaggccgtgtttantttcccccctattcccaactttccatcaca

SEQ ID NO: 30519 - DNA, 101 bp, rice(Oryza sativa)
  misc_feature (71): n=a or c
aaaaaaaaaagagaaaaggggaggtgggagcgagatccgaggcgtgttaattattgtttaacgcgcagcgnttgtattagcgctaccgattattttcaaca

SEQ ID NO: 30520 - DNA, 101 bp, rice(Oryza sativa)
  misc_feature (71): n=a or g
aatgactaaaagtgaagcaaacaacaaacctgttctagctgctgatgatgttcataccgtaacagtgtatnaccttttcttccttatcttcttttcagaca

SEQ ID NO: 30521 - DNA, 101 bp, rice(Oryza sativa)
  misc_feature (71): n=t or c
actattaggcttttttctgtcagtgtgacaattttggtaaattcttctgccaggcactgaaaaaaggacangagaaaaatacagaaaaaaaatggcttgga

SEQ ID NO: 30522 - DNA, 101 bp, rice(Oryza sativa)
  misc_feature (71): n=t or g
cttttttttttaaaaaaaaagtccgcattaattgtataggagcatgcatttgatcaagtgaagttgcatanaacctattttcttatgatataaatcaataa

SEQ ID NO: 30523 - DNA, 101 bp, rice(Oryza sativa)
  misc_feature (71): n=t or g
ggtaatcttgatattcttgttgttgatatgcccccgggcactggtgatgctcagctatcaatgtcccaaangcttcggttatctggtatttataagtcggt

SEQ ID NO: 30524 - DNA, 101 bp, rice(Oryza sativa)
  misc_feature (71): n=t or c
acttcactagcacaaattttgtgctagccccctatacaattctactgttcatactatatactccccccatnctaaaatataaacatttttagcatagtaac

SEQ ID NO: 30525 - DNA, 101 bp, rice(Oryza sativa)
  misc_feature (71): n=t or c
tcgctcctgatggcgggggcggcgaattctcctgctggtcaccgtgaccgtttgcttccaccgtagctccngagggcgggagtggcggatccgcccaccgg

SEQ ID NO: 30526 - DNA, 101 bp, rice(Oryza sativa)
  misc_feature (71): n=t or c
ctaattaattaatccaataaaggtataatatccagtagcatcaaaagttcctaagcatgagtccccccccnctctctctctctctctaaactgcaggagtt

SEQ ID NO: 30527 - DNA, 101 bp, rice(Oryza sativa)
  misc_feature (71): n=a or c
atctggtgatagtgatgggggcaagatatgagctttctacctccacatgtagctagagaaaggtcagttanagtttatgtcgaaaaaagagaggggtgtgt

SEQ ID NO: 30528 - DNA, 101 bp, rice(Oryza sativa)
  misc_feature (71): n=t or c
tagtgatgcacgtattaattttaattgctaattatttttcaggtttagaatgaaaaggctgctctttttangcataatgaatgctgttgaagcgcatgatg

SEQ ID NO: 30529 - DNA, 101 bp, rice(Oryza sativa)
  misc_feature (71): n=a or g
gtatatgtgtgagaattttgtcccactatctccgtttcataaaaatagcatattaggatgaacttttgaangttaaatataagttacaatgtaattatatc

SEQ ID NO: 30530 - DNA, 101 bp, rice(Oryza sativa)
  misc_feature (71): n=t or c
atcagttgtggtagggtacgtactcggtatatgctagcagagtcagaacaacatgttgcaattaagtcacngctgcagagaggggttaactccaagcttcc

SEQ ID NO: 30531 - DNA, 101 bp, rice(Oryza sativa)
  misc_feature (71): n=a or g
agaagaatacacatggttaccaaggtttagaacatcaacggtaaccgctctattgttgcggttatcagccntcttgatttggcttacatcaagaaaccggt

SEQ ID NO: 30532 - DNA, 101 bp, rice(Oryza sativa)
  misc_feature (71): n=t or g
aattccgtgcgggatttacctttggctgccacttgcgcttttaagtttttagttatactccctccgtttcntaacataagtcattctaatattgtccacat

SEQ ID NO: 30533 - DNA, 101 bp, rice(Oryza sativa)
  misc_feature (71): n=t or c
aggctcgcagatcccatttgctccggtccactctgtgcacagccctgtgttgtctaggactacctccgtcncaaaataagtgcggtcatggaaatctgttt

SEQ ID NO: 30534 - DNA, 101 bp, rice(Oryza sativa)
  misc_feature (71): n=a or g
cacgcgcaagagatgaggagagagagaaacgctgggtgagagagataagggggatagagagctacacactnacatgtgggtcccatcacgctgagtcagct

SEQ ID NO: 30535 - DNA, 101 bp, rice(Oryza sativa)
  misc_feature (71): n=t or c
tacggaaaccttgcgtattttttaattaggtatatagatatggccgtggcctgtgggtcctgttggttaangaagtgtcctgttacatatataaaaaaact

SEQ ID NO: 30536 - DNA, 101 bp, rice(Oryza sativa)
  misc_feature (71): n=a or g
cttaattggaatggaagccatcttggatgggcacactactagaaaaatcctcacaaatcctacagggaccngctcataggtgccggttcatttaaaaccag

SEQ ID NO: 30537 - DNA, 101 bp, rice(Oryza sativa)
  misc_feature (71): n=t or c
gcctccattatagctctcctacctctagttatagtgccaagtcaagaacacatatgacaaggaaaaaaacngttcgatttaggaatacctcatacaacaat

SEQ ID NO: 30538 - DNA, 101 bp, rice(Oryza sativa)
  misc_feature (71): n=t or g
ctagttggaagaggacctacctgccgatgttgtgccatatttcaaagtttttagaggaggggagatttttnaacttttttttaaggatagccctgacctaa

SEQ ID NO: 30539 - DNA, 101 bp, rice(Oryza sativa)
  misc_feature (71): n=t or c
cccttaatcagtcataatcccttttagaagtgtttgactagcagattagctccatatcatgatatgggagngttcaaagtaaaatgaatctctttgtatct

SEQ ID NO: 30540 - DNA, 101 bp, rice(Oryza sativa)
  misc_feature (71): n=t or c
ccgtaggaatccaaactaactcactcctgccttaaattgtttttcagctgggtctgaatcgaaccaacacntcagacaaaacggcagtccatgttcaagtt

SEQ ID NO: 30541 - DNA, 101 bp, rice(Oryza sativa)
  misc_feature (71): n=t or g
atagcactcgcccgctatattcaccctagcccacaagcacaaatcttcggcgggtctctttatatgtcttntccagaaagaggaggagcacatacatttct

SEQ ID NO: 30542 - DNA, 101 bp, rice(Oryza sativa)
  misc_feature (71): n=t or c
aaaaattggtatggtagcaatccaaataggcccctagttacttggaggacattaatttttcgtcttccatnaggcttcaaggtgggacataactacacagc

SEQ ID NO: 30543 - DNA, 101 bp, rice(Oryza sativa)
  misc_feature (71): n=a or c
tcatatctaatatcctgatacttggtcttatacatatgagtatcatatctgatatctaatagtaccacgtntgatacccatgagtatcagatctgatacct

SEQ ID NO: 30544 - DNA, 101 bp, rice(Oryza sativa)
  misc_feature (71): n=t or c
ttgttatttatctcagttatgagattaggggtgtatatactcgtgtaacttttagctatatacttgaggcngggattctatccattatctaaaaatatata

SEQ ID NO: 30545 - DNA, 101 bp, rice(Oryza sativa)
  misc_feature (71): n=a or c
ggatggtgagatggtagatgctttcgatgcaagttgcagctttgcaaccagccttgatcctatctctttgnatgagatttgcttcggttgatttttttttt

SEQ ID NO: 30546 - DNA, 101 bp, rice(Oryza sativa)
  misc_feature (71): n=t or c
taaaagtttcagtgcaaagcctagctatttaaacaacaccaagtcagggtctcgtgccatcccaaaggacngtggtactgcagaaaagtgcatcacaacta

SEQ ID NO: 30547 - DNA, 101 bp, rice(Oryza sativa)
  misc_feature (71): n=a or g
tgttgaaacattgtgatcaattcgaggttccatcaatttttgtaagcatccagcggagcgaacagtcactnacgctctgttttttagctcgatgtcagtgg

SEQ ID NO: 30548 - DNA, 101 bp, rice(Oryza sativa)
  misc_feature (71): n=a or c
cataaaaaactaacttctaccttcctacctaccttcagcacgtaaaaattctttcaatactttttatctanctatcactcttactaattttttcaatggtt

SEQ ID NO: 30549 - DNA, 101 bp, rice(Oryza sativa)
  misc_feature (71): n=a or c
ataataagatcttcccagtacatcatttctacccagacaagaaatacgagtctctaattatggaccaagantattcactacgccggaccaggtcatctctg

SEQ ID NO: 30550 - DNA, 101 bp, rice(Oryza sativa)
  misc_feature (71): n=t or c
ttatgacgtgggatgagagttcaaggatgcttcccaattacatatttgtagctccacaattactacaatantataactgataaaatagaaaggcacgcgat

SEQ ID NO: 30551 - DNA, 101 bp, rice(Oryza sativa)
  misc_feature (71): n=a or c
aaggtctcatcttgtcgatagcctagcttggaagtgccataggaacctatctggaaaatcagccccggacnacccccgcgctcacacctcacccctccttc

SEQ ID NO: 30552 - DNA, 101 bp, rice(Oryza sativa)
  misc_feature (71): n=a or c
gttgtcccaatgtctaccttagagtccgcccatttcctaagcttgtaccgccagtatctcaaccctcttgntgtctagcccatatgaagaatttgatatgt

SEQ ID NO: 30553 - DNA, 101 bp, rice(Oryza sativa)
  misc_feature (71): n=t or c
tctgagcaggcaccgagtgtgggtgacgtggtgaaggtggccgtagtggcgacggcgcttcagaccaaggnggagatcctttcaacaagtcagctgctggt

SEQ ID NO: 30554 - DNA, 101 bp, rice(Oryza sativa)
  misc_feature (71): n=t or c
ctggagccgcttgttctcggcctttgtctctttaagggtgtgggcgaggccttccatttccaagctcttgnagccaagttcgtcgtccttggctcgaagac

SEQ ID NO: 30555 - DNA, 101 bp, rice(Oryza sativa)
  misc_feature (71): n=t or c
tcctatgggctagctcgcccccatgggctaggattttttttctgattccaaacgactgtccttgccaggcnaggctaggcccctgctagccttggatccaa

SEQ ID NO: 30556 - DNA, 101 bp, rice(Oryza sativa)
  misc_feature (71): n=a or g
tctcttgaatttgtgatgttggaacttggatgtgatgtttcttggctctatagttttagctgttgacaacnggtctttgggccgtttcttgtggcatttgg

SEQ ID NO: 30557 - DNA, 101 bp, rice(Oryza sativa)
  misc_feature (71): n=a or c
taattggttcacaatttgatgtgttaggttcacctctctgaactattatttattaaatcacaagtgaaacntttttgaaaacagagaaaaaatgggttatt

SEQ ID NO: 30558 - DNA, 101 bp, rice(Oryza sativa)
  misc_feature (71): n=a or g
aagctcagcaaaaccagtgctgcggcgccggtgaaccccaactggtaccgtggcatcgttggctgtttgcngtatctggtacatacgaggccggatatcgc

SEQ ID NO: 30559 - DNA, 101 bp, rice(Oryza sativa)
  misc_feature (71): n=a or g
ttgactcaattaatttctctatccaagtcagcagtgttctgtgagttaaaccctcatcatgtctttagctntaacaagattgatagtctgaactttagtca

SEQ ID NO: 30560 - DNA, 101 bp, rice(Oryza sativa)
  misc_feature (71): n=t or c
acagattgatatatttgtccaagttcttcaagctgatggtggtgagtgcactttcacatctttttagctcngatgtccaatctatatgccttggagattct

SEQ ID NO: 30561 - DNA, 101 bp, rice(Oryza sativa)
  misc_feature (71): n=t or c
cgcattggcgtttagacattaccgtagcatgtcacgtcaacgtaaagagtgtgttggagtccgtttggacntatgtgatacccaggacgtgtcaacgtata

SEQ ID NO: 30562 - DNA, 101 bp, rice(Oryza sativa)
  misc_feature (71): n=a or g
tgcataagtgtgaaagtttgccggcatgtcgttgccaatgtgctcaacgtggttgacatgctacagatgtngtttgtgatagtctattatgcaacaaagat

SEQ ID NO: 30563 - DNA, 101 bp, rice(Oryza sativa)
  misc_feature (71): n=a or c
aattaaaaggtgaaagggtttaaaagaaataaaaaaaagacattctcaggcacatgagctgtgccgcttcntgcgtctttgcgattcgtacgtgctctgcc

SEQ ID NO: 30564 - DNA, 101 bp, rice(Oryza sativa)
  misc_feature (71): n=t or g
ggctatacataattgatatgcatggtgtggaaaagagagacaatttgtaccttagaacaatcacctaaaanactatgaaaacaattgaggtaatgtgtcta

SEQ ID NO: 30565 - DNA, 101 bp, rice(Oryza sativa)
  misc_feature (71): n=t or c
aaaagagctaaaggcggcagctacttcctcatagacaagagaggcgatggccccacgtgaggaaaatcagncgggggaggcagagaggatggtggcaagga

SEQ ID NO: 30566 - DNA, 101 bp, rice(Oryza sativa)
  misc_feature (71): n=t or c
attatataaataagcttgttctttcatacgtcaggttatactagagtcaggaagaactatcattctcatanccaaatagacatgtcagagatgaatagtaa

SEQ ID NO: 30567 - DNA, 101 bp, rice(Oryza sativa)
  misc_feature (71): n=t or c
aagagcatctattgttttatgggagattaaagaatcttaaaggcgctgaattagagaaggtatagttatcntcacactcatctctttattttccttcactg

SEQ ID NO: 30568 - DNA, 101 bp, rice(Oryza sativa)
  misc_feature (71): n=t or c
gcatcagcgagtttgcgcgagaaacctctaaaatgattttttagggataggtagggagctcctgcaatttnagtatagaagaagagagttgatccagttta

SEQ ID NO: 30569 - DNA, 101 bp, rice(Oryza sativa)
  misc_feature (71): n=t or c
cgcgatgtattatttacagtcggtacctcgtaggtaccatatctagtacatctggtatcagacttaataantataggtaccatacttagtaactatggtat

SEQ ID NO: 30570 - DNA, 101 bp, rice(Oryza sativa)
  misc_feature (71): n=a or g
gagagaggttgggaatgggaatcatgcccaattctgggatgatgtgtggtgtggagcagtgcctctgaaantgttgtttcccaagttatatagcataagca

SEQ ID NO: 30571 - DNA, 101 bp, rice(Oryza sativa)
  misc_feature (71): n=a or c
attatgggtattcaagatttacaccatgacatttaaaagaactattctttgtgttatcgatgataaaatgntagtttttttttataaaaaagatgataatg

SEQ ID NO: 30572 - DNA, 101 bp, rice(Oryza sativa)
  misc_feature (71): n=a or g
atcctactgcctcaccgacgcctgcgcacgtcggcacctttgctgcttgctgccacatcatctgctaacancaggtacaatagcaaactataagtcggttt

SEQ ID NO: 30573 - DNA, 101 bp, rice(Oryza sativa)
  misc_feature (71): n=a or c
aactgcagtccgtctaatatgtttgcaaatactatggttgctcctcttaactaatctagcagaaatccagnagaaattgcatttgcatttgttcgaaaagt

SEQ ID NO: 30574 - DNA, 101 bp, rice(Oryza sativa)
  misc_feature (71): n=a or g
ctcctctgtttgcaggtgctactgcatacttcacgaggacaacgtcctgggagccatatttagcctgtggnaggatctgggcaccgcgacgtcatgggaag

SEQ ID NO: 30575 - DNA, 101 bp, rice(Oryza sativa)
  misc_feature (71): n=a or g
atgcccgcgggaacgacgacgatgagaaggctcacaaggcataccacaagagttacttcgagggtgtcccnttcaaggtgttgcacctgatgtatatttgt

SEQ ID NO: 30576 - DNA, 101 bp, rice(Oryza sativa)
  misc_feature (71): n=t or c
atgtaagcaaagcctgtgctatattttgctggatcatatgagctactcccatggagtagtatatttcaganttggagatgtcctagtctcccatgcttcca

SEQ ID NO: 30577 - DNA, 101 bp, rice(Oryza sativa)
  misc_feature (71): n=t or c
atttgatcatctatatccttatttaggtggtcatctaaaaaagattcccactctatattcttcttcactcnaatagatcatctatattacaccctctatat

SEQ ID NO: 30578 - DNA, 101 bp, rice(Oryza sativa)
  misc_feature (71): n=t or c
tggaatctggaaataatttggtatttaatggcttatggaatgaattaagttcaagtgattgagtactctcnctgtgatctctgttttcaaaacaatgattg

SEQ ID NO: 30579 - DNA, 101 bp, rice(Oryza sativa)
  misc_feature (71): n=a or g
tttaagtaagatgattttccaccatgctacttatcccccggtggacgtttgagtatcaatacatgttttgnggttgtggtcttgtgggggtattactgtat

SEQ ID NO: 30580 - DNA, 101 bp, rice(Oryza sativa)
  misc_feature (71): n=a or g
taaaccaatatagagtgagcaatttagtgcttcgaagctacgaacacaagttgtaatagtacatatctaantaacaagcatgcaacagaaagaacctttca

SEQ ID NO: 30581 - DNA, 101 bp, rice(Oryza sativa)
  misc_feature (71): n=t or c
tacttttaagagttttgttaagacgtttttttctaggtcccgactgtcaagctagccttattggtgcggtncaaccgacatgtatagtgtggttggaccga

SEQ ID NO: 30582 - DNA, 101 bp, rice(Oryza sativa)
  misc_feature (71): n=a or g
catcgctagattcatgtctggacaagcctccccacgattgcagctcgacgatgacacgacagataccaacnagtgcttttcggacctcgtcaacggcgtcc

SEQ ID NO: 30583 - DNA, 101 bp, rice(Oryza sativa)
  misc_feature (71): n=a or g
atacccaaaatttctaaaataatttgatatatggagatatattacatgcatcagtgtcgcctgccacaacncgaccagctggggactggggaaatcatagt

SEQ ID NO: 30584 - DNA, 101 bp, rice(Oryza sativa)
  misc_feature (71): n=a or g
actaaacaaatcctaaatagattgcgggtggaaaattggaaatggtgttagttgcgtggcatggcacggcngcattgggatgagcagcacgttggcacggg

SEQ ID NO: 30585 - DNA, 101 bp, rice(Oryza sativa)
  misc_feature (71): n=t or c
atagcgtgaatttgtcgcattttgataattgatatcaagttgagccagttggttgttggaatttttccgtnccaagtccaaggagtagctgacgacgacgc

SEQ ID NO: 30586 - DNA, 101 bp, rice(Oryza sativa)
  misc_feature (71): n=t or c
gtgtcatggtccctttgctgtccaagctcatcgagagcatggaacagccgaggttcaaggacctgaagaangacttgaagtccctcagggccgagctcgca

SEQ ID NO: 30587 - DNA, 101 bp, rice(Oryza sativa)
  misc_feature (71): n=t or c
ttcatcttatcatgttcgtttccgagcgagccaggagcatagcatctgaggttgttttcagattgctcaanccttggaaagatgtaatggagaagatacca

SEQ ID NO: 30588 - DNA, 101 bp, rice(Oryza sativa)
  misc_feature (71): n=t or c
cagtcagcggcgacgaggcggccggtcagtgaagaagtagacacctaataacggtggagtgaatatccaancgtgtaggcggaaacactagtcagtggcga

SEQ ID NO: 30589 - DNA, 101 bp, rice(Oryza sativa)
  misc_feature (71): n=a or g
agggggaggggtcgcgtggatggggccaatctttccccatgtggaataaagtgggatgaaacacctccccntcgagtgaagccggaggcgtttcaccagtc

SEQ ID NO: 30590 - DNA, 101 bp, rice(Oryza sativa)
  misc_feature (71): n=a or g
tgagtagatctttagtagtagtaaaaatgaagatggatccagtctatctgggtgtgtttttggggaaaagnaaacttttaggtgtcacatcggacgtttga

SEQ ID NO: 30591 - DNA, 101 bp, rice(Oryza sativa)
  misc_feature (71): n=a or g
tttgatcaatgtggcatgtgtgtatcatacatacatatgcagagaggtgcaggattgggtcagggccgcanaacgactggtacttcttcagccacaaggac

SEQ ID NO: 30592 - DNA, 101 bp, rice(Oryza sativa)
  misc_feature (71): n=a or c
agaaggcaatttcgttgatcgatcatatgtacacactctttgagaagatgatgtgaaatcttgaactaaanatctacaaaatttggacattttacacttga

SEQ ID NO: 30593 - DNA, 101 bp, rice(Oryza sativa)
  misc_feature (71): n=a or g
cacgtccttcgtcgtcgtgcacgccataaacagaatggcgaacagctcagcagtgggatcgaacccacacnttcgacacacccacgcaaaaacagctaact

SEQ ID NO: 30594 - DNA, 101 bp, rice(Oryza sativa)
  misc_feature (71): n=a or g
gacatgaagagcccattttggtggacattcatatgcatgttgcatagacgcatgatctatgctcggcttgncgagcgcgtgcgtgctcctctagatctctc

SEQ ID NO: 30595 - DNA, 101 bp, rice(Oryza sativa)
  misc_feature (71): n=a or c
acgaaattgaatttctgcaaggtgaatcctcagagagacccacatatattttattcacccagctaactccntctactttttttccttctctcatcgtcttc

SEQ ID NO: 30596 - DNA, 101 bp, rice(Oryza sativa)
  misc_feature (71): n=a or g
ttttttttatcgatgctaatcacagatcagccaccgtcggttcatttcctgaaatgctttagatttgtcgnttagtaggatatatcttacccgatattgaa

SEQ ID NO: 30597 - DNA, 101 bp, rice(Oryza sativa)
  misc_feature (71): n=a or g
atcgtccgtcgcctccttcggcaggttggaaatttagagaatcttttggggatgagctgaactactaagtncagtcgtagatattcgtgctcaacgtttga

SEQ ID NO: 30598 - DNA, 101 bp, rice(Oryza sativa)
  misc_feature (71): n=t or g
ttcggcttttcgccactaatcaggttgctgctgcatagctagaaagatccatattgttgacgatccctagnatgtttgacgaggactttgcctttttgtca

SEQ ID NO: 30599 - DNA, 101 bp, rice(Oryza sativa)
  misc_feature (71): n=a or g
gcatagaaaattactttataaataagagcctgccgtaatgtgtttggcagatgttcttcagctctgggggngaaacaagaggattgcaaacttcaggaaga

SEQ ID NO: 30600 - DNA, 101 bp, rice(Oryza sativa)
  misc_feature (71): n=a or g
tttgaagtcttttcattcacgagaccttggtggcctaattttacgaaagggctgaaattcttcgcagggcngcgcgcgcgaaggcgacgcaggacggggcc

SEQ ID NO: 30601 - DNA, 101 bp, rice(Oryza sativa)
  misc_feature (71): n=t or g
tggtcaaactaaagtatgcatgcgctttgtgccaagttgctgattgatctacccagttattgtacattttnctgcatataaatctatataagctgccagtt

SEQ ID NO: 30602 - DNA, 101 bp, rice(Oryza sativa)
  misc_feature (71): n=a or g
cgactgtcatgccctccctggcagcgaggcctatgatgcgactcatgacatggaaggaggcggcgctgtcnaggccgctggtgggttcgtcgaggaacagc

SEQ ID NO: 30603 - DNA, 101 bp, rice(Oryza sativa)
  misc_feature (71): n=t or c
caaaaccgtccaaaacagtgttcgggggattatttccggtataaatagttcaaggtaaacgatgtctggtnttttagtttaggagggtaattcggttgatt

SEQ ID NO: 30604 - DNA, 101 bp, rice(Oryza sativa)
  misc_feature (71): n=a or g
gaaggtgtgcaaacttgcaaactctcaatcaagaccacataatcaccatctgatgggtagggatagaggtnggctaattttgcacttaagcgcccaccatt

SEQ ID NO: 30605 - DNA, 101 bp, rice(Oryza sativa)
  misc_feature (71): n=a or g
aaggcactgtaacaacgacatataaatgtcaccttgcacaagactggattcaccagttaaatcctcggtcnaggaatccagaaaatttgatgcgggagaac

SEQ ID NO: 30606 - DNA, 101 bp, rice(Oryza sativa)
  misc_feature (71): n=t or g
tatctctcggcagacctacctaaactggctttacgtgtagcttacctttgatcattgttcgtgtttttttngtataaagtgtgcaataatctgactgcagc

SEQ ID NO: 30607 - DNA, 101 bp, rice(Oryza sativa)
  misc_feature (71): n=t or c
tatacagatttatccccttgttctaaacgcatctgtttcttgcataaatctctgtgaaaagatgaaggaanaaatttatcgtgcataactatcttaagttc

SEQ ID NO: 30608 - DNA, 101 bp, rice(Oryza sativa)
  misc_feature (71): n=a or c
gcagggaaggtccttttcaatttcttgtttgctccgattggttgtgattttctctagtcttgacccatatncttaagtacttttggggtagtactcctact

SEQ ID NO: 30609 - DNA, 101 bp, rice(Oryza sativa)
  misc_feature (71): n=t or c
aatcacgattagccattgttagctacctttaaataatcatcaatgatatataagtgaagcattagttatcncaaaagtgtgctaatgtttttcagcatagc

SEQ ID NO: 30610 - DNA, 101 bp, rice(Oryza sativa)
  misc_feature (71): n=a or g
atttctggactagagttagtttagttttacttttcctattcctatataaaaatagacattacaaaattgtnaaaagaaaaaactacaacaacaaaaagtta

SEQ ID NO: 30611 - DNA, 101 bp, rice(Oryza sativa)
  misc_feature (71): n=a or g
gctttaggtttttattacttgcgccgtccaatgtgttgttccgtggaaaaaaatgtttttttaacaacagncaaatatattactccctccgtattttaatg

SEQ ID NO: 30612 - DNA, 101 bp, rice(Oryza sativa)
  misc_feature (71): n=a or g
caattaaatatcattactaacatcgctgaaataccacagtaaacatgacctggctagctaataataagtcngacaagctctgagaaccgaacgaagtaaca

SEQ ID NO: 30613 - DNA, 101 bp, rice(Oryza sativa)
  misc_feature (71): n=a or g
cttccaattttaacgtgaactaagcacaccctaactcttgttggagtatccaagacagcctaactctgatnagttgggatcctctcctgtaatgcatgtgc

SEQ ID NO: 30614 - DNA, 101 bp, rice(Oryza sativa)
  misc_feature (71): n=a or c
ccaggaatatgcgaaggtagctcaacttgttagtttttttatggaatttctttaaacggcccacgcacctnatttcttttctcttttgtttttccagaaga

SEQ ID NO: 30615 - DNA, 101 bp, rice(Oryza sativa)
  misc_feature (71): n=t or c
aaattatgaattatattgatgaagtgtacaaatttatcacccaatcccttctatgctctcaagatttgctnattcccttccatatcgctaaattttagttt

SEQ ID NO: 30616 - DNA, 101 bp, rice(Oryza sativa)
  misc_feature (71): n=t or c
cggcggctgccttccgttcgatcccagcttgggctgcttttgctgatgcgctcacgttttccccaagttanccgcgcgcgcgcgcgaagtcgtcgcggtga

SEQ ID NO: 30617 - DNA, 101 bp, rice(Oryza sativa)
  misc_feature (71): n=t or c
tgtagccatggttcgttagctttctcctgtcgtcgtggtgatttggagctttaactcctaagagcatctcnaacagtctctccaagtgactctctaagttg

SEQ ID NO: 30618 - DNA, 101 bp, rice(Oryza sativa)
  misc_feature (71): n=t or c
cgaatgaggtgctaaagggtggcagcagcactggatagtatgatatgatgattaaatgcacgagggatctngtggtttctcaccttgatagcctccaggat

SEQ ID NO: 30619 - DNA, 101 bp, rice(Oryza sativa)
  misc_feature (71): n=t or c
caaaattcccacacaactacacatgatgattgttgagtagtcctactgttttaaatggacgctcacatagncccttgagctcatcttaggcctagttctga

SEQ ID NO: 30620 - DNA, 101 bp, rice(Oryza sativa)
  misc_feature (71): n=a or g
aatatcataaggttaaggctaacactacgtcagaacctgaatactgtaacacaattttgtaacacttgtanacatgtaaataaaacggaacgactcattag

SEQ ID NO: 30621 - DNA, 101 bp, rice(Oryza sativa)
  misc_feature (71): n=a or g
ctagaattattacttgatttattgcgcaattaatatgttatgacgtcagccgagcggataggtggcaccgncaaatggaacccacctgtcggtgactcaaa

SEQ ID NO: 30622 - DNA, 101 bp, rice(Oryza sativa)
  misc_feature (71): n=t or c
atggctgtggatgaggtggcgatgacgggagtgggttggtgaaggtggattagttgcttgacgatattttncttttttttttgtgtgtgttgctgaatggg

SEQ ID NO: 30623 - DNA, 101 bp, rice(Oryza sativa)
  misc_feature (71): n=a or g
caagcacggataataatactaaaaactttcttggtgctcctgatcggtgtcaacccaacgctcacggatantactgacaatactcatggtaacattgataa

SEQ ID NO: 30624 - DNA, 101 bp, rice(Oryza sativa)
  misc_feature (71): n=a or g
caactattattttttacaaatgcccctttttgtccggaaggtgttcatagatggagctatccactatgacncccttcaattacatggtcatcacagaacaa

SEQ ID NO: 30625 - DNA, 101 bp, rice(Oryza sativa)
  misc_feature (71): n=t or c
tataagccatagcaaaataacatccacatgtcagtgacttgcatctatagttaagttggaggatctgcttnccccataacatagatccccttataagttcc

SEQ ID NO: 30626 - DNA, 101 bp, rice(Oryza sativa)
  misc_feature (71): n=t or c
caattcgtttatttgtagtcgtgtcataaattttataaaattaagatcgcggtgcactagaggaggaaaancacgcggggacgaacactgtcgacgaggga

SEQ ID NO: 30627 - DNA, 101 bp, rice(Oryza sativa)
  misc_feature (71): n=t or c
ccgtcacagttgagagaggatcagcagaggacggattaagaaaatgacatgatcgatcacacgtagaaagntaggtggcagcagtacgtggtggagggagg

SEQ ID NO: 30628 - DNA, 101 bp, rice(Oryza sativa)
  misc_feature (71): n=t or c
gagcaggatctaaacaaggccaaaatgacagttttgtccctgggaacaaacattttttcccagtcagcttnccggtcagcttgtttgaccccatgattaac

SEQ ID NO: 30629 - DNA, 101 bp, rice(Oryza sativa)
  misc_feature (71): n=t or c
caaacactgggataatatttcttcaagtatttgtcatttagagctcggccataaacttttccatcgagtcnttgcaacatgtatgctcccttagacactac

SEQ ID NO: 30630 - DNA, 101 bp, rice(Oryza sativa)
  misc_feature (71): n=t or c
tttcagctaagtttactgaggtattgtgactgagagaaggtcagaagtttatactcccttccaaacaaaanttctacctacaaatccgacatatgatttct

SEQ ID NO: 30631 - DNA, 101 bp, rice(Oryza sativa)
  misc_feature (71): n=a or g
atcgtgctgaaaatcgctaaaaaaatcacacaaaaaaaagagaaaaatcgggaagtcgcaaaaaaaaaaangccacgtggccggtggaggggcgcgcgcca

SEQ ID NO: 30632 - DNA, 101 bp, rice(Oryza sativa)
  misc_feature (71): n=t or c
ataagggactatatgatggctagctgatgcccgtttccaccatattaaaaaaagccggaccggtaagtganccggccgacctcatggttgagcggtccgcc

SEQ ID NO: 30633 - DNA, 101 bp, rice(Oryza sativa)
  misc_feature (71): n=t or c
gggttttatttgttgtccatgcattaagtgcaagaaccagaaggattgtacagtaaggactattcatttcnacttgtttgagtaggggttcatgcctagct

SEQ ID NO: 30634 - DNA, 101 bp, rice(Oryza sativa)
  misc_feature (71): n=a or c
acagtagcccccgacttcaacttaaatgaattcatgttatcgcttgcgacttctcttgataacacgttgtngtactcgtgtcgtaggctctccggaccttc

SEQ ID NO: 30635 - DNA, 101 bp, rice(Oryza sativa)
  misc_feature (71): n=a or g
ctaggcttaattacgttggcaacaaataggatcatgaatcggagaggacgagttagcacatatgcatgccngaaattaaaccatctcgctgaaatgaattg

SEQ ID NO: 30636 - DNA, 101 bp, rice(Oryza sativa)
  misc_feature (71): n=a or g
ttactgggccattgtttgagtggatcagttttttggtccaaactcgagccccacagaaaaaaaaatcttcnacatttactctgactaaggacattcgtaaa

SEQ ID NO: 30637 - DNA, 101 bp, rice(Oryza sativa)
  misc_feature (71): n=t or c
gtgtgggtgcgtcatataataaaaaaatcgttagatactccagaaaagagtagcaactaactagggagcancaaggcatatttagtacttgcactagtaga

SEQ ID NO: 30638 - DNA, 101 bp, rice(Oryza sativa)
  misc_feature (71): n=a or g
tgcactccacctagtgccattcaaccacaagccatcattgtttgaacccctccaatgaatggtttaccccntcatgaactaggtttgcaacacaataacag

SEQ ID NO: 30639 - DNA, 101 bp, rice(Oryza sativa)
  misc_feature (71): n=a or g
aagtttttctagaaagctgtcaacctcagtaaacagagacgaagtcctctcagtaaggagcctgcagaagntgtaagatttaatcactgatgaagaaaaaa

SEQ ID NO: 30640 - DNA, 101 bp, rice(Oryza sativa)
  misc_feature (71): n=a or g
ggacgtgaaccttcaaattttgcattgcacttgttgctacatagagggcacctaaaaactccaaagctctntcctgaccacggtgctaccatgatagaaat

SEQ ID NO: 30641 - DNA, 101 bp, rice(Oryza sativa)
  misc_feature (71): n=a or g
tctggatcatgcatacttgcttatgcgagtcgactgtgtcgtgtcattggtgcatgcagcatccaaactcntgcaaacttaagttcatcagtaatttctag

SEQ ID NO: 30642 - DNA, 101 bp, rice(Oryza sativa)
  misc_feature (71): n=t or c
gtggttgctgtgtggaactctcgttttagtgttgtatccacatgtatgatgtactgtcatcatatcctctnttttttttctttttttcttgttctctttac

SEQ ID NO: 30643 - DNA, 101 bp, rice(Oryza sativa)
  misc_feature (71): n=t or c
cccagtttctccatattctcacgagctgaatttctaccaggtgttcctcaaacagacccttagtaagtgangtagaagaaaagagaatgctaatttagcta

SEQ ID NO: 30644 - DNA, 101 bp, rice(Oryza sativa)
  misc_feature (71): n=t or g
tttgaaaatggttctctttcatctaatgtgagatgcacgttcagatgcaggccaatgagatcttactatgntctgctgggtgcacgtccagtcacggagtg

SEQ ID NO: 30645 - DNA, 101 bp, rice(Oryza sativa)
  misc_feature (71): n=t or c
tataccatatgcatgtatacaagtttctggtcgaatcgttgcccgcataagcgccgggcatacgcgaccgnccgagttccaaacttttgtcttctcatctc

SEQ ID NO: 30646 - DNA, 101 bp, rice(Oryza sativa)
  misc_feature (71): n=a or g
atacctttacgaggatacattaacagtgttgtttgttgtccaggtggttctctattcctttataatcgccntgtgaatcggtattttcggagggatggcca

SEQ ID NO: 30647 - DNA, 101 bp, rice(Oryza sativa)
  misc_feature (71): n=a or g
gcaagttattaattattttttctttttgctaattctatgttgacggtttcaggcaaagccattactatcangtggggaaattaaacaattggttgatccat

SEQ ID NO: 30648 - DNA, 101 bp, rice(Oryza sativa)
  misc_feature (71): n=t or c
tttgctatgctgttgtttgaacgaggcagtgccgactcctgaatgagttaagcattacgcgagtttgatanggagaatttgtctgccgttggctatcaagg

SEQ ID NO: 30649 - DNA, 101 bp, rice(Oryza sativa)
  misc_feature (71): n=t or c
ccacacatcactatctgcatcggcatccatatctaccggatagctaaaaacccttaacatattctcacttngaacatatatatagcggactatatccgatc

SEQ ID NO: 30650 - DNA, 101 bp, rice(Oryza sativa)
  misc_feature (71): n=a or g
gttcacctcttgaatcatctatcagcactaactagctttttcataacgaaattcgaagtgatggcgttctncatggtaatactccctccgtccaaaaaaaa

SEQ ID NO: 30651 - DNA, 101 bp, rice(Oryza sativa)
  misc_feature (71): n=a or g
taataaacgtcaacatagcaaagcaatatatctaggcctgttcaaaatcgccaaaggcacaccccaaaatncatgtaaccaccaaggtaagtgcaagatca

SEQ ID NO: 30652 - DNA, 101 bp, rice(Oryza sativa)
  misc_feature (71): n=a or g
attaggcaggcatcttttaggtgctcttttgtttaggaaaagaaaaacactcgagtatgtgctaggacganaaatttgcgtaccaggtttcttttgtgcaa

SEQ ID NO: 30653 - DNA, 101 bp, rice(Oryza sativa)
  misc_feature (71): n=t or c
aaagctaggaatacctaattttaaaaaatcttgaattaagagcagtgtcaataagaccaaattaagaggcnagtaaccatcaagcaaatccagaagaaata

SEQ ID NO: 30654 - DNA, 101 bp, rice(Oryza sativa)
  misc_feature (71): n=a or g
ttaaactggagaagatcggttatggagaagcatcttgtggcattatgcggaccatggatgaaaaatatggntgacgaagggaagcattatcaatttttctc

SEQ ID NO: 30655 - DNA, 101 bp, rice(Oryza sativa)
  misc_feature (71): n=a or g
gttggatggctgggttgggtgttcgacgtatcaacgacgtatccataattgttttatttatctgaaaatcnatgagtcgctggatacgtacgggatacgta

SEQ ID NO: 30656 - DNA, 101 bp, rice(Oryza sativa)
  misc_feature (71): n=a or g
cgggaggtgttcgacgaaatgccagtgagggatgagatttcttggagcacgctggtgggcgggtatgtganggaagaggagctggaggtggcgctgggagt

SEQ ID NO: 30657 - DNA, 101 bp, rice(Oryza sativa)
  misc_feature (71): n=t or c
tggcatgatcagtaggcaacgaagaccatttaatcagaacttgcacatgtgcagcatttcctctttttttntaccaggcagcgatccaggatttcctcaga

SEQ ID NO: 30658 - DNA, 101 bp, rice(Oryza sativa)
  misc_feature (71): n=a or g
atccccttccctcgagttaccaaacaagccgagaaagaaaaagaggaatttgcaaaagaatgggaaaaagncagactctgggcagagtaaggatgtatttg

SEQ ID NO: 30659 - DNA, 101 bp, rice(Oryza sativa)
  misc_feature (71): n=t or g
tttattaaaaaaaatagttttcagtggcctaaaaatcggggcgttgtcattgaaatacaaaattgtccctnaaccaaaataccatatatatatatatatag

SEQ ID NO: 30660 - DNA, 101 bp, rice(Oryza sativa)
  misc_feature (71): n=t or c
ttcactagtaaagaaaatgtaagtgaggatgagactacgtaggacgataaacacagaggacaacgaagttnatgtccacctagcttgatttttttttaagg

SEQ ID NO: 30661 - DNA, 101 bp, rice(Oryza sativa)
  misc_feature (71): n=t or c
gagggcactgtctagcagagtgacccatcttgtcccaccggaaacactgtacggttgacagtcctggtggngacttgaaagaggtaacactgtttggcgca

SEQ ID NO: 30662 - DNA, 101 bp, rice(Oryza sativa)
  misc_feature (71): n=a or g
ttaggaaattaagtctttttacttgtgcccctctagttagggaaattagttcgcgaaaagtaattttttantgtcacatcggatgtttcatcggatgtcgg

SEQ ID NO: 30663 - DNA, 101 bp, rice(Oryza sativa)
  misc_feature (71): n=a or g
ttatgttgtgaatagcaacataggcgaagttaggcgtaggatggttatggcttgaaccccataatttcacntaaattatataaaaacactactcttctaaa

SEQ ID NO: 30664 - DNA, 101 bp, rice(Oryza sativa)
  misc_feature (71): n=t or c
ttagtatttcctagataacccaggaatccttatatatcgtaatggaggagtatttgggacaaccacatgtngataaaaaaaatattttaaatgatatcatt

SEQ ID NO: 30665 - DNA, 101 bp, rice(Oryza sativa)
  misc_feature (71): n=t or g
ctcatatgttgacctcgcatgcatggtgggaaaaaaaaaggagaagcattgatttttttcacttacatgtnggtcccgtacttttttttattttctctttg

SEQ ID NO: 30666 - DNA, 101 bp, rice(Oryza sativa)
  misc_feature (71): n=t or c
gatggttgccactactagatccgttgttgtttcctgcctccttctagatctcttgctcgtgttgcccttgnttccatccctcgactctatgggcaaagcac

SEQ ID NO: 30667 - DNA, 101 bp, rice(Oryza sativa)
  misc_feature (71): n=a or g
gacgcacgtgtgtcctcgaccccatggcgactccacgcgcggtccagtagctatagtagtactactagctnctccttctatctcctaaaataaagaatttt

SEQ ID NO: 30668 - DNA, 101 bp, rice(Oryza sativa)
  misc_feature (71): n=a or c
ttcctagtactgcatgctgctactaccactaatgctgatgtgtgttttgctgcttgcttagctgaaaactncactgtttttcttgtcttcatgctgaatcc

SEQ ID NO: 30669 - DNA, 101 bp, rice(Oryza sativa)
  misc_feature (71): n=t or g
ccttggggaatactaataatttgttgattgatatccggcaaggagagtgcaattctcttggcattctccanatatgttgcaaattttgtatgatttggctc

SEQ ID NO: 30670 - DNA, 101 bp, rice(Oryza sativa)
  misc_feature (71): n=a or g
tgctcattgatatgaaatttatgaatttatgtagtagcaaaagccagtgctcacacaccaagcatatcatncattgattgttagcttgtgagcatgctaac

SEQ ID NO: 30671 - DNA, 101 bp, rice(Oryza sativa)
  misc_feature (71): n=t or c
gataaaaagaacaaaggttgcttgttaaatatttgtcagccagcaaaaattgtcgtggtaaattggatggntaatagctacggatgcttcctccgtctttt

SEQ ID NO: 30672 - DNA, 101 bp, rice(Oryza sativa)
  misc_feature (71): n=a or g
gtaaatgcaatataatttatatttaacttttatgcaacaatccaaagcaagcactggtgcaaagtggctancgtagctagcgtttgagccgagcattgcaa

SEQ ID NO: 30673 - DNA, 101 bp, rice(Oryza sativa)
  misc_feature (71): n=a or c
cccgtgtagccgttgatgcccaggtaagggatgacgtagacggccaggaggaagttgaggctgttggcgtnggggtcgaagggcgggtctaggtggtagcc

SEQ ID NO: 30674 - DNA, 101 bp, rice(Oryza sativa)
  misc_feature (71): n=a or c
actggctagctacatgggtgccagattgcatgtttgatgagctcatgctcatgaacaacagaagaagatcntttggttgtccctcttagaacaggtacaat

SEQ ID NO: 30675 - DNA, 101 bp, rice(Oryza sativa)
  misc_feature (71): n=t or c
ggtcgtctactactccatgatccaatgtaacagaagcaagcaactgggacgcgcagtttggcacttttgcnatcatagggggtggttgatgggtcccgggg

SEQ ID NO: 30676 - DNA, 101 bp, rice(Oryza sativa)
  misc_feature (71): n=a or c
ctctctcaacccttgtgtgacaaactgtgatatcattgcactggtaatggttaggtgaatgaaatttaacntcaatgatttatcgaagcaccttcatagtt

SEQ ID NO: 30677 - DNA, 101 bp, rice(Oryza sativa)
  misc_feature (71): n=t or c
acctcaagcacaaaagcatgacactgcacactaaacgttggccttgtacatttcaaatgggatttaaggcnattcctaacccaatgactaggatggtgtct

SEQ ID NO: 30678 - DNA, 101 bp, rice(Oryza sativa)
  misc_feature (71): n=a or g
gaggtgctggtccaccgaaccagcgaggcgtcccgagttcaaacagatcgtgtccgtgctggagagctacnaccgctgcctccggcaaggcctgccaatgg

SEQ ID NO: 30679 - DNA, 101 bp, rice(Oryza sativa)
  misc_feature (71): n=a or c
acaaattaattactaccaattagacgacgctgactcaaaatttttttagtacacagtacaatacacgcacnctcacccctatgaatatatgcacgtaaacc

SEQ ID NO: 30680 - DNA, 101 bp, rice(Oryza sativa)
  misc_feature (71): n=a or g
atctaatttttattagagaaaaaaaaataaggcctaaagatacatccaacctatttcgatcgtttctcccngtgacttttttttttggaatgctaggggac

SEQ ID NO: 30681 - DNA, 101 bp, rice(Oryza sativa)
  misc_feature (71): n=a or c
tagcatatggacctatcatgcctgctagctctttgctgggcagcccacctcctgggtatatctccaatgcnacgccatctcatcaagcagctcacttcacc

SEQ ID NO: 30682 - DNA, 101 bp, rice(Oryza sativa)
  misc_feature (71): n=t or c
ctttcaaactcctacaaattgcctaaaacaaatcatttatctcgggttacaaccacacatctaaccctagncatcatcacacattcaaaatataggttcag

SEQ ID NO: 30683 - DNA, 101 bp, rice(Oryza sativa)
  misc_feature (71): n=t or c
cacaagtgtgagatatataccacccaaaatggatggaacatgcgaaagaacactgacataatattgcatanttcacacaaaaaggcctagttaccttacta

SEQ ID NO: 30684 - DNA, 101 bp, rice(Oryza sativa)
  misc_feature (71): n=t or c
ttagatgcactgccacaagggaggtgatggccatcttcttcaccggtgaagagatcaatggaggtggcggngatggcaatggaatagcgaaggttcagatg

SEQ ID NO: 30685 - DNA, 101 bp, rice(Oryza sativa)
  misc_feature (71): n=t or c
ttattattttgtatgtgtaactgacatgtaggttctatggttttaattacttttccaggttaaattgacangtaagtgctacgtcaatgccacgtgacacg

SEQ ID NO: 30686 - DNA, 101 bp, rice(Oryza sativa)
  misc_feature (71): n=t or c
cacctctcgctcgccgctcgtcgtctttgtcttcgtctccagcctgtgccggaggagacagagggaacganggcgatggggaaggggcggagcaggaggag

SEQ ID NO: 30687 - DNA, 101 bp, rice(Oryza sativa)
  misc_feature (71): n=a or g
ctttgaatttttctcctttgaggtagttggagacgctgaatttttggccctcttatgtgcgtgatcatgantaccatcctttgacgagtcctcatgatcct

SEQ ID NO: 30688 - DNA, 101 bp, rice(Oryza sativa)
  misc_feature (71): n=a or g
ttttataagagagagtacaaagcatccatttagaaaagatatgtatgttgagttagtcagaccaacaaagncgagaaagagataaaaatgaagagaaaaga

SEQ ID NO: 30689 - DNA, 101 bp, rice(Oryza sativa)
  misc_feature (71): n=t or c
tttggaaatggagtatctataaaaaaaaccgtcgaagtataattacattgtaacggcgtagaggcggacgnggtcgaggagaggcgggaggtggaggagca

SEQ ID NO: 30690 - DNA, 101 bp, rice(Oryza sativa)
  misc_feature (71): n=t or c
tttaggagatgagtgactcggtggagaaatgatctattactagcaggcattgtgcgatactagattttctntgtatccgtcgtgccgatttatggtgtgcg

SEQ ID NO: 30691 - DNA, 101 bp, rice(Oryza sativa)
  misc_feature (71): n=a or g
ctatcggctgatcttttcagagattggttcactaacttctatgatggcttcccaaggaattctagaatctngtttgcatatgaagggtttgcctgcttcga

SEQ ID NO: 30692 - DNA, 101 bp, rice(Oryza sativa)
  misc_feature (71): n=t or c
tctgttggcctaggctacctgcaatagctaactttaagttcttctcaattgaaccatttgggcaaaacgantgaatatttaacaactcctatgagacctta

SEQ ID NO: 30693 - DNA, 101 bp, rice(Oryza sativa)
  misc_feature (71): n=t or c
aaagaggggaagaggtggaggaagaagttatagattgggacttgtttttttttttctgaatatgatgccgngtcggataaatactggatcaacgtgccact

SEQ ID NO: 30694 - DNA, 101 bp, rice(Oryza sativa)
  misc_feature (71): n=t or c
actatatatatgagctaaatgcatgtgctttactatggtaaaaaaaaagtagaagtgtgttccccatcttngtgctatagggaatattaatcttaatctaa

SEQ ID NO: 30695 - DNA, 101 bp, rice(Oryza sativa)
  misc_feature (71): n=a or g
agggttatctccaatttggttaggaattagttctactgttcacaaaactaactctccgtctttaggaatcngatacgtgtgatttatcttccttatctagc

SEQ ID NO: 30696 - DNA, 101 bp, rice(Oryza sativa)
  misc_feature (71): n=t or g
tgaaacagcaagacaagcgaaggcctcttgggtagccccgcaaccgccttcgtgtcgatgcgaaaaacacncacggcctaggagatctgcgtagatctaat

SEQ ID NO: 30697 - DNA, 101 bp, rice(Oryza sativa)
  misc_feature (71): n=a or g
ggattccggagcctcattgctcaacctgagctagtaatttggtcgaacaggttgcgcgcatgcccagaaantcaacgaccaacaacgactaacctccccgc

SEQ ID NO: 30698 - DNA, 101 bp, rice(Oryza sativa)
  misc_feature (71): n=a or g
gacggcttatctctgttactgaaggagaaagtgatgaagggtgcaatttcccccgtgcatgtgtgtcgccntgccccaggcatatcacacttactatttgc

SEQ ID NO: 30699 - DNA, 101 bp, rice(Oryza sativa)
  misc_feature (71): n=a or g
ctgctgcttctagtggacgggtcaaagcagaggacgagtaccggagctacatggcatttgcacggagcctngccgactccttgggcggatgtctggataac

SEQ ID NO: 30700 - DNA, 101 bp, rice(Oryza sativa)
  misc_feature (71): n=t or c
ccagcataatgatatttgcaggagtatcaacatttctctggtactagagttgctcttgatgtggctgaaangccatcaaacctctttgagtacgtatgact

SEQ ID NO: 30701 - DNA, 101 bp, rice(Oryza sativa)
  misc_feature (71): n=a or g
gctcggaaggagagggcggcacccttcgcaacgccctataggtactcgttgaaataagagatgaaactacnttgttttttccaaaagcgataactcaatag

SEQ ID NO: 30702 - DNA, 101 bp, rice(Oryza sativa)
  misc_feature (71): n=a or g
gattaatgtaacctgtcatgaacgatgctgctttgcgttccctttcacataaccgtgaaaccgacaagggngaacaacttaattgccgctcttttcatgac

SEQ ID NO: 30703 - DNA, 101 bp, rice(Oryza sativa)
  misc_feature (71): n=a or c
tagtgtgggtggcagggccaaagcaatgcttctagtttgaacgcggtgttttgtgatggtgatccagcagnagggaaccgttaaagacgaagaagaatgcg

SEQ ID NO: 30704 - DNA, 101 bp, rice(Oryza sativa)
  misc_feature (71): n=a or g
gtagtacccgaaatatttatccccaacttataacaaactgagttaaattagatcctccgacagtatagatntctagtttcactgacgtggcaagttgatca

SEQ ID NO: 30705 - DNA, 101 bp, rice(Oryza sativa)
  misc_feature (71): n=t or c
cgtgctatgatagtctgatgtgaccatctgccttaattattctaggtcaattgtggccttttgccatttcntataatgtgaactcatgtttctttctcttg

SEQ ID NO: 30706 - DNA, 101 bp, rice(Oryza sativa)
  misc_feature (71): n=t or c
tattgagaggcccatcctttaccacgtgagaaatgcgcaaccgcagagggcctctgaaaggtgtatgtttnaatctacgccaacgcattttaaataggatc

SEQ ID NO: 30707 - DNA, 101 bp, rice(Oryza sativa)
  misc_feature (71): n=a or g
tgcctgtcatatgaggccacatccacttctaaaaaatcattgcctctacatactgactactgacaaccggnttgccattagtttcatcatgtatagtatgt

SEQ ID NO: 30708 - DNA, 101 bp, rice(Oryza sativa)
  misc_feature (71): n=t or c
attccattttcgtaaatcccgatgagagcaaacatacggcggcggcgatgatagtggtactaaacgtgacnaaaaatcgaaactctaaacgaactagacgc

SEQ ID NO: 30709 - DNA, 101 bp, rice(Oryza sativa)
  misc_feature (71): n=t or c
aattagcacttgtggataaaaaaaatcgcattcatatagtctctccatcacactctccaaactattcggcnggccaaactccttaactcgtcaaacttggc

SEQ ID NO: 30710 - DNA, 101 bp, rice(Oryza sativa)
  misc_feature (71): n=a or c
atagccatcgtattgggccggcccataaaccctgggctggaaatgttcgtatgggccacactaggcccaanttttgggcccatgaggcgatagaaaagcag

SEQ ID NO: 30711 - DNA, 101 bp, rice(Oryza sativa)
  misc_feature (71): n=a or g
gtggcatactgaagagctggtttatttacatgaagaccaaagtgcaaaaatcctctggttcattctaggcnaattaagggagaatgaaaaagctcatcaaa

SEQ ID NO: 30712 - DNA, 101 bp, rice(Oryza sativa)
  misc_feature (71): n=a or g
acaattcaacaatatctaaatgtgcatgctttgcatgctttgagatccacacaagcatatggatggtccanattgctggtgcatatgcacctaggttcata

SEQ ID NO: 30713 - DNA, 101 bp, rice(Oryza sativa)
  misc_feature (71): n=a or g
gcttttagaccatactgtcatcaatgcccattatcctaagaccattttttgtcatcaatgaaggaatttantccatctaaactgttgctttcattggtgtt

SEQ ID NO: 30714 - DNA, 101 bp, rice(Oryza sativa)
  misc_feature (71): n=a or g
cattgtgaaacggaggaagtaactttttaacccagagtcgattagtagcaatttatattttagtgaggccntttatgtaaattggacttacatatactccc

SEQ ID NO: 30715 - DNA, 101 bp, rice(Oryza sativa)
  misc_feature (71): n=t or g
cgggggaatgtttctgggagaggagcatatgtggacgacctgagtacctgaccagatgagtctgtgccganccaggtaaggggaacgttgtctaggccaat

SEQ ID NO: 30716 - DNA, 101 bp, rice(Oryza sativa)
  misc_feature (71): n=t or c
gattggaagtgcattttttccggatatgttctgttgccctggttaaagcgtcatttgctgtcgcaaactantagatgatgccctgtgctttctgcgggata

SEQ ID NO: 30717 - DNA, 101 bp, rice(Oryza sativa)
  misc_feature (71): n=a or g
agctctatccttagccgatttcaagaaagatgaactaatgctgccagcagccaactacttttggtccaatnctttcaatagttttttattcaatcatggac

SEQ ID NO: 30718 - DNA, 101 bp, rice(Oryza sativa)
  misc_feature (71): n=a or g
ctccctgacacagagaaggacatgttgtggaccaccatcttggagacattcacgatccctgatgcagatcntcccagatgcaaagaatggaccctgaagaa

SEQ ID NO: 30719 - DNA, 101 bp, rice(Oryza sativa)
  misc_feature (71): n=t or c
tgtagtatatctcagatcgatcggctagctagtgcgaggagaggtgaacggcaagggatcatcagaaggancgatatcgtaggttgttacgagttactatt

SEQ ID NO: 30720 - DNA, 101 bp, rice(Oryza sativa)
  misc_feature (71): n=t or g
tgtatctcaaactgcagtttaaactgctcgaacctagagatgggtttgtatcacttgacaactttcggacngtgagtttaccatattatttctgactacct

SEQ ID NO: 30721 - DNA, 101 bp, rice(Oryza sativa)
  misc_feature (71): n=t or c
cacgatccacacgttctccttccttgccaccaaagcctcatgatcttcatattctatatccgattcaccangcgccatgaagcaaacaccggagatgttct

SEQ ID NO: 30722 - DNA, 101 bp, rice(Oryza sativa)
  misc_feature (71): n=t or g
gtacttatgtaggactggacgagtttgagttttacaatttttggtacgtgccgaccgatcgagctgtccancagccatggacgtacttttttttatttgca

SEQ ID NO: 30723 - DNA, 101 bp, rice(Oryza sativa)
  misc_feature (71): n=t or c
ttctcacatttgactggctttataaccatggttcaggggcaaaatccttctcggggtgcgacagtgaaaanccctaccatcatctacgagagttagcaatt

SEQ ID NO: 30724 - DNA, 101 bp, rice(Oryza sativa)
  misc_feature (71): n=a or c
cacaagaatgtcttccccgttccaccatgtccagatataaaaaaaaatacacttttcgtgatggtctatcntgtcaaaaatcttgtcatatatcatcttct

SEQ ID NO: 30725 - DNA, 101 bp, rice(Oryza sativa)
  misc_feature (71): n=t or c
tggctaaaatcctcacaaattttttagaactaaaaaagtgtgacaaaataagtcaaaataatcaaccgtgnagttttgtgaaactttagaactacaatact

SEQ ID NO: 30726 - DNA, 101 bp, rice(Oryza sativa)
  misc_feature (71): n=t or c
ataaagtcgcaaggcggtttggatagtggtttagactgatgtggcacctatgtaacgttaatgtggattgntggccacactttgccacaactaacgttagg

SEQ ID NO: 30727 - DNA, 101 bp, rice(Oryza sativa)
  misc_feature (71): n=a or c
tgtgtttccaaaaaccaaactgaattctacagcaaaaggaaaccacgtttgcacaagcatgaggagccctncgcgtccgatctggcccgtgccgagcctgg

SEQ ID NO: 30728 - DNA, 101 bp, rice(Oryza sativa)
  misc_feature (71): n=t or c
cagaccggccttggtcacacagcaagcacaacaggaaaatgagacaaagccaaatctaaatgcataataanctaatgtggcaatttaaatcatctctttgc

SEQ ID NO: 30729 - DNA, 101 bp, rice(Oryza sativa)
  misc_feature (71): n=a or g
gtttacactatttgtatcctcagacctgcctggtttgctattatgcaccaccattgggccccctttaagantctttgcctgagcagctggtatatgtgcag

SEQ ID NO: 30730 - DNA, 101 bp, rice(Oryza sativa)
  misc_feature (71): n=a or g
ggatccgtggcggccggcgacatcctgggccggggagggtttctcggatccggttcttgctaatccgatcngaatccgagcggatggggtcagcgatggat

SEQ ID NO: 30731 - DNA, 101 bp, rice(Oryza sativa)
  misc_feature (71): n=t or c
gtggctccgcccctgcttaagagaagccatccccatcacgccgttgcccatcgggggaactcagctccctngcggagtcgcggtccgaagcttgcaatgca

SEQ ID NO: 30732 - DNA, 101 bp, rice(Oryza sativa)
  misc_feature (71): n=t or c
gggtggaggtaggaaagatcaagtggctgcaccacagtatagattttggtaatacatactcccttcgtccnagaatataagaagttttagggttggacacg

SEQ ID NO: 30733 - DNA, 101 bp, rice(Oryza sativa)
  misc_feature (71): n=a or g
taagtgataaaagaaggtgagatcagtatcaaaacccaccccgggcaatctagccactatctcaagttaantgttaaaagaagttctcgaatttttctaat

SEQ ID NO: 30734 - DNA, 101 bp, rice(Oryza sativa)
  misc_feature (71): n=t or c
accgttggatcatttgcgtgtataccaatcacatgtcaggagaattctagatgagaaggtcccatgcatangcagatactttcatatgatagtcaaagcaa

SEQ ID NO: 30735 - DNA, 101 bp, rice(Oryza sativa)
  misc_feature (71): n=a or g
tgtctgaagtcgttgaaaaattttaaaatttcgtttatccaaatagagccaacacttctaacatatattcnggcatataaatgacttacaatgaaaatatt

SEQ ID NO: 30736 - DNA, 101 bp, rice(Oryza sativa)
  misc_feature (71): n=a or g
agagagcgataaggttgacttataggataaggccgatgcatcggcctggatcggctctgcaacttggctcngtttggataggtgccgattttttttaaaaa

SEQ ID NO: 30737 - DNA, 101 bp, rice(Oryza sativa)
  misc_feature (71): n=t or g
cacgaaagctacccttcccaggtacttttttcttgaatgacttgggaccaccagaattcctgaaggaactnaagtggagagtttaaaaccacagatgggca

SEQ ID NO: 30738 - DNA, 101 bp, rice(Oryza sativa)
  misc_feature (71): n=a or c
gggaggtgcagagagaaacttatctcacacttatatttcctttacatgtacgcataagagaagcaagctgnaggcataataatattctgtatatatgaagc

SEQ ID NO: 30739 - DNA, 101 bp, rice(Oryza sativa)
  misc_feature (71): n=a or g
gcatcgctacgttgacctagtttggcacgacgtacacattggtccgaaccaagagaacacgtgtaagatgnaaaaaaaaatcaagcagtggaattttgcgt

SEQ ID NO: 30740 - DNA, 101 bp, rice(Oryza sativa)
  misc_feature (71): n=t or c
cgcaaccattctccttctgtcctcttcccactgtgcgcagtcgcctgctccttcatgtgtgcgtaaccacngtagcatccagtattttatccttaatccat

SEQ ID NO: 30741 - DNA, 101 bp, rice(Oryza sativa)
  misc_feature (71): n=t or g
catagagagcagtacagattagtacgtgtctgcgaatacagcctaaatttatcaggattcaggaagaaaangtttggaatttgcaaaggatttgtagagct

SEQ ID NO: 30742 - DNA, 101 bp, rice(Oryza sativa)
  misc_feature (71): n=t or g
tattaggtaaaatcggctgaaactccgatactatccttattatgattaagtgcaggctagtttctagggtncaggctagtttctagggttcaaaacaggac

SEQ ID NO: 30743 - DNA, 101 bp, rice(Oryza sativa)
  misc_feature (71): n=a or g
aatgtgtatacgtatacagctagctagctgggcatttttgtatagtattaagggggaccaaagtgtacctncacactatttgtttaactgtataccagaaa

SEQ ID NO: 30744 - DNA, 101 bp, rice(Oryza sativa)
  misc_feature (71): n=t or c
tatactaatttaaataaaaatcgataaccggatgttttaattttattctcatattttcctgaaatttttcnaatttattaaagtgcatttttacaacttaa

SEQ ID NO: 30745 - DNA, 101 bp, rice(Oryza sativa)
  misc_feature (71): n=t or c
ctgaaagttctgaaaaagaaaaaaagaaactcacctgtgttctttctgcagctgcaatcggcgctgacggnggaggggacggcgaagaggaggagctttgt

SEQ ID NO: 30746 - DNA, 101 bp, rice(Oryza sativa)
  misc_feature (71): n=a or g
tgcatgcactgttaatatgatgctccgtttaacgtttcaggtcaggtttagtagatcagaagagaaaactnggtgacatcacagaaaatattgaaagaact

SEQ ID NO: 30747 - DNA, 101 bp, rice(Oryza sativa)
  misc_feature (71): n=t or g
aaatattccttgctcagattacaacatgttcttgctactataccaacaacgcaaaatctaaaccgagagcnctctcgatttagtgttaaagagcgacgcac

SEQ ID NO: 30748 - DNA, 101 bp, rice(Oryza sativa)
  misc_feature (71): n=t or c
gcagtggtaggtcgacattggttaggtcgcagacggatccggccctccacactaaaatctggccatgcagngacggctgctccggtgggtgtgccgatgct

SEQ ID NO: 30749 - DNA, 101 bp, rice(Oryza sativa)
  misc_feature (71): n=t or c
agcgcgttactactagccaccgagaagttatacaatgtggtggtgacagtgtgtgaccgcaccggattccngtgtcggtcgagcaagctgaatgtaacttg

SEQ ID NO: 30750 - DNA, 101 bp, rice(Oryza sativa)
  misc_feature (71): n=t or c
aatgttaaagcgggatgagcctcttttgaaatgctggtgtaagccatatttaaaatgaaggtaaattgtantggtgataaataaatttattagataatacg

SEQ ID NO: 30751 - DNA, 101 bp, rice(Oryza sativa)
  misc_feature (71): n=t or c
ttatgctgatcaacataattaattgatgaagcaaagggtaagtaaacgttctacaccgtaccgttatttcntgtctatgcttccttgaagaccacatattg

SEQ ID NO: 30752 - DNA, 101 bp, rice(Oryza sativa)
  misc_feature (71): n=a or c
ccaacgcaataagtgaacaaacaggtcggtgtgctctggttgttcaaaatggcgcacaacttcaagctcgngtgcaagatgtatattcactgctacaaaat

SEQ ID NO: 30753 - DNA, 101 bp, rice(Oryza sativa)
  misc_feature (71): n=a or c
aattatgatataatatctctacatatcctccaatttaatgaccggttgtacaaatggaatggacggcttcnatgatggacttctgcacattggcccttcag

SEQ ID NO: 30754 - DNA, 101 bp, rice(Oryza sativa)
  misc_feature (71): n=t or c
cccctgtcacacaccttttaatggacgaagacttaaggacgtgcgtgtatcggggacacaatcttgggcgngtccggtgtagtcatgcatactccgattag

SEQ ID NO: 30755 - DNA, 101 bp, rice(Oryza sativa)
  misc_feature (71): n=t or c
tcatgttagtcagccacacatgcttagcccttgtttgttttgcttccatagtttagtctgccaaagaaagntagacagcttcttgctgctttgccacatat

SEQ ID NO: 30756 - DNA, 101 bp, rice(Oryza sativa)
  misc_feature (71): n=a or c
tgacatagctgcaaacaaacttgtagagtcacgagtcagaacaccaaaggccccaacaagttacaagcttntttatatagaaagggatagcactaaatttt

SEQ ID NO: 30757 - DNA, 101 bp, rice(Oryza sativa)
  misc_feature (71): n=a or g
cgaggacgctagttttgagtaatatattttccccttccccgcaaaaaaaagggagaggagaagagaaaaanaaaaggtgcatgtgagcggagaggaggaga

SEQ ID NO: 30758 - DNA, 101 bp, rice(Oryza sativa)
  misc_feature (71): n=a or c
aaaaaattaatttggcgaaacacacatctaaaactttaatgaatccttaataaaaaccaacacacgtctcnatgtcaaaaaaaaaagaaagaaagaaagaa

SEQ ID NO: 30759 - DNA, 101 bp, rice(Oryza sativa)
  misc_feature (71): n=t or g
gtcatgctgttgcacgaccacgacacatccggccacttgtacgccgcacatatccatatatctatccatcnaccggcggcgacgtcgatcagtacgtagcg

SEQ ID NO: 30760 - DNA, 101 bp, rice(Oryza sativa)
  misc_feature (71): n=t or c
ccaagaagaaaatctatgtacacgcattagagtgacaccaaaactcaaaagtaaatggaaaatacataggntgtgtttagttcgtgtgccaaaatttttct

SEQ ID NO: 30761 - DNA, 101 bp, rice(Oryza sativa)
  misc_feature (71): n=t or c
attattatttttttttgtgtaactgacatgcatgccgatggtttttattattttttcggggatagaattgncacgtaagcgccacgtcaatgccacgtgag

SEQ ID NO: 30762 - DNA, 101 bp, rice(Oryza sativa)
  misc_feature (71): n=t or c
aattatttctgagtggttggttgacgttgcaactagggtctactttatagaccgccaggaaatggcagtantaccacaaagaaatacaaacccagtctggg

SEQ ID NO: 30763 - DNA, 101 bp, rice(Oryza sativa)
  misc_feature (71): n=t or c
gagagatgtactcatggaggagcttggcatcaagatgttcagtggtggggaggattgacattctggagccntgaggagaccatgtaggccattcgatgcag

SEQ ID NO: 30764 - DNA, 101 bp, rice(Oryza sativa)
  misc_feature (71): n=t or g
acaacaaaaatttgtgagatgtgtgtggcgagagagtattttccctctctctcagtattgcattcttaaanattcttaaaaactgtcacaaacaataatca

SEQ ID NO: 30765 - DNA, 101 bp, rice(Oryza sativa)
  misc_feature (71): n=t or c
tacgtaagggtttccaactctttttaaggttctatgtacatatgggttgggaactaatccttcacacatgngaaacagaataatttatcatgattaattaa

SEQ ID NO: 30766 - DNA, 101 bp, rice(Oryza sativa)
  misc_feature (71): n=a or c
aaaattgtgagtctctttgtaatgttaattgcctcaatcaataccaagcagactttattaagaaaatacantctatttataaaatcctttattttaaagga

SEQ ID NO: 30767 - DNA, 101 bp, rice(Oryza sativa)
  misc_feature (71): n=t or c
ttcattctattattctttggaatctggtcggtgtgaactggagctgctcgaatgagccgatgcatcaagcngactttgtttttttcattcttgcaacacta

SEQ ID NO: 30768 - DNA, 101 bp, rice(Oryza sativa)
  misc_feature (71): n=a or g
cgagtcaattcatacacatcctcaattttcctacaaactatatttttttattttagattacacggcagacncataaacacacacaccactacacatgcgac

SEQ ID NO: 30769 - DNA, 101 bp, rice(Oryza sativa)
  misc_feature (71): n=t or c
gatagcaaggaaatgaggggagtacaatgcgtttatggagtacagagaaaggactagggattatagcatgngctcaccttgctttgtcgtcgtcagagctt

SEQ ID NO: 30770 - DNA, 101 bp, rice(Oryza sativa)
  misc_feature (71): n=t or c
ggaagaccaaatgtgtgaagaaaattaaggtttttatgtggttgcttttgtgggacatgctaaataccaangacatgttggataggaggcattgtgctcct

SEQ ID NO: 30771 - DNA, 101 bp, rice(Oryza sativa)
  misc_feature (71): n=a or g
ccaccacgtgtgagcgccgccgtcatcgaccaatccatggacagagctccacttttctccacccaaaaccnagctctctctctctctcttctcatgccgtg

SEQ ID NO: 30772 - DNA, 101 bp, rice(Oryza sativa)
  misc_feature (71): n=a or g
cacatggaaggtgacgtggatttcatagtagaggccacaatttatttatggggaagctcttatgtgttagngcacccacaatggttatctataggctctct

SEQ ID NO: 30773 - DNA, 101 bp, rice(Oryza sativa)
  misc_feature (71): n=t or c
gattacatgactagtagttcatccaactagaagccctgcagctatcttatctcggtgcctcgttggctggncgcgtcgtcgtcgtcgtctccgccttgtca

SEQ ID NO: 30774 - DNA, 101 bp, rice(Oryza sativa)
  misc_feature (71): n=a or g
aaactgaggtttgattgagacggcaccgttagaactaacataacatacccataacataccctgttggcctnttgaaaccactagggtaacataacctctag

SEQ ID NO: 30775 - DNA, 101 bp, rice(Oryza sativa)
  misc_feature (71): n=a or g
aggtgttataccagtgttgtgcctgggacagccactgtgaccacttatgaggagctgcatgtactgtacancgaatgaatgcctcaagacactgatttaat

SEQ ID NO: 30776 - DNA, 101 bp, rice(Oryza sativa)
  misc_feature (71): n=a or g
agaagttttcatcgagtggtttagaagttagggtttccagtgtcacatatgtgcgtctctctccccacctnaccgagccgactcccaccctccacgtccga

SEQ ID NO: 30777 - DNA, 101 bp, rice(Oryza sativa)
  misc_feature (71): n=t or c
aacaaagaatagttcaaccagtcaggttgtaattggacagtagacatggtgcactttgttggcttcaattnttttatgttcatctaaggccgtgtttagtt

SEQ ID NO: 30778 - DNA, 101 bp, rice(Oryza sativa)
  misc_feature (71): n=a or g
gcctgctgtattaattaatttgcacttgcacacaggcagtgtttgtaatccttggctgtgtttagttcctnaaattcaagagaagttttgagaaagttggt

SEQ ID NO: 30779 - DNA, 101 bp, rice(Oryza sativa)
  misc_feature (71): n=a or g
taatttgtcgtgatttatacacaaaatagtttgaaaatttgattaaatttctaggcgtgatagcataacgncaactagatcgtcagatcaatacaacaccc

SEQ ID NO: 30780 - DNA, 101 bp, rice(Oryza sativa)
  misc_feature (71): n=t or c
gtatgcttcaatacatactgttcgtgaccacaagtggggctgaaacatagacctgtgagctagattcttancattgttatctacaaactcatgtacatttg

SEQ ID NO: 30781 - DNA, 101 bp, rice(Oryza sativa)
  misc_feature (71): n=t or c
cgatgtaagtagctaatgtatacatctgcccgtctcgtaacagacgtcacgtaattcttatatttttaganaaggtaatagctaatgtacctgtcccataa

SEQ ID NO: 30782 - DNA, 101 bp, rice(Oryza sativa)
  misc_feature (71): n=a or g
gaatccaattagacctttgagaggtgtttatctccttttcaatctttgtttgagaggtgtttataatacantaatatgtgtattcctaaaaaaaatggctg

SEQ ID NO: 30783 - DNA, 101 bp, rice(Oryza sativa)
  misc_feature (71): n=a or g
gggtttgtcctcaagctcaatgaaaaggaagttgtgtcatctgctactttcttctccgatgagctacaccncaactgcgatgatctcctttctcgttccag

SEQ ID NO: 30784 - DNA, 101 bp, rice(Oryza sativa)
  misc_feature (71): n=a or c
caggagctctggcaagtggcaaacccgaagagccttatgttgtatcatgtgttaattatatatgaggatcngtcctgtacttccaagttattttcttttag

SEQ ID NO: 30785 - DNA, 101 bp, rice(Oryza sativa)
  misc_feature (71): n=t or c
ttctcttctctagctgatgtcactattcgtagcaaacttggaggttatctaatggaagcagccaatagaangagttgttctggtgctttatttagtcgata

SEQ ID NO: 30786 - DNA, 101 bp, rice(Oryza sativa)
  misc_feature (71): n=a or g
gtgtgacagcctcgagccccaatcgacttcggattaccgttaattaccaaatccgaatccggatgcattantcaccttcggattttcgaaactgccagcac

SEQ ID NO: 30787 - DNA, 101 bp, rice(Oryza sativa)
  misc_feature (71): n=t or c
ttgtgtctcttttttttcttttcttttaactattttttcttatgtaaaattttctcaagacgacccagttntagaaaaatatacattagtctctagattta

SEQ ID NO: 30788 - DNA, 101 bp, rice(Oryza sativa)
  misc_feature (71): n=t or c
aggtggtgggatgcggtgggatcaagaggagtaggggtttgggaggtggaagaggaggctgagttctttcnccaactttcccaactcacatatctcgtttt

SEQ ID NO: 30789 - DNA, 101 bp, rice(Oryza sativa)
  misc_feature (71): n=a or c
atgatggaggcaacgacccatagaagcagtggctgatcttggggattcagggattttttttgtatggattntgtcttcttatatgttggtttcttctatct

SEQ ID NO: 30790 - DNA, 101 bp, rice(Oryza sativa)
  misc_feature (71): n=t or c
ttctaatttttgtgtgaactaaacacagccgatattcatcgatcgatcgatcgtcttctgactcacttgtnactgctcatcaccgagttaccaacgcctat

SEQ ID NO: 30791 - DNA, 101 bp, rice(Oryza sativa)
  misc_feature (71): n=t or g
tcctcaacttctaaaactggtgcaaattacgttcctcggtagtattatgggtgattttagatgacttggcntctacatgtcctgtttgacttgatcttcgt

SEQ ID NO: 30792 - DNA, 101 bp, rice(Oryza sativa)
  misc_feature (71): n=t or c
caattttatagatcctaatgactgataaagagggtggcagtgtctaggcaataggccgggagtacaatgangacatttgatgagacttctaaaacccattg

SEQ ID NO: 30793 - DNA, 101 bp, rice(Oryza sativa)
  misc_feature (71): n=t or c
ggtttgcatgcacctacacatgttcgtgtactggaatgagagttttatgagtttttttactagatcgcatngttttttgtaccgctagcgaaattcactta

SEQ ID NO: 30794 - DNA, 101 bp, rice(Oryza sativa)
  misc_feature (71): n=t or c
tcagtgtacattctgatgagtatcagaaacctctcatgaattgaggtgataagtaatagatgtttgtcttncgttcaaaaaaaatagatgtttgtcttaac

SEQ ID NO: 30795 - DNA, 101 bp, rice(Oryza sativa)
  misc_feature (71): n=t or c
gggagaatgacaaacatacctccactccttgcattttaaaatggctatggcttaccgaaattttgacaatntgacctttttagaaaaacttatttgaagaa

SEQ ID NO: 30796 - DNA, 101 bp, rice(Oryza sativa)
  misc_feature (71): n=a or c
atagctgttgagttttcacgatttatagacccacagctagctagctagcagcaggcatgttacgtactccntccgtcccataaaaaaccaacctaatacta

SEQ ID NO: 30797 - DNA, 101 bp, rice(Oryza sativa)
  misc_feature (71): n=a or g
aaaagaaaaacgggaagaggaaccgttcttggcgacgccactgcctggaaagtcctccatgcgcggaacancgtcgcccatccatccgccaccgctgcgcg

SEQ ID NO: 30798 - DNA, 101 bp, rice(Oryza sativa)
  misc_feature (71): n=t or c
gccaacccaaatttttcggaatgcttcccaagacctgtgaggcgtttcacacattctaagaaagttggatnttagaattcctttgtttttacttacagggc

SEQ ID NO: 30799 - DNA, 101 bp, rice(Oryza sativa)
  misc_feature (71): n=a or g
tgagcgcgtttgagctcaggtcaaggtatgtgcaagtggagagcctccgcagcgactccggcaggttgccngagatgttgttggagccgaggtccactgac

SEQ ID NO: 30800 - DNA, 101 bp, rice(Oryza sativa)
  misc_feature (71): n=a or g
tgaatctcctcaatctttctttctcctgcaaccattcacattactggtgatatccgaggatgctggtgaancattaatttacatcggaggccggctgggga

SEQ ID NO: 30801 - DNA, 101 bp, rice(Oryza sativa)
  misc_feature (71): n=a or g
cagataaaaaacggacgcgaatctcttataccgaattcagggcgacttctcgaacggttagccccgacacntggcacttccggattcctggatttgattca

SEQ ID NO: 30802 - DNA, 101 bp, rice(Oryza sativa)
  misc_feature (71): n=t or c
caaaatagttgcgcttagtgttgtctgacaaaaaaattaagcatgtggtgtgatattctcaagttgtaagnatttcagtttctgtttatagcatatgtgaa

SEQ ID NO: 30803 - DNA, 101 bp, rice(Oryza sativa)
  misc_feature (71): n=t or g
tgtttagacaaaataaaggaggaatttcctcacaattatcgcccctacccacgtattaaaaagtagggagntcctccctcaattctccattccccatccca

SEQ ID NO: 30804 - DNA, 101 bp, rice(Oryza sativa)
  misc_feature (71): n=t or c
tagtaaaaaaattagtggggtcttcatgggggctcttaaagccttcacgccagtagtgaggcctcagagancccgccgcctccatgctggatccgctctac

SEQ ID NO: 30805 - DNA, 101 bp, rice(Oryza sativa)
  misc_feature (71): n=a or g
acctttggtttggcaagggtggacggtttggaccatgaattcttccacttcggaattcatgggttacatcncaacttttatgtggtataaaagccgtgaga

SEQ ID NO: 30806 - DNA, 101 bp, rice(Oryza sativa)
  misc_feature (71): n=a or g
gccacacctacttattatgctaaagtattgcgagccacgcattttgctaacaaattgttgatcacactttngataagagttgttaaaattataagtattac

SEQ ID NO: 30807 - DNA, 101 bp, rice(Oryza sativa)
  misc_feature (71): n=a or g
ttgcagtgtattgaaaatatcccacattcctacccctatcaaagccgtacatgtgtatgggtacactgttngagaaagggttttcacctacggttcgtaac

SEQ ID NO: 30808 - DNA, 101 bp, rice(Oryza sativa)
  misc_feature (71): n=a or g
cgtagcgtagagcatcgtatgggcttccaatttggactcctcgggatgatgccacgtccatgaatcaccangccatgtatggacgcaccagtgcttgtggg

SEQ ID NO: 30809 - DNA, 101 bp, rice(Oryza sativa)
  misc_feature (71): n=a or g
gcccccacgccgcgtcgtcagcgaaggagaagctcaacgtgcctgaggaactcaacggcagcgaaggagangctgtcgaggagggagcccggacggaggac

SEQ ID NO: 30810 - DNA, 101 bp, rice(Oryza sativa)
  misc_feature (71): n=t or g
caacgagagaaatgaaacaggttggattggtccatcaatttttgaggtatgaagctaacctggatctagangaatcatttttttaaagcgatcattctatc

SEQ ID NO: 30811 - DNA, 101 bp, rice(Oryza sativa)
  misc_feature (71): n=t or c
taacaaaaggtttaaaccacccgcatttcgcctatgttgatgtatgcaaatatcagggtaatgagtgtttngctatggactgaatttctctctctcttaca

SEQ ID NO: 30812 - DNA, 101 bp, rice(Oryza sativa)
  misc_feature (71): n=t or g
gctaaccgctaaatgtcttattccgctatttaaaacattgaaatacgtggtacggcgatattgtgatatgncatattttcaaaaatatatgaggatagaca

SEQ ID NO: 30813 - DNA, 101 bp, rice(Oryza sativa)
  misc_feature (71): n=t or c
atctccggcaatgtggtcaccatgtacagattcgcaagagtatcctctacattttagtttttggttgcgtnggccgaagagcagcacacgtcgcgccgcca

SEQ ID NO: 30814 - DNA, 101 bp, rice(Oryza sativa)
  misc_feature (71): n=a or g
gattatcatgagatgagttatctaagggtcgacaactcgacctagattctgctgaagcatctaggctcccntagttaattttggtaattaatgacaagcgc

SEQ ID NO: 30815 - DNA, 101 bp, rice(Oryza sativa)
  misc_feature (71): n=t or c
cccgaacatcgtcttctttgttccggccggggtcaccaccgtcttcaaattcacggtggaaaaaatatggngccaaagagttcagcgctagattcaaaccc

SEQ ID NO: 30816 - DNA, 101 bp, rice(Oryza sativa)
  misc_feature (71): n=t or g
atgtcgcaatgattcccaatcaaataatgcctccatatctttaatgcatgaactacagccgccaattccangtcatgagtagggtaattctcctcatgggg

SEQ ID NO: 30817 - DNA, 101 bp, rice(Oryza sativa)
  misc_feature (71): n=t or c
aaaagatccactatcctttatttttaacatatttacaacaaaatgccagtgaactaccctacctaacccanctcacccctcaggccctcatcccatactct

SEQ ID NO: 30818 - DNA, 101 bp, rice(Oryza sativa)
  misc_feature (71): n=t or c
aaaaactttggaacttgcttaagaagcaaggctctattttgtactcttaaatcaatgacccctagaccccntttcttcttaggcctacaaacctttcccca

SEQ ID NO: 30819 - DNA, 101 bp, rice(Oryza sativa)
  misc_feature (71): n=a or g
acaacttttacatcttatgctactaaacgacatgtaggtgacaatagtatgcttaggccacgtaaaagttncacttttgtgataatttcccacgcaatctt

SEQ ID NO: 30820 - DNA, 101 bp, rice(Oryza sativa)
  misc_feature (71): n=t or c
cgccgttcgcacttccataccaacaattgagctggcctgctcaacaaggggatatggtcaagccgggggcngaaaagggtttgcccctcagctgaggaatc

SEQ ID NO: 30821 - DNA, 101 bp, rice(Oryza sativa)
  misc_feature (71): n=a or g
gaagagagcgcggagtcaatcaccctagagttacgttcctttcatagctgccacaagaccaggaggaccanggagtcgaaactggaacggaggtgatcagg

SEQ ID NO: 30822 - DNA, 101 bp, rice(Oryza sativa)
  misc_feature (71): n=a or g
tctacatgtcaagaataatagggagataactagtgagggagcttcattacatgtggggcccacatgtcatngccgaaggggagaagatgggaggaagaaga

SEQ ID NO: 30823 - DNA, 101 bp, rice(Oryza sativa)
  misc_feature (71): n=a or g
aatttcgtatggttgtgtgagtgaacttgcgatctctagtattgccctgttgtgaacttgcgattatatgngtcgagaaggtgaggccagtgaagtgaaga

SEQ ID NO: 30824 - DNA, 101 bp, rice(Oryza sativa)
  misc_feature (71): n=a or c
tgggatcttccactttgacatgaatatcttcaagtggagaaatataaacatttcattttgacacgttagcngcagtacccagagatgctactttactttgt

SEQ ID NO: 30825 - DNA, 101 bp, rice(Oryza sativa)
  misc_feature (71): n=t or g
gagttggagtaattattattgctctgaccaagtgacctgcacacagggctccccaaactatttttgggtgnttaccatcgtcccatagtttaacggttatt

SEQ ID NO: 30826 - DNA, 101 bp, rice(Oryza sativa)
  misc_feature (71): n=a or g
gatacgagatggtcatgctcaacatcggcttcttcaccatcgacgagagatgccaacttctcgacaagatncatatgaggtacctgactataattttgcat

SEQ ID NO: 30827 - DNA, 101 bp, rice(Oryza sativa)
  misc_feature (71): n=t or c
cttatggtgcgctaatcatataggcagccgtaaatcaacagcgtcgtatatttaaatatacaacatcatanggaagaagtaacaaaaattctcaagactaa

SEQ ID NO: 30828 - DNA, 101 bp, rice(Oryza sativa)
  misc_feature (71): n=t or c
aggagaagggatttggggatattttgattttattttttcacccaaaaaacattatcgcagttggccgtctnaaccggtcatgttggataatcgattcaccc

SEQ ID NO: 30829 - DNA, 101 bp, rice(Oryza sativa)
  misc_feature (71): n=t or c
ggcatgacaaatcgagttgccactactatctactgcaattacttcaatttactccattcgtctcacggtanataaaacataaaactagataagtaatttcc

SEQ ID NO: 30830 - DNA, 101 bp, rice(Oryza sativa)
  misc_feature (71): n=a or g
gtggccataccgcctctggcccaagttgcaaagcgagactgctttgccatctccacccctttgcacctcanggcccaaacagaaaggccacggtagcagta

SEQ ID NO: 30831 - DNA, 101 bp, rice(Oryza sativa)
  misc_feature (71): n=t or c
ctcaggctccacgtagccatgctttactattatttttttccctccggacttcaggtcaaaattgccggtgngaggttttttaatcgaagtttatttttagt

SEQ ID NO: 30832 - DNA, 101 bp, rice(Oryza sativa)
  misc_feature (71): n=t or c
aggaatctgaatctccaatacttgtttaaaagacagaggcatgcacaacattgcatcacagaagctatatncatttctatcaaattaattaggaaagaaat

SEQ ID NO: 30833 - DNA, 101 bp, rice(Oryza sativa)
  misc_feature (71): n=a or g
gatgatatggcccggacggccggtcaaatcctctgctgatcgacagggaggattacaagcgtttccatcancaatgctctcgatcgattcagcaacttcgg

SEQ ID NO: 30834 - DNA, 101 bp, rice(Oryza sativa)
  misc_feature (71): n=a or g
gggcgccaccccgtgccacacaccgcccagccatatgcagttgttcgtacccgtaattaaccacaagctcncttgccctttaccgtcaacgctagcccacc

SEQ ID NO: 30835 - DNA, 101 bp, rice(Oryza sativa)
  misc_feature (71): n=a or g
agtggcattgcaacgaatgcccgcgagttgagcatttgatcgaatcccatatttagagtggcattctagcnaaactatgttttttgagtggcacatatgca

SEQ ID NO: 30836 - DNA, 101 bp, rice(Oryza sativa)
  misc_feature (71): n=a or g
ttacaatctaatataggatataatacaattcataatactataagtattatagtgtgtgtttgattgctttnttttaaaacggaggtagtactccctccgtt

SEQ ID NO: 30837 - DNA, 101 bp, rice(Oryza sativa)
  misc_feature (71): n=a or g
gacaagaggctggccagtggcaaggcaaggaggctagccagcgtcggcaggtggcagggtgatgggcaagnaggctagggggggtgcctggcgacaaggct

SEQ ID NO: 30838 - DNA, 101 bp, rice(Oryza sativa)
  misc_feature (71): n=t or c
gtgttaatccaactgttcaaaatcgtcgttacaagatcacttgctatgacctctttccgactatatattantccgcttccttgaagaaaggccaaaacatt

SEQ ID NO: 30839 - DNA, 101 bp, rice(Oryza sativa)
  misc_feature (71): n=a or g
aacaaggtaatgttgtaaaagctatgaagttggtggtgggaactaaccccttgcgcatgcaagacgaagcnattcattagcacatgattaattaagtatta

SEQ ID NO: 30840 - DNA, 101 bp, rice(Oryza sativa)
  misc_feature (71): n=t or c
agctctgactcgaagaagcaggcgaccccgtgcgacgaggatagcatgacgagcttcgacgaggctagcangaaggagagcgacggggatgggtgttgatg

SEQ ID NO: 30841 - DNA, 101 bp, rice(Oryza sativa)
  misc_feature (71): n=t or c
gagagacgctaatgaaactgacctatagttaatggacctaaagtggactttttctatctgggctttattancaaagggcccaataagggagcgaccattcc

SEQ ID NO: 30842 - DNA, 101 bp, rice(Oryza sativa)
  misc_feature (71): n=a or g
acttcaattaatcaattaaagtaaatggaaaaccaattaaaatttccccttcttcctttgtgcccctttcngcccaaagctctccctctctcctcggcctg

SEQ ID NO: 30843 - DNA, 101 bp, rice(Oryza sativa)
  misc_feature (71): n=a or g
aatagcgtttttgacacaagaatagcgggctcagaaggatgcgactgccaaaaaaaaaaaaagaggaagcnaacacatcagcgccatcgttgttcaagaat

SEQ ID NO: 30844 - DNA, 101 bp, rice(Oryza sativa)
  misc_feature (71): n=a or g
aagatccagctttagagcgacggtttcaaccagttaaggttccagagccaactgttgatgaaacaatacanatcttaagaggacttcgtgagcgatatgaa

SEQ ID NO: 30845 - DNA, 101 bp, rice(Oryza sativa)
  misc_feature (71): n=a or g
gatgatgctatccagataatatccagatagtttgctgggtaatatccgtattatttatcgggtactccgtntccatcaaataccgccctccaaactagatc

SEQ ID NO: 30846 - DNA, 101 bp, rice(Oryza sativa)
  misc_feature (71): n=t or g
aggagagaagatgacctggttggctagagatgctgagtaactgcgctgatggatgaatacggagggggggnggagacgccggcgccggcgccaaggaagaa

SEQ ID NO: 30847 - DNA, 101 bp, rice(Oryza sativa)
  misc_feature (71): n=t or g
aaatccatcaacctttaaaacacagcagcaaaatgaatggtaggtaacccgaaactatcatctaatttttntgtgtgtgtgtgtgtaaatctggttgctta

SEQ ID NO: 30848 - DNA, 101 bp, rice(Oryza sativa)
  misc_feature (71): n=t or c
agccgtggtagccgcctgctgaacgctcccaatatatttttctcctttagtctcactccacagtggaagcngcctcctccaatgtcacctcctcacggcat

SEQ ID NO: 30849 - DNA, 101 bp, rice(Oryza sativa)
  misc_feature (71): n=t or c
tgattcgtatcctaaaccacagtactatcgaatatcttgatcatgaactattgaaaccaatgcagtttgantcccttgacggttttagacagtggtttcgc

SEQ ID NO: 30850 - DNA, 101 bp, rice(Oryza sativa)
  misc_feature (71): n=a or g
caacagtgggtattacttattaggatcgttggtataatggcacggtgggcgccattgcttttgctccaacngcagtagcttgtaacctctccaatgcgtcg

SEQ ID NO: 30851 - DNA, 101 bp, rice(Oryza sativa)
  misc_feature (71): n=a or g
aattatcgaatgtaaacctgatttcaagcttgtttcagtactggtcttccatctcatccgtttttgtattnaaatttggcaagttcaaagttgcagaaaat

SEQ ID NO: 30852 - DNA, 101 bp, rice(Oryza sativa)
  misc_feature (71): n=t or c
tcatcgtatcggcgatccaacaggcaacagactgacacgaactaatctgaaaatgcaatttaatattgggnctatttggcacagcttcaactctagctcca

SEQ ID NO: 30853 - DNA, 101 bp, rice(Oryza sativa)
  misc_feature (71): n=t or c
ttcgcaagcggtcataggtctacttgcaaaaatcaattttagtaggtgggcccattaagaagaccgccggngaaaagtatcttgtgccaaaaaaaagtttt

SEQ ID NO: 30854 - DNA, 101 bp, rice(Oryza sativa)
  misc_feature (71): n=a or g
cagtaacaacgggaccgcggcacaaagtgtttccgaggaagagtaagcaagagagaggatgaacaaagcanttgtgcggtgtcatttgtctttcccggtgg

SEQ ID NO: 30855 - DNA, 101 bp, rice(Oryza sativa)
  misc_feature (71): n=a or g
gaatttgtttgtttgcaggagcgaagcattgacattccgctatggaggctccttcgtcgtccccgtcatcnccaagtctgaaagatcatctctcttcgcca

SEQ ID NO: 30856 - DNA, 101 bp, rice(Oryza sativa)
  misc_feature (71): n=t or c
gtgggtttctccaaaagacctaagcgagcaactggttaggtgtaaccgaagctgagttcatgagttatganagctttcgaatatctgtcgaatacctttca

SEQ ID NO: 30857 - DNA, 101 bp, rice(Oryza sativa)
  misc_feature (71): n=t or c
ggatgatcaatccgtaatcaacatgtcatagatcacacaatcttaattctttatagccttttgataggatngatcaaagatgcaattactttggtgcaaac

SEQ ID NO: 30858 - DNA, 101 bp, rice(Oryza sativa)
  misc_feature (71): n=t or g
gggggatcctgccggtgggggtggaggggtacgagctccgggaggacgggagcttcgaggtgtacttcccncgggactgcgagttcatgctggcgaggacg

SEQ ID NO: 30859 - DNA, 101 bp, rice(Oryza sativa)
  misc_feature (71): n=t or c
aaaatgaatagcaggttctctacaagttaaaaggtacactgtcctcgtgttgtcggagaatgtcaattcgngatattttattttattttattggggagtac

SEQ ID NO: 30860 - DNA, 101 bp, rice(Oryza sativa)
  misc_feature (71): n=t or c
ggcttctcctcgcgcgccgccatggtgcttggcaacgtcgccatcctcgtcggctccggtgagtcactttncgccgtctgctccctcctgaggtccacccg

SEQ ID NO: 30861 - DNA, 101 bp, rice(Oryza sativa)
  misc_feature (71): n=a or g
tagtaaatttggaaaaattacacatatcctatcagaagggcattatcaaaagtcaaaaccattgtcaatantagaattgtatctttatattattagtttat

SEQ ID NO: 30862 - DNA, 101 bp, rice(Oryza sativa)
  misc_feature (71): n=t or c
aaccaactgctcctgctatcccagtaagttttctttgacaaaaatactcagatcggctatgcctatttganctctaactctctttaaatcattgctgcagg

SEQ ID NO: 30863 - DNA, 101 bp, rice(Oryza sativa)
  misc_feature (71): n=a or c
ttatttgagaaacttagtacaagcgtggccatgaacatacacacccacaatctaaaccgacctataagcanatatttaattaaaaactagttggatggccc

SEQ ID NO: 30864 - DNA, 101 bp, rice(Oryza sativa)
  misc_feature (71): n=a or g
ttgttcctgcgtttgacacagataaatgaatgtataagaagcgtgtccagataagagggataaaccacttnaacatcctataaagcacactgtcacctcta

SEQ ID NO: 30865 - DNA, 101 bp, rice(Oryza sativa)
  misc_feature (71): n=t or c
agttcctcgtgccaacaatgctctagtgcctgtaaaattggtgttccatcggttgtcttctttcttctggngatcaccggaggtaagatggataagaatcc

SEQ ID NO: 30866 - DNA, 101 bp, rice(Oryza sativa)
  misc_feature (71): n=a or g
atgatgataacagcctgtttcctgtcactgcctgcctgcagtgacgaaatggctgtcatcacaaaaggtgngtcactaaccagcttctgtgaccaccagag

SEQ ID NO: 30867 - DNA, 101 bp, rice(Oryza sativa)
  misc_feature (71): n=a or g
tgcagcccacatcgttgcgaaggaggacagctgaaaaggaaaaaaggcatgacatgccaaattcaaccagnaggaaaaaaaagaagaagtgctactttatt

SEQ ID NO: 30868 - DNA, 101 bp, rice(Oryza sativa)
  misc_feature (71): n=a or g
atgaaatgaacggattatacaagttgtcacatcgtatttgtgcttatgtagaggaagaatgagatgagagnaaaaaaaacaggttagtagccagatgtagc

SEQ ID NO: 30869 - DNA, 101 bp, rice(Oryza sativa)
  misc_feature (71): n=a or g
tgcggtaggagtagagctgataaagatttggcgtcaagaaaaagagtggatgatacagattctggcatcgngaaacgcgtttgccttcaacatgtgggccg

SEQ ID NO: 30870 - DNA, 101 bp, rice(Oryza sativa)
  misc_feature (71): n=a or g
cgaacaggccactagttatccaacacgttatcagcacgagttctcgctcgttccgctgatccgggtaagcntttttaatagatcaatttgtttcgttacta

SEQ ID NO: 30871 - DNA, 101 bp, rice(Oryza sativa)
  misc_feature (71): n=a or g
cactacttaatttgtagttaatcacttgtcagcgtattgaagtcatttcaacattagagcaggtacaatancagactataagccagctacaaacatatttt

SEQ ID NO: 30872 - DNA, 101 bp, rice(Oryza sativa)
  misc_feature (71): n=a or g
aatcaggcacccctgagctcaatgtggccagatctaacggggagatggcagtgatgattgagattgagatnccaaccttcggcatcctggttacatagcaa

SEQ ID NO: 30873 - DNA, 101 bp, rice(Oryza sativa)
  misc_feature (71): n=t or c
tcactgcgctgcatgtggcaaagtgacgctaattaagtattactggtcacttgatgcatgcggcggagccngggcacctgtggcggcctgtccagggtagt

SEQ ID NO: 30874 - DNA, 101 bp, rice(Oryza sativa)
  misc_feature (71): n=t or c
cttgggcccttcatgttgtcgttgaatttcaaaatcgttcctaggctgaaataccaaatataacgcatccntaatcttacaaaatcgggtcacattcggtc

SEQ ID NO: 30875 - DNA, 101 bp, rice(Oryza sativa)
  misc_feature (71): n=t or c
tagggtgtggtttcctaacatacacacccagccaaacctctcgaaatacaagcatcagctaccgagccgcngcccctcgtaggccttgtttggttaatccc

SEQ ID NO: 30876 - DNA, 101 bp, rice(Oryza sativa)
  misc_feature (71): n=a or g
ttcagcataaagttgaacagcccaaaaaagggtaataaaacagaggggagggtgaaactaaatcgaacccnctgttgtcgacggccttgccagcatactca

SEQ ID NO: 30877 - DNA, 101 bp, rice(Oryza sativa)
  misc_feature (71): n=t or c
ctatcggatgcaggtatggcgtacgatacaccgacgttgttcaatcgtggcattgacaggagccaccgctngttcttgtcagcagtcgagggtgcacagct

SEQ ID NO: 30878 - DNA, 101 bp, rice(Oryza sativa)
  misc_feature (71): n=a or g
agcaaccaacaatgccgttcaactaccacggattattgtacgatcagtacgagttgatgagagagagaganagatggggaacgtacgaccgagaggctagt

SEQ ID NO: 30879 - DNA, 101 bp, rice(Oryza sativa)
  misc_feature (71): n=a or g
tcgctgcacgtgggcccaactaatccaacctggaccccagtcatcccatgtcttgttccactttactcacncactctcgcacctcgttgcacacgtggcca

SEQ ID NO: 30880 - DNA, 101 bp, rice(Oryza sativa)
  misc_feature (71): n=t or c
tcgcggagaaatggctcgggcgagaaagagagaggaacaaggttagaagaaaaacaaagatttgggaaagntatgctgagccaaccaaacccttaaaaaca

SEQ ID NO: 30881 - DNA, 101 bp, rice(Oryza sativa)
  misc_feature (71): n=t or c
gcggcgacggtagaggtggtggaggctgtgaggaagaagccgccgatgtcgagtctggagtcggtaagatnagtttgctgacgcggagtggatggggatgg

SEQ ID NO: 30882 - DNA, 101 bp, rice(Oryza sativa)
  misc_feature (71): n=a or c
gcattatgtttgcacatgaacaaacagtggcgctcatgttttacttactttgagttaggactacaacaacnagccatcttatcagcgtaactggccggaag

SEQ ID NO: 30883 - DNA, 101 bp, rice(Oryza sativa)
  misc_feature (71): n=t or c
atatgtgcaataattccatttttcggaaattctgaaaataaatatcggacaactccgaaaatctccagaanaacaaacacaatgaagtcaatagtgatttt

SEQ ID NO: 30884 - DNA, 101 bp, rice(Oryza sativa)
  misc_feature (71): n=a or c
cccagtgaacagcacggcgccgcaagctttggcccatctaatgctcttcctgcctgccgcggcgccctcgncgttgccctcccgcaccaggcaccaccaac

SEQ ID NO: 30885 - DNA, 101 bp, rice(Oryza sativa)
  misc_feature (71): n=a or g
atggccaaagaggagcttgcaatgctcatgctttaatacatatgtcatcctttaaaatttggtacatttgngactgagggagaaatgataacaatccggcc

SEQ ID NO: 30886 - DNA, 101 bp, rice(Oryza sativa)
  misc_feature (71): n=t or c
cttaaccctatatatcctttgtgtctagaaaaggtagaatatttagtggcaattttaaacactataaaaantgtttacttctaaattctacaaattctaac

SEQ ID NO: 30887 - DNA, 101 bp, rice(Oryza sativa)
  misc_feature (71): n=a or g
tatgaaggagggatatttttcctcgatattgtattcccaattgactatccgtttaaacctcccatggtaanaactaagaattagcttcttttttttttttc

SEQ ID NO: 30888 - DNA, 101 bp, rice(Oryza sativa)
  misc_feature (71): n=a or g
agccgccaacgcgcgccagagaggaggctcgtaggtcctcctcggcgttcgccgatgtgcacgctcctcancctctaccgtggggaagcttgtcgctgaga

SEQ ID NO: 30889 - DNA, 101 bp, rice(Oryza sativa)
  misc_feature (71): n=a or g
tacgaccacagataaatccgcaagtgcacggaataccgctgtagtggttaagacttatactttgggattgnagtaataaaatcatccaccattcatcccta

SEQ ID NO: 30890 - DNA, 101 bp, rice(Oryza sativa)
  misc_feature (71): n=t or c
tccataaccaaagtggtaattattgttacacatgcacatacacaaatatacaagcaatacaacacttttangaattcgtctcctaacacatattagaaaag

SEQ ID NO: 30891 - DNA, 101 bp, rice(Oryza sativa)
  misc_feature (71): n=t or g
gcgttgacgtcatcaccggcggcgctaaccgagggcattggtgggttcagcttgacgcgggaactcaccgntggatggcgcaatgatgggtggcgaaggac

SEQ ID NO: 30892 - DNA, 101 bp, rice(Oryza sativa)
  misc_feature (71): n=t or c
tttaatcgtgatttgatttagctaatcacgctggttaacgggtggaaaacgataacgcgtgattttctccngatttccttagccgagagattaactttcct

SEQ ID NO: 30893 - DNA, 101 bp, rice(Oryza sativa)
  misc_feature (71): n=t or c
tcaacatatttcctaccatcacgacctgagattcaaattgcagacaataacaaaacatcaggccgtgtatnatttttaccatctacatgtaagtatgtaac

SEQ ID NO: 30894 - DNA, 101 bp, rice(Oryza sativa)
  misc_feature (71): n=a or g
aaatgggcatcttactttcaccgtactgattgcacgtctagcttaaagttccaaagggtctaacgtgagtntggcttgtccggttgccatcaaagacaatg

SEQ ID NO: 30895 - DNA, 101 bp, rice(Oryza sativa)
  misc_feature (71): n=t or c
attgtttaatagttcgagaagtatgctcagaatatagcaaaatcaaaactcacttcccaacatagccttangcaaaacaaaatagtaagaagaaaaatagt

SEQ ID NO: 30896 - DNA, 101 bp, rice(Oryza sativa)
  misc_feature (71): n=t or c
gttaaattcagtcgtactatacacagaaccgccaacacaataacttttggatagttctgagaaacatttgnttttagataatggattaaaccggcctctac

SEQ ID NO: 30897 - DNA, 101 bp, rice(Oryza sativa)
  misc_feature (71): n=t or c
gctttgaggctatcatgtatatcatgtccgagggtgctcacctttcactatcaaattatgctttctgtatngaagcgtcacggcagtttgctgaatccagg

SEQ ID NO: 30898 - DNA, 101 bp, rice(Oryza sativa)
  misc_feature (71): n=a or g
tcaaaatatctgtattgatgtggtttataagctagacctatacaaaagagtacatattaggctattagccncatcaaaagtttgaatacacatacttattt

SEQ ID NO: 30899 - DNA, 101 bp, rice(Oryza sativa)
  misc_feature (71): n=a or g
aaatcctaaatgtggagctggaggggagacatgagtgtagaaccacaaaatccccatcatgacactagcanatagatagtgattattcacaaaaacaaaat

SEQ ID NO: 30900 - DNA, 101 bp, rice(Oryza sativa)
  misc_feature (71): n=t or c
acttttatgttctcgtctctgaccctgttcactgacgtcctataaccccataattccaacggtattatcancaactcattacctaccattgtcttccatcg

SEQ ID NO: 30901 - DNA, 101 bp, rice(Oryza sativa)
  misc_feature (71): n=t or c
atataaatgtacacaatccttttgcgtattccaaaaaaaagaattgagaattatgctgctgtcgtgctgtngagtactagtatttcaattgaataagctta

SEQ ID NO: 30902 - DNA, 101 bp, rice(Oryza sativa)
  misc_feature (71): n=a or g
agtaatagcctcacattatacagcaaccataaataaaatatcaaaagccaaactccaatatcaatacgcantgttttagaagcactgaatactaattgcac

SEQ ID NO: 30903 - DNA, 101 bp, rice(Oryza sativa)
  misc_feature (71): n=a or g
cgtcttctgccgccacaaggaaacggaactaaggcgacgcatgttgctatgcttcgtcttaacaaaatcangctcggctgtgtgcccttgtcacgtaggac

SEQ ID NO: 30904 - DNA, 101 bp, rice(Oryza sativa)
  misc_feature (71): n=t or c
gaagctacgacgattttgatggcatagatggccgcaatcgaaatgggaagagaaagctgggaacttgtagntgtcttgtactttcttcgtttcaggttata

SEQ ID NO: 30905 - DNA, 101 bp, rice(Oryza sativa)
  misc_feature (71): n=a or g
atcagaaacaggtttacaggcatttaattttaacaaggttcgccgatgtctctacattgatatgatgctcncctatgtgtagcccaatttgtgcaatacta

SEQ ID NO: 30906 - DNA, 101 bp, rice(Oryza sativa)
  misc_feature (71): n=t or c
tgtggagaagtttacacagtagtattatggttcaattcaggctgagatcaagtacttcctccgattcatancataatactttctagcattatccacattca

SEQ ID NO: 30907 - DNA, 101 bp, rice(Oryza sativa)
  misc_feature (71): n=a or g
aaaaactacagccggcaatgtttctcgacatcgaccaaaaagttcaacagagcccgaccaggttaaggttncttcaaacaccttcaccataatttgagaac

SEQ ID NO: 30908 - DNA, 101 bp, rice(Oryza sativa)
  misc_feature (71): n=a or g
ctcgcgaaggggaaatggcctttgtaccaaagtcatcgtcctactcaaatacccttgatgcaagtattacnaacatttggtcttatgaattaggatgcgga

SEQ ID NO: 30909 - DNA, 101 bp, rice(Oryza sativa)
  misc_feature (71): n=a or g
aaaagcccaagctcacgatggtgtctgggcctgctatctcgtaagcctccttatacagctaatgagagtanttttattcttaattaaattttatatgggag

SEQ ID NO: 30910 - DNA, 101 bp, rice(Oryza sativa)
  misc_feature (71): n=a or g
ttcaggcctcataacgaaagaatacataacctggaaggatatttcatatgattatatagatcttatctccntaacaggataataatcccaaagcaaatcgg

SEQ ID NO: 30911 - DNA, 101 bp, rice(Oryza sativa)
  misc_feature (71): n=t or g
ttgctatggtctcctgggcaaagaaggccctgtcgaccacgacggccaagtaggtggagtaagtgctaaangatgagttcgacctacgcggtgatgtggtg

SEQ ID NO: 30912 - DNA, 101 bp, rice(Oryza sativa)
  misc_feature (71): n=a or g
tatgtacagaattgtagtgcgctatgatgtatatttttttatagtgatctatgacgtaaatggaaatcttntagtcctcataataattttgttagagaata

SEQ ID NO: 30913 - DNA, 101 bp, rice(Oryza sativa)
  misc_feature (71): n=t or c
catagctgcagaggtcagttgccaatgtgcggaaaccacgagtgatgagggcggctatctggtggttccangagagccataactctaggaatccaaggatg

SEQ ID NO: 30914 - DNA, 101 bp, rice(Oryza sativa)
  misc_feature (71): n=t or c
tacgcttcaaccgtcagaagataatataataaccagtgaaagaacaactctcttaggccttcgggtttgcncttaacgccgatggcttggagtgctccaaa

SEQ ID NO: 30915 - DNA, 101 bp, rice(Oryza sativa)
  misc_feature (71): n=a or g
cgtaggcgcggaggtagtcgacgggcgcaccggcgccaaccgacctccaactcccatagttgccattgcanccgtcgggatcgggctagggtttggggagc

SEQ ID NO: 30916 - DNA, 101 bp, rice(Oryza sativa)
  misc_feature (71): n=t or g
agttggagatcgcgcgtgatcgcggacgaggaaaacggatttttgttgttactttaaaggagtgcccattnttagttataggaaatcaaatttaggctctc

SEQ ID NO: 30917 - DNA, 101 bp, rice(Oryza sativa)
  misc_feature (71): n=a or g
ggcggaatagatggttttatcttgaggtcaaagattcgaaccctgtcttcatcgttcccacagaacaaccnggcaagatttcgtcttggaccgccaagcct

SEQ ID NO: 30918 - DNA, 101 bp, rice(Oryza sativa)
  misc_feature (71): n=a or g
gttatgtcctgctccatcatattcctgcaattaataaatgatataacacaccattttgcattgcatcagancaggttcaataggggtagaaaagccggcga

SEQ ID NO: 30919 - DNA, 101 bp, rice(Oryza sativa)
  misc_feature (71): n=t or c
atatatatacatatatatatatatatatttctcatccgtatccctccctccctcctcctgttccccctccngtcgcttcccctccctcctcccaatctctc

SEQ ID NO: 30920 - DNA, 101 bp, rice(Oryza sativa)
  misc_feature (71): n=a or g
agaataatttgcatggtgatatcagaatctgatcatgtttggaatcaaattacattggtttgaatgttganagatatttgctatatgtgattgctgatgaa

SEQ ID NO: 30921 - DNA, 101 bp, rice(Oryza sativa)
  misc_feature (71): n=a or g
tgccacctgtgttgctgctttctgtacgcttcatatgattctggcaactcacattgacactgcaagggaantcacatgaatcaaattattagtctttgaca

SEQ ID NO: 30922 - DNA, 101 bp, rice(Oryza sativa)
  misc_feature (71): n=a or g
acggggtgcccgcgagcaccattgctgcgagctcaaccacaaggtgctagagcttgccccgtgcaccgtcngcatcttcaccgaccgcccgttctggaggg

SEQ ID NO: 30923 - DNA, 101 bp, rice(Oryza sativa)
  misc_feature (71): n=a or g
gtactggggccagctcttttaggccatctacaatgcgtagctcagcgagtggctttggctcacggcgtccngctcccgttcgcttgggcgcttttccgccc

SEQ ID NO: 30924 - DNA, 101 bp, rice(Oryza sativa)
  misc_feature (71): n=a or g
aaccaatgaaccaatcaactaatattgacatagtgtgatagatgcaactccaatggttaaagcatacatcngatggaaatcccatgtaagtagattcacat

SEQ ID NO: 30925 - DNA, 101 bp, rice(Oryza sativa)
  misc_feature (71): n=a or g
gtttatgggtggtaaggttaatccgtagtagagttttactgatatggtcatatttaagaacccaacaatcncatattcatcccctctagtcgatatctcga

SEQ ID NO: 30926 - DNA, 101 bp, rice(Oryza sativa)
  misc_feature (71): n=t or c
gcgcggaacaaatggaggaaacacacacgcacacacaacagaacataagcaagaacaagcaaatcatgggngaatcaaacatatttacgatggagcttgca

SEQ ID NO: 30927 - DNA, 101 bp, rice(Oryza sativa)
  misc_feature (71): n=a or g
ggttgagaaacctccatatatagatgtcagatatcccaacaggcgccatggaggtagtattgatgaggatnacttaaaggtgggtgctggtttaagaaccg

SEQ ID NO: 30928 - DNA, 101 bp, rice(Oryza sativa)
  misc_feature (71): n=t or c
tcgccggagttgggcacaagtatcggcgttggtgtgggcaggaggagaagcccacgaattgccgcccctgnttctcaagcccacaagccgccgtcgacaag

SEQ ID NO: 30929 - DNA, 101 bp, rice(Oryza sativa)
  misc_feature (71): n=t or g
agaaagctaggcctgcaatttgcatcaacactaggggtggtcctgatctagtgatcttgttcattctgccnttgcacgcaacggcaaaccgttttttgtcg

SEQ ID NO: 30930 - DNA, 101 bp, rice(Oryza sativa)
  misc_feature (71): n=a or g
gggccggcgtggcgagcggtccttggatccacctgctggtggctaccactccattccctaggccctagcgncaccgcagccgaggccacctcccgccacgg

SEQ ID NO: 30931 - DNA, 101 bp, rice(Oryza sativa)
  misc_feature (71): n=a or g
tggagtttaaaatatgtaaaacaacatgatacttcgtgttttgctgcggaatccataaattaatatatgcnaattattgtacaaatgattgataaatgttg

SEQ ID NO: 30932 - DNA, 101 bp, rice(Oryza sativa)
  misc_feature (71): n=t or c
tcttgctctaaaagagtgagcttgcaagttaggaaggtggctccacgattctttccaccttttagatagantaggagcttgcctttctatagcggtgccaa

SEQ ID NO: 30933 - DNA, 101 bp, rice(Oryza sativa)
  misc_feature (71): n=t or c
ccaagagaaactttactggatctgttcttttcgtgtccgtttagcaggagctgctgggatcgtcttcgaantagatggaattcaaatttgggaatttatca

SEQ ID NO: 30934 - DNA, 101 bp, rice(Oryza sativa)
  misc_feature (71): n=t or c
aattgtggtgattcaaattttaaaggtggggattaatctataccattttaccattttttatttaacctttntaatttttaattttaaaaacaatctattcc

SEQ ID NO: 30935 - DNA, 101 bp, rice(Oryza sativa)
  misc_feature (71): n=t or c
ggagtaacgttcagccaggtactcatgaaggcaagacttgcatgtccttgaaccgagagatagaagtaggntgtgtttagtttcgtgcaaagtttagattt

SEQ ID NO: 30936 - DNA, 101 bp, rice(Oryza sativa)
  misc_feature (71): n=t or c
ttttcggttctttcaagcatatgtaaggaggaaagtttcaatttatacggcagatttagtttgcccctttnaatgtagtagcttgatccgcagttgcgaac

SEQ ID NO: 30937 - DNA, 101 bp, rice(Oryza sativa)
  misc_feature (71): n=a or g
caaatcgcaaccaacctccagtaatcaaatcaaccaatacttgatgaaacaaggaaggtcagaaatcaganccacaagagtgcgcatggtcgcgtatcgtg

SEQ ID NO: 30938 - DNA, 101 bp, rice(Oryza sativa)
  misc_feature (71): n=t or c
taggtttctagctcgttgtgaaacctaaattcatgggctcgtatttgattaattatttttcagtggtaaangatgtaccagtaaacaaacgtagctcgtac

SEQ ID NO: 30939 - DNA, 101 bp, rice(Oryza sativa)
  misc_feature (71): n=t or c
tatccacaagacatgtcatggggttcctatccaatgctgccgtcgggttatccctatccttacttcttgcnatggggggcgacgccgccaatgttcaatca

SEQ ID NO: 30940 - DNA, 101 bp, rice(Oryza sativa)
  misc_feature (71): n=a or g
tgtgactgtgagctgaaccagttgcatccatacaactatgaggagttggaatgcagtgcaaaatctatgcngcaatcttaaacttacaagaaggattggat

SEQ ID NO: 30941 - DNA, 101 bp, rice(Oryza sativa)
  misc_feature (71): n=t or c
gaaaatatatccatcataattaatgggcagtcttcgggccatggcccgagtgatctgaggtgtgagtctgnccctaattatacatattttaaaaatatctt

SEQ ID NO: 30942 - DNA, 101 bp, rice(Oryza sativa)
  misc_feature (71): n=t or c
taatttgtaagtatcatccttatctactcaccttctctctctcacttctctttttttttccagagcctctnctctctctctctctcccctcctcctctcac

SEQ ID NO: 30943 - DNA, 101 bp, rice(Oryza sativa)
  misc_feature (71): n=t or g
atacctagctacaggtgtagctaaggcaaaggaatggaggtttccaaaagcgaatggtgaggaccaagaanggaatcccctccctgtgcttgtcccaggaa

SEQ ID NO: 30944 - DNA, 101 bp, rice(Oryza sativa)
  misc_feature (71): n=t or g
ctaagctggagtgatgaactatgatgctaggttaacatgtgtcaaacttgtgattatttcacatggcatanggacagtactgtccatgactgaaaatgtgt

SEQ ID NO: 30945 - DNA, 101 bp, rice(Oryza sativa)
  misc_feature (71): n=t or c
tgcgaggacacgtggagatagcccacttgctctccacgttgcctgcttgcgaaaatctatttttgtaggcncccttaagaggcccacatgcgataattggt

SEQ ID NO: 30946 - DNA, 101 bp, rice(Oryza sativa)
  misc_feature (71): n=t or g
ttgccctgccatttccttctccttcctcctgcagcagctgtcgtaagtcgtggcacgacagctgctgcganatctatcgcaccaggaaggatccttccgag

SEQ ID NO: 30947 - DNA, 101 bp, rice(Oryza sativa)
  misc_feature (71): n=a or g
catcatctactactgaaagaaaaattagccataagtacgagcatccatatcaaatctaaaatttaaacccngatagattggttctatcataaggaatctaa

SEQ ID NO: 30948 - DNA, 101 bp, rice(Oryza sativa)
  misc_feature (71): n=a or g
taatttatatttctatgtctttttccactttatctttttaaacatacgttacaattgtgtgtgtgtgtgtntatatatatacaagtcgtacgtacgtacct

SEQ ID NO: 30949 - DNA, 101 bp, rice(Oryza sativa)
  misc_feature (71): n=t or g
taaaatagagaattgcaaaatgcataaaaatataggaatgatggcttggttagactgcaggaaaaatatangatggtgaggagagaaaaagactcaaagaa

SEQ ID NO: 30950 - DNA, 101 bp, rice(Oryza sativa)
  misc_feature (71): n=t or g
tattgtagtccacatcgtgttctcttgacctgaacaatttctcatcacaccctgatggcaggtactgtttntatatgttaaatgcaaagtactaattggat

SEQ ID NO: 30951 - DNA, 101 bp, rice(Oryza sativa)
  misc_feature (71): n=a or c
agtacacttcacaaggatcctgttgtcactttgtcaacctatgcatgtcaagacttatgccagtcacatgnttgattacattagttttataaaaaaaaaca

SEQ ID NO: 30952 - DNA, 101 bp, rice(Oryza sativa)
  misc_feature (71): n=t or c
ctactcgatctccggttgctagtttcagaatccgggggatggcccctcggtgagatatgccgggatgccgncgaggtcggcacccttaatcactggccgcc

SEQ ID NO: 30953 - DNA, 101 bp, rice(Oryza sativa)
  misc_feature (71): n=a or g
tccatatggcccaacataaacagtacttttaagagagagggaaaattacctatctgcccactattaaagcnagagagtagtttgagagtaatatatattat

SEQ ID NO: 30954 - DNA, 101 bp, rice(Oryza sativa)
  misc_feature (71): n=a or g
cttcgtatctaataaattaaattgattgaaaaagaaatagatgaagcatgtttcttaccttggctctactnacgcacagtgtggttgtgtgctgatcagtt

SEQ ID NO: 30955 - DNA, 101 bp, rice(Oryza sativa)
  misc_feature (71): n=a or c
ccaaccgggattaaaaatattaggagacctgtcacgtcgtgccaataaataaactgggacaaaagatgatntttagtcccggttggtaacactaactggga

SEQ ID NO: 30956 - DNA, 101 bp, rice(Oryza sativa)
  misc_feature (71): n=t or c
tgggtcccaccgatatttttttaattgtaatgacatataagcgccacggtgggacgaataccggtcaacancgccatatcagcgccacgtcagtaaaactg

SEQ ID NO: 30957 - DNA, 101 bp, rice(Oryza sativa)
  misc_feature (71): n=a or g
atggtaaaagttaaactattttaagttcgattattctctatctatttttggtaagttatattttatcttgntacaatgaacaatgataagtaattttactt

SEQ ID NO: 30958 - DNA, 101 bp, rice(Oryza sativa)
  misc_feature (71): n=a or g
ggccctgccaatgtttgttgtgtttcagataccgaaactatccacctgaacttctggtggatattgttgcnagaattctatccatggtaccaccttggaca

SEQ ID NO: 30959 - DNA, 101 bp, rice(Oryza sativa)
  misc_feature (71): n=a or g
gaggaatattttgtaagatcgaataaaataggattaattagatacatggaattaaaaatatgccggtttcnaaatatgccatcagtattcgtgtatttgga

SEQ ID NO: 30960 - DNA, 101 bp, rice(Oryza sativa)
  misc_feature (71): n=a or g
ttaaatagtatgaaaacaatatgagaaatggtaatttagcatgcttatatattgaggtttagaatgtaatnaattgtagatgtcattgctatgcatgcatg

SEQ ID NO: 30961 - DNA, 101 bp, rice(Oryza sativa)
  misc_feature (71): n=a or g
ccttgtattgttctaacaggcccgtttatatatcttttaaattacgtagagacactgcctcactattattnttgtttgtcactgttcgatataaacagtgt

SEQ ID NO: 30962 - DNA, 101 bp, rice(Oryza sativa)
  misc_feature (71): n=t or c
cagctgaaaactcagcactcatagcattcattccttgtatcaccgcttcctccactgtcccgtaaccatgntcatcagcatattttctaatatcctctgtg

SEQ ID NO: 30963 - DNA, 101 bp, rice(Oryza sativa)
  misc_feature (71): n=t or c
atatatgtgctggcgtcgacattaggctttggcaccagacatcgccgaactccgagattgctagttcgcgngcgcgttaccggcgcttacttccggcccac

SEQ ID NO: 30964 - DNA, 101 bp, rice(Oryza sativa)
  misc_feature (71): n=t or c
cagggactaaagttaagtccctggatctaaacaccacctgactgcttcggggttgtgcacggttgtgatgntgctttatgtttgccgctttgtcgcagccc

SEQ ID NO: 30965 - DNA, 101 bp, rice(Oryza sativa)
  misc_feature (71): n=t or c
gcaacccgctgcgccgccgtgcgtgcgcgcaggagtcgccgaggagttggaggatctcgatcgacgaagtngccgtcgtcgccgacagcgacggcgatgca

SEQ ID NO: 30966 - DNA, 101 bp, rice(Oryza sativa)
  misc_feature (71): n=a or g
tttgttgtgtttgatacataggttgaagaaagatggatatcttgctgtgatgtgaggaggagctcctttcnatccaattcaggagaggaagtggtgggatg

SEQ ID NO: 30967 - DNA, 101 bp, rice(Oryza sativa)
  misc_feature (71): n=t or g
tcacatcacatgacggcacatgcgctcgccgccgggtactcctcgtacacgaacttgccctcctgaacganccggcaacccttgcaccctctgcacgacga

SEQ ID NO: 30968 - DNA, 101 bp, rice(Oryza sativa)
  misc_feature (71): n=a or g
agcaacccggcggcggctcggcggcatcagcgacgtagacgaaagagggagccacgaaggactcgaggaangagaagagcaagaccaattcgtcctccaaa

SEQ ID NO: 30969 - DNA, 101 bp, rice(Oryza sativa)
  misc_feature (71): n=a or g
atcctaaaatactaaaatgagagacaagaagagtccacctaggacaaacgatttgtgatctagcagcaatntagtataacaagattttttttgttttttaa

SEQ ID NO: 30970 - DNA, 101 bp, rice(Oryza sativa)
  misc_feature (71): n=a or g
tatagagtcatgagccaaatatacagtcccaccacactttggattgtcatgggcctagttacaccagagtnggcacatggcaaatggagtaattgtttcac

SEQ ID NO: 30971 - DNA, 101 bp, rice(Oryza sativa)
  misc_feature (71): n=t or c
taagagatcatatctgagtatatcatgccccaacaacacacagaaaagaaagccttgagttcttaaaatanatgggtaacttgccgaatataaagaaagca

SEQ ID NO: 30972 - DNA, 101 bp, rice(Oryza sativa)
  misc_feature (71): n=a or g
aaatacccctgagcccacaagtcagctctttcatctctctatttgtatctctctagcactgaagggcgtcnatagtgtagagcggcatccctcctcctccc

SEQ ID NO: 30973 - DNA, 101 bp, rice(Oryza sativa)
  misc_feature (71): n=t or c
ttttccaatttacctgtcatcacataactcctcaccgctctcaggccatccacaatcggtactctcaaccngtgccctcgcaaacaacgcctcctttccgt

SEQ ID NO: 30974 - DNA, 101 bp, rice(Oryza sativa)
  misc_feature (71): n=t or c
tccgcgggtccatccagcccctacccccagagtggagggagatttgaaatcgatccccgccccaccctctntggggacccgccacacgacgggggcttgct

SEQ ID NO: 30975 - DNA, 101 bp, rice(Oryza sativa)
  misc_feature (71): n=t or c
agccatactttagcccatgtttagacggtgggatttttctcctaagttataagaaatttaaccattgccgnaagtttaacttcatttggttgaattccact

SEQ ID NO: 30976 - DNA, 101 bp, rice(Oryza sativa)
  misc_feature (71): n=a or g
ccttgcctcctccaggccaccttggatccacctccaatgccggctcccctgaaagaggatataaggagctnactgcggaagtggaggagtagtggtggagc

SEQ ID NO: 30977 - DNA, 101 bp, rice(Oryza sativa)
  misc_feature (71): n=a or g
tgaaatgaaataaataagctaaacaacctagacctaagcgtgcctatcaggcctaaggacttggggcattnaaaactaacggatcaagggggacctaaaga

SEQ ID NO: 30978 - DNA, 101 bp, rice(Oryza sativa)
  misc_feature (71): n=a or g
tcatttttattttcgtatatggttctgtggagtcaattgaattttactcttctcgtattatatactccatncgtttcacattattagtcgtttgaattttt

SEQ ID NO: 30979 - DNA, 101 bp, rice(Oryza sativa)
  misc_feature (71): n=t or c
ccaatgaataaaattgaaaattttaattttaaactcttagttatggactaaagaaactccaaggaaaatgngaaaactgaagaaaacatgataacacaaga

SEQ ID NO: 30980 - DNA, 101 bp, rice(Oryza sativa)
  misc_feature (71): n=t or c
aaggaagtaccctaggtcgccagctccatgagtggcgactcatccagcgtctaggcaaccactttttggangtgctcctcctccgtaggtgattgtagact

SEQ ID NO: 30981 - DNA, 101 bp, rice(Oryza sativa)
  misc_feature (71): n=t or c
gtacctcatgccatctctttggatgtccctcattatttttcttgactaatttcaacaaaatcttattactngactcaacttgtccattagcctgagcatag

SEQ ID NO: 30982 - DNA, 101 bp, rice(Oryza sativa)
  misc_feature (71): n=a or g
gtcttgtcccatatccacccactgacaaacctgtaaagcatatgaaaggtatggtcaaaaagggtaatgcncaatttcttattatatataactccaacata

SEQ ID NO: 30983 - DNA, 101 bp, rice(Oryza sativa)
  misc_feature (71): n=a or g
aatgaagtcaaaaacgaaattcagataattattgtgcagtgaattaactagtcagagaagattcctattgnatatagatcagagatccagatagctctcaa

SEQ ID NO: 30984 - DNA, 101 bp, rice(Oryza sativa)
  misc_feature (71): n=t or c
tgctgctagtatctttttttttcaattaattattgggtttgcgtcacccatcgcctcatcgatttctgcgnatctccgaaattggcattgactctagcttc

SEQ ID NO: 30985 - DNA, 101 bp, rice(Oryza sativa)
  misc_feature (71): n=t or g
agattaaacgacctattacatattgagtggctcacttcggcccagctccgctattcataggttcaccaganattctccacaagtttacaaacttgactcca

SEQ ID NO: 30986 - DNA, 101 bp, rice(Oryza sativa)
  misc_feature (71): n=t or c
caaagaccctagaggcgaggttggtgctatggaataaggtcgccatcaccaggtcaaaggcagcatcgcangggcggaggaaacgtcccttctgtggatgg

SEQ ID NO: 30987 - DNA, 101 bp, rice(Oryza sativa)
  misc_feature (71): n=t or c
tccaaagccgctaggtccgcaaagctccacctcgtgcgcaaaaaactgtcattcctaaagcccccttcctngcctcaacactcaagatggagggtgctggc

SEQ ID NO: 30988 - DNA, 101 bp, rice(Oryza sativa)
  misc_feature (71): n=a or g
gaagatagcctgcatagggttagacaatttcttgttattggaaactatatcactccgacgacaccaaattnaccaacataaggcactagttccaattaaaa

SEQ ID NO: 30989 - DNA, 101 bp, rice(Oryza sativa)
  misc_feature (71): n=t or c
gatcaaactagaacgagacaaaatttaagacggaggaagtattttaatggtgaagctagtgtagtactccntccttccctaaggccctgtttagatttcat

SEQ ID NO: 30990 - DNA, 101 bp, rice(Oryza sativa)
  misc_feature (71): n=t or c
aatgaattcaacaatgccttgaaacaaaacacctctctctccgaagctttgagaagaattagagtgtcatnagcatactgtattactgggaaacccttctc

SEQ ID NO: 30991 - DNA, 101 bp, rice(Oryza sativa)
  misc_feature (71): n=a or g
cacttcatactatcgagcccccttttagtgatgcggccagcaacacatccagcccgagctcctctaaatcntcagggtgagacctggtcagggccaccaag

SEQ ID NO: 30992 - DNA, 101 bp, rice(Oryza sativa)
  misc_feature (71): n=a or g
tgttcacttgaattctctggcctgggttgtcacctcaccgatcaagctagcgcacgcggtcgcgcgcagancaggcggccgtgccgtgcctgtgtgtcgca

SEQ ID NO: 30993 - DNA, 101 bp, rice(Oryza sativa)
  misc_feature (71): n=a or g
aagcgtggaggaggcccttcaaagtggcctcttgcttgcttgccgggggacagtggggtgttggtcggttnccgtgcgccgaaggtgttcggagggtgggg

SEQ ID NO: 30994 - DNA, 101 bp, rice(Oryza sativa)
  misc_feature (71): n=a or g
ccacgcgccatgcccggactttccatgcatcttcgagcctcatcggtggctcgtattctctaccacctccntaccataaaaattacatttctagctagttt

SEQ ID NO: 30995 - DNA, 101 bp, rice(Oryza sativa)
  misc_feature (71): n=t or c
cttgacaaataacgatccccccacttaatctgaagtggttttggttctacgtggcattcgcgtcacaatcnggtcattatttttttattaaaaaaatcaat

SEQ ID NO: 30996 - DNA, 101 bp, rice(Oryza sativa)
  misc_feature (71): n=t or c
agaaggtgcaaagattttagaagtcacaccatattgctcaatattacagccatactcaatgataaaggtcnggggtcttcccggctagcaacgcaagctgc

SEQ ID NO: 30997 - DNA, 101 bp, rice(Oryza sativa)
  misc_feature (71): n=a or g
tgaagtctggagaggggagaagaaggggagaggagacagagaagagggagaatgaggtggaggaagtggancccactatttttaattttattatttgattg

SEQ ID NO: 30998 - DNA, 101 bp, rice(Oryza sativa)
  misc_feature (71): n=t or c
taatctcctccaagaacaacagaacattcattgccattcacaggatgaatatacctgaaaacaccaaatanaatgtaaataaacacaaaacaataaatagg

SEQ ID NO: 30999 - DNA, 101 bp, rice(Oryza sativa)
  misc_feature (71): n=a or g
ggaccagagacggacggtcgtacgcacgcatctccggtgcaggagccggatggaaaaggttagtactgccntgtttagttctaaaataatcctttatattt

SEQ ID NO: 31000 - DNA, 101 bp, rice(Oryza sativa)
  misc_feature (71): n=t or g
ttgggatatcggtggagcggacgaataggtggcgggaggaggagattagctgcggcgggagaggatttttnagggcgaatcggggatttcgcgatggggat

SEQ ID NO: 31001 - DNA, 101 bp, rice(Oryza sativa)
  misc_feature (71): n=a or g
ttctaagccaaattgccacgtggctattaaaataggtagcggtttttagtttaaaaccaacacctatatgntcctaataggtgccagttcaagcctaaaaa

SEQ ID NO: 31002 - DNA, 101 bp, rice(Oryza sativa)
  misc_feature (71): n=a or g
acaattgcctaaaactctagatggtgaatctgatcatagaacagtgtcctatccacctgatgtcccatccncaaaaattggaatcagataatcactttaac

SEQ ID NO: 31003 - DNA, 101 bp, rice(Oryza sativa)
  misc_feature (71): n=t or c
ggatgttgctgtggccataacctgaaaaaacaaaagaggaaaaacaaaggaaactgtttgaatatctaggncttttcttagcactgtatgtaaaaatttga

SEQ ID NO: 31004 - DNA, 101 bp, rice(Oryza sativa)
  misc_feature (71): n=t or g
tataaccatcaaacctttatgcggatacttctagcataatgactacatgaaattctagtgtgaaaggattnctgcaaagacttgacaaaagaaattagtga

SEQ ID NO: 31005 - DNA, 101 bp, rice(Oryza sativa)
  misc_feature (71): n=t or c
aaatccctttaaaaactcgcatgctaacttgggaggagagttgtactcctaattgcttcagagttcttgtnagaccataagaaagtgatgtacatgatatg

SEQ ID NO: 31006 - DNA, 101 bp, rice(Oryza sativa)
  misc_feature (71): n=t or c
atcccgatcgatttcacatgcggaccatagattatttccattcgccagctggagtggcagacgcggctcangtggcggcgatcggtctcgaacgggatgcg

SEQ ID NO: 31007 - DNA, 101 bp, rice(Oryza sativa)
  misc_feature (71): n=t or c
tatgatccatggaaaggggacggccacaattgcagagtctgtaaatttcctcgtcaactatgagaaggtantgttgccgatccgacaacaaagcgatgaca

SEQ ID NO: 31008 - DNA, 101 bp, rice(Oryza sativa)
  misc_feature (71): n=a or g
tccgcgtattagacgcccctgaaactcccattcatctttctcgatcccccctgctctgatttattcccagncatagagaagagggaaaccccgtggtgggc

SEQ ID NO: 31009 - DNA, 101 bp, rice(Oryza sativa)
  misc_feature (71): n=a or g
attatatagaaagtatagatatggaaaatatgtgtcaatttggaaaatcggcaataatataagggataccncataagatctaaagtagatgagtaaagtga

SEQ ID NO: 31010 - DNA, 101 bp, rice(Oryza sativa)
  misc_feature (71): n=t or g
gctatatcactagatttcgtaggcattcatcatccagttattcagttgtgttgtacatcagcctcttaganctgttatcctaacagggctccaactgaatt

SEQ ID NO: 31011 - DNA, 101 bp, rice(Oryza sativa)
  misc_feature (71): n=a or g
aaaaatattagagtcctattttacaaaaatctgtttagccctcgaacccttttatattgggtaaagacacngacataatagtagatagccaataagtgact

SEQ ID NO: 31012 - DNA, 101 bp, rice(Oryza sativa)
  misc_feature (71): n=t or c
atataggtatatttatagtctaatttgaattacaaagatatgtactttctctatcatgaaatactccctcnatctaaagtatatagtaacttttagctata

SEQ ID NO: 31013 - DNA, 101 bp, rice(Oryza sativa)
  misc_feature (71): n=t or c
catatcggcccaaacctgtataaatcccttgtctctcttttgtcccgaaaacctcggatctcacccgctgnccccggccgaaccaaaaaaggggggcctca

SEQ ID NO: 31014 - DNA, 101 bp, rice(Oryza sativa)
  misc_feature (71): n=t or g
gcgagctagggtttcgtcacttttgctcagatttcttctgtgcccggttgcaggggcatcggcgtcggcgncggcggcggcggaggcgagcttgctgttgt

SEQ ID NO: 31015 - DNA, 101 bp, rice(Oryza sativa)
  misc_feature (71): n=t or c
caggcaactctatgttcggcaccggatgtaggctttgcagcgacatgcaagccttcatcgacctcaagacntggacgctgacactgtgtgacaacagagcc

SEQ ID NO: 31016 - DNA, 101 bp, rice(Oryza sativa)
  misc_feature (71): n=t or c
tactacgcaacatcacgatcgacatgcttcgatcagcagccaagtgtccgtacgttctgtaacagcaaganctaaagcgccagaaccttctgctaatgact

SEQ ID NO: 31017 - DNA, 101 bp, rice(Oryza sativa)
  misc_feature (71): n=a or g
tgacttgggatagacaaagcaggtgaatttaaagtgaggaaaatattttgaatattgaactatatatggcnaatatttatatgatgaacatctataaaatg

SEQ ID NO: 31018 - DNA, 101 bp, rice(Oryza sativa)
  misc_feature (71): n=t or g
tctttatgttcgctttgcacgcaaacttaactagtaggttgctaatcttctgttctcttgtaaaattcttncaaacagaaaaaggatgcacctgctggtga

SEQ ID NO: 31019 - DNA, 101 bp, rice(Oryza sativa)
  misc_feature (71): n=a or g
aaatgggttcgtcccgaccgatcatgtaatcatgttcttctaaccaaacacatgctaaactctataaaatnggttcgtcccgaccgatcatgtaatcatgt

SEQ ID NO: 31020 - DNA, 101 bp, rice(Oryza sativa)
  misc_feature (71): n=t or c
ggacggtaatcttacttcaccatttttttctcttttggtgacgtaaacacgcgccgtactcatgcgtgtgncgtaacatactcccttcgtcccagaaaaag

SEQ ID NO: 31021 - DNA, 101 bp, rice(Oryza sativa)
  misc_feature (71): n=a or g
tcgcgccatcctcgcgcaagaccgttcttgacgtcatcgccacctaatttttgtgcaatgtttctgcgggnccgatggtatatttctgtcaaaacaattgc

SEQ ID NO: 31022 - DNA, 101 bp, rice(Oryza sativa)
  misc_feature (71): n=t or c
ctcacctgaaaggctgaaaccgttcgctgcgctatcaaaacctgaaacagctaggagttgaagtgacagcngccatggacatttattaccctcaatatgcc

SEQ ID NO: 31023 - DNA, 101 bp, rice(Oryza sativa)
  misc_feature (71): n=t or c
gtttcagaatttgatgtacacaacccgtgaagaactagcaacaacaataataatgtactactactacattngtcctaaaatataaaagattttggctatgc

SEQ ID NO: 31024 - DNA, 101 bp, rice(Oryza sativa)
  misc_feature (71): n=t or c
ggtcaccccttttttttcctttttcgtcttcgcatcagatcgatctggttcagttcccagattggtcgttngtggttcgtcgccgagaagatcgatcccga

SEQ ID NO: 31025 - DNA, 101 bp, rice(Oryza sativa)
  misc_feature (71): n=a or g
aactgatgtttgtattgttgattattgcgtacgtgtgcagatgggtccgaggattcagcagctggccgctntgttgctggcggctgtcgtcgtcgtcgcag

SEQ ID NO: 31026 - DNA, 101 bp, rice(Oryza sativa)
  misc_feature (71): n=t or c
cttccaggtcctggccaatcctgatttggtgtgctaagcagtgcatgtaatagcagacgtagtagccgcanaagttagtcccctattcctgctttgcacac

SEQ ID NO: 31027 - DNA, 101 bp, rice(Oryza sativa)
  misc_feature (71): n=t or c
ataaattcttaatgttggagtctactagttgttctcttcacttcatccatacatgtatgtattttgtgatnttcaacatatttttttctcctaaattactt

SEQ ID NO: 31028 - DNA, 101 bp, rice(Oryza sativa)
  misc_feature (71): n=t or c
gcaacgaaaatcacctcaaatgttcacccaagatttatgcattagttttgggtaccatcaccctgatttgngagaaaattcaattatgatacagagcttct

SEQ ID NO: 31029 - DNA, 101 bp, rice(Oryza sativa)
  misc_feature (71): n=t or c
cttcaaaacttatttattaagaaccttttggccacgctagccggactggcatgacaaaacaatactgccanactggtctggctggtgtaacaacgttattt

SEQ ID NO: 31030 - DNA, 101 bp, rice(Oryza sativa)
  misc_feature (71): n=a or g
ttgtaatatgaaactgagcaagtagctagtggcatttcgatcggacacgacagtgagctagctgcacgctnagttgccgatagatgaaagtacatctgtac

SEQ ID NO: 31031 - DNA, 101 bp, rice(Oryza sativa)
  misc_feature (71): n=a or g
ctccccgatctctctctctccattgcccccctcctccctctttttttttcgccttttcttctcctggcgcnctcctctacttttttttcttttattcgctt

SEQ ID NO: 31032 - DNA, 101 bp, rice(Oryza sativa)
  misc_feature (71): n=t or c
acggcgacgccgcggcgtgcattggcaacggcagctcgccctgcgccccagaaagatccatttgcaatggnggacacacagcagaagcttccagaagctac

SEQ ID NO: 31033 - DNA, 101 bp, rice(Oryza sativa)
  misc_feature (71): n=a or g
ataggagaaaaagtattttgaatatcgttatatgcatgcatatatggagtggagagagagagagagtaagngcctgtttgttagagctccaactcaattta

SEQ ID NO: 31034 - DNA, 101 bp, rice(Oryza sativa)
  misc_feature (71): n=t or g
aaaaagatgtctaattgtctcatcattgtgacaaaaacaaccgttcttattgctttgccagtttccttttntcaaattatccatcgttaacaccactccac

SEQ ID NO: 31035 - DNA, 101 bp, rice(Oryza sativa)
  misc_feature (71): n=t or c
gtaaaatgagtaaagtagcgcacaataaaaaaacatactactattgaattctctcgtgtgctactttagtnagtcgtctaaatttttataatgttatctat

SEQ ID NO: 31036 - DNA, 101 bp, rice(Oryza sativa)
  misc_feature (71): n=t or c
gtttattttacattttaggtggttttaacactggttttatccgacgtggttatttagtcagcgtggaactnatatggccccgcatgtcagggtgtccacgt

SEQ ID NO: 31037 - DNA, 101 bp, rice(Oryza sativa)
  misc_feature (71): n=a or g
aagaatcacaagaggtttttggtggggtggtgaaaagggggtgcggaaaacacactggaaggcttgggatncgctgactaaacccaagaattgtggtggct

SEQ ID NO: 31038 - DNA, 101 bp, rice(Oryza sativa)
  misc_feature (71): n=a or g
cgtggcgcctatgtggctaatttgactcgatgatcttcatctgacgtggtaatgacacggcgcttacgtgncaatttgatttgaaaaataataaaaactat

SEQ ID NO: 31039 - DNA, 101 bp, rice(Oryza sativa)
  misc_feature (71): n=t or c
ttactgtcggtgggttgtgctgaaaatcggccagcggtcagaccgatctttgatggccggtcagaccgccngaaggacccgaaagcccccgtgggctagtt

SEQ ID NO: 31040 - DNA, 101 bp, rice(Oryza sativa)
  misc_feature (71): n=a or g
cctacgatgcatccgaagctctacaatcctctataagtttctctgttttttttgggatgtctatacatctnttgatagaaaatcccacctcccatctttca

SEQ ID NO: 31041 - DNA, 101 bp, rice(Oryza sativa)
  misc_feature (71): n=a or c
cattcttcccctgggacctcaccccaactgactacatcttcccgccggtggtcaccgtcaagtcccatgtngcagttgcctcctacattctgctgtccata

SEQ ID NO: 31042 - DNA, 101 bp, rice(Oryza sativa)
  misc_feature (71): n=a or g
ctgcatggaatcgtagtgcgacacatgggcaatgccctcgctggctgggaattgtgcgctcttggccaggnatcgtcgccgccactgccagccaccagcca

SEQ ID NO: 31043 - DNA, 101 bp, rice(Oryza sativa)
  misc_feature (71): n=t or c
gggcaaaattcacaagtctgaagttagatgaggtcaaggaggctgccagccgaattgtgggctagatgggncggcccatggttcggccgaaccctcctcaa

SEQ ID NO: 31044 - DNA, 101 bp, rice(Oryza sativa)
  misc_feature (71): n=t or g
agtactaaagatttttttctttttttctccaaaaagcttgttattgctttatgatttcttatacacaggcncatatgcatacatatatatatatgcacaca

SEQ ID NO: 31045 - DNA, 101 bp, rice(Oryza sativa)
  misc_feature (71): n=t or c
aaggggtagttcagagtttcacttacttgccccgtggccccccttcagcagcctcctcttgggagacgacngaagatcgctggtgtcctatgtaagatggc

SEQ ID NO: 31046 - DNA, 101 bp, rice(Oryza sativa)
  misc_feature (71): n=a or c
tccctccgcgccgtctacctccagtacactccctctccgtgcccattctctagtcattcctcgccaactanacaactccagacgttcgacgtgtccggcaa

SEQ ID NO: 31047 - DNA, 101 bp, rice(Oryza sativa)
  misc_feature (71): n=t or c
aaacatatcatctgggggatacgttaattgccagtattcctggcacgtgtactaaacaatcttacgttatnagtgttgaccacactaaattgatttaaaca

SEQ ID NO: 31048 - DNA, 101 bp, rice(Oryza sativa)
  misc_feature (71): n=t or c
aagaatattgggttgtactccagctccacacagttagtgggaagcaaccaagtcagctccatggctgccgncgcccacctggatgggcttcctcggcctcc

SEQ ID NO: 31049 - DNA, 101 bp, rice(Oryza sativa)
  misc_feature (71): n=a or g
agccactaaacagccgtcgtggaaactttacaccttctgtggagacgttcgcgtggtcataatccccagcntcaaaccgttggtcataaacctcggcataa

SEQ ID NO: 31050 - DNA, 101 bp, rice(Oryza sativa)
  misc_feature (71): n=a or g
tgtttcttttttgatggttgaataatatttttttgagccttattccaggtcccagaggtgaacctgaccanctgctctctggaatcctttttttgtttaag

SEQ ID NO: 31051 - DNA, 101 bp, rice(Oryza sativa)
  misc_feature (71): n=a or g
ctctctctctccccccctcgttcgaaaacgacgccttttgcgttgtgttgcgtttgcgcggccgtgctgcntgcgcgcggcgacggcgacgtcgtgcgcgc

SEQ ID NO: 31052 - DNA, 101 bp, rice(Oryza sativa)
  misc_feature (71): n=a or g
cgaatgaagaagccatatggtcgccttagatgcgtcggtgtagtggttgtaaggcgccacgacggcgatgngagtttgcctttggctaaccgtaagtcgat

SEQ ID NO: 31053 - DNA, 101 bp, rice(Oryza sativa)
  misc_feature (71): n=a or g
aaaaaatcaaattaattttttttcttgttccctttttgccactggggatgaaaacagtcacggaaattccnggtcgaccgagcaccatttccatatgagtg

SEQ ID NO: 31054 - DNA, 101 bp, rice(Oryza sativa)
  misc_feature (71): n=t or c
atctaaagcacatttttggttctggagtccattcacaaggagggctatctttggtctttagctggcgttgntgtttttgggacttgttgagagtatagcgt

SEQ ID NO: 31055 - DNA, 101 bp, rice(Oryza sativa)
  misc_feature (71): n=a or g
cgcagagagaggggggggttgcaccactgcacctctctctcctatcacagtggagggcagtgacaaggccnagcttaggtagagatgacaaagcacatcga

SEQ ID NO: 31056 - DNA, 101 bp, rice(Oryza sativa)
  misc_feature (71): n=a or c
aaaaggagaggggggaggagcgctcgggtgggggaggaagaatagtcttaccctctctctctctctctctntatatatatatatatagacacacacaccaa

SEQ ID NO: 31057 - DNA, 101 bp, rice(Oryza sativa)
  misc_feature (71): n=a or t
taccagaatgaactgaattatctcgaaaggttggtgttccaggccgttgtcatgttattattccttttttntaaaaaaaaacaactcaagatcaatactgt

SEQ ID NO: 31058 - DNA, 101 bp, rice(Oryza sativa)
  misc_feature (71): n=a or t
ttcaccaatcattgtatgcgttagttcgtgcgtcataggattgttgtaacctgatttgcgcgtgatctganttgcgcgtgatctgaagttccttagacaag

SEQ ID NO: 31059 - DNA, 101 bp, rice(Oryza sativa)
  misc_feature (71): n=a or t
caaattacaaaaaaattgaatgtcctaagtaaaatttgtctctttttttacactgtgtagttttttttttnaaaaaagaaaagacataactattgttattg

SEQ ID NO: 31060 - DNA, 101 bp, rice(Oryza sativa)
  misc_feature (71): n=c or g
tcctctctgcttctctctcttttcctccctccggcgaccaccagcataccataccatcgccggcttgcttncttccttccttccttccttgggggagagag

SEQ ID NO: 31061 - DNA, 101 bp, rice(Oryza sativa)
  misc_feature (71): n=c or g
agccttgtgtttgcccatccggtgtacactgtttacggtgcccacagcatatatggccatcaaggtcaaantggacaaaagttagcagcaactggcctgtc

SEQ ID NO: 31062 - DNA, 101 bp, rice(Oryza sativa)
  misc_feature (71): n=c or g
cactctcggggtgagcaaatccatctcctctgatttgcttaacctgtccaacatgaacaatgcattttcanttattacaattccaatacaaggcctacaac

SEQ ID NO: 31063 - DNA, 101 bp, rice(Oryza sativa)
  misc_feature (71): n=a or t
taacagagcagataataccccagagaggattgaggcaaggtgatccactgtcgccctatttgtttttgctntgtgctaaagcgttctcttgcctactcaat

SEQ ID NO: 31064 - DNA, 101 bp, rice(Oryza sativa)
  misc_feature (71): n=a or t
cagaccaacacagcagtatgcattccgtcatcatcactacgtcagctcttaaccattcaactggactagtngatgataaattctttgtcaaggcaagcttg

SEQ ID NO: 31065 - DNA, 101 bp, rice(Oryza sativa)
  misc_feature (71): n=c or g
ttacgtactcctaccctactatgctcgcgttcttgcataagcatgcagacgtaagacgatctgaataaggnaacgttcgttcctgggcaatctgggggatt

SEQ ID NO: 31066 - DNA, 101 bp, rice(Oryza sativa)
  misc_feature (71): n=c or g
ttttaaaggattttgagctctgcaacagaggaggttttagagctatgtaacagagaacgggttttagaagnactagttccaaatcttgtgaatgaggtttt

SEQ ID NO: 31067 - DNA, 101 bp, rice(Oryza sativa)
  misc_feature (71): n=c or g
tgcatgtgtgttgcaaatgcagtatgaattccagaatataacatcggaaccacattccttcaatggagatnaatataaggttattataaccaagagcataa

SEQ ID NO: 31068 - DNA, 101 bp, rice(Oryza sativa)
  misc_feature (71): n=c or g
gccatttacatggcctaaagcgcaaatcaagacaagcttcggaatctgcccaagaattcagactgccacanttaaaacagccatatctggagttctactcg

SEQ ID NO: 31069 - DNA, 101 bp, rice(Oryza sativa)
  misc_feature (71): n=a or t
tcctcggggtatctttctcgcattcatcttgacatacttgtgtccgcattcctcttgacttatcgaaggtnggttctcgattaacaggtctgagcggcgaa

SEQ ID NO: 31070 - DNA, 101 bp, rice(Oryza sativa)
  misc_feature (71): n=c or g
agtacctaacacaaagtacaaattcagagaaaatatggacagattttttgcacactcatgcagtctttgtncgttcctcctgccaaacgttgtaaacttac

SEQ ID NO: 31071 - DNA, 101 bp, rice(Oryza sativa)
  misc_feature (71): n=a or t
tctaaagtttattgctacatgccctgcaagtgcaatacaggttaatgactagtattactaactagcgacgnatagacattgggagctagatattgccatcg

SEQ ID NO: 31072 - DNA, 101 bp, rice(Oryza sativa)
  misc_feature (71): n=c or g
acgttggttgcgtgtggctgcggcatcgatcaagtggctaccgtacaagtagtttttactctacttccacngttctaaaatatatactccctccgtcctat

SEQ ID NO: 31073 - DNA, 101 bp, rice(Oryza sativa)
  misc_feature (71): n=c or g
tcggattgctaaaaccggcacttatagaatttttcccacctttgcggggtggaaagttttcaaatctcganttgaaagttttcaaatctggacttgaaagt

SEQ ID NO: 31074 - DNA, 101 bp, rice(Oryza sativa)
  misc_feature (71): n=c or g
acgcacatcacaacctcactgccattgagggagtgactgctgagtggacacacacacacacatattcacanagagagagagagagagagagtgagtgagag

SEQ ID NO: 31075 - DNA, 101 bp, rice(Oryza sativa)
  misc_feature (71): n=a or t
tctagtattttttttaacaaattatatttaccagcaagcatgaagcgacacacaagacaacaaagatagtnttttttttaccacgttaaagcatgagtatt

SEQ ID NO: 31076 - DNA, 101 bp, rice(Oryza sativa)
  misc_feature (71): n=a or t
ggaatggtcataaatcatccatagcatatttttttaatggtttgttgaaaatctaaaatagaatgatgagntgtaaacttagcttttacgtatgtgtgagc

SEQ ID NO: 31077 - DNA, 101 bp, rice(Oryza sativa)
  misc_feature (71): n=c or g
ttgagccggaggtagtcttggctagctactaagttgaattcttggcacatactcctatctatctatctatntatctatctatccatccatctcgatcatgc

SEQ ID NO: 31078 - DNA, 101 bp, rice(Oryza sativa)
  misc_feature (71): n=a or t
caattttctcggtcgcgacatttgagcacaaacatcaactcaaaatggattgagcaggaataaagtcaccntttgaagaaccactcaactcgaagttggcg

SEQ ID NO: 31079 - DNA, 101 bp, rice(Oryza sativa)
  misc_feature (71): n=a or g
ccaatcctttgcaacgttgtgataccgcgagggttctttgagtacctcctagtaagtggaacaaggattcngtcatatataggaacagagatgacgatcga

SEQ ID NO: 31080 - DNA, 101 bp, rice(Oryza sativa)
  misc_feature (71): n=a or g
tcggttagcatcgtttttttggctacagggctggatagcaaggactttaggtcagaaccttttttgtatcngacaaagttcatgtttggaaggtgcacagc

SEQ ID NO: 31081 - DNA, 101 bp, rice(Oryza sativa)
  misc_feature (71): n=a or g
cttttttgatactttgtgggaaatatctgctcatcctgtggatatctgcactgcttttgtggatgaagaantgaattgctttcctttaaacagcattagtt

SEQ ID NO: 31082 - DNA, 101 bp, rice(Oryza sativa)
  misc_feature (71): n=t or c
caatgttaggtacatgaggcagataaccactaaattctccgagtctatggatatcagtcaacaagtgatcnaacaagcacactttgtgaaaatggaatcta

SEQ ID NO: 31083 - DNA, 101 bp, rice(Oryza sativa)
  misc_feature (71): n=t or c
ttgtcatatcaagacgtgagacacgagcgacatgatatgaacctcttgcactgagctcttgaacactgaanctacataaaccttcaaggacgacaatatat

SEQ ID NO: 31084 - DNA, 101 bp, rice(Oryza sativa)
  misc_feature (71): n=t or c
gcatctacacatggaggcctatctgctttgttcgatgggcttcctgtattaactccaccatctccagcacncaatcactgcaaatccccacgttgaacatc

SEQ ID NO: 31085 - DNA, 101 bp, rice(Oryza sativa)
  misc_feature (71): n=a or g
gtgaaactattgtcttaatgattacttcgtttgtgtttcaataaccgggaactaaatgagctccttagccntcaattaacacactaataaattagagaaaa

SEQ ID NO: 31086 - DNA, 101 bp, rice(Oryza sativa)
  misc_feature (71): n=t or c
gatgcatgtgtcggacatgaatagcttggggcagtgccaacagaaggaagggatgcagcttaagaaggttnaggctggtgcactggtgaaaggaattgcta

SEQ ID NO: 31087 - DNA, 101 bp, rice(Oryza sativa)
  misc_feature (71): n=a or g
ttcattcatgtggccatccatccaccatcttgcatgctagctagctaccctgcaggcccataacgacattnttcaattcgaattaattccatcatcatata

SEQ ID NO: 31088 - DNA, 101 bp, rice(Oryza sativa)
  misc_feature (71): n=a or g
acaaaaagatacagaagaggagatccgtcctgatgaatctgaagagcaagaggaagaagctgaagctccantggagagcgatggcgcgaagcaaggaggag

SEQ ID NO: 31089 - DNA, 101 bp, rice(Oryza sativa)
  misc_feature (71): n=a or g
ggccaccttcaattaattttgcttcagttttcatcagaaaggctctggtttttaatgttgttgctgggttntttcgttgattgccgagaattcgagcatgc

SEQ ID NO: 31090 - DNA, 101 bp, rice(Oryza sativa)
  misc_feature (71): n=t or c
atagagaggagagctagcgaaagtttgagtgacaaagacgcacgtacgcgcgaaaacgttgtcacgctttngagtgatcgatacacgggggggatacacac

SEQ ID NO: 31091 - DNA, 101 bp, rice(Oryza sativa)
  misc_feature (71): n=t or c
aaatcatagaacaccaacaacctgcaaggaaacgaagaatcatcatcctcccccaccttcacctccgaggntgcccatcatagggcacctgcacctcatcg

SEQ ID NO: 31092 - DNA, 101 bp, rice(Oryza sativa)
  misc_feature (71): n=a or g
tcaatttcacgcaccggtggcagccctggtggtacgtccttgggaaacacatcctaatacttctgcaaaanattagtgaccacaagaagaaaagagatagg

SEQ ID NO: 31093 - DNA, 101 bp, rice(Oryza sativa)
  misc_feature (71): n=a or c
attaaaggctcaaaggtgcaccatgttggaaggttgctgggccttattttccacttgtttgtatggctttnaaactttgttgagttcaagggtgcggggta

SEQ ID NO: 31094 - DNA, 101 bp, rice(Oryza sativa)
  misc_feature (71): n=a or g
tagatggcgcgtggttccttatttgcctgaaagatgtcatcaatggagacccaaagatcacgggctgtctngtccggctccatggcgacgtcaagaattgc

SEQ ID NO: 31095 - DNA, 101 bp, rice(Oryza sativa)
  misc_feature (71): n=t or c
tgagatgagatccaacctgatttcgggggatggctttgacttgcggtgtcaagctccaagtggcagtgcanggcctcggcaagcggcggaagcttggcggc

SEQ ID NO: 31096 - DNA, 101 bp, rice(Oryza sativa)
  misc_feature (71): n=a or g
acacgcagagagctggattgggttcagataaactcgagagactttttttttgttttggtagtactaacctnacaggctgcgataggctcgtcagaggatgt

SEQ ID NO: 31097 - DNA, 101 bp, rice(Oryza sativa)
  misc_feature (71): n=a or g
caaatcaagggatgacaaagaaagtggtagagccagtaaataaccgtcatttgcctctctataagataatnatcacacactctgctctcagctctctctct

SEQ ID NO: 31098 - DNA, 101 bp, rice(Oryza sativa)
  misc_feature (71): n=t or g
aaagggatttggtttttggtgcccttctcttcttccatttgctcagctttgcttctccactctcccctctngctacttcagctgctgcctgccaagcaaca

SEQ ID NO: 31099 - DNA, 101 bp, rice(Oryza sativa)
  misc_feature (71): n=t or c
acacacttgcctgatcgagatttgggtctgctttgtaaatctccttgaagtaatcagtagccaacttttcnatagttgttgccgtattatgaatagtacca

SEQ ID NO: 31100 - DNA, 101 bp, rice(Oryza sativa)
  misc_feature (71): n=t or c
aactgggacaccgagcagctcttcctcaatagaggttgagtcagatgatatttcctcagccgacagcccgnagacaggccagctcaaccagtttcttgctc

SEQ ID NO: 31101 - DNA, 101 bp, rice(Oryza sativa)
  misc_feature (71): n=a or g
tgattgtctgaccctttcttcaaatttatcacatactgcaaccccataagcttaaggaaggctttttgttncatgtttgtactgagttgctgatcagttaa

SEQ ID NO: 31102 - DNA, 101 bp, rice(Oryza sativa)
  misc_feature (71): n=a or c
gggggtgtcaggcttaccggcccgaagacacgcctcttagcaagcgagcgtaattatgtctcaatcgcttntttccatttgacccaatctgagcgctttct

SEQ ID NO: 31103 - DNA, 101 bp, rice(Oryza sativa)
  misc_feature (71): n=t or c
cctcttcttccacgactgcttcgtcagggtcagtacactaacacccgcaaaccagctactctctccgtccnagtatgtcctaatttaattaggatgagatt

SEQ ID NO: 31104 - DNA, 101 bp, rice(Oryza sativa)
  misc_feature (71): n=a or g
taaggttaatcttgctagaaaattacttaatctttgttcttggcacaggtagtcgaaaaatatcgcctctnaaggtcagcactgaggcatgggggagtgca

SEQ ID NO: 31105 - DNA, 101 bp, rice(Oryza sativa)
  misc_feature (71): n=t or c
gtgaagcacgacgaagatgacgatcatggtggacaaggacggtggcggcggtggtgacagacgagggtggngacccagtggagtgcgatggcgggcatggt

SEQ ID NO: 31106 - DNA, 101 bp, rice(Oryza sativa)
  misc_feature (71): n=a or g
tgacgactgtgtctatggatttgttttgtttgtgaatcatgttgcctctatgtgaatttgcgatgcttctntgaatttgatttggtttgattggattggac

SEQ ID NO: 31107 - DNA, 101 bp, rice(Oryza sativa)
  misc_feature (71): n=t or c
cttcgtgatccaagatctgcacatcaaatcacattagaacatataaattcgattagaaaaaaaattaaccnagtaagatagacacgtggcatttaacgtgg

SEQ ID NO: 31108 - DNA, 101 bp, rice(Oryza sativa)
  misc_feature (71): n=a or g
tctagaagattcagattcctctcttgaaataccagccgaaatttctcagctccttcatgagtcaatcttcntccctaccgttataacccagcccagaagga

SEQ ID NO: 31109 - DNA, 101 bp, rice(Oryza sativa)
  misc_feature (71): n=a or c
tcgatcgctgctcctgtcgcccaacgattgatcgcgcattaggagtttcgttccatttaggtataaagtanactgacttccctagcatttctggtaattca

SEQ ID NO: 31110 - DNA, 101 bp, rice(Oryza sativa)
  misc_feature (71): n=a or g
actattttggccttttgggtaagcacagacccggccataaaagtaaagcagccgatcgagcagcggtgcanccgccattcgtgcacaggcatcatggcgac

SEQ ID NO: 31111 - DNA, 101 bp, rice(Oryza sativa)
  misc_feature (71): n=t or c
ttgaagaggcacatatcgcgtatacaatgtcggtcataaacaactagatagagcctcccacgggattcgangaccagatgtgggaatgccagctcccaaca

SEQ ID NO: 31112 - DNA, 101 bp, rice(Oryza sativa)
  misc_feature (71): n=a or g
tccttagtgtcttgcaaataacgaaagacctttttaacagccttccagtggtctactcctagattggactnaaatctgccatgcatcccggtaacaaatgc

SEQ ID NO: 31113 - DNA, 101 bp, rice(Oryza sativa)
  misc_feature (71): n=t or c
atagaaccttgtccgatccagaactccggctatttccacaaccaccgctgctggaagccctccttgctccncacccccgaggaggaggccgccctcgtcgc

SEQ ID NO: 31114 - DNA, 101 bp, rice(Oryza sativa)
  misc_feature (71): n=t or c
cggtggacatgatctccatccatccccaataatactccaaaacataatcaaggaggaagctaagggcctcnatctaattgattgctagccattactgtact

SEQ ID NO: 31115 - DNA, 101 bp, rice(Oryza sativa)
  misc_feature (71): n=t or c
gcagcagccaaccccatcgccactgtactccatggcagagcactaccgtggagattgagagaggggccacnatgtggggctgggccgctgggcgttggagg

SEQ ID NO: 31116 - DNA, 101 bp, rice(Oryza sativa)
  misc_feature (71): n=a or g
aaacgaaacaaggccggacggcccaagtcaagaagagaaaggatccagtcaaaatctgagagagccgaatnctctcttccccaaactatctccgcctcttc

SEQ ID NO: 31117 - DNA, 101 bp, rice(Oryza sativa)
  misc_feature (71): n=a or c
ttccagactgagaacagaggcatcccatggcaaaccgtcacattgtcagccttctccaccatctctgactncggtgtcggcaaaacccagctgttgccccc

SEQ ID NO: 31118 - DNA, 101 bp, rice(Oryza sativa)
  misc_feature (71): n=a or c
aggtattttggcccaaaacaatcaataatacctttgcagaaattaaccaagctctcaatgacagtggtctnagctatttgtaaattttcatcaagtatatc

SEQ ID NO: 31119 - DNA, 101 bp, rice(Oryza sativa)
  misc_feature (71): n=t or c
attatttcttgaaggcccaattaatttcgggctgggccattagcaagcaagccgcgtcgaatttgtcgctntgaatgggccggaaatgctagggttaccgt

SEQ ID NO: 31120 - DNA, 101 bp, rice(Oryza sativa)
  misc_feature (71): n=t or g
aacaaaaccaaatctacagcgaaacgatcggagcaaaagaatcgaacttttcgacgggatgagcatagcangtcgaggagatcgattggaaggatgagaga

SEQ ID NO: 31121 - DNA, 101 bp, rice(Oryza sativa)
  misc_feature (71): n=a or g
tcggagaattgattcgctggaggctttcctcaaatcattcaagtttctgtcaacgttggatcttcaaggtntttcaatcaagaggctacctaagattgttt

SEQ ID NO: 31122 - DNA, 101 bp, rice(Oryza sativa)
  misc_feature (71): n=a or g
cattgtacccagattttgactcacattttcggtgaccatctatttcttcaatttaagtaattgcctctcanattgtctggtggatttggaatgtatttatt

SEQ ID NO: 31123 - DNA, 101 bp, rice(Oryza sativa)
  misc_feature (71): n=a or g
ttattgccgcctcctaggagcacctaccactcaacccctcgatcgattcctaccgattcttgattcccccnacgcgaggaacaggacgatgctcgcttgca

SEQ ID NO: 31124 - DNA, 101 bp, rice(Oryza sativa)
  misc_feature (71): n=a or g
agccctttgggagggcctatcaagatccataccctcacttcagaagggtcctgataaagatgaggaagctngctttgctgttgatgcttcaaagatgggca

SEQ ID NO: 31125 - DNA, 101 bp, rice(Oryza sativa)
  misc_feature (71): n=a or c
gtgcgcaccgacgccggccggccgcggcggcgatggctggctttccgctgatcacatcagcgatcacttgngcagtgggcatcatcttcttctccgtttgc

SEQ ID NO: 31126 - DNA, 101 bp, rice(Oryza sativa)
  misc_feature (71): n=a or g
gcgacccatacttcaatactttcaatctggttagctttatgcttagctgtgttgtgtgtttactgcagccnattcttctgtgccaaagaaacatttgactg

SEQ ID NO: 31127 - DNA, 101 bp, rice(Oryza sativa)
  misc_feature (71): n=a or g
ttgctagactctggtgtatccttgttggttgttttcttctcgtcgcccgtttttcctttcccatctttctnacggagggcgtcatctgcatgggcgcatct

SEQ ID NO: 31128 - DNA, 101 bp, rice(Oryza sativa)
  misc_feature (71): n=a or g
gtttattttcctttcatttctacaggcagattttgacctttgttctgattgctacaacgagggaaagtttnatataggcatggcaaaaaccgatttcatcc

SEQ ID NO: 31129 - DNA, 101 bp, rice(Oryza sativa)
  misc_feature (71): n=t or c
aaatcattgttttccttttcttttgctagatgagcctccctttctcttgccaattgtgccgcctcatcttnagcttgtttggttctcatatcaaggtacct

SEQ ID NO: 31130 - DNA, 101 bp, rice(Oryza sativa)
  misc_feature (71): n=a or g
cagaccgcttgacgaaccagtaatccccttcggtcgccttcatagaaattgcacaaattggagatttgctnttgagccgtagattttggtgtaggtttcac

SEQ ID NO: 31131 - DNA, 101 bp, rice(Oryza sativa)
  misc_feature (71): n=t or c
agcatgtacggaagccataatcaagctcatacaaacccccaagtgcctttgtcaaacagttatctcagtgntgataactccaagaatttctctcagcaaca

SEQ ID NO: 31132 - DNA, 101 bp, rice(Oryza sativa)
  misc_feature (71): n=a or g
tcactttctggacgaagttctcctttgcaatgctcgcagtgaaaatagtcatccatatcgctgacaagttncagtgcatcaaatgctgaatacctatggtt

SEQ ID NO: 31133 - DNA, 101 bp, rice(Oryza sativa)
  misc_feature (71): n=a or g
agggcgtcgggcggcggacgcagggaagcagaagaccgcgttttctttttgatagacagaatgactcaacncgatggtgtattgatcatggagcattacat

SEQ ID NO: 31134 - DNA, 101 bp, rice(Oryza sativa)
  misc_feature (71): n=a or c
acaatgatgcaaaagtaatgctgtattctttatcatgtggaaagtacagcatcctaaaaaaggagccgagnaacaaaacaattgctccagacgacatattt

SEQ ID NO: 31135 - DNA, 101 bp, rice(Oryza sativa)
  misc_feature (71): n=a or g
gagcaagcgatcacaactagtggacttggcaacggctcagaggatgaggttggaaagcttagaacaataanaatagaagaagcttaacgagcagcacagca

SEQ ID NO: 31136 - DNA, 101 bp, rice(Oryza sativa)
  misc_feature (71): n=a or g
caaatttcttcaaagtcatatgggcattgcatcaattttctgtcactggacggttcaatgacagagctacnttcaagggaatctttttccttcgtatcaga

SEQ ID NO: 31137 - DNA, 101 bp, rice(Oryza sativa)
  misc_feature (71): n=t or c
ctaatgatcaccgtgaacaatatggcattcatgagtctcatggaatgactagccaaggacctccctaccgncaccagcgtgatcagaagcgccagggcaat

SEQ ID NO: 31138 - DNA, 101 bp, rice(Oryza sativa)
  misc_feature (71): n=a or g
agggccattcatagatgacctttcgatctgtgttacaggcatgaaggccaatgcagtggtaggtgcaggcngtgctgatggtttggctgaagagatgaagg

SEQ ID NO: 31139 - DNA, 101 bp, rice(Oryza sativa)
  misc_feature (71): n=a or g
aacaaaacggtctaaatcatcattctgctcatcagaaacttcatcaccacactcagcctgagactgacttncacatacatcattctcaatgctgccctccc

SEQ ID NO: 31140 - DNA, 101 bp, rice(Oryza sativa)
  misc_feature (71): n=t or g
gttcggtcctgctaaccggtgtgttaggtttcctccttgtctacctccagctccttcctatccgtctcctntggttagtgccattggtagccccgctcggc

SEQ ID NO: 31141 - DNA, 101 bp, rice(Oryza sativa)
  misc_feature (71): n=a or g
cgaggcgctccacgttcatggaagcttcgagaaggaatggaacgggaagacgatacgtgggggccgatctnattggagttttttttttcttttttttttcc

SEQ ID NO: 31142 - DNA, 101 bp, rice(Oryza sativa)
  misc_feature (71): n=a or g
ctgggcgcaaaaggacttcgctgtactcatcgccctgtactactccatcggatgtcctcaacgtcatcatngagcccatggtagttggcccacgacccgtg

SEQ ID NO: 31143 - DNA, 101 bp, rice(Oryza sativa)
  misc_feature (71): n=a or g
aggattcattctttatgatatgcagaagttcaagcacataatgagggaactgcagggagctatacttgtcngttcagttttccagatcattttgggataca

SEQ ID NO: 31144 - DNA, 101 bp, rice(Oryza sativa)
  misc_feature (71): n=t or c
gaaaaaaaaaacagcgagctcccaccacccaccaataccagcggcagtaaattttgagctgcggctgctgntgctgcttggactccacctcggcacctcgc

SEQ ID NO: 31145 - DNA, 101 bp, rice(Oryza sativa)
  misc_feature (71): n=t or c
acaaatgtttgatatatacttactggttgaacctggagttgaagctgtgcgtcctgctgattcttgctcgncagtgctggtggagtcaatggcctatacat

SEQ ID NO: 31146 - DNA, 101 bp, rice(Oryza sativa)
  misc_feature (71): n=a or g
tgcttcagcatcaacaggtaagaacacctggtttactctggtttcatcccaggcaccattttctgacagcngttccgagacccattttagtctgcagttac

SEQ ID NO: 31147 - DNA, 101 bp, rice(Oryza sativa)
  misc_feature (71): n=a or g
ctaagaaaggattcaattcgatgtggattgggctagatttggtttgggcatcatggtagaaaattagattntggtgcatttgctgcaaatgctgctagttt

SEQ ID NO: 31148 - DNA, 101 bp, rice(Oryza sativa)
  misc_feature (71): n=a or c
aagatttgctaacgatcccgaaaaagaaagcgatgccctccaaaaggtcacctttgatcaacaatgtgatntgcttgcctgtgatggggagtctgtatgtt

SEQ ID NO: 31149 - DNA, 101 bp, rice(Oryza sativa)
  misc_feature (71): n=t or c
gtcgctgggcatttgattggaatggcaatatcactagccctaatagttgctcataagagaagaggtcgtgncaaagctgactaggtagcctatggatgtca

SEQ ID NO: 31150 - DNA, 101 bp, rice(Oryza sativa)
  misc_feature (71): n=t or c
ttttcaatctccaaggtgatcccacaaggaattaaaatctcactgtcatggcagatggaagtctgaatggnggagtcaacatagaaggcatcaactactac

SEQ ID NO: 31151 - DNA, 101 bp, rice(Oryza sativa)
  misc_feature (71): n=a or g
acaaatagggagcaagctatgagagcattgcgtgactgcattgccgatgttgtctacaatcacttgagacncgcatgtcatctccaatcagactagtatct

SEQ ID NO: 31152 - DNA, 101 bp, rice(Oryza sativa)
  misc_feature (71): n=a or g
catataactttgtgacgaattgtattgcctctgatttctgaagcgtgcaacatcatctagttggatgaccntgcgcgctgcaacgagttttaaatacataa

SEQ ID NO: 31153 - DNA, 101 bp, rice(Oryza sativa)
  misc_feature (71): n=t or c
cccaaatcaagaggagacaagtgaacaaaatggagtcagacacttatgttgatgatggcggacttctcggngttggtgaactcgcagacgacactcgtcgg

SEQ ID NO: 31154 - DNA, 101 bp, rice(Oryza sativa)
  misc_feature (71): n=t or g
tctcgtctcatggcatctgttgttgctccatctgtgtttctagcttgggatagtgcagactccctgtgccnagaactagttttgaagatcatctgcgagct

SEQ ID NO: 31155 - DNA, 101 bp, rice(Oryza sativa)
  misc_feature (71): n=a or g
tcccgcgccagcacgtgtgatgatgacctcccatttccgagtagcccgaggaacacggacgaatgtcactntggcctccactggagctcgaacgcaacacc

SEQ ID NO: 31156 - DNA, 101 bp, rice(Oryza sativa)
  misc_feature (71): n=t or c
cctcctatacaagattagtagcagtacaagaacaagagctgtgtgtactgatcaatgttagagataatgcnaagacctgattaggattaaattagttctcc

SEQ ID NO: 31157 - DNA, 101 bp, rice(Oryza sativa)
  misc_feature (71): n=a or g
ttgtgccagagccacctcaacctcaaggccctcgtgaacttgtccaaatttagaactccaagtccaccctngctggttggcaagcatgtctttgtccaatt

SEQ ID NO: 31158 - DNA, 101 bp, rice(Oryza sativa)
  misc_feature (71): n=t or g
atgcacaacctttactatatgtagggtatcttttttgggggtatgtgctaatgccatgttcttctcagatngaattattgcatgtacgcttctaggctgcg

SEQ ID NO: 31159 - DNA, 101 bp, rice(Oryza sativa)
  misc_feature (71): n=a or g
aaacgggaaattaacccgcagtagttgccgcccgttccttccaccaatacgtacctcgatggagatcatgnaagagccgccgccggcagcgggaggcgacg

SEQ ID NO: 31160 - DNA, 101 bp, rice(Oryza sativa)
  misc_feature (71): n=a or g
cagaacatgttcgacggacctctaccgggtcttccattacatctggttagtttctctgcagaatccaaccngctgtcaggatctatccctgccaagatatg

SEQ ID NO: 31161 - DNA, 101 bp, rice(Oryza sativa)
  misc_feature (71): n=a or g
ccaaatcctccctgtcccagctttttgctaaagttattagtcgcctctctcagctgtttgtaggagaaccntgttggcatgccagccagtcctttaaatgg

SEQ ID NO: 31162 - DNA, 101 bp, rice(Oryza sativa)
  misc_feature (71): n=a or g
aagcttcgagtagttatcatcaggtatacttctatgcctagtagcacaggttgaagcaccaagatttgagncactctgcacacccatagtaggatccctta

SEQ ID NO: 31163 - DNA, 101 bp, rice(Oryza sativa)
  misc_feature (71): n=t or c
caacaacacactggcacacttcagggtattcgctcactcagattattgggaaactcaagtggtagcatctnagagccgtgttattctcctgttaaaacaat

SEQ ID NO: 31164 - DNA, 101 bp, rice(Oryza sativa)
  misc_feature (71): n=a or g
tgtcaaatcaaaatcacaaaatatcaagagcttatctttcggaccacaatatcttgagagtggagctacancaggttggtctactggctgagcagagaaga

SEQ ID NO: 31165 - DNA, 101 bp, rice(Oryza sativa)
  misc_feature (71): n=t or c
ctccggcatgcatgatgacggcgaagtttggttacgcgccggcccgtgtagcgacatagcaggcattgtcngatggagtagccgccgaatttggggccctg

SEQ ID NO: 31166 - DNA, 101 bp, rice(Oryza sativa)
  misc_feature (71): n=t or c
gcacaatgttgacaactgtagtagaacatccgacatcaaaccagttgttccactttcacttgccatattgncagggcaatcaatttcatcaagtatatctt

SEQ ID NO: 31167 - DNA, 101 bp, rice(Oryza sativa)
  misc_feature (71): n=t or g
gacgcggcggcggcgggcggtgccgagcggatggatgttgattccaggagttggaatgaaaatctgattcnccatgtaatgaagaaggaagatgctgatga

SEQ ID NO: 31168 - DNA, 101 bp, rice(Oryza sativa)
  misc_feature (71): n=t or g
ccgcatccgccaatagaccaatatcgcccaaatggactccgagatgtctcatgttggttagctcaccgagncactcgatattgttcaccgagtttagtgcc

SEQ ID NO: 31169 - DNA, 101 bp, rice(Oryza sativa)
  misc_feature (71): n=a or g
aaagagtgggagttcatggatagcctggccaattgtactgagctagaagttttctccgtagcgagaaatcntttacaaggccaagtaccaagctcactaag

SEQ ID NO: 31170 - DNA, 101 bp, rice(Oryza sativa)
  misc_feature (71): n=a or g
gagatccttccatccacttcaagatatggacaggcttcaacatcttacgcttcatcttcgtcgtcctcctntcgaccaccaccgtccaagaagggtgggat

SEQ ID NO: 31171 - DNA, 101 bp, rice(Oryza sativa)
  misc_feature (71): n=a or c
atacatgcaagaaataatcccaaatgttgcccagcctctcattggattactctctttttcttgtatatganctacacaaacaaacaaatgcataactcaca

SEQ ID NO: 31172 - DNA, 101 bp, rice(Oryza sativa)
  misc_feature (71): n=a or g
tccaacaactcctatcttttcaccaccactaatgcttacagttatgcctttcaaaattagaggtgtattcngtcggtacctaacctgaaaggataaaaatg

SEQ ID NO: 31173 - DNA, 101 bp, rice(Oryza sativa)
  misc_feature (71): n=a or g
ccaaccctcctacgcttctcccccctctcctcgcaccagtgctgctcacggtcatccaccttcaccttctnatcgttcccaaccctcctgcgcttctcccc

SEQ ID NO: 31174 - DNA, 101 bp, rice(Oryza sativa)
  misc_feature (71): n=a or g
gagatcacagagttcatgaacaaaataaggagttccttttaccttttctgtgcttgtggatggttcatcanaaccagatacctcagcaccagatcccctta

SEQ ID NO: 31175 - DNA, 101 bp, rice(Oryza sativa)
  misc_feature (71): n=t or c
aagcagaaacacagcagtaccattagcaggttgatatatgagactaacctgaatgacagcattttgcgtantctaggtgcacgtggcatgtccatgaataa

SEQ ID NO: 31176 - DNA, 101 bp, rice(Oryza sativa)
  misc_feature (71): n=t or g
tgcaattgtatctaaaagtctctcttcacgagtcttaacccctgtttgacttgaaccagtatcatcagttngtgcagaactggatggactaggaccccatg

SEQ ID NO: 31177 - DNA, 101 bp, rice(Oryza sativa)
  misc_feature (71): n=t or c
gaacaaatctctttatatgttttccttgcacagtgtttacggtagcatgtctgaattttcaatgaagctgnctctctacgcatagtttcataccgccatct

SEQ ID NO: 31178 - DNA, 101 bp, rice(Oryza sativa)
  misc_feature (71): n=t or c
ctaaaaaggccctcagtcctcagcttcagtgcctcacgcttgcaacaatatcgtcctccctgtccgtgtantgtgaatctgccatctgtgacttcgtgaga

SEQ ID NO: 31179 - DNA, 101 bp, rice(Oryza sativa)
  misc_feature (71): n=a or g
aggggaggaagaacagagatggtaccatgagtttgggccttgctgctctccatgaccgaatggaaaattgnggggaatgccgccccatcctcctccttgag

SEQ ID NO: 31180 - DNA, 101 bp, rice(Oryza sativa)
  misc_feature (71): n=t or c
atgtcacctattgtagattctaaactccccacagtaacctggattttcttcagattgaaagaatggcccancatggtgtgtcccttgaaggtgtcaagcat

SEQ ID NO: 31181 - DNA, 101 bp, rice(Oryza sativa)
  misc_feature (71): n=t or c
gtactatacaagaacttcagtgtgctaaatttgctctatcatttcttgcctctagcagatctcagtcagtngattactagctttcctttatgaccttgctg

SEQ ID NO: 31182 - DNA, 101 bp, rice(Oryza sativa)
  misc_feature (71): n=a or g
tgacgatgtcgtggacttctttgaccttttatgcacggaagacaggattaatgcttcagggaatggaaatntggagtgggaaggatttgactacttgatca

SEQ ID NO: 31183 - DNA, 101 bp, rice(Oryza sativa)
  misc_feature (71): n=t or c
agcgtggacaaatcaagttgtgcgcacacattaagtgcaattacattttctcttgggcattgactaccgcnagatggtgttggtggctgcgtgggtgctat

SEQ ID NO: 31184 - DNA, 101 bp, rice(Oryza sativa)
  misc_feature (71): n=a or c
cgttcacatttgcaataggaacctcaaagaatttttgatgctcctggagaataccacatgatacaaaacgnttctcttctaccatgccattatgaccatca

SEQ ID NO: 31185 - DNA, 101 bp, rice(Oryza sativa)
  misc_feature (71): n=t or g
gcagtttgccttttgttgaactgggtgatagcctgctttcagcgaacaaagttcataaacctcaccactancgcttgacacatttagtacttttaatagtt

SEQ ID NO: 31186 - DNA, 101 bp, rice(Oryza sativa)
  misc_feature (71): n=t or g
accaccagctgcagggatcccattcactacatgcccgctggatagaccacaggccattgagtcaatgtgangctggccaggagcaggcatcataggttgct

SEQ ID NO: 31187 - DNA, 101 bp, rice(Oryza sativa)
  misc_feature (71): n=t or g
cactagctttcatggcttcaatgtggcagcattgtagtgtaaggaataccctattaagagtagttggattntagtcacggtattccttgtgaacattctct

SEQ ID NO: 31188 - DNA, 101 bp, rice(Oryza sativa)
  misc_feature (71): n=t or c
caagctattctctttctggactggacaacatacatcgggtctgttcgtccaggattaggagatatatcaanagcctgtaaagaaaacaaaaaccgttcatg

SEQ ID NO: 31189 - DNA, 101 bp, rice(Oryza sativa)
  misc_feature (71): n=t or c
atatgcatatgcttggaaaggttctgcgcagcttgttcctgaactcaataatgttcttatctatcaaccanccgggaaaccattacaatggaaaaatccct

SEQ ID NO: 31190 - DNA, 101 bp, rice(Oryza sativa)
  misc_feature (71): n=t or c
attacatagtaccctgcaaacaattttacctgggcatgcagatgaaagcatgggaagattttttccagctnctttgccactagataactggttttgatgat

SEQ ID NO: 31191 - DNA, 101 bp, rice(Oryza sativa)
  misc_feature (71): n=a or g
tcgtggatcgagctgttcttccttcgcttcccttgtactatactctatatctagggttttgaggaggaaanaagaagaagaagaagaagaagggctaattt

SEQ ID NO: 31192 - DNA, 101 bp, rice(Oryza sativa)
  misc_feature (71): n=t or c
aaaaaaagcaagaataaggagaaggttgcgcaaagagcagggaattcaagtgattctactgcaaagcagangaatggacccaaggagtattacagtgcaac

SEQ ID NO: 31193 - DNA, 101 bp, rice(Oryza sativa)
  misc_feature (71): n=t or c
tccattcactattaaaattgatcaccagtccctttgtcatttggatgatcaagtattggggagtgaattanaaaagaaagccatgactaaattgattggtc

SEQ ID NO: 31194 - DNA, 101 bp, rice(Oryza sativa)
  misc_feature (71): n=a or g
acgctaaaattgccatcctcttctcaaactgcagttgcacgctaccgtgatgaatgcaaggttcaggaagnggtaacacagtaaatcttctctctgcatct

SEQ ID NO: 31195 - DNA, 101 bp, rice(Oryza sativa)
  misc_feature (71): n=t or g
tattccgcagaaaaaggaatcgttttgtctgcttatttgtagcaccactcgaacggcttcctcttctgctncagctgatgcgctcccgagctgctgccgcc

SEQ ID NO: 31196 - DNA, 101 bp, rice(Oryza sativa)
  misc_feature (71): n=t or c
gacctgaaccaacttgccgatgtctgtgtggtcatcagcagggtccaatccatctggaatggagagcatgngaattccaccagggattgctcctttctctg

SEQ ID NO: 31197 - DNA, 101 bp, rice(Oryza sativa)
  misc_feature (71): n=a or g
ctccaccaatgtccgtggggaggaaccatggccaacaatggaattatgttcttcttgttgctggagcaccnttatcttcttctcctattattttctgttgc

SEQ ID NO: 31198 - DNA, 101 bp, rice(Oryza sativa)
  misc_feature (71): n=t or c
tttttggcaattcggcatagcagaaattagaaaatattagttatctctcatcttaccgcgcgttcttcggngattccctgatttcgtcctcctcccggcga

SEQ ID NO: 31199 - DNA, 101 bp, rice(Oryza sativa)
  misc_feature (71): n=t or g
ttgtctgagagatttagatatcttagatgttgtaggtgtcttggcctgattggtaattcttcccttcttgngagctctaatgctcttagctgtagagaatt

SEQ ID NO: 31200 - DNA, 101 bp, rice(Oryza sativa)
  misc_feature (71): n=a or g
ggagcggtccccccgtcgagctggtgaagctgaaaacgataggaaggaagttgccgatgctgcccggccangccgtggtgaactctcgtcgatggagcgcg

SEQ ID NO: 31201 - DNA, 101 bp, rice(Oryza sativa)
  misc_feature (71): n=t or c
ggtgtggattgttcattattattctgatccttctcttggctgccactgatcatcgtcttctccaccacaancatctctgtagaaattttgtggtgggattg

SEQ ID NO: 31202 - DNA, 101 bp, rice(Oryza sativa)
  misc_feature (71): n=t or c
aagaacgttgtgaagaccaaggttacaggagcactgaagctagtgttgaaagactttgacctgaacgtgcntgttgtggcaacgatggtgggagacgaggc

SEQ ID NO: 31203 - DNA, 101 bp, rice(Oryza sativa)
  misc_feature (71): n=t or c
tcaggtggaggacacactatctctataatcaggtaagaactcctaggtccattatagagatagtgcgtccnagacgaagttacaagcccatagacccatta

SEQ ID NO: 31204 - DNA, 101 bp, rice(Oryza sativa)
  misc_feature (71): n=a or g
aaatctgaactaatcggtaaacctccaataggcaaacccaaaacaatatgaactgattctttggaaagtgnaatgactttatctctaacgatgatatcaca

SEQ ID NO: 31205 - DNA, 101 bp, rice(Oryza sativa)
  misc_feature (71): n=a or g
aacaaaaacatcactcccgtcacatacgatgaaatcaattgcagccaatcttgaagagaacggaaggaacngtttcaaatcattcccagcaagcatttctt

SEQ ID NO: 31206 - DNA, 101 bp, rice(Oryza sativa)
  misc_feature (71): n=a or g
tgggtgttctgatgcgtctgtttgcctctgtcgttgcagatctggtgaggtttttgaatctgagcaggagnctgaggagggtaagtgagaagtatggcaga

SEQ ID NO: 31207 - DNA, 101 bp, rice(Oryza sativa)
  misc_feature (71): n=a or g
ttgattagaaaccatgtgggggcttacttccttagttgtgtgattagacacaaatttaaccaaaaaacctnggaaattgttgtggtgtatggccctgttac

SEQ ID NO: 31208 - DNA, 101 bp, rice(Oryza sativa)
  misc_feature (71): n=a or g
gataaagcaagattttctagaactcttccctgatatgattgtatatgaccctccagatagcctgtcagatntggacgatgaattcaaattttgatcagtta

SEQ ID NO: 31209 - DNA, 101 bp, rice(Oryza sativa)
  misc_feature (71): n=a or c
ttataatgtcgaacaacaattcaagatggactttgcctgtcatgcaagcttgctacttgtttttttgaccntgtgtgcagtcagtttgtgaagaaccctac

SEQ ID NO: 31210 - DNA, 101 bp, rice(Oryza sativa)
  misc_feature (71): n=a or g
ggcgatggggtgatggtggcaaaaggtggaggggactgattccgatggtttttgtgtggattttgttgcantggcttcaaagagaaggaagtagcaaggaa

SEQ ID NO: 31211 - DNA, 101 bp, rice(Oryza sativa)
  misc_feature (71): n=a or g
gtgtgtagcagctggttatttgattggattctgtgagttttatggtagtcgattgggtgactgcgtgtgcnccaaatgcacaaatgctgtgcaagccggcc

SEQ ID NO: 31212 - DNA, 101 bp, rice(Oryza sativa)
  misc_feature (71): n=a or g
ttgcttgttagatttgtgcattgagcggcgtagagtaggcacgtataatggtgcacaaatgagtggtgaanggtaccaagccatcgtcgacggcttacttg

SEQ ID NO: 31213 - DNA, 101 bp, rice(Oryza sativa)
  misc_feature (71): n=t or c
tcttacatctgacagctgttttggttgcagctaacttgtggaatatgttttgaagggtattcttctgatgngatgagttctgctgattgtgatcattttta

SEQ ID NO: 31214 - DNA, 101 bp, rice(Oryza sativa)
  misc_feature (71): n=t or c
tgacgttcaatttcatccttcagtgcaggtttatacctatagggtcgaagattaacaggttttgcaccttncactaatggtatatggtggtcacacatcct

SEQ ID NO: 31215 - DNA, 101 bp, rice(Oryza sativa)
  misc_feature (71): n=a or g
accttcccaccatttcggatcttgcgatgaggggttatctccatcctcaggtttctcagtagccatatgcncaacatcttctacagcgttatcttcgttgt

SEQ ID NO: 31216 - DNA, 101 bp, rice(Oryza sativa)
  misc_feature (71): n=a or g
ctttcaagttcgtgatgcttggttttgtttgagaccgttcgtctgcttgcagctatgcagtttttccttcngatctagtaatttttatgataaggtcaagt

SEQ ID NO: 31217 - DNA, 101 bp, rice(Oryza sativa)
  misc_feature (71): n=t or c
gggctaaagcgatgttcccagctgacacggaagtctcgcgcaattatctgctcagtcaactcctcatcttnaaactcctcttcatcttcaagctccgccac

SEQ ID NO: 31218 - DNA, 101 bp, rice(Oryza sativa)
  misc_feature (71): n=a or g
taattgagtaaaaaatgcatcaaaactcactagtaaactagtaacacccaatctttcaaccacggtgatgntgttctttgcatttcccctttcatcttttt

SEQ ID NO: 31219 - DNA, 101 bp, rice(Oryza sativa)
  misc_feature (71): n=t or c
aaaggataggaggaagttggcgaaccgattgtaccaagcgtggggtgcttgcttcaaaccataaagtgacntgttcaaatggtacactaagtcaggtttga

SEQ ID NO: 31220 - DNA, 101 bp, rice(Oryza sativa)
  misc_feature (71): n=a or g
gaagggatttgtccagcgaatggacatgaacgtggtgaagaatgatctaccagaaaagaaggtttttgttnttactgttaaactctctcaactacaaagga

SEQ ID NO: 31221 - DNA, 101 bp, rice(Oryza sativa)
  misc_feature (71): n=t or c
gatacagagctcagcattacaatctgtgccatcacctacaggagatcactgatattgcttgacaattcacnatatctcgtcattgcaatctgtttcatcac

SEQ ID NO: 31222 - DNA, 101 bp, rice(Oryza sativa)
  misc_feature (71): n=a or g
cttgcagacggttggtgttgacgtccaacctttgcaacgctgtcatgttgccaatctcaggtgggattacnccggtgagatcgttgaagaacaacgccaaa

SEQ ID NO: 31223 - DNA, 101 bp, rice(Oryza sativa)
  misc_feature (71): n=t or g
gcagaaccatatattagctcctcatgctcaagaagacgatggtgaagaatacggtaatgatccaaatccangttaacaattggttcagtttgaaaatccaa

SEQ ID NO: 31224 - DNA, 101 bp, rice(Oryza sativa)
  misc_feature (71): n=a or g
cttttcattttgaaaatcgtagccaaacaaggtctccgcagattcagagacaccattagctgcaacacttnttgcttctgatggactgaatgaacctgctg

SEQ ID NO: 31225 - DNA, 101 bp, rice(Oryza sativa)
  misc_feature (71): n=a or g
ataagttggagcaccagatggtccagcatgatgagcaaaaccagtatttgcagttccagaatatctacggntgaaatttggtctcagcttttgatatgagc

SEQ ID NO: 31226 - DNA, 101 bp, rice(Oryza sativa)
  misc_feature (71): n=a or g
tgcggcagcaaccttagcttctacccaggccataggggaggattaggcaagggtgtaatgactggcctcantgtgggaagcaggcgccgacaagggtgtca

SEQ ID NO: 31227 - DNA, 101 bp, rice(Oryza sativa)
  misc_feature (71): n=a or c
gatctggttggcaacgacggctttgagcaggagtggctgctggcgatatatgaggaggtggagaaagacanaggaaaacagggagaaatagagagaacgag

SEQ ID NO: 31228 - DNA, 101 bp, rice(Oryza sativa)
  misc_feature (71): n=t or c
tataaactatctggggacagaccagccgacgttcactctgaacttctccaaaggtacatacattttcttgnagtttcatcaccaaactttaattcttttgt

SEQ ID NO: 31229 - DNA, 101 bp, rice(Oryza sativa)
  misc_feature (71): n=t or c
aatatgttctttaataacttaattattccctaaaaaaaccttaagaagcatgaaagctgctccttgccganagcaggcttttatccaatgaggccggaaca

SEQ ID NO: 31230 - DNA, 101 bp, rice(Oryza sativa)
  misc_feature (71): n=a or g
atttttgcatgttggtccaaatattattgactctactctgtttgataccattaggctgctaatgggccgcntcagcatcaaattggctgcaaatttttatt

SEQ ID NO: 31231 - DNA, 101 bp, rice(Oryza sativa)
  misc_feature (71): n=a or g
ggtacacctgtacagcgatagtcaacgaggttttcaataggagaagcaaacctaatgcaaaagttgggagnacgtggaagatctcttctgtactgacaaag

SEQ ID NO: 31232 - DNA, 101 bp, rice(Oryza sativa)
  misc_feature (71): n=t or c
aatggtggtggtgattggcagaactgcgactgacatgtgggccatggtataagtataagttatgagtgttngacatgtcttcgctgtgcccctgcggctta

SEQ ID NO: 31233 - DNA, 101 bp, rice(Oryza sativa)
  misc_feature (71): n=a or g
ttcactgcatgccattcaacgaattgatctctctgagaacaacttatccagtgaagttcctgtgttcttcnagaactttatcagcctagcccacctaaatt

SEQ ID NO: 31234 - DNA, 101 bp, rice(Oryza sativa)
  misc_feature (71): n=t or g
taacaagtctgaatgtcacgacttccatcaaccccttcaaactggacattaagtgtaaaacagatccatgnaggttggaaaggatacatagcagaatatca

SEQ ID NO: 31235 - DNA, 101 bp, rice(Oryza sativa)
  misc_feature (71): n=t or g
aagtattagtagtaactatgctaattttgttgcaggagagtgcattatccgtgtttggaatcatggacctnctgtacagccttgcaagtgtcccatttgcc

SEQ ID NO: 31236 - DNA, 101 bp, rice(Oryza sativa)
  misc_feature (71): n=a or g
tatcctgaacagcatacctgagattttttttcatgcctgacagatgagttctagggcgcgtttgcttgctnccctcagattcgcgcctggctcaggcgtcg

SEQ ID NO: 31237 - DNA, 101 bp, rice(Oryza sativa)
  misc_feature (71): n=a or c
cccagggagatcttttactcttgataatgccttgctaaacattactggctgtgactttgatatatacctgnttgatcaagacagaaatagcgctgtgaggc

SEQ ID NO: 31238 - DNA, 101 bp, rice(Oryza sativa)
  misc_feature (71): n=t or c
gatactcgtcgccatggacgactccggccgccgccaggcactgcacggtctcattggacctgtcttgaaantgtaagtcaacctcttctacatggcacttc

SEQ ID NO: 31239 - DNA, 101 bp, rice(Oryza sativa)
  misc_feature (71): n=t or c
cgccctccagcaaagtgaattgtgtcaacaaagaggaaagagccctggatcatcatgcgcccaacttttgncaggtagtagtatcagtcatcctagtgatt

SEQ ID NO: 31240 - DNA, 101 bp, rice(Oryza sativa)
  misc_feature (71): n=a or g
gttgacatcatttacattgagcaggtcttttcatgctacaggttgctgtcctggtgttacatgaatctcgntaatcatattatcttgttatttcaaacaca

SEQ ID NO: 31241 - DNA, 101 bp, rice(Oryza sativa)
  misc_feature (71): n=t or c
cattcggaagaatctgtccttgtggaagcataaatgccgttgttccttctcccagtcaccatctcaagaanaatcaccccaaagctgaacatatctgattt

SEQ ID NO: 31242 - DNA, 101 bp, rice(Oryza sativa)
  misc_feature (71): n=t or g
cccacccagctggtgcgcctccaagaattcctcctcctcttcctcggattccttccccctcttcggcggcnggctcccccaccggcaccggcgtccccgct

SEQ ID NO: 31243 - DNA, 101 bp, rice(Oryza sativa)
  misc_feature (71): n=t or c
acggacaaacagtagatatcaaagagagatccagcattttgtgtggttgcagagaaattccgtctcccttnctgatcgatcaacctatggccagtagaagg

SEQ ID NO: 31244 - DNA, 101 bp, rice(Oryza sativa)
  misc_feature (71): n=t or c
aattgaaatgcctttgctttcctaacttgtccacaccaatttcaacagaaacacatggcgattctggaagncagagcggccgagcaggttgttgaagcctg

SEQ ID NO: 31245 - DNA, 101 bp, rice(Oryza sativa)
  misc_feature (71): n=a or g
aggaagtatatattttcacattccattgtattctattctcacgcctccgatcctaacctttccatgtcttngcaccaaagtcacagtcacactctcatctt

SEQ ID NO: 31246 - DNA, 101 bp, rice(Oryza sativa)
  misc_feature (71): n=t or c
ccggtgagcggcgagatgttgcccatcttgaccatggaccgcgcgaagtgggcgaagaagatgtcctgatnggcggcgtagagctcgacgagctccgccgt

SEQ ID NO: 31247 - DNA, 101 bp, rice(Oryza sativa)
  misc_feature (71): n=a or g
atttcttccggacatgtcattcaggaacatcccaatgctgcaacatgatgattaaaaatcaaacaagtgtnatgtgtgaaaaagttggaaaacgaactaca

SEQ ID NO: 31248 - DNA, 101 bp, rice(Oryza sativa)
  misc_feature (71): n=t or c
tggataaacattagctatgtttgtgcaattatccattcgtatgtccggaaggcagatgcctgcaccatccntggttaattgaacatcacaccacagggctg

SEQ ID NO: 31249 - DNA, 101 bp, rice(Oryza sativa)
  misc_feature (71): n=t or g
tagtttctgtaagggaagaaccagtcattgtacaactcatgaagccttcgtcgattgagataagtgaaaantcttgaccacctgggaaattcggaactgat

SEQ ID NO: 31250 - DNA, 101 bp, rice(Oryza sativa)
  misc_feature (71): n=a or c
gagtacttgtccattatgtcttcaacacggtaagccagcttccgcagttcgtcgatccaacccttgacaanattcatgttggtatttgtggaatctaaatc

SEQ ID NO: 31251 - DNA, 101 bp, rice(Oryza sativa)
  misc_feature (71): n=a or g
actgggactagatagttccttgttagaagctacgaactccattctaacggatgttgccgatgatccagtgnttacattgtcatagaatgaatccttcagta

SEQ ID NO: 31252 - DNA, 101 bp, rice(Oryza sativa)
  misc_feature (71): n=a or g
ttcagggtagtgtgtatcggcatggatgaaccacttcaggctttgttctatggaatgtgttgaggaggttncgagagtttgtgttgtttttaaagattacg

SEQ ID NO: 31253 - DNA, 101 bp, rice(Oryza sativa)
  misc_feature (71): n=a or g
gagatgtgttttgcagactgaacagaaaaagcaagccgctgcagatgtccttttccactattcacagtttnttatggtttgcattggtgagggtgttcgcc

SEQ ID NO: 31254 - DNA, 101 bp, rice(Oryza sativa)
  misc_feature (71): n=a or g
taatcaggctacttcccagttatgtacccgtttgaaaatcatcccacacttcaaaaaggatccgctagccngatgtgatcatgttcctacagtcttggaag

SEQ ID NO: 31255 - DNA, 101 bp, rice(Oryza sativa)
  misc_feature (71): n=t or c
atagctggattttgggtgaggggtatttaaacccctccacacccacaagctaaagttgttggttctattgnaaacattgttcatttgggttgagatatttg

SEQ ID NO: 31256 - DNA, 101 bp, rice(Oryza sativa)
  misc_feature (71): n=a or g
atggagcatacattgtcaggagccttggatgactctattctcagggctttctcacgtgataagcgaacaanttttcttactcgcgtacgttgacttgcaaa

SEQ ID NO: 31257 - DNA, 101 bp, rice(Oryza sativa)
  misc_feature (71): n=t or c
agaaactccactgcatttggagctctgcagttggatacttctgagcctgtttggcacaactttaccttttntgtaactggagtccagccaaacagtgtaaa

SEQ ID NO: 31258 - DNA, 101 bp, rice(Oryza sativa)
  misc_feature (71): n=a or g
agagactaaagttaagtccctggatccaaacatcacctgaaatctaccctcacatcccatcctaaattaangccctgtttgggggagcttcacccagttgt

SEQ ID NO: 31259 - DNA, 101 bp, rice(Oryza sativa)
  misc_feature (71): n=a or c
tcaacagaaacaacacgccttgacagctctatcatgccatcggcagtgacagacatcttcttcatctcatntccagaatcaagcagtaagactctataatc

SEQ ID NO: 31260 - DNA, 101 bp, rice(Oryza sativa)
  misc_feature (71): n=t or c
catgctttgccatccccggagctgttgcaaccgataggtatgtattgttccctgtggcaaagtacatccangcaccaccccacacaaactcatcccagtaa

SEQ ID NO: 31261 - DNA, 101 bp, rice(Oryza sativa)
  misc_feature (71): n=t or c
ttcacacatttccatcgaaagtatccccccatcaatcccaaaaacccataggcgaatccacaccgtccatncatccatctgaagcagacgcctttgctttc

SEQ ID NO: 31262 - DNA, 101 bp, rice(Oryza sativa)
  misc_feature (71): n=a or g
ctcttccttcatcttgcaatccttctctagtttatggagctcttcctttgttctgccatctttatctttcnctgtaactgggagcaaagatgatccatttg

SEQ ID NO: 31263 - DNA, 101 bp, rice(Oryza sativa)
  misc_feature (71): n=a or c
ttgcctcattcacctctattgcttcctccttatgcaattccacatttatctccaccccttctgattcaagnctgcttgacttattagcctcaactgcttcc

SEQ ID NO: 31264 - DNA, 101 bp, rice(Oryza sativa)
  misc_feature (71): n=t or c
ctcgcatactaatggactggagaaagcattttgactccctcctatattggttgaatatgattcataccacncagctgtaaaattgggtatatcaccactca

SEQ ID NO: 31265 - DNA, 101 bp, rice(Oryza sativa)
  misc_feature (71): n=t or g
tcattataatcactgaatacaaaaggacgagaaggttgcagcggcttggaggttggaagaaaaatggcagngctgttcgcctctcaagtctcaacgttggt

SEQ ID NO: 31266 - DNA, 101 bp, rice(Oryza sativa)
  misc_feature (71): n=t or g
ctctctttcagattggtaaaggagagattcttgctgaggggaaagagatagcttttcttggttatggtgangtggtccagagatgcttgatagctcgatct

SEQ ID NO: 31267 - DNA, 101 bp, rice(Oryza sativa)
  misc_feature (71): n=t or c
attgcactgggagtctcagaactgcagtgcatgtggtcctcgaatatcataaccagccctctgcatctgtnagcggaaaacaaatgaaaagaaggcaatca

SEQ ID NO: 31268 - DNA, 101 bp, rice(Oryza sativa)
  misc_feature (71): n=t or c
catttgacctccagttccagatggtgcaaaagaactcatgtttgtggggttgtttgggtagttcagatttncattaccccaaacattccttgacattgaac

SEQ ID NO: 31269 - DNA, 101 bp, rice(Oryza sativa)
  misc_feature (71): n=a or g
cccaacccagatctggcgtgatatttcatctgggatcccagaatttcgacgacacacttgtgcgatccttnggtgacgggacttccatatcgttctgggat

SEQ ID NO: 31270 - DNA, 101 bp, rice(Oryza sativa)
  misc_feature (71): n=t or g
gatatgtcaagactgcaggtctgcagactgcagccacaggaacggtctatatatatacgtcctggcctctnaatttcttcccaaggaggagtcgatcgagc

SEQ ID NO: 31271 - DNA, 101 bp, rice(Oryza sativa)
  misc_feature (71): n=t or c
tagtgggagaagggcagagccacactacactcccaagaagccctcaaaaatagcaatgccagcggaagatnacagatggccttccgagagaatggactcca

SEQ ID NO: 31272 - DNA, 101 bp, rice(Oryza sativa)
  misc_feature (71): n=t or g
tcctcagaaaattgcagatgttatcaactgggcagttcccaaaactctgaagaaattgagaggcttcttgngtttggcaggctattacagaaaatttgtca

SEQ ID NO: 31273 - DNA, 101 bp, rice(Oryza sativa)
  misc_feature (71): n=t or g
gttgtttcctccgctgcatccttcacttgcacctgccaaaagatccaagagctcataatcaacttcatcanatgagctcttggacttagattcactagcat

SEQ ID NO: 31274 - DNA, 101 bp, rice(Oryza sativa)
  misc_feature (71): n=t or c
aacgataacggttgtcaaatatttagaaacggagacgataacatatgcgtatatattatcgatcggtttgnagggcgattggccatgctggcttttgtggg

SEQ ID NO: 31275 - DNA, 101 bp, rice(Oryza sativa)
  misc_feature (71): n=t or c
gtcattgagtcttttatgtcataagacttgtctcgctcttccaatgatggataacctccaaacaaagaacngtggtttgactcttttgaaatcaaattatc

SEQ ID NO: 31276 - DNA, 101 bp, rice(Oryza sativa)
  misc_feature (71): n=a or g
tctaagatggcctgctctgccaagaacgcctacgagcaggcacttgaggagctggacgaacttcgtgatcngtacaccaacttagaagcccgttaccagca

SEQ ID NO: 31277 - DNA, 101 bp, rice(Oryza sativa)
  misc_feature (71): n=a or c
ttctcctagctatcgcagtattcagggaaccttgcactaaaacttgatagccttggagtacatggagttangaatccaagttcttcaggcttcgttataaa

SEQ ID NO: 31278 - DNA, 101 bp, rice(Oryza sativa)
  misc_feature (71): n=t or g
gccaatctgcaaattttatgtggatcctctgtctctgtcggcatggacctgcttcttctcgacgctgcaangcgcagcgctcgccgtcttcctggtcccgg

SEQ ID NO: 31279 - DNA, 101 bp, rice(Oryza sativa)
  misc_feature (71): n=t or c
tcgtcactcgaatcaacttcgaagcagatgaggaattatcaaatcgaagagatggacagatggggggcaancgtggcttcgtcgagccgagtcgtggtcat

SEQ ID NO: 31280 - DNA, 101 bp, rice(Oryza sativa)
  misc_feature (71): n=a or g
catgccgcgctgcctacttcaccatctcctgcggtggacgaggaaacatcacattctttaggtggtgtttngaaaagagggactaagggtgtgtttggatg

SEQ ID NO: 31281 - DNA, 101 bp, rice(Oryza sativa)
  misc_feature (71): n=t or c
tcaattggatagagaagggcatgtggcgaaagcttccaccaagaaggtcgatggggatcatcgtccttgcnagggacgtcagcaacagatggtgagagggc

SEQ ID NO: 31282 - DNA, 101 bp, rice(Oryza sativa)
  misc_feature (71): n=a or g
actacaaattaacggcgtcatctatacctgaggcttatttgagcttgtggtgtgctgaaatgtcctaacantttcagcattatttccagttagattgagag

SEQ ID NO: 31283 - DNA, 101 bp, rice(Oryza sativa)
  misc_feature (71): n=t or c
gtgcgttgttgtggtggaacccctggtcctgttgccccaagagggaaagcgagagctagagcgaggtgagngggtcatcgtcgacgtccccggcactaatg

SEQ ID NO: 31284 - DNA, 101 bp, rice(Oryza sativa)
  misc_feature (71): n=t or c
caatgaagaggagcagcatgacgagctagcgacaagtacaatgtaacaacctcgagacctccatgaactcngagattgccctcacaccgagaacgaccgac

SEQ ID NO: 31285 - DNA, 101 bp, rice(Oryza sativa)
  misc_feature (71): n=t or g
gcagcggccggcacggcgacgaggacgttgcccatggcacggtggtagtactggtacgtagccttgaggcngtcgagaaaacgtgcagccatactcatgcc

SEQ ID NO: 31286 - DNA, 101 bp, rice(Oryza sativa)
  misc_feature (71): n=t or c
cttctgtccaccagataatttaactattggagtgagatggttgtgccctggtaaaccaaattttccgagcntcgcacgtacagcctctgctttgctcattc

SEQ ID NO: 31287 - DNA, 101 bp, rice(Oryza sativa)
  misc_feature (71): n=a or g
agtggcagtagtactgcaagatgtatgtaccggagagaagcttttggaccaatctgcggccaacgaaaccngtggcgccagtgatggagacggtcatcgtc

SEQ ID NO: 31288 - DNA, 101 bp, rice(Oryza sativa)
  misc_feature (71): n=t or g
tataactattgtcgatctggacctatttacagcggttgacttgatctaccaatggtaggctagcgatccangacacggtggcccgagcagaggcccaagtc

SEQ ID NO: 31289 - DNA, 101 bp, rice(Oryza sativa)
  misc_feature (71): n=a or g
ggattctgatctgatagtgtttgtggtcttgcaactgaacctatcttttgggtgattgtatttacagaaantcatatgtttacattccccaaacttcatgt

SEQ ID NO: 31290 - DNA, 101 bp, rice(Oryza sativa)
  misc_feature (71): n=a or g
cttgatgtgatgcctttggcagtagctgcaccagttagttgtggtgctaatgtctctaacggttctgcggngaatgttagggatgtggccagtttgttgat

SEQ ID NO: 31291 - DNA, 101 bp, rice(Oryza sativa)
  misc_feature (71): n=a or g
tcagttaatatataggcatatgagcgcagtcgtgtactcgtgtcatagagatcgaccaagtgaaaattaantacgtcttttcatattattaatcctatatt

SEQ ID NO: 31292 - DNA, 101 bp, rice(Oryza sativa)
  misc_feature (71): n=t or g
ggcctcaagggacctaatcttctcctctactacggcgagccgcccttcccgttcggcggcattcttcttcnacttctccaagtcggtgcaaagagacttgt

SEQ ID NO: 31293 - DNA, 101 bp, rice(Oryza sativa)
  misc_feature (71): n=t or c
gcatccacaactcttcaatgtagatgctatcaactggatgctaagtacaacgacatccaccttattttcanaccttacaaatcactatatatcttaaaact

SEQ ID NO: 31294 - DNA, 101 bp, rice(Oryza sativa)
  misc_feature (71): n=a or g
actagtgaagcttaatggcaatggctcaaattcaaaggagggtatgattgtttcatcaaatgatgatgatncttgggagactgttggaaagaagaacaagt

SEQ ID NO: 31295 - DNA, 101 bp, rice(Oryza sativa)
  misc_feature (71): n=t or c
cacggcaaggactaagtcaagctattcttctcacttgagaatgcagctaattaagtcggtccaaagggagngaaggaaacaaaacacgaacctaaggacat

SEQ ID NO: 31296 - DNA, 101 bp, rice(Oryza sativa)
  misc_feature (71): n=t or g
tgccacagctccagattctgatgggaaagagacatatggagatttgtacaagaatgcccggatcttcaatncatcctcaagctacaagttcatcgtcgccg

SEQ ID NO: 31297 - DNA, 101 bp, rice(Oryza sativa)
  misc_feature (71): n=t or c
ggaggatgaaatggtggacactggagtgcaaacacctcatgcccctgctccaattcatacagttcccctanaagcagtggcaccacctggtggtttcccta

SEQ ID NO: 31298 - DNA, 101 bp, rice(Oryza sativa)
  misc_feature (71): n=t or g
cagcaatataccgtttttggggggtgcagtggctgctcatatcatctgcatctacaggttcagctagcttncatgttttctcaaaatgtccaaatctttta

SEQ ID NO: 31299 - DNA, 101 bp, rice(Oryza sativa)
  misc_feature (71): n=t or c
gactctagtatcattgtcctttcgtcataaaccatggccttgatagacaacttaacagccacccttcccantgcattcttaatcaagctgagcttaggtac

SEQ ID NO: 31300 - DNA, 101 bp, rice(Oryza sativa)
  misc_feature (71): n=a or c
tgttttgtggcaatctgattccggaatcgattcttcttgttttgtttggagcagcctggtggcaaatgcgnttgatgcactcaacctggctaagggatccg

SEQ ID NO: 31301 - DNA, 101 bp, rice(Oryza sativa)
  misc_feature (71): n=a or g
ataaaggcaggcttgctctttattactcgaattaggaatatgttgctgctgccctttttagctggaagagnaatgcaaagtaggtccatagagtccgatga

SEQ ID NO: 31302 - DNA, 101 bp, rice(Oryza sativa)
  misc_feature (71): n=a or g
cggctcaatgggtgaagtgtgatcgtgatgtgctctagaaaaacttatctgcttctcccgtcgaatcgagngaagtatatggccgcggtagtggtgttttc

SEQ ID NO: 31303 - DNA, 101 bp, rice(Oryza sativa)
  misc_feature (71): n=a or g
tgttggtaccaaagactcaaaaacaggctttcacgactaaaagaaataggccctgttcttttctccaatangagttggatgaaaattaagattttcgtggt

SEQ ID NO: 31304 - DNA, 101 bp, rice(Oryza sativa)
  misc_feature (71): n=a or g
tcaaaggttatatcaataaaattgaccgagcagaatgatacctttttgtgggagacacaaaagaatgggtntttctcagttaactcaatgtacaaagcaat

SEQ ID NO: 31305 - DNA, 101 bp, rice(Oryza sativa)
  misc_feature (71): n=t or c
tatattggttactaggttttgatcgatgtacgtaatgcatgttaatcgatcgtctcctgtatgtacgtgtngttcatctgctgttcattgtctccactgat

SEQ ID NO: 31306 - DNA, 101 bp, rice(Oryza sativa)
  misc_feature (71): n=a or g
atgattgtaagtatcattatggccaggtacagatgatgtaaggctcgactttgatcaaaatgagaaggaancctccgttacacatcacagcaagaagttga

SEQ ID NO: 31307 - DNA, 101 bp, rice(Oryza sativa)
  misc_feature (71): n=t or c
ttgccaaatgcaatcgcctccaggacctttgcagacacctcaatcaccttcaatctagtcttcaggcagcngattcccccacaagctttgtcgacagcttc

SEQ ID NO: 31308 - DNA, 101 bp, rice(Oryza sativa)
  misc_feature (71): n=a or g
gcctggtttgtggcattattatcaacacgtaacctcctctctgtaggagttcctcgcttccacactcggcnttgccacagcgatgtacacgcgtcgagcgc

SEQ ID NO: 31309 - DNA, 101 bp, rice(Oryza sativa)
  misc_feature (71): n=a or g
tgaaagattaaagacaaccctcgagggcatgttcaatgaatatgctcagcaaacgatcaaccttggttctncgcaacaatggggtggtaatgttgagatag

SEQ ID NO: 31310 - DNA, 101 bp, rice(Oryza sativa)
  misc_feature (71): n=t or c
ctaggtgcattctgaatgagcttatgaaaagtagtgcgaaggtaacgatttggccgttggatcttgcgatngtatagggtagaattaagtttgtctgtcaa

SEQ ID NO: 31311 - DNA, 101 bp, rice(Oryza sativa)
  misc_feature (71): n=t or c
ttcagttgcgagtgcctgaatttggttggactacccagaaggttttccatctgatgaactttgttgtaaanggaggtaatgttgtgctcctttgttttgtt

SEQ ID NO: 31312 - DNA, 101 bp, rice(Oryza sativa)
  misc_feature (71): n=a or g
gatgagaacgacgatacatcggtttcttcacaagtaacttcgaagcctaaacatcagcaggcgtcaggaanctcggccaatgcaaggatatcacatgatgc

SEQ ID NO: 31313 - DNA, 101 bp, rice(Oryza sativa)
  misc_feature (71): n=t or g
ccttgagaatttgtgatttcagtgtacaggcaaaagtaactggatcactggggactttgagaacagcattncaaatacgtagagacattgatagcgaaagg

SEQ ID NO: 31314 - DNA, 101 bp, rice(Oryza sativa)
  misc_feature (71): n=a or g
aggatcagtataatacaagatatgttcatagctgaattttcgtgtctctcgaaggatgtcccctatgcctntcccctacgtcatcgaaaaatttaaaaaac

SEQ ID NO: 31315 - DNA, 101 bp, rice(Oryza sativa)
  misc_feature (71): n=a or g
tatttgagatgttgaatgatgctatattcctgtcacaggcagtatcagttctgttgagttctctctcttcntacaatgaccttgattcagtcacgaataaa

SEQ ID NO: 31316 - DNA, 101 bp, rice(Oryza sativa)
  misc_feature (71): n=a or g
tgctgagagaacaagcacaagtagcactgagagcagcatcattcctagtgtttttcttccgcagggaaatncatcgcttgcatttcgaatgtaatttgggc

SEQ ID NO: 31317 - DNA, 101 bp, rice(Oryza sativa)
  misc_feature (71): n=t or c
ttgtaactagctttgtggcattgtctaacacattgtgctgtgttgttccattccatgcagtttttgttccngcagactcctcaggtgcagcaggagtccta

SEQ ID NO: 31318 - DNA, 101 bp, rice(Oryza sativa)
  misc_feature (71): n=a or c
agaaatgtacatcagttacaaactactacttgagtgagcttaacaagcaatgagtgaacaccagcatgcgnatgtacctgtactcggtcaccaagatgtgg

SEQ ID NO: 31319 - DNA, 101 bp, rice(Oryza sativa)
  misc_feature (71): n=t or c
tggagggtggcacggcatcgttggaccacgtgccctccttcaaaacaagcactagaaattagtagtatganttttgaataaaaggcgtttgtagtccaacg

SEQ ID NO: 31320 - DNA, 101 bp, rice(Oryza sativa)
  misc_feature (71): n=a or g
aagaatttttttaaaaagataagaatgctctaagagccaaaagtttcaaacatgaggctagagtaaagttngaatatgatatatgctagcaatgtacttag

SEQ ID NO: 31321 - DNA, 101 bp, rice(Oryza sativa)
  misc_feature (71): n=a or c
tatgttcatgaagacaaagaggaattagctcgtgcaaaaaagagaagggatttaggcaaacctgtcgatcnttggtacctacaagaggaattaggcccatc

SEQ ID NO: 31322 - DNA, 101 bp, rice(Oryza sativa)
  misc_feature (71): n=t or c
gagatgtcctacttggggctacaatgcaatgctgttatccataatgcgataattgatgggtacgggaaagncggcatgttggaggagatggagaatgcact

SEQ ID NO: 31323 - DNA, 101 bp, rice(Oryza sativa)
  misc_feature (71): n=a or g
gaaaacgacattcggctcttccaagcatgtactgaaattcaagtcagaaatggaaaaaaaacattcttttngaaggacaactggctctatgggttttgctc

SEQ ID NO: 31324 - DNA, 101 bp, rice(Oryza sativa)
  misc_feature (71): n=a or c
tttctttcatgttttcaattatccatgccatgttgaagacaagacagaaagttaccatcagccaccgtatntaaccgagatacaataagatgaccataaga

SEQ ID NO: 31325 - DNA, 101 bp, rice(Oryza sativa)
  misc_feature (71): n=t or c
ttaataccaactaagaggttgatctcctgggagtcagtgactcagtggaagattagaaatttccacctacnaagttgttgttgatgtgaaaacacgaggcc

SEQ ID NO: 31326 - DNA, 101 bp, rice(Oryza sativa)
  misc_feature (71): n=t or c
cactaatgggggattattactctgagcaagtaaaaacataatgaaaatttactcaccgcacatagtgctgngactgaacgtaagggtgcctgcaggagaaa

SEQ ID NO: 31327 - DNA, 101 bp, rice(Oryza sativa)
  misc_feature (71): n=a or g
tttaggaggatagcaaatagtaaattttcctctgtgaattgggatagaggcaaggctgcactatgacaccnatttggcagtgatcttgttagcataatggc

SEQ ID NO: 31328 - DNA, 101 bp, rice(Oryza sativa)
  misc_feature (71): n=t or c
tagtcgtcatcaacatagatggcaatgacttctctccatcgatattgattgatgatgctagctatagcacncatttggaaataatcacttgttgtagccct

SEQ ID NO: 31329 - DNA, 101 bp, rice(Oryza sativa)
  misc_feature (71): n=t or g
cggcaacgaattcgaagcgcgatgagcaattggaatttggaaaaattcggaccgaattggagatgcgagtncgtttgcctgtttggactgcggcgagtgag

SEQ ID NO: 31330 - DNA, 101 bp, rice(Oryza sativa)
  misc_feature (71): n=a or g
agagatatcttgattgttaataaatactagttgacaaatgatttcagttcacttgtatccgggactgggancaatgcttattttgtgaacatgaaggggat

SEQ ID NO: 31331 - DNA, 101 bp, rice(Oryza sativa)
  misc_feature (71): n=a or c
ctccatcaattgcattttcccgtagttttgtgaaattgtgtcgtcgcataatgttatttgtgatgcagtanaatacgaaccattgacgatgtttttaggcc

SEQ ID NO: 31332 - DNA, 101 bp, rice(Oryza sativa)
  misc_feature (71): n=a or g
tattaaagcctgtcttctttgctcttcagtaacaattcttgaatcctcagcttgagtttctttgtctctcnggtttctttggtctccaagcagcacaacat

SEQ ID NO: 31333 - DNA, 101 bp, rice(Oryza sativa)
  misc_feature (71): n=a or g
gcaaaaagctctcgaattgtactgtttattttctgaaggtattcactagcttctgttatctcaaatccttncttcaagcgatactcaagaaaggtcaactt

SEQ ID NO: 31334 - DNA, 101 bp, rice(Oryza sativa)
  misc_feature (71): n=t or c
atcgcaactcgcgtgtctcacctagctagggtttttccctgttttccctaggatcaattttggttggtccnggttagaaaatagggtacacacgtgggtgc

SEQ ID NO: 31335 - DNA, 101 bp, rice(Oryza sativa)
  misc_feature (71): n=a or g
agccaattgaagatggagagcccgaattattattttgagggcgtctggagggttcaaacgtctacacctangacacggtagatgatctcgatgacaagcaa

SEQ ID NO: 31336 - DNA, 101 bp, rice(Oryza sativa)
  misc_feature (71): n=t or c
atagatagatagatagatagaagatttgctgttttccaaagagaaggttgggttatccaaattacaacaangcatccatgcacacaatactaaaaaaaaca

SEQ ID NO: 31337 - DNA, 101 bp, rice(Oryza sativa)
  misc_feature (71): n=a or g
ttgtgtggtggccaaataaatactatcagctgatcgatccatggtctctgcgacgaccgactcaaaacacnacgcgtttgccacctagcagctatatatct

SEQ ID NO: 31338 - DNA, 101 bp, rice(Oryza sativa)
  misc_feature (71): n=a or g
ttatccgccctccgttttacgcttttctgtttcccccggttatttaagccagactcaagtttctcgaaatngaatttaaggaagggtgtgtttcacgtcaa

SEQ ID NO: 31339 - DNA, 101 bp, rice(Oryza sativa)
  misc_feature (71): n=t or g
taggagatgtcccattggttggactgtgggttacctacatgggctattataaccctggcacagtattggantattataatccaaagcaactctgaattctc

SEQ ID NO: 31340 - DNA, 101 bp, rice(Oryza sativa)
  misc_feature (71): n=a or g
atgaatgtgttcttggatgttagattgatcttaggggtgatggaatctgagagatgaaggtgaactgctcnatgcatcggcttgaatcaagtctttttttt

SEQ ID NO: 31341 - DNA, 101 bp, rice(Oryza sativa)
  misc_feature (71): n=a or g
gaatcacttgactcacatgcttctaacgtgcaaatttggtgaaaacagaaagcagcggtatgtgtattgcnctattctaaacagcatagcgaaggtagcag

SEQ ID NO: 31342 - DNA, 101 bp, rice(Oryza sativa)
  misc_feature (71): n=a or g
acacattttctttaaaaagaaaaacaatgttctatacacatgcgtggctaacaacttagactataagaccnagaatggtaaaaccacaacttcaaaataaa

SEQ ID NO: 31343 - DNA, 101 bp, rice(Oryza sativa)
  misc_feature (71): n=t or c
gactgtgatgagatatatcagtttgaagtttttgtgatggtgacgactgtgactgcgatgagcaaaccacnatagcagtgtgctccaattttcttgctagg

SEQ ID NO: 31344 - DNA, 101 bp, rice(Oryza sativa)
  misc_feature (71): n=a or g
aatgcgacgagggtttggaggtggagcattttgagagtctcgggtgatgatattgacgcctgtgggtgtcntttcctccttgaaggcatcgtcatgatggc

SEQ ID NO: 31345 - DNA, 101 bp, rice(Oryza sativa)
  misc_feature (71): n=a or g
gttttaatctgactagattccttttcagcgtgagctttgctttctcagcttctgtccttgttttgactttntgtagattggagatggtgagtgctcctcca

SEQ ID NO: 31346 - DNA, 101 bp, rice(Oryza sativa)
  misc_feature (71): n=a or c
cggactctggtagccgcgatgattatttttttggtttcaggggcttattcgaattgtattggaggaatttnggctaaatggttatttgttgttttggtatt

SEQ ID NO: 31347 - DNA, 101 bp, rice(Oryza sativa)
  misc_feature (71): n=t or c
agatttttggcggcgacgtggtttcaaagtaatcaatcgggccaaggcctcacgatcgacaacattgaacngttgttctccgcggcggtgacgtcttgaag

SEQ ID NO: 31348 - DNA, 101 bp, rice(Oryza sativa)
  misc_feature (71): n=a or g
taggccaacacgaagaaggtatggaaggatctgtaatccgaaaatacctagcagtcactactcaccattgncccacgtactcgccgagagcttttgtgaat

SEQ ID NO: 31349 - DNA, 101 bp, rice(Oryza sativa)
  misc_feature (71): n=t or c
gctcgtcgcctgactcgcccgatttgctttaccgcgctcgtcaagatctgtgagggcctcaaaatgtgttncacacgtatcaggcgggtggcatggatctg

SEQ ID NO: 31350 - DNA, 101 bp, rice(Oryza sativa)
  misc_feature (71): n=t or c
gcgatgccgggccatgcgcagggcatgacactccgaatcgaagcttctcacagcttgttccagctccatgntgagaacttttattgccaccatagtaccgt

SEQ ID NO: 31351 - DNA, 101 bp, rice(Oryza sativa)
  misc_feature (71): n=a or g
gaacaaatgggaattttttatgttcctgatcctagaagtttctgcaatgattattactggtgtgacggccntcataagtatgttcacatctttctttaaaa

SEQ ID NO: 31352 - DNA, 101 bp, rice(Oryza sativa)
  misc_feature (71): n=t or c
cactacggagtttttcccattgttgatgagttccctttgttgcgaagaatgctgaagaccaccaagaaaantaaaaaccaaagttttgtgagatttatgtg

SEQ ID NO: 31353 - DNA, 101 bp, rice(Oryza sativa)
  misc_feature (71): n=a or g
tatctagagtaaaaggccacatcaccaaggcaaacatgtaaatcagagtaaaaggccttccagccccatcngatggcctaataagtcaaagaaaaagccag

SEQ ID NO: 31354 - DNA, 101 bp, rice(Oryza sativa)
  misc_feature (71): n=a or g
gatgtttctgaatttgtttgcttctcattctcaatgggatgaccaaaagctgaaaccacataatttttctnaggatcgatcaagttattcgggatatcatt

SEQ ID NO: 31355 - DNA, 101 bp, rice(Oryza sativa)
  misc_feature (71): n=t or c
ccaatcttcatcgtcaagatcggtgtgggaaggataatgatgatccgaccagtgtcccaaaacctccaccngtgcttccttattcagcctaatcgcgtcct

SEQ ID NO: 31356 - DNA, 101 bp, rice(Oryza sativa)
  misc_feature (71): n=a or g
gccatatagaccaaaaaccactccgaattgagttaagggggggtgattcgttcggatttaagagtttaggntttgtaatatccgatattgcagtttagggg

SEQ ID NO: 31357 - DNA, 101 bp, rice(Oryza sativa)
  misc_feature (71): n=a or c
aagcaaagagcattgttacagttacaatggaaagtaatgggcgaaacccaacaggttgatcaagaagtaanctctaagaaggtattctctgatttctatct

SEQ ID NO: 31358 - DNA, 101 bp, rice(Oryza sativa)
  misc_feature (71): n=a or g
ttgtcactgaatacatattgaaggtacaggctgccaacacatagaactaattgtagaactacgtaaatgantttttactgaatgtttgtttgtctgttaca

SEQ ID NO: 31359 - DNA, 101 bp, rice(Oryza sativa)
  misc_feature (71): n=t or c
gtgcactgtcactgacctgatcatcactgcactcagcaacaacatcaaagaggctggcccggcgcttcttnttgccagggttggtctgccggaggaagtac

SEQ ID NO: 31360 - DNA, 101 bp, rice(Oryza sativa)
  misc_feature (71): n=t or c
acatatcaaatatatttgacccaacatcaagggaagaaagcccaaaacaacacacacggatcaatggagtncaataccttaatccttgcagctggggaggg

SEQ ID NO: 31361 - DNA, 101 bp, rice(Oryza sativa)
  misc_feature (71): n=a or g
tacggatccgatacgtatccgtatcctattacgtatccgatatggatacgtggttttttaccgtatctaantatcatagattttaatttcaatcaaatttt

SEQ ID NO: 31362 - DNA, 101 bp, rice(Oryza sativa)
  misc_feature (71): n=t or c
cgccccccgccggtatacaaaaatggaaatgctagctgttggattaaatccagcgttacaatctagacgtnataatttgaacgacctgcatgtgtttatca

SEQ ID NO: 31363 - DNA, 101 bp, rice(Oryza sativa)
  misc_feature (71): n=a or g
tatggaagattatattgaagaagtaaatgacatgttgcttaggctcttcagggaatattctggtcagactnaagaccctaactgcacttccagttttataa

SEQ ID NO: 31364 - DNA, 101 bp, rice(Oryza sativa)
  misc_feature (71): n=t or c
ccttctccaatccttcttgtgtgctccaatatgagcattctccacattgactggtctatgttgaacaagancatcttcattttcctcatcgtcagcactaa

SEQ ID NO: 31365 - DNA, 101 bp, rice(Oryza sativa)
  misc_feature (71): n=a or g
gtccaaaccatacctgagcgcgtcccacgtcgagaacaggtcgcctccgtcgttcatcgtcgtcgtgagcngcggcgccgccaacgcctcggctgccgtga

SEQ ID NO: 31366 - DNA, 101 bp, rice(Oryza sativa)
  misc_feature (71): n=t or c
ttggcattgacgaccaaaccctcggctacatcattcttcagttcagtggatgaagtgcttggtagtttttnttttccttttttttttgggaaaaagggtga

SEQ ID NO: 31367 - DNA, 101 bp, rice(Oryza sativa)
  misc_feature (71): n=t or c
cactgtttccctcattcgcaggccagttttgtgtcgaagctacttaaacatattgcaaatgcctggaaagntgagagcggatagcggtaatccattgtgaa

SEQ ID NO: 31368 - DNA, 101 bp, rice(Oryza sativa)
  misc_feature (71): n=a or g
caaggctagtggcacaatggtccatgcagagacccggtattgactatgatgaaacttactctcctgtgatnagtggaatcacgttccgatacttgatctca

SEQ ID NO: 31369 - DNA, 101 bp, rice(Oryza sativa)
  misc_feature (71): n=t or c
cagctgactgtgtcccggaaagcgcaattcctagaacaagtgagacgtctaggatctacaaaatagaagtncatggggttcttgataatttaccggcgcct

SEQ ID NO: 31370 - DNA, 101 bp, rice(Oryza sativa)
  misc_feature (71): n=a or g
ggagcctcctctcctcgagccgggatcgccgccgatatattggaggaaggggggagacgagaaattggggnaaaaaacggaagagggacgagacgatacga

SEQ ID NO: 31371 - DNA, 101 bp, rice(Oryza sativa)
  misc_feature (71): n=a or g
caatgcaatcatgctatctgtatctgcatcacacttcaaactcctcagaccatcactaaatgtttttcctnggagtagccacaacaccttggtcttctctg

SEQ ID NO: 31372 - DNA, 101 bp, rice(Oryza sativa)
  misc_feature (71): n=t or c
ccggcgtccgtttagatgtttgcgaagatcgccatcttcacggcgcggcggtgtaggatctcgtcttcttngaggtgaacggtctccggaggtacgtcttc

SEQ ID NO: 31373 - DNA, 101 bp, rice(Oryza sativa)
  misc_feature (71): n=t or c
ccggcgcgacttccacatccccaacgtccgccgaatggtacaggactacatcaaggcatgcgccacgtgcnagaggtacaagtcagaacatcttcacccgg

SEQ ID NO: 31374 - DNA, 101 bp, rice(Oryza sativa)
  misc_feature (71): n=t or c
tgcaacaaacacaataaagcaggaaagaaaaaaatacctcggcatccatcacggatgtaaggattgccttngtatccttgggaacagttgcaccgtcttcg

SEQ ID NO: 31375 - DNA, 101 bp, rice(Oryza sativa)
  misc_feature (71): n=a or c
taacagcttatcattcaatgtttttgtttatttacttccacatgtgaaatgacaggatggctgatttgganaaggttggtggaggggttgctggacaaggt

SEQ ID NO: 31376 - DNA, 101 bp, rice(Oryza sativa)
  misc_feature (71): n=a or g
agtgctgcaatgctctgtgttgggttcatcaaagatgactcgagagttttcctgtttgaaggagcacttgnccagaaggataatgtagaatgtttcttgat

SEQ ID NO: 31377 - DNA, 101 bp, rice(Oryza sativa)
  misc_feature (71): n=t or g
ccactcgatgcttgagcagttgagcttgagtttgggaacgatatcctttggcttttagctttcatgacaanaccaatttgccccttgcatgttgggcattc

SEQ ID NO: 31378 - DNA, 101 bp, rice(Oryza sativa)
  misc_feature (71): n=a or g
tatcccttaattactgatagaactaggctttcgcactctattcaacggtcgatccaatccttgaacagaancatcatgtatagagggacattcaatgcggc

SEQ ID NO: 31379 - DNA, 101 bp, rice(Oryza sativa)
  misc_feature (71): n=t or c
gtcatggtcgctagcgaaatgtgatgcatccgtggtaagcaaggacatgggaaagaagaggaggacacaangatccttaccactacttacacgaagacgga

SEQ ID NO: 31380 - DNA, 101 bp, rice(Oryza sativa)
  misc_feature (71): n=a or g
atgcacgacgattggatacccaaatgggaaaaaaacgcaacgtgcgcgagaatggacggatgtaagcgacnacataccaaattataccatgaaaacaactt

SEQ ID NO: 31381 - DNA, 101 bp, rice(Oryza sativa)
  misc_feature (71): n=a or g
acagaggaaccttgattaccggaaagcacaagatagctgcagctgctggtggaaagacaagtcgaaggccntcagtcgggtgcttgtgatgaattccatga

SEQ ID NO: 31382 - DNA, 101 bp, rice(Oryza sativa)
  misc_feature (71): n=a or c
atacaatcacttgtgacagaggcactgaaccaacttaaagcatgcaagcagcatagtcaagcttactctgnttctgccctcacagcactaataaatatttc

SEQ ID NO: 31383 - DNA, 101 bp, rice(Oryza sativa)
  misc_feature (71): n=a or g
attattctttggttttttaattattcattttcttcctatcagttgggccgacgtggacagattgttttganaaaaaatggttcaaattcttgttgtgaaac

SEQ ID NO: 31384 - DNA, 101 bp, rice(Oryza sativa)
  misc_feature (71): n=a or c
cagtgtaacctttctttccattctcgttgtctgcaataattgcctgacttgcacatttcagttttatcccntcatatgccccatccaacacctgaagaaaa

SEQ ID NO: 31385 - DNA, 101 bp, rice(Oryza sativa)
  misc_feature (71): n=a or g
aacatgctccaggatggtgaaggttcagatgtgacattcaccgtgggtggccaagagttccgtgctcatanatgtgttcttgccttccggtccccggtgtt

SEQ ID NO: 31386 - DNA, 101 bp, rice(Oryza sativa)
  misc_feature (71): n=t or g
gatgatagatatcagtgcatcctctcaatgaaaggtacctaaggtgaagaaaattgccaatttgactcagntcacgatctttcaaaccagatgtgccctcc

SEQ ID NO: 31387 - DNA, 101 bp, rice(Oryza sativa)
  misc_feature (71): n=a or c
cagcaggttcactcgctgtgcattcgcgcgcattttgattggggtgatgagacggatgatcccatttaatngtttgcctcgaagcgatttttgtttcagcc

SEQ ID NO: 31388 - DNA, 101 bp, rice(Oryza sativa)
  misc_feature (71): n=a or g
gggcagtggctccacgtacgtacccccgatgctacttgacttaaagctgagtacttttgagcagctcctcntgataacttttttttttccgttaacacttt

SEQ ID NO: 31389 - DNA, 101 bp, rice(Oryza sativa)
  misc_feature (71): n=t or g
gtgtttgtctggctgtccaattctgcactccattcctgaaggcctaacatgtagcgacattattgttgaanattgccccaattttaaagaaccatcaggta

SEQ ID NO: 31390 - DNA, 101 bp, rice(Oryza sativa)
  misc_feature (71): n=t or c
tcttcacacatggtccagtgggtcttgtcagagctaatgaggaacccagaagcgatgcacaaagcacaaancgagcttcggagtacccttcaagggaagca

SEQ ID NO: 31391 - DNA, 101 bp, rice(Oryza sativa)
  misc_feature (71): n=a or c
cacgcatcgtgtgctctcattcagctctgcctgtgctgagtcgctgaccctttctgtggatttatatgcanctagggtgtgtttttcttgctaaaattgaa

SEQ ID NO: 31392 - DNA, 101 bp, rice(Oryza sativa)
  misc_feature (71): n=a or g
gttgtggcggtcttggcagtgagattagcggcaggagacagcgccaatacagggtatagcaggattagcgntggcacagtgcggccagatttgcgatagga

SEQ ID NO: 31393 - DNA, 101 bp, rice(Oryza sativa)
  misc_feature (71): n=t or c
atctctgtgggcggaagatttgaccggaaaggaaatcgctttgagatcgccttgtgcgccgaggggttcgntggagagagaaaagacaaagttggcttaag

SEQ ID NO: 31394 - DNA, 101 bp, rice(Oryza sativa)
  misc_feature (71): n=a or c
ctctcactctagacgtgcatgacatgtaggtccacctacagtggggcctacctgccattgagtgaagatangacgagagagaacggcagtcacgagttcgg

SEQ ID NO: 31395 - DNA, 101 bp, rice(Oryza sativa)
  misc_feature (71): n=a or g
taattttttttaagcacccatagtcccgtgtcatcaaagtgtgaaagtaaaatttcaaggacgtgactagntctaaaccagctaccgctttatctatggaa

SEQ ID NO: 31396 - DNA, 101 bp, rice(Oryza sativa)
  misc_feature (71): n=a or g
agatcagtttaacataagcatcacagcagaacactgagcagcatgtaatttctgaccatcaaaacaagcantacgttcagtaactgagaagctgtagttac

SEQ ID NO: 31397 - DNA, 101 bp, rice(Oryza sativa)
  misc_feature (71): n=a or g
aatagtgttgctatgcttggcaacctctttgctaactgcgtctgtcgtcatcttaatgttggggctgttgntgtaccgtatgttgtagcatagtgttacct

SEQ ID NO: 31398 - DNA, 101 bp, rice(Oryza sativa)
  misc_feature (71): n=a or g
tgatacggaagaaatgggcaggagagaggatgctagccggccctcctttgaccgaaggggtgagaagctcnttggcgtaagccttgccaccgtcgactgaa

SEQ ID NO: 31399 - DNA, 101 bp, rice(Oryza sativa)
  misc_feature (71): n=t or c
tctaggctgagcacaagcgcaatgatggaaaggatgaggcggataatgtcacttagctaccatgacctgcnctaccatttgaaggcttgcttcctctacct

SEQ ID NO: 31400 - DNA, 101 bp, rice(Oryza sativa)
  misc_feature (71): n=t or g
cggtcagccgaacgaagccttgaggggtcaaattagactatttcaatagttaaggggattttgataccggntttggagtttataggtgaatttcgaacaaa

SEQ ID NO: 31401 - DNA, 101 bp, rice(Oryza sativa)
  misc_feature (71): n=t or c
gatgagatgagtgacataagcagatatctccagcctccagtttcttcagaaaaacggcaaaaaccatcgcntccccgcctcctgtttcgcccacgaaaact

SEQ ID NO: 31402 - DNA, 101 bp, rice(Oryza sativa)
  misc_feature (71): n=t or c
ttgacagcccctccaagaaattgacagcaagggtagcttgcacagcataaggaacaggtgtatagataaangccactctactcatgaaactttctagttct

SEQ ID NO: 31403 - DNA, 101 bp, rice(Oryza sativa)
  misc_feature (71): n=a or g
tggtagtttaaagatgccattcttggcaacaatttaaactacctacaggagctgagaagtcttcagatgtngcttctgtcgttgtgcataatcagccaaat

SEQ ID NO: 31404 - DNA, 101 bp, rice(Oryza sativa)
  misc_feature (71): n=t or g
ttgggaaaattttatagtcaatgattataacagggcagggttgcacaggacagtgttggtaaacaaaaaanaatgaggcaagctaattcaagacatcaaca

SEQ ID NO: 31405 - DNA, 101 bp, rice(Oryza sativa)
  misc_feature (71): n=a or g
ttcttgtactatcagacaattatcagtccgatactatcagtttttgaaaaaaacacccgcagctgtatgtnaaaacggtcggaatcggtagcatcttttcg

SEQ ID NO: 31406 - DNA, 101 bp, rice(Oryza sativa)
  misc_feature (71): n=t or c
ctatataaggagagcacgaagccctccaaggacataacataattaggtcatcagattaatatacatccggnggatacaatagccaaacaggagtagggtat

SEQ ID NO: 31407 - DNA, 101 bp, rice(Oryza sativa)
  misc_feature (71): n=a or g
gctctgaatataagggcatcaccattcaccaatatacatgacaaaagtggtccatataaataggatctacntaaatagattttaactatagcaatcttcac

SEQ ID NO: 31408 - DNA, 101 bp, rice(Oryza sativa)
  misc_feature (71): n=a or g
atgacgaagcaaggcgtgaaccctgatataatcacattttcaactgtgatatccgctttttgcagactggntaggttggatgatgctatggaaaaattcaa

SEQ ID NO: 31409 - DNA, 101 bp, rice(Oryza sativa)
  misc_feature (71): n=a or c
tataaaaagtttacaaaattttcaaatcttactatgattggcttagctgtacaaaatgatagaagcaaccnaaaatagcttatggataaaactttttataa

SEQ ID NO: 31410 - DNA, 101 bp, rice(Oryza sativa)
  misc_feature (71): n=t or g
ccttacacaaaacctagccacgtgcgtgggaaattcggtacaaatttatagtcccctttctcaatagcaantcatagacttaaaaatatgtattacgaaag

SEQ ID NO: 31411 - DNA, 101 bp, rice(Oryza sativa)
  misc_feature (71): n=a or g
tactctcttcgtcctaataaaactcaacctagaacttggatgaaattcgtgcatactagaacttgtccctngaacttggatgaaacataatctaataaaat

SEQ ID NO: 31412 - DNA, 101 bp, rice(Oryza sativa)
  misc_feature (71): n=a or g
agagacattcagtatttgaataaacttcattcacttaggttagggatcaacctcaaggtcgagattacctngtttaatcagctctccaacatcctatttat

SEQ ID NO: 31413 - DNA, 101 bp, rice(Oryza sativa)
  misc_feature (71): n=t or c
aattggtacatattaatgagcctttgtgatagataacattgaaaaaatgaattgttataaggttttaatcnatgaatttacaatatacttagttttggata

SEQ ID NO: 31414 - DNA, 101 bp, rice(Oryza sativa)
  misc_feature (71): n=t or c
ttatgtcatattttattagacatctttggtgccttctaatctactccttctagatatagagtaatgtctanatttattgtactatgatgtgttatatccta

SEQ ID NO: 31415 - DNA, 101 bp, rice(Oryza sativa)
  misc_feature (71): n=a or g
caaattgcattggttttaatagttcaggagtcatcctatctgataggatggggattgaatacgggaccttnagattgaaaccgcacaccttttaccactac

SEQ ID NO: 31416 - DNA, 101 bp, rice(Oryza sativa)
  misc_feature (71): n=t or g
actattggtaggagaatttgcaaggagtgtttgtgaacttggtgtgtgttaagctgtggaggtggtggtgncgcaaagaagttgcctccccatccatatgt

SEQ ID NO: 31417 - DNA, 101 bp, rice(Oryza sativa)
  misc_feature (71): n=a or g
gtttctagaatacatgtttaactgatcttctgaagatatatgctttgcttgtgttgtgaagctaaccttancctgattgaactcactttaagtaactacca

SEQ ID NO: 31418 - DNA, 101 bp, rice(Oryza sativa)
  misc_feature (71): n=a or g
agctccatcgccgctgtgagccccctactcgcctctgtgctcgatccatgtgtttataatgaagatacacntgggtattgggtttatgacttagtgcaaat

SEQ ID NO: 31419 - DNA, 101 bp, rice(Oryza sativa)
  misc_feature (71): n=a or g
aagatgatttgaggtcagaatcttatagcatcctagtatcctctgcagatgcacctttggcaacaaatacncatttaccttgtatggagtctctaacagtg

SEQ ID NO: 31420 - DNA, 101 bp, rice(Oryza sativa)
  misc_feature (71): n=a or g
tttctattgcatatactacttgaaatatgatgtcactattgttgaaacgatttaggaatagttgtgtgtgnctctcctttttttttttgggtttatattcg

SEQ ID NO: 31421 - DNA, 101 bp, rice(Oryza sativa)
  misc_feature (71): n=t or c
aactctgtcggttacaataacctaatatccctctgttttaatcatgagagagaggggtgggtggttttcantgtattacaagattgttcctttcttgccaa

SEQ ID NO: 31422 - DNA, 101 bp, rice(Oryza sativa)
  misc_feature (71): n=a or g
gcttcaggtggccaaggattgagatcgcccaagaatgcgcattcggaagcgatttcttcagagaagaatgntaaagacactgtcctagaaaatggtatctc

SEQ ID NO: 31423 - DNA, 101 bp, rice(Oryza sativa)
  misc_feature (71): n=t or c
ttcctgcaggcatttgttcttttatttttactgttcttattgctcttcttggaatgcaagtgatcattcanaggcgaagtatcaaaagacagcgtcttata

SEQ ID NO: 31424 - DNA, 101 bp, rice(Oryza sativa)
  misc_feature (71): n=t or c
ttgatttattgaaaatctttcaacttctctaaatatgctgctactgaattctagtatgtaacttctaccantaaagttttaaagtggcataaaaaataagg

SEQ ID NO: 31425 - DNA, 101 bp, rice(Oryza sativa)
  misc_feature (71): n=t or c
agaagaatatagggcgtgacggagacatggacgacgatattcgtgagcggattatggttggagcttattgntggagacgtggttggcgccgacgtggacgt

SEQ ID NO: 31426 - DNA, 101 bp, rice(Oryza sativa)
  misc_feature (71): n=t or c
tcacgatatgcagtattcttttcccccctgctgtttctaacattttttaggagtactcttatgtgtttccnaaggaagtaccaccggggttgccaccagtg

SEQ ID NO: 31427 - DNA, 101 bp, rice(Oryza sativa)
  misc_feature (71): n=a or c
atttgtgattctgtccatttcagctgcgggaggatccatcttttaagccttctggtggaagattaggtganaatgatatggactatgatacagatgataaa

SEQ ID NO: 31428 - DNA, 101 bp, rice(Oryza sativa)
  misc_feature (71): n=t or c
aattaactttgtgcttggtggaagccacatcttcatcaacacaagtggtcctagcaagatatcattgtacntatgtttatgcatgtcgagctttgatttta

SEQ ID NO: 31429 - DNA, 101 bp, rice(Oryza sativa)
  misc_feature (71): n=t or c
caacctactatcatcttcctcacatttagctctgacaacacttctgtgctttgcatgcacatatatatgangtaaactccaacttaggtgaaactcacatg

SEQ ID NO: 31430 - DNA, 101 bp, rice(Oryza sativa)
  misc_feature (71): n=a or g
atgggactcgcagtgatgcggtgactccaccagaattcattctggtgcagcgcacatgacgggcaccatcngaggccctcggcgagtcgcgagggtgttgg

SEQ ID NO: 31431 - DNA, 101 bp, rice(Oryza sativa)
  misc_feature (71): n=t or c
aattagacaaaaggggctcttagtttgaggaattcctctctgaccagtagatatcaggctgtaatttgccnagacagaatcttttctattcaaaacaacag

SEQ ID NO: 31432 - DNA, 101 bp, rice(Oryza sativa)
  misc_feature (71): n=a or c
agctctcgcgttcttggctacttcttcttctccttccaagctcggacctttcttcccgcgttcccgcgacnaagcttgcctcctctctccccgcgcgaagt

SEQ ID NO: 31433 - DNA, 101 bp, rice(Oryza sativa)
  misc_feature (71): n=t or c
atactggcaaacagccatggaagaggagttcactgctctcaccgccaaccgcacatgggacttggtgcccngaccatccagcgccaatgtcgtcaccggca

SEQ ID NO: 31434 - DNA, 101 bp, rice(Oryza sativa)
  misc_feature (71): n=t or g
tccgccgaactgggaaaaggaggagtcaccgggcgtgcccgtcgaggccttcttgacaggaggaccatgcnagtcgctgtcaacggtcttgcgcttacggt

SEQ ID NO: 31435 - DNA, 101 bp, rice(Oryza sativa)
  misc_feature (71): n=a or g
tttattgcccccactttgggtagcgaggggcatttacgttattagcagcaattgaaatgtatatggaccancttgtaggagccttttcaccgtccctactg

SEQ ID NO: 31436 - DNA, 101 bp, rice(Oryza sativa)
  misc_feature (71): n=t or c
gtacaaagatgaaatattacatgcttcaatgaatctggatacagaaagaatgtccagtgccaattggatanagaaagaatgtccagtgccaattgtacaga

SEQ ID NO: 31437 - DNA, 101 bp, rice(Oryza sativa)
  misc_feature (71): n=t or c
aatgggccctcataggaaaacggggatctatgtgggatatttatccccgtcgattattaaatacctggagncccttacaggggatttactcacggcccggt

SEQ ID NO: 31438 - DNA, 101 bp, rice(Oryza sativa)
  misc_feature (71): n=a or g
ttcctttaggtaatttgtctgttctgtgcttgttaaggtacgcaaagagaatattatttcccaggaaaagntgctccaagcatttgataatgcccttcaga

SEQ ID NO: 31439 - DNA, 101 bp, rice(Oryza sativa)
  misc_feature (71): n=a or c
taggaggggaggagctccacgaaggtgggttttttcagccggctgggaagaagagacgcctccgccgccanccgcttccccgtgcacaggccagagagagg

SEQ ID NO: 31440 - DNA, 101 bp, rice(Oryza sativa)
  misc_feature (71): n=t or c
cactttcagcgaaaatgtccgaattcgtattgatgtgccgaatctactttccctgtggctacaagattatngctgccggactcctgtgtttgaggttatgc

SEQ ID NO: 31441 - DNA, 101 bp, rice(Oryza sativa)
  misc_feature (71): n=a or g
cgaccaaggaaatggtggcaaactagctccatgagttgtcacggaaggtaaagaaggcttaactgcagcanaactctcacatccaggtgataaaagagagt

SEQ ID NO: 31442 - DNA, 101 bp, rice(Oryza sativa)
  misc_feature (71): n=t or c
aagatgcataaccaactgggtattaaggcaaaatttgttctatgacaccctgttagcaacttttttttganaagaagacaatcacgatcgcaacacctaaa

SEQ ID NO: 31443 - DNA, 101 bp, rice(Oryza sativa)
  misc_feature (71): n=a or g
tccagatctagttgttgcattcatttccaaaatccctcaacactagttttcctgtgatggccaaatcttcngggaaagaagcctgaagagcctacaagaaa

SEQ ID NO: 31444 - DNA, 101 bp, rice(Oryza sativa)
  misc_feature (71): n=t or c
gttttaataagtaggaaataaatataattttaagttggatcttaatagaacactacactggatcaggtcancactgacgggctcaaaccctcaactttgac

SEQ ID NO: 31445 - DNA, 101 bp, rice(Oryza sativa)
  misc_feature (71): n=t or c
ccaacttccatataggcagaaacagaaggcgacgacgagtgaacttttctacccttttactcttttagtcnctggaagcttgctctgagctatatatgtgg

SEQ ID NO: 31446 - DNA, 101 bp, rice(Oryza sativa)
  misc_feature (71): n=t or c
atgtacggtggcatgcttgctgcgatagtgatgatgcttttcatggttgatccagtccttcaacacgtgangatcttgctcgatttatgtggttttgccat

SEQ ID NO: 31447 - DNA, 101 bp, rice(Oryza sativa)
  misc_feature (71): n=a or g
ctcaaattatttcatagtatgtgctttttgtttttcccacggtggctctacaaagcaaggtttgcaatttngatttgggccaaaagttttggtaatttcgg

SEQ ID NO: 31448 - DNA, 101 bp, rice(Oryza sativa)
  misc_feature (71): n=a or c
tggttaaaaattcacatggtttaggttaggttcacacccagctcattaccattggtactaacccattgcantatatggacattttctcttttattataaag

SEQ ID NO: 31449 - DNA, 101 bp, rice(Oryza sativa)
  misc_feature (71): n=t or c
aattagtcactagagtcctaatctgtagtttaatactttccaggtcatggcaatagttgcagactttatgntggtttggcttcctgctccaacagtgtctc

SEQ ID NO: 31450 - DNA, 101 bp, rice(Oryza sativa)
  misc_feature (71): n=a or g
aacacaatcttatgaagtagatttttattgttgtgtcgaggggagccggatagcacattatctcacaccanccttccaaagtaaatatagatcatcaccat

SEQ ID NO: 31451 - DNA, 101 bp, rice(Oryza sativa)
  misc_feature (71): n=a or g
aatcaacaattagtagaattttgcttgtgaggctcatatctggaccctcaaccatttaaccaagaaccaantcaagtcgtcgactcgtcgtcatcgacgtc

SEQ ID NO: 31452 - DNA, 101 bp, rice(Oryza sativa)
  misc_feature (71): n=t or c
ccgctctcatcaccttcgcccaactcctctcttgctagatgaggagtcgccaccaccccctgtgaaacatnaagcattgctcccgctccctcccgctggag

SEQ ID NO: 31453 - DNA, 101 bp, rice(Oryza sativa)
  misc_feature (71): n=a or g
ttatggctccatctttccatgtggttcaaggtgaccttcagatatatcatattgtttttcattgtcccccncaaaaaaaaaaattgtttttcattgtctgc

SEQ ID NO: 31454 - DNA, 101 bp, rice(Oryza sativa)
  misc_feature (71): n=t or c
atcgtcgtagcggtctattgaacggcgtggaaggtagcctctttctgcgtggcgccgattgagtgtctcgngaagatcgacgggctacctacgacgtggag

SEQ ID NO: 31455 - DNA, 101 bp, rice(Oryza sativa)
  misc_feature (71): n=t or c
gtagctgaacattgtaacttgtcgggggatgtgttttttgccatctccttcgttgcttgcgttgccctgancttgtttgagggcaacttgcaatcgcaggt

SEQ ID NO: 31456 - DNA, 101 bp, rice(Oryza sativa)
  misc_feature (71): n=t or c
actacacttataacccatcaccgatctcttcttactcggatgagcctgaaaacttctgaagtagctagtanaagatagtaacaagactagctcgagttggg

SEQ ID NO: 31457 - DNA, 101 bp, rice(Oryza sativa)
  misc_feature (71): n=a or c
aaaattgcagcttgttattactgctatcttgttgaaaagaagaagcatttgtcgaagcttccaaaaacgcnaatggcaaatgccaaagcagtagtacagct

SEQ ID NO: 31458 - DNA, 101 bp, rice(Oryza sativa)
  misc_feature (71): n=a or g
gctgaggtggagataatcagtcgtgtgcaccaccgccatctagtttctcttgttgggtattgcatttcggnggaccagaggttgcttgtctatgattttgt

SEQ ID NO: 31459 - DNA, 101 bp, rice(Oryza sativa)
  misc_feature (71): n=a or c
ctggtggtagaggcgctttatgtactccggtttgggctctagaccacttatagctcaaggaagaccatatntactactacttaaaaaataagaggtgcttc

SEQ ID NO: 31460 - DNA, 101 bp, rice(Oryza sativa)
  misc_feature (71): n=a or g
gtcgtgtaggtgcaagacacaaataggtgttcataatcttcatcaaccaccaagcaaagttggcaaacctnctggttcggccagccacgcttacttagatt

SEQ ID NO: 31461 - DNA, 101 bp, rice(Oryza sativa)
  misc_feature (71): n=a or g
ctagctcatgcatattagctttcccaatgaataacactccacatttccgcaaacgagcaacacaaactgcntctttctccacagagcgaattttgtcgaaa

SEQ ID NO: 31462 - DNA, 101 bp, rice(Oryza sativa)
  misc_feature (71): n=a or g
gagcttgaaatcactggaatcttgcttaggagagctcccgtcgctgcaacaactcaccctttttgattgcnagagcctggtatccttgccgaaggggcctc

SEQ ID NO: 31463 - DNA, 101 bp, rice(Oryza sativa)
  misc_feature (71): n=t or c
aacactgtattcatgacaccttggaaagtagcgggtgcaccagttaatccataagacataacccgaaactngtaatgtccatgatgcgttttgaacgcagt

SEQ ID NO: 31464 - DNA, 101 bp, rice(Oryza sativa)
  misc_feature (71): n=a or c
agaggaaagtttttttacacttcacactagtcttgagccattcatgaagagtgtttatgcctcgttgcttntctttttccttcactcccatgaaatactgc

SEQ ID NO: 31465 - DNA, 101 bp, rice(Oryza sativa)
  misc_feature (71): n=t or c
tttaaagtacgatacaaatctaagttgttgttagtactacaatagattttccatctggcatcaagcttgcnacaatagcccatggacatccctcagccttg

SEQ ID NO: 31466 - DNA, 101 bp, rice(Oryza sativa)
  misc_feature (71): n=a or g
gcgctaccccatcatatcatcgacttagcttccacagagagactagagagatgtcgctaatgttattggcntcgtcatgttgaatcacgacgctaatgacg

SEQ ID NO: 31467 - DNA, 101 bp, rice(Oryza sativa)
  misc_feature (71): n=a or g
cgtaaagcatgtatatgcctagtagcttacttgggttgtgacctataggcccacatatcaagtagaaaatnttttcggctcgatcattaaacgtcttaatt

SEQ ID NO: 31468 - DNA, 101 bp, rice(Oryza sativa)
  misc_feature (71): n=a or g
acgactacgcgatgttcatggggtacctgtcaatggctgtcaccgggacgggcttcctggtgctcacttgntccaccgtcgtcctcctcggtggattcgtt

SEQ ID NO: 31469 - DNA, 101 bp, rice(Oryza sativa)
  misc_feature (71): n=a or g
tctccttctcctcatgttcccacccataaaaaatcctatccgggctagcagttcaatcgtaaaaaaaaaanatggtgaaatggtgatgatttgggactaat

SEQ ID NO: 31470 - DNA, 101 bp, rice(Oryza sativa)
  misc_feature (71): n=t or c
atgagtggatgggataagctgttagctccattgaaacatagtcaagtaaccggctgtatggtgctagcaanaacccgaaaaaactcagttgcagaaatgat

SEQ ID NO: 31471 - DNA, 101 bp, rice(Oryza sativa)
  misc_feature (71): n=a or g
atatgtcctgatactggaaatcaggctatgcaccttccaattgtcaggtgattggtgcgaccgaatctgtnagaggatattgatgagaagcctcctcatat

SEQ ID NO: 31472 - DNA, 101 bp, rice(Oryza sativa)
  misc_feature (71): n=a or g
gatgcgcccaattttggtcgctggtactctatattccctaatgtaagatgtttaaccaagttaatttaatnaaaaacatagcaatatttgtaaaaaagaaa

SEQ ID NO: 31473 - DNA, 101 bp, rice(Oryza sativa)
  misc_feature (71): n=t or c
atactgcacgtgcaaaaagaaaatgttactagctgtttgcaaatgttgatatggcatggaatcttggttgnttttttataatatataacatttaacaaatt

SEQ ID NO: 31474 - DNA, 101 bp, rice(Oryza sativa)
  misc_feature (71): n=t or c
tgatgtttgcgtatttactgtatccattgcatgtgtgttaaaatcatatcgcaaattcaactatcctgtgngtttattctcactggtggagaaaacgtttg

SEQ ID NO: 31475 - DNA, 101 bp, rice(Oryza sativa)
  misc_feature (71): n=t or c
tcctgtctggaattttcagaagtgcatgcataaatggacagagaaaaattctggcgagcaattctacggtncttgagaaggtaccatgaggtactaaaaaa

SEQ ID NO: 31476 - DNA, 101 bp, rice(Oryza sativa)
  misc_feature (71): n=a or g
agtcatgatcttaaggtccgcctctcctatagcctatactaaaatttaattcgtagagaaaactcacttcnttttcttttgaattagatacttcaacgtca

SEQ ID NO: 31477 - DNA, 101 bp, rice(Oryza sativa)
  misc_feature (71): n=t or c
gctctcgccaagatgtatggcagtacgcttgacctggctactatcccgaagaagctgcatccttgagaaantgcatatcgtcgcatgtagttgtatgactc

SEQ ID NO: 31478 - DNA, 101 bp, rice(Oryza sativa)
  misc_feature (71): n=a or g
ggtcgaatgcgctaagctccttgcatttcaaactacaggccacggcgtcggctctgaggagctggggcgcntggcggatcagcgacttgcggctgcaactg

SEQ ID NO: 31479 - DNA, 101 bp, rice(Oryza sativa)
  misc_feature (71): n=t or g
tgcttgcaatatctgagacctgagccaccaaggatcccaagtccaatgcatgggagaaacatacagttagnagggaagggtgcaagattcgacaatgcagc

SEQ ID NO: 31480 - DNA, 101 bp, rice(Oryza sativa)
  misc_feature (71): n=t or c
ccttgctgatagtgggctagccaatagatactggctgactccactcgcttgtttagtttctagctttgatngtctgtcttctttattttttttaaaaaaaa

SEQ ID NO: 31481 - DNA, 101 bp, rice(Oryza sativa)
  misc_feature (71): n=a or g
gatcccaaggaacactgcaatcccgaccaagaaggtgaaaaacttcactactctctacgacaaccagatcnacgtgagctttccggtgtacgagggtgaga

SEQ ID NO: 31482 - DNA, 101 bp, rice(Oryza sativa)
  misc_feature (71): n=a or g
cactgacctcactcacctcacgctctactgatttgattaccgtgcatttcactcgattgctctatcccatnatgtactccctccgttccaatatattaaaa

SEQ ID NO: 31483 - DNA, 101 bp, rice(Oryza sativa)
  misc_feature (71): n=a or g
tccaactctaattcagaatggggaaatatcgagggaaaccagggaaaacttagatcattactttctcaaanaaaaaacttaatctaggagaagatgtctat

SEQ ID NO: 31484 - DNA, 101 bp, rice(Oryza sativa)
  misc_feature (71): n=t or g
gagaaaaaggaaaagaacagtagaggataaccagcaaaaagatgaaaggattcgaacccatgacctagcgntacaattgtttcacaggctaaccaattgag

SEQ ID NO: 31485 - DNA, 101 bp, rice(Oryza sativa)
  misc_feature (71): n=a or g
acccacagaaattcctatacttgattctgttatttctaatgctgtagttcctggatctgatatatcaacanttttaagtcgtgaagaccgtgaagatattt

SEQ ID NO: 31486 - DNA, 101 bp, rice(Oryza sativa)
  misc_feature (71): n=t or c
ataaaaaaaatgaccttaatcatagattagcaacacaaccccaccagccacacctagaaatgtaattcggnggctaatccaagcatgatgaacaatacaat

SEQ ID NO: 31487 - DNA, 101 bp, rice(Oryza sativa)
  misc_feature (71): n=t or g
ttgaggacctgccgccgcctcaaataagtagaagtagcatccgatggcgacaataagcttgggaagatcanagccagcaggaggagcgccaccaagcctcg

SEQ ID NO: 31488 - DNA, 101 bp, rice(Oryza sativa)
  misc_feature (71): n=a or g
aacaaacgttacatagtctggctttctacccgttgcaaccatttgcttaaatgtttcctcagcttccttgnaatacccatattttgcataaccagatatca

SEQ ID NO: 31489 - DNA, 101 bp, rice(Oryza sativa)
  misc_feature (71): n=t or c
cctgatcgagacgaggagcaccgacgagcacatcgtccgcaagcgcataattgccgaggacgatgagaaanaatccgcgcaatcgggaatagctgtcggcg

SEQ ID NO: 31490 - DNA, 101 bp, rice(Oryza sativa)
  misc_feature (71): n=a or g
atgttttacttagctaaatcctccacaaagagctaaaggaaagatcctatgtgaagagtaaaaaagtagcnttgcaacaaacatcctatgctactctttac

SEQ ID NO: 31491 - DNA, 101 bp, rice(Oryza sativa)
  misc_feature (71): n=a or g
ggttggatagtgtgtgcaatccgctagagaagttaacagataggaagttggaaacaccttgccacaactcntcaaagagaggatgtgtgtgttggggagag

SEQ ID NO: 31492 - DNA, 101 bp, rice(Oryza sativa)
  misc_feature (71): n=t or c
agatggaaagaacacagaagaggacaaggaggagagtgaacgagaagaagaggagaagacaacagaagaanaacatgagtggcaaaagcgggacgggtggt

SEQ ID NO: 31493 - DNA, 101 bp, rice(Oryza sativa)
  misc_feature (71): n=t or c
taactaacattttattctttttttatagagggtgtatctctcttgcctatctatttttttctccgtcgccngcccaactcttgctagtgttggttgctagt

SEQ ID NO: 31494 - DNA, 101 bp, rice(Oryza sativa)
  misc_feature (71): n=a or c
cttctataggtgagttcggtttccttttctcaaagaccgatctttttaaagaccgaattaaccggaccganctttcggtctacaccgaatacgcaccacta

SEQ ID NO: 31495 - DNA, 101 bp, rice(Oryza sativa)
  misc_feature (71): n=t or g
atctaggtgtagaagagggattggaaaactctagccatggctaccaaggatgtacccgtggaggtggaagntactcaaacaccaccttgaatctcctgaag

SEQ ID NO: 31496 - DNA, 101 bp, rice(Oryza sativa)
  misc_feature (71): n=t or c
gcacaagtgtttaaagctctgcttgtttttatctacacggacacttggccagagataggtcaagacgagangactatggttcaacaactactcgttgcagc

SEQ ID NO: 31497 - DNA, 101 bp, rice(Oryza sativa)
  misc_feature (71): n=a or g
aataagttgcatttttgttgcaaaactgcactgacagaaaagctgtagtgtccaattgttgcaaggatatnctccctccgtttcaaaatgtttgacaccgt

SEQ ID NO: 31498 - DNA, 101 bp, rice(Oryza sativa)
  misc_feature (71): n=a or g
cattcaggctgtacatacatatatataaagatcagtaagttgaactttgaaaaaaatgttggcgatattcntgtacagtaattcgaatttggaatgcatta

SEQ ID NO: 31499 - DNA, 101 bp, rice(Oryza sativa)
  misc_feature (71): n=t or c
ttcactctgttgccacttcgaaaatctatgatgtgaaaacgcacaaggtcaccatgaacaaaggcacttgnaggacggccatctagatgccatgtctgaaa

SEQ ID NO: 31500 - DNA, 101 bp, rice(Oryza sativa)
  misc_feature (71): n=a or g
agtatgatggccgccaagagcgagatgaatacccatggattgctgaagtacgtatgcataagggtcgctcnccacttgttccacggcttcttgcagtgcgc

SEQ ID NO: 31501 - DNA, 101 bp, rice(Oryza sativa)
  misc_feature (71): n=t or c
gaaaatcaggtcaacaccaccacgtcagtaaaaaccgttctccaaaactgctagagaagttaaaaccatcntccaaaatcgctggggagttaaattacact

SEQ ID NO: 31502 - DNA, 101 bp, rice(Oryza sativa)
  misc_feature (71): n=a or g
atggatgagcctggtccataccttaatgttgcatctcgtagtcaagagaacgaacctaatgctgatactcnggtggaagaaaaatgggaacgaagagtaca

SEQ ID NO: 31503 - DNA, 101 bp, rice(Oryza sativa)
  misc_feature (71): n=t or c
gagggtgcatcccgtgaagactggagagattcggcgctacaaggcggcaaagctggcggcgttactctatntgaggccaaggctgtggttgctcggatgga

SEQ ID NO: 31504 - DNA, 101 bp, rice(Oryza sativa)
  misc_feature (71): n=t or c
atttgttatttgcttccaatcgataccgacatgttgctgttgccgtccgtatagaccatttccggttttcngatattttcgatatcttttttttccggctt

SEQ ID NO: 31505 - DNA, 101 bp, rice(Oryza sativa)
  misc_feature (71): n=a or c
gacgtcgccgccgcggcggacggctcgaccatcgacctcgcaatgctgtacgccaagtttctgaaccaccngccgaccgacgccgggctcggcgccgtcac

SEQ ID NO: 31506 - DNA, 101 bp, rice(Oryza sativa)
  misc_feature (71): n=t or c
aaggcaaaaccccaacagcttggcaggatgtccgaataccgaatccaataattgtgcatgcagtgtgacantgtgatgtaactttttctttaactaggaag

SEQ ID NO: 31507 - DNA, 101 bp, rice(Oryza sativa)
  misc_feature (71): n=a or g
atgtgagagtgtgacaatattctcattcattctcttctctagcggggctacaatagtgactcgtcgagganagggggacagcggatccatcctcgtcgaag

SEQ ID NO: 31508 - DNA, 101 bp, rice(Oryza sativa)
  misc_feature (71): n=t or c
gtttcttgagggttaggttagtaatttttctcatgcatctctacttctctagtagctactacctccatccnaaaatataacaacttttggctgtccggatt

SEQ ID NO: 31509 - DNA, 101 bp, rice(Oryza sativa)
  misc_feature (71): n=t or c
ctgataattttgacgtgaacgaggggaaataactctggggagttttgaacttcaatctcctttcttttctnttttttttttcatattccaaccattgccct

SEQ ID NO: 31510 - DNA, 101 bp, rice(Oryza sativa)
  misc_feature (71): n=t or c
caaggctagtatgctgtactattctcttgtttcaggttttcctttttctgcccccaaagtagttggcaagnagtgaccaactgtgggcaagagttttgaaa

SEQ ID NO: 31511 - DNA, 101 bp, rice(Oryza sativa)
  misc_feature (71): n=t or g
tcttgtgctgccacttcctatatcatctgcacctaacgttgaatctctataccaacctttcgctgtcgatngtgcacggcgtgtcaatattgttccagttt

SEQ ID NO: 31512 - DNA, 101 bp, rice(Oryza sativa)
  misc_feature (71): n=a or g
ttgatctaatctaatcctagtaaaatctaatctatggattatttgtggcatctaaagatgtggcaccccantgagattataggattgatctcatctcccca

SEQ ID NO: 31513 - DNA, 101 bp, rice(Oryza sativa)
  misc_feature (71): n=a or g
ccaaagtctgctgtcccgtccatcatgacgggcggagttaccaacttagaaaaatttgctagaaccctacngctgagataactttgatatgaatagagggc

SEQ ID NO: 31514 - DNA, 101 bp, rice(Oryza sativa)
  misc_feature (71): n=t or c
caaaaagaacttcatatcggccctcttaccatgcattcttcctactggagtatcccaaggtcgattcactnagaattcatatgaattctatcatccaatga

SEQ ID NO: 31515 - DNA, 101 bp, rice(Oryza sativa)
  misc_feature (71): n=a or g
tctggcctctgtggctctgttttttacttttcctgtggtctattccaggaggaggtaattgcttcagctgnaaaaatagcaagggaccttctagcgcgagc

SEQ ID NO: 31516 - DNA, 101 bp, rice(Oryza sativa)
  misc_feature (71): n=a or g
ggatatgtccatcaacaaggagttgattttgatgaagtatttgccccagtgacgaggatggagactgtgcnattgctgattgcaacggctgctcatcaggg

SEQ ID NO: 31517 - DNA, 101 bp, rice(Oryza sativa)
  misc_feature (71): n=a or c
gtaaacctttgtgtcatactttgctgactgaccaagctgatcaagatacctagttgaaacagcaagtttangaacaaaacaagaaaaatccccatggttgg

SEQ ID NO: 31518 - DNA, 101 bp, rice(Oryza sativa)
  misc_feature (71): n=t or c
tataacgaccacttcacgtgccctatctttctccgcctcctcgctcacgagctcgtcctcctcttcttctnctccttccacggaagtctaggttcatctct

SEQ ID NO: 31519 - DNA, 101 bp, rice(Oryza sativa)
  misc_feature (71): n=a or g
tgtgtttcagatagccacactatcttatttctaacacgatatcatggaccatgtatagtgccaagttggtntatatatatatatatatatatatatgaatt

SEQ ID NO: 31520 - DNA, 101 bp, rice(Oryza sativa)
  misc_feature (71): n=t or g
gcaacctcttcaatctgctatcacctccaggataacaaatttggtaagtcatacctctgagcaaacaaaanaattgactataatagaaagtctcttctggt

SEQ ID NO: 31521 - DNA, 101 bp, rice(Oryza sativa)
  misc_feature (71): n=t or g
tgaggccggctttatataggatcagctctccaacttgcaagaaccaaccacaggtacgtagctcctgcttnaattaataatcgtccatgcatgcatatatg

SEQ ID NO: 31522 - DNA, 101 bp, rice(Oryza sativa)
  misc_feature (71): n=a or g
tggcgcgttcttcagcaatagtcgcaagaggcttttgcggtcatcgaacggtataaatcccttgaactctnccctctttaggttatctagttgtatcttct

SEQ ID NO: 31523 - DNA, 101 bp, rice(Oryza sativa)
  misc_feature (71): n=a or g
ggttcttgagaccatatgtttgcgtggcacgtctccgatatttatggagaaaacgtgtgtagtttctcttntgcttctaggtatattaattcttattaatc

SEQ ID NO: 31524 - DNA, 101 bp, rice(Oryza sativa)
  misc_feature (71): n=t or c
cgtgcgtgtcagcctcgcggggtatcgccttgcagaacataactacttcggtgttgatgaccaaaaaaatnttggtgaatctctaaccatcttctatagca

SEQ ID NO: 31525 - DNA, 101 bp, rice(Oryza sativa)
  misc_feature (71): n=a or g
ggcattaaaaatttctattagttggatcaaaacaaacactatcttaagcccaaaatcatattctctaaggncatcagcaatgtatccttcccaagtagtaa

SEQ ID NO: 31526 - DNA, 101 bp, rice(Oryza sativa)
  misc_feature (71): n=a or c
atggcaagctgtctgtcatcagcatggtgacccagcaacaagtggatcgatttcagtactcctttcgtccnctaatataagggatttttatattttagtta

SEQ ID NO: 31527 - DNA, 101 bp, rice(Oryza sativa)
  misc_feature (71): n=a or g
aagtaaagttatggttctggttgaacatgtgatgttgccagtctaatgtgaccttaatgacccatgattgntggattgggtcacgcactctaacatatatc

SEQ ID NO: 31528 - DNA, 101 bp, rice(Oryza sativa)
  misc_feature (71): n=t or c
ttttcaagaggactcatattttggataactctgctaggaactctgttgatgagataggtggcagcctgcanagcttcatcccaaaattttaaaggcatagt

SEQ ID NO: 31529 - DNA, 101 bp, rice(Oryza sativa)
  misc_feature (71): n=t or g
gtgcgccacacatttttaccgaacctcacttaccacctatgctagcaacggtattagctacaagctcaagntcactcgtggtgggtcccaccactctctct

SEQ ID NO: 31530 - DNA, 101 bp, rice(Oryza sativa)
  misc_feature (71): n=t or c
atacttttgctggttggaaggaggggttgatcaactttccgcctacttacaagtatgaaacaaattcaagnaaatatgttggggagaaacctgacgaagtg

SEQ ID NO: 31531 - DNA, 101 bp, rice(Oryza sativa)
  misc_feature (71): n=t or c
tgacgcgccacccatgctcaaaatccgcaacatctgttgcatctcttcgttctccaatatctcgtggctcngcatcctgatctcctccatcaggtagtcgt

SEQ ID NO: 31532 - DNA, 101 bp, rice(Oryza sativa)
  misc_feature (71): n=a or g
ggaagctttctgttcaggctgctggttgggaacccaaacgtttcattactatccatcccacaccgaagtcnaaggcgcctgctcgcatcctgggttccaag

SEQ ID NO: 31533 - DNA, 101 bp, rice(Oryza sativa)
  misc_feature (71): n=a or g
gaagaggcagggtttgaggcagatgaagccacaatagttacagtgctttcagcttgtgttggttatggtancatcgatctggcaaagaggcttcattgtct

SEQ ID NO: 31534 - DNA, 101 bp, rice(Oryza sativa)
  misc_feature (71): n=t or g
aggatccaatgacccatcaacgactttaacctcaaatgtcgcctccactgtctctggaattaaagcaaacntgatctgcaccgtgctgcgcttgttggaag

SEQ ID NO: 31535 - DNA, 101 bp, rice(Oryza sativa)
  misc_feature (71): n=a or g
caaaattgttggccatggactatttggagatggcgctggcgctatcattgtcggtgcgggctccttggccnatggtgagcgcccgctattcaagatggtag

SEQ ID NO: 31536 - DNA, 101 bp, rice(Oryza sativa)
  misc_feature (71): n=a or g
acatcgaaagtccaaagtccaaattcagcccataccgtatgcacagatgcaagaggaagcaattgggctangcgtggccatcgtccatacatcttgtcatc

SEQ ID NO: 31537 - DNA, 101 bp, rice(Oryza sativa)
  misc_feature (71): n=t or c
ccatgagatgtagcaagcttcatcttcatcttctcctcctacctccagaaaagttgtctgattctctctanactagccatggatttcctggccctgacaag

SEQ ID NO: 31538 - DNA, 101 bp, rice(Oryza sativa)
  misc_feature (71): n=a or g
tgtgctgtgcacatgcatgatatatgcatgaatcatgatgggttgatcgcagtgatgcagcagccgccgcncggctttcctcctctgccgtcgtcgagcgg

SEQ ID NO: 31539 - DNA, 101 bp, rice(Oryza sativa)
  misc_feature (71): n=t or c
ccgccatgatgttatcgtgtatcgctgagaggatatcggggaatggtacttcaggtaccatgctcttctgnttatttcaactatagcagaagaatgatttg

SEQ ID NO: 31540 - DNA, 101 bp, rice(Oryza sativa)
  misc_feature (71): n=t or g
aaatgaaagagaagggtgtcctaccctgtatgcatatgttttcagcgttgatcaatgggttatgctttganaaccggctggaagaagcttgtgtatatttc

SEQ ID NO: 31541 - DNA, 101 bp, rice(Oryza sativa)
  misc_feature (71): n=t or c
taagggcacatttaatgcccacaactatctgccgctctctcgtaggaagcccgcagctaagcattcatggngagaagatgggccattaagggcacattcaa

SEQ ID NO: 31542 - DNA, 101 bp, rice(Oryza sativa)
  misc_feature (71): n=a or g
agccactcgggttatgctcgccaactaccttagctcctcataagacagcttctacgacgacactgagatcngagatggatctgacttcgacgacgactata

SEQ ID NO: 31543 - DNA, 101 bp, rice(Oryza sativa)
  misc_feature (71): n=a or g
caagcagacttgcggacatgctgctttttgtttccaaaattgatataatgaggatccaccgcgaataggcnaaccaatataccaactgtgacactgatgag

SEQ ID NO: 31544 - DNA, 101 bp, rice(Oryza sativa)
  misc_feature (71): n=t or g
ttagaagtcctagactgagcactttgacccctttttcattagcatctaatattgccttctcgatcaagatngttgagggacttactttcccaagacaagcc

SEQ ID NO: 31545 - DNA, 101 bp, rice(Oryza sativa)
  misc_feature (71): n=t or g
aaaagggcggtttcttgtgtagctgaatttggggtaggggagttgctgtcagtgtgtgaactgtgaagggngggttgggggtggctgcttctgagaatttt

SEQ ID NO: 31546 - DNA, 101 bp, rice(Oryza sativa)
  misc_feature (71): n=t or c
tatgtaatacccccgctagccgagtggcttaaaccttgatgcagtatatacgatgtgaatactagagtaanatgactcgagtgatatattgattatataat

SEQ ID NO: 31547 - DNA, 101 bp, rice(Oryza sativa)
  misc_feature (71): n=t or c
tgaacttggcgatcactgcaaacatcaatgctgaaactgggccttgaaccatacgattcactacccaaaancagttgcctaagggtatttactagagaacc

SEQ ID NO: 31548 - DNA, 101 bp, rice(Oryza sativa)
  misc_feature (71): n=t or c
cccgcaccggcccagcccaccttcttcatcttcttcctcgaggcaaccacacacacgcaaacaaacagttngacaaaatgtctcgcccaacgttgcacggc

SEQ ID NO: 31549 - DNA, 101 bp, rice(Oryza sativa)
  misc_feature (71): n=a or g
tggctcccattgttgctgattatgttgattatttccctgtgatacgatgtatgtatattgctatgagtcanagatgaaggtagtactgggttctttatata

SEQ ID NO: 31550 - DNA, 101 bp, rice(Oryza sativa)
  misc_feature (71): n=a or g
cgtggatcaaggagttcggagttttattctccgaatccctttcaccgcctcatcgaggcctcgccggagcnccgccgcatcgtgcgtctcctggttaggag

SEQ ID NO: 31551 - DNA, 101 bp, rice(Oryza sativa)
  misc_feature (71): n=t or c
aactctagataaaatgatgcaacttaagaacctgtaatgctagtgccgactaaacgacttaactcaaacanaacgtaaatcaaatctagagaaaaccacat

SEQ ID NO: 31552 - DNA, 101 bp, rice(Oryza sativa)
  misc_feature (71): n=t or c
agctgagtcacaaattaaagccggccgttctttagctggctagtaggtagctagttgactctcatggatgnatatgtttgcttctttttgcaaccaattta

SEQ ID NO: 31553 - DNA, 101 bp, rice(Oryza sativa)
  misc_feature (71): n=a or g
acaatggacatactacctttcctcctgctgctcctcctctgttgtccccttcttcctcatcgacggcagcnccctcccaccgctccaccacgccgtcgtct

SEQ ID NO: 31554 - DNA, 101 bp, rice(Oryza sativa)
  misc_feature (71): n=a or g
aaaataattatccgtaaataagagtattgtgtcttctagaacttaaaccgaataaattggttccaccgctnaaaacctaatcagttgggctagctacggtc

SEQ ID NO: 31555 - DNA, 101 bp, rice(Oryza sativa)
  misc_feature (71): n=a or c
cataataaatatcgaatttcaatggtcaggtcagataggctagctatgatatgctgtgtagattaatactncctccaggcattgtcaaacttagcacagtc

SEQ ID NO: 31556 - DNA, 101 bp, rice(Oryza sativa)
  misc_feature (71): n=a or g
aaggcaggtaagctagacttctatagaaggattaatgtctgggcttgaacagggaagtagagggggtcgantatactttttagagggaagatggtgcacag

SEQ ID NO: 31557 - DNA, 101 bp, rice(Oryza sativa)
  misc_feature (71): n=a or g
tttgagggttgccatgacagaacaggggttaaatgtagagagacaatgtagccgcttgtatcttggtacanatgtacacacatttgaggctggagattcct

SEQ ID NO: 31558 - DNA, 101 bp, rice(Oryza sativa)
  misc_feature (71): n=a or g
tccagaaaatgcagctactcgtggacctcaaaatattcttgggtttcctataaaaaatgcagacacacgcncagagagagacacacacaaacacatgtaca

SEQ ID NO: 31559 - DNA, 101 bp, rice(Oryza sativa)
  misc_feature (71): n=t or c
tactaagaaaaccggattggtgccggttgggaagcccacttaatgccggatttgctttgaatgcaaattangagtggttaaaataataggtttattatatc

SEQ ID NO: 31560 - DNA, 101 bp, rice(Oryza sativa)
  misc_feature (71): n=a or g
gtatcccgttcggacgggatgataacttagagatattgtctgatacctgagaatcaaccgatactaccagntatcaggcgatacctcaaaagtatcatcct

SEQ ID NO: 31561 - DNA, 101 bp, rice(Oryza sativa)
  misc_feature (71): n=t or c
ctctattcgtatgcatgttttttggctgtgttcttccctcaagattcatgacctcatctatctcgtttttngtgcctacgctttctaaactactaaacggt

SEQ ID NO: 31562 - DNA, 101 bp, rice(Oryza sativa)
  misc_feature (71): n=a or g
gtaaagggggttgcaaaccgggataaaaaggcttcccccgtagcgatggtggataataatttttaaagtcnaaatttttgaaagttgaataaccaagttaa

SEQ ID NO: 31563 - DNA, 101 bp, rice(Oryza sativa)
  misc_feature (71): n=t or g
aagtgcttcagatctctagcttccttcagcagagcagatgcattaattggagttgaagcatcgacatgaanagctgcatgcttcatattttcaactacaga

SEQ ID NO: 31564 - DNA, 101 bp, rice(Oryza sativa)
  misc_feature (71): n=a or g
ggaaattacattgtgcttggactcttttctgctgtttcttgccttgatttctccttgatggcttcttcagngggaacctgatcaccagtgccacagccaca

SEQ ID NO: 31565 - DNA, 101 bp, rice(Oryza sativa)
  misc_feature (71): n=t or c
tatagtaggatcaacctcaggaccttcatagcgtggaatccccacataagcaagcaagagctgcaacatangttatatcattcactgcctccagcagaaaa

SEQ ID NO: 31566 - DNA, 101 bp, rice(Oryza sativa)
  misc_feature (71): n=t or c
gcacaccatttgccctctgcaacgagtattcacaagcacgagattatcatctgccacttcatgagacaagncagacccgcgcgaaaatcaccggccttccg

SEQ ID NO: 31567 - DNA, 101 bp, rice(Oryza sativa)
  misc_feature (71): n=a or g
caccgagacatgccaaccagaccaacatgagggacaagcctagatagacccaatgtaagtgcaaatcattnagctcgaacaaactcagtggtttagaacag

SEQ ID NO: 31568 - DNA, 101 bp, rice(Oryza sativa)
  misc_feature (71): n=t or g
tcttcctcatacatgggcacgcctttaagagactctaaaagaagcactctccaaacggggaagagtactantaatggtcacaaatctggagctaatggaac

SEQ ID NO: 31569 - DNA, 101 bp, rice(Oryza sativa)
  misc_feature (71): n=a or g
tatagtaatattatcggtatgtcgaacaggtgcgcaactaatctgctgttaaattgaggcaaaaacatacntatcgatttgcacatcatgacgaatcccac

SEQ ID NO: 31570 - DNA, 101 bp, rice(Oryza sativa)
  misc_feature (71): n=t or c
cgcagccgccgccattgtgtgattggggtaggaggggggagtggggaattagattagggtttcagttgagnatatatatgcccttggttgatgggccaaat

SEQ ID NO: 31571 - DNA, 101 bp, rice(Oryza sativa)
  misc_feature (71): n=t or g
caaaaggatggtattcatgtcttgtagcttgacaaaggatgtgtacaggtagtccaacacttctttttcgnacttttcacctccctcaattttagtggaat

SEQ ID NO: 31572 - DNA, 101 bp, rice(Oryza sativa)
  misc_feature (71): n=t or g
tttttacctgaactttggatgcatgtcctgatcccacatggaagctagctagcttcgatcttgtggattantggccataatatattttggtagcagttttc

SEQ ID NO: 31573 - DNA, 101 bp, rice(Oryza sativa)
  misc_feature (71): n=t or g
tctatcacttttgtgctagtattcaggaactcatcattcctgtgtataaaagcagaagggcatatgggcanctggctaagtgtcatacatcactcaaggat

SEQ ID NO: 31574 - DNA, 101 bp, rice(Oryza sativa)
  misc_feature (71): n=a or g
agcactgtcactagatctactcatattgcaaatgtcatgtttacttatttgggtttacccatcccagcccnaggtgatgataatttcctagtgcttcagta

SEQ ID NO: 31575 - DNA, 101 bp, rice(Oryza sativa)
  misc_feature (71): n=a or g
ttcgtcccgtccgtccgtgttcaacctcaagcgtgttcgacgagaaactaaccgacatcgatcaatggcgncagtaaaggagggagccgacgccggcgaca

SEQ ID NO: 31576 - DNA, 101 bp, rice(Oryza sativa)
  misc_feature (71): n=a or g
tatatacacgcatgcacactcaactctgaatgacagtggcaacgccatggatacgtcggtgcttcttcttntgctcttcgtctttaccctcctctgctgcc

SEQ ID NO: 31577 - DNA, 101 bp, rice(Oryza sativa)
  misc_feature (71): n=a or g
cgctgttcgtcctcgtcgggttcatcttcctcgtctacttctccgtcctctgctccttcagcgtcgtcgtntccgtggctgagccctggtgccacggagcc

SEQ ID NO: 31578 - DNA, 101 bp, rice(Oryza sativa)
  misc_feature (71): n=t or g
gcaatgttttactcagtagtgatatttttggcaacttttcacgtcaatagttcatcatgagtaacgacggnagacaaagcccaaaaggatatagagaccaa

SEQ ID NO: 31579 - DNA, 101 bp, rice(Oryza sativa)
  misc_feature (71): n=a or g
ttcaaagagcagcttttctatttccatcactgttattttggctgcaagaagcaagatcatgttatcggtcnaatttgtgtacgcaaatataccgtgtggcc

SEQ ID NO: 31580 - DNA, 101 bp, rice(Oryza sativa)
  misc_feature (71): n=t or c
atactactgtacatatagatcccattttgtacaaaccgttccatattaacttgaaggagcacaaccctccngataacgaaaactcagcaccaaatcatttt

SEQ ID NO: 31581 - DNA, 101 bp, rice(Oryza sativa)
  misc_feature (71): n=t or c
actcgctgctgaaaattttacgaaaatgcaactcatgctgtacgatctgtatcagacatacggctgaatanatgataaaatgagatcgacccaactactaa

SEQ ID NO: 31582 - DNA, 101 bp, rice(Oryza sativa)
  misc_feature (71): n=a or g
taaagaggaacttgtaactggtagttacctttttaaggtatttcctgtgaagtttcaatgcaacagcgcangcctttttcgcatccaaattcccattaaca

SEQ ID NO: 31583 - DNA, 101 bp, rice(Oryza sativa)
  misc_feature (71): n=t or c
ggggaggatgtaatggacagtgggagcaacggttcaagtattatggggaatgtgttatcttgtagtctatntttggccaagaactcatttcgagtggacaa

SEQ ID NO: 31584 - DNA, 101 bp, rice(Oryza sativa)
  misc_feature (71): n=a or c
cactggagaaatatcggataagctgagcatcttgtgcaaaacgctggttgagctagacttgtcaagcaacnagctgattggcagcttgcctgcaagttttg

SEQ ID NO: 31585 - DNA, 101 bp, rice(Oryza sativa)
  misc_feature (71): n=t or c
cgtgttctattcgccttctgcttgtggctttcgcgcacaatgcgtttgttcgccttcgtgctgggccaggnctcaggcctgaggatgcctggggtttggga

SEQ ID NO: 31586 - DNA, 101 bp, rice(Oryza sativa)
  misc_feature (71): n=t or g
gattgatcatgttgatgaactctgtgatgggtgtcttgtgggcaagcaatggcgaactacattcccggagnaggccaagtatagggcgcaggcgcgctcga

SEQ ID NO: 31587 - DNA, 101 bp, rice(Oryza sativa)
  misc_feature (71): n=t or c
attaatatatagcaatcatagtgttcgataagaaataaaaccaaaataagccgaagcacgtcggttcggtntctcggtttcctggcgaagctgcaggggtg

SEQ ID NO: 31588 - DNA, 101 bp, rice(Oryza sativa)
  misc_feature (71): n=t or c
aacctagccaaacattttgatgagtatgcactgttgatgggagatgatgtacggtatcacactacacggancacaccagatatttccgcaacattgcttga

SEQ ID NO: 31589 - DNA, 101 bp, rice(Oryza sativa)
  misc_feature (71): n=a or g
tttggctccgcggacttcggttgggaacgccacgcacatatatgggaaggaatatctgacgtggatggttngggcagaatgccacctcagtgcactgtgaa

SEQ ID NO: 31590 - DNA, 101 bp, rice(Oryza sativa)
  misc_feature (71): n=a or g
gtagagtttaatcctaccgatagcgatctactctggcatctggctgcagaagttggaaatggtcaggctcntcgtcatccttttatcaacgagtttattaa

SEQ ID NO: 31591 - DNA, 101 bp, rice(Oryza sativa)
  misc_feature (71): n=a or g
aaatataggtaaggacgaataagaatttcccatggtaaagtgttctaggccagcatgatttacacagagancaccaccagaattactggcatttccacaca

SEQ ID NO: 31592 - DNA, 101 bp, rice(Oryza sativa)
  misc_feature (71): n=a or g
acagtatgagcaaatactctaggagtatttcaaatgtcaaacggtaaaaatttcactcaggccgagtttanatccaaactttttcttcaaactttcaattt

SEQ ID NO: 31593 - DNA, 101 bp, rice(Oryza sativa)
  misc_feature (71): n=t or c
ttgggctgtgccttgtgaggcttgacattaggcaagaatctgacaggcacaccgatgtcctcgatgccatnaccacatacctgggaataggatcataccgt

SEQ ID NO: 31594 - DNA, 101 bp, rice(Oryza sativa)
  misc_feature (71): n=t or c
gttgtcatcttgtcaatctgagtcttgtcaactacagaattaactccctctcatttatattattatgagtnattttgatttttttttcgcgttaaactttt

SEQ ID NO: 31595 - DNA, 101 bp, rice(Oryza sativa)
  misc_feature (71): n=t or g
ttatcactttttcaggggaagggaatggacaggagagtatcttctagatttcaaggatttgatcactacanataaaccagaaatttcaagcacaactgaag

SEQ ID NO: 31596 - DNA, 101 bp, rice(Oryza sativa)
  misc_feature (71): n=a or g
cgtcttcggttggcggagtttcaagatggtgaactccgttttggttggactattgctcagaggtctactanttggattatcgacatcctcgagattgtgtg

SEQ ID NO: 31597 - DNA, 101 bp, rice(Oryza sativa)
  misc_feature (71): n=t or c
attaaggtcgcggatggaggtcatcggtaaaatgccggcaaaggtgaagaggattcggttcgctgactctnaaacagagtgcgaggttgttcttcccctaa

SEQ ID NO: 31598 - DNA, 101 bp, rice(Oryza sativa)
  misc_feature (71): n=t or c
actatggctcagaaacttgtcacccatcttattgtgcaaatcattcttaacaatcttcatagcagagaaanacctctcaacggttgtttagatcaaaaact

SEQ ID NO: 31599 - DNA, 101 bp, rice(Oryza sativa)
  misc_feature (71): n=t or c
atcataacaggaatcattttgaggttgcaaactactgctacatgaatgctccaagaaactgttcagtgatngcagttggaagggatggtctaccacagagc

SEQ ID NO: 31600 - DNA, 101 bp, rice(Oryza sativa)
  misc_feature (71): n=t or c
cccaattgagttataattgcattgacttgattgctacagaaacaaacaatccccacattgagccttcctgnggcatttgttagtcctgtaatagaataaca

SEQ ID NO: 31601 - DNA, 101 bp, rice(Oryza sativa)
  misc_feature (71): n=t or c
ctttcacctaatgtatattttcataattcaccccactaatccttgcgatcctcatatatatcatcgttganctagctgctgataatctgacatcctctact

SEQ ID NO: 31602 - DNA, 101 bp, rice(Oryza sativa)
  misc_feature (71): n=t or g
ttcgtggccattttcatccctggctaaagtataagcaaattatcatgcaattagcatccagtaaaggccgnataatccattatttaaaaacaaccaattaa

SEQ ID NO: 31603 - DNA, 101 bp, rice(Oryza sativa)
  misc_feature (71): n=t or c
ttgattgtatggaaagcacatggctgggggatgctgcagataactcctatttctccaaatatttcaccatngcacagtacttcctggacctggattttgta

SEQ ID NO: 31604 - DNA, 101 bp, rice(Oryza sativa)
  misc_feature (71): n=a or g
ttctcggttgccattgatgggcaatgtgccgctcctgtcggttttaacattacattttctggtatgcttcnccttgccattgggatgggtttgaaattccc

SEQ ID NO: 31605 - DNA, 101 bp, rice(Oryza sativa)
  misc_feature (71): n=t or g
atggcagcggcgacgtggagagaagaggagtggtggtagcattgggactaaggtttggatgggttggctgntattaattaagtgttatatttatataaact

SEQ ID NO: 31606 - DNA, 101 bp, rice(Oryza sativa)
  misc_feature (71): n=t or c
ataccaaatgcaaatgttctaacctttatctgtgtgtgaagtcatttctcgttccttgtctaacatatatngtcccatggggaatgctttcctcggctcct

SEQ ID NO: 31607 - DNA, 101 bp, rice(Oryza sativa)
  misc_feature (71): n=t or c
tatatcaatgctgctggtatctttcaatactctgtccacaaattccttccaataggcacgctctgccacangaagtccagccaatgccgcatctctggttg

SEQ ID NO: 31608 - DNA, 101 bp, rice(Oryza sativa)
  misc_feature (71): n=t or g
aggtggtctctattgtgggatttgggggtcttggtaaaacaacgttggccagccaggtctacaagaaaatncatagcagatttgagtgcgcggtgtttgtg

SEQ ID NO: 31609 - DNA, 101 bp, rice(Oryza sativa)
  misc_feature (71): n=t or c
acttagaaaccctttgaatacggaaccaaagctacctcccccaagcttctctgtgaaattgttagttgcangttgcaaatcaatgtatccaaatggaatga

SEQ ID NO: 31610 - DNA, 101 bp, rice(Oryza sativa)
  misc_feature (71): n=a or c
tgccgtatctcgggacgtgcgtcatgtgcccaagtccaccttgtaagacgagaaagttgaaatatacggcnattagttaagctcctcttttaatttgttac

SEQ ID NO: 31611 - DNA, 101 bp, rice(Oryza sativa)
  misc_feature (71): n=a or g
tcatgtctatattattatcatatgccatgcttttacagcgtgctgtgtttcttgagaaggatgatgacatngcaagagctcacttatcggctgccagtgcc

SEQ ID NO: 31612 - DNA, 101 bp, rice(Oryza sativa)
  misc_feature (71): n=a or c
ggagtggaaggggaactggtacatcaagattggagctgatgatgatgatgatccactcttcttcttcctcntctcgaccttctccacaccagcatgatgat

SEQ ID NO: 31613 - DNA, 101 bp, rice(Oryza sativa)
  misc_feature (71): n=t or c
ctcaacctctacgcggtccaaattgccaattggccagcccttgaagagtctgaattcctgactgattatgntaaagacgccaatgagacagttcaccggtg

SEQ ID NO: 31614 - DNA, 101 bp, rice(Oryza sativa)
  misc_feature (71): n=a or g
aacaaggaggattgtgaggcctctcaataagggttcagctgttcatcatcctcgtacaagaactttgattnctgttcatgatggaatcttggaggatgtag

SEQ ID NO: 31615 - DNA, 101 bp, rice(Oryza sativa)
  misc_feature (71): n=a or g
cagttcacactttctgaaattctgaatcggattgtatttatttgcagagaaaacgaaaaataggattggtncagttctagcgatagttatgcctgcaatag

SEQ ID NO: 31616 - DNA, 101 bp, rice(Oryza sativa)
  misc_feature (71): n=t or c
aatttctaaaagaccggattgcccctacgcgccgtagcttgtaaacccgactgggtctagtcgtcgtgtcnatctcccccacccgattttccctttcctcc

SEQ ID NO: 31617 - DNA, 101 bp, rice(Oryza sativa)
  misc_feature (71): n=a or g
aaactgtatgaagaaacagtagaaaaaaaaaacgcgttttgcgccaccctcctctctgcgcgcgacaagtntccagtcgcgcgaggcacccatgctactgt

SEQ ID NO: 31618 - DNA, 101 bp, rice(Oryza sativa)
  misc_feature (71): n=t or g
atcgagcacgggcttttctggtcaaaacgtatcttgtctttatcactttatcgtgagttttttttccttgnttaacaatacttgttgttttgccgatattt

SEQ ID NO: 31619 - DNA, 101 bp, rice(Oryza sativa)
  misc_feature (71): n=a or g
ggttgtccccgcgaattccgaagtccgattacgattccaagtagcatgcttgtccggttcggtttctaccngtatgcccgctttaaaaggacacagcagag

SEQ ID NO: 31620 - DNA, 101 bp, rice(Oryza sativa)
  misc_feature (71): n=t or c
ggatatggaattcttcaaagatttttgtactcactagtagaacacatggcccactgaatagtgggaccggnaaacgaagtatcatacatcgcacggttttt

SEQ ID NO: 31621 - DNA, 101 bp, rice(Oryza sativa)
  misc_feature (71): n=a or g
acagatcaagggggcaagccccgtacatcgccaacagaaagaaccaacaagatgcacatcagagaaaactngactaagagtacaaacaacctcctgaaact

SEQ ID NO: 31622 - DNA, 101 bp, rice(Oryza sativa)
  misc_feature (71): n=t or c
ttagtaacccaaaaccaacaatgcttgcagtggtaacaactgcaataactggttttcgtttgtttttggtngaagctggcatatctttggcagctaggcga

SEQ ID NO: 31623 - DNA, 101 bp, rice(Oryza sativa)
  misc_feature (71): n=t or c
gctgatcaacccggagggtattactcacagttactgaaagaatatgatggagtcataatttcaggcatttnggtcaatatgactaccttgcctacatccca

SEQ ID NO: 31624 - DNA, 101 bp, rice(Oryza sativa)
  misc_feature (71): n=t or g
tctacgcgatagcttcccatttctcatcactgtctctcactctcactcccaaatcacatcctcaaattcanattcagagtcgtcgaaatcagtagtattca

SEQ ID NO: 31625 - DNA, 101 bp, rice(Oryza sativa)
  misc_feature (71): n=t or c
cagaagatggtagcatggtggaggttctgttgttaaacccggtatcaggacttgatcaagcaatttggtangttcggtgaaaattcatgcacatttgagcg

SEQ ID NO: 31626 - DNA, 101 bp, rice(Oryza sativa)
  misc_feature (71): n=a or c
actggcctcatggcgtgtacaagtagagttgcacttgagctgttctttggcttcttcttgcaagagtagtngtacaagtagtcttgtagttagtgtgtttt

SEQ ID NO: 31627 - DNA, 101 bp, rice(Oryza sativa)
  misc_feature (71): n=t or c
gcaactcgatttgtgacaacatgtgattgatcttctccaaacaactttgccaatccaaagtctgaaatctncggagttaaatcagagtctaacagaatgtt

SEQ ID NO: 31628 - DNA, 101 bp, rice(Oryza sativa)
  misc_feature (71): n=t or c
aatggcccatctaatctaaaatagaactaacctttttcctgcaagaaatgttctatggacatagccattgnagtgttcgcttgtgtgctcgcctgtgaaaa

SEQ ID NO: 31629 - DNA, 101 bp, rice(Oryza sativa)
  misc_feature (71): n=t or c
tacacaggagcattatgatacaaagagcctaccttctccctttctcggttttgatccttgcttgtctcaangttcagctttcgcttctcaacaaatgcctt

SEQ ID NO: 31630 - DNA, 101 bp, rice(Oryza sativa)
  misc_feature (71): n=t or g
ctcaacaagtgcgttcattctatcagaaggagaccccaaggtcagcttgcacggctctaatctttgaagancttctgatgagagtagtttccttggtgcgt

SEQ ID NO: 31631 - DNA, 101 bp, rice(Oryza sativa)
  misc_feature (71): n=a or g
agagtccgttttagagagtctgttggagatgctctaagccaaccagtcgatatcatcgccgtcatattcancaatggacgatgactgatgatgactctcaa

SEQ ID NO: 31632 - DNA, 101 bp, rice(Oryza sativa)
  misc_feature (71): n=a or g
cggtggcggcgggaagtggaggaagggagcacaagattagaacaagattagattagtagaacaagtattgntccgaaggttaaagcacccatcggctggag

SEQ ID NO: 31633 - DNA, 101 bp, rice(Oryza sativa)
  misc_feature (71): n=a or g
catgaggaatacaggtagctcccttatagtcccaagaccgtgatgtggagtacatctctactacttaaaancagggaaaaaaaggttcgttaataaaaaga

SEQ ID NO: 31634 - DNA, 101 bp, rice(Oryza sativa)
  misc_feature (71): n=t or c
gtgcgtggcgcacttcaccaattttgttggcgaaaaaagcccaacgttttctcctcccctaaacacaaagnccatcacaaacaaaatcctaacgtgttttg

SEQ ID NO: 31635 - DNA, 101 bp, rice(Oryza sativa)
  misc_feature (71): n=t or g
cttcctggttgcactgttccataatttggtacagcacccagattggcaaatgtcacaagcttgcagcgatncgtacagtaaaactctcaagaaatggcacg

SEQ ID NO: 31636 - DNA, 101 bp, rice(Oryza sativa)
  misc_feature (71): n=a or c
atgtgttggtgaggaggtgaatgtggcaagactatcttgctcattggatagaatcacttgaggctctttanaaattgtcgatgaatttgagcactccacaa

SEQ ID NO: 31637 - DNA, 101 bp, rice(Oryza sativa)
  misc_feature (71): n=t or c
tcgatgggtttcaaaggttaccttctcttgttcatcagttctgaccaaggctaatttcttttctattgccngtagccaatcttcggcatccataggttctt

SEQ ID NO: 31638 - DNA, 101 bp, rice(Oryza sativa)
  misc_feature (71): n=t or c
tggtgtgattctcaagcctggacctcttcctaaattctcctttgagaagataatctccgattcgcccaacncatcccttgctattcaaaaagttaatgatc

SEQ ID NO: 31639 - DNA, 101 bp, rice(Oryza sativa)
  misc_feature (71): n=t or c
agttaaaatatacctatgcccgaagcatgcatcagtattactgacagtaccaaactcaacacaacgtatancatccccccattcctatctctcagtctgtc

SEQ ID NO: 31640 - DNA, 101 bp, rice(Oryza sativa)
  misc_feature (71): n=a or g
ttcctcccacgtcctgtcaaacgaagatgtgcgtcgaagttcaggcttttgtaaaagcatggagtctttcnatgattgtttactgggactgttcgtttcag

SEQ ID NO: 31641 - DNA, 101 bp, rice(Oryza sativa)
  misc_feature (71): n=a or g
acaaagttctcttcttcctcagactggaaagcctccaataattcttccaccacatgcagttggacagactnggcacacttatggtccttactccatcgttt

SEQ ID NO: 31642 - DNA, 101 bp, rice(Oryza sativa)
  misc_feature (71): n=a or g
cctgtattacagaaaatcgatacaccaagttgtcaacatacagaatgaagcgtattcagccatgaacaaangaaggtgagttaataacctgatcagagtgt

SEQ ID NO: 31643 - DNA, 101 bp, rice(Oryza sativa)
  misc_feature (71): n=a or g
gtttgacaggtagacttatcagtaaatcatttactaaagtcatttgtatgggaaacatttttttaaggtantgagtaaaaattttacgattagttagctac

SEQ ID NO: 31644 - DNA, 101 bp, rice(Oryza sativa)
  misc_feature (71): n=t or g
gcatctggagtgtccacaccaaaaccaggatccaacgacattcacctgggttcggccaaaccagggctggnccagatggcctccaaacctggtctgggcct

SEQ ID NO: 31645 - DNA, 101 bp, rice(Oryza sativa)
  misc_feature (71): n=t or g
ggcatgtgatacaatatttttgcctctcgacgacgtgatctatattgatttcgattatatgtacgtatgcngatacttcatccgttttattatacaagtcg

SEQ ID NO: 31646 - DNA, 101 bp, rice(Oryza sativa)
  misc_feature (71): n=t or c
cacttttcatgctactcaatgccatgtcaacttcattgtctgccctcatgatcaggaagaacagaagaagnggatgcagagttattaaacaggaaatgtga

SEQ ID NO: 31647 - DNA, 101 bp, rice(Oryza sativa)
  misc_feature (71): n=a or g
gcaacatttccgaaagatattcccaggataccgaatcgaaggcctttgctatatccaatttaaagaagagncatggcttcctctgcatatgcatggagcag

SEQ ID NO: 31648 - DNA, 101 bp, rice(Oryza sativa)
  misc_feature (71): n=t or c
agagggacaaggttcacgctcgataagaggttgtgaaggtggttctttggagtgcaattcaagggtctcancagaatctttttaaatgaaatgaagatcat

SEQ ID NO: 31649 - DNA, 101 bp, rice(Oryza sativa)
  misc_feature (71): n=a or g
tgctctcctttaatttccatgtcaatctatggatgatgcaccatgtattgagttttggaaagttatatgcngttccaggttgcaagtttcaaatgatgcct

SEQ ID NO: 31650 - DNA, 101 bp, rice(Oryza sativa)
  misc_feature (71): n=a or g
acccaaatcccaaaaatgatgccccaaatccatgaacacatcaacacatgaactacaaacaacacatctcnatcctcaagatcaataccgagacaaacaaa

SEQ ID NO: 31651 - DNA, 101 bp, rice(Oryza sativa)
  misc_feature (71): n=t or c
gtcaatgtgtggttttgtctctcttcttcaagttgcttctcctttacttcaagctcagttctcgttttctnatgctcttctttttctttgagctgcaataa

SEQ ID NO: 31652 - DNA, 101 bp, rice(Oryza sativa)
  misc_feature (71): n=a or g
gctctacatcaatgtctgactgttcacctttattggaacctacgcgctgcaagaggaaagaaaagcaggcntatgagagaaatatatacatactccctccg

SEQ ID NO: 31653 - DNA, 101 bp, rice(Oryza sativa)
  misc_feature (71): n=t or c
tggctaccaatctaggtcaactattatatttaagatcaatattaagttacagagtacctagacaaccaatngaactccatatcgtgtgacttttggtatat

SEQ ID NO: 31654 - DNA, 101 bp, rice(Oryza sativa)
  misc_feature (71): n=t or g
acaaatccagaaggctctgaattttctcccaaacttattcagaagtccaccaccaagcatagacgtgggtngtggagacaattccgtttgctgtttaagag

SEQ ID NO: 31655 - DNA, 101 bp, rice(Oryza sativa)
  misc_feature (71): n=t or c
tcattaaaatgaacggttacaatacatgcagtcctatggtgcagttgtgtctgcatcggatctcaatcccnactaaacaactactccctccgtcccataat

SEQ ID NO: 31656 - DNA, 101 bp, rice(Oryza sativa)
  misc_feature (71): n=t or c
ggttttgtgtgaagagaggagtgaaatggctgtgtgcgtgtgagccctgtgtagtgatggtctccttttanaggcgcagggagccctaacccacactgcga

SEQ ID NO: 31657 - DNA, 101 bp, rice(Oryza sativa)
  misc_feature (71): n=a or g
tcgttgtggtcttcatcgacgacattctgatttactcaagggatgaacaagatcacgccaatcatctacgnaaagtaatggaaaggttgcgtgaacaccag

SEQ ID NO: 31658 - DNA, 101 bp, rice(Oryza sativa)
  misc_feature (71): n=t or c
ccttgagcagtataaggtgatctagcacctggaggtggaaaggatgtaaatggaggagattgtggtgcaangataggttcacttgcgcggtgctgcaatgg

SEQ ID NO: 31659 - DNA, 101 bp, rice(Oryza sativa)
  misc_feature (71): n=t or c
ccacttcaccaacggtgatgcaacagtccacttcaccaacagtccaccaccagcctttcatcgctcttctncttcagaatttcatcgttatcctcgactgc

SEQ ID NO: 31660 - DNA, 101 bp, rice(Oryza sativa)
  misc_feature (71): n=t or g
tgtaaactgatgctggactgggttagagattttgaggccatgaaaacttgctcttgttttatgaaacagtnggccatgttagttgtactggctatttatta

SEQ ID NO: 31661 - DNA, 101 bp, rice(Oryza sativa)
  misc_feature (71): n=t or c
aaagggcaaaagacgatttgcatagtaagaataggcgaaagaaaaaaaaaagagaaagtactgcacaatgngaaatgggcgtaatcataatgcgccaaaga

SEQ ID NO: 31662 - DNA, 101 bp, rice(Oryza sativa)
  misc_feature (71): n=t or c
aaagcgcatgacatgtgatcaaacccatccaacttatatatagcttagataaaaccactatgcaaaaccanctcggggttatataaacaatattgtaaagt

SEQ ID NO: 31663 - DNA, 101 bp, rice(Oryza sativa)
  misc_feature (71): n=a or g
ctctcacggtccctgtcatttcttagttactcgcgctctaggacgcattgctccctcttcaactcacttcnggttcagaggaccattttgtctggcgttgg

SEQ ID NO: 31664 - DNA, 101 bp, rice(Oryza sativa)
  misc_feature (71): n=t or c
taatggtccgtgctgtaaaatgggtgcacgatgtcattccagatgcaccttacgccataactgaagatttnatgaataaattattcaatgagtataatata

SEQ ID NO: 31665 - DNA, 101 bp, rice(Oryza sativa)
  misc_feature (71): n=a or c
gccttgattcttggggatggcctctacaactttctcaagatgattattctcacagccttctcgctaagatntcaaatcaagaagaaaaatgctagtacact

SEQ ID NO: 31666 - DNA, 101 bp, rice(Oryza sativa)
  misc_feature (71): n=a or c
attgttgtgtaagcgataggtggagtatgtccgtcggaatatgtatccttggcagatgttgttaggaaagnaaccaacttgctcgaggcacaaactaacgt

SEQ ID NO: 31667 - DNA, 101 bp, rice(Oryza sativa)
  misc_feature (71): n=t or c
tgtgcatccatggcggcgagataatcagtcagcaacagacgagagcggccgacgatgataacaatgacgcncatcaacagttgtggaaccatgcacccgta

SEQ ID NO: 31668 - DNA, 101 bp, rice(Oryza sativa)
  misc_feature (71): n=t or c
gtttgttatcatcactgaccaaacagaaaacagttacaagaacacatctttgagttttgggcggatccaanacaaataattgaaacagaaagctttaagct

SEQ ID NO: 31669 - DNA, 101 bp, rice(Oryza sativa)
  misc_feature (71): n=a or g
acgaatgtggcgctgatcccttggaccttagcgccattaacattggcgttgagcccacgacctatttttgnttgaagttttttacgagggttagtttcaaa

SEQ ID NO: 31670 - DNA, 101 bp, rice(Oryza sativa)
  misc_feature (71): n=t or c
aacctgtttgcaggaacttcagctccctcaaagcttgacattttgcgaacaaattcttgcatggactctgnaatctctccaagattaaactcgtttgactg

SEQ ID NO: 31671 - DNA, 101 bp, rice(Oryza sativa)
  misc_feature (71): n=a or g
tatcatgccttgatcaatcaatcaggagtgctagttaatacttttaactaatatgatcaagtccgtggtcnatggtacaattgctgagcatcaagctaatg

SEQ ID NO: 31672 - DNA, 101 bp, rice(Oryza sativa)
  misc_feature (71): n=t or c
aacttcaattttggcccggaaacgtaatgtcattcccgccatcgttgggccggttcctcatttgtgtaacnttttcttttttagaactcattcgtatataa

SEQ ID NO: 31673 - DNA, 101 bp, rice(Oryza sativa)
  misc_feature (71): n=t or c
tcatctctcacgcagattcgcgagcgatctagtagttaaagtctaagcagagatacgctcccgatcatcgngccttatcccctggccgaactcacaaaggg

SEQ ID NO: 31674 - DNA, 101 bp, rice(Oryza sativa)
  misc_feature (71): n=t or c
attttgctatcccaacagtatcccgcttatctcattattatcccatcacaccctacgactgtcaacgcttncaaatgggccctagctgcacggcgaaacca

SEQ ID NO: 31675 - DNA, 101 bp, rice(Oryza sativa)
  misc_feature (71): n=t or c
taattgaggtatatgcatctcctagttattcattttcgaatacattggcatgcgtacatgcacacacagangtacacgcaataccacgctcacacactcac

SEQ ID NO: 31676 - DNA, 101 bp, rice(Oryza sativa)
  misc_feature (71): n=t or g
tatcatttgcaattttacagagactggacttcacagaagctagcaaaacagccactctgtcgtgttcattnttctcccaagcagagaagattccatagatt

SEQ ID NO: 31677 - DNA, 101 bp, rice(Oryza sativa)
  misc_feature (71): n=t or c
tctgacaccaatgaacacaacatttacgatgggtgttgcctgcttgatgtccagcacacgcagtctttccntggaaatggtgctaacgtgattcccaccaa

SEQ ID NO: 31678 - DNA, 101 bp, rice(Oryza sativa)
  misc_feature (71): n=a or g
atttttatctctaataaggcctgtcacaacttgaatatcttggcaactaccaactaccgagttgattactngtgtaccttatacaactatttcattgaagc

SEQ ID NO: 31679 - DNA, 101 bp, rice(Oryza sativa)
  misc_feature (71): n=a or g
ttgacatggttcgttgacagttggataagggggcttttaactgtgtgctatttaccacccctatctcaatnacatgtggattcacatgtgtctatgacatg

SEQ ID NO: 31680 - DNA, 101 bp, rice(Oryza sativa)
  misc_feature (71): n=t or c
gaatttagatgttctacatagcaaccatgaaattggaagttccattttggaagttctagtgcatacaaagnttttcttttcacataatgttagcaaagaag

SEQ ID NO: 31681 - DNA, 101 bp, rice(Oryza sativa)
  misc_feature (71): n=t or c
tatgtggtagcttgtggtagctaggtcttttatctatactttccctgcttcttcttcttcttgttgtgttnttgttgctggatgagtggattgatcaaaac

SEQ ID NO: 31682 - DNA, 101 bp, rice(Oryza sativa)
  misc_feature (71): n=a or g
gaatgacttgcattgtgaaacggagggagtatctccttaggaaatgtggccaacaagaaaaaaggaagagnaactgtacaaatgggtaggaaatgtggcct

SEQ ID NO: 31683 - DNA, 101 bp, rice(Oryza sativa)
  misc_feature (71): n=t or c
aattgacctgacatgttgttgatgtttccagagctccagcatctgaagaacagcctgcctgatcaggtggncgtccagcgcatcgaggagcgcctctccgc

SEQ ID NO: 31684 - DNA, 101 bp, rice(Oryza sativa)
  misc_feature (71): n=t or c
tgaactacacctacctgatcttcgtcggagctcagaagtcggcaccgagccgaccagcgaggcaaatctangggcatgttcacattttcaatctaaccaaa

SEQ ID NO: 31685 - DNA, 101 bp, rice(Oryza sativa)
  misc_feature (71): n=t or c
tgctaagaatgttttgattactatcgttgaaacttctatgtcttcgtgtgcttggatcgtaggatttattnttcctcgagggattgattgtaggaatttgg

SEQ ID NO: 31686 - DNA, 101 bp, rice(Oryza sativa)
  misc_feature (71): n=t or c
cgttgctattgattgttcgattggaggtcgatagaagcgtatcatatcagactatcagtgggattcggatnaggggattagccattgagtgtgtctgaaca

SEQ ID NO: 31687 - DNA, 101 bp, rice(Oryza sativa)
  misc_feature (71): n=t or c
aatataattagggacatcgtaggattagccctagggtattcactccttaggcttagccacgacacaattanagggttgaatgtccaaatcagactcgaact

SEQ ID NO: 31688 - DNA, 101 bp, rice(Oryza sativa)
  misc_feature (71): n=a or g
ctcataaaaatatatatcttgtgtttgttctgttgttagattttaggaatcatactgttgaaacatctctntattatagttccaagagtaattttacggtc

SEQ ID NO: 31689 - DNA, 101 bp, rice(Oryza sativa)
  misc_feature (71): n=t or c
tgatgcaactattttctatgaagacaatatcacataatgcaaacacttcccttattgagaccaaacatggntctttaaattaaaacaaaacaaattcaaaa

SEQ ID NO: 31690 - DNA, 101 bp, rice(Oryza sativa)
  misc_feature (71): n=a or g
tccagcagcaaccccttcagtgaaatcagagtgcgcgtcgccaaggaatagtggccttttggaagagttgnttcatgaagctcagaccctaagatccggga

SEQ ID NO: 31691 - DNA, 101 bp, rice(Oryza sativa)
  misc_feature (71): n=t or c
agggcatgttcgaaatagcacgtttgtttagctaaatgagacgagtcattagcataagacttcatccgttncgcaatgtaagtcattctagtatttcccac

SEQ ID NO: 31692 - DNA, 101 bp, rice(Oryza sativa)
  misc_feature (71): n=a or g
ccgtccgccgctggccctcgtcccacggctgccgctcgcccgaaggttgatgaagagaaagagagagaagnggaggatgaagagaggatgatttatgtggg

SEQ ID NO: 31693 - DNA, 101 bp, rice(Oryza sativa)
  misc_feature (71): n=a or g
tcacgctcctcctcatctgtgccgcagcagctgcaaccatggccttgccggagtaagggagtcttcctccntctccccacctcgggccaccccgtcaccac

SEQ ID NO: 31694 - DNA, 101 bp, rice(Oryza sativa)
  misc_feature (71): n=a or g
cgaattcttgtttcgacgaaacactcgaagatcctccgccaatcagttaccatgaaaaaaaaatgaaacantgaaaggaaaaatctgcacaagaccaaacg

SEQ ID NO: 31695 - DNA, 101 bp, rice(Oryza sativa)
  misc_feature (71): n=t or c
tcaaagatcgtctgcttcatttttgcagagcaatttaaatttatcctagtttctggccgagtttagttccnagttttttcttcaaactttcaacttttcca

SEQ ID NO: 31696 - DNA, 101 bp, rice(Oryza sativa)
  misc_feature (71): n=a or g
gcctcgatcacaaaccaagagatgctaaattttatgatagagaaaacatttaggaataagttcaccagccntccctctttacgccgagtttttatgacatc

SEQ ID NO: 31697 - DNA, 101 bp, rice(Oryza sativa)
  misc_feature (71): n=a or g
cctattcaattctctttgaggttttttcccccttgtgcttttatctgaaggatcatttacttcagccatcntatccaccatctcaggtggaagaatactgt

SEQ ID NO: 31698 - DNA, 101 bp, rice(Oryza sativa)
  misc_feature (71): n=a or g
agtgcagatcatgtcatgcattgcaccacctctgttcgtaacaaggcactgaatggttctaagttctaacnttcagtgcacgggatttgatcgtcataaat

SEQ ID NO: 31699 - DNA, 101 bp, rice(Oryza sativa)
  misc_feature (71): n=t or c
aacaatatattttcaaatttaattcgatggcatttgatgcgcacaataagatttggatatacttttagaangttaatcatcaattttatatgtaaatagat

SEQ ID NO: 31700 - DNA, 101 bp, rice(Oryza sativa)
  misc_feature (71): n=a or g
cctgtaaattttggagtctttgaagtttgcatgtttgaggtttttctcatagtcataggacttggtgcttnattagtgaaatacaggaccagtaccttttg

SEQ ID NO: 31701 - DNA, 101 bp, rice(Oryza sativa)
  misc_feature (71): n=t or g
tcttaattagtttcatctaacggtccttactattttaggtgatgtggctcattctcctttgagatcgatancttgttgctttcacctagtggataccgtgc

SEQ ID NO: 31702 - DNA, 101 bp, rice(Oryza sativa)
  misc_feature (71): n=t or g
tttcagaatgagaagactggccataggaatcgagaaaatcctagcatttgatacgaacggatacatgcagnggttgaaatttcagattgaaattcctgaat

SEQ ID NO: 31703 - DNA, 101 bp, rice(Oryza sativa)
  misc_feature (71): n=t or c
agactttttttttcttcagaatgtgcagccaaagttgtgaaagtggtttgcttatcgtgttttttttttgngagaattgaactatacataaaacagaaaat

SEQ ID NO: 31704 - DNA, 101 bp, rice(Oryza sativa)
  misc_feature (71): n=a or g
ataatattagtgtcggtcttttcagaagaactgacaccgataattaagatcccaatttttttaagaaccancacttatatttatactataggtgctggttt

SEQ ID NO: 31705 - DNA, 101 bp, rice(Oryza sativa)
  misc_feature (71): n=a or g
aaggaagcgatcagctcaagcaaattcagaaagttaagaaactcagtggagactcactgagcatctctgcntgtgccatccttttatttgcgattgctgga

SEQ ID NO: 31706 - DNA, 101 bp, rice(Oryza sativa)
  misc_feature (71): n=t or g
cgccgatctccggcgggatcttgccggtgatgttgttgccggagagtcccaagaacttgagcttggtgagnctccggtaagccgcggggatggcgccgccg

SEQ ID NO: 31707 - DNA, 101 bp, rice(Oryza sativa)
  misc_feature (71): n=t or c
gtgatgtaatcatggtgcatatatgcagatgcccggatgaaaaaacacgggaattgttgaaattggtgtgngacctttacgcgcttgataggatctggaaa

SEQ ID NO: 31708 - DNA, 101 bp, rice(Oryza sativa)
  misc_feature (71): n=t or c
tgtgttccagcttgcattgcaaaagaaacgatccagcttgaccagggtcgggttatcttgttcgttgctcnaggtgtagcgtctattctgaagtgcgatct

SEQ ID NO: 31709 - DNA, 101 bp, rice(Oryza sativa)
  misc_feature (71): n=a or g
tatttgcacatgattgatcacaagttgtgattcacaaatcacaactagctgaccagcttggtgcttggagnacctttaaattagctagctagcggccggag

SEQ ID NO: 31710 - DNA, 101 bp, rice(Oryza sativa)
  misc_feature (71): n=t or g
aatcatctgttccagctactctaacaaccaaccatctcgtaattacgatttatgctgattctaacttgtanggtcatcagtgttgcaagctgcgaaatttt

SEQ ID NO: 31711 - DNA, 101 bp, rice(Oryza sativa)
  misc_feature (71): n=t or c
tatctgtgcatcatactactactatcagtatcgcctgttctgtctggattttgcagggtgacggccatgangctggtttggagctacgggtagaggacggg

SEQ ID NO: 31712 - DNA, 101 bp, rice(Oryza sativa)
  misc_feature (71): n=a or g
ccatcagccaaagtgccaaacgatcgatcgatctctgcagtctgcagattagcccaccacctccagcatcnggtccacgaatgcacaccctgtcaactcca

SEQ ID NO: 31713 - DNA, 101 bp, rice(Oryza sativa)
  misc_feature (71): n=t or c
ggtcgtgcatcgcggcggcggtcgccgttggcatcatgctcggctgcttgtgcaccttcctctaccccgangggctcctctcctgctgctccaacgccgcc

SEQ ID NO: 31714 - DNA, 101 bp, rice(Oryza sativa)
  misc_feature (71): n=t or c
tgtaaaatttcagtggcacggttacggatagactgagttgttgacgatcttgagttgtgcatctgccatcnagccaaggctggtaagctgctcaatggtaa

SEQ ID NO: 31715 - DNA, 101 bp, rice(Oryza sativa)
  misc_feature (71): n=t or c
cattctcatgtatgatcacattgtgcaaactttgcaaaaaaggaaaataactaagggtgtgcttagctcangccaaaattgaaagtttggttgaaattgga

SEQ ID NO: 31716 - DNA, 101 bp, rice(Oryza sativa)
  misc_feature (71): n=t or c
acccttggttaacatctccttgacttgcatttcattctcatccttttgagcaggtgtataacggtaggggngcacattgactggagtagctcctggcatga

SEQ ID NO: 31717 - DNA, 101 bp, rice(Oryza sativa)
  misc_feature (71): n=a or g
tttcctgtgaagatgtgaataaagtcacccttatctattgcctgcagatcagatgggctgtacgaaatggncaggagagatagggacaatttcactgattg

SEQ ID NO: 31718 - DNA, 101 bp, rice(Oryza sativa)
  misc_feature (71): n=a or c
tcgatttattttgaacgaagggatcgagtacacatcttcgcttaatttgttgactgttgagtcgtcttctncttctcctctcatttatttccggcccagca

SEQ ID NO: 31719 - DNA, 101 bp, rice(Oryza sativa)
  misc_feature (71): n=t or c
aagtcaatttgctccttataaaaatgaagggaggagggtattcgtgttgcacatcccatcaactctcttgntattcctgtttcactaaactaatcccaact

SEQ ID NO: 31720 - DNA, 101 bp, rice(Oryza sativa)
  misc_feature (71): n=t or c
cgatcctatgcatccaatgatatcgatcaagtaaggccccaatttttttattacatgaaagatcgacacangttcaccgtacacatttgtatctacatcct

SEQ ID NO: 31721 - DNA, 101 bp, rice(Oryza sativa)
  misc_feature (71): n=a or g
cagacttgcctaatgtgacgtttcctcggtggagaagttggagcgctgggcaagaacatgtagataccaanggacaggaggaaagctgacatcgaccaatc

SEQ ID NO: 31722 - DNA, 101 bp, rice(Oryza sativa)
  misc_feature (71): n=a or g
gaagggagtacttactgcccattgttgtcaatatcatgtactcctatctcataggttgtgtttagtttatnaaattagggagaagtttggagaaagttgat

SEQ ID NO: 31723 - DNA, 101 bp, rice(Oryza sativa)
  misc_feature (71): n=a or g
gctgggtgtagttgatttgtcttattgcatttatatgggaggcacacagcgatttcatcctgaatcacccngcgagcttgcggcgtgcggaagttcttgtt

SEQ ID NO: 31724 - DNA, 101 bp, rice(Oryza sativa)
  misc_feature (71): n=a or g
aagatctctcctccactatcgctggaaaaaaaatgcaatgtttgatgaggtgtgtgcgagagtggtaatgnagttgtggatttgtggttgccgccgattgt

SEQ ID NO: 31725 - DNA, 101 bp, rice(Oryza sativa)
  misc_feature (71): n=a or g
tgtccatttgacagcactccctctgtcccaatatatagctaagacgagcccatcctacttgctatatgttnagacggagggaatagtttttatgatattat

SEQ ID NO: 31726 - DNA, 101 bp, rice(Oryza sativa)
  misc_feature (71): n=a or g
caacttattaacgctgacaacacctgaaaatctgcgtttgtgccgttgtgtacatatatgtcttccacgtnagttggaaaaaaaacaagacacctaaggga

SEQ ID NO: 31727 - DNA, 101 bp, rice(Oryza sativa)
  misc_feature (71): n=a or g
aaacattggtctatgtggtcctcctttaactagaaactgttctggaaatgcgacaagcaaagacttacctngaaatcatgttgatttggaacatatatccc

SEQ ID NO: 31728 - DNA, 101 bp, rice(Oryza sativa)
  misc_feature (71): n=t or c
tttggaggtttaaagtgtacggtgaggctctcatatttaatttccattgtaacatggaacggagggagtancattcatggaaattgtggagttggcaactt

SEQ ID NO: 31729 - DNA, 101 bp, rice(Oryza sativa)
  misc_feature (71): n=t or c
agtacataatcactgctaattgcatcatagatggtgcactgcttgctgggatctttggaaacatctaacangaagatgaagtaaacaaacatgtaaaagaa

SEQ ID NO: 31730 - DNA, 101 bp, rice(Oryza sativa)
  misc_feature (71): n=t or c
agcagcttccgaacattgaatgaaggagccatccacatttgctttaacccagcccatcggcgggggggtcnatcccatggtcgtagtgtgattcctttcat

SEQ ID NO: 31731 - DNA, 101 bp, rice(Oryza sativa)
  misc_feature (71): n=t or c
tttggccatagatgtgaggatgaaagaaagagatgaagggggatgaacagagcaattgcaatcttctaccntcttgcttttcccatgcctcttgctgtttg

SEQ ID NO: 31732 - DNA, 101 bp, rice(Oryza sativa)
  misc_feature (71): n=t or c
atcaaccgtttaccatcttaatgttttatgggtctatttttaatgttatttgtcatcgttgagttctaggntgattaattatttgaaaattccatattttt

SEQ ID NO: 31733 - DNA, 101 bp, rice(Oryza sativa)
  misc_feature (71): n=t or c
ctaatgcaagatcaggttgctgccatatttctaccacctcaatttgctgttgacccagtccagcagcagcngattcaacaaacacccccaatccaataggt

SEQ ID NO: 31734 - DNA, 101 bp, rice(Oryza sativa)
  misc_feature (71): n=a or g
tttactatggtacattcttctgtggtgatcttttctgagcattcctttttacatcaggttacaagtggacnatggcgatgatgtgtgttatgatgatgacg

SEQ ID NO: 31735 - DNA, 101 bp, rice(Oryza sativa)
  misc_feature (71): n=a or g
tctgccctccacagacatcttcaaaataggttctcttgccaagcttcaggccaatcaagggctctacacgnttggctgctaccaccggtgatcgagaagtt

SEQ ID NO: 31736 - DNA, 101 bp, rice(Oryza sativa)
  misc_feature (71): n=t or c
tggaggacgcaacaaatgggttctctgatgacaatatcataggagagggcggctatggggttgtttaccanggtcgtcttataaatggaactgatgttgca

SEQ ID NO: 31737 - DNA, 101 bp, rice(Oryza sativa)
  misc_feature (71): n=a or g
tagctaaaaggttagtaatatatttttgaaacgaaagtaggtactctatctatctaaaaaaaatgtactanatatgacatatactagtacaacgaatcttg

SEQ ID NO: 31738 - DNA, 101 bp, rice(Oryza sativa)
  misc_feature (71): n=t or c
aggacagagtagtgatggtgatgcggaaggcctgctactggaagctcacctactgttcgacatctgcaagngcttgataaaggggccgggcgtggccgtag

SEQ ID NO: 31739 - DNA, 101 bp, rice(Oryza sativa)
  misc_feature (71): n=t or c
taatccctcaaattatatatcaattactaaaataatgacttggcttggatgatagagggggtagatgaagncatgaagatcatgctggacagctactacag

SEQ ID NO: 31740 - DNA, 101 bp, rice(Oryza sativa)
  misc_feature (71): n=t or c
atccaccattctcacaattcccgcatcttcttcatttgagtaattttgatcaagtgttgacttgattgccnagatttcatagaatacctttaagaacctca

SEQ ID NO: 31741 - DNA, 101 bp, rice(Oryza sativa)
  misc_feature (71): n=t or c
gcttcatgctattttggtgcttcacgttcagctgatgagtgtgggctggagaaggattgtgtctactctanttttgcgcgcgataagtattttgaggtgtg

SEQ ID NO: 31742 - DNA, 101 bp, rice(Oryza sativa)
  misc_feature (71): n=t or c
tactaagtatgtatcatctggtacatcttttgtcgatgacaagaatggattcaaaactatgagaaagcgcngatctagtagttaatttggttgatggaagt

SEQ ID NO: 31743 - DNA, 101 bp, rice(Oryza sativa)
  misc_feature (71): n=t or g
tctgattctagaagaaattgctccagctagaagcttccctatagtcacacgtttgccacctcactttcacnatcaagtgcgtctcacattgtttgtatttg

SEQ ID NO: 31744 - DNA, 101 bp, rice(Oryza sativa)
  misc_feature (71): n=a or g
ctgtggggagatcactgcttgcaccagcactatccgagatagcattgtgctccatgatagcagattactancagatgatggcattgtggctgatggatcta

SEQ ID NO: 31745 - DNA, 101 bp, rice(Oryza sativa)
  misc_feature (71): n=a or g
atggaatttcctaagatatggtatgacctagtacaaaacatttgtgtgggtttgcttaatagcttttgttngagccgtggagatgaaggaggcttgtgggc

SEQ ID NO: 31746 - DNA, 101 bp, rice(Oryza sativa)
  misc_feature (71): n=t or c
acattactaatagtaaagtgcatctagtccatgcacttgcaagcagcttatgaagagaacctgaaagtccnattctcttgtatggactatatttctgcagc

SEQ ID NO: 31747 - DNA, 101 bp, rice(Oryza sativa)
  misc_feature (71): n=t or c
catcaggatttttttatggcaaaccaaaagtatatagtttacaccctccattgcacattgatccaagggcnagtgttactcttttatatactcccctctgt

SEQ ID NO: 31748 - DNA, 101 bp, rice(Oryza sativa)
  misc_feature (71): n=t or c
tttaccattaaacatccaaactagatcatcatacatcattgttgtagccaataatacgttaggttagaganagcacaaaagtaaagagccacaaagctatc

SEQ ID NO: 31749 - DNA, 101 bp, rice(Oryza sativa)
  misc_feature (71): n=t or c
atatagactcctctctgtctcttttttccttgtctctttttgtcctctaactgagagctgagccttatctntttccagccttgtctccttacttcattctc

SEQ ID NO: 31750 - DNA, 101 bp, rice(Oryza sativa)
  misc_feature (71): n=t or g
cgacgaaaacctatacatattgagtcacatgtaccgaccatcagctcaaaatgtcagcgatcgagtgagantttgttattttcacgtgcaattgagtttta

SEQ ID NO: 31751 - DNA, 101 bp, rice(Oryza sativa)
  misc_feature (71): n=a or g
gaatgtccttgctgaacaattcaggtttagcaaggccaccaccggctgggtatgagttttgcttcctgaantgcatcgatgactgtgaccaaacctgtagg

SEQ ID NO: 31752 - DNA, 101 bp, rice(Oryza sativa)
  misc_feature (71): n=a or g
ttgtcgtatttcctccggattcaaattccgttgttcgatcctccccaatcgaacccctcccaaaccgattnttccagtgtctggaattactcgaacccagt

SEQ ID NO: 31753 - DNA, 101 bp, rice(Oryza sativa)
  misc_feature (71): n=a or g
aggatgggaaagcttggttactataatttcaagtgacatgcggtgctgggaagcccctgagaaagcagatnttttggtatgttgatccctgctataaatgg

SEQ ID NO: 31754 - DNA, 101 bp, rice(Oryza sativa)
  misc_feature (71): n=t or c
cagaaagttactaaccgtttaattagttaagatttgccttaggatgcacttgtacggacgaaaaatcatgnggatggacaaaatggactatgacgaaagga

SEQ ID NO: 31755 - DNA, 101 bp, rice(Oryza sativa)
  misc_feature (71): n=t or c
ctacacttgttttagttgctttccctccaactcctcttatagacaaatattatctgatatctgaatgctanaaagcttttcaggtggtccccttccactaa

SEQ ID NO: 31756 - DNA, 101 bp, rice(Oryza sativa)
  misc_feature (71): n=t or g
ctgtgatgacctgcacttttaacactgaagataaatgtgtcagactgtagattactagtcgtcaacctgtncgttgcacgggatgaatttatatattgcta

SEQ ID NO: 31757 - DNA, 101 bp, rice(Oryza sativa)
  misc_feature (71): n=t or c
tggcttgacgaaggagccttgtcgactctgtcggcaccagagatgttcgcctccgccgactcgattgctcngaccggagcagcggccggggccgaagcgct

SEQ ID NO: 31758 - DNA, 101 bp, rice(Oryza sativa)
  misc_feature (71): n=a or g
gtgcgcaacccggatgccgcaccaaagaccgagagaataacctggatgaactcgagatcctgctgaaccgnggagaggaagaggaccaagtcatcaatgta

SEQ ID NO: 31759 - DNA, 101 bp, rice(Oryza sativa)
  misc_feature (71): n=a or g
cactgaaatattgtaacatgtttacgagtataaaatcgggcagtaaattgccggtacaaaagacaagtgtngaaaagcggaaaacaaaagtaagttcttag

SEQ ID NO: 31760 - DNA, 101 bp, rice(Oryza sativa)
  misc_feature (71): n=t or c
tatccaccatgcaaacaagtttggcgatataaatcactttttaagggtgtcgacgaacttttccccttggngacgcaatgcttttaactggcccttgtaat

SEQ ID NO: 31761 - DNA, 101 bp, rice(Oryza sativa)
  misc_feature (71): n=t or c
tggggatggagtggaagagttgctgtccgtctgatgcacaaaggatgacgattcaggaccggacgtccccntgacgtagaattatgatctggttccgtgct

SEQ ID NO: 31762 - DNA, 101 bp, rice(Oryza sativa)
  misc_feature (71): n=a or g
tcttgtaacgtgttagttgaccactgaacatcttttctgtcgacttggagatgggatagttgggagaaatnatggaatagttgacctggttagtgtctgcc

SEQ ID NO: 31763 - DNA, 101 bp, rice(Oryza sativa)
  misc_feature (71): n=t or c
attcccgggtatttaaatcgggactacaaatgacgatctttagtctcagattactcctctcggtttgttanccgggattaaatggggttgcaaatcgggag

SEQ ID NO: 31764 - DNA, 101 bp, rice(Oryza sativa)
  misc_feature (71): n=t or c
ggcgtgacactgtagcagccgtcttcgcctcatcagccgccatcctttcctccatggcccacaacgatgtncgcccagggaggccgtcgtcatcctcgtgg

SEQ ID NO: 31765 - DNA, 101 bp, rice(Oryza sativa)
  misc_feature (71): n=t or c
cttaaaacatgtccattatcatgcaacatatgaacctggcaaaacaatacaccgtaaactgcaaaatcacngacaggtagctagcattatttcagatgata

SEQ ID NO: 31766 - DNA, 101 bp, rice(Oryza sativa)
  misc_feature (71): n=a or c
gttcagtaatgggtgtcactaccactccaactgctcagttagtttcaaataaaggacctctgacaattcangcaacccataatgagaggtcagttccagtt

SEQ ID NO: 31767 - DNA, 101 bp, rice(Oryza sativa)
  misc_feature (71): n=a or g
cggtggcatctttcgatttcatcttgaagaagaacaagctggcgatttttctcctccacaaccttcaaagnatcgataactgctctgaagggattatgggg

SEQ ID NO: 31768 - DNA, 101 bp, rice(Oryza sativa)
  misc_feature (71): n=a or g
tgaggtgtgtcaaataataccggttgagatgtcctattcctgaactagaagatgcagacaaagattttccntaaaatgtttacaggtagcacgtgttacca

SEQ ID NO: 31769 - DNA, 101 bp, rice(Oryza sativa)
  misc_feature (71): n=a or g
tttatatttccatttcagaaatgcgcaatctacaccggagagctcgtgattatgctttaagagttttccangataatgaaaacttgaagcttgaattagat

SEQ ID NO: 31770 - DNA, 101 bp, rice(Oryza sativa)
  misc_feature (71): n=t or c
agagtctattttatttccgttttttgaggcttggttgttaaggatcgagctgcgcttgtaaagccggaatngtgcttgttcacgatgaggcgtagtgtagc

SEQ ID NO: 31771 - DNA, 101 bp, rice(Oryza sativa)
  misc_feature (71): n=t or c
ttgaccaaaaaagtactaaggttcacagttgccaccaagtagaagaatttcaattttaaagataacgcgancgattacttgtatgtatctttttttctaaa

SEQ ID NO: 31772 - DNA, 101 bp, rice(Oryza sativa)
  misc_feature (71): n=t or c
taaatttttaaaaagaaattattgatccttattctttgtgagacggagtgagccgattgacatcctatctncaagtggacttgcacccaatactaaactag

SEQ ID NO: 31773 - DNA, 101 bp, rice(Oryza sativa)
  misc_feature (71): n=a or g
gtcgaacgagttaactcgggcagactcgagtcaaaccgagcgtcggaccagggatggtaattttagcgctngtttattttgctaccatttttaactttatc

SEQ ID NO: 31774 - DNA, 101 bp, rice(Oryza sativa)
  misc_feature (71): n=t or c
tcggggaggaaggaggagagggtgttggcgatgatgttggtggtagggtcgccgaagccgaagcagacgcnggcgccaacgaggcgcggggcaagctccgg

SEQ ID NO: 31775 - DNA, 101 bp, rice(Oryza sativa)
  misc_feature (71): n=t or c
gaagccgacgattttgaagtgttcactgtagaagagttgctagcagaggatgagatcatcgaagagttgcnagcagaagaattcaaggctgcaggtgatgg

SEQ ID NO: 31776 - DNA, 101 bp, rice(Oryza sativa)
  misc_feature (71): n=a or c
aaacttaccaacaggtcactattagctctcaaagtacaaatgcctttaaatcccatccatagcacctagancatgggctctagatcacatcccccaactat

SEQ ID NO: 31777 - DNA, 101 bp, rice(Oryza sativa)
  misc_feature (71): n=t or c
ttaaatttagaagttgaagctctaccaaatgggaccttaaactcccataaacatgtcctaagcttagaatntaaaactccttcaaatgtccaaaaaaaatc

SEQ ID NO: 31778 - DNA, 101 bp, rice(Oryza sativa)
  misc_feature (71): n=a or g
gaatgcctggcgccgccgcgacatccttgacggccacatcctcttctcacgcaacatcgacggccccaacnaagaccggaggatagcaccaaagtggagga

SEQ ID NO: 31779 - DNA, 101 bp, rice(Oryza sativa)
  misc_feature (71): n=t or g
cgagattacgcggattgatgggatgaatggtgcttgagatcgagttgaaaatggtgggaactagctcaccntccctgtcggccgtgctgctcccccgcgcg

SEQ ID NO: 31780 - DNA, 101 bp, rice(Oryza sativa)
  misc_feature (71): n=a or g
caaataccccccatctcggtgtacgcagacgatgcagtcctgttctttaggccaacggccggtgaagcaancacgatcaaaagactgctgacgctgttcgg

SEQ ID NO: 31781 - DNA, 101 bp, rice(Oryza sativa)
  misc_feature (71): n=t or c
tgttttcctactatttagattccacttttatactttgctatgtagctattttcctaccatatagattccanttttatactacctccgttttttaatatata

SEQ ID NO: 31782 - DNA, 101 bp, rice(Oryza sativa)
  misc_feature (71): n=a or g
tagctggcaatcgcatagtgggggcacctctctcattctcgcttttccttttttttttatttaagaaaatngatttactacttcctccgttctaaaatata

SEQ ID NO: 31783 - DNA, 101 bp, rice(Oryza sativa)
  misc_feature (71): n=t or c
ggatataaatcctttgaaattcatatgttttttttttcaaattaagggggctatttttttaggctcctctnatttatcccaaaataaatttatttttacat

SEQ ID NO: 31784 - DNA, 101 bp, rice(Oryza sativa)
  misc_feature (71): n=a or g
ggcgtttgtgaggcacccgtactgcatgtccgtgtcgaatgacaaggtgaagctcatctggcagtttctcncgaagaagctcaggtggaccaccgattatg

SEQ ID NO: 31785 - DNA, 101 bp, rice(Oryza sativa)
  misc_feature (71): n=t or c
tctggaaatatagtgcatgataagatatacaactgtaggtgaaaacaacagaccagggtcgatcgggagtngggaccgagatttgactagcccttcacaaa

SEQ ID NO: 31786 - DNA, 101 bp, rice(Oryza sativa)
  misc_feature (71): n=t or c
ccggtccccgccaagtacacgcactcaccggcgctcatgtgagtacactaaaaaataattaatatgttatngattttgtttttttgctttgttgtactgga

SEQ ID NO: 31787 - DNA, 101 bp, rice(Oryza sativa)
  misc_feature (71): n=a or g
atgcccaacagctggattgggttttcaccggggaagagtccacaaagtcaacacctccaaggaggaaacancacccgtagacgtcgatttgcccatcctgg

SEQ ID NO: 31788 - DNA, 101 bp, rice(Oryza sativa)
  misc_feature (71): n=a or g
acagtatgctgcttcagttcacgttactttccggccaaattactacgccaaaagaaaattagagagcagcntggaggcaatgcacgtgaggagaagatgac

SEQ ID NO: 31789 - DNA, 101 bp, rice(Oryza sativa)
  misc_feature (71): n=t or c
atgggccaagtaatggaggttaatcctgatggtatgctagctttggtacctgctattcctgatgtcagtgntcctgttcctacagctgtttctcttgttag

SEQ ID NO: 31790 - DNA, 101 bp, rice(Oryza sativa)
  misc_feature (71): n=t or g
tcaggtgcaacaagcccagttatgtacgcaaaactatggactcactcgatcaacgtatattgaaaataagncttccaatataaagaagtctgatgaaatca

SEQ ID NO: 31791 - DNA, 101 bp, rice(Oryza sativa)
  misc_feature (71): n=t or c
caccagtgcgacatgctcaaacaggcatgcttctccttcattgccaatccgaacacactggaaacggtgantggaacaccagagtatcatcagtttaagag

SEQ ID NO: 31792 - DNA, 101 bp, rice(Oryza sativa)
  misc_feature (71): n=t or c
gttcaatgtgcgatcaaaaggaaaaaaccaacgattattctaaagcttgacttccaaaaagcttttgacanagttaactgggattgcttatacttggtcct

SEQ ID NO: 31793 - DNA, 101 bp, rice(Oryza sativa)
  misc_feature (71): n=a or g
cacatggaatttctttttctcctcctcttcacttcaaccatactccatacacacacataaatatatgcatntattctagtctcagttttaccaaatcttta

SEQ ID NO: 31794 - DNA, 101 bp, rice(Oryza sativa)
  misc_feature (71): n=t or c
atcccaatatgctccatattttctgctttgtaagtaaggtacctatggaatgctgtcagaaaaacagttcnctatgatgacagaacactaacagatgagat

SEQ ID NO: 31795 - DNA, 101 bp, rice(Oryza sativa)
  misc_feature (71): n=t or c
cttggtgtagtgcgcctggtacctaacctcgccggagactgtcacctctaccttcaactcccctgtcgcgntctggcatcacctccaccacgtcgtgtcgg

SEQ ID NO: 31796 - DNA, 101 bp, rice(Oryza sativa)
  misc_feature (71): n=a or g
tttcgttgctagctagctaggctcccctatctgctgctgcacctaattaatactatggccgtgattagttnttttggcaaaaaaaaaattttaacgtatac

SEQ ID NO: 31797 - DNA, 101 bp, rice(Oryza sativa)
  misc_feature (71): n=t or c
atctccacaacaatagggcattgacaatgcaaaaggcctaccggcatattagtaatagctaaacatctttntcacttcttaaatcaaagaaaaattaactt

SEQ ID NO: 31798 - DNA, 101 bp, rice(Oryza sativa)
  misc_feature (71): n=t or c
agggatgagtgttgagatgagaaagttggttgacaaattaaacgaaagatgattgatgcgtttagaggagngggtaggtgaagaattagttatattttaaa

SEQ ID NO: 31799 - DNA, 101 bp, rice(Oryza sativa)
  misc_feature (71): n=a or c
ctttccttggctcgttccccaagtagcatcattaccacccctactctgtgccccggcttcttccccaagcngtgccaccaccaccgccgtctcctcctccc

SEQ ID NO: 31800 - DNA, 101 bp, rice(Oryza sativa)
  misc_feature (71): n=t or c
cgagctgaatctgtccaggcaagttagcggttctctctctctctctcggtttacctctactaccccttaanaaggacgtcttctcaagttacgtggtgaag

SEQ ID NO: 31801 - DNA, 101 bp, rice(Oryza sativa)
  misc_feature (71): n=a or c
tttccctttgttaatatgtcgctaaccattcttttctattcctaaggcggtttgttatcgatgttaacctncgttactcctttcgtggtccactggagtac

SEQ ID NO: 31802 - DNA, 101 bp, rice(Oryza sativa)
  misc_feature (71): n=a or g
tagccggcgcccccccccccccccccatcgaatccgttcttccctacaaaggtttaaaaacacaaaagatnttattgcaattgattgttaacgatttgtga

SEQ ID NO: 31803 - DNA, 101 bp, rice(Oryza sativa)
  misc_feature (71): n=a or g
gcggcccagttgaagcgcagcagcttcatgaagctggcgatcctcttcttgctcttctccggtctcgagcngtagccgatggcgtacttcttgccgccgcc

SEQ ID NO: 31804 - DNA, 101 bp, rice(Oryza sativa)
  misc_feature (71): n=a or g
gtgatgccgtctttagtctgattcacctccaatccgacgtaatacttcaacaatccgagatcgctcatctngaacgtgcccttcatctcctccttgaactg

SEQ ID NO: 31805 - DNA, 101 bp, rice(Oryza sativa)
  misc_feature (71): n=t or c
cccccgtggccttacgacaaggtcgtcatctggcgaagctcgatgtacagcgtctgcccgttcggcttctncctacatcctttgccggttgcctctgggcc

SEQ ID NO: 31806 - DNA, 101 bp, rice(Oryza sativa)
  misc_feature (71): n=a or g
attcaaggcctttatatttttgttgatctttttttgtgctaatgggagcaaaaccagttaaaatccgtgcntcttcaactattccttacaccaatcttcat

SEQ ID NO: 31807 - DNA, 101 bp, rice(Oryza sativa)
  misc_feature (71): n=t or g
cgtatgtactgctcatacatgacaaggaaggagcgcatacaaaacagtagtacaacaaggtttgtaacatngcaaaacaaaggcatagagcagcattacta

SEQ ID NO: 31808 - DNA, 101 bp, rice(Oryza sativa)
  misc_feature (71): n=t or c
agatcgacggagaattggagatagatagaaagatcgaagaactgaagaagagagcgaggagaggtagaacngtagaactagacgacctccgtagtatagca

SEQ ID NO: 31809 - DNA, 101 bp, rice(Oryza sativa)
  misc_feature (71): n=t or c
cattgccctactgtgctggttcacttgggtgctggccttatcgattgcttggcaaatgttcatgattgacnggttactcgatgtgtttttttcccaatgac

SEQ ID NO: 31810 - DNA, 101 bp, rice(Oryza sativa)
  misc_feature (71): n=t or c
acaacttttttactccatctctgatgatggaaattacctgtacatatcccggctgcaaagtcctttctgcnccccttgttataaatgacatgatgaacatt

SEQ ID NO: 31811 - DNA, 101 bp, rice(Oryza sativa)
  misc_feature (71): n=a or c
gcttattcgatccgatcgatctccattaattatccaacgacgacacgacgacgcagcggcagcgatcgatngatggaggaggcctactgcatgatgatggt

SEQ ID NO: 31812 - DNA, 101 bp, rice(Oryza sativa)
  misc_feature (71): n=t or c
gcaactcaacacatactttggttgacgacaatttaggtgaatttgttgcagattcacctgaacaagttgcnttatcttctagttcttatttaagctctcaa

SEQ ID NO: 31813 - DNA, 101 bp, rice(Oryza sativa)
  misc_feature (71): n=a or g
gtacctactcaaggaccgtagaattgctctaaaattaatgtgactgacatatcctattaccatgaatctgnatagctaagaatctatccatatttattata

SEQ ID NO: 31814 - DNA, 101 bp, rice(Oryza sativa)
  misc_feature (71): n=t or c
ttcctctttgcgctgccccaccgctttacctccccttcgacaataccggccctgttgcaaccactagcctngggtccctcccttgctcgatccatctccga

SEQ ID NO: 31815 - DNA, 101 bp, rice(Oryza sativa)
  misc_feature (71): n=t or c
accatgctcggttatctcaacctttcattcaatgattttgttggagaagtacctacacttggtgtcttttngaatgcttctgcaatttcaattcaagggaa

SEQ ID NO: 31816 - DNA, 101 bp, rice(Oryza sativa)
  misc_feature (71): n=t or c
gtggcacctacgtggtgttgacttggcacttaaagttagaaaaaaatgtagtgaggggtagttggatgggngcttttacctaccttgaggagctcggctcc

SEQ ID NO: 31817 - DNA, 101 bp, rice(Oryza sativa)
  misc_feature (71): n=t or c
ttctatcctcactttccatctctcctctctctctcctttatccgttccctaccggcggaaggaagcgaggnagcggcgctgaggcggaggaagtgagcggc

SEQ ID NO: 31818 - DNA, 101 bp, rice(Oryza sativa)
  misc_feature (71): n=a or g
tttattctaaaataatagttcttcaatttatgtttgcaccatcggaaaaccacgtgttttttatctacccngtctggacagataagatgaaatccagccgt

SEQ ID NO: 31819 - DNA, 101 bp, rice(Oryza sativa)
  misc_feature (71): n=a or c
tgtaaaggagaaggtttctatgggcaatatcgaggcaattgttgacccacgatttggtggcgagtacgatnccaattcagtctggaaggttgtggacatag

SEQ ID NO: 31820 - DNA, 101 bp, rice(Oryza sativa)
  misc_feature (71): n=a or g
cttactatatttagtagaattgttatatgacacatggttttatttatgggagaactacgtcctcgagcctnaggtctgaatttattcataatagtactcct

SEQ ID NO: 31821 - DNA, 101 bp, rice(Oryza sativa)
  misc_feature (71): n=t or c
attttaacctcctggaaaattttggaagttccgaaaatatccgcgagccaaatatgcttctgcaaattttnggaagtttctgaaaatgtttttcggaagtt

SEQ ID NO: 31822 - DNA, 101 bp, rice(Oryza sativa)
  misc_feature (71): n=a or c
ccgtatttggactgctggatgaacagaacggaagacaatgagtatctaaagctcgttgctaatttggattnaaaaaaagtggctttgaaagttaacaaggt

SEQ ID NO: 31823 - DNA, 101 bp, rice(Oryza sativa)
  misc_feature (71): n=a or c
cagacgggcccttgtcagtcaaagcatcttgcaccaacaaaccaactgcaccagctatgccacaaagagcnaaagcttcactctgcaaaataaagaaatat

SEQ ID NO: 31824 - DNA, 101 bp, rice(Oryza sativa)
  misc_feature (71): n=a or g
ttattatggtcatatcagcacatgcatatgccactgggaatctgggttaccctgatacgcctgcatagttncgtatccgtatcggatacggcaacggttac

SEQ ID NO: 31825 - DNA, 101 bp, rice(Oryza sativa)
  misc_feature (71): n=a or g
agatggagtgggaggataatcgaaaggaattttggctccgcatgagtcaacatccttcccatcccctgttnggctcgacattatctctctaagcggttgag

SEQ ID NO: 31826 - DNA, 101 bp, rice(Oryza sativa)
  misc_feature (71): n=a or g
cagaagtccacacgtcgcacacgccgggttcaaatgctgttgatttgagtggaatttatgatcagtttaanaataggattgcagtgttttttgatttttct

SEQ ID NO: 31827 - DNA, 101 bp, rice(Oryza sativa)
  misc_feature (71): n=a or g
ttttggaacattgcacagatgcaactgaaatcttccttctccaagtctatcataacaaggtactttcttcntctatacacctcaattgtctgattcagagc

SEQ ID NO: 31828 - DNA, 101 bp, rice(Oryza sativa)
  misc_feature (71): n=a or g
cagttcgtgtcctattgcagagtgcatactgcatgctccctccgtccaaaaaatataaactttagttttcntgtataacatttgaccgtccgtcttatttg

SEQ ID NO: 31829 - DNA, 101 bp, rice(Oryza sativa)
  misc_feature (71): n=t or g
acaagggcaagtctcagcaactcgaatctgagttatgacagcctcagcattgccacgacatacagattgantatgttctttctccttgggtcttcctgaga

SEQ ID NO: 31830 - DNA, 101 bp, rice(Oryza sativa)
  misc_feature (71): n=a or g
cactatactagtcatatactgtactccactagtgtgaaacagtacatagtactagaagtagtacagtagtntaggtggtacgaaatttaaggaatgaaggt

SEQ ID NO: 31831 - DNA, 101 bp, rice(Oryza sativa)
  misc_feature (71): n=a or g
tctgcttcgtgctagctagctagctgttgcgtgagtcttccaaaagcttggctggcgatcaagataggcanctagctagatacagtttctgtttcgattga

SEQ ID NO: 31832 - DNA, 101 bp, rice(Oryza sativa)
  misc_feature (71): n=a or g
ctgaaatagaattacctcgtgagcaaggtttccaacataaacagttctgtactgtggattgttctctgggncatcttcatttgctttctccttcccgtctt

SEQ ID NO: 31833 - DNA, 101 bp, rice(Oryza sativa)
  misc_feature (71): n=a or g
gaaaaaattaaccagaattactgccgcagttagtgcggcgctgggttccgtgatagtaatagctgatgtangcgtggatatgatgtaattcaccagaaata

SEQ ID NO: 31834 - DNA, 101 bp, rice(Oryza sativa)
  misc_feature (71): n=t or c
caagatagataaaattacgatgttttgcacataatttctccttcaggaacaagtacttatatctcatgggntgaagaggtatatatctccttgcgacgcat

SEQ ID NO: 31835 - DNA, 101 bp, rice(Oryza sativa)
  misc_feature (71): n=t or c
ccggaggagagagagaaaagaggaaatcatggaggcgatttgctgtggagattcgggtgtgtgatctggtnggatcttgctttcctgggaggaggaagaag

SEQ ID NO: 31836 - DNA, 101 bp, rice(Oryza sativa)
  misc_feature (71): n=a or g
tgtctctccttcctctcagtgtcctgcggcaaagtgtcaccaattaagtgattaattaaatcaccctgttnccataaatcgtgctggcaactttttgatct

SEQ ID NO: 31837 - DNA, 101 bp, rice(Oryza sativa)
  misc_feature (71): n=a or c
aaccaatacaatagcagttaaacgttcagtaatgcgtcacccacggccagaacaacgatggggaaggtatnagtgaaatctaagcatacatttttcttacc

SEQ ID NO: 31838 - DNA, 101 bp, rice(Oryza sativa)
  misc_feature (71): n=t or c
caaaacagtacctctgcaaacagcatgtgagtccatactggatgtgccttgccgttcatttaaaacacaanttccagtggaagcatttgattttgcgtgca

SEQ ID NO: 31839 - DNA, 101 bp, rice(Oryza sativa)
  misc_feature (71): n=a or c
gaggtcaggtcaatgaatagtgaaattctgagagaaaacaggaaattgaaaaggtcgctccgtactagagntgttgaaggaatttcaaggaacgttctaga

SEQ ID NO: 31840 - DNA, 101 bp, rice(Oryza sativa)
  misc_feature (71): n=t or c
caatcaacttcaagcacacagaaagcaggattgggactttatgaatggcttaaccaactgtactaggctanaaatgatctcgatagctaataaccgtctac

SEQ ID NO: 31841 - DNA, 101 bp, rice(Oryza sativa)
  misc_feature (71): n=t or c
accaaatgggagccacatatattattcgcaatccagttcaggggtgctagaactatatgcggtttatgcantaatctcctgtcggtgcatactggcacaca

SEQ ID NO: 31842 - DNA, 101 bp, rice(Oryza sativa)
  misc_feature (71): n=t or c
agctccaattccttttcagacataatagcttctacgtcaagtcttctggggataagcatattggttcttgnggtcttccaagtttataagaaacacatgca

SEQ ID NO: 31843 - DNA, 101 bp, rice(Oryza sativa)
  misc_feature (71): n=a or c
gttagggagctggcttttttggaaggtcacttttcagggcaggccttcggcatcatggccccgacggcctnttcctgtcccagcgacagtacgccatcgat

SEQ ID NO: 31844 - DNA, 101 bp, rice(Oryza sativa)
  misc_feature (71): n=t or c
tccaattaaagctgtgttagtctagagaatatgggatttctccccctagatgtatgtcaaataaagcgacncattaacacataattaattaattaatagct

SEQ ID NO: 31845 - DNA, 101 bp, rice(Oryza sativa)
  misc_feature (71): n=a or g
caaggaaattctcgtattaatcagataaacagtgaattaagtctgtcgatccatctaggtggaccgaattntaacgccttagattaaatacaacataccaa

SEQ ID NO: 31846 - DNA, 101 bp, rice(Oryza sativa)
  misc_feature (71): n=a or c
gccatcaaaatatataactcttgtgtccctctgatttttaacaaaatgttcaagtatcccttgcacagccnaatcaaaagtatcccaatttacattctgcc

SEQ ID NO: 31847 - DNA, 101 bp, rice(Oryza sativa)
  misc_feature (71): n=t or c
aaattgtatgatggtttaaaaatatttacatataattaattgattatgaaggcaaacctaggtcggcttgncctaggcttgcctccacccttgaaaacaca

SEQ ID NO: 31848 - DNA, 101 bp, rice(Oryza sativa)
  misc_feature (71): n=a or c
tggcagctgccagagactccagtatgcatatggagaggtatccacaaaggcatcacaccttgaggtacttnggaggaatcacctcgtgcagatagatacat

SEQ ID NO: 31849 - DNA, 101 bp, rice(Oryza sativa)
  misc_feature (71): n=t or c
tccatggcaatcaaatctgaagtgcctgcccatcccatgcaggcgaatggtgtttcacgaataccttattnaaaagaagtagatgtacctgttgtaaaaac

SEQ ID NO: 31850 - DNA, 101 bp, rice(Oryza sativa)
  misc_feature (71): n=a or g
ttaatttattgacttttttatttaacttatccgcttccgcctcgaaaagcttcctaatttatcacagcacnattttacgaaagcttttttttcattgacac

SEQ ID NO: 31851 - DNA, 101 bp, rice(Oryza sativa)
  misc_feature (71): n=a or g
cgtaacagcctcggccaacacatgacccttctcaggcaccaacccaagcttgcgcatcaaattgtgctgcncacataaggtcatgtcactcgggccggcga

SEQ ID NO: 31852 - DNA, 101 bp, rice(Oryza sativa)
  misc_feature (71): n=a or g
ttttctcccttattcctcaatcatttttctcttctttgtcgccgccgtcgtcgaggaagaaggctgcatcngcaccacgcctgctggcgccgcctgggaag

SEQ ID NO: 31853 - DNA, 101 bp, rice(Oryza sativa)
  misc_feature (71): n=t or c
ttagaatcagcattgcatttgtgtataattgtgctcatcgattgatgaatttgtgcagcccgatcttcagncacctggcggggaagacgtcggtgtggaag

SEQ ID NO: 31854 - DNA, 101 bp, rice(Oryza sativa)
  misc_feature (71): n=a or c
ccctgtgctatagaatgatactactactacttgctaatgcatgcacaccataaatcaacaatagccaatgnatagagcccggcgcttgcctcttccaactt

SEQ ID NO: 31855 - DNA, 101 bp, rice(Oryza sativa)
  misc_feature (71): n=t or c
cgttgtagttgcctgtatttgaattcctgggagataagattcgctccaatgctccatgaacttaagggtgnacaggccacacgagacgctacaagaattta

SEQ ID NO: 31856 - DNA, 101 bp, rice(Oryza sativa)
  misc_feature (71): n=a or g
gagaagattagcttggtctttctataagcaattttcatccatgatgctgtggtaaactcatgattatactntgaaaccagagattcaggttaaaatcggag

SEQ ID NO: 31857 - DNA, 101 bp, rice(Oryza sativa)
  misc_feature (71): n=t or c
aaacaaagcacaaactttgggcctcctcactgccccaatcccaaatggagatagccaatttccaatcctgnaatacgctgatgatactctgataattatga

SEQ ID NO: 31858 - DNA, 101 bp, rice(Oryza sativa)
  misc_feature (71): n=a or g
gattctacggccctcaatgggaagtggaatggccacttggcagcatcaaatgccttagatgggcataattngatgtacccaatggcatttgggttctttga

SEQ ID NO: 31859 - DNA, 101 bp, rice(Oryza sativa)
  misc_feature (71): n=a or g
gaagcatcattgttcctccagacatgtcgcctcggcaagaagcggcgatgtcccatataacaatatttgtncccattaacaagtctgtggtagcaggtttc

SEQ ID NO: 31860 - DNA, 101 bp, rice(Oryza sativa)
  misc_feature (71): n=t or g
gtactccattccaggtaaatccacaagagagagatgagttagactaggaaatgcttctggatccaacgagncaccgacatctgcaggatgtgccggatatc

SEQ ID NO: 31861 - DNA, 101 bp, rice(Oryza sativa)
  misc_feature (71): n=t or c
attcggaggcttgggaaagacaactcttgccaattcattactccaggagcttgaggcaaaatttgattgcnatttttttgtttcggtatccttgaaacctg

SEQ ID NO: 31862 - DNA, 101 bp, rice(Oryza sativa)
  misc_feature (71): n=t or c
cccatagagaaactcatagatgtacccgaaactggtgtcctcaacttgaaaatagaaataatcatcagctncgtccctgtgttgcaatcgaccaattgttt

SEQ ID NO: 31863 - DNA, 101 bp, rice(Oryza sativa)
  misc_feature (71): n=a or g
aattgctctagcaattgctattctttgcttctgccctccggacaattgaattccacgttccccaaccatcntctcaagaccctgcaatgttccataaccat

SEQ ID NO: 31864 - DNA, 101 bp, rice(Oryza sativa)
  misc_feature (71): n=t or c
aaaaaaaattgaaatataaatagggccagaatccctaattttgttttctttcgagtcatccttatccagtncttgatcattggataggcatggaaaccagt

SEQ ID NO: 31865 - DNA, 101 bp, rice(Oryza sativa)
  misc_feature (71): n=a or c
atctccttcgccgtcgcctcctacctcctcgtcatgatcgtgctccagaaaaccatcagcttctcgcacgncgcctacgccgcgacggccatcgtgctcct

SEQ ID NO: 31866 - DNA, 101 bp, rice(Oryza sativa)
  misc_feature (71): n=a or c
ttacagagagcagtgcgcatcaactgtatttgtccctttttgctgacctttggcactctttggtgttctanttgagggatgcagttagcatgatactcctg

SEQ ID NO: 31867 - DNA, 101 bp, rice(Oryza sativa)
  misc_feature (71): n=t or c
aacaaagggagtagagacgacaagagggtagatctggtcaccaagtcacatcttgccgacaaagacaggtngacggttgaattttgatttggctggacttt

SEQ ID NO: 31868 - DNA, 101 bp, rice(Oryza sativa)
  misc_feature (71): n=t or g
gatggggatctcccagcgtgatgaatctcagcgaagccgaataattggctatcagggcagcgtgcttggcnaaagcgaggagatcacgtttaatttttcaa

SEQ ID NO: 31869 - DNA, 101 bp, rice(Oryza sativa)
  misc_feature (71): n=t or g
cacacatggcagggctatttcttcttcctccaatgtcccttctctctccttcgtttgcatgccttcacgtngagtgtccgatgtgtacagcttcggcgtga

SEQ ID NO: 31870 - DNA, 101 bp, rice(Oryza sativa)
  misc_feature (71): n=a or c
gggccagcaaaattttctaaatttagatcataccatcgccgtcatgttttccgtcacactctccttccttntcttcttttcttctcctctccttctctgtc

SEQ ID NO: 31871 - DNA, 101 bp, rice(Oryza sativa)
  misc_feature (71): n=t or g
tcagagtgggaatccttttggttcctatgcaactgctgtagctggaggaggtagttctagcactagtcagnatggtggatccggaaacggcgcgggtggcg

SEQ ID NO: 31872 - DNA, 101 bp, rice(Oryza sativa)
  misc_feature (71): n=a or g
taaaggttttttggcttacctttgttgccaaatattctgctatttttgcgctcatcttgtttggacatcantgatttaactcaagatttcaatatatcatc

SEQ ID NO: 31873 - DNA, 101 bp, rice(Oryza sativa)
  misc_feature (71): n=a or g
tgtatgcaaattgtactgcacaacagcaagttttcagcaacacatcttccagttatgggcaggacgcagcncatatacgagggtgctagtgcatatatacc

SEQ ID NO: 31874 - DNA, 101 bp, rice(Oryza sativa)
  misc_feature (71): n=t or c
taggggagcataagggttgggattgggagggtagaagggaaaggggaagccgaagccaggagagccagggntgaaagtcattgctatggaaatggaatgct

SEQ ID NO: 31875 - DNA, 101 bp, rice(Oryza sativa)
  misc_feature (71): n=a or g
ttcatggctagaaacaagctatgtgtacacctcgagtttttttttagcgtcattattttggtctcctttanttcttatgattttagcggctaaaacctagt

SEQ ID NO: 31876 - DNA, 101 bp, rice(Oryza sativa)
  misc_feature (71): n=a or g
tcctgccttgttaattcctcctcctggcctgccctcattcttcaacaatggcctctcgccaaagcgcttcntcgagaagcgattgttttcccagcctcccc

SEQ ID NO: 31877 - DNA, 101 bp, rice(Oryza sativa)
  misc_feature (71): n=t or c
tttttattgttggacagagatttggcttgcatgatgactcatccaagaagatgtcctctttgccagctagnttagcttcttgcgcgcgagaagagtctcag

SEQ ID NO: 31878 - DNA, 101 bp, rice(Oryza sativa)
  misc_feature (71): n=t or c
ttaccatagccaccaccaatgccaggaccaatgccaccacctaaaccaccacctttgccaaatccacctcnagcaccatgtccgatgcctccaccaatccc

SEQ ID NO: 31879 - DNA, 101 bp, rice(Oryza sativa)
  misc_feature (71): n=t or c
aacaaaagaattgttggtaggcaggcaagagacgggcctgtaccatggactagtagtatcttgtattggtntggaacaattcacaaagcatgcccaagcac

SEQ ID NO: 31880 - DNA, 101 bp, rice(Oryza sativa)
  misc_feature (71): n=a or g
gttatcacttctaactgctttcgggtatggtcctagcagaaagttgaaccttcctgcattagcttcttgcnttagcttaccatgataatcaaagagatgtc

SEQ ID NO: 31881 - DNA, 101 bp, rice(Oryza sativa)
  misc_feature (71): n=t or c
caactttctctgctcacccttccaaaaatgtgatcattaaaacagaaagtgatgaagggggcatggtcacngcagctatcacaacagagaaaatggctccc

SEQ ID NO: 31882 - DNA, 101 bp, rice(Oryza sativa)
  misc_feature (71): n=a or g
tgcacaatctactctgacgacaatgaaccacaccagagtaaccatcaggtacatcacaggttatatgatanttttatgcaatgaaaagcatgcaaactcta

SEQ ID NO: 31883 - DNA, 101 bp, rice(Oryza sativa)
  misc_feature (71): n=a or c
acgtcaaacaaaaataagaattctcggcttcccattgttccaccagttcagcaaaccgagcaacaaatcanccaattgagaacatctcagcaaactgatca

SEQ ID NO: 31884 - DNA, 101 bp, rice(Oryza sativa)
  misc_feature (71): n=a or g
tgtttatattgttgttgtacacaaacaagaatcgggaattaatgcatttgagtctatatttgcacaggctntttcactaatttgaacacaagcaggaaaac

SEQ ID NO: 31885 - DNA, 101 bp, rice(Oryza sativa)
  misc_feature (71): n=a or g
tttactagttggtggctggtttgcttcactggtggtggctggttacacggcgctgagtgtgagaaggatantgaagacacagcttataccagctgagccca

SEQ ID NO: 31886 - DNA, 101 bp, rice(Oryza sativa)
  misc_feature (71): n=t or g
aacggataggaatgtgggccgaaatgcatgttagcccacagacaaatcgaagcccaaggtggaatgttgcntgggccagcccatctagggcggcggctagc

SEQ ID NO: 31887 - DNA, 101 bp, rice(Oryza sativa)
  misc_feature (71): n=t or g
cgatctgctatatatgtgtgttgatgcgaggaatgctcgatggctgcgtgtgtgtgaggagaagagtaatncgtgtgaagagagaaaatggaatggttgtc

SEQ ID NO: 31888 - DNA, 101 bp, rice(Oryza sativa)
  misc_feature (71): n=a or g
gaccaaccagaagcaccccttcagggggaacatatctgcaaactcaccatctaagataaagacagaaattntccaagactctccaacaccagctgttggat

SEQ ID NO: 31889 - DNA, 101 bp, rice(Oryza sativa)
  misc_feature (71): n=t or c
gtcactgaaatgtgggtacatagaaaagagggtctacatatcagtgacttaaagttatgtgacttaggctntgttcgggagtgagggttgggaacctcact

SEQ ID NO: 31890 - DNA, 101 bp, rice(Oryza sativa)
  misc_feature (71): n=t or g
gtatgaatatttatatactacagtagttgtgaaaccatcggggataatgcttttgtcgttttaattagccnttaattgagtctccatcctgagatataaaa

SEQ ID NO: 31891 - DNA, 101 bp, rice(Oryza sativa)
  misc_feature (71): n=a or g
catgcctggcactgaatttcctttacctacttgtctatctcaatttgcaacgtaactctcagatctggtgntctggtcaagcttagtttagaatcagatgt

SEQ ID NO: 31892 - DNA, 101 bp, rice(Oryza sativa)
  misc_feature (71): n=a or g
ttgagcggactgtaccatgtctcctctctaatctcctactagtagctattagtagcagctagctagacagnaatatcctactaagctactccctccgtccc

SEQ ID NO: 31893 - DNA, 101 bp, rice(Oryza sativa)
  misc_feature (71): n=a or g
gcacgatggcattgaattgatggagttgacatggccaagaccatgacgattaaagttttaacgtgttcacntagggtattatatagagtgtgtcgtatatg

SEQ ID NO: 31894 - DNA, 101 bp, rice(Oryza sativa)
  misc_feature (71): n=t or g
ggggacaggagcttcttctccggtgacgagtttgggttcctagacatcgtgctcatacctttctcaagcangttccatggttacaagcagcatatggtggg

SEQ ID NO: 31895 - DNA, 101 bp, rice(Oryza sativa)
  misc_feature (71): n=a or g
attagccaagtattcgtgtgctgctatgacacactcgtgtttggcagttctatcccatttggcggtaattnactatcccaaagccatacaccatgaacatt

SEQ ID NO: 31896 - DNA, 101 bp, rice(Oryza sativa)
  misc_feature (71): n=t or c
attataacaagggatttggggcaacaaaccaacagtgaaaatcatttttgctagcagcccacttaagtaanttgcaacaaacatcggtttttgctcgtggt

SEQ ID NO: 31897 - DNA, 101 bp, rice(Oryza sativa)
  misc_feature (71): n=t or c
ggcttcacctcccgagtgccgagagaggcgacacgggagtccggtgcggaagggtcgaggagattcaaaanagcagaaatctgatacaatattgttctttt

SEQ ID NO: 31898 - DNA, 101 bp, rice(Oryza sativa)
  misc_feature (71): n=t or c
acgaagaaattgccgcagcaagttatccgaacgaactcagagtaggtttgcaatttcgttttgaaattttngaaatttcgataatttcggtcccctggcaa

SEQ ID NO: 31899 - DNA, 101 bp, rice(Oryza sativa)
  misc_feature (71): n=t or c
ggtagctatggaaatgtagcaaaaatgtgggccattaggtggatgattacataggtaattttgtgcctganatcaaattagaaggcaaggctatttccaat

SEQ ID NO: 31900 - DNA, 101 bp, rice(Oryza sativa)
  misc_feature (71): n=a or g
gattactgtgtagacagtctcatgtttcgattgtctgtcgcagtaactgcatcttctcattttgatatctntgcaaggtcctcgttgtactgatctatcca

SEQ ID NO: 31901 - DNA, 101 bp, rice(Oryza sativa)
  misc_feature (71): n=a or g
ttatgcaaataagtttttagcacggtcgttgcaaaaagttttctggaagggtcagtttgtagagagatctntgctgcgcacaggcacaacctttaggcagc

SEQ ID NO: 31902 - DNA, 101 bp, rice(Oryza sativa)
  misc_feature (71): n=t or c
ccgtgacaatttccattttggtactgtatactcgatactcactactcactccggtgataaatataagtcgngcatgtatttcaattttcaagaggtagcat

SEQ ID NO: 31903 - DNA, 101 bp, rice(Oryza sativa)
  misc_feature (71): n=a or g
cccgtggagagtagaacagctcgttctgtagaaagctatcctacggcaacatacaagaatcataaagaaancacacatgataagttgtgattcactgtcac

SEQ ID NO: 31904 - DNA, 101 bp, rice(Oryza sativa)
  misc_feature (71): n=a or g
cgccgacgtggacggcgtcgccgcggagaagaagccgccccgcaacgacaggaagaggaagaggaataagngcgcgagcgggaggacgtacgaggagacgc

SEQ ID NO: 31905 - DNA, 101 bp, rice(Oryza sativa)
  misc_feature (71): n=t or c
atgcttggaatgaaaggggggaggggaagaacgagtaaatttgctggcctcaaaggattgttgtggaaggnggtgagtcgaagataagcaatggaacaagt

SEQ ID NO: 31906 - DNA, 101 bp, rice(Oryza sativa)
  misc_feature (71): n=a or g
ttatttgaaattggaccaattaaaatatggtaccgttttgttgggaaataatctctccgctgagagaatcntgcgtgcggccaattccacccgttggccca

SEQ ID NO: 31907 - DNA, 101 bp, rice(Oryza sativa)
  misc_feature (71): n=t or c
aaatggaacgattgcgattatccttctctggctctggtggggtgagcgaaatagagttagagaaggggagnagagaagaacagcagctgaattggccttca

SEQ ID NO: 31908 - DNA, 101 bp, rice(Oryza sativa)
  misc_feature (71): n=t or c
ctcctcttgcagctcgtcagttcgatacgccgcatttcgcggatcggtggagctctgtcactgtgccttgngcatgcgtttacattgtgcgcggacatgcg

SEQ ID NO: 31909 - DNA, 101 bp, rice(Oryza sativa)
  misc_feature (71): n=a or g
tggtgcaacactcttatggactccaggcctatggaatcagccatattcaattaagatcccaggcgattacngtgcagttgacataactgtagcacacctta

SEQ ID NO: 31910 - DNA, 101 bp, rice(Oryza sativa)
  misc_feature (71): n=t or c
tcccatactcccatgattatcctgtgcgatttttcgtatggcctatcttgaaacaaaagtgtcccgcgtcnagaaaaatgttttgcgtagtagtgaatata

SEQ ID NO: 31911 - DNA, 101 bp, rice(Oryza sativa)
  misc_feature (71): n=t or c
tcctgcagtctcggagctttcgtctctccaaattccctaggttatttcgtcctgctccggcggtcttcctncgatggcggacctcggcatatcgacctccg

SEQ ID NO: 31912 - DNA, 101 bp, rice(Oryza sativa)
  misc_feature (71): n=t or c
gcgttacgggagagagaaatttgaggtggattgcattcaaaatgggaaaaggatggagaaaccgagaaacnatgctggattctctgttgggcagccgccgg

SEQ ID NO: 31913 - DNA, 101 bp, rice(Oryza sativa)
  misc_feature (71): n=a or g
atattattattatttctttttttttctcacttcttcctctctcatttccctcttctttggcctcttcaacntgggggagctcgaggtggctctagtggagg

SEQ ID NO: 31914 - DNA, 101 bp, rice(Oryza sativa)
  misc_feature (71): n=t or g
aggtagtgcagccagttgatgtcgtcatcgcaatctgatttggtcgtgcacgtacgcatttttttcatcangctctctccatcctttgatcgatccagatt

SEQ ID NO: 31915 - DNA, 101 bp, rice(Oryza sativa)
  misc_feature (71): n=t or c
tgcaggcacatattatgcaacagactcgctgccacatatatgtatttatcatcatggattagaatcataangaagcagttatgcgggttttctgatgacag

SEQ ID NO: 31916 - DNA, 101 bp, rice(Oryza sativa)
  misc_feature (71): n=a or c
cacacaagtcccagcgattagtcccataacttttccttttaggctgaagaccggagaacccactaatctgnaatgcccattgaaacccttctcggcatagt

SEQ ID NO: 31917 - DNA, 101 bp, rice(Oryza sativa)
  misc_feature (71): n=t or c
gtgtacaatgtttatgatgaagcataaatttagtatttagcctattcatcaggagcagccaaccaaaaacnttcacttttgaagtaactttactattccaa

SEQ ID NO: 31918 - DNA, 101 bp, rice(Oryza sativa)
  misc_feature (71): n=t or g
ctaacctcacctcacctcgctttcgatttctccggtcttctcttctcttccgttccatccactttcttctnctgctggagcgcgcaaaggagcttgctttg

SEQ ID NO: 31919 - DNA, 101 bp, rice(Oryza sativa)
  misc_feature (71): n=a or g
ccttcaccttgatccaccataaaccacgagtatgcagtttcccctttcctcctcagatttcttccattttngcatgctagaatgattgatagtttggggct

SEQ ID NO: 31920 - DNA, 101 bp, rice(Oryza sativa)
  misc_feature (71): n=a or g
tagagcctcttgtaattcagctctatatcttggtgtgtgttgaaatgagggatgaggaggggtatttatangtgaagaagtgccttgggaatgtggagatg

SEQ ID NO: 31921 - DNA, 101 bp, rice(Oryza sativa)
  misc_feature (71): n=t or c
aaatattctattcccatgctgcgctcgtgccgccttaatttatacgtactgtcttccacttgctaattatngttgcatttatagcatagtggctcttgtag

SEQ ID NO: 31922 - DNA, 101 bp, rice(Oryza sativa)
  misc_feature (71): n=a or g
ttattttaacatggaagttctaatgcacgatcacgcggggcaccacttggaaaaaatacttactccattcntcccaaaatatcatagcaacctagtattaa

SEQ ID NO: 31923 - DNA, 101 bp, rice(Oryza sativa)
  misc_feature (71): n=a or g
tcggcacgctttctgcaaagcgtgggatgcccagcactagtattggctatgccaccgaggtcgctgctgtncaagatggcgtggcgttgaagcgcctcctg

SEQ ID NO: 31924 - DNA, 101 bp, rice(Oryza sativa)
  misc_feature (71): n=a or g
tgatgatagtggacttgcatttacaacctttaacatgtactgggagaagtgcatggaattacctattgacncatcaccgtcacttgcaccttggaaattgg

SEQ ID NO: 31925 - DNA, 101 bp, rice(Oryza sativa)
  misc_feature (71): n=a or g
ctggtcgtggggagctagattgacgagacgatggcggtagtggtaggggtaagggatgctccggtggcgtngctttgcgggatctggcagaaggcggcaat

SEQ ID NO: 31926 - DNA, 101 bp, rice(Oryza sativa)
  misc_feature (71): n=t or c
taggaattgattaagatatcattcagtttctgctggctctagtctatataagcaaagcttccttccctcanatctatccaaggagaaaataacccagccat

SEQ ID NO: 31927 - DNA, 101 bp, rice(Oryza sativa)
  misc_feature (71): n=t or c
cctcaagattaatgccaggcgaaggaagaacttcatccagcacattaaaaaaggaaccgtatgggtagaangccattacgacaaggcagcagcaatccagg

SEQ ID NO: 31928 - DNA, 101 bp, rice(Oryza sativa)
  misc_feature (71): n=t or c
ttgaaaacggactttttttctttcatgggcccgtgccctactccctcccgtgaggcccaaccatctccgtntctctctctctctctctctctctcttctct

SEQ ID NO: 31929 - DNA, 101 bp, rice(Oryza sativa)
  misc_feature (71): n=a or g
gactgagagatgtgcgggggttggcccgagcccaaaaaagcaaaaagtgcgcgacactatggatagaagcngcggagatgcttgacattccaggggttagg

SEQ ID NO: 31930 - DNA, 101 bp, rice(Oryza sativa)
  misc_feature (71): n=t or c
agggattcatcagtagaaaggcgctttgcatccataagtttttgcctcatctgatctagatcaggactacnagtcttgccaaatgttgaagttacattttc

SEQ ID NO: 31931 - DNA, 101 bp, rice(Oryza sativa)
  misc_feature (71): n=a or g
atatgggacaaagagatcgacttattgcagagggagatcgaggagcaagacgaactaagtcgccttcgacncgagcaagagagagaagacgacctatacgt

SEQ ID NO: 31932 - DNA, 101 bp, rice(Oryza sativa)
  misc_feature (71): n=t or c
cataagagaaaaatcacattggattttttttattatttcagcactgaaccatagaaattaactacatgagntatcttacaaaagtcacaatgcattaataa

SEQ ID NO: 31933 - DNA, 101 bp, rice(Oryza sativa)
  misc_feature (71): n=t or c
gcataaacccaactcaaacaaaaattgatcgcgcctttgttacaactgattgggacatgatgtttgactgntcgaatctttaccctctgtcatccgcatgc

SEQ ID NO: 31934 - DNA, 101 bp, rice(Oryza sativa)
  misc_feature (71): n=t or c
catatgaaaactttcggtcagcgtgactagaacttctacttgacactttaaagcaacctgagcgggttacngaaacttctagtcagggtattgttgatggt

SEQ ID NO: 31935 - DNA, 101 bp, rice(Oryza sativa)
  misc_feature (71): n=a or c
gcagaagcacaggatcaaccacgcgtgcagaaagttgagaacatgtgacatgtactatacgacgtccggtntatatatgtcacttaattaattagatgtcg

SEQ ID NO: 31936 - DNA, 101 bp, rice(Oryza sativa)
  misc_feature (71): n=a or g
agaagagcaatgcttgtacctgtagtttctttatagaagtccaccagagagctgagatcttttgggccccngtatcgtaccattgtagtctcatttacaag

SEQ ID NO: 31937 - DNA, 101 bp, rice(Oryza sativa)
  misc_feature (71): n=t or c
gctatggacagcgatatgctcacgttgggctcctgctgctcctggaacaagaacccacctccgcctccgcngccgccatggtagtggctcgggttgaacca

SEQ ID NO: 31938 - DNA, 101 bp, rice(Oryza sativa)
  misc_feature (71): n=t or c
ctgcctataagttttagtcagagattaaaaagaaaaaccacgctttatgacgaaccccacgagtagatggntagatataggtccattaccttctaacattt

SEQ ID NO: 31939 - DNA, 101 bp, rice(Oryza sativa)
  misc_feature (71): n=t or c
ctattgataaaatagtgggttcatatgtttattagggttaaaggtttagcctatgcctggtgataatcaantttttgttcagatttatgtggatgatatca

SEQ ID NO: 31940 - DNA, 101 bp, rice(Oryza sativa)
  misc_feature (71): n=t or c
ggtgggctcttcaatttgttcagctcaattcacgatgctaagagtcttggatctagagaatgcagtatttncagtgacacaaaaagacataaacaaaattg

SEQ ID NO: 31941 - DNA, 101 bp, rice(Oryza sativa)
  misc_feature (71): n=t or c
tattacaaagcaaaaatagtttgtgaaacctggtggtacgaatatattgtatgtgtagcttgtctagctcnatatattaacaagtgaaaagtgaaatcatt

SEQ ID NO: 31942 - DNA, 101 bp, rice(Oryza sativa)
  misc_feature (71): n=t or c
ctaaaggagacaagaaacatacccaaatcatcagaagcagcagcatttccaccatctggttgcgcgtcttngtcgtcggcgttgccatcgtcttccacctc

SEQ ID NO: 31943 - DNA, 101 bp, rice(Oryza sativa)
  misc_feature (71): n=a or g
ttctcgataagggtgtcatttattgattctaccacagatgacaactgttcatgattcgcatctacaggagnacccctaaccttttcctcatcatattcttg

SEQ ID NO: 31944 - DNA, 101 bp, rice(Oryza sativa)
  misc_feature (71): n=t or c
ggattagattctgacctctcattgttcatctgtgattcttgtggagaaatggcaagacttttgatgtagtnttgcagaactgtacttcctgatttggaggt

SEQ ID NO: 31945 - DNA, 101 bp, rice(Oryza sativa)
  misc_feature (71): n=a or g
tgaaggagaagaggaggagaagaacaagttcatggctgctgatgagaagagttgccactcatggaccagtnagagggtgcacccatgctcatctccggctt

SEQ ID NO: 31946 - DNA, 101 bp, rice(Oryza sativa)
  misc_feature (71): n=a or g
tccttgtgtcggacgtaccctgattgattgttgtgccaagtgccaactccactgtgagcctgtaccacctncatgcatgcatatggattacttttaacgta

SEQ ID NO: 31947 - DNA, 101 bp, rice(Oryza sativa)
  misc_feature (71): n=a or g
accggaggcgcggaacgacggcaagcggccgagaggcggcagctagcaaggaaggggatgggaaaggaagnagggaggagggatcctcaccggaagcggca

SEQ ID NO: 31948 - DNA, 101 bp, rice(Oryza sativa)
  misc_feature (71): n=t or g
aagcaaatagataatggcaactacataaggggaagcatgagtaaagcaggttggaaggagatcagaaaggntttttatgccaccactgatttggtccacga

SEQ ID NO: 31949 - DNA, 101 bp, rice(Oryza sativa)
  misc_feature (71): n=a or c
ccagcacccagccgccatataaaacgagccactcccaatcccccaaccctaaattgccagatctgtactcnggaggcgaagggtcggagccactcgctact

SEQ ID NO: 31950 - DNA, 101 bp, rice(Oryza sativa)
  misc_feature (71): n=a or g
tctcccctttctcaaacacagcctatagtgtattgatgcagattcgggattccgcacttggttttgtcttnacaaacaatagatgagctgtcacttgtagg

SEQ ID NO: 31951 - DNA, 101 bp, rice(Oryza sativa)
  misc_feature (71): n=t or c
ttgtgggtgggatattcccctcaaattctagggtttcaattattttcccgctcgctgcgcgaatttggaantgacgaactaggcgtcgcggatagagagga

SEQ ID NO: 31952 - DNA, 101 bp, rice(Oryza sativa)
  misc_feature (71): n=t or c
tgtgaggctaacatttgggcccgggtggtatttgggaataaaattttaggagagcgcatttaagcactagnattttgggaggatggtaaaaagttaattct

SEQ ID NO: 31953 - DNA, 101 bp, rice(Oryza sativa)
  misc_feature (71): n=a or g
ctcgactgtcagggcatgcacagtcgacataccaacccaccagaacgattggaacggagaaatttagtacncatgcaattagaccataggaccctttgtca

SEQ ID NO: 31954 - DNA, 101 bp, rice(Oryza sativa)
  misc_feature (71): n=t or c
taacaaggtataaatattttcaagaaccgtcacttttaacgttgtagagatcccatcgcgtcaaaaaaaangcaaaacagtacccgattttaccgttaatt

SEQ ID NO: 31955 - DNA, 101 bp, rice(Oryza sativa)
  misc_feature (71): n=a or g
agagaggaatgaaaaatggaagagaaaggggtgagggggagagaagctaataggtgggttccaacgatttntttttttaaaaaaatgatgattttggagca

SEQ ID NO: 31956 - DNA, 101 bp, rice(Oryza sativa)
  misc_feature (71): n=t or c
tcctgcataaattgcactgaatgcatgcatcatcatccatcagatgttaaactaataacatctgaaagcangttaattagtcatcaataccatgaactatc

SEQ ID NO: 31957 - DNA, 101 bp, rice(Oryza sativa)
  misc_feature (71): n=t or c
ttgagcagccatctcttaccacttctgacatctcacactgcattagctcactggaaactgcattatttggnattgtctggtggtcattgctcaccatgttc

SEQ ID NO: 31958 - DNA, 101 bp, rice(Oryza sativa)
  misc_feature (71): n=t or c
acaaaattttattcaaaatttcaaaaatttcaagctgaaattttggtatttcggtgatgtccaatcaaatnggctaaaccaataggtttaaccctgctacc

SEQ ID NO: 31959 - DNA, 101 bp, rice(Oryza sativa)
  misc_feature (71): n=a or g
aagtgaccaacaaatcacggaaaaataaccaccctcaggatagctctgaagtatgaagtctggtagtggcncaagcagcatatgtagtcgaggaatatatg

SEQ ID NO: 31960 - DNA, 101 bp, rice(Oryza sativa)
  misc_feature (71): n=t or c
aaagagtgccgtacattttttttttgttactcctacttggttgggagacgctctgactttttactctaagnttaactagctttatagaactattttttgta

SEQ ID NO: 31961 - DNA, 101 bp, rice(Oryza sativa)
  misc_feature (71): n=t or c
tctttgattattgtcttctttgggtgcatcttgctactccttccttccggttccacgattcttatcgtttnggaggtccttctttgactatagttttatta

SEQ ID NO: 31962 - DNA, 101 bp, rice(Oryza sativa)
  misc_feature (71): n=a or g
actttgttggcttcttgtgatttagcagaggaatatcaagtatccaaccatcccaactagtacttctaccntctcagaaataatcagtctagaaatggatg

SEQ ID NO: 31963 - DNA, 101 bp, rice(Oryza sativa)
  misc_feature (71): n=t or c
accccgttggttaacctcatcagcaatttcttcaactatgatggccagttttcctgggttcattcaaaccngctgaatgaggatctccctaatgcaaacca

SEQ ID NO: 31964 - DNA, 101 bp, rice(Oryza sativa)
  misc_feature (71): n=a or g
gtccgcttcttcacgtggatcacgctaaagaatcagtgcctcactgctgacaaccttgccaagcggaactngccacatgacgatctttgcccgctctatca

SEQ ID NO: 31965 - DNA, 101 bp, rice(Oryza sativa)
  misc_feature (71): n=t or c
tttcaaagggataaaagaaccagctttatcaaatggatttgttgggttttagtaagtatcattgagatacngatggcatatctcaaactttgcaaaattat

SEQ ID NO: 31966 - DNA, 101 bp, rice(Oryza sativa)
  misc_feature (71): n=t or c
ggccattctgatacattatgtttggtttgtataggcctccaggttagaacagtagcagtaacaattgttgntaggtagagtcatgttttttgctttcttct

SEQ ID NO: 31967 - DNA, 101 bp, rice(Oryza sativa)
  misc_feature (71): n=a or g
gattgtgtctctagatttcattgagggacttcccaggtctgccactttcaattgcatccttgttgtggttnacaaattttccaaatacagccattttgttc

SEQ ID NO: 31968 - DNA, 101 bp, rice(Oryza sativa)
  misc_feature (71): n=t or c
cggcggcggcggcgctccaccaccaatgcatcggcgcaccagcaataggaggagagaatcccttggaatanaaggagtacatcgtcctcctgagaccgtgg

SEQ ID NO: 31969 - DNA, 101 bp, rice(Oryza sativa)
  misc_feature (71): n=a or g
aaacacccagaattatttcagtaaaaagaaacctcctatggccttgccacctcctgatctaatcgaagatnaatatcttaaagaaatagtctgggagctga

SEQ ID NO: 31970 - DNA, 101 bp, rice(Oryza sativa)
  misc_feature (71): n=a or g
tgtctttggcccctcaaaggcagatgatgtgaaccctggttggactaccttcactgtgagctgagcgcacngcggagatgtactgtagttagagatagtac

SEQ ID NO: 31971 - DNA, 101 bp, rice(Oryza sativa)
  misc_feature (71): n=a or g
gtatccaacattttgaagagtcttttttgtgctcagggattcatgtaagaaaaaaaaattatgatctctancacaaataatttggatcaatttttgtttct

SEQ ID NO: 31972 - DNA, 101 bp, rice(Oryza sativa)
  misc_feature (71): n=t or c
aggtcaataagaccacaatcatccaagcaacttctgaagtgttgcatatgtggctctgatctctctcgcanccccaagtgctcatcgaggcataaaacctc

SEQ ID NO: 31973 - DNA, 101 bp, rice(Oryza sativa)
  misc_feature (71): n=t or g
tgaggtaaatacaaatggttcgattctgttccagttaacttgctgacaaggagctgaaaaacgagcagaangcaaaatattatatgcataccttgtgttgg

SEQ ID NO: 31974 - DNA, 101 bp, rice(Oryza sativa)
  misc_feature (71): n=t or c
gatgtgctgccaagaaatatttgaaggctaggataggaagttggttcgtgaatgtccttcagtggtagctntcctttcgctggtagtgtagtgtgatgcag

SEQ ID NO: 31975 - DNA, 101 bp, rice(Oryza sativa)
  misc_feature (71): n=a or g
tgaagtatcttacatatgtggtgatgcttttaggtgtgaggatttcaaccctgaatggcaagcattgttcngacttcgttggccccgttgtgataatgctg

SEQ ID NO: 31976 - DNA, 101 bp, rice(Oryza sativa)
  misc_feature (71): n=t or c
cgttaaatccacgacctttttcgcctgttcgttgcttttcctcggctgttatatctccagggatcaaagangaagaaaaaaaataacttctgatgatatat

SEQ ID NO: 31977 - DNA, 101 bp, rice(Oryza sativa)
  misc_feature (71): n=a or g
gtcactcagaactaatttccttttccaagagcccgattggttagttggctttgagatgcttggctgagcancagactggatttttggcccgccactggcct

SEQ ID NO: 31978 - DNA, 101 bp, rice(Oryza sativa)
  misc_feature (71): n=a or g
atatgggggcttcgctgttttgacactccgagtgatgataactgggcccatctatgtgtgtgtatgaaatntgggtccagtgtcattatagcaaaggttaa

SEQ ID NO: 31979 - DNA, 101 bp, rice(Oryza sativa)
  misc_feature (71): n=t or c
gtgagtgaactgtacagtgtgattactacagtaactcacttgctgttcaccgttcgcaattgctgcctttnagcatccattgaccgtaaagcctcactagc

SEQ ID NO: 31980 - DNA, 101 bp, rice(Oryza sativa)
  misc_feature (71): n=a or g
tcctgggccatcacttcttgaaattgatcgagatgaaagaccagaggatggtactcttgcttcttcactcncggtatgatggtttctgctacatctgaact

SEQ ID NO: 31981 - DNA, 101 bp, rice(Oryza sativa)
  misc_feature (71): n=a or g
actacaaccatacgaatcccggtcacagatcaattcaatgtaattgacctcttgaaccactatacccagtntattccaatcaaacacaacacctttcaagt

SEQ ID NO: 31982 - DNA, 101 bp, rice(Oryza sativa)
  misc_feature (71): n=t or c
taaattgtcacaccacagaactggagactgatctatctttactcctaactcttccaagacagaccgaaccnaaattaattcagcagtagcattggccatgg

SEQ ID NO: 31983 - DNA, 101 bp, rice(Oryza sativa)
  misc_feature (71): n=t or c
gagagaatggactcttcctgtgctagctcactttgcacatgacattctattggattggttccaacttcttntatctcttcagagcttgcaattagcgaggt

SEQ ID NO: 31984 - DNA, 101 bp, rice(Oryza sativa)
  misc_feature (71): n=t or c
cgtatttataaagcaagaagaagggatgtgaacatatagtaaacatgtcctactaggacatgtcccctcangaagaagtgtctcttgctatggttaagttt

SEQ ID NO: 31985 - DNA, 101 bp, rice(Oryza sativa)
  misc_feature (71): n=a or g
atttttcctagagaaattttctcacgttcccacgagttttcactcaattctttctatacccctgaattttntccattcactgtatgtctttgagttttact

SEQ ID NO: 31986 - DNA, 101 bp, rice(Oryza sativa)
  misc_feature (71): n=a or g
gattaattgaatttgtttggttggaataatttcggtacttacgaatccacttacttaagaaatatgtatcntcccatttgtaggagaatggtgggagcttg

SEQ ID NO: 31987 - DNA, 101 bp, rice(Oryza sativa)
  misc_feature (71): n=t or c
atagtttttatatggaaattgaattgtgttcttggctgtgttcgtttcaacaaatgagaaaactgcaactntttttacatgcacgcttcctaaaccgctaa

SEQ ID NO: 31988 - DNA, 101 bp, rice(Oryza sativa)
  misc_feature (71): n=a or c
gatgaaccgtaggagaacctggtgatatgcagatcctaaagccgatttttttttagtgaggctggtgtttntgatttgccacgccatattgctactctagc

SEQ ID NO: 31989 - DNA, 101 bp, rice(Oryza sativa)
  misc_feature (71): n=t or g
gcatgagcaccccaacatggcaacacacgtacaaacagcataacaacattagttacctctgttggcaacgngcatcacgaagatcgacacgaactggttga

SEQ ID NO: 31990 - DNA, 101 bp, rice(Oryza sativa)
  misc_feature (71): n=a or g
tatcgctagaggaagcatcatttatataagttctgaagagttaacctgtcgcggggctccggaggggactncgagttcgtcgacgacgtcgagtagttgcg

SEQ ID NO: 31991 - DNA, 101 bp, rice(Oryza sativa)
  misc_feature (71): n=a or c
cagggagggttgcagtgccgtctaatttaggggagaagagtgaagtaagaggaggcgacggggaggcctgnaacgccgtgtgatttgggagaggagagtga

SEQ ID NO: 31992 - DNA, 101 bp, rice(Oryza sativa)
  misc_feature (71): n=a or c
gcattattcaacatatttgtggaatattctcgcaatgccaatcaaattaaaccaaagcaagatcttccccnaaaaccaatgatagagccgtcattaatgta

SEQ ID NO: 31993 - DNA, 101 bp, rice(Oryza sativa)
  misc_feature (71): n=t or c
tggatgctgcctgggataatgggagcactggcattggcattttctttcactctcctcataatcataatgcnattttcattaggaaaaagtacgaattaccc

SEQ ID NO: 31994 - DNA, 101 bp, rice(Oryza sativa)
  misc_feature (71): n=t or c
atatcggatgattatattttgataaaaatatataatgacaaatgggcccccactaacttttgcatttttcnattcatgggatatccctccaatcaaataag

SEQ ID NO: 31995 - DNA, 101 bp, rice(Oryza sativa)
  misc_feature (71): n=a or g
agcaactcagtgaagctcttatcggaccatccattgcttgtcttcatgtgaagtagagataggaccacctngagcttggtgtgctccgccttacatccatt

SEQ ID NO: 31996 - DNA, 101 bp, rice(Oryza sativa)
  misc_feature (71): n=t or g
gagcgtttgggaaaatggtagcatttttcccgacgtgacaatgtgtctgccacctatttagtttttgtggntggatcttacaatgttttactccggtgaaa

SEQ ID NO: 31997 - DNA, 101 bp, rice(Oryza sativa)
  misc_feature (71): n=a or g
aaccatattagagtaagttttgttgaggtgatggtcacctctaattttatccatatcattttctagtagcntatacaacacattgcctctaatacacttat

SEQ ID NO: 31998 - DNA, 101 bp, rice(Oryza sativa)
  misc_feature (71): n=t or c
tctgctgaaaggaagcccaagaaaaagctgcaaacctgggcttgcgatgggccagaaaattttccgtagtngcgatgggctcaaccgctcgagaccgaagg

SEQ ID NO: 31999 - DNA, 101 bp, rice(Oryza sativa)
  misc_feature (71): n=a or c
ttgttatgatatagtggccaaatccgagtagaaaagaatctgggtactactccatagcatggttgttcaanccttccaaggaaatagtttacactaggaat

SEQ ID NO: 32000 - DNA, 101 bp, rice(Oryza sativa)
  misc_feature (71): n=t or c
tacacgtactgagtatctagcagtgccggtatctttagactagtttattgatcggattatctacacctaanataaatagcttaaaacaaatggtttaaata

SEQ ID NO: 32001 - DNA, 101 bp, rice(Oryza sativa)
  misc_feature (71): n=t or c
agtcatggagagcaccatgattcgataggtaaatgatactctactacagtctacacactccatgttctgcntgattttgaaatgaaatttccctggatcat

SEQ ID NO: 32002 - DNA, 101 bp, rice(Oryza sativa)
  misc_feature (71): n=t or g
ctatgcctttcgcctctgccatggctaccttcattgcgagctagccatccgacgcacactgccgtctctancccgctgtaacgatgccgtcatctccatct

SEQ ID NO: 32003 - DNA, 101 bp, rice(Oryza sativa)
  misc_feature (71): n=a or g
tctgatgtatgacattactcaacggtcactccgacatttgattctagaggaactgttatcttttggtctcngctgcgtacaaattctcaatggattgtgca

SEQ ID NO: 32004 - DNA, 101 bp, rice(Oryza sativa)
  misc_feature (71): n=a or g
atctggcttagaactggcacctatttaaaccatataggtaccggtttttaggtcaaaacgcctccttaatnccggttcggaaaaccggcacttattagcta

SEQ ID NO: 32005 - DNA, 101 bp, rice(Oryza sativa)
  misc_feature (71): n=t or g
ctttctatacattcatacctttaaggctgtaatgaaattatgctaaacaaacagcaattgattgaattganaaaaaaataaacatatatatgctctcatga

SEQ ID NO: 32006 - DNA, 101 bp, rice(Oryza sativa)
  misc_feature (71): n=a or g
ttgtctacagcaagttacagtgttcccccatacctcctaaccctacagtttgcagtggaagattacgatgnatattagttctcaggtgccattccaacttt

SEQ ID NO: 32007 - DNA, 101 bp, rice(Oryza sativa)
  misc_feature (71): n=t or c
gtgcatataacctaataatagacttgtgaaataaggtgacgtagatcactgtctccaactcccttgtcttngcaatcgtacatacgcctacatctaaaaag

SEQ ID NO: 32008 - DNA, 101 bp, rice(Oryza sativa)
  misc_feature (71): n=a or g
ggcaaaagccatttcttccttacaattataatttgcaaaatctggaggacatcaccaagggcatgttgctncaagcacgatttctttaaaatagtcgcagc

SEQ ID NO: 32009 - DNA, 101 bp, rice(Oryza sativa)
  misc_feature (71): n=a or c
ttgtgtgcactcacaaagaaacacttcatttattcatagaattattggaagcttacagacccctccgttcnaaaaaaaaaaagtccaatcctagctacaga

SEQ ID NO: 32010 - DNA, 101 bp, rice(Oryza sativa)
  misc_feature (71): n=a or g
tttcagtcagtagtatcttcgtatgatgtatgggccactccccggatgataagatatacttgccggaggangtggatgataagatatactaggtggaggtg

SEQ ID NO: 32011 - DNA, 101 bp, rice(Oryza sativa)
  misc_feature (71): n=a or c
tagaatattttccagagaaaggccaaaagcatagttgtattattggtctcttgtgcatttgccaaaaaaanaaacaaacaaaacaaaacagagacaatcat

SEQ ID NO: 32012 - DNA, 101 bp, rice(Oryza sativa)
  misc_feature (71): n=a or g
ttgtaagcctttatgaagatcccatagctcacgttgtacagttttttggcaaagtgagcaaatcatctgcnttcataatatgacagtatagattaaatctg

SEQ ID NO: 32013 - DNA, 101 bp, rice(Oryza sativa)
  misc_feature (71): n=t or g
gccagtacagcatgtatcacatattcacattgtatgaatcttcctgactcaggtagagttctgccagagantgcatcatcctagtctcctagatgggcatt

SEQ ID NO: 32014 - DNA, 101 bp, rice(Oryza sativa)
  misc_feature (71): n=a or c
ttggctaagtttgcatgtacattgagtgaggggcgtcatgtgtggcttctaaaccctccaggttttattgngatgcatgtaaatctgacttctcatgaatg

SEQ ID NO: 32015 - DNA, 101 bp, rice(Oryza sativa)
  misc_feature (71): n=t or g
taaaacaagtacacggtaacctcgagaatgtgcagagtaaccaagcataagcccatcagtagaacgtgacncaaattttccaaatttcccgatttcaacac

SEQ ID NO: 32016 - DNA, 101 bp, rice(Oryza sativa)
  misc_feature (71): n=a or g
taatagaaagattttactatgagtaatttatttgctgaaagaaagaatatatgagcaagaaaaggtgtggnaggcatgtgaggggagcgctttagatatag

SEQ ID NO: 32017 - DNA, 101 bp, rice(Oryza sativa)
  misc_feature (71): n=a or g
gtgccagaggtcggcgcctgtgtaccggttagtggacctcggcgagactcacatgaaaaatccttcaaaanaataataataacccaagtatatttggacat

SEQ ID NO: 32018 - DNA, 101 bp, rice(Oryza sativa)
  misc_feature (71): n=a or c
ttggaggtttacctgttcaacggtgactctgggcagttgtctgtattgaataggcacattggttaaatatntcttctcttgtgctgttttctttttttctt

SEQ ID NO: 32019 - DNA, 101 bp, rice(Oryza sativa)
  misc_feature (71): n=t or c
tgcccgtgcgtacaccggccagccagccaagtccattgggcagtagttgcatgcatactccctctgttttnataggtcaacttttgtgtaccaatctaagc

SEQ ID NO: 32020 - DNA, 101 bp, rice(Oryza sativa)
  misc_feature (71): n=a or g
gcccacaaagtcacggtcatctcttctttccccctatgcgaggtggtcaggaacaaagatgttgtaggacncattgccaagtgggtcatcaagcttagcca

SEQ ID NO: 32021 - DNA, 101 bp, rice(Oryza sativa)
  misc_feature (71): n=t or c
ttttagttaggtaccctgtttaggaaatatgctggctcatactacctccgttttttttaatagatgacgcngttgaccttttctcacatgtttaaccattc

SEQ ID NO: 32022 - DNA, 101 bp, rice(Oryza sativa)
  misc_feature (71): n=t or c
tatgttttcaaaccgctctggcttaaactcctcggcactcttccaatactttgaatccctacatattgccnatgcattcacaaacacgatagtgcccttgg

SEQ ID NO: 32023 - DNA, 101 bp, rice(Oryza sativa)
  misc_feature (71): n=t or c
acatccttcgaagagatcgtgatgcccagaagcgtcgtcattgccaatcaaaaagagtcaggctatatttncttttgtagtttaccctttccttatatggt

SEQ ID NO: 32024 - DNA, 101 bp, rice(Oryza sativa)
  misc_feature (71): n=a or c
cgcgatctctagttataaaaagagaaaattccctggttcccttaaaagttcgcacaatctattccataccnctgagggctgagatttactcattttcttct

SEQ ID NO: 32025 - DNA, 101 bp, rice(Oryza sativa)
  misc_feature (71): n=t or c
tggagggacaaactgagggtgagtgattctgaaaatgagtatctgcagaagccttttgatttggcagagantgatagggtgatgaaaagtatgaagtcaaa

SEQ ID NO: 32026 - DNA, 101 bp, rice(Oryza sativa)
  misc_feature (71): n=a or g
aggactgggctgcctggcactatgaccaaaaaggggttttttcagttaaatcggcctacaaagtggcgatncagaacaaagatgctagaagtggcaaagaa

SEQ ID NO: 32027 - DNA, 101 bp, rice(Oryza sativa)
  misc_feature (71): n=a or g
ctcatgtactttattgctggacatgtcaataacctgcagggacgtcaaattggaaatccagcctgtggtgntgatctcattcccggctaggtgcagctccg

SEQ ID NO: 32028 - DNA, 101 bp, rice(Oryza sativa)
  misc_feature (71): n=a or g
ggacagatcccacagcattaagctgcaggtcagtcacagttgcaactccaacaccaaaaaggagaacactnagggagagctggatattccgactgcacagt

SEQ ID NO: 32029 - DNA, 101 bp, rice(Oryza sativa)
  misc_feature (71): n=t or c
cctctacacctatcttagttttttttttagggagggggggggggaacggagatatattactcattgaatgngatgtgaaataaaattacaactgtcatccg

SEQ ID NO: 32030 - DNA, 101 bp, rice(Oryza sativa)
  misc_feature (71): n=a or g
ccggcttgtccttgatttgtttgctgttgctgtcatcttccgtgcagtgcaggctccgtatgcggcattgntcgctccagcgtaattgtcgatggggcctc

SEQ ID NO: 32031 - DNA, 101 bp, rice(Oryza sativa)
  misc_feature (71): n=t or c
ttttttgatgaaatttacctttgatttctcgaattgctcattctcccccgttgaacacatgtagagagagnaaaggtggatgctgtgaagagcgcggcgcg

SEQ ID NO: 32032 - DNA, 101 bp, rice(Oryza sativa)
  misc_feature (71): n=t or g
aaacccgttgcaagcagttgcgcaacaataattatatcaagcattggctggagcaatctatatgaacatangagatacaacaaataatacgaccaagcatg

SEQ ID NO: 32033 - DNA, 101 bp, rice(Oryza sativa)
  misc_feature (71): n=a or g
ttatccactcatggagcatcccaccaatctagaggtggtggtaggataatatactcatcaccaccaagggngtgtttagattcaggggtgtaaagttttga

SEQ ID NO: 32034 - DNA, 101 bp, rice(Oryza sativa)
  misc_feature (71): n=a or g
tgacattaaaattttaaaaatatgtagctccagaagagagcgcagcagaagtacagcgccaagcagtgacntgaagcagcactgccacgacgagcatgtgc

SEQ ID NO: 32035 - DNA, 101 bp, rice(Oryza sativa)
  misc_feature (71): n=t or c
actagcacggacggaggtgtgtcaatttcattgaatatagtgaatttccttcaggattcgctctgcaggtnccaattttctcattgccggattttcttttt

SEQ ID NO: 32036 - DNA, 101 bp, rice(Oryza sativa)
  misc_feature (71): n=t or c
attaaacaagtggcaccaccctctatttcgctatagctccgcccttttcctacatacataaactcccaacnatttttccaaactaccaactttctccaaaa

SEQ ID NO: 32037 - DNA, 101 bp, rice(Oryza sativa)
  misc_feature (71): n=a or g
acatcgaccattattgcagactgcgagaggttgctttccttcagcaagtctgatgcgcttttgcgaagtgnagtatatattttgcaattgcacgagactct

SEQ ID NO: 32038 - DNA, 101 bp, rice(Oryza sativa)
  misc_feature (71): n=a or g
gttaatataagccttaaagtcttcgcaaattgcaatgattgtctttaaattagcaaaatctattgtctgcncatagacttattgatgcctatgaaaagcca

SEQ ID NO: 32039 - DNA, 101 bp, rice(Oryza sativa)
  misc_feature (71): n=a or c
ggtggggagaggaggagaggtgaaggggaggggatgagagaggtgagggactgagaggtgaggggataagnttgccggccgtgagtggtgaggtgtggaga

SEQ ID NO: 32040 - DNA, 101 bp, rice(Oryza sativa)
  misc_feature (71): n=a or g
cgtgtgctcagtgttcatcttctccaaaacttcaatcaggttgtccctctgatctcctgaagaagaatggnttcaatccagaggcaggactcctttgatga

SEQ ID NO: 32041 - DNA, 101 bp, rice(Oryza sativa)
  misc_feature (71): n=a or g
catgtgcaccctatgaaccctcactactagaaaacacattatctacgacgtaggggttccactttcgcagncgggcatggccttcggaggcaaaaccccgc

SEQ ID NO: 32042 - DNA, 101 bp, rice(Oryza sativa)
  misc_feature (71): n=a or g
ctaggttatggatgtccttgttctttgtcttgtcgagctcaagcagcatgtccttgaaaactttcttaatntcaggagcgctggaaacagagacaaatgcc

SEQ ID NO: 32043 - DNA, 101 bp, rice(Oryza sativa)
  misc_feature (71): n=t or c
ctccaatagtggaatggctggcaaacatcggtatctacgcttacgtataatagttgggtcaaggatcaacngatcgagacctaacaacaaatgaatatgta

SEQ ID NO: 32044 - DNA, 101 bp, rice(Oryza sativa)
  misc_feature (71): n=a or g
tatacatacattgtcgttgactttctccttttaaaattctatcatgtagcccatggggtttgctgctcccntagggtattgctagatttcatgcgtacgtc

SEQ ID NO: 32045 - DNA, 101 bp, rice(Oryza sativa)
  misc_feature (71): n=a or g
tcgacaagggatgggcttcatctgtggaccagaaccgatcgtactgatcatcagggtacctgtattacgtntgaaatttggaatataagacgattaccggt

SEQ ID NO: 32046 - DNA, 101 bp, rice(Oryza sativa)
  misc_feature (71): n=t or c
aatggtcctgccatgcgcgccacacgacagcgtgacagtgtcaccaacctcggcagacgcacacacggaancctccaccacggtgcggaccgccacctccg

SEQ ID NO: 32047 - DNA, 101 bp, rice(Oryza sativa)
  misc_feature (71): n=a or g
gtgaagactggaaaggtagaagcataccaaagaacgagatgtagatgatagagcgaggcctgagcccaccnctagtgccgcccacaacttcatcgccccgc

SEQ ID NO: 32048 - DNA, 101 bp, rice(Oryza sativa)
  misc_feature (71): n=a or c
gcgtatacacgcgtacgcacatttctcaccgctctttttttgagagagaagagaagagaaactcagccatngtcgtcttcttcctccgcgaaggcgagagc

SEQ ID NO: 32049 - DNA, 101 bp, rice(Oryza sativa)
  misc_feature (71): n=t or c
gcaataccacacttacacacatatgaatatgatcggcccgtaacacatgcttgaaaagacggaaaatcaanggtatatacctaatatcgccaaatttattt

SEQ ID NO: 32050 - DNA, 101 bp, rice(Oryza sativa)
  misc_feature (71): n=t or c
actgatactgaattaggaaatgattctgtctgtctgttgcctggttcaattgattgtggtttgggtcccantgaaaatactgggtctggtgctaatataac

SEQ ID NO: 32051 - DNA, 101 bp, rice(Oryza sativa)
  misc_feature (71): n=t or c
acaattcaggaaaatgcttatgaggtaaaagacactaaggtaagtaaggtgaagagggatgttcgattttncgagggtggttgtacttgtttgccgattcc

SEQ ID NO: 32052 - DNA, 101 bp, rice(Oryza sativa)
  misc_feature (71): n=a or g
cagcgaagcataggttgtagcacgccgatgcgatataattgcccggagactagtttgtacttggcaactcngagctgtaagtgttttgcttctgcttcgtc

SEQ ID NO: 32053 - DNA, 101 bp, rice(Oryza sativa)
  misc_feature (71): n=t or c
tggttacctgtttcaggaaaatgctgagcataagtgattcgattttgtttctgttccaggatcgagagtgnggtaactgaagtctcacatgaccaccacac

SEQ ID NO: 32054 - DNA, 101 bp, rice(Oryza sativa)
  misc_feature (71): n=a or c
tttgtagttcagaggtatttaggatctgatcgggtgtttttcttgaaaggtcaccgtccagatgataaatnaagattgcggtttcaggctttggaaatgga

SEQ ID NO: 32055 - DNA, 101 bp, rice(Oryza sativa)
  misc_feature (71): n=a or c
catcatcattcatccacacacacagagagagctagccaggggcacatatcaaaacagtccctattgtatgntgcatgcaataacagatcgatcgatggatg

SEQ ID NO: 32056 - DNA, 101 bp, rice(Oryza sativa)
  misc_feature (71): n=t or c
gttcatcctatttctgcaaatttaatatgtgatttactggtaactattcggggaatttgcaaatttgccantggttttttcaattttgcaaggataccact

SEQ ID NO: 32057 - DNA, 101 bp, rice(Oryza sativa)
  misc_feature (71): n=a or c
agaagaggacgaggtttgaatatttacaagacacccacagtggatgatggaaagggaaaggaaaaaccacnaaaatcttccgaaaccaataaaaaacctga

SEQ ID NO: 32058 - DNA, 101 bp, rice(Oryza sativa)
  misc_feature (71): n=a or g
acaattattcagcgccgtcattctctcctgcaggtgatgtattatgcagttaactgttcgctgtaattttncagtgtcactgctcccactctgcttttgaa

SEQ ID NO: 32059 - DNA, 101 bp, rice(Oryza sativa)
  misc_feature (71): n=t or c
gtcaaaacgtcttataacttgaaacggagggagtagctagcttctgagaatatagagaagctaggtttttntagtttctgactctagtttattttctagat

SEQ ID NO: 32060 - DNA, 101 bp, rice(Oryza sativa)
  misc_feature (71): n=a or g
gcatagcctcctcatgcacagtggcgtttcgacaggcaaaaactctcaaaaacagttccatcatttgatcngcatattgcaagaaggaatattttgttgac

SEQ ID NO: 32061 - DNA, 101 bp, rice(Oryza sativa)
  misc_feature (71): n=a or g
actcgtaaattctcatcggtgaaggttcttaattaattataaccagtcacgaataagtcatcggtgaatgntgttcacctgatatagataagatttttttc

SEQ ID NO: 32062 - DNA, 101 bp, rice(Oryza sativa)
  misc_feature (71): n=a or g
tccttgtcctcaaggatgaaatgttggatacatgctttgaatcacagcagcatcctcccatgtggcatctnctggtcccaaattttcccacagtatcaacc

SEQ ID NO: 32063 - DNA, 101 bp, rice(Oryza sativa)
  misc_feature (71): n=t or c
ccatcaaaccatcactacatccatccaattagaaacatccatgaattgactgcaatcctcctaccggcatntagagacagtcatgctgacgacatccatcc

SEQ ID NO: 32064 - DNA, 101 bp, rice(Oryza sativa)
  misc_feature (71): n=t or g
cctacgacgagacctgcagcaaggaacgccatgtacacactaatctgcatcaagcaaaaaaaaacgaaaangagaagatcggatttgtatcaaagctgaga

SEQ ID NO: 32065 - DNA, 101 bp, rice(Oryza sativa)
  misc_feature (71): n=t or c
atggtaaaaacctgcagaaaattgcttgggagcatcctcggttggttgggcacttgatgttggtgattaanatccataccaaaatgatgattaaatgaaag

SEQ ID NO: 32066 - DNA, 101 bp, rice(Oryza sativa)
  misc_feature (71): n=t or c
cgccggtaggtggaggggcccgattttatttggccacctacatttttgccggcagatgtctcaagaggccngcctgcaaaaataagaggttatttttgcag

SEQ ID NO: 32067 - DNA, 101 bp, rice(Oryza sativa)
  misc_feature (71): n=t or c
tttggccgccgtcgccagtcggtggattcatcagctgctactcgcgtttttttagggtggcggaatgagangacgagaaacgacacgtttttctgttcacg

SEQ ID NO: 32068 - DNA, 101 bp, rice(Oryza sativa)
  misc_feature (71): n=t or g
acataatttgatcggtggatcgaacacttcaggcagcggtctaaaccgttcgacggctgctttcaataggnagatgatagacatggtgctcgggttgatgg

SEQ ID NO: 32069 - DNA, 101 bp, rice(Oryza sativa)
  misc_feature (71): n=a or g
attccctagacaagtttgttcttttgcaaagttgcagtgttttccagattttcctctgtgctcaagtctgntagcttctgtaggtctgttctttcccgtgc

SEQ ID NO: 32070 - DNA, 101 bp, rice(Oryza sativa)
  misc_feature (71): n=a or g
agaagatgcaagggaattggacacaacaagacaacttgtgcaagagaaatgcaggcactgctcaggcttcntctagtgcacaatctaggcctattaacaag

SEQ ID NO: 32071 - DNA, 101 bp, rice(Oryza sativa)
  misc_feature (71): n=a or g
agaagcatgagcagaattaccccactcatgatcttgagcttgcaacagtggtctttgctctcaaaatatgnaggcactacctgtatggagaatcttgtgat

SEQ ID NO: 32072 - DNA, 101 bp, rice(Oryza sativa)
  misc_feature (71): n=t or c
ttgccataagcagggcaggtgaacgaattcacctcaaacattatctgtctctgggtttcatgtgagtccancattattttccaagttcttgtcagcctgcc

SEQ ID NO: 32073 - DNA, 101 bp, rice(Oryza sativa)
  misc_feature (71): n=t or c
acacccccacccaaatgcatctacggtttgtttcctgcaggaatccaaacgaaaattgattcgacacgttngcattaaaaaacaactatgatgaaacaatc

SEQ ID NO: 32074 - DNA, 101 bp, rice(Oryza sativa)
  misc_feature (71): n=a or g
gcggtcggatctggtgcccggatcaagtgcaccaaggtcacggtggccatggaaagcggaagaagcaatangagcggagcttgggaggtggaggagaggat

SEQ ID NO: 32075 - DNA, 101 bp, rice(Oryza sativa)
  misc_feature (71): n=t or c
cgccgtggaagatgatgccgtcctagctcgatggctgatgggtatcagaacgctgtccaactacatgatgnacctccttgccgtgcgccccgacatgcttc

SEQ ID NO: 32076 - DNA, 101 bp, rice(Oryza sativa)
  misc_feature (71): n=a or g
atggaccaaccatcttgacttcttgagcctcgagtcttaacagaaatcgaccgtgcgtgcgttcatagggntgagtgtgcgtgcgttgtgagtgtctgtgt

SEQ ID NO: 32077 - DNA, 101 bp, rice(Oryza sativa)
  misc_feature (71): n=t or g
agcaggtgtgctggccgtagtagaccaccgtgtacatgacgggatgatcgccattgtagctgttggcatgntgcaggtcttctcgctgctgcaccgtcttt

SEQ ID NO: 32078 - DNA, 101 bp, rice(Oryza sativa)
  misc_feature (71): n=t or c
atcccaagaagatgaggaagaggatgagggatcgtcgtgatcaaggttatgaccccttggacgatgatctncgcctcctcttcactttgggcggcgtgatc

SEQ ID NO: 32079 - DNA, 101 bp, rice(Oryza sativa)
  misc_feature (71): n=t or c
ttcgtcaggatcccagatgaaacaaacgaagagtttagaccgtggtaaagcacaaaccatactacgggccngatactgtcacccaaccgccttgcaacctg

SEQ ID NO: 32080 - DNA, 101 bp, rice(Oryza sativa)
  misc_feature (71): n=a or g
tgacgtgtgcccaacatcttcagcatgttcatcgcctacatgtccattattggtgtatggaactattccgncgcacgtggatgagctcggcctctgatgat

SEQ ID NO: 32081 - DNA, 101 bp, rice(Oryza sativa)
  misc_feature (71): n=t or c
cgatgacacctgcggcttcgaaagatggctcgctgctgcaagtggagccgcaggcggtaccagttcaacangaaatccggggtggatctcatccccaggag

SEQ ID NO: 32082 - DNA, 101 bp, rice(Oryza sativa)
  misc_feature (71): n=a or g
cgtgtccagccggccggcatgaagcatgcattatattgctgtgcgtgttgtatccatgcggacaaaagagntgttaattaaagtgcaaagtgtgtagtttg

SEQ ID NO: 32083 - DNA, 101 bp, rice(Oryza sativa)
  misc_feature (71): n=t or c
ttgcattttagaccatcccaaacaacttattaagcacatgtcgacggctttaaataaataggcgaactttnccatctatgtgcatgccatatttttcctag

SEQ ID NO: 32084 - DNA, 101 bp, rice(Oryza sativa)
  misc_feature (71): n=t or c
tggcggcgccagcccacacagtccaataggcggcaagacacagttaggattttctttttttcgaatttttncatatatgtgtaaactttcaacctagattt

SEQ ID NO: 32085 - DNA, 101 bp, rice(Oryza sativa)
  misc_feature (71): n=t or c
tcgcgctcccgcccgtcacggccctccaccatgtggagagcttcgtggacgaggaagggaacatagtgtanagtgttgatgagtctctggggcccgacgat

SEQ ID NO: 32086 - DNA, 101 bp, rice(Oryza sativa)
  misc_feature (71): n=t or g
ctctcatccactggcatggggcaatttaggaacccaaatcgattcatttgcaaaacaagcttatcaatctnttcaactatctgctggagtctctttcctat

SEQ ID NO: 32087 - DNA, 101 bp, rice(Oryza sativa)
  misc_feature (71): n=a or c
tgcctagggagattctgggcatctcaacatttggcctctcagtgttccttctcaagtggtttcccataaantgggttgatgctttactactcattttctcg

SEQ ID NO: 32088 - DNA, 101 bp, rice(Oryza sativa)
  misc_feature (71): n=t or g
aaatgaatttctagccaacacaaggttttcgagccttgcagattttttgttctttagaacattaaacatgnctaacatgttttcatcaccacatgttaaat

SEQ ID NO: 32089 - DNA, 101 bp, rice(Oryza sativa)
  misc_feature (71): n=a or g
ccacgaatcacgagtgtgtaagtgaatctatcaggcaccataccagaatctctcatacaagagaagaagtnacaggcttcgttgtattgaccatctatata

SEQ ID NO: 32090 - DNA, 101 bp, rice(Oryza sativa)
  misc_feature (71): n=t or c
atcgcgtgagattcaccgccttcagcagcggctttgatcatgagatcgtgttgtacgatgacagattatgnaagaaggggaagttgttccagaatgttgtc

SEQ ID NO: 32091 - DNA, 101 bp, rice(Oryza sativa)
  misc_feature (71): n=a or g
atcgatggatggcgcgttcttatctttatttaacttgtataattatgagtgtgcttagggcatccacaatngttatctatatgctctctacaagagattca

SEQ ID NO: 32092 - DNA, 101 bp, rice(Oryza sativa)
  misc_feature (71): n=t or c
tggtgtcgacagaaacatctgtccctttcgaagtaaattggtcagaggtttgctcaagattccataatggngcacaaatttgcgataatacccagccaacc

SEQ ID NO: 32093 - DNA, 101 bp, rice(Oryza sativa)
  misc_feature (71): n=a or g
cagtcacccccggatcgtttctgaatccaaccttttctttctttgctcttttggtatgagagcagcggtgntggtgatgagcgccatgggcggcgcggagg

SEQ ID NO: 32094 - DNA, 101 bp, rice(Oryza sativa)
  misc_feature (71): n=a or g
gatcagggcgcccgcacgatctccactctgcgtaaccgaaccgattttttgtgtgttgcatggaggcggcngctcggtttatatagagaaaaggtcgcttg

SEQ ID NO: 32095 - DNA, 101 bp, rice(Oryza sativa)
  misc_feature (71): n=a or g
tgatagttctgaggttagcaactttgatgctatcccattccacttgatttgggattacatcaatgatccanttgagactcagattgaaaaagacattagtt

SEQ ID NO: 32096 - DNA, 101 bp, rice(Oryza sativa)
  misc_feature (71): n=t or c
acgacgacgccatgatccttcacctagctagagatcgaatcgatcgagtagaaatcaagcaaaacttgacnataacttgctagctagctatcttgcatatc

SEQ ID NO: 32097 - DNA, 101 bp, rice(Oryza sativa)
  misc_feature (71): n=a or g
ctcgaccacttaaagggaatccagagtaatagatggacggcattcatgtgacctgcgagaactgcctcctnatgacgacgaagacaatgaggaattatcgt

SEQ ID NO: 32098 - DNA, 101 bp, rice(Oryza sativa)
  misc_feature (71): n=a or c
tccagtacttaaatcacatctcagggacagcaggtagccatccattagctagctagtcaaattaacttctncacggccatgtatccccctgatccgtccaa

SEQ ID NO: 32099 - DNA, 101 bp, rice(Oryza sativa)
  misc_feature (71): n=a or c
aaaggtgactatttgattttgagtttcttaaaaattcactacttgaggcttgagcactgtggagtatgggnttttcggctcagcaaaaggaaacgttatgg

SEQ ID NO: 32100 - DNA, 101 bp, rice(Oryza sativa)
  misc_feature (71): n=a or g
aaccatttagatgatttttaagcaaacgagaggatattcccttgagggatcaggatagtttcccggtgaangacactagtagtagtagaggaattgagggg

SEQ ID NO: 32101 - DNA, 101 bp, rice(Oryza sativa)
  misc_feature (71): n=a or g
ccacatatgattattagtatatgaattgccacggtggaggttagttccggcaagcaattaacagtagtagntctcattgaggtgcatcagtggtgacgaca

SEQ ID NO: 32102 - DNA, 101 bp, rice(Oryza sativa)
  misc_feature (71): n=a or g
aaacttagtttgttattttgtttgccacaaaagtatggtaaaactaagcttagctaccttaataaaaaatntgtggtaatattagttcacaaccaactgaa

SEQ ID NO: 32103 - DNA, 101 bp, rice(Oryza sativa)
  misc_feature (71): n=a or c
ggacacaacatatatttgctcatactatttttcatgtcattatccacaaaactaatgaatgcagtgacccnctccctatactctagggacgaacggcgaat

SEQ ID NO: 32104 - DNA, 101 bp, rice(Oryza sativa)
  misc_feature (71): n=a or g
caagccgatgcggtatatttcggatcagcagtgatatatatagtaaacaaagggctaaatttactttatcngctttagataataacaatatataatctata

SEQ ID NO: 32105 - DNA, 101 bp, rice(Oryza sativa)
  misc_feature (71): n=a or c
attcaccactctctctagtgtctcagtggaagctcgaatacttgtaagcaccctccctttgtacttctcantcttgtagatgtcaagaacacctgctctag

SEQ ID NO: 32106 - DNA, 101 bp, rice(Oryza sativa)
  misc_feature (71): n=a or c
gcttgctgccgaatcttccggtcaaccccaagactggatctttcaaatattctattcaaagggattctccnatctatttctgacttatgggcacaaatgtc

SEQ ID NO: 32107 - DNA, 101 bp, rice(Oryza sativa)
  misc_feature (71): n=a or g
atgatgaagtggccaaagaatgggaacacacaatgctgcaggatagcatgggcaaagagttgaatgaattnaacagacaactggagcaaaaggaggtaata

SEQ ID NO: 32108 - DNA, 101 bp, rice(Oryza sativa)
  misc_feature (71): n=a or g
gaaataacccgaagcaagacgagtcgagatcgacaatgacaacgatgacgacgacctggcagccacctccntcatcgccgtcgccgccgctgcaatggtcg

SEQ ID NO: 32109 - DNA, 101 bp, rice(Oryza sativa)
  misc_feature (71): n=t or c
tcaaaaataattgatcaactactataaaaggtgtcacgcgaatttccactcccgtgactttaccaaaaatngacttcagtttgtcacgtccaaaacgaaat

SEQ ID NO: 32110 - DNA, 101 bp, rice(Oryza sativa)
  misc_feature (71): n=a or c
ttgtagagcgtagatttaaggatgattataagatatggacttgtcacgggcaaatcgccgttcataatgangaggctgatgtcttttgctttgatgcggga

SEQ ID NO: 32111 - DNA, 101 bp, rice(Oryza sativa)
  misc_feature (71): n=a or g
ttggttgattaatttgtttgtggagaagttgtggtgaactcggggttattatatactgcggtgattgattnattaattgctgctgttaattttgtgggggt

SEQ ID NO: 32112 - DNA, 101 bp, rice(Oryza sativa)
  misc_feature (71): n=a or g
gaaaactccatggccactagctccaattgttgacaagccggaatgatagttccctgcaaattgaccttctnaaggatagcccatgagcggagccaatgtgt

SEQ ID NO: 32113 - DNA, 101 bp, rice(Oryza sativa)
  misc_feature (71): n=a or c
caattataactattctcttcacttactttatctaatccactaattacaaccctccttcaatcatctatacntattccatctgttccaaaatataaatattt

SEQ ID NO: 32114 - DNA, 101 bp, rice(Oryza sativa)
  misc_feature (71): n=t or g
gccccgttccccaattcgtttcgaaatcgaattccaaatcgaaatcgaaatcgaatcgattcgtccgtgcntgcgtgcgtgcgcgactcgctctcacacac

SEQ ID NO: 32115 - DNA, 101 bp, rice(Oryza sativa)
  misc_feature (71): n=t or g
cgacgggatggcgtcggacagtatcttcacgatggacatcctggtcagggagcatggcgaggtgttccagnggatcagctcgctggtcgacgtcgccggcg

SEQ ID NO: 32116 - DNA, 101 bp, rice(Oryza sativa)
  misc_feature (71): n=t or g
attgcggtaattggcttcgaggcgaaaccccttgagccagctggttcgcttggcttgaaatgccgtactgncccagcagttgcccagctagagcaccctga

SEQ ID NO: 32117 - DNA, 101 bp, rice(Oryza sativa)
  misc_feature (71): n=t or c
ctctctttcttgctccttcaccctctttcttcttgcttgtgtggtttattcattgggatccatggggtatntatcgagtttacctcgtgatagttttggta

SEQ ID NO: 32118 - DNA, 101 bp, rice(Oryza sativa)
  misc_feature (71): n=t or c
aatatattgtgcatataagatgaatctcacaaattagggttcgacaaaccagactagcggtaaaactacantggcagaataaactaagcaaaactcccctc

SEQ ID NO: 32119 - DNA, 101 bp, rice(Oryza sativa)
  misc_feature (71): n=t or g
tcgaccatagctatgtcttgagtgtccgcggcttcagctgtttgtctcttgggtatggttggctcataaanatgttcgacgaacacatcagaaggggccgc

SEQ ID NO: 32120 - DNA, 101 bp, rice(Oryza sativa)
  misc_feature (71): n=t or c
tgtgagcttgagtgactttggaccattttcttaggttaagtctctcattacgtgccttacaatatcaatancttaaggtggtgggctatacgatctaagtt

SEQ ID NO: 32121 - DNA, 101 bp, rice(Oryza sativa)
  misc_feature (71): n=t or c
ttatattattgcagggagtacattgttgatctcatgtcagatccaggtactcttataccttcagacggtgngggcttgggtagagaatttgaagatagttt

SEQ ID NO: 32122 - DNA, 101 bp, rice(Oryza sativa)
  misc_feature (71): n=t or g
tcagcttggtcttcccatcacagaaggccctcctgaagatgaacatttaagaggtacatcaagccaggttntcaatatttactctattgtaaattcatgat

SEQ ID NO: 32123 - DNA, 101 bp, rice(Oryza sativa)
  misc_feature (71): n=t or g
tttcatccttcatttcaaagtaagtgttcatagggtgagcacgtgcgtttttgtactgattgaatccaacnctaatccccgcgccacccaactccagcgag

SEQ ID NO: 32124 - DNA, 101 bp, rice(Oryza sativa)
  misc_feature (71): n=a or g
gctgccacttggcgatgcctggttcacgcatgaatattagacgtttaacttgtgtactaccacggaattgngaaaaaaattgtcattctgccatcatcgaa

SEQ ID NO: 32125 - DNA, 101 bp, rice(Oryza sativa)
  misc_feature (71): n=t or c
agaaaaggacggccaaaattgttggttggtgacagaattgacactcactcttgggtttcaggagaagcatnatttggaggcgcgtccaccgatccagattt

SEQ ID NO: 32126 - DNA, 101 bp, rice(Oryza sativa)
  misc_feature (71): n=a or g
atacgggtgatcaatccgttgtcgctacacgtataaactttataaatatatttataagtactagcaaaatncccgtgcttcgatacggtgtattaaaactt

SEQ ID NO: 32127 - DNA, 101 bp, rice(Oryza sativa)
  misc_feature (71): n=t or c
acgagcaccaagacgggtacctcagcagtcgggcatgcaatgggttatggaaacaatgaacaacccagagnagtgccataacatgtttcggatgagagcgg

SEQ ID NO: 32128 - DNA, 101 bp, rice(Oryza sativa)
  misc_feature (71): n=a or c
tctctaggtcaaaccataaggaagatcggaagcaatattccgatgggactgaaaaacgtggtcagccatgngagcttgaatgtttgctatcaggaagagag

SEQ ID NO: 32129 - DNA, 101 bp, rice(Oryza sativa)
  misc_feature (71): n=t or g
caatcagacttccgcaagaggaaattagttctgagcgatgatgaaaatgatgactctgaaaaagctggcancaaggggatgactggaaaaccagcaaggca

SEQ ID NO: 32130 - DNA, 101 bp, rice(Oryza sativa)
  misc_feature (71): n=t or c
gctttacaaacctgtcaatagtggcctgatctacttcttggtcttgcttgggacaatatcgtcgttttganatcgaagagtagatccgtgcgagcttcgtg

SEQ ID NO: 32131 - DNA, 101 bp, rice(Oryza sativa)
  misc_feature (71): n=t or c
gccacatggtgaggggcctgtcgatccaaatgttgaggatgcaccagcctggcagtttggaaatgaacagnagcagcataatcagcagaatccaaattggg

SEQ ID NO: 32132 - DNA, 101 bp, rice(Oryza sativa)
  misc_feature (71): n=a or g
cttagaacgataatctaattaccagccatatcacttctcaagcatcttttggaccaattgaaagttgtgcnattccgacctcatccatggcacgaaattct

SEQ ID NO: 32133 - DNA, 101 bp, rice(Oryza sativa)
  misc_feature (71): n=a or g
ctgggtcgagggagaaggcatgctgcatgccctctacttcaccaagagcagagaaggaaacacttggtcantctcatacaacaaccgctacgtgcaatctg

SEQ ID NO: 32134 - DNA, 101 bp, rice(Oryza sativa)
  misc_feature (71): n=a or g
acttggcatacatgtccacgagagcattgttcaacaccatgtcctccctaaacctatcagacttcaccatncgggtatggacctggcggccttctctaccc

SEQ ID NO: 32135 - DNA, 101 bp, rice(Oryza sativa)
  misc_feature (71): n=t or g
attctctaaagtagtgcatgtacaatatcgctcattgatgtggggggttggatgggactaaatctttttantacctatcacatcggatatttgaacactaa

SEQ ID NO: 32136 - DNA, 101 bp, rice(Oryza sativa)
  misc_feature (71): n=a or g
gaaaatttcaccgaaatcaccgaaatttcccctgaaattgaaagtttaaaccctgggtggaacccttcctngatgacatactccgggagaagcccgcctgg

SEQ ID NO: 32137 - DNA, 101 bp, rice(Oryza sativa)
  misc_feature (71): n=a or c
acagtgtagtactactacacttgtactagtactaatttggaaccgtgtgctgacacatggtgaaacgcgantcttgatgcaggaatcggcgagggagacgg

SEQ ID NO: 32138 - DNA, 101 bp, rice(Oryza sativa)
  misc_feature (71): n=t or c
gtccggcaaggtgtgcctggcgaacagcttgagccctcgctccaggagcatcaggtacttgtccctgtccntgaaccggctcccgatgatggcgtgcaccg

SEQ ID NO: 32139 - DNA, 101 bp, rice(Oryza sativa)
  misc_feature (71): n=t or c
tatacgaacgaccaatgcattcgactagcgtacgtctcatctcatcggattgtcctgtttggtagagcttnagcttctaaatttagctccaagctccagga

SEQ ID NO: 32140 - DNA, 101 bp, rice(Oryza sativa)
  misc_feature (71): n=t or c
ctctaagagccaaagaatcactgcagcaagagaaaggctccaacgagcaatcgatataaacaacaatgctngttgtgaagtcgatgtggagcgtgttctca

SEQ ID NO: 32141 - DNA, 101 bp, rice(Oryza sativa)
  misc_feature (71): n=a or c
tatatcagtttgtcagcagcaagagtgcacaacacatacttcaaggctatctcaaactgcccttttccagnttcagcatgcagctgttacattttttatta

SEQ ID NO: 32142 - DNA, 101 bp, rice(Oryza sativa)
  misc_feature (71): n=a or g
aatgcaactcatatcttcttacctatcatcgatgaataaatcgataaatttctttcaatatcccatcaccntacctactaatataactttcctattaattt

SEQ ID NO: 32143 - DNA, 101 bp, rice(Oryza sativa)
  misc_feature (71): n=t or c
gcaagttcttctcaacggcatccctagtcaaagaatcacgcatgggaaaggacttcggcagggagacccgntgtctccgctcctttttgtcctagcaatcg

SEQ ID NO: 32144 - DNA, 101 bp, rice(Oryza sativa)
  misc_feature (71): n=t or g
caatatcaaactatattgcctaggtctataatgacacttaaactaccttttagtttctttccatggattanatggatggatagtgctatgggaatgatgtt

SEQ ID NO: 32145 - DNA, 101 bp, rice(Oryza sativa)
  misc_feature (71): n=t or g
agcgcggtagcactacaaggagagatcaggtctgcgggactccaggatttgttacccttttaaagcgagancagagattagcaccctacatgtgatggcta

SEQ ID NO: 32146 - DNA, 101 bp, rice(Oryza sativa)
  misc_feature (71): n=a or g
tgggcccacatgtcaagtccttttttttttcttccccacctctccatccttcttctctccctctctcttcntaggcagcagcaggagagcaccgcaacggc

SEQ ID NO: 32147 - DNA, 101 bp, rice(Oryza sativa)
  misc_feature (71): n=a or g
ccctttccccttcaaatccgcctctcccgggcatgatctccccctcccgatcccttaaaaagcttccctcngtcctcctctctcgtttcccctcctcgccc

SEQ ID NO: 32148 - DNA, 101 bp, rice(Oryza sativa)
  misc_feature (71): n=t or c
agcgccaggtgccgaaactatctccaattccccactcttctactcctatataagaagccctctttctctanatcatcctcctctccgacacagcccgcgca

SEQ ID NO: 32149 - DNA, 101 bp, rice(Oryza sativa)
  misc_feature (71): n=t or c
gttatgagccgataacatttcgatagaatcggactcgaatgtggttggatatgcttagcctatatgagtgngagagtcagagtccataatgttggaattta

SEQ ID NO: 32150 - DNA, 101 bp, rice(Oryza sativa)
  misc_feature (71): n=a or g
accaatttgaacatacacatagttggaggggttttctgcaaaatggacatcttcttctccccttctggccncctgcctcgaacgtgatgtcactgctactg

SEQ ID NO: 32151 - DNA, 101 bp, rice(Oryza sativa)
  misc_feature (71): n=a or g
aattttgatcctgatgtcgtggatgggtatttgggatcctgagacaatgagggtatcacttgcctcttctnctgctgtttcactgggaacgtaagctgctt

SEQ ID NO: 32152 - DNA, 101 bp, rice(Oryza sativa)
  misc_feature (71): n=t or c
tcaatgcatgtgtaactatagatatatgctttccttgtctacaaagtagggaatctgagggagcaaaaagnttatcacatggagggagcagatgaggagag

SEQ ID NO: 32153 - DNA, 101 bp, rice(Oryza sativa)
  misc_feature (71): n=a or c
gtcggttttataaaaagctagcccgagccaatagatcatgggatggtgattccttttaaccccaccgagtnaaccagcccctccttatccatcccccctct

SEQ ID NO: 32154 - DNA, 101 bp, rice(Oryza sativa)
  misc_feature (71): n=a or g
tgcttgctgcgtctccttcacaaccattatattgcatggtggctatatacattctagcttgttgatcattnattaattagatatagctaggtaggtatata

SEQ ID NO: 32155 - DNA, 101 bp, rice(Oryza sativa)
  misc_feature (71): n=t or c
atcatcagtttcaggttgattaactgtttcatgaatttggtatgtttgcagtgggaattcaaagaacggancacggagaccgagccacgagcagctcgaag

SEQ ID NO: 32156 - DNA, 101 bp, rice(Oryza sativa)
  misc_feature (71): n=a or g
tggcaagtacttctactggacagtctgtagaactggttaccattgtgtgttgtagcagtagcacatatagntagatctatatatagtcgctccggcctata

SEQ ID NO: 32157 - DNA, 101 bp, rice(Oryza sativa)
  misc_feature (71): n=a or g
gctttcgccatctcccgcgtcaacctttgtgcgtctttttcagcagctgctttcgctttacgggcctcctngcgaagagcctccatcttcggctcggtgag

SEQ ID NO: 32158 - DNA, 101 bp, rice(Oryza sativa)
  misc_feature (71): n=a or g
gatgcgcccgctggccgccgcgcggtcgccgagggtatcaaacgaagtggtgtatcaaactaaactaccanaaactcaccgcgagacgaaatggggaagcg

SEQ ID NO: 32159 - DNA, 101 bp, rice(Oryza sativa)
  misc_feature (71): n=t or c
cttctcacacaaattttacgcaactggattgggtacaagctaactaaagtctaagagcatctttcccatcnttgaggaggtactacgaggtaccatgagat

SEQ ID NO: 32160 - DNA, 101 bp, rice(Oryza sativa)
  misc_feature (71): n=a or g
tgtcttcatcctggaaatagatgcggctcctgcgcatcccggacctgatatgggaggtcgaggtgaaggcngcgacaagaccctgcctcagagctactgat

SEQ ID NO: 32161 - DNA, 101 bp, rice(Oryza sativa)
  misc_feature (71): n=a or c
tgactacgtcgaggctgtcagccaaggcagccacatgtatggggtataatccttcagcgtccggttgatangctgcacatgtgttggcttctagcagcagc

SEQ ID NO: 32162 - DNA, 101 bp, rice(Oryza sativa)
  misc_feature (71): n=t or c
ggggttcacttgacaggcattgcaaaattttcagactacatcctggagaaactaagctcgttcaagccttntcttttttttgctttcagatatttagatct

SEQ ID NO: 32163 - DNA, 101 bp, rice(Oryza sativa)
  misc_feature (71): n=a or c
tttgtaatattagcccatgtgtggctctctatgttgccttcttgtcttgttttcaagcactcgtattaganaataataatctcgcagcatatcgtgcacaa

SEQ ID NO: 32164 - DNA, 101 bp, rice(Oryza sativa)
  misc_feature (71): n=a or c
cgaatactaacttattcagcctgacatacgttggtctatttttttcagggcaagccggagagagcgaactngtcgtcaagcaggtgtggatgcaatgcatt

SEQ ID NO: 32165 - DNA, 101 bp, rice(Oryza sativa)
  misc_feature (71): n=t or g
ctggataccaccaaattcgactactggagcaggatgaatgcaaaacaacctttacgacacatcagggtctntatgaattcaaagtgatgccatttggtctt

SEQ ID NO: 32166 - DNA, 101 bp, rice(Oryza sativa)
  misc_feature (71): n=a or g
actctcccctcgtaggctgcccatctttctctgtcatcagcgtcactcaggccccacgccacgcctcctcncgctcttagcctcaccaccatcgacatcgc

SEQ ID NO: 32167 - DNA, 101 bp, rice(Oryza sativa)
  misc_feature (71): n=t or g
tggtgtagtttatgccttgctaatacttatccatttattgatctttgttctgttcagatttttgggatagngttttctgttctctctcataactcataagg

SEQ ID NO: 32168 - DNA, 101 bp, rice(Oryza sativa)
  misc_feature (71): n=a or g
attgttcttcagcatgaaaagcaacatgcaaatcgtggaactaaacttgcaaatagttgtaataataaagnacaaacgagtgtatcatttgtcaacaaaca

SEQ ID NO: 32169 - DNA, 101 bp, rice(Oryza sativa)
  misc_feature (71): n=t or g
gggagaatactatctccatccagcccaatcacaagaaaggtattgttatctcaattttcgaaggagagagnccacaagcaagtgagaacactctcctctgc

SEQ ID NO: 32170 - DNA, 101 bp, rice(Oryza sativa)
  misc_feature (71): n=t or c
actagtagagattggctgtttgatatgtgtcgctttgataatgtcgaggggggaaagtattcaaaacctcngaagggacgtctcatcgttgttttatatgt

SEQ ID NO: 32171 - DNA, 101 bp, rice(Oryza sativa)
  misc_feature (71): n=a or c
ctaactgttatagctaaaatttcactctggatcataacttaatcaatccttttacttttcaccttgagtancttgtctttttagaaatttggatcacccca

SEQ ID NO: 32172 - DNA, 101 bp, rice(Oryza sativa)
  misc_feature (71): n=a or c
aaatttccctaatttgtgaaatcgctgaaattccgcaacgttgctctgccttttcctttccttcttcctcntgtacaacctctctgtacccttctctctga

SEQ ID NO: 32173 - DNA, 101 bp, rice(Oryza sativa)
  misc_feature (71): n=a or g
tcgtgagatatatggatacagtataccctcaagtatatgggaaggtacctctgaattgaggaaatcggctnatcagtaaggaatcgtttctttgaatagaa

SEQ ID NO: 32174 - DNA, 101 bp, rice(Oryza sativa)
  misc_feature (71): n=t or c
ttacaaccattagattaattttcaagaaaaaaattcccctcctaaacccgggcctacctaagcatgtagcntatatgtataagttatttttaaaaaaaaaa

SEQ ID NO: 32175 - DNA, 101 bp, rice(Oryza sativa)
  misc_feature (71): n=a or g
cctcaatatcattttccaataagaatttatgccatttttactgaagaccgcgcaggagctgaagggctgtncacgaacccaagaaaactctttgcattctc

SEQ ID NO: 32176 - DNA, 101 bp, rice(Oryza sativa)
  misc_feature (71): n=t or c
atttgagagcgcagcaatgacagaatatagggtgcacgagacgatatagggtaagtggtagacagtaatgntcctacagggatagcaggaacacgtaacat

SEQ ID NO: 32177 - DNA, 101 bp, rice(Oryza sativa)
  misc_feature (71): n=a or g
ggtgagtgattatgattaaattaaacatttcatctcaacagataccagtaggggaaacacaccaaactggnagcaactgtacaacatcatttttggaattg

SEQ ID NO: 32178 - DNA, 101 bp, rice(Oryza sativa)
  misc_feature (71): n=a or g
gttttttaattaaaagatgttcgaatattgtcgagggtctattgttttgaaacaattttcattaactccgngacaatagttgatattccattttttggctc

SEQ ID NO: 32179 - DNA, 101 bp, rice(Oryza sativa)
  misc_feature (71): n=t or c
ccaaatgaactccagccagtgggagcacgaatcctccttggacgtccaatccacgctgcattcgagtcgtnatcacccccggcgccggaccggcacagccg

SEQ ID NO: 32180 - DNA, 101 bp, rice(Oryza sativa)
  misc_feature (71): n=t or c
gatctggaatcttcaccacccttcgggaccattgcgggaggatgtttccaccaccagagctgcgattcgcnatcctagaagcacaaagccactagctccaa

SEQ ID NO: 32181 - DNA, 101 bp, rice(Oryza sativa)
  misc_feature (71): n=a or g
ttttctcgtattagtaggcagcagctgttcggaatcctctcctaacatttcagaacaatcgtcagacctgntgttaagctctgagggattgaatattttgg

SEQ ID NO: 32182 - DNA, 101 bp, rice(Oryza sativa)
  misc_feature (71): n=t or c
agctcagcttaattgggtctgtttgctcggtgcagtctgaacctgtactactggttgatagtccagtttgnatcaatcgtttcgaatatcttggatcatga

SEQ ID NO: 32183 - DNA, 101 bp, rice(Oryza sativa)
  misc_feature (71): n=a or g
ggttagggtttcgccgctggtggggaatcgagacggggagagagatggacgcggataggaggagacgaganagagagagagagagagagagagagagatct

SEQ ID NO: 32184 - DNA, 101 bp, rice(Oryza sativa)
  misc_feature (71): n=a or g
tgttgggctacaatcaaacttctccttaattcctgggctaggtggctgttggtttggctcgttttggctcntgagtagctcgcgagtcagctcgacctagc

SEQ ID NO: 32185 - DNA, 101 bp, rice(Oryza sativa)
  misc_feature (71): n=a or g
taaactagatattaactttttatacattcataatagatatgtatatcttttaagaccatggtgttgttcanaacattaagaattatgtaatcggaggaatt

SEQ ID NO: 32186 - DNA, 101 bp, rice(Oryza sativa)
  misc_feature (71): n=a or g
ctcgacgccatcctccgccgttgcagcgctccctccctcacgtttccctctcttttttacggtaccctctnataccccacaagtatcatgcttgatacctt

SEQ ID NO: 32187 - DNA, 101 bp, rice(Oryza sativa)
  misc_feature (71): n=t or c
caatccggttttatgtttgatgcacaacttttcattaccctgcttttttttgagaaagctaaaaactgagncttttacataaaacagaaacgaaaacaagt

SEQ ID NO: 32188 - DNA, 101 bp, rice(Oryza sativa)
  misc_feature (71): n=t or c
tagattggactttaatgtcagtctggcagtcaggtcactatcacatgcatactttaaaaccatctgaatgnttgattgcaggaaaaataccgttgccacgg

SEQ ID NO: 32189 - DNA, 101 bp, rice(Oryza sativa)
  misc_feature (71): n=t or c
attctccttctctggaatcctccgtctccccgtctctcgttcgctttctccactcccagcgacggcggcangccttctccacttcttttctcaccactccc

SEQ ID NO: 32190 - DNA, 101 bp, rice(Oryza sativa)
  misc_feature (71): n=t or c
atgtgttcaaacacacactctattgtttctctccttttatatctctcatgtcattagtagtagcagcctgnaaacacctttcctgcacaccaggtatggac

SEQ ID NO: 32191 - DNA, 101 bp, rice(Oryza sativa)
  misc_feature (71): n=t or c
attgccattgatagaagatcggctgggtcagaaaaggttgcctattcatcagagattgggctcagtacacnaggatcaccttcaggacgaagatgaagaca

SEQ ID NO: 32192 - DNA, 101 bp, rice(Oryza sativa)
  misc_feature (71): n=a or g
tcaacgtagtcatgtgttgatgataaggtggacgctggatgattatcttgatcatcgaaagtagtcacttnaggttcttcgcaatttggtgatgaagttga

SEQ ID NO: 32193 - DNA, 101 bp, rice(Oryza sativa)
  misc_feature (71): n=a or c
gcaacgggaggtttgactcctgtccctggtgacggtggtagtttttgggccaacgggaagaagtcgttaanactcgtggtcccactgggcatgccaaaagt

SEQ ID NO: 32194 - DNA, 101 bp, rice(Oryza sativa)
  misc_feature (71): n=a or c
tatcttttttactctattctaatttatttgggattacgttggaaatgatttttttttctaattacccttgnatcatataaattgtaaactaaaatcatgtg

SEQ ID NO: 32195 - DNA, 101 bp, rice(Oryza sativa)
  misc_feature (71): n=t or c
tccttagactgtgcacttgacatcgtgagaagatcacaaccatcgctatctgagtcatttgaagaagtcantgtattagcctttgcttttcccttcagtgt

SEQ ID NO: 32196 - DNA, 101 bp, rice(Oryza sativa)
  misc_feature (71): n=t or g
aatgaaaagtcaatgacatcctatatcaaaaccggatgatcatcgtaaatataaccatccaactttcacanatcatcgtaaatttaaattgaagaagatga

SEQ ID NO: 32197 - DNA, 101 bp, rice(Oryza sativa)
  misc_feature (71): n=t or c
attggccggtcgccgtcgctgccggctgtcttcccatacgtggaggcggaggcaacgaacaatctaagtanagggcacccgcaatggttatctataggctc

SEQ ID NO: 32198 - DNA, 101 bp, rice(Oryza sativa)
  misc_feature (71): n=t or c
cttttatttttgcaatgaggtactttgttgtggcctccttgtgctcaaagattctccgattgtgttccttncatatttcccaaacaacgaggaggatcagg

SEQ ID NO: 32199 - DNA, 101 bp, rice(Oryza sativa)
  misc_feature (71): n=t or c
acaggctaaaactaaacattgtaagacaccaggtacacttcaaccactacctgttcccttgcaggcttggnacacagtcagcatggactttgtggagggct

SEQ ID NO: 32200 - DNA, 101 bp, rice(Oryza sativa)
  misc_feature (71): n=t or c
caagagggttatccacatacggaaaggagtacatgaccattttgctggctatagaacactagaggacttanctacaacatggggagttcctaattttgact

SEQ ID NO: 32201 - DNA, 101 bp, rice(Oryza sativa)
  misc_feature (71): n=t or g
cgcacagacaagagaaacaagaggcatcgaatcgaatcaaattatcgaagcaaatacagtaatatattatngccgatgtacaaagcggcggcggcggcggc

SEQ ID NO: 32202 - DNA, 101 bp, rice(Oryza sativa)
  misc_feature (71): n=t or g
ctaattgacaacgacacgacacaacacaggtatatgcatacaaagggaagagaaatgtctagggtgttccncctagctccacatggtggtgggccagatga

SEQ ID NO: 32203 - DNA, 101 bp, rice(Oryza sativa)
  misc_feature (71): n=t or c
ctctttgttcttgtgttcaagttcctggtccagcatctgagttttctgtaccatcttctccatttctgatngcactactaaaacctgtgcttccaaataag

SEQ ID NO: 32204 - DNA, 101 bp, rice(Oryza sativa)
  misc_feature (71): n=t or g
tagctgcttctcatacaacttctgattgaaacttgcattgtgaagaacagaaacatcagcttgtgctgganatgttatttcccttcgattgtctggagctg

SEQ ID NO: 32205 - DNA, 101 bp, rice(Oryza sativa)
  misc_feature (71): n=t or c
atgtaatatatcgaaggaaactcgatactataattcatgaaaaactcgaatggtacgatcctccgtcaccncagaataaaaggggtgatctaacttataag

SEQ ID NO: 32206 - DNA, 101 bp, rice(Oryza sativa)
  misc_feature (71): n=t or c
tgttggttctaaagatacgctgaacctccctcttaacctggacctagtcctaagagcaaagttaatagtanagccaactactagctacaattcatctataa

SEQ ID NO: 32207 - DNA, 101 bp, rice(Oryza sativa)
  misc_feature (71): n=a or g
cgaagcaggccaaaaaccagtatacttcatctccgaagccctccagggggcaaaaatcagatacattgaantggaaaaacttgcttatgccctagtgatgg

SEQ ID NO: 32208 - DNA, 101 bp, rice(Oryza sativa)
  misc_feature (71): n=t or c
gttactaccgatactactctgtgttactacaccatagtagtaacaacgtgtgaaataaatatagtaaccanatacctaatgtgtactttctccgtttcata

SEQ ID NO: 32209 - DNA, 101 bp, rice(Oryza sativa)
  misc_feature (71): n=t or c
gagttggcaatagcgttttagctcattctcattggtcagctctggtgctctccttatctccatctctgttnagggagcttatagttgctacaacttttttc

SEQ ID NO: 32210 - DNA, 101 bp, rice(Oryza sativa)
  misc_feature (71): n=a or g
atcacccatcatcatctctacatcattggccgagaggttccttccttcatcatagaactgaatcctctccnacccagcaccatagttcccaccgacattct

SEQ ID NO: 32211 - DNA, 101 bp, rice(Oryza sativa)
  misc_feature (71): n=a or c
ttcctgcttacaggcacaattggtttcttctcttgtttcttcttcacgaggtttatttactcacagagggnatttggatgaacttgagattagaattttgg

SEQ ID NO: 32212 - DNA, 101 bp, rice(Oryza sativa)
  misc_feature (71): n=t or c
cacacaacttccggtgaacgccctgccaatataatataggaaaggcaggcggaagaacgtggaattaaganatgaaaaagcaagcgaagatggtagacttt

SEQ ID NO: 32213 - DNA, 101 bp, rice(Oryza sativa)
  misc_feature (71): n=t or c
cgtatttacaaacaaacaaactgctgcatgatgtgatagaattaaaacggcaacataagagcatctccaanagcctctccaagtgactctctaagctaaat

SEQ ID NO: 32214 - DNA, 101 bp, rice(Oryza sativa)
  misc_feature (71): n=a or g
gaatttctcggttttgatcatggcaggcaccctttttatttccttatgaggcaatttgcatcaataggcantttgagaggggtcaacagagtgtggaaaga

SEQ ID NO: 32215 - DNA, 101 bp, rice(Oryza sativa)
  misc_feature (71): n=a or c
caccgggcagcagcactccgaatggcgatctcctcgagtggcttcatgatgagcgtgaggaaggtggtagnaccgtcgaagatgattgagtagacgttgat

SEQ ID NO: 32216 - DNA, 101 bp, rice(Oryza sativa)
  misc_feature (71): n=t or c
gcctaaaataccttctgttagcttcaacctgaatactctgttgtggttgccgcaaaaaaaaatttctgatnaatcttaactgattggtatggataggagac

SEQ ID NO: 32217 - DNA, 101 bp, rice(Oryza sativa)
  misc_feature (71): n=t or g
attgtacgtgaatctgtttattctttttgagccaatctgaatgaatttgagcatgtgagtgcagcttgtgncggaatatccaattaaattgcattttatct

SEQ ID NO: 32218 - DNA, 101 bp, rice(Oryza sativa)
  misc_feature (71): n=a or g
tggttctcaggttgttcttctccggttgattcattcacgcctaaatttttgcgtcttttttttgggtgccntgtgctgtatgattcgtctgtaaggattcc

SEQ ID NO: 32219 - DNA, 101 bp, rice(Oryza sativa)
  misc_feature (71): n=t or c
atcctattggtaaacttatcattcaatcctgagttctccagtctcagttttcttctgtgctttctctaacngagaggcaggcaggatagatctcagctggt

SEQ ID NO: 32220 - DNA, 101 bp, rice(Oryza sativa)
  misc_feature (71): n=t or c
agtctagtgacaacaaaacacaagcttttagcaagcttgcgtctttgcaagagtttattcctcatgactangatgctagtgaccatggtacatcaagcttt

SEQ ID NO: 32221 - DNA, 101 bp, rice(Oryza sativa)
  misc_feature (71): n=a or c
tcctttaaaaaaaaaaactaacactagacagtgattgttgagtactactaccaacctgttgcttcgggctntgagtgaagtgaaaagctgaaaaaggtaaa

SEQ ID NO: 32222 - DNA, 101 bp, rice(Oryza sativa)
  misc_feature (71): n=t or c
agttcttcctcagatcctgcatcggaacttggtgacatggagaacaatgagtttctggtttattcttatgncagcaagaaattggataatatcgagaacct

SEQ ID NO: 32223 - DNA, 101 bp, rice(Oryza sativa)
  misc_feature (71): n=a or g
cgtgtctacgtgtgaggcgatgagcttttaggcgagtataaaatctccacgacattcgtacgtggcgtcantcagatcagtaatttcaataggagcacttg

SEQ ID NO: 32224 - DNA, 101 bp, rice(Oryza sativa)
  misc_feature (71): n=t or c
catatttgaagcccgtcaccgatgaccctcatctctgacgggctcgatgtctaggcccgattgagatatgngaggtcatctcaatcgggcttaaatctttg

SEQ ID NO: 32225 - DNA, 101 bp, rice(Oryza sativa)
  misc_feature (71): n=t or c
cattgtgattgcatgtacgtacgtaactacgtagagggagggcagagtcgcagagagacagaggcagaggncatagcagaggaggcaggagcagagagaga

SEQ ID NO: 32226 - DNA, 101 bp, rice(Oryza sativa)
  misc_feature (71): n=a or g
ggctattttaattccacaaacaaacaatctttgacattcttcaatgtctatgttacagcgtcatacccagncaggtcatattatggtccaccaacatatga

SEQ ID NO: 32227 - DNA, 101 bp, rice(Oryza sativa)
  misc_feature (71): n=a or g
accaataaataattaacgcatccatcatgcactatatacatatattatatctaggtaacaatttaatttancatataacgactagaaatagattttagagt

SEQ ID NO: 32228 - DNA, 101 bp, rice(Oryza sativa)
  misc_feature (71): n=a or g
attgaagggtatcgtcaaggagaagaacctgtcactgaatgaaagagaacttgcccagagaattatcgtcnaggttcagcagccacacgaggagaatgaag

SEQ ID NO: 32229 - DNA, 101 bp, rice(Oryza sativa)
  misc_feature (71): n=t or c
ggttactttagcataatagataatcccaaggaatgcttgatgatcaccatgtgcttaccgatggttttctnaacttcaataaatttcagtgaccgtgtgaa

SEQ ID NO: 32230 - DNA, 101 bp, rice(Oryza sativa)
  misc_feature (71): n=a or g
taagcagcttatacgtgagcactcgtggccgtacgcctatagtatacgtatacgtgtatgtataccaaatnatcctccctaggattaaaccaacggcaagc

SEQ ID NO: 32231 - DNA, 101 bp, rice(Oryza sativa)
  misc_feature (71): n=t or g
tataaggattatatatcattaatgtgaaaatcagtgataatttcactgttaacaccaaatttgaaaatcanctacaaactgctccatttgttgcctttgtt

SEQ ID NO: 32232 - DNA, 101 bp, rice(Oryza sativa)
  misc_feature (71): n=t or c
gctgcacgggacggcgtacatcgggttaatttctgactacttaccgttgaggaaccggggaagcagccgtnaatcccgaatcagatcaaactctgcttctt

SEQ ID NO: 32233 - DNA, 101 bp, rice(Oryza sativa)
  misc_feature (71): n=a or g
cccgatcttcacgtgctgaaagtatgttgtcgtgtgcataagtagtactccactgtggtaaggtttctacngcgtaccgatgatgtgttcgtccactgtgg

SEQ ID NO: 32234 - DNA, 101 bp, rice(Oryza sativa)
  misc_feature (71): n=t or c
aagagagagaaaaagaagctaacacaaagatgcaaatcactcgcggcagctcactctcgtacatccaggangagtacaccaagtctaagactactcttaaa

SEQ ID NO: 32235 - DNA, 101 bp, rice(Oryza sativa)
  misc_feature (71): n=t or c
attctggctcccagttctggaaggggattatgaacattaggaaatggttgaaacttggttcagaatgggcnttggggaagggtgaccatatctggttctgg

SEQ ID NO: 32236 - DNA, 101 bp, rice(Oryza sativa)
  misc_feature (71): n=a or g
aatattgagctagccaaaaaaatcacagcacatgagttgaccagaatgagcaaattccaccgttcacattntagtgttattcaattgtaatgaagggcaaa

SEQ ID NO: 32237 - DNA, 101 bp, rice(Oryza sativa)
  misc_feature (71): n=t or c
taaagctaggcccggcccaaaaagttccaggttcaaaacaaggcttgggcccttttttggcaaaatcacanaaatttttgtaaccatgcaatttgctatgt

SEQ ID NO: 32238 - DNA, 101 bp, rice(Oryza sativa)
  misc_feature (71): n=t or c
ttatccaataatggctttccttcttggacctccacatgatgacacagaggcaattattggctatacttttnccttttcgcttcctcttcccttatttcttc

SEQ ID NO: 32239 - DNA, 101 bp, rice(Oryza sativa)
  misc_feature (71): n=t or c
taagatgagattgaactggctccatatgtaagggaattaatagaggcactcactgaagcaatcaggtttgngtagtcgtcgtgtggtaaatacgtatatga

SEQ ID NO: 32240 - DNA, 101 bp, rice(Oryza sativa)
  misc_feature (71): n=t or c
agctacgggcctaaacgggtcgggctggctgatgcatcaagaggtcgccttgcctagtaacaaatttattngtttagtgatgatgtttgttctttcttttt

SEQ ID NO: 32241 - DNA, 101 bp, rice(Oryza sativa)
  misc_feature (71): n=a or g
gctaacttttggagattttgtcagtgtgtgtgatcgatgatactattacgttggcaggtgacatggctgcnaaaagatgggcatgttcactttgataaaaa

SEQ ID NO: 32242 - DNA, 101 bp, rice(Oryza sativa)
  misc_feature (71): n=a or g
gaacacatgaatgagataagagtccgcaaccctagaagaacggccatttggatttgtaaagaacagaaacngaaatttcctgaatggttgaaggagaaaga

SEQ ID NO: 32243 - DNA, 101 bp, rice(Oryza sativa)
  misc_feature (71): n=t or g
tacagggcttccattaaatcatattgaaagttcagcatggtgtcaggtctatgctatgaatgagaatgcanatagttcaggccaaacagatcccggctacc

SEQ ID NO: 32244 - DNA, 101 bp, rice(Oryza sativa)
  misc_feature (71): n=a or c
ctctctctctctcctctcatttttctctcccacaaaggcacaaaccgcgtctccctctccctctctccgcncatccatcctcctagagagggagcgcgcgc

SEQ ID NO: 32245 - DNA, 101 bp, rice(Oryza sativa)
  misc_feature (71): n=a or g
atagtgcctacattttttcaggcaacgtcaccctgacgatatagaactataaattattggtatcggtatantttatgtatatacttctgtcacagatattc

SEQ ID NO: 32246 - DNA, 101 bp, rice(Oryza sativa)
  misc_feature (71): n=a or g
gccgcctcgtcttttgcagtctcgcctcatggataggtaaattgaagaatctcctacggaggagcttgtanagggcaaaggagaggcagaggtccttggtc

SEQ ID NO: 32247 - DNA, 101 bp, rice(Oryza sativa)
  misc_feature (71): n=a or g
acaacggcaccggcctcgacgccgtcgcaaggggaagaagaagaatgttagttgcgatccaaattcatttntacttaataaaggccagcttctgccgtagc

SEQ ID NO: 32248 - DNA, 101 bp, rice(Oryza sativa)
  misc_feature (71): n=t or c
tttttggtatctcactggtttattggctgtgattttgggaaagaaaatcacctgcaaattttggtaccgtngaagcttctcaccattagattgacaattat

SEQ ID NO: 32249 - DNA, 101 bp, rice(Oryza sativa)
  misc_feature (71): n=t or c
aggcccttctcctttggatcactaggtttcctccacctgttgcatttgaacgtgtgtcttgtcacaacatnggtttttctgctatggtaattgctagcttt

SEQ ID NO: 32250 - DNA, 101 bp, rice(Oryza sativa)
  misc_feature (71): n=t or c
ggctttcaaagctttgtctctcttccaccatggatgtgaactagatggtatgatttggtccggaatgtggntgggaatggatgggagattgatgtggtggt

SEQ ID NO: 32251 - DNA, 101 bp, rice(Oryza sativa)
  misc_feature (71): n=a or g
tgtaggactgcacatgctcactgacatgtagcccccacagcttttaggaccttgtcagtaagtggaccttntcagtaagtagtactgtagatatagtactg

SEQ ID NO: 32252 - DNA, 101 bp, rice(Oryza sativa)
  misc_feature (71): n=a or c
atcagatttccccggcacacagttttccaatgagggtatggattaaaataatacagattatgtacgatttnattaatctgatttcgattgacacagctagg

SEQ ID NO: 32253 - DNA, 101 bp, rice(Oryza sativa)
  misc_feature (71): n=t or g
agtactctgtacccttgtcatatcaataattcaatcttgattcattctgggactgtttggttctcgaaaangaaatttttcagtatcacatcagacgttta

SEQ ID NO: 32254 - DNA, 101 bp, rice(Oryza sativa)
  misc_feature (71): n=t or c
tctacaacgccatgatcgccgacgccgtcacccctgacctgtccacctacaacacattgatctgggggttnggcctgtgcaagaagatggaggcagccttg

SEQ ID NO: 32255 - DNA, 101 bp, rice(Oryza sativa)
  misc_feature (71): n=t or c
cgagtggataaaccccagcccacccgtcattgtacacagcatcatcaaagggggtggccacatgaatttcnccttgtgcgttcatgcgaggatcgatatgc

SEQ ID NO: 32256 - DNA, 101 bp, rice(Oryza sativa)
  misc_feature (71): n=t or g
gacgctggtgtctgggccttgacattgtgtgttgaccctactatcaaagataccagaccgaagtgcgattnctccacactctagctctacttgtgccccga

SEQ ID NO: 32257 - DNA, 101 bp, rice(Oryza sativa)
  misc_feature (71): n=t or c
tagaccgtttggtataaaaatagtatttataatctgtaaatcatgtaggccgtcaaataccatagtgttangcatgcaaattcaaaaaaccactgataaac

SEQ ID NO: 32258 - DNA, 101 bp, rice(Oryza sativa)
  misc_feature (71): n=t or c
tggcggcatcctcggaggcacacggcaacatctcggtctgcttgttcttcacgctgcgccacaagctcaantgcaatggccgccgccgcggcgtcaagctc

SEQ ID NO: 32259 - DNA, 101 bp, rice(Oryza sativa)
  misc_feature (71): n=a or g
ggggtcctcctctggccttcctcaagaatgaggggcaccttgccctccctctccctgttcagccgctcctncgcgccgccgcgcagcttctccagtccccg

SEQ ID NO: 32260 - DNA, 101 bp, rice(Oryza sativa)
  misc_feature (71): n=t or g
attcatgagacaaattataaacacctctgttagggagtacatatttttagataatggcatgatcgccaaantagatttaactactactccctctgtcccaa

SEQ ID NO: 32261 - DNA, 101 bp, rice(Oryza sativa)
  misc_feature (71): n=t or c
taatacatgaaatatttaaaaaaaatttccttggacacaaatataggcgtaatacagatcttgttgcaganatgaaaaaaatcaataatttattcctggtg

SEQ ID NO: 32262 - DNA, 101 bp, rice(Oryza sativa)
  misc_feature (71): n=a or g
aattgatgagcaagctgttaatatcttcacaagattgcgatgccgtaggtatcttaatgcctcacattccncaagaaaactatgtgatgctcccctctctt

SEQ ID NO: 32263 - DNA, 101 bp, rice(Oryza sativa)
  misc_feature (71): n=a or g
gagcagtaagcaattgacatggtacaagtactctaattcattaccggttttgcttaccctatatgaagatnctagaaaatacttatcatatgctctaagaa

SEQ ID NO: 32264 - DNA, 101 bp, rice(Oryza sativa)
  misc_feature (71): n=a or g
ttgaagtgttaccgtttatgtcgtaaacaacatcgaagccctttgccgcaaggcttgtcttaacgaaatcnaagtcttgcctgtcacctttcaagtgcaac

SEQ ID NO: 32265 - DNA, 101 bp, rice(Oryza sativa)
  misc_feature (71): n=t or c
atcccataaaaaaccaacctagtactggatgtggcatatcttgtacaactaattgtaacatatccctgtcnaaattcgttgtactaggatatgtctattcg

SEQ ID NO: 32266 - DNA, 101 bp, rice(Oryza sativa)
  misc_feature (71): n=a or c
gttcaatttcaaggtgtttttatttttatcgttagaactccgaactgtgaaagatggctggacgcctgcanctgcactgctccacagtactgatgggattt

SEQ ID NO: 32267 - DNA, 101 bp, rice(Oryza sativa)
  misc_feature (71): n=t or c
tcacatggatcttcgtcgcatctatgactttctcactcgtcttcgctccgagtatgaatcgactcgtgcanagttgcttgctcgacaccctcgtgttactt

SEQ ID NO: 32268 - DNA, 101 bp, rice(Oryza sativa)
  misc_feature (71): n=t or c
attcggaacattctaaaggcacgttctgttcagcctataagttttggctgattggctgattagttgcactntgatatatgaaaagttttcgcacaaaacag

SEQ ID NO: 32269 - DNA, 101 bp, rice(Oryza sativa)
  misc_feature (71): n=t or c
tcagggagagtttccaggttgtaacactccctgagttcgaggaattgcaggttactgacgcccccatgttnccttgacagccaacttggtgttgtgcgacc

SEQ ID NO: 32270 - DNA, 101 bp, rice(Oryza sativa)
  misc_feature (71): n=t or c
ttccattggagttgcagtcttgagggttatgctttgcagattgtgttgcatcatttgttgcctcccagctnggtctttatactcggcaacgactgcgacct

SEQ ID NO: 32271 - DNA, 101 bp, rice(Oryza sativa)
  misc_feature (71): n=a or g
attgagcctgcttaatagggaagtggattttttttcccttgagacaacatccccttgttttgtgcatggcntttaaaaagttataaaaaattttaaaaaat

SEQ ID NO: 32272 - DNA, 101 bp, rice(Oryza sativa)
  misc_feature (71): n=t or c
ggatcttagcaagtgcctcttatctggtgacacaaaaccatggctgtgctccccaatcattgaagatattngatacttcttatcactgccaagcttgacaa

SEQ ID NO: 32273 - DNA, 101 bp, rice(Oryza sativa)
  misc_feature (71): n=t or g
agggatccaatacttgcccttggtgagctttcccatagagaagtagtccaagcagaggtcatcactagctncttcttcttcctcctccctctccacctcca

SEQ ID NO: 32274 - DNA, 101 bp, rice(Oryza sativa)
  misc_feature (71): n=a or g
ggccaagctctgctgctactcctgctttgcttcgtctgtcatgccggttcatgcaccgagcaggagagggnatctctcctccagttcctctccgggctatc

SEQ ID NO: 32275 - DNA, 101 bp, rice(Oryza sativa)
  misc_feature (71): n=a or g
gtcagatgggattaaactagctgatcatttgctgcaatggctacatggtaattgctgggtcaaatttcccnaatgtgaatactcttacgaggcaaaatttg

SEQ ID NO: 32276 - DNA, 101 bp, rice(Oryza sativa)
  misc_feature (71): n=t or g
tgaaggccttgctttttaatggcaggaagtcccaagaccactataatgatttctatctaaaacttcccaangcgacgccctattcacaattgttggcttcc

SEQ ID NO: 32277 - DNA, 101 bp, rice(Oryza sativa)
  misc_feature (71): n=t or c
gtcctattacttacaattagtagagcaacacaacatgtcatatatggagatataacttttccccttttttncggaaaggcactacactcgtctttcaaacc

SEQ ID NO: 32278 - DNA, 101 bp, rice(Oryza sativa)
  misc_feature (71): n=t or c
aaaaatgcatgctatatgcaaaactagtgaataccccacgcactacagcgagaaattttaaaataattccnagaaaacttggaaatcatgtactcgtaatg

SEQ ID NO: 32279 - DNA, 101 bp, rice(Oryza sativa)
  misc_feature (71): n=t or c
tggcaatgatagacaactgttgctacttactgaactgacgataagaactaagccaagtagcagacagccangctcaagctcatgctcgacctccgctagtg

SEQ ID NO: 32280 - DNA, 101 bp, rice(Oryza sativa)
  misc_feature (71): n=t or c
ttataaatcacttctacagatgatgctttcaattgtactattgacctgcacatctcagcttgattattaanatcagcacttgatttctgcatttcatcata

SEQ ID NO: 32281 - DNA, 101 bp, rice(Oryza sativa)
  misc_feature (71): n=t or g
gttgcttcactgatagggagaaatttacgataccacgttcaccgtgcattggtcagttctctccttagtancagcaaacgtcgaaaggacatacacgctct

SEQ ID NO: 32282 - DNA, 101 bp, rice(Oryza sativa)
  misc_feature (71): n=t or g
tggaacaaaaatacaggagcatttttttttctttttaagttgtcgtcgacctcatgggctagaatcgaagnaatatttggggtttttttaggggagaggta

SEQ ID NO: 32283 - DNA, 101 bp, rice(Oryza sativa)
  misc_feature (71): n=a or g
tgagcaatgaatgcaatgtttcatggactaggaattactacctccatctactagtacagaaatgattttcncaaggggactaaaactcattttcgtaagcg

SEQ ID NO: 32284 - DNA, 101 bp, rice(Oryza sativa)
  misc_feature (71): n=a or c
attttatgcggagtgatcaaatcgtccctcctttatcttcctcattcccttttcttccttatctcatcctntatttcctcctttctctcttctttagtgag

SEQ ID NO: 32285 - DNA, 101 bp, rice(Oryza sativa)
  misc_feature (71): n=t or c
atatttgtaactgaggtgacgcttctcagtggggcccattgcaagacaaatggatcgctaatttgcagtcncttaagtttcctaaggtatgaagtacaggc

SEQ ID NO: 32286 - DNA, 101 bp, rice(Oryza sativa)
  misc_feature (71): n=t or c
agttgcccttgaagcatccattggttcttcactgccttggcatttgagttcacttacttctgattcctgangtattttcactggaagtatcacaagtcatg

SEQ ID NO: 32287 - DNA, 101 bp, rice(Oryza sativa)
  misc_feature (71): n=a or g
gagatgaagcaagagacgtggagtcggtcactagagcaatcagatcagtcaaacattaccactggaaaccntgacttgtatcatgctcaaattcatccgta

SEQ ID NO: 32288 - DNA, 101 bp, rice(Oryza sativa)
  misc_feature (71): n=a or g
gctcatatcctcactttgctcgcggctttatttaggtgggcataagaagaatctgtccatgtatatgccantgtggttttaaaatagttcatagatatgaa

SEQ ID NO: 32289 - DNA, 101 bp, rice(Oryza sativa)
  misc_feature (71): n=t or c
ggcagaatccttgacagagttgatgtcgatggcgatgtggtcggtcttttccttcgggtcattgtcaaatncgatgccgatgtcgaactcgacggcgatga

SEQ ID NO: 32290 - DNA, 101 bp, rice(Oryza sativa)
  misc_feature (71): n=t or g
gctagcagtagctgccgtttagttttttttatgcattatatagatggacctacagctgccctgtaaatttnttactactagtagcacatttatgttgtcat

SEQ ID NO: 32291 - DNA, 101 bp, rice(Oryza sativa)
  misc_feature (71): n=a or g
tccacactgatttgaatgatacaagctcaattcaactactttcctcctgaattactctgcccaacctccancaaatattagttcaaaatcatactgcttca

SEQ ID NO: 32292 - DNA, 101 bp, rice(Oryza sativa)
  misc_feature (71): n=t or c
ggtttccttctgatccctgggacaaggtttccgattcagcgaaggagctaataaccgagatgctgcggcgngatcctcgacagaggctcacagccaagcag

SEQ ID NO: 32293 - DNA, 101 bp, rice(Oryza sativa)
  misc_feature (71): n=a or g
gttgcgtatggcagcagccatcaactttgttttatacccatttttgtgaatgtaggcatacactttcttcncctgcattacaatatagaattatatggaga

SEQ ID NO: 32294 - DNA, 101 bp, rice(Oryza sativa)
  misc_feature (71): n=t or g
ttttttaacattatattaagatatgaatgatgtcccttgtgcaaacatactcattgatgcatcttattttnctcaactctatgtttggtttaacattgttt

SEQ ID NO: 32295 - DNA, 101 bp, rice(Oryza sativa)
  misc_feature (71): n=a or g
gtaaaattgaatgtacttaaccaatatcctacacttatcacaaaccaacaagcattcgagaacggagtgantattatttttttctcgagtgaaaagatttg

SEQ ID NO: 32296 - DNA, 101 bp, rice(Oryza sativa)
  misc_feature (71): n=a or g
aaggattatattattatatatagaggcaaagattttcttcccggtggcgttgctgaatcagttattgaacnggagtctcaggtacatgaccagcaggcgaa

SEQ ID NO: 32297 - DNA, 101 bp, rice(Oryza sativa)
  misc_feature (71): n=a or c
tatactgtaatctcaactatttttagtagaattttctactggtggtagagtttaggttgttcctacacgtnataattctagtggaattccactactatgga

SEQ ID NO: 32298 - DNA, 101 bp, rice(Oryza sativa)
  misc_feature (71): n=a or g
taaaatggttcttcgtgttcgacacaatcacacaacctgatggttttctatttttcatttggcaggttgcnaacatgattagatttcttgtggatagctac

SEQ ID NO: 32299 - DNA, 101 bp, rice(Oryza sativa)
  misc_feature (71): n=a or c
ctcattggcattgtcctgaacaaaatgcgtgctgtagatgggtcattgcatttcatatacaaatcaagtangctatttcctacagaacactcctcgtaaat

SEQ ID NO: 32300 - DNA, 101 bp, rice(Oryza sativa)
  misc_feature (71): n=t or c
cgttaatgtgcaacatctttttccgtcccgaacacaacctaacaacttttcttttaactcacgaaaacatngtatattccatacgaaagtagtagtaaaac

SEQ ID NO: 32301 - DNA, 101 bp, rice(Oryza sativa)
  misc_feature (71): n=a or g
aggataatggagtacatgaagaataaagtgggtgacaagtgttgggaagcgggaacatagtgttggagagntctttgagtccaaagcacaatggtgaggat

SEQ ID NO: 32302 - DNA, 101 bp, rice(Oryza sativa)
  misc_feature (71): n=a or g
tcctcgctccatcacgatcaccaacaatacgtgagctatggcgttgaagatgacgaagagaggaggagganaagcgatgacgaagatgacgagcagatgcc

SEQ ID NO: 32303 - DNA, 101 bp, rice(Oryza sativa)
  misc_feature (71): n=a or g
tttcatgtagtctgaacttgagcgtgatcgactagcaatggaacttgacgaagaaaggaggttaagggaancactagagcaccgtttggctgagcaacaaa

SEQ ID NO: 32304 - DNA, 101 bp, rice(Oryza sativa)
  misc_feature (71): n=a or g
atcaaacagctggatctgggttgaaaaggggattgattgggtcatggtgtatcatcaactcaaccgtattncacttgggcgtttgggttggcttgtcgtgg

SEQ ID NO: 32305 - DNA, 101 bp, rice(Oryza sativa)
  misc_feature (71): n=a or c
cgcgagccaccttcctagttttataaaaagtttgtcatcatccgaaatgactttatatggaattacgattntttttcatattttagtggcgttcccatttc

SEQ ID NO: 32306 - DNA, 101 bp, rice(Oryza sativa)
  misc_feature (71): n=a or g
catgaacttagttatatgggtgtctcatcatacattttcaccacatgaattgcaatgtgtgtgtgtgtgtntatatatatatatatataaggggtataagg

SEQ ID NO: 32307 - DNA, 101 bp, rice(Oryza sativa)
  misc_feature (71): n=a or g
taagtttggttattttttgaaggttcaatagaactgtcagcacagcacgctagtgacttaggtaacctccncctgaaggctgctcagctacggcgtcaaga

SEQ ID NO: 32308 - DNA, 101 bp, rice(Oryza sativa)
  misc_feature (71): n=a or g
gataagattttctcatgacgaattaatcaacttagaccatcctcgtacaaccgatcaagaagtcactaccnagtgactagaccgtactagagaatagaggt

SEQ ID NO: 32309 - DNA, 101 bp, rice(Oryza sativa)
  misc_feature (71): n=a or g
gatcgatccatggttgttccatattcctagcaccataatatgcgcgcattgctaggaatgtagtctccacnacgaacatcattatgaggtatatcaccttc

SEQ ID NO: 32310 - DNA, 101 bp, rice(Oryza sativa)
  misc_feature (71): n=a or c
gcctgatgttgtcacattcaacacactgatgaaggcgttgtgccgagcacatcaggtcaggactgcagttntcatgctcgaggaaatgtctagcagaggcg

SEQ ID NO: 32311 - DNA, 101 bp, rice(Oryza sativa)
  misc_feature (71): n=a or g
cactgctcgccgccgccagtctgactgcttgattgccgctggtgaccgctcgtaatacttcggtcaaaccntcgaccgtcgagatccagaaaacaccgata

SEQ ID NO: 32312 - DNA, 101 bp, rice(Oryza sativa)
  misc_feature (71): n=a or g
ggcatccaacttaaaaatttcaagtatgatctcatgtttaaattgacaaccttttgcactgcagcaccagnggaaacagggctgtctctcattcctctgag

SEQ ID NO: 32313 - DNA, 101 bp, rice(Oryza sativa)
  misc_feature (71): n=a or g
catgcgaagcaactccgcagtgccacttcgcttcatgaagttgcacatgctattgtgagcaattttaatanggattttgaatctcgagtgcgcagtacgtc

SEQ ID NO: 32314 - DNA, 101 bp, rice(Oryza sativa)
  misc_feature (71): n=a or c
gtcccctccactagagctagggagctaagtgcatgcactattgatggtccgcatatgtcttctgcgccttncagggactaaaggataagagaaattttagg

SEQ ID NO: 32315 - DNA, 101 bp, rice(Oryza sativa)
  misc_feature (71): n=a or g
agtacatggtacctataggtatcaagcctgatacctagctagtacggtggtacccatatgtattaggcctngtacaattggtatcaagagatggtagatac

SEQ ID NO: 32316 - DNA, 101 bp, rice(Oryza sativa)
  misc_feature (71): n=t or c
tgtcaccactccatgagatgtcaacttcagaaagcaaggtaaatagacacgagtttatgattgcagacttngttcataattcacatgccacaatttaatca

SEQ ID NO: 32317 - DNA, 101 bp, rice(Oryza sativa)
  misc_feature (71): n=a or c
ctatgccatctaggctctgaatcttttaagataaaaaccttcgatcacagggggtggttacaatgcagctngtccttggcccttaggcagcttcttagtcc

SEQ ID NO: 32318 - DNA, 101 bp, rice(Oryza sativa)
  misc_feature (71): n=t or c
tatgtttggggcacgttggattatggattgcacattcagaagtctcctgtcactgacctagttgtctactntgatgctgattgggctggctgtcctgacac

SEQ ID NO: 32319 - DNA, 101 bp, rice(Oryza sativa)
  misc_feature (71): n=t or c
cctctgaccacacccactacatcctcagcaccaagtagatttagagtttgttgtcataggaggcaatcttnaggttccaggggcacactgtgcaaccatgg

SEQ ID NO: 32320 - DNA, 101 bp, rice(Oryza sativa)
  misc_feature (71): n=t or c
atgagatttagctggtactcatggaccaatggagtaattaatagagtgtgcctagtcgtaggacgaccgangacccttcaaattaaccaactaattccccg

SEQ ID NO: 32321 - DNA, 101 bp, rice(Oryza sativa)
  misc_feature (71): n=t or c
tccattgccacaagtctcctcctttcttttttctttcttcagctggatgtattcaggagaacagcagtggngaagcaacaacctcgagaaattcagaaatc

SEQ ID NO: 32322 - DNA, 101 bp, rice(Oryza sativa)
  misc_feature (71): n=t or c
ggttattgtttttatcccctcatattgtaccatgtctttaacacaacaatgtctctagctgctacaatctnttctcggagtttctcaaaaacttcatgtgt

SEQ ID NO: 32323 - DNA, 101 bp, rice(Oryza sativa)
  misc_feature (71): n=t or c
aaaactcacctcctaggacaatatggaaacggatttctgaagagctgaatgtttgcgcacaatgtgtttgngaacaccaccaggcacagaaggattttgat

SEQ ID NO: 32324 - DNA, 101 bp, rice(Oryza sativa)
  misc_feature (71): n=a or c
catcttgatgtagaggctcctaagtatgaaaaaaaaaagattcaccgtgctactaagtagagtgatcttgncatatggacgttacatgcatgccatgaact

SEQ ID NO: 32325 - DNA, 101 bp, rice(Oryza sativa)
  misc_feature (71): n=a or g
ctcagtagcaggctgtggacgagacaagcataggatggtaggaggcgacagcgacgaagcgacgatggcgnacaaggcaagcacaggtggctgacgaggcg

SEQ ID NO: 32326 - DNA, 101 bp, rice(Oryza sativa)
  misc_feature (71): n=a or g
ttacaatgaaacacatggatcaaattcaggtaaattaacataaaaaattgatcgcatagacatgttagatntgcataaaactcaggcccgtcacggatgac

SEQ ID NO: 32327 - DNA, 101 bp, rice(Oryza sativa)
  misc_feature (71): n=a or g
tggaactactactaccaccaccagcagtatgacgacgaaaaccaccaccaggcgccgccggaggtgatgcngtcggctcccgccgtcgccgtggcggcggc

SEQ ID NO: 32328 - DNA, 101 bp, rice(Oryza sativa)
  misc_feature (71): n=t or g
cttgaagcaatctctttgctgaaatcagattaagaatgcaaattcgcttagaaattagcagaagcaggctntgtacatttttgtacaccaaataaccaacc

SEQ ID NO: 32329 - DNA, 101 bp, rice(Oryza sativa)
  misc_feature (71): n=t or c
ggatctagtctccttgttgatagatccggtcattctgttcatgttgtttttctgagacggtcctttgcaanattaatccgtttgtaaaaatcagttttcac

SEQ ID NO: 32330 - DNA, 101 bp, rice(Oryza sativa)
  misc_feature (71): n=a or c
cgatggccggatatttatttttattttctctaaaacaatgtggcactcaatttaagtagaaacggatggtngaatgtatttgtttattttaagagttccac

SEQ ID NO: 32331 - DNA, 101 bp, rice(Oryza sativa)
  misc_feature (71): n=a or g
ggtaaatattgtaactcaaacaatagaaaaatagagattgaccataccacaaaacaatacatatgtgcatntaaatcatcggaattcatgtatcaatagta

SEQ ID NO: 32332 - DNA, 101 bp, rice(Oryza sativa)
  misc_feature (71): n=a or g
gatatactcacaatcatgggactttgggaaaggtccccatagatcaaataactccacttgaaagttgtagntcaagggaatcgcatcttgagtggtgatat

SEQ ID NO: 32333 - DNA, 101 bp, rice(Oryza sativa)
  misc_feature (71): n=t or c
ctagtatacacctagctatcacaacctctagatagcatttcattttcagaggttgctatacccatcaaacncaaatatatcaaaattgcacaataatttca

SEQ ID NO: 32334 - DNA, 101 bp, rice(Oryza sativa)
  misc_feature (71): n=a or g
cccgctaggcgccacgacggaacgggcgctacattaggactgttaattgtggttgtttaaggctgaatganccggagttgtgatgctgtgccgataatatt

SEQ ID NO: 32335 - DNA, 101 bp, rice(Oryza sativa)
  misc_feature (71): n=t or c
cttcgtgggtatcgattatgtttgttcatttttttggcatttgggtagcatcgcactgaagtcaaagttgncgtgtcgcttgggtggcaagctcaacgacg

SEQ ID NO: 32336 - DNA, 101 bp, rice(Oryza sativa)
  misc_feature (71): n=t or c
actggaagatgcacatgactatatgggtgtttatgcaacaggctttaaaaaaagagaatcccttatatgcnattataaattggccaattctcttatatgcc

SEQ ID NO: 32337 - DNA, 101 bp, rice(Oryza sativa)
  misc_feature (71): n=t or c
gaattttactctgttaccacctattacctacactctcactagaacctttgtgatgcttattgatacattantgaacaaggtagtgttttataagcctaaag

SEQ ID NO: 32338 - DNA, 101 bp, rice(Oryza sativa)
  misc_feature (71): n=t or c
attttagttaagaggttgtatctaaggaagatggtatactatacactcattgtgtaactgttactccctcngttttaaaatgtttgacaccgttgcctttt

SEQ ID NO: 32339 - DNA, 101 bp, rice(Oryza sativa)
  misc_feature (71): n=t or c
agagggaatttttttatttgccaaactaaacaatatttgtgcagatcatagttatccttgatgcattgtgntaatctactagcttctgtggctactattgt

SEQ ID NO: 32340 - DNA, 101 bp, rice(Oryza sativa)
  misc_feature (71): n=a or g
ttccatgatacacagtgccaaatgttccagaaccaagttccctaagttcttcaaggtcttcattcttgatnatctgtggataaaatattcaacttcagaat

SEQ ID NO: 32341 - DNA, 101 bp, rice(Oryza sativa)
  misc_feature (71): n=a or g
catggaagatctagaacgttactccggtggaccacttctttctatcccacgtcaacattcttgggactctngttctttagcttctccatgggtggtggagt

SEQ ID NO: 32342 - DNA, 101 bp, rice(Oryza sativa)
  misc_feature (71): n=a or g
ggccggcatggcgtcgccggaagatggggaagagaagatggccgggaagaacaagcatgggttcccgctcngcttccgcttcgttcccgaggaccaggagc

SEQ ID NO: 32343 - DNA, 101 bp, rice(Oryza sativa)
  misc_feature (71): n=a or g
agccaagctgttttgaattgtctgcgtcaaggaggcttccaatgcctggatatctgcaagggttgctggtngcagttgttctgcgacgggcagcagtcgtg

SEQ ID NO: 32344 - DNA, 101 bp, rice(Oryza sativa)
  misc_feature (71): n=t or c
gtggagatgggagcatgcaactcctggagtagctggcagagccaacagcactcggcaaccatgtgagcaanggcacgatactccgcttcggcactagagcg

SEQ ID NO: 32345 - DNA, 101 bp, rice(Oryza sativa)
  misc_feature (71): n=a or g
ttcattcgattgcttacatttttggcctacactgcaggagaagattgttaaggcattatgcattaaaacancatcgtcagagctagagggctactgtcaaa

SEQ ID NO: 32346 - DNA, 101 bp, rice(Oryza sativa)
  misc_feature (71): n=a or g
ttgtatctatttatgttgaagatgatctatcctgatgagatgatgttaaagcaccgcctgacttcagctantgagagcacaattgtgccaggttagagaac

SEQ ID NO: 32347 - DNA, 101 bp, rice(Oryza sativa)
  misc_feature (71): n=a or g
gccagggtaatctatggggttaaattaagatgattgagctgaagtgcacttcagtctgatcatttacatcnttgtcaattattttgctgatgaataattat

SEQ ID NO: 32348 - DNA, 101 bp, rice(Oryza sativa)
  misc_feature (71): n=t or c
tcctcacttgcacaaggctgtgtcagaaaaagtatctaggcatcggcgcttgagccggcgacaatttagtngttcgcttttctctctcagcttttatctct

SEQ ID NO: 32349 - DNA, 101 bp, rice(Oryza sativa)
  misc_feature (71): n=a or g
atttcaacacgagatcaccatcgaactcagcaagaagctcgaatcaaacaagcaacacagcattgatgaangcatcaaccacgcactgcactaactaacta

SEQ ID NO: 32350 - DNA, 101 bp, rice(Oryza sativa)
  misc_feature (71): n=a or g
accgggaacagatcttttcatacgtgctaatgcgtgatatagcgtgacatactgatgatacaggtactgcngatactaccgatagtttactcatccgtggt

SEQ ID NO: 32351 - DNA, 101 bp, rice(Oryza sativa)
  misc_feature (71): n=t or c
gttcggctatgcccccgccatcaagaactcgcccaacaaatgcggcggcagctctatgtaccatagcgtgncgtcccaccacggttcttaatcaatcccca

SEQ ID NO: 32352 - DNA, 101 bp, rice(Oryza sativa)
  misc_feature (71): n=a or g
actagatgatggatatgggtacagatgtgtgtgcgcatgcatgtgtgatgtttgtgtgtttgatccctttncacaagatctaaagaaaaagagggcgtagc

SEQ ID NO: 32353 - DNA, 101 bp, rice(Oryza sativa)
  misc_feature (71): n=a or g
attcatgacccagcaagcagcaagaatattcatgatccacaaagtggatttagcaagctgacttcagtganccgataagaaagcccaccctatctccaaca

SEQ ID NO: 32354 - DNA, 101 bp, rice(Oryza sativa)
  misc_feature (71): n=t or g
ctatttctgacgaatatagtgtactcctgatgagctgctatgatttagcaagttggactttgggcatctgnaggagagggaagaaaggggaggggctggtg

SEQ ID NO: 32355 - DNA, 101 bp, rice(Oryza sativa)
  misc_feature (71): n=a or c
tgttgtagaggtattattcattatatttggatcacttattttgcaaagggaggacaaacaactaagagaantagctgaggttggctatgaaatgataacca

SEQ ID NO: 32356 - DNA, 101 bp, rice(Oryza sativa)
  misc_feature (71): n=a or g
aaagcagatgctctcttcctcttcttatatgaggtagaatcctcaccagtaggcccaacaccacttgctcnagcagcaattccaggaccttcagcacccac

SEQ ID NO: 32357 - DNA, 101 bp, rice(Oryza sativa)
  misc_feature (71): n=a or g
ttgtttgaagaaaatatatcgtttgaagtgtggaataaatagagagaacctacggcttgggcgcccgatcngctgggagcaaaatccggcgctgatgtcaa

SEQ ID NO: 32358 - DNA, 101 bp, rice(Oryza sativa)
  misc_feature (71): n=a or g
gatccttcacatagtcagatggatgtaatggtggaacttaacaatggtggagaatcttttgatcactcagnggatacctcttatagattgcttagcaatgg

SEQ ID NO: 32359 - DNA, 101 bp, rice(Oryza sativa)
  misc_feature (71): n=t or c
cctaggtaagtttgatcaatcttctacctgaagaattatggcatcagatctcactaacattgatcatttcngtttattatggcgttcatcaaaattaattg

SEQ ID NO: 32360 - DNA, 101 bp, rice(Oryza sativa)
  misc_feature (71): n=a or g
tgttgcttgtttgcggcacagcagaagaacagaaaacacggtcaacccaacaaattcaaaccctgagtcangatatctactgccaagtgcttcagtgtctt

SEQ ID NO: 32361 - DNA, 101 bp, rice(Oryza sativa)
  misc_feature (71): n=a or c
tcaacttgagtactaggacatcagtaatttccatataggacatgcatgcaccaagaactcaactgcatagnatagacgaacaaatatccttgctcaaaagt

SEQ ID NO: 32362 - DNA, 101 bp, rice(Oryza sativa)
  misc_feature (71): n=t or c
ctcatcactttcccctactatcatggacatgtctatttatgacgactcaagattatcatttgtaacggttngctttcacccgtcacggatagcctgttaca

SEQ ID NO: 32363 - DNA, 101 bp, rice(Oryza sativa)
  misc_feature (71): n=a or g
tattcggtttgattccaacaaatagaacttagtactcagaaagatacagcaactatgcaagcgaagccacnaacgagaggcttcgacgtcgttgttgcggt

SEQ ID NO: 32364 - DNA, 101 bp, rice(Oryza sativa)
  misc_feature (71): n=a or g
tattggcaagacagcaacctcttaagaaataattaactatttgctaatagacccatatgccatagacaacnaatggcaaatctttaattttcataccttaa

SEQ ID NO: 32365 - DNA, 101 bp, rice(Oryza sativa)
  misc_feature (71): n=a or g
gattcggatttggataaaagagggagacatgatcatcctgccagctgggatttatcatcggttcatcgtcnacagcaacaactatatcaaggtaggagcca

SEQ ID NO: 32366 - DNA, 101 bp, rice(Oryza sativa)
  misc_feature (71): n=t or g
ctctgtacttatttgggtgtctgattgtccatcaccaaaactattttgtggcttagcaaactgatctgcanataatggcacgaaaggaacaggatcaatgc

SEQ ID NO: 32367 - DNA, 101 bp, rice(Oryza sativa)
  misc_feature (71): n=a or g
ttccaggcaatatactacatgactttgttattgaggccccattcagtttaaaaaaagaaacttgcatcgantgttatggtacatgtatggagtattaaatg

SEQ ID NO: 32368 - DNA, 101 bp, rice(Oryza sativa)
  misc_feature (71): n=t or c
cttgccttttccacgtcgcgtgcaaccctcattctcaccgcctcctgttcaaccttcgtgctccttttctntggggatctcctcttgtcgcttccttggat

SEQ ID NO: 32369 - DNA, 101 bp, rice(Oryza sativa)
  misc_feature (71): n=a or g
aagattcctgagtataccatcacagggctcaacaccttgaaggacatgcgaggcaatttcttttggtatgncaggggatggtggctcacgcatgagatcat

SEQ ID NO: 32370 - DNA, 101 bp, rice(Oryza sativa)
  misc_feature (71): n=t or c
cattatttgtaaagaaccagtaatgccttatttggggaattcgagatttggacaggtaactgttgagtacnaaataatcggtgaaaatctagaaaactggg

SEQ ID NO: 32371 - DNA, 101 bp, rice(Oryza sativa)
  misc_feature (71): n=a or c
catctgacaattggaaatcaacccattgttgattaggaacagcaccatcatatacattctgaaggtctgcnacaaagttccactgtataccccactgattt

SEQ ID NO: 32372 - DNA, 101 bp, rice(Oryza sativa)
  misc_feature (71): n=t or g
caaaatgaatataaatatcagcactgagagttctccaaagtgctttagacttgcttattttgtgttctctnctcttgattacattcatgaaataccaaaac

SEQ ID NO: 32373 - DNA, 101 bp, rice(Oryza sativa)
  misc_feature (71): n=a or g
cagagcatacgtggagataaaaccaatattgtatgtccccagtcccactaatgatgatggagtcccaaccngagaacaggaggctggagggtcattgccag

SEQ ID NO: 32374 - DNA, 101 bp, rice(Oryza sativa)
  misc_feature (71): n=t or c
cgtcgagatacccttgttagtggcattccgggtccacatgtcatacatatatgcttgagagagggaggaanggcaggccatattagcatgccacctcatgg

SEQ ID NO: 32375 - DNA, 101 bp, rice(Oryza sativa)
  misc_feature (71): n=a or g
tcgtcagtcatcgcatcaaaaatatgttggagtggattattggtgcatattaacagaaacaatatagaatntagaatggtataccgttccaatgaaataga

SEQ ID NO: 32376 - DNA, 101 bp, rice(Oryza sativa)
  misc_feature (71): n=a or g
atgatgattaagaggataagctaaggatgttggagccattcagaacacgggcaccaccaagtgtatgaacncggcgaggatggcagccatgacgccggcga

SEQ ID NO: 32377 - DNA, 101 bp, rice(Oryza sativa)
  misc_feature (71): n=t or c
agacgcggcatggcatcctcatcctgatgctcaagctgaattcgctgtgtcaacccatccaatgctgttgnccattgacaagccatcgctagcggttagcc

SEQ ID NO: 32378 - DNA, 101 bp, rice(Oryza sativa)
  misc_feature (71): n=t or g
cttgcacaacagatgtttcgaattatattgtactgtatgatagcaatgtttgtggtgcaacctcagttggngatgacagagttatgcaactgctgcgacgt

SEQ ID NO: 32379 - DNA, 101 bp, rice(Oryza sativa)
  misc_feature (71): n=t or c
catttgttttaaagaaactcacgaaaggcaaatttcatatccctctactttaggaggaaaaaaaatccacntcaacataatgttttcaatcctttgtactg

SEQ ID NO: 32380 - DNA, 101 bp, rice(Oryza sativa)
  misc_feature (71): n=a or g
cgggtggccgtcggccggcggggactcggccacgatcgacatcgcgcggacctacgtgcagaacctgattnagcatgcgaagaaggggacgccgaagcggc

SEQ ID NO: 32381 - DNA, 101 bp, rice(Oryza sativa)
  misc_feature (71): n=a or g
gagtgactgaaagagatcacttgtgctagggcttcaatcaaacatggtgttaaatatgtgatcgaattttnggcccacgatatattcggattagtttccta

SEQ ID NO: 32382 - DNA, 101 bp, rice(Oryza sativa)
  misc_feature (71): n=t or c
gctgtgatttgggactgagctcctgaggatgtggttgtgctatgggtgtttggttttgagtcaatttttgngtagaattttgcgtagaatttgataccatt

SEQ ID NO: 32383 - DNA, 101 bp, rice(Oryza sativa)
  misc_feature (71): n=t or c
ctcaggatggctatctcggagggcacattcatcaatatctgtgcgcaaacagcaattaattttcacatatncgtgtactcatggtgtaatattgttatact

SEQ ID NO: 32384 - DNA, 101 bp, rice(Oryza sativa)
  misc_feature (71): n=t or c
cgagattggttttcccactcctgcttctcgttggtgggaacaaaaaagcccgatagtgtcaggggtgactncgactgccccacctatcaccgaggacgatc

SEQ ID NO: 32385 - DNA, 101 bp, rice(Oryza sativa)
  misc_feature (71): n=t or g
ggtgcacatcgagatggatgacatgttggcctggcactatgatgaaaagggtttgttctcagtgaaatcancctataaggtgcagcgagatggggagttac

SEQ ID NO: 32386 - DNA, 101 bp, rice(Oryza sativa)
  misc_feature (71): n=a or g
tgaagccccttcacgaatgatcttgacatcttcactctgtcctaatggagatgagtttttctctgaacgancatcattattcttttctccatattttggtg

SEQ ID NO: 32387 - DNA, 101 bp, rice(Oryza sativa)
  misc_feature (71): n=a or g
aaaggctgcaattgagacatgctgcaagagctcgatgaagtgataaaacctcaaagttcacccacttctcnccaagcgtcacaagccattgccgtcgtgga

SEQ ID NO: 32388 - DNA, 101 bp, rice(Oryza sativa)
  misc_feature (71): n=a or g
tgtttgcaaaggtttcctccaagtcagcaatcaagttgtcatcctgcttggtcttgataataacatcgccnacatatgcttccacattccatccaaaaggt

SEQ ID NO: 32389 - DNA, 101 bp, rice(Oryza sativa)
  misc_feature (71): n=t or c
ggaggaatcagaccatcgctgatgctcgcaatcagaacctgaatcagcaaccacaagcacatcggtcgtanatgaagtattgcagaaatcatcaggtaatt

SEQ ID NO: 32390 - DNA, 101 bp, rice(Oryza sativa)
  misc_feature (71): n=a or g
gccccggatcttgcttggctcccttgcactcggctgggtcggaagagctagccgcgagagcatcgcatgangacccttgacgccgcccaagtcgcttgagc

SEQ ID NO: 32391 - DNA, 101 bp, rice(Oryza sativa)
  misc_feature (71): n=t or c
cgatctgttaccagggagagtgttctgaagatggacgtaagaacacctagcaagacaaggcctactatgangcaactgaagggtgcaacaaccacagtggt

SEQ ID NO: 32392 - DNA, 101 bp, rice(Oryza sativa)
  misc_feature (71): n=t or c
cacgtttgcattgcagcagctcataagtttcttcttcgtttctgctcccagtgctaaggcagcacagtcgntcgtcgccatgccagggctcaccatcggcg

SEQ ID NO: 32393 - DNA, 101 bp, rice(Oryza sativa)
  misc_feature (71): n=a or g
aagatcgggcttgcattcatccagtcggcgtacgtgtaaatcgatcatctaggacgacacacgcgtgcatntttgctctctcaactgcttaagctccttga

SEQ ID NO: 32394 - DNA, 101 bp, rice(Oryza sativa)
  misc_feature (71): n=a or g
tcgcgggtaacggaaaaagcgtgagaaaagatagatgttgtttgtttggaagtggaagaggacttgggganttgttgactggtcccgtgcaccccggggac

SEQ ID NO: 32395 - DNA, 101 bp, rice(Oryza sativa)
  misc_feature (71): n=t or c
taaaaaaattcaaagtattacatatccatccactaatgttcctggggaggacgatttttatgacatggcanatggttgttagctcgtactaacggctacgc

SEQ ID NO: 32396 - DNA, 101 bp, rice(Oryza sativa)
  misc_feature (71): n=a or g
ccttacaatgtggttatacaatatgcaggaaaataatagaagtgaactcaacagactagaccgagagaagnaggaggatatgcttgagatgataaaaggat

SEQ ID NO: 32397 - DNA, 101 bp, rice(Oryza sativa)
  misc_feature (71): n=a or g
tctttagaaagtttttctagtgtccaatcaggacttgagtttttccttttgtctttagaacacgtatgtcntgtccaatatgtactagtatctgcccatgg

SEQ ID NO: 32398 - DNA, 101 bp, rice(Oryza sativa)
  misc_feature (71): n=t or c
ccatcgtcaaccaatgaggccagcttcttcaacagctctgggtttttagacacatctacagcaagcaacangtttactataagtaacagttactctgtaaa

SEQ ID NO: 32399 - DNA, 101 bp, rice(Oryza sativa)
  misc_feature (71): n=a or c
aagcctactcatacagcgagaataagaacgcggattggaatgcgtctgcgtcagatttcaagaaccacagnctgtcaacgttagtcatgtttggctttcag

SEQ ID NO: 32400 - DNA, 101 bp, rice(Oryza sativa)
  misc_feature (71): n=t or c
gcatactaaaatgcgccattctgctatttttcttaaattcttcatgcttcccaatttttacttgaattttngaagcaaacttaatagttttaaagcaacaa

SEQ ID NO: 32401 - DNA, 101 bp, rice(Oryza sativa)
  misc_feature (71): n=a or g
atgtcttcttgttggtacctatgctagttgggtgcacacactaacaataaccccttgtcgctaataaccantggattagaaatagtttaaatttttaaaag

SEQ ID NO: 32402 - DNA, 101 bp, rice(Oryza sativa)
  misc_feature (71): n=t or c
ttttgttcaggtcattgtcagcagtaaccatgagcgtgcattgcatatatgctttttagatcccttcaagntagtcatccaagtgagagcaacgacgtgta

SEQ ID NO: 32403 - DNA, 101 bp, rice(Oryza sativa)
  misc_feature (71): n=a or g
gttatgcaacaattagaaaagcagaacagtcaagaatttctgaatgaccaacagaacatacaagattcctntcaacaagagaacaattgggcatctgtaca

SEQ ID NO: 32404 - DNA, 101 bp, rice(Oryza sativa)
  misc_feature (71): n=t or g
ggcatttgaggtactgaccatatagaatcatgcaaaattttctcccaatctgctcgccgtctctccttttngcacaagagtccccccattactttgacagc

SEQ ID NO: 32405 - DNA, 101 bp, rice(Oryza sativa)
  misc_feature (71): n=a or g
tagaaattagttcctctctagctgagaagcaattggaaactgttggtgaggtgcgaagccatttgtcaaanttcatggttgagtgtcgtgacgcaactgac

SEQ ID NO: 32406 - DNA, 101 bp, rice(Oryza sativa)
  misc_feature (71): n=t or g
taaggagtaaagattatacaaggagtcttcacattctagagctttctaaacagaatttcactctttttttngttggacttcagctctaagaaatggagcta

SEQ ID NO: 32407 - DNA, 101 bp, rice(Oryza sativa)
  misc_feature (71): n=t or c
atgatagtatattacctttgggttatatacatatgacatggatagcatatagtgatagcggttatcaagcnccctttagaacggagaaatttcacgggaat

SEQ ID NO: 32408 - DNA, 101 bp, rice(Oryza sativa)
  misc_feature (71): n=a or g
cagtagtcatgagagcaccgagagtaaggaaaatatagctcatgatagcaccggcaataaggaaagcatcnccttagagagacgcacggaaacaggtgcgg

SEQ ID NO: 32409 - DNA, 101 bp, rice(Oryza sativa)
  misc_feature (71): n=t or c
ccggttttcttaattatttcccctttccgtcttccgatcttcctagctgagaaaattgggattatactatngtaaaagagtggtttcactgaaatgctatc

SEQ ID NO: 32410 - DNA, 101 bp, rice(Oryza sativa)
  misc_feature (71): n=a or g
cctcatcctgagcgcctgaaccagtataaatcgctaggtcaccatttctttcttgcatctagcgcaccctntaaattttattgctgatttttgaaatcgac

SEQ ID NO: 32411 - DNA, 101 bp, rice(Oryza sativa)
  misc_feature (71): n=a or g
atatggatatatgtatgtgatttggttggttcaacctcttgataatttgtttgtttgacagtagagttagngcctgttcactttgatgccaaaaaaacctt

SEQ ID NO: 32412 - DNA, 101 bp, rice(Oryza sativa)
  misc_feature (71): n=a or g
ctagagggcaaaagaaattaattccatttcatttgcggttaaccattggggaaagcttaattggtggtccnctctcgatacagaaaactatagccatttca

SEQ ID NO: 32413 - DNA, 101 bp, rice(Oryza sativa)
  misc_feature (71): n=a or c
tctagctaatggattatgaaggggtgtaactgtgctacaccaacaggcttgagctaatcttatcgcatacnttgccataactaatccaaacttcaaattta

SEQ ID NO: 32414 - DNA, 101 bp, rice(Oryza sativa)
  misc_feature (71): n=t or c
ctcaagtcccaaaattgttactagcacattgtgttctttttgtgtgggatatagggcatgtttggcatagntctctagagctcgagctcagccaaacactt

SEQ ID NO: 32415 - DNA, 101 bp, rice(Oryza sativa)
  misc_feature (71): n=t or g
tcaggtatgtaaatgttcctttcctttactttcaatccttggtcctttttttttactcaggagatatttgntttttttttaattttctggtcatacatatt

SEQ ID NO: 32416 - DNA, 101 bp, rice(Oryza sativa)
  misc_feature (71): n=t or c
ggccgggccccagcaactcacttctggagaattccgccagaacaacaacaggaagacgatcttgtaggcgncgccgacatcatcgtctccgggagcagcat

SEQ ID NO: 32417 - DNA, 101 bp, rice(Oryza sativa)
  misc_feature (71): n=t or g
gaaatgacgaaaataagaagagaacagtgttaggaaactttacaacttctcacgaactttttgagcagaangtagaatttccaaatattaattttgaagag

SEQ ID NO: 32418 - DNA, 101 bp, rice(Oryza sativa)
  misc_feature (71): n=t or c
tagctgctgttggtaagccagttcaagagggcgaatctcaaccttggcatgcaactcttcgtactgtatangtgtgttcctggtcaggcacacaatcttcc

SEQ ID NO: 32419 - DNA, 101 bp, rice(Oryza sativa)
  misc_feature (71): n=a or g
gtttgtatttttaccccttattttgaaaactgattagacgtttgccctcacttttgacgcctattaggcangtccactacactaaacatgccttgtagaga

SEQ ID NO: 32420 - DNA, 101 bp, rice(Oryza sativa)
  misc_feature (71): n=t or c
tttgttgttagttagtacactctttgttcttactatttggcctggaagcacaagaggattttacttggtgncaattaggtgattcacattgatgcaattta

SEQ ID NO: 32421 - DNA, 101 bp, rice(Oryza sativa)
  misc_feature (71): n=t or c
cttctcggatttttactcttcattcttgtcattggagcttttgatcagccatacaatcaacctttgggcangggaggggagggtgacaataacatgatgct

SEQ ID NO: 32422 - DNA, 101 bp, rice(Oryza sativa)
  misc_feature (71): n=a or g
atttcatttggctcaaggaaaatttttgattgttgattgtttgccttgaatatattacctgaattgtcgcngagtgtgattgccctgtgagatgaggtgtt

SEQ ID NO: 32423 - DNA, 101 bp, rice(Oryza sativa)
  misc_feature (71): n=a or g
atgttgcagacagtggaaatcaacacaagcagcaaagtgctcctctatatgattaagggttcaccattttnattctttgttctttacagatgattggacat

SEQ ID NO: 32424 - DNA, 101 bp, rice(Oryza sativa)
  misc_feature (71): n=a or c
aagaagagcatgagcctgctgttataatgaccgactggtcaacaagacactctgatgcatgtcttgacaantcttgaatttcacctgttttgcccaaacat

SEQ ID NO: 32425 - DNA, 101 bp, rice(Oryza sativa)
  misc_feature (71): n=t or c
aagtttttcaattcaaacttgtcatttaccttgaccaaacctataaagaacggcactaatagaagcatcancaaagataatcgattcagtcttggatgcct

SEQ ID NO: 32426 - DNA, 101 bp, rice(Oryza sativa)
  misc_feature (71): n=a or g
gccacctagaaatagtgggtttgatgactccaaaaacttgcttggacgaagatgacgacgatggtggattnggatagagaccgttgcggcaaggccctcta

SEQ ID NO: 32427 - DNA, 101 bp, rice(Oryza sativa)
  misc_feature (71): n=a or g
gtatcagctccggcatcttcatgtctccgtcgaggtattgcatggcttgcctcatgctaggccttgcttgngggaccgggtgtgagcatagcagccctagc

SEQ ID NO: 32428 - DNA, 101 bp, rice(Oryza sativa)
  misc_feature (71): n=t or c
gatgtgcactaaaaatccatcagatattttcctatccatggatatttatataggcgacacttgtggggctngggggttacctcaattagtttaggattctg

SEQ ID NO: 32429 - DNA, 101 bp, rice(Oryza sativa)
  misc_feature (71): n=t or c
atttcaataattttgttggtgttcacacatcaagcaaatgatcgcggaatgtagggtctattttaatgcangcgcttcatcgattcaatagatactaagct

SEQ ID NO: 32430 - DNA, 101 bp, rice(Oryza sativa)
  misc_feature (71): n=a or c
gttcaccaacacaccggggaaagagattcaggccatgtttggcaaaggcacaactatagatcctaaatccncgctgcaaattaaattagagtggtttaaaa

SEQ ID NO: 32431 - DNA, 101 bp, rice(Oryza sativa)
  misc_feature (71): n=t or c
cggactgataccaatccgtttttccacatgaccttttttttaaccgtcggtgattttttttacggtcggcnttttttcttttacccagcattttttgcaaa

SEQ ID NO: 32432 - DNA, 101 bp, rice(Oryza sativa)
  misc_feature (71): n=t or g
ttaacatcaaaggaagaattaggagatcatgttgtgctgtaaataagataagtttcagtgactcaagtgtncagctaatcttgagtaaaatcagttggcct

SEQ ID NO: 32433 - DNA, 101 bp, rice(Oryza sativa)
  misc_feature (71): n=t or c
gcgaactcggtgaactcggctagatcactacctcagcgagctcgcactggcgaacgatgacaaggtgtcangccccgaactagccccgagtggaactagcc

SEQ ID NO: 32434 - DNA, 101 bp, rice(Oryza sativa)
  misc_feature (71): n=t or c
tgcaaggactgagaataacactgaaacaaaaccaaatgcgcccagcaatgccatccacaatgcttaataanccttttttaagttcctgtatcggtcaaact

SEQ ID NO: 32435 - DNA, 101 bp, rice(Oryza sativa)
  misc_feature (71): n=a or c
atccatgccactggcatctattcagacttcatagaaactgcctaaagagcttctctccgaaatgggaatgnaggttgggagactggagcacttgttgtgat

SEQ ID NO: 32436 - DNA, 101 bp, rice(Oryza sativa)
  misc_feature (71): n=t or g
ctagcgcaaattattgccattccatgaattttcctttttatttctttttctctccgggcattggccacagngcacctctcgtggaccagcctgtgtctcct

SEQ ID NO: 32437 - DNA, 101 bp, rice(Oryza sativa)
  misc_feature (71): n=a or c
tctgatgtgacaaggataagaactatgatacaagagagaaatttgaagaaggaaacaggaaatagcttganctaaaagttaaacaatgagtgcacaagtct

SEQ ID NO: 32438 - DNA, 101 bp, rice(Oryza sativa)
  misc_feature (71): n=t or g
ggttcggatggcagacggccgcacgcatttttgcgcaatggttcatggacaataatgtgccaattatcatncgcacccgtttacatgggtgttcagattga

SEQ ID NO: 32439 - DNA, 101 bp, rice(Oryza sativa)
  misc_feature (71): n=a or c
tgactcctctgtatgattcacaacattccataatcgcagagtgaatatttgcttatagtatgatcagcccntagataaagagagtaaagaactatgcacac

SEQ ID NO: 32440 - DNA, 101 bp, rice(Oryza sativa)
  misc_feature (71): n=t or c
aagccgttttggcttattgggaaaaagccaaacgatgaggaccatatcatctcttaattgttgcatgtacngacatacaaaccatttagcctcacaatgtc

SEQ ID NO: 32441 - DNA, 101 bp, rice(Oryza sativa)
  misc_feature (71): n=t or c
acatttgcagagttccttttttgcacattttatgtgctttgaagtacctgcccttgttccagctggtgctncgaatgctaaaagtagatcagggggaaatg

SEQ ID NO: 32442 - DNA, 101 bp, rice(Oryza sativa)
  misc_feature (71): n=t or g
tcatcgacttcctttatcctgcaggctataattacatctaatcctcatttgctccaaaaacttgattcgcngagttggagaagtttgtctggagttcgtgt

SEQ ID NO: 32443 - DNA, 101 bp, rice(Oryza sativa)
  misc_feature (71): n=a or g
atttgactgatctgctcacaaggaatgtaaatatggataggttggtgactcactttttgacccaagagacnggtgatcagtaagacgaatgccaatatata

SEQ ID NO: 32444 - DNA, 101 bp, rice(Oryza sativa)
  misc_feature (71): n=a or g
gccgctgccgccgctgctgctgcaacttcagctgcctatcaaccgcaacggtaggcaccattgtcaccacncgcggggagcggcgaaccgagcggattcgt

SEQ ID NO: 32445 - DNA, 101 bp, rice(Oryza sativa)
  misc_feature (71): n=a or c
ttgttgaaaagatagtggctgtttgcagccttagaaaactgtaggaaggtaagcagtagggcgaacaccantgccgtgaaactggaaggaaaacccatggc

SEQ ID NO: 32446 - DNA, 101 bp, rice(Oryza sativa)
  misc_feature (71): n=a or g
ggcagttatgtctacctgtcatgttttgaggacggtgtaaacagagacttggtctcggagaattattttcncacctactcagggcagcctactactagtaa

SEQ ID NO: 32447 - DNA, 101 bp, rice(Oryza sativa)
  misc_feature (71): n=t or c
ggacacacggtaaaagaatgtcgttatgatgaaaattttgttgccgatgaaagatttgcaggaccggcatnctcgtatggtgtagataccaactggtatct

SEQ ID NO: 32448 - DNA, 101 bp, rice(Oryza sativa)
  misc_feature (71): n=t or g
ttttaggcaagcagccactggagacaatataaatgtaaaaaacagttgcagtagggtgtgtttagttcacnccaaaattggaagtttggttgaaattggaa

SEQ ID NO: 32449 - DNA, 101 bp, rice(Oryza sativa)
  misc_feature (71): n=t or c
caccaccggcgggtgctgttgctgcgtcgaagatgtttgcaaggcagacttagtaggtaagggaaatagtnatacttttgttattgtctctctctgcattt

SEQ ID NO: 32450 - DNA, 101 bp, rice(Oryza sativa)
  misc_feature (71): n=a or c
gcaggcacttaccaaggaaaactgtcatactgtgccaactgacgtgcagtgtcttgataagattcctgaangttttgtagaaaaatcaaaggttgagattc

SEQ ID NO: 32451 - DNA, 101 bp, rice(Oryza sativa)
  misc_feature (71): n=t or c
ctaaaagttttatataagatatatacatcgttcaagtatttaggtactgatgtttggtttgtggtctcttngtataacagaggcttgcatattctatttgc

SEQ ID NO: 32452 - DNA, 101 bp, rice(Oryza sativa)
  misc_feature (71): n=a or c
tggttgtactttgtaatttggtgagggcatactagtcttttaccactgctgctaaagtcacctcgggtttntaggaatcgtgattttatgggacggaggga

SEQ ID NO: 32453 - DNA, 101 bp, rice(Oryza sativa)
  misc_feature (71): n=t or c
tctgaattgtctggcaactgcaatccttcatcatctaatgaaacttgctcagtgcaatcttctgtactaanttgtttacccttcaacttacttcctgttgc

SEQ ID NO: 32454 - DNA, 101 bp, rice(Oryza sativa)
  misc_feature (71): n=a or c
gaacaattaaagcaggcacgcacccggagggggcagagatcaccatcaagcatgctgtgattactactccntccgttccaaaataagtacagttttacact

SEQ ID NO: 32455 - DNA, 101 bp, rice(Oryza sativa)
  misc_feature (71): n=a or g
gatcccaaacatactgctctacaccaggtagatagctcacaacaagcaagagataccataagtaaccaacntacctcaggctctgggtaaataggttcctc

SEQ ID NO: 32456 - DNA, 101 bp, rice(Oryza sativa)
  misc_feature (71): n=a or c
aaggatatttttcgtcttacccctcttttcagaggctttagctccatccaaatcaattcaggagacacagntctcctttggaaggatccttggacagatgt

SEQ ID NO: 32457 - DNA, 101 bp, rice(Oryza sativa)
  misc_feature (71): n=a or g
tgtccgcggtggatgtttcttttcttcggaactcctctcattccctaggagggatttgtgctactcccatntttgtaaatatataacacaatatataatac

SEQ ID NO: 32458 - DNA, 101 bp, rice(Oryza sativa)
  misc_feature (71): n=a or c
agccgaaagctaggccgccctgtcgagtgccgaccaaattaagctcgatcaaattgttaatctaggtagtnccgtacctaattaatctgaccacaaaacaa

SEQ ID NO: 32459 - DNA, 101 bp, rice(Oryza sativa)
  misc_feature (71): n=t or c
ttagcaaatactgagaagaagcttctcaggatggatgccatggccccaagattatcgatcaatggaaactngtcgatcaatgggaactcatttaccatatc

SEQ ID NO: 32460 - DNA, 101 bp, rice(Oryza sativa)
  misc_feature (71): n=t or c
ttgtaatatggggaaaaattactatagaaatcatgatctgacttggatattccacttccaccaaattttcngaaggaatgtatttaattttcattagttgt

SEQ ID NO: 32461 - DNA, 101 bp, rice(Oryza sativa)
  misc_feature (71): n=a or g
ggcggagagccgacaaggctaggtcactatgctattaacacatctaaaatggacgggaactggatacaccnttgctgagcaccgacgagacaaaagcaacc

SEQ ID NO: 32462 - DNA, 101 bp, rice(Oryza sativa)
  misc_feature (71): n=t or c
ctttgccttactcgtgttccaatacccaaggatatgctcccagattgggcctcccaagtatgcaccctcanggatggactcccacacatcagataatgaca

SEQ ID NO: 32463 - DNA, 101 bp, rice(Oryza sativa)
  misc_feature (71): n=a or c
gcttcttcaatgcaaggcttccggctctaattaatttccatctggagaagagtcgccatcgaaatatactnctatacctaggtctgtttgggaatgtgctc

SEQ ID NO: 32464 - DNA, 101 bp, rice(Oryza sativa)
  misc_feature (71): n=a or g
actgagtttcttttatttccgcctagatgaactatatgtgttgctttcaagcaaaatatggttcattacgncatgcatcattcacaaaaaaaaaagccctc

SEQ ID NO: 32465 - DNA, 101 bp, rice(Oryza sativa)
  misc_feature (71): n=t or g
aaagagtctggactttgtggtacttgtgagttgtcagtcacttctacacactctacacactgacaattctncgtccgtatatacccataagaccctttttt

SEQ ID NO: 32466 - DNA, 101 bp, rice(Oryza sativa)
  misc_feature (71): n=t or c
atcgtccaataatatagttcattatccaaccaggtgtattgtaaggccttataacgtactttccgcgaagncgactgagatggattgtgcaaatattgaaa

SEQ ID NO: 32467 - DNA, 101 bp, rice(Oryza sativa)
  misc_feature (71): n=a or g
cagcagtgaccgccagcacaccggcgtcatgggcctgctctacatccttgttgcagagcaagaacagccanctcccaagcctgctctgtgcttcagcttcc

SEQ ID NO: 32468 - DNA, 101 bp, rice(Oryza sativa)
  misc_feature (71): n=a or g
ctctgcatatccatgaagattctgtcgagtaggcaatggagcatggacttgtgggatattaggactttgcncattcaaggatggcgagtgatgagaaccat

SEQ ID NO: 32469 - DNA, 101 bp, rice(Oryza sativa)
  misc_feature (71): n=a or g
tgaagtaaatctttgtggccacatttcctacagattccagcacagcaaccagcaaagaattgtggatatgnttatcaatggtttttccattcggttctctc

SEQ ID NO: 32470 - DNA, 101 bp, rice(Oryza sativa)
  misc_feature (71): n=a or g
tgaggactaccattttaataatatagagattagtcatttttgggaagcattaggcatcatagattctggangtcataaaaatagagctgaggatattggat

SEQ ID NO: 32471 - DNA, 101 bp, rice(Oryza sativa)
  misc_feature (71): n=t or c
tatctgcaaaacgacctcccaaaccatttccgcatcttctcttctccccctgattccgtttccgtttctcntcccctcaccgactcgtcgtcgtcgtcgcc

SEQ ID NO: 32472 - DNA, 101 bp, rice(Oryza sativa)
  misc_feature (71): n=t or c
agcccaagcgtcttggtgctgaggagcaccgggatccgctccttggcgtccttgatcagcttcaccaagtngacgacgtcgccgttcgccaccgcgtcggc

SEQ ID NO: 32473 - DNA, 101 bp, rice(Oryza sativa)
  misc_feature (71): n=a or g
aaagttaaaattatattataggacagaggtagtatatatatactgcacacgcgccctagttagactacatntgatcctctctagtctgaacacgcatgcta

SEQ ID NO: 32474 - DNA, 101 bp, rice(Oryza sativa)
  misc_feature (71): n=a or g
agataattattagactgaaaatgccgtcttttggctgaatcactctgatcaatcaaaatcaccatatttcngctgagattgcacattgttgttacgcgaaa

SEQ ID NO: 32475 - DNA, 101 bp, rice(Oryza sativa)
  misc_feature (71): n=t or c
taactctcatctctatcgaatgccatgtcattggtcataatgcattatatgtgtcgatcgagtgaagaacncacagtgtggtaacggtcatctgcgagggg

SEQ ID NO: 32476 - DNA, 101 bp, rice(Oryza sativa)
  misc_feature (71): n=t or c
ttggttttgatgtctagtttaaaagggttgtgctctatagacaacttaggtcttattttccatcagcacgnttttcaaacagttaaaaggtaaattatttt

SEQ ID NO: 32477 - DNA, 101 bp, rice(Oryza sativa)
  misc_feature (71): n=a or g
taagtgccacaaaaattcctggcaatatttgccatctaaagaacttgcaagctttacagaccgtttcagcnaataaggatttggtttcacatctggggaac

SEQ ID NO: 32478 - DNA, 101 bp, rice(Oryza sativa)
  misc_feature (71): n=a or g
attgttgtcttcccaatcccgcccgtcccaacaataccaaacctgtatgcccttttatccttatgtgcaancacaagtttcaccaatcttgtgcaaccatg

SEQ ID NO: 32479 - DNA, 101 bp, rice(Oryza sativa)
  misc_feature (71): n=t or g
ttctccacgatttaattgttgtttctctgcaatttgatatgaatgtgaccaatagggcttcatatgtgcangatgtcagcaacagagaagatagcgtgagg

SEQ ID NO: 32480 - DNA, 101 bp, rice(Oryza sativa)
  misc_feature (71): n=a or g
ttgagatcacgttttcttttttctttctttctttggccctttgagatcaccttctttttcttttttttcgngcacaggctcgcggtctcttggctcgagct

SEQ ID NO: 32481 - DNA, 101 bp, rice(Oryza sativa)
  misc_feature (71): n=a or c
gctaatacttaattaagcatgaactaataaccttcctcgttttgtgtacggcttatagtcacttcaaattntgtttcgaatagaagcctaagttgtttctt

SEQ ID NO: 32482 - DNA, 101 bp, rice(Oryza sativa)
  misc_feature (71): n=t or c
actattgcatgccgaagcagacataagtataatctttatttgtggtgtagttttggtactccattcattcnaaaatataagaacatatgatcggatgagac

SEQ ID NO: 32483 - DNA, 101 bp, rice(Oryza sativa)
  misc_feature (71): n=t or c
cacaaaccaaggagaaaaactaacaccaaaccaactatcgctgcgagaccgatcatcattagacctacganaaagccatatacctctcaatgccgatagag

SEQ ID NO: 32484 - DNA, 101 bp, rice(Oryza sativa)
  misc_feature (71): n=t or c
atccatggcgacgcacacacaccaatcgaaacctgtagaagaacccatggctgcagctacgcaagatcacntcccttcttctccggccgccgccgccgccg

SEQ ID NO: 32485 - DNA, 101 bp, rice(Oryza sativa)
  misc_feature (71): n=t or c
tctcctggtcttccaagcgtcagcacactttgtctcgttctagtgccaaagcggagtacagggctgtggcnaatgctgttgcagaaacttattggctgcgc

SEQ ID NO: 32486 - DNA, 101 bp, rice(Oryza sativa)
  misc_feature (71): n=t or g
cattaatttagagagagagagggagagagatagaaagaacaatggcaaagcttaagggcccctttgaatcncaggattgagaaaacgtaggaataggaaaa

SEQ ID NO: 32487 - DNA, 101 bp, rice(Oryza sativa)
  misc_feature (71): n=a or g
tatttttttattccagcagcatacgctctacacattgtattacccatcgtccgcaatagcttgcttcggcnccgttacaccgtccttaccattgctgcatc

SEQ ID NO: 32488 - DNA, 101 bp, rice(Oryza sativa)
  misc_feature (71): n=a or c
ccgtttctttctcattttctcaagacgcgctcgtcccggagtttttactcctgttcaaagttgctgcttangtgtgcaccataaaaaaaattgaagttact

SEQ ID NO: 32489 - DNA, 101 bp, rice(Oryza sativa)
  misc_feature (71): n=a or c
cattggctgtatgattggtcgcaaatgccggagaaagattgatctgaactgcttatcttttgatcatgttnctgtagatcagtttgggctgtttccacgtt

SEQ ID NO: 32490 - DNA, 101 bp, rice(Oryza sativa)
  misc_feature (71): n=t or c
atacctataaaaaaatgtgcttgagctattaggtgttgcccaaagagagtgtgcgtacagttttgtaatgnggcatagtgtgttgttgctgaaagtgcaat

SEQ ID NO: 32491 - DNA, 101 bp, rice(Oryza sativa)
  misc_feature (71): n=t or c
ttatcactacaatccacagtattaactgtatgtttttctttatctctacttttgacatctttaaaccggcnatattgtttaacttctttagcacggttttc

SEQ ID NO: 32492 - DNA, 101 bp, rice(Oryza sativa)
  misc_feature (71): n=t or c
tttgtctgtcaacactaatgtggtgttgcctaatcaagacacgagcatggtgaaagatgctgctacaactnggtaccgaagggaagacgacgatgacaaag

SEQ ID NO: 32493 - DNA, 101 bp, rice(Oryza sativa)
  misc_feature (71): n=a or g
gggtgagttaagagccctgcatgtaaacataccttatttttgtgtgcggatattttaagtggtccgtctgnaaaatttgaattttgcgtatagatctctta

SEQ ID NO: 32494 - DNA, 101 bp, rice(Oryza sativa)
  misc_feature (71): n=t or c
gttggatgtcgagggcggcgagcgcctcgccgtcgggggacaggctgagcagctgctgattataggcaggnatgatgaggcgtggatgggaattgttgacg

SEQ ID NO: 32495 - DNA, 101 bp, rice(Oryza sativa)
  misc_feature (71): n=t or c
atcaattaactaactaattaaccaaattaactaaaaattattgctgttcttgctgctggcagctagcttgntgctttgttccattccacgtgtccatgaag

SEQ ID NO: 32496 - DNA, 101 bp, rice(Oryza sativa)
  misc_feature (71): n=t or c
gcctggaatccggaaagtttccgtaccgttttcacccctacggtacgggcacgagactgttcgagatgggnctacagctacacttacgggctgagccgaag

SEQ ID NO: 32497 - DNA, 101 bp, rice(Oryza sativa)
  misc_feature (71): n=a or g
gtgaatcggctgaatagtttgctgtcctgatggcatctgctgagttggctgtgcgacctggtgccttggcngtgtttgttgaattgtctgtgcagcctggt

SEQ ID NO: 32498 - DNA, 101 bp, rice(Oryza sativa)
  misc_feature (71): n=a or g
tgaacatacaactccagctgataacacgtctgagaaaacagaagttcacagtggactgctttcacgttcangaaccaggttgcttgcgatgattggtgctc

SEQ ID NO: 32499 - DNA, 101 bp, rice(Oryza sativa)
  misc_feature (71): n=a or g
aatggcctgcgtggtggcatagtgctggatggcttcatggtccttcttgaagttggatctttcttctatcntcttcatctagaggtccatcctggcggagg

SEQ ID NO: 32500 - DNA, 101 bp, rice(Oryza sativa)
  misc_feature (71): n=t or c
tgcaaggagtacaaagctaggaccaataccaccccaccactatcagatctaacggcagcattacatacagnagaagaagaagaaacccgattcagactcta

SEQ ID NO: 32501 - DNA, 101 bp, rice(Oryza sativa)
  misc_feature (71): n=t or c
tcagaggacagacttcctcctgttggtgttgaacacgcgctgcgcattccctattttcgccgccatcattntctcgcgcagagctggattgaagatgccag

SEQ ID NO: 32502 - DNA, 101 bp, rice(Oryza sativa)
  misc_feature (71): n=t or c
tggtgctgtcgccgcctcccttttttccttattgccggtgcccggtgctgcccctcttcctccaccactgncaaggatctcgggtacatgctgctgggcat

SEQ ID NO: 32503 - DNA, 101 bp, rice(Oryza sativa)
  misc_feature (71): n=a or g
catcattgatgccattcgcaccaccacactttctcatgactagtcaaggattcgacactcagtgccactcntcctcgaaaattttcagatctggcgtggag

SEQ ID NO: 32504 - DNA, 101 bp, rice(Oryza sativa)
  misc_feature (71): n=a or c
aattcgatgatccatgatacagtaacatgtaacagcttctatagttgcataccaccacaaatatccgatgntaaacttcgaacaatgcggtgtatgtatca

SEQ ID NO: 32505 - DNA, 101 bp, rice(Oryza sativa)
  misc_feature (71): n=a or c
ccctgcacaaggcgacgagatcagcggtgtcgagatccatgtgacggtgctcgatcttgagctctcccccntctctaccggtgagatcgagctgccgccac

SEQ ID NO: 32506 - DNA, 101 bp, rice(Oryza sativa)
  misc_feature (71): n=a or g
ttactttacatctatactactttaaatgaagctagtggtggtcgagtccgccttcaacacaagctgacatncgaggtcaggtcataaagtccccacacgtg

SEQ ID NO: 32507 - DNA, 101 bp, rice(Oryza sativa)
  misc_feature (71): n=a or g
ttcagagggatcatacaggactttgcaaaattcactcttaggccagaagagacagcaaaggagttcaacanagcctttaaagcaaataactgagtggagga

SEQ ID NO: 32508 - DNA, 101 bp, rice(Oryza sativa)
  misc_feature (71): n=a or g
aaatgtttagagtttggacacatacatgggacattaaatgtgaggggaaaaaataccaattgtacaatttncttgtaaattacgagacgaatcttttgagc

SEQ ID NO: 32509 - DNA, 101 bp, rice(Oryza sativa)
  misc_feature (71): n=t or c
gacactttttcagttaggcttgtcggactgcgaacagtatctgaactgcgtctctcatctgcacgattacngacaggcactccccctccttttcctggtgg

SEQ ID NO: 32510 - DNA, 101 bp, rice(Oryza sativa)
  misc_feature (71): n=a or g
gttaacagaggctaccttttcacgtttcccaagttctgtgaaggtcgctgttgtaccaatttgaggccctntatagatgggactaaaacttttaagtccct

SEQ ID NO: 32511 - DNA, 101 bp, rice(Oryza sativa)
  misc_feature (71): n=t or g
ggtaccgacactagaccatctggttagttcaataccattgcccagtgtgtaggatcaaggagaccgactanaggggggtgaataggcggttttaaaactta

SEQ ID NO: 32512 - DNA, 101 bp, rice(Oryza sativa)
  misc_feature (71): n=t or c
aaactcatcatcggtgctgtcataatcactatcctcatccagatcttcatcttccacctcatcctctactngctccgacaaagtgttcgtgtcaaaagagt

SEQ ID NO: 32513 - DNA, 101 bp, rice(Oryza sativa)
  misc_feature (71): n=a or c
acaaaagatcatctcttcgctgacaaaggagagctccagtctatcagaactggctgatcttcaggaggtgntgggaaaaaaactacaggggaagagttttt

SEQ ID NO: 32514 - DNA, 101 bp, rice(Oryza sativa)
  misc_feature (71): n=t or c
tcacggctcttgggccaaggaaaaggggtgacatagcctttgggtgctgggattagacagcgcagtttctnagtctctgtaggacaatgcctctctcggta

SEQ ID NO: 32515 - DNA, 101 bp, rice(Oryza sativa)
  misc_feature (71): n=t or c
aacattttttttctaagagatacctactacatttcaaaaacatcttaggacaatcatacctggtttttaantatgggaaacaagaaaagtaatttgccatt

SEQ ID NO: 32516 - DNA, 101 bp, rice(Oryza sativa)
  misc_feature (71): n=t or c
atagggcagcagcgctatccgtacgtacgttcaggttcagggaccctgcttactgcgcgcatgcatgatanagccgtccggaccaacacagcacgagccat

SEQ ID NO: 32517 - DNA, 101 bp, rice(Oryza sativa)
  misc_feature (71): n=a or g
aaaattgaaacaaatccgtcccacgcattgcattgggatgtgtaatccgggtttccatatgcatggttatnggaatgtgccatgtgtctgctattgctata

SEQ ID NO: 32518 - DNA, 101 bp, rice(Oryza sativa)
  misc_feature (71): n=a or c
cgattgtatctcggtgtgaaaggatcagagactcacttaggcggagcttgttcctgattgagaacatggtnccaccagcactagctaatcaggttagttca

SEQ ID NO: 32519 - DNA, 101 bp, rice(Oryza sativa)
  misc_feature (71): n=t or c
gcttaattagtataaggtgtaaacagatagatttgttacataggggctgttcagattatatcattttcaancataatatttttttcggtaaagttacttaa

SEQ ID NO: 32520 - DNA, 101 bp, rice(Oryza sativa)
  misc_feature (71): n=a or g
cttcaaatatttgtccatctcttttctcctattcagcacatcagtcttctcttcgctcacaagaacagatnggaactcccagagcccagcgagcaggccct

SEQ ID NO: 32521 - DNA, 101 bp, rice(Oryza sativa)
  misc_feature (71): n=a or g
cgcagatgaccaaatccacactagggcgtgtgggatggagggaatactaagattcatcatcatattttacnttgtttatttctcgattacactgaatggaa

SEQ ID NO: 32522 - DNA, 101 bp, rice(Oryza sativa)
  misc_feature (71): n=t or c
atgcgcaaataaatataaatggagagatagtagtgcatatgaggcatgcaacccaacattaacaccgtagnggactcatagaaaactaagtgtgatgcagt

SEQ ID NO: 32523 - DNA, 101 bp, rice(Oryza sativa)
  misc_feature (71): n=a or g
gacggcaacgctgtatcattgtcctagatcgatgcccttatccactgttttggccagtttcaaaaaaaaangaaaaaaaaaacactgtgtggcccctccac

SEQ ID NO: 32524 - DNA, 101 bp, rice(Oryza sativa)
  misc_feature (71): n=a or c
cattagtgcatgtgtccatgtccacaaccatttacacaacaacacataatgtcttggtttgttattagctngaaaatattagggatgatgtatgtattgag

SEQ ID NO: 32525 - DNA, 101 bp, rice(Oryza sativa)
  misc_feature (71): n=t or c
ctctggactccggtggccaggccaatggatttgccgccacaagcttggtggcaactagatctaaccgtcangagatcggcagtaacgatgacgggtgctag

SEQ ID NO: 32526 - DNA, 101 bp, rice(Oryza sativa)
  misc_feature (71): n=t or c
ggacggcagctcgggctctgtccagagctggaagatgaacagtagtagagggaggaacagtagacttttcnggctgggctgagaggagaggaggcggctca

SEQ ID NO: 32527 - DNA, 101 bp, rice(Oryza sativa)
  misc_feature (71): n=t or c
aaaagaaaaatatgctgtatcatttgtttcatgaaagggcatacgagcctataaatacagccatccactgnctttcgaggtgcgcaacacaagctatagcc

SEQ ID NO: 32528 - DNA, 101 bp, rice(Oryza sativa)
  misc_feature (71): n=t or g
gtcgactcaacgccacaatccaacggcaccagcggagagaatatacacgcaaggggaaggatccttgtttnacaaactgtgatttggatgtacattattac

SEQ ID NO: 32529 - DNA, 101 bp, rice(Oryza sativa)
  misc_feature (71): n=t or c
tttaacattgaccaaaagaatgtagtatccaactatgcatttactaccgctacttcttcttctgtgtcctngtcctcgttgttttcctcttcttcctcctc

SEQ ID NO: 32530 - DNA, 101 bp, rice(Oryza sativa)
  misc_feature (71): n=a or g
ggaaaggaaagtgaagagagtttttttagactgttcggattgttgttgtttttttttaggaagtaggcccngggaagtaagaacaagtttaatagtacagt

SEQ ID NO: 32531 - DNA, 101 bp, rice(Oryza sativa)
  misc_feature (71): n=t or c
tgtccaccgacttagagccactctgtctcgcacagtaaaattcctgtgttaggcctgatttagttcccaantttttctttaaatttctaattttttcatca

SEQ ID NO: 32532 - DNA, 101 bp, rice(Oryza sativa)
  misc_feature (71): n=t or c
aaattactagcttgcaaggacagccgacgaatcttcctaggagaagattcataccctttatcatcaatcgngataacaaagttgatttgtgctgatagaga

SEQ ID NO: 32533 - DNA, 101 bp, rice(Oryza sativa)
  misc_feature (71): n=t or c
tcagcttcgagcatgacaagctgcaatacgtgtttcccatcgttgcagctgcactgcacctttgcacaccnctctctctctctctctctctctctctctac

SEQ ID NO: 32534 - DNA, 101 bp, rice(Oryza sativa)
  misc_feature (71): n=a or g
attattagaatttagcaggggttgcgttggtaatggcgtatttgctatgttgcctctttaaatttcgacantgaaaaacttggtaatgttaaaaataacaa

SEQ ID NO: 32535 - DNA, 101 bp, rice(Oryza sativa)
  misc_feature (71): n=a or g
tgagcttgagctgaactatttcagggatctatcctttaacaacctgagtggtccagcaccagtttttagcncgaatagtgtattgtaagtgatttagaatg

SEQ ID NO: 32536 - DNA, 101 bp, rice(Oryza sativa)
  misc_feature (71): n=t or c
gataagaggaaaaaatatgttcttaatacagaagtgtgcaacaaaaaggatttatacactgttacaccacngtcgacgctgccctgcggatagtcgcctcc

SEQ ID NO: 32537 - DNA, 101 bp, rice(Oryza sativa)
  misc_feature (71): n=a or g
ggcgatgtcagcattaacgacatactgctggatcatgtctcttcgtccctggtaaagattgctggctatgngacatcagggctccctgacatcgacaaggc

SEQ ID NO: 32538 - DNA, 101 bp, rice(Oryza sativa)
  misc_feature (71): n=a or g
agtggcgatgaaggaaacaaatctgacaacggtggtgctcgggagctccaagagaaaggtggcaacgacantgccccgtgcgaatgaaggcagctacgtgg

SEQ ID NO: 32539 - DNA, 101 bp, rice(Oryza sativa)
  misc_feature (71): n=t or c
acctccccctacccaccctgaccctaactcgagaccctaattcgtaggtctctaccaaaatttaaggtgtngcaagtgttggagaagacgagtagatcact

SEQ ID NO: 32540 - DNA, 101 bp, rice(Oryza sativa)
  misc_feature (71): n=a or g
tcaccatttgttacatgtagatgaagttgtccatggtgacatctctgcattagcgcacaccaacatgctantactatgtatgtatggcttgtgagaatgtg

SEQ ID NO: 32541 - DNA, 101 bp, rice(Oryza sativa)
  misc_feature (71): n=a or g
gcgatcaaggtgaaagttttaattaaccatgcctagcttcctggtattcatgaatggtattctatgctacnatagtccgaaggcctatggaacctgtttca

SEQ ID NO: 32542 - DNA, 101 bp, rice(Oryza sativa)
  misc_feature (71): n=t or g
gaacgcaaccagcaggaggatggtcatggctattgatactattatggtattattttgctcgcgcatatttncagtactgggaaagaacatgtttatgtgtg

SEQ ID NO: 32543 - DNA, 101 bp, rice(Oryza sativa)
  misc_feature (71): n=t or c
aattacaaacccaagggctaaagtttattacctgcatgttaattgaaggaaaaatatctgcctcgtactgnactgataacgtacagtggattgagaaaata

SEQ ID NO: 32544 - DNA, 101 bp, rice(Oryza sativa)
  misc_feature (71): n=a or g
aacggcagcatcatacaacgaaatctaaccaaaacatataatcacattccgaaatgctgaatagcagaggnaactagcataatcacaatccgttgctcaat

SEQ ID NO: 32545 - DNA, 101 bp, rice(Oryza sativa)
  misc_feature (71): n=t or c
tctcgcgcgtgttgaaatagccccccctgcgttccccatccaaccctatttcgatttggccaccatgtcgnggcaggcacggaaggaggcggcggcggcgg

SEQ ID NO: 32546 - DNA, 101 bp, rice(Oryza sativa)
  misc_feature (71): n=a or g
gcgttgacattgtcacaatagaccactgtagctttggagggaggtgaatgtaactcattcaggagttggcngagccaacaggtttcagccacggctctgta

SEQ ID NO: 32547 - DNA, 101 bp, rice(Oryza sativa)
  misc_feature (71): n=a or g
aaacattagagtacaaaagcaacaaacctgagctgcattattgggaggtctgtactcaacagctggtgacnatggttccaaggatgcgttacctaaaaaaa

SEQ ID NO: 32548 - DNA, 101 bp, rice(Oryza sativa)
  misc_feature (71): n=t or g
tgtgagcctactccatcagagctcggcagctcgcagagaaaacgaatgctggagtactcgtgaaaacgtcnagccccatcatttcacatataggagaaaaa

SEQ ID NO: 32549 - DNA, 101 bp, rice(Oryza sativa)
  misc_feature (71): n=t or c
acacatttggacgggaagtttttcaacgatccgatcaagtttgatcctactaggtttgacaaccagtcttngatcccaccttattgctttgtgccatttgg

SEQ ID NO: 32550 - DNA, 101 bp, rice(Oryza sativa)
  misc_feature (71): n=a or g
tgaagtctggttattatcagataaggatggctgaaaaggatgttcacaaaactgcttttaggacacatacngggcattatgaatatcaggtgatgcctttt

SEQ ID NO: 32551 - DNA, 101 bp, rice(Oryza sativa)
  misc_feature (71): n=t or c
tagaacagtgacaaagttctcttccatggacttgaccacaatgaaatcatgtattactgggtgaagtgtgnagcagcttggggtgccattatgtctcagat

SEQ ID NO: 32552 - DNA, 101 bp, rice(Oryza sativa)
  misc_feature (71): n=a or g
ggcactcaccgttcgttctgaaagacttccaactggacgattcatagctaaaagttactccctccgtttcnaaatgtttgacgccgttaactttgtagcat

SEQ ID NO: 32553 - DNA, 101 bp, rice(Oryza sativa)
  misc_feature (71): n=a or g
ttggtgaaatgccatgatttcaaggcagctcgaagtcagatttcgagggggatttcaaacggctttcaatnaaatcaattttaaaacagtaaatttgatca

SEQ ID NO: 32554 - DNA, 101 bp, rice(Oryza sativa)
  misc_feature (71): n=a or g
ttttatcatgtccagtatgcatagaagaacgctaggatctgtgcctttttctgaaaggagtgcttgaagtntttggcccatagatcgcctgaactcagaag

SEQ ID NO: 32555 - DNA, 101 bp, rice(Oryza sativa)
  misc_feature (71): n=a or g
ttgaggacgtgggaagaagaaaacaatggcgcttccaaagagacccagcccaagtcaaacgacgcgggccncaatcctggaaattgcacctattgtggaaa

SEQ ID NO: 32556 - DNA, 101 bp, rice(Oryza sativa)
  misc_feature (71): n=t or c
gctcttattgaatacacatcagggtgatattcctcatcaaataggccttgaaacctctccttgactctganagcaaggttgtatagctcttcctccccttc

SEQ ID NO: 32557 - DNA, 101 bp, rice(Oryza sativa)
  misc_feature (71): n=a or c
tttattaaaaatcctatgtttagaaggagaccggaaagttgacttaagtctcctctgtgctgtttggattncaatgaaacacataatttgaaaaaaaaaag

SEQ ID NO: 32558 - DNA, 101 bp, rice(Oryza sativa)
  misc_feature (71): n=a or g
gcgaaggcccacggcggccggcggcgagaaggaaagctttagggttcgggaggaaagagggatccaaatcnagctcaaatccgacactttccaagcgattt

SEQ ID NO: 32559 - DNA, 101 bp, rice(Oryza sativa)
  misc_feature (71): n=a or g
ggccttatggccatctatagtcgagaccttaatgtggatcttggttggggttggtctaagtgtcgtttctntaagtatatttttgcctattatctttacga

SEQ ID NO: 32560 - DNA, 101 bp, rice(Oryza sativa)
  misc_feature (71): n=t or c
gagaaggcgcttgaagcccgaatacagggtccacggaggcgtgtctcttggcgtcgtcgtcgtatggaaantatattgcaattttgtttgttcttgtcagt

SEQ ID NO: 32561 - DNA, 101 bp, rice(Oryza sativa)
  misc_feature (71): n=t or c
gatctctcttttggagaatgaggctttaactcaggatttcactgaaaaggaaattaagaaggctatttttnagatggaacataataaagcgtcgggtcctg

SEQ ID NO: 32562 - DNA, 101 bp, rice(Oryza sativa)
  misc_feature (71): n=a or g
atatgatacattgatatttgtctttttggttcagggggagagaaaaatgtcagtccttgttgggatcacantattattcgttgttcatgtatttggagttt

SEQ ID NO: 32563 - DNA, 101 bp, rice(Oryza sativa)
  misc_feature (71): n=a or g
gtttaacctcctcgatgttattcgagatgactccgatcatgatgaccaattcattattggcgcaatatacnagcatgtgccacctcttggcgagcccgctc

SEQ ID NO: 32564 - DNA, 101 bp, rice(Oryza sativa)
  misc_feature (71): n=t or c
agaaatactgttggtctcactattcggtatttcgtggttctcaagatccttcagtggaagtatgcgtgacntgagatccccacctgcttcagacatctggt

SEQ ID NO: 32565 - DNA, 101 bp, rice(Oryza sativa)
  misc_feature (71): n=t or c
ccgtcacccccggcatagaattagcgcccctgttgccgccgccggagatgacacgttgctcctacaagtgnggtggcggctgtgttggtgacggtggcggc

SEQ ID NO: 32566 - DNA, 101 bp, rice(Oryza sativa)
  misc_feature (71): n=t or c
tcgtcctcatggacggtgacttttttgctgaccaattgctgccgctggtgggggtaatgccagtgtggagngaagtttccaggccgacaacgatgagacca

SEQ ID NO: 32567 - DNA, 101 bp, rice(Oryza sativa)
  misc_feature (71): n=t or c
atcaccatcaaatatataatcaccagcatccacaacaagttttctacctcatgatcaggtacaatctcaanaaaagacgagtaatcatcaatttcattcag

SEQ ID NO: 32568 - DNA, 101 bp, rice(Oryza sativa)
  misc_feature (71): n=t or c
taggttagaaaaaatccacaaaaaaaaagatattcgatggcagctgctatagaaggaaatctgatgcgggngctgggagaggctccgtcgccgcagatgca

SEQ ID NO: 32569 - DNA, 101 bp, rice(Oryza sativa)
  misc_feature (71): n=t or c
gttgcgacttaggacaggttgactgggggattgggtagagcagccaagcagctctagggttagggatttanggtttttgttgggccgagaaaatgggccaa

SEQ ID NO: 32570 - DNA, 101 bp, rice(Oryza sativa)
  misc_feature (71): n=t or c
atcctgccctatatatgtgtataagctgaggaattctgttcgattttttgacctacacgtggataggtacnggagtcgtacgctgagccttattcaagctt

SEQ ID NO: 32571 - DNA, 101 bp, rice(Oryza sativa)
  misc_feature (71): n=t or c
tgaaataacacaaatagcgaaaaatagctaggtcaacataaaagatttgccatcagatcaagcttaccagnatctggaagtccttcttttgtcaagacaaa

SEQ ID NO: 32572 - DNA, 101 bp, rice(Oryza sativa)
  misc_feature (71): n=t or c
tgctacaggacgagtgaccacattacgattgtcgttgctgcgattaccagtgttgttcttgtagagctggngttgagggcgagcaactgaagagaatcctc

SEQ ID NO: 32573 - DNA, 101 bp, rice(Oryza sativa)
  misc_feature (71): n=a or g
ccggcagcggcagctttgactgggcgcctatcgactggatgtaactaagtgagtgtagaatcgaaccacancaactaagccaaccagagaggggtgaatgg

SEQ ID NO: 32574 - DNA, 101 bp, rice(Oryza sativa)
  misc_feature (71): n=a or g
tcgcaagactcttttgatttgatacatctctatcttgagtgtgtgaaggagcctcaacgcagagcagggangacttccaagcattataccccctagctctg

SEQ ID NO: 32575 - DNA, 101 bp, rice(Oryza sativa)
  misc_feature (71): n=a or g
ggctgtggaacttggtctaggcatttgtctgtcgatattggccagttcactacggcacagagtacttggantagatgcttagtggattcttgttcagttgt

SEQ ID NO: 32576 - DNA, 101 bp, rice(Oryza sativa)
  misc_feature (71): n=a or g
agtattatgcaatgattggtgatacgagctagccaccgatgcgtccacagactacagtattgtgaattgtncgtgttattatttgtgtgtgccatctgttg

SEQ ID NO: 32577 - DNA, 101 bp, rice(Oryza sativa)
  misc_feature (71): n=t or g
aggtgaagcatcaaaattatttgatgagatggcagagaggaacgtagtgagttggaacactatgatcatgncccatgccgtgcatggtcagtctgaagaag

SEQ ID NO: 32578 - DNA, 101 bp, rice(Oryza sativa)
  misc_feature (71): n=a or g
atctgatgcttcatttttctattggtctcagtgatgtcttcaaatgattccgttagcatggttttcaaatncatgctaaagggtgctgcagatttccttgt

SEQ ID NO: 32579 - DNA, 101 bp, rice(Oryza sativa)
  misc_feature (71): n=t or c
agatcatcatagctaagggataatatcctctgcatctcttcgacacttggatctttttccagtgtcgaacnaattgaattatgtaccctctcccattcttc

SEQ ID NO: 32580 - DNA, 101 bp, rice(Oryza sativa)
  misc_feature (71): n=t or c
gcttgccggccacttagacatgataaggtgccatcctccgttgctttgtctagtacttgaagaattgggtngatcgttaggattaaaaggagaagtgacat

SEQ ID NO: 32581 - DNA, 101 bp, rice(Oryza sativa)
  misc_feature (71): n=t or c
tttgtcttggcagccaacgagcaccgccgacactggcacgacaggagggcaaggacatcgagcacgttgtngacgagacccagatcgacgaccagcaagag

SEQ ID NO: 32582 - DNA, 101 bp, rice(Oryza sativa)
  misc_feature (71): n=t or c
gtatgggtaatgggtgtactatcttttccatggacaaatatcttttctactgtttgctggctctctctctnttttttttcaccactaataactgattatac

SEQ ID NO: 32583 - DNA, 101 bp, rice(Oryza sativa)
  misc_feature (71): n=t or c
tgaggaggaggaggagccccagacggtccaccgtggcaacgtcatagaggagcaggagcagctcaatgagnagcggcggcatgggggcgaggacggcgatg

SEQ ID NO: 32584 - DNA, 101 bp, rice(Oryza sativa)
  misc_feature (71): n=t or g
ttttttgagctaccctgcaaattagttccaatatccttgctggtgtgattcacctcataagcatttttttngggcttttagcaaccttgcaaattaattca

SEQ ID NO: 32585 - DNA, 101 bp, rice(Oryza sativa)
  misc_feature (71): n=t or c
gtctgcaagttaggtagcaggtgactgaaacctactgagctgctgttgttcatcatgaagtctggctcttnagcttttgctaatcttagtcctctcaatgc

SEQ ID NO: 32586 - DNA, 101 bp, rice(Oryza sativa)
  misc_feature (71): n=t or c
atgtggttacagtgatgagcgaaagtgtcaagcaaagaaatatgtgcagcaagaaaacaacaaacatcccncagagttcagggtcaccctcaccaacgagc

SEQ ID NO: 32587 - DNA, 101 bp, rice(Oryza sativa)
  misc_feature (71): n=t or g
agagctcctaggggtgaagatgtgtagctcctagcttgtccagaacttgaggattgtctcagatgatctangttgttgaaggatgagtttgagctaccaag

SEQ ID NO: 32588 - DNA, 101 bp, rice(Oryza sativa)
  misc_feature (71): n=t or c
tggcagcttctgcgaacatattaagagactgctaaaatgtggcgtaagaacggagatgtttttttggtgtngacaaacaggaaggatgtacgtggaggctg

SEQ ID NO: 32589 - DNA, 101 bp, rice(Oryza sativa)
  misc_feature (71): n=t or c
tctaattaatttttagagatattttagttaaaaaaaactccgttgtctggacattgtttttcatttgccgngtaccaggatttttttcatttgccaacttt

SEQ ID NO: 32590 - DNA, 101 bp, rice(Oryza sativa)
  misc_feature (71): n=a or g
aaaatcgatttcacattcttccaaagccaacggtacttaacataatgcaaaatcaattaaatttctttctnggtgtagctcatcactgacgggttataatg

SEQ ID NO: 32591 - DNA, 101 bp, rice(Oryza sativa)
  misc_feature (71): n=t or c
aatttttttaatgaaatggataagttttttaataacatggatttacttaaatattaccgtagcgttagcgnggataaattactagtatacgtaaaaagaat

SEQ ID NO: 32592 - DNA, 101 bp, rice(Oryza sativa)
  misc_feature (71): n=t or c
ttaacctggagaagcttacaaattactggaagaaaacagaagcataatgggtgttggattgcatactgctnaccaagccataatggaacttctatttcaga

SEQ ID NO: 32593 - DNA, 101 bp, rice(Oryza sativa)
  misc_feature (71): n=t or c
ccgccgagctcgctcgccgcggctattttcaggggcagcgtgcatgcaattgagcctctcctcgtcgtcgncgtcgtctgtaattcccttttttttatatt

SEQ ID NO: 32594 - DNA, 101 bp, rice(Oryza sativa)
  misc_feature (71): n=t or c
gtaaaactagggaaacaggtatgtaaaaactatccaagtagtcctaggactatgtttctccttctttatcnggaacaccttctatatataagctgacttga

SEQ ID NO: 32595 - DNA, 101 bp, rice(Oryza sativa)
  misc_feature (71): n=a or c
cttgatccatgtcatcgtccagttcgacattgataacgtgtgtgacacactgcaatctttagcgggactanagatatttttttcctttttttcaatgtttt

SEQ ID NO: 32596 - DNA, 101 bp, rice(Oryza sativa)
  misc_feature (71): n=t or c
gaccgcacgggataatcaattatcacgtgcggtccgcccgtccgaacgcaaaaatatggattttcgtaganacctgggtgtagacgggcaggtcctctgca

SEQ ID NO: 32597 - DNA, 101 bp, rice(Oryza sativa)
  misc_feature (71): n=a or g
aaaaattgatgactggactgtcacgtgtgctatttgaagcctaatccactcgcaactgtgctcagggggtnttttgtccggtattaaaagttcaaggtgag

SEQ ID NO: 32598 - DNA, 101 bp, rice(Oryza sativa)
  misc_feature (71): n=a or g
tcaccctatctaatgggtagatccacccctggtgtctttagaaagcagtagttgtataatttcgtgatggngtattgtttttaccaacttactgatttttt

SEQ ID NO: 32599 - DNA, 101 bp, rice(Oryza sativa)
  misc_feature (71): n=a or g
agaccccgactgaggggaaaccaaagaggcaaagaggaggaaaaccggagaaagaaaacgagagttgagtngaggttcgctatgaagagggggggccatcg

SEQ ID NO: 32600 - DNA, 101 bp, rice(Oryza sativa)
  misc_feature (71): n=a or g
cggtcgaggttgtctgccctaaaaccaactctgggcgtgtcccattattccacgtgatcggactctaattnagaagctcatatagcccttgtttagttccc

SEQ ID NO: 32601 - DNA, 101 bp, rice(Oryza sativa)
  misc_feature (71): n=a or c
aagcaaacggtgttaataaaaggaaaaagagacgtttatacccttctcatttgacctagtttctatctacncagacttcacacgccggcgagctcccatgc

SEQ ID NO: 32602 - DNA, 101 bp, rice(Oryza sativa)
  misc_feature (71): n=a or g
gagtcataagtctactataatcttatgtggagcagagaggtaatcaaaagtcaagggtgttggctctcatncaagagctaacttaacacaaactccaagat

SEQ ID NO: 32603 - DNA, 101 bp, rice(Oryza sativa)
  misc_feature (71): n=t or g
atccggttaactgaatgtgatgaggcaaaaagagcttttagaactcaccatgggcactatgagttcagagngatgccttttggtctgacaaatgccccagc

SEQ ID NO: 32604 - DNA, 101 bp, rice(Oryza sativa)
  misc_feature (71): n=a or g
cacacaagttttccgcaccccgcaacagaatgcggtcgctgcgattacacttttggatacccttctaacancggcgccgccggacaacgtcgccaacatac

SEQ ID NO: 32605 - DNA, 101 bp, rice(Oryza sativa)
  misc_feature (71): n=a or g
ttagggacgacgtgtggcatacaaatccaatcatcgtggtaggaatagatttgaggatattcaaatcaatntacgataaataaatacgtcgatcgtttgta

SEQ ID NO: 32606 - DNA, 101 bp, rice(Oryza sativa)
  misc_feature (71): n=t or g
tcggatactagaaattggccttggcaacaaactcttggtcatcttaattgggtctgtaaaaacatcgtccngggtatctgtggtgttagacacttgatcag

SEQ ID NO: 32607 - DNA, 101 bp, rice(Oryza sativa)
  misc_feature (71): n=t or g
caaaataagggttacaaaaggtgaactgtgggagcatgtgccgttttctaattctagatagagcccgaggnaaacacatacgtggcggccggtggccgcat

SEQ ID NO: 32608 - DNA, 101 bp, rice(Oryza sativa)
  misc_feature (71): n=a or c
cagcccccctctcgatcgcccttgccttttgagatcgatcaccaggttactgtagaagtacagatcggagngagcgatcgatcgaggaagaagaagaggta

SEQ ID NO: 32609 - DNA, 101 bp, rice(Oryza sativa)
  misc_feature (71): n=t or c
atggagtccatttccttcttcacgagtcgtgtctttccagaatgcgccttcctctgttcttcaacctatgnggttgggccatctctcccgacatgacacag

SEQ ID NO: 32610 - DNA, 101 bp, rice(Oryza sativa)
  misc_feature (71): n=t or c
ggaaaattaaggcccaaacttgcagaaagagacgtaaattctagcgtcctgaatgatctcatttgtggaangtgggatgcagagccttcgaaaaggccttc

SEQ ID NO: 32611 - DNA, 101 bp, rice(Oryza sativa)
  misc_feature (71): n=a or c
acaattcgtgcccttcggaatattggtgcttcaagggcaaaggatacttccgttgataatattgagtctgntgattccaacacaccctcaaggcgacttat

SEQ ID NO: 32612 - DNA, 101 bp, rice(Oryza sativa)
  misc_feature (71): n=a or g
gatgtcgtccatggaccagcggtttgttctaagatatagctttgtgttgttctctcttctagccgaccgtngaggaggagctcaacgtggcacgcgccgcg

SEQ ID NO: 32613 - DNA, 101 bp, rice(Oryza sativa)
  misc_feature (71): n=t or c
attaaatctaagtgttgagatattaattgttagtaagagcttagatagtttttttcccaaatacatactcnctccatctacttttgatagtcatatttcat

SEQ ID NO: 32614 - DNA, 101 bp, rice(Oryza sativa)
  misc_feature (71): n=t or c
tcctttgccaacttaaacatctcaactagagcatcagcaaccaaattgaaaaacaatggtgacaaaggtcntgaaaaaacctcctaccttgccatttatat

SEQ ID NO: 32615 - DNA, 101 bp, rice(Oryza sativa)
  misc_feature (71): n=a or g
ggcatcagagaacaacttaatgcttcaacaccagaaattagcccatgcaacgatgccaaaaatgctccaanatgtgcgcaggatgaaactgtcatgactca

SEQ ID NO: 32616 - DNA, 101 bp, rice(Oryza sativa)
  misc_feature (71): n=t or g
cattctgcactagtttttctacaagttggtcacaatgatgtgatcagcctattttaaggtgtgaaggatcnccatattgaattgtgacatttccctaacat

SEQ ID NO: 32617 - DNA, 101 bp, rice(Oryza sativa)
  misc_feature (71): n=a or c
agatgatgagcggcaagattatttcggaggagcagcgtctagtggagttggagttggagttggaagatgangaggaggtggaagatgaggagttggccgag

SEQ ID NO: 32618 - DNA, 101 bp, rice(Oryza sativa)
  misc_feature (71): n=a or c
cgtgaaagccctgaggcgcgcacggagggggattttatttttattttcctgtaaagataaatctaacgatntaaaataatgagtctaccaatttaaatgaa

SEQ ID NO: 32619 - DNA, 101 bp, rice(Oryza sativa)
  misc_feature (71): n=a or g
ttgaaagctgcctcggcattcatgttcttcctggtgcaacccgagcacatggccaagccgaccacgaccgncgctgtccctgcgtacgcagcatgcgccaa

SEQ ID NO: 32620 - DNA, 101 bp, rice(Oryza sativa)
  misc_feature (71): n=t or c
ctcggcctccgcggcgacctcctgcgtcttgccatcatacaggcatacacacatttacacgaaattcattngccaagttctttttttcttctttcacctga

SEQ ID NO: 32621 - DNA, 101 bp, rice(Oryza sativa)
  misc_feature (71): n=t or c
cgatttttggatctcttaccattaccttcagtagcatgccgtgcctcattagatgatgcagctaattgatnggactcagacatttctaactcatgacttag

SEQ ID NO: 32622 - DNA, 101 bp, rice(Oryza sativa)
  misc_feature (71): n=a or c
ggacgagagaacgggccagcttctgcacaaagctccttgcactcaccaaaaggtcattcgtaaatatgcanagggatatggggtactactggatgcgtttt

SEQ ID NO: 32623 - DNA, 101 bp, rice(Oryza sativa)
  misc_feature (71): n=a or g
ttcagcttcaactcgtgcaatacagagaaagcaaccacataccatccatcagttagttcaatctttgtagncatgttccttttagcaggtctcaagctttt

SEQ ID NO: 32624 - DNA, 101 bp, rice(Oryza sativa)
  misc_feature (71): n=a or g
cgcgcggccgctgcccaagcatcacgaatataggcaactgccgaccagagctgccccctaccatcgccacncgcatcgctgatctactccgcgtctctacc

SEQ ID NO: 32625 - DNA, 101 bp, rice(Oryza sativa)
  misc_feature (71): n=t or g
catcatgcttgaagccaagaatattttgaatgaagcgaaagacttaccctagtatagagccagtgagagtngggacttatataggaaaccctaaatctgcc

SEQ ID NO: 32626 - DNA, 101 bp, rice(Oryza sativa)
  misc_feature (71): n=t or c
tcttcaattgccctttaatcccttttaaagaggtattaaccgaacaggaccttagcgggaatgctagaaanggaatccatgcccatcaccttcccaatgtg

SEQ ID NO: 32627 - DNA, 101 bp, rice(Oryza sativa)
  misc_feature (71): n=a or g
ccccaggtgtttcgcccccgccataacccatgttctgtcctcctccttaattttggctatcggactattcnccgggagctcctgatgctaaaagactctac

SEQ ID NO: 32628 - DNA, 101 bp, rice(Oryza sativa)
  misc_feature (71): n=t or c
tcagcattctgggggttcgtcttggagaactggaccaaagccacagaaaatcttctctctgcatgtgtcanaaaggttcctgttttcaatgaaagcaagat

SEQ ID NO: 32629 - DNA, 101 bp, rice(Oryza sativa)
  misc_feature (71): n=t or c
ttgaagaacacgaggagtttgttgaatcggcggcgaaagggttcgaatctggatctgtgcggttttcaggntagacctagcaaaaagtcgatgagttccct

SEQ ID NO: 32630 - DNA, 101 bp, rice(Oryza sativa)
  misc_feature (71): n=t or c
tgtctgagactatgccccaagaatatgctcctacaagcatacctacaaaaacaacacttgtgatgagagantctgcctgcgcagaaagctcccattcagct

SEQ ID NO: 32631 - DNA, 101 bp, rice(Oryza sativa)
  misc_feature (71): n=a or c
gacttcattgtcattctgctgatctttgtacatttgcaatgagaaaagagactcatgggactcctgcttgntatcttcagtgtacagttcatccttgtcta

SEQ ID NO: 32632 - DNA, 101 bp, rice(Oryza sativa)
  misc_feature (71): n=a or g
agctaaaccttttgagcccatttcaatagaagttgaggtcggtgtatccatatgggttgatatcggtgtanccatatgagtagggcagcaattcttcgatg

SEQ ID NO: 32633 - DNA, 101 bp, rice(Oryza sativa)
  misc_feature (71): n=t or g
tgaccccggtctgatctatgacattgatgatgcacaatacatttcatatctctgtggcctgggttacacanatgttcaagttgagataattgcaaatcaga

SEQ ID NO: 32634 - DNA, 101 bp, rice(Oryza sativa)
  misc_feature (71): n=t or c
gggttgatgtaggacgggctcttggagggtggtggaggaggccttgtagaggcctgagatccacaattcgngaatcgcaaggcggcagaagtggcagagcc

SEQ ID NO: 32635 - DNA, 101 bp, rice(Oryza sativa)
  misc_feature (71): n=a or g
ccttgcccgcagctttccaagaacaaggaggcaccgcaacaatgcattcaagcaagtgtttccttgattcnatatccctctgataacacagccatgcccgt

SEQ ID NO: 32636 - DNA, 101 bp, rice(Oryza sativa)
  misc_feature (71): n=t or c
caagggcaaaatagcaaagtctaaaaaagagggataaaattacaattgcaatcgaaagtaaaggtaagaanacaattgccccttaataaaattaaaacata

SEQ ID NO: 32637 - DNA, 101 bp, rice(Oryza sativa)
  misc_feature (71): n=t or c
gtgtgcagaagtgataaaccggttttgctattttaagaagtataaacacaccatatcactggtggagaaancatctttggtcggtcgaccaaattccacaa

SEQ ID NO: 32638 - DNA, 101 bp, rice(Oryza sativa)
  misc_feature (71): n=t or c
gaattgccatgcaatgcaggtgcgtctcttctgattgtggtgttcaacgagttacagcgagttgaattacngctaattttgtttggaaggcaagaattatt

SEQ ID NO: 32639 - DNA, 101 bp, rice(Oryza sativa)
  misc_feature (71): n=a or c
tatcatgggcggtgggtgtaaggggagtgacataggtgcattacaaacccacgataggaaccgccatcttngtcgccttgtggctgcggacttctcacttg

SEQ ID NO: 32640 - DNA, 101 bp, rice(Oryza sativa)
  misc_feature (71): n=a or g
acatttgtaccagtgattgtttaacctgagatatgtcacataatggccagcttctagcttaccactatgcntgatcaccgcaaatatttcaaattctgatg

SEQ ID NO: 32641 - DNA, 101 bp, rice(Oryza sativa)
  misc_feature (71): n=t or g
gacacaactgagaatacaaagataatgcacccggtttttttcaagctacactatcgaattatttccgcggnttttttttatttactatacgtcttgaaaaa

SEQ ID NO: 32642 - DNA, 101 bp, rice(Oryza sativa)
  misc_feature (71): n=a or c
ctcaataccgtcgaaaacaacctcctcaactgttttgattgtggtttttgctaacgtgacaaccatgtggnggcctagtcatcatgatattaacagtagag

SEQ ID NO: 32643 - DNA, 101 bp, rice(Oryza sativa)
  misc_feature (71): n=a or c
aacaacagtcttacaggggatatcccaactgcgttgatgaacacgccgatgctacaattaggaaagaatgntgcccagttggacccaaatttccttgaatt

SEQ ID NO: 32644 - DNA, 101 bp, rice(Oryza sativa)
  misc_feature (71): n=a or g
ttcatcctactgcataggcaagatctcatccttcggcgtcgagtcatggagacttgactttgcttgtcacncttttctttcgcagctctttagtagcatcc

SEQ ID NO: 32645 - DNA, 101 bp, rice(Oryza sativa)
  misc_feature (71): n=t or g
ggaatgatgtgcgctagctcgcaggtcgctcgctcgctcgatcgatccagctgcttcttctgtccattcgngcgtgcgcgcgcgcatgattgaattgaccc

SEQ ID NO: 32646 - DNA, 101 bp, rice(Oryza sativa)
  misc_feature (71): n=t or c
tcgaagacatgcaaccgtaggtcaatgaaataaatatatgctcatgcactgttgccatcgataatttagtngtatgcatagaaattacattttatccatgg

SEQ ID NO: 32647 - DNA, 101 bp, rice(Oryza sativa)
  misc_feature (71): n=t or c
gcttcagatggtggctacctgcccgcctgcctgccattggtgtcgcactaacttcaccagtttagggttanagttacttaaaaaaaattggaagtttgaag

SEQ ID NO: 32648 - DNA, 101 bp, rice(Oryza sativa)
  misc_feature (71): n=t or c
ctgtgcgaacgtcccggatccgctggtctttgctacgaggggctagcatttcctcttcaagcagctacccncagcgatgttggcggctccttgattcgacc

SEQ ID NO: 32649 - DNA, 101 bp, rice(Oryza sativa)
  misc_feature (71): n=a or g
tctctttgtagtcctgaatttgacatacatcttgtagttttggcggggaactattggtgaagcaaatgaancctttgcaactcggcagccaaagggagaaa

SEQ ID NO: 32650 - DNA, 101 bp, rice(Oryza sativa)
  misc_feature (71): n=t or g
ttcagtcaatgtgtaggtgaaccacaaaaaatttcaaatggcattggcatataaacagctgggctgttgcncctcttcatcaaaaagtcaaaaatattctg

SEQ ID NO: 32651 - DNA, 101 bp, rice(Oryza sativa)
  misc_feature (71): n=a or g
cacatccgtgacacgttgtgtacccccatggaggatatcccagtggacatggtcggccacacgagcacganccccatggctcatcaccccacccacacggc

SEQ ID NO: 32652 - DNA, 101 bp, rice(Oryza sativa)
  misc_feature (71): n=t or c
ttcagcaccaacaataacatttggaaccggtatatcgataaactgtatgggctcgtagttccctttgatgntgcacagagttaatgtggttagtgaaacag

SEQ ID NO: 32653 - DNA, 101 bp, rice(Oryza sativa)
  misc_feature (71): n=a or g
gttcaatgtccctggcctctccatcgattgcttcatcccgcccaccgacatcaagtctggatccatcagcnagaccgtcgagcttcctcatggcgagaaga

SEQ ID NO: 32654 - DNA, 101 bp, rice(Oryza sativa)
  misc_feature (71): n=t or c
agctctatctgatcatcttcctccacatttttcttgtttcattttttccctcctggatctttctgctgttntttttgcaaaattttatttgctgtgttcat

SEQ ID NO: 32655 - DNA, 101 bp, rice(Oryza sativa)
  misc_feature (71): n=t or c
acttgccatatcggctaagtcatgctctgttccaaccgatacaatacccagctgttgacggacaacacganggattgggagatctgcataactccagtgta

SEQ ID NO: 32656 - DNA, 101 bp, rice(Oryza sativa)
  misc_feature (71): n=a or g
actcggattaatccctaccgtccatccgcgcgcacgaatttaccaccgcacgattccacacgcaaacttcnctcctcctccacacgcgaagacttcgctcc

SEQ ID NO: 32657 - DNA, 101 bp, rice(Oryza sativa)
  misc_feature (71): n=a or g
ttatattcaactcgtaaatctttatgcaatattgtaagcggatgggagaagccttggtaccgggtgaaccnccaatggctctgccctttgcagcaggaggg

SEQ ID NO: 32658 - DNA, 101 bp, rice(Oryza sativa)
  misc_feature (71): n=a or g
cttcgtttttacgaaaagaacagccaggtaatgtgttgaactcttgtcctgtttctgtcatctcttcatcncagccatgacttgattccaccatctgtact

SEQ ID NO: 32659 - DNA, 101 bp, rice(Oryza sativa)
  misc_feature (71): n=t or c
ttcatatatgcacctagaatctagaccattaaacgtgttccaagattcgcgcacatatataatgggttacnatgaagttatcagccataggaccattaatt

SEQ ID NO: 32660 - DNA, 101 bp, rice(Oryza sativa)
  misc_feature (71): n=t or g
cctcctgatatctgcgaccatcatcacgcaaggtgccggcgcaggactacttattcatccacaggattatngcatctcagctggcaagcgtgtcgtggaac

SEQ ID NO: 32661 - DNA, 101 bp, rice(Oryza sativa)
  misc_feature (71): n=t or c
gaagcaattagacccagaacaaggctccagggaggtattagcaagccaaaaatctacacagatggtacagnaaggtactcttgctttacttctactggtga

SEQ ID NO: 32662 - DNA, 101 bp, rice(Oryza sativa)
  misc_feature (71): n=t or c
ctataaacgtcctatctgctcttgccatctcatagaacatcaccatctaataacctgagaacgcacgaaanggggggggggggggggggcgattttaagac

SEQ ID NO: 32663 - DNA, 101 bp, rice(Oryza sativa)
  misc_feature (71): n=t or c
tctgaataactgtctctagactgggcaagggaaaaaaaaagtggttcagcaaacatggaacaaaaaaaagnatgtaatttatgtctcataaccttctgcgg

SEQ ID NO: 32664 - DNA, 101 bp, rice(Oryza sativa)
  misc_feature (71): n=a or g
cattttcaatgcatacaactgctccttcacaggtgatgaattccttgggtttgcaattttcaggaggatcngcagaagtattgtcaatagatgtagcttta

SEQ ID NO: 32665 - DNA, 101 bp, rice(Oryza sativa)
  misc_feature (71): n=t or g
ttttagttaatcggtgaggagcgtttttcacctttccgtaaacatgccacttacctcatgcaattcttttngcgaaacaaatgagaatttaacaacagaaa

SEQ ID NO: 32666 - DNA, 101 bp, rice(Oryza sativa)
  misc_feature (71): n=t or c
attgtaatgcaacaagttcatgacatgacagaaaataacggtaagagttaactaggaagtttagcgcacanggcaatcttgaaatgcagtcagtcaataat

SEQ ID NO: 32667 - DNA, 101 bp, rice(Oryza sativa)
  misc_feature (71): n=a or g
aggttgccccatttaatttcctgagaacctaaaagctctaaaccgcactccaaaccacttactccctccgnttttattttaattgacattttggacaatga

SEQ ID NO: 32668 - DNA, 101 bp, rice(Oryza sativa)
  misc_feature (71): n=a or g
cgactcggcttgaccgaactgggatgacacagcaatacactacatggcatgcggcaagacgtggcacggcnaggcaaggccgcctcgccgatatgggccgg

SEQ ID NO: 32669 - DNA, 101 bp, rice(Oryza sativa)
  misc_feature (71): n=t or c
tgtgccgccgcgccggctagtcacagcggcatgtgccactcacctgacccgtcaaccacgacgtcgagcanggcagggtcgtcggtgacgcacggcgagca

SEQ ID NO: 32670 - DNA, 101 bp, rice(Oryza sativa)
  misc_feature (71): n=a or g
tttaaaaactagatccatccctactgaagcccctaaatcatctcgaaattatttcatgccaagcccctcantcttaaggggctggcgactgtggatggatc

SEQ ID NO: 32671 - DNA, 101 bp, rice(Oryza sativa)
  misc_feature (71): n=t or c
gcagcttgaatcaattcatgccatcattttttgggcaccggaagcccataatttttgcaagatacataacnaattcaccactgtttgtccaggcggcataa

SEQ ID NO: 32672 - DNA, 101 bp, rice(Oryza sativa)
  misc_feature (71): n=a or g
tgtatacacctgaatcaacacgcttcgatcaatggatatgcatcttaaattaattaatttcacccaaattntattttgtatgcatatatatatgcatgcat

SEQ ID NO: 32673 - DNA, 101 bp, rice(Oryza sativa)
  misc_feature (71): n=t or g
ttttactggacgtggcgatgttgctgctgtgttgatcccacaacgatcgcttggagctcaacatcgtatcntcctctgcatgccctatattttttagaaca

SEQ ID NO: 32674 - DNA, 101 bp, rice(Oryza sativa)
  misc_feature (71): n=a or g
atgtttgccaccctaatgtggctctgctcgctaatggaggttcccaatcggaacagtatgcacggaaaacngagcggtctattagcacgtgattaattaag

SEQ ID NO: 32675 - DNA, 101 bp, rice(Oryza sativa)
  misc_feature (71): n=a or g
aaccattatatctacttttaaagaaaatcataagccgctcggtcttacatctcttaataattagaaaaaantatttgaaattttaggaacaaaacaaaaga

SEQ ID NO: 32676 - DNA, 101 bp, rice(Oryza sativa)
  misc_feature (71): n=a or g
caattaacgatgatccaatctgtgttcaactatactaacttgcggagccaataagcaaaacggcatatttncaaacgaaaaaaatttgtgagtaaaatttt

SEQ ID NO: 32677 - DNA, 101 bp, rice(Oryza sativa)
  misc_feature (71): n=a or c
ctctcagcagtaaaaggttcgaataactccattgattgtacttgacaattacctgaaagcaacgacatccnggaaacaactttcgatctgaaaagtggagt

SEQ ID NO: 32678 - DNA, 101 bp, rice(Oryza sativa)
  misc_feature (71): n=t or c
tcccaggcctcgtgtttttcgtcaacagataggttcttcagatatgcaacaatctcgttcctccaatcatncgcgtcaacatttgcaatcccaattaggca

SEQ ID NO: 32679 - DNA, 101 bp, rice(Oryza sativa)
  misc_feature (71): n=a or g
gctgcggttgccggcgattttggccgtgatcttggggcgcaggatgagacgtctcactccaagtccgcgtnatccaggggcacgcaataggagctttccaa

SEQ ID NO: 32680 - DNA, 101 bp, rice(Oryza sativa)
  misc_feature (71): n=a or c
cgtcctccgaattacttgatgttctttgatttctttgaacctccaaaccttgcggacaagatacatgttgnggagtggaacccttctgtgcagcaagtggt

SEQ ID NO: 32681 - DNA, 101 bp, rice(Oryza sativa)
  misc_feature (71): n=a or g
ttatctagaattcagaaacaacagtacaccaaaagcataaggactacgattatagcatttggagagaggcncaaaaatgttgttcattaagaaaagggtag

SEQ ID NO: 32682 - DNA, 101 bp, rice(Oryza sativa)
  misc_feature (71): n=a or c
ttgtcgtcagctacaattttaccagcaacagcaagcagaggatggcagtgttgcatttggagaggctgatntataccaacaacatgatagggcattgggaa

SEQ ID NO: 32683 - DNA, 101 bp, rice(Oryza sativa)
  misc_feature (71): n=a or g
ggttctcactagttcatgttctgttgcttatctgcatttgtcaggatgaatagtcctgatgttctttctgngtctgagaaagctacactaaatattcatgc

SEQ ID NO: 32684 - DNA, 101 bp, rice(Oryza sativa)
  misc_feature (71): n=t or g
tcaatggagaatgacaaaaaatatatccgtgaaaactcatataccatgctcatctctacacgtcatgtaangtatcttaactaattaaaaaattagtagtt

SEQ ID NO: 32685 - DNA, 101 bp, rice(Oryza sativa)
  misc_feature (71): n=a or g
ccaagctaactgcgcatacatatctacaagtttagggttcagggttcagagttcaaagttaatttacactngctcggttgcttgcttgggtgatgaaagtt

SEQ ID NO: 32686 - DNA, 101 bp, rice(Oryza sativa)
  misc_feature (71): n=t or c
ggacctcttctcaaggcaccttcttctaaatatccaaggtcaatgcttgatggaggagttgtggattgaanttgcgaagggacattcgcttctgcataagc

SEQ ID NO: 32687 - DNA, 101 bp, rice(Oryza sativa)
  misc_feature (71): n=a or g
cttaaggggaaaaggaccttgtatagatgcctcccagtttgagggtctacagcactgaaaggatcatcaancaggtagacatcagcatccttgtaaactgc

SEQ ID NO: 32688 - DNA, 101 bp, rice(Oryza sativa)
  misc_feature (71): n=t or c
catacacatgccactgatttcttatttgcaagtgttgcatttattgaccggttgccattgcatatgcgtgngtcgactatatattggacaccgatagttcg

SEQ ID NO: 32689 - DNA, 101 bp, rice(Oryza sativa)
  misc_feature (71): n=t or c
agtgcagctttgagaaatatctggatcaggaataacacttctaacagtagcttctctgaaactaccagtgntaggctggggttgcacctcattgcaggtat

SEQ ID NO: 32690 - DNA, 101 bp, rice(Oryza sativa)
  misc_feature (71): n=t or c
gttgccacactttcttagtactcggctagctatagtcagataatttataattgggttaattagatacatgncatgaaaattttgccggttttaaaatatgc

SEQ ID NO: 32691 - DNA, 101 bp, rice(Oryza sativa)
  misc_feature (71): n=a or g
attgcgcgcccatccactccggccgtccggcgagtgctgcttaaatgcgctccttctctttttcgccaagncgcaaaaggattacacgtaaatatattagc

SEQ ID NO: 32692 - DNA, 101 bp, rice(Oryza sativa)
  misc_feature (71): n=t or c
agttggctctgcaatggccatgacacgtctccaatgaccaacttgctacttgaacatgaggagctcattcngaatcgcgcactgcgttctgctattcagga

SEQ ID NO: 32693 - DNA, 101 bp, rice(Oryza sativa)
  misc_feature (71): n=t or c
actgggaaagtgcccccgactggaaatcagtcagcagaagttgagaccgatgctcaccaagagcgtccgantggagaccagccgggtgttgaaccaaataa

SEQ ID NO: 32694 - DNA, 101 bp, rice(Oryza sativa)
  misc_feature (71): n=a or g
acgaattttagagctctgtgagtagcgctggaatatggttttggggatttttccggtggtggtggcgattnagtcagtgaaggctcggcctggctgagaaa

SEQ ID NO: 32695 - DNA, 101 bp, rice(Oryza sativa)
  misc_feature (71): n=a or g
ttaattaacacacacgtaaacagatgattacatagcttatatagctagctagtcttcctcacatgcacatncgggagcgcctactccccaggtcatacgcg

SEQ ID NO: 32696 - DNA, 101 bp, rice(Oryza sativa)
  misc_feature (71): n=a or g
accactcgaatcctacagctctacagagtccaatcctggcaaatccaagatcggatctagggaggtctggntcatggtacaaccactcgaatcctacagct

SEQ ID NO: 32697 - DNA, 101 bp, rice(Oryza sativa)
  misc_feature (71): n=t or c
cttcgaatcaaatgagcaaatcagttcccacaagcaagggattttaattccccatgtttttcccttgaatngggcttttaatctcattgtattgctagatc

SEQ ID NO: 32698 - DNA, 101 bp, rice(Oryza sativa)
  misc_feature (71): n=a or g
catgctacctgcccttgcaactgtttagtgaagaattttagatatctactcggctaattccacacgaaacncaccttcctcttcattatatcatctccact

SEQ ID NO: 32699 - DNA, 101 bp, rice(Oryza sativa)
  misc_feature (71): n=a or g
cgcaaaaatgacagatgaagctcaacactataacgtcctctgcgttgcggaagaaatatgttaggttatcngagaaaacaataaggagataatcatgaaag

SEQ ID NO: 32700 - DNA, 101 bp, rice(Oryza sativa)
  misc_feature (71): n=t or c
aggtataaaaaaaatggtacctctgatatctcctcaaggacataaaattactcaagtttaatagtatagcnaactactaactccaaatcatcaatagtcaa

SEQ ID NO: 32701 - DNA, 101 bp, rice(Oryza sativa)
  misc_feature (71): n=a or c
gaccgagtttaacaacaaaaacacggagcacgacatggtacactcccaaaaaacatccccaaactattaantgcaaataataaatccccaaagtacaaaaa

SEQ ID NO: 32702 - DNA, 101 bp, rice(Oryza sativa)
  misc_feature (71): n=a or g
catcatagattgatcacaaaactttcacatcacatcatagagcacgaggtcaggatggattcgtgctcccnaaggaggcgtggatggccggtgctggatct

SEQ ID NO: 32703 - DNA, 101 bp, rice(Oryza sativa)
  misc_feature (71): n=t or g
caggtgtaatgccgatggccttggaaatggaatgtttctatgtgcggtttacatggtttgtgcctctattnttccgatcgtggctcttgcgactttcacag

SEQ ID NO: 32704 - DNA, 101 bp, rice(Oryza sativa)
  misc_feature (71): n=a or g
agggggaacagcaacaatgaacctgcatgctcatggacgatcagcacatgcctcatcaaatgtgaccattnccgtgacttctggaactgcaagtgctcatg

SEQ ID NO: 32705 - DNA, 101 bp, rice(Oryza sativa)
  misc_feature (71): n=t or c
aacatccaccagttgaagaaggacatcttgtgcatcttctcccgggggtcgaactcgtcgaactggtcggngccgatggtcgagatgttgggcttggtgcc

SEQ ID NO: 32706 - DNA, 101 bp, rice(Oryza sativa)
  misc_feature (71): n=a or g
ttagatcccaattcagagtcgatgtattttgaggagagatggagccaaaagtaccttgcctacgaggaagngcgggatgacgaaggcaggcactgtggaca

SEQ ID NO: 32707 - DNA, 101 bp, rice(Oryza sativa)
  misc_feature (71): n=a or g
gaaaaatacaacccctaggggtaaagaaaaagcaaaaaaacaaggaaagctgtacactatacaaactgcgngatgatctctccaagacgcttggcacctgc

SEQ ID NO: 32708 - DNA, 101 bp, rice(Oryza sativa)
  misc_feature (71): n=t or c
cagttggaggaacaggtgggtcatcaaccaaattagtagcaggaataggaagattctcctgcccaccaganatgtcatcacaaaccaacctagaaagtagc

SEQ ID NO: 32709 - DNA, 101 bp, rice(Oryza sativa)
  misc_feature (71): n=a or g
agatgaaagatcaatttgtagtaaaaagggagatagtatatgcatatacttcattttggtggcccagtggntcaatgcatgggttgttcttgattgataat

SEQ ID NO: 32710 - DNA, 101 bp, rice(Oryza sativa)
  misc_feature (71): n=a or c
atgttgtttggctagccccaacaccgtctccttctgctctggcactctggctcaattaattcttcccattncctgtatatattctttgtctctaaagcccc

SEQ ID NO: 32711 - DNA, 101 bp, rice(Oryza sativa)
  misc_feature (71): n=t or c
gtttcgactcatgtttaatttatacaggaggaagatgaagatgccatgttacttgccgcacagttttgcangtattctttctcatctatgatgctagatga

SEQ ID NO: 32712 - DNA, 101 bp, rice(Oryza sativa)
  misc_feature (71): n=t or g
atttctgaacccctgtcttaattgcaaacctgacgctgttatcttcttccagaagagcctgaagggttttnggagcttatggcacggaacctgcagaccgt

SEQ ID NO: 32713 - DNA, 101 bp, rice(Oryza sativa)
  misc_feature (71): n=t or g
atatgacgtgtgtatgtgtgttactaaggtgagtgtatgcacgtactccctctttccacaatctaggttgnttttttctgatatggaagaaatgtgttttt

SEQ ID NO: 32714 - DNA, 101 bp, rice(Oryza sativa)
  misc_feature (71): n=a or g
acttgcatgcaccaaatggtctgcgaaaatcgttatttttgtgagtggattttcgcttgcaggtgtttacntcatctgcatccaaagccgtcgccactctc

SEQ ID NO: 32715 - DNA, 101 bp, rice(Oryza sativa)
  misc_feature (71): n=a or g
acattcaaaattatacctttaaggtcctgtatttggttgtataatttgcggttttcctcaagaactttatngtagctggaagccgcattggagagagtgta

SEQ ID NO: 32716 - DNA, 101 bp, rice(Oryza sativa)
  misc_feature (71): n=a or c
aaaccgaaagaaatctttcctaaggattcccaacctcttgcctcttaacccatctatattcaagaattgcntataaccatcttctgggatatattgcaacg

SEQ ID NO: 32717 - DNA, 101 bp, rice(Oryza sativa)
  misc_feature (71): n=a or g
tataaaaggggttaggtgtcggttgggaatatatcatagatgtctaaatttcctaatcagcacccagcagncggtacctttgaggtctcaggaatgaaaaa

SEQ ID NO: 32718 - DNA, 101 bp, rice(Oryza sativa)
  misc_feature (71): n=a or g
gagcttccaaaggatctaggcaaattacagaagctgcaaactctggataccaagtggtccatggtccaaangttaccaagcagcttgtcgaaactgaagag

SEQ ID NO: 32719 - DNA, 101 bp, rice(Oryza sativa)
  misc_feature (71): n=a or g
cctgtctcgccggcatgacgcaaagacaatgacggcacaactccatttgagtggataaggagagagagggntcgagtgcggcgggtaccgccggctagatc

SEQ ID NO: 32720 - DNA, 101 bp, rice(Oryza sativa)
  misc_feature (71): n=t or c
ctatttgtcgtcgtaaatcattcattcattcattcatttgagcaacctaccggtggaccaatcgggatgcnattgcggtaacctgcgaattgaatcgaaca

SEQ ID NO: 32721 - DNA, 101 bp, rice(Oryza sativa)
  misc_feature (71): n=a or c
acgaactggtggtgtttgtgcagatggaaaagcactgaatgtcccttgctgaaaaggtacaccagttggtngaaactgaaaattaccattagaaccttgtg

SEQ ID NO: 32722 - DNA, 101 bp, rice(Oryza sativa)
  misc_feature (71): n=a or g
gaaaaatgttctgctaaattattagtcccttcagcacaagccacacacttaattggcaagcaaggagtcangatcaagtcaattcaagaaactaccggtgc

SEQ ID NO: 32723 - DNA, 101 bp, rice(Oryza sativa)
  misc_feature (71): n=t or c
gcatttttccctttcctttacgaagtccttgctaagctataaagctcaaaacagatgattattacttgagngcaacctaaagtaaaattgttattattcaa

SEQ ID NO: 32724 - DNA, 101 bp, rice(Oryza sativa)
  misc_feature (71): n=a or g
ggaggttacaattaccatgtcctcttctgacatctctttgcccatgtcctgctctgcagcatctttcttcnccgtctcagaactcctcttctccggtgaca

SEQ ID NO: 32725 - DNA, 101 bp, rice(Oryza sativa)
  misc_feature (71): n=t or c
ggtattgccatgcctacaataagaacctcagtacggtctgtatcgagattctggtcttgacctgctactanttccactggggccataaccatactgcaata

SEQ ID NO: 32726 - DNA, 101 bp, rice(Oryza sativa)
  misc_feature (71): n=a or g
ctcgcgatcaaacaatcttgccttgctttttcaacatgctcaaggggaaaatggagtaggggctagggtgnagatcgacatggcgatgccgatggtggtgt

SEQ ID NO: 32727 - DNA, 101 bp, rice(Oryza sativa)
  misc_feature (71): n=a or c
cgccatcctcgccgtcgtcttcttcctcttcggcttgctcaacctgctgatccagaacctgctccggatgngccgggcgcggcggcggcggcggcgcgtgg

SEQ ID NO: 32728 - DNA, 101 bp, rice(Oryza sativa)
  misc_feature (71): n=t or c
ttgtaagaaaatctcagttacatttgacccattcatgtacttgtcactgccattgccctcaacagttactngcatgattaatgtaactgtatttagtggta

SEQ ID NO: 32729 - DNA, 101 bp, rice(Oryza sativa)
  misc_feature (71): n=t or c
tattgcactgagaggtaactagatgggatgttttcatgctgtctaaactgtaaactagggattgtgaattnaagtttatctggaagtaagttgcatgttcc

SEQ ID NO: 32730 - DNA, 101 bp, rice(Oryza sativa)
  misc_feature (71): n=t or g
gacgctgttgaagccgccggtgaagagcgagttggagacgtactgctcctccacgcgcgccgagatggccnggtccatcggctggttgtccggcgtcgccg

SEQ ID NO: 32731 - DNA, 101 bp, rice(Oryza sativa)
  misc_feature (71): n=t or c
ccacatccaactgtgaatttgttgcagtgagagctaggagaactactatatggccttgtttaggcctagtntagttcccaactttttcttcaaactttcaa

SEQ ID NO: 32732 - DNA, 101 bp, rice(Oryza sativa)
  misc_feature (71): n=a or g
atcactgtcattattgactttttcatctcgggcagcagaaactggggagcctccaatgtcaatcctctcanatatatcaggatcatccatttttaagcttg

SEQ ID NO: 32733 - DNA, 101 bp, rice(Oryza sativa)
  misc_feature (71): n=a or g
atcgtttccgatcgttgaatctaacaatgcccattctatatctaataatcggaaacaatttgataccatcnctggtggagaaaccatttttggtcggtcga

SEQ ID NO: 32734 - DNA, 101 bp, rice(Oryza sativa)
  misc_feature (71): n=a or c
gcaggcaaacctctcgatgatgaagaattcacttcgtatatcctcgctggtttggacagtgattatgaacnggtggtttcctctattgttgggcgatctga

SEQ ID NO: 32735 - DNA, 101 bp, rice(Oryza sativa)
  misc_feature (71): n=a or g
gcgaagaatccacaatttcctgtctagccttcatcttcataaaaaaataagctgtgttcgcgtctccctcncgcaagtttctgacccatgcctgttgatgg

SEQ ID NO: 32736 - DNA, 101 bp, rice(Oryza sativa)
  misc_feature (71): n=t or c
gataccatgattgtccaggagtactcgtttcgggcgggcattgcatcgaatagccctcgcgcatcctcgangcgcccgtgctgagagcatgccaccatcat

SEQ ID NO: 32737 - DNA, 101 bp, rice(Oryza sativa)
  misc_feature (71): n=t or c
acttcattcccgcctgcacgtcatgccaccgctgccttcgcttccactcgatcgctccctggatttcgttntctctttctcaacctattcactggtctgca

SEQ ID NO: 32738 - DNA, 101 bp, rice(Oryza sativa)
  misc_feature (71): n=t or c
ttcgctcaaggttcaagacccatctgctttgttggctttgtttagtttgaatatttaagatgcacgatttntttatttataaatctaaaaatgtttttcag

SEQ ID NO: 32739 - DNA, 101 bp, rice(Oryza sativa)
  misc_feature (71): n=a or g
ggtatctcgttgcttgtaccaaagcttgcccataaatttccaagccttaaactgtctacgcaaaacacaanagagagagagagagagaggaatgagctgaa

SEQ ID NO: 32740 - DNA, 101 bp, rice(Oryza sativa)
  misc_feature (71): n=a or g
aaacaagcatgatttatacataggaaaataaaacgagcccccaatattaaaccgtagtcagctaatgtcgnaaacactcgtataatagatattgtataaaa

SEQ ID NO: 32741 - DNA, 101 bp, rice(Oryza sativa)
  misc_feature (71): n=a or g
taccgttctgcttcaatttgcagaattcgcatttccagattctcaaggttggcaaagcttaggaaagaggnttttcgacatatatgtccaggtaaaaatgg

SEQ ID NO: 32742 - DNA, 101 bp, rice(Oryza sativa)
  misc_feature (71): n=t or c
gttcttgatctgtgatctggcttgtttgagtttcccagctaagtttgcagccccgtccgttgaaatttggnctgcagaccaacttgcaagcgctgtgggaa

SEQ ID NO: 32743 - DNA, 101 bp, rice(Oryza sativa)
  misc_feature (71): n=a or g
ctgataactctgtttttgtggaaattcactctaagtattttttgattaaggatcgaaccacgaggagcacngttcttaaggggccacgccgccatggtctc

SEQ ID NO: 32744 - DNA, 101 bp, rice(Oryza sativa)
  misc_feature (71): n=a or g
atagcttttttgtctattttgggccaccttttggttcttctagataatcttaactttgtcctttgcttctntaagaatatcggtcccaaagacatgatgtt

SEQ ID NO: 32745 - DNA, 101 bp, rice(Oryza sativa)
  misc_feature (71): n=a or g
aagcattgcatggtggcagttggatggtgtggctcaccagatgttgaggttgggaacaaatgcatcagcantattgcaggcaggaggagcagcagctttag

SEQ ID NO: 32746 - DNA, 101 bp, rice(Oryza sativa)
  misc_feature (71): n=t or g
ctggcccaaccagcccacagttcggctggcgacctcctctcctgatccttgttgcagacttgtgaattttngcccaattcgtcgtgtcaattctgagttct

SEQ ID NO: 32747 - DNA, 101 bp, rice(Oryza sativa)
  misc_feature (71): n=a or g
aacttattttaaaaatttgaacattttgatcatgctagcttgcttgcgcgtggtaattttatcatgccacntcaaccagagtgatgtaacaatattgtttt

SEQ ID NO: 32748 - DNA, 101 bp, rice(Oryza sativa)
  misc_feature (71): n=a or g
actactactaattcttgattaggagtactgtcatagtgttacacactcaaagctacttgcaactctaaggnaaagcctggagcaaattaagatcatatatg

SEQ ID NO: 32749 - DNA, 101 bp, rice(Oryza sativa)
  misc_feature (71): n=t or c
atttgtcataggtgtggtatgataaacaaagtgtggtcaacaatttgttcgtcacaagtgtggcaatgttnggctagaaaataagtatatgacatgtagcc

SEQ ID NO: 32750 - DNA, 101 bp, rice(Oryza sativa)
  misc_feature (71): n=t or c
ttgtttggagcttcgctgatatatgatgaatcttcagagtctttcaattggctgtttcaaaccttccttanggcaatgtctgggaagcaaccggcaacaat

SEQ ID NO: 32751 - DNA, 101 bp, rice(Oryza sativa)
  misc_feature (71): n=a or g
taagttgagggaaatgggcttttatggtgtggaacaatggagacagtttgttgcctcgccgtacatctgcntcggcgtcaccaccgtcgcaaagtacaggg

SEQ ID NO: 32752 - DNA, 101 bp, rice(Oryza sativa)
  misc_feature (71): n=t or c
tcatccaatagcactagcacaaatattcccgtgtttcaaaatcccgtggtatttgttatgagaatagatgnataacggagacataaattttacgtggaaaa

SEQ ID NO: 32753 - DNA, 101 bp, rice(Oryza sativa)
  misc_feature (71): n=t or c
gaaattggcggctcgccgttttcgttttaacctaacgaacccttgaacctgctgcagatgctctacgatgnatctgaattcgagcagacacagagggaccc

SEQ ID NO: 32754 - DNA, 101 bp, rice(Oryza sativa)
  misc_feature (71): n=a or g
tctggtaatgtcgggcgatctgcttcacctgcattggtgctcagaaactggtattttcatgtgcatcacanagtgtggttttcacctaggaaagataaacg

SEQ ID NO: 32755 - DNA, 101 bp, rice(Oryza sativa)
  misc_feature (71): n=t or c
cggacagatacgcgctcgataggctgaagctcatgtgcgctcagagcacccacaatgataaaggaagttgntctctataaaacatgtgcatctcagcaata

SEQ ID NO: 32756 - DNA, 101 bp, rice(Oryza sativa)
  misc_feature (71): n=t or c
gtggggcatccactccctagcccccaaggcctattgacctaatgccatcttcggtgtattttcttagtccnataaaaaaacaaatcaaatcaacggcgtcg

SEQ ID NO: 32757 - DNA, 101 bp, rice(Oryza sativa)
  misc_feature (71): n=t or c
aaaggaaatgagatacttctactccggcaaggctagtaggctacagagattaatgggcaaaataagggcangttcagattgtagccaaaataaattttatc

SEQ ID NO: 32758 - DNA, 101 bp, rice(Oryza sativa)
  misc_feature (71): n=a or g
ctaatcattaaggttgcgttcttaagagcatttttattgggctacttgtacttcgtgagcacacttctttnactattaaatggtgtgtttcatgaaaaaaa

SEQ ID NO: 32759 - DNA, 101 bp, rice(Oryza sativa)
  misc_feature (71): n=t or c
tgttcaagaaggaggagaacataacaagaaaaccggagaatcgagaagaatggaagcttggcttggaagcnagaatatataaccgagctttatagttttag

SEQ ID NO: 32760 - DNA, 101 bp, rice(Oryza sativa)
  misc_feature (71): n=a or g
accggttgtagctaagaacaattaaaaaaactaaaacataccgctcgaagatgagtgcaaagggaaggatnaagatggcaccgaatacgctgcggtacgag

SEQ ID NO: 32761 - DNA, 101 bp, rice(Oryza sativa)
  misc_feature (71): n=a or g
gaagggagtgttccagatgcaacatttcaaattgacaaaaagatattgccagtttgggttaagatctgggncgtgcctcgtagaccgttgttgggttgtgg

SEQ ID NO: 32762 - DNA, 101 bp, rice(Oryza sativa)
  misc_feature (71): n=t or c
tgatcctttgctttcttcctcttgattgccttcttctataccttcccgaacacgaccttaatcttcttggncatgtcgaagacttgtgcaccagttcatgc

SEQ ID NO: 32763 - DNA, 101 bp, rice(Oryza sativa)
  misc_feature (71): n=a or g
aaatcttttagacactgaagatgttgatgtgtctagaataaaacgagaaagatacttgagtaggaatgccntagattcactgttagaaggaaaggagtcat

SEQ ID NO: 32764 - DNA, 101 bp, rice(Oryza sativa)
  misc_feature (71): n=a or c
agatttgctgcagtcgtgttcggaaaccatgatttcattcgtccacaacatgacggcttcctacgccgacnagagcaacgagtcctccgtggtgtccacct

SEQ ID NO: 32765 - DNA, 101 bp, rice(Oryza sativa)
  misc_feature (71): n=a or g
gccattgaatacttctcccgatggatcgaggccaaaccacttgggtcgatcacttcaacggcagtacagangttcgtatggaacaacattatttgtcgttt

SEQ ID NO: 32766 - DNA, 101 bp, rice(Oryza sativa)
  misc_feature (71): n=t or g
tctgcttcgcgcgatgcatacctcgatattccctgcactcttttgttccattttgcatatacctgcgaaanacataattttcaaacacgctcatagaaaat

SEQ ID NO: 32767 - DNA, 101 bp, rice(Oryza sativa)
  misc_feature (71): n=a or g
caggctcatgggaatgctggctaaccatctgcaggttatgatcagaatgccatctacaagaatcctgcctnccctgatgatcatgatcagaatgccatctc

SEQ ID NO: 32768 - DNA, 101 bp, rice(Oryza sativa)
  misc_feature (71): n=t or g
tcttgagcacggacatctcgatgttgtcgcagcactcccacggtctggatttcgcctgtttgtttccatcngtttcgccggcggcgccgttgctggggagg

SEQ ID NO: 32769 - DNA, 101 bp, rice(Oryza sativa)
  misc_feature (71): n=t or c
atcttctccggatttagaaagattagatcatccggtctaaccgccccgaagaagctgtagtcgcctgaagncttcaccgtactgcccgccatgtagccgcc

SEQ ID NO: 32770 - DNA, 101 bp, rice(Oryza sativa)
  misc_feature (71): n=a or c
gacaataagaaaaggtcagggtcagccatcaattgttgaccatcccgcagttgagcctcacctccaccggnatccactccggcgggcgtatctcccccatc

SEQ ID NO: 32771 - DNA, 101 bp, rice(Oryza sativa)
  misc_feature (71): n=a or g
ctttgtcaaacttgctggagaggagttgctcttatcaccagaattttctccattgccagatggatgagccnccttactatttcctccatgagattttcttt

SEQ ID NO: 32772 - DNA, 101 bp, rice(Oryza sativa)
  misc_feature (71): n=t or c
ctgatctttggctgcctaccaccttgtcaaagtaagaaatatgcatcaacaacaaaagggatgtttagatncaggggtgtaaagttttggcgtgtcacatc

SEQ ID NO: 32773 - DNA, 101 bp, rice(Oryza sativa)
  misc_feature (71): n=t or c
acaccaatagctagaaggaagggcaaagaaaccgcaattcaacatgataatccaccaagccctctagttgntgtcgattcattcagagcaaattttagcca

SEQ ID NO: 32774 - DNA, 101 bp, rice(Oryza sativa)
  misc_feature (71): n=t or c
ggcagcacaagtaggtccccgagctgaaaggatcatccataccagtacagtcgtagtgcgtactacctacngcccattgtccattgatgacacggtcactc

SEQ ID NO: 32775 - DNA, 101 bp, rice(Oryza sativa)
  misc_feature (71): n=t or g
ggaatattttattccacattaatccttaacctttacatgggattatgacctcccaatgacggttgtgagtnttatacctgaagaaaccgtaatagacactt

SEQ ID NO: 32776 - DNA, 101 bp, rice(Oryza sativa)
  misc_feature (71): n=a or g
ccacgtggcatgtttagagcattttgaggaagccacgtggcagttagagagagtttgtaggaaggttaatngatttttagtatataatagaagatagatag

SEQ ID NO: 32777 - DNA, 101 bp, rice(Oryza sativa)
  misc_feature (71): n=a or g
taccgacccttatttcttatactcgaccgatgagattgtccaatcaaaacaagtgtggtgcaaaccttttnttgttaatgtacaaggctaaacccattaat

SEQ ID NO: 32778 - DNA, 101 bp, rice(Oryza sativa)
  misc_feature (71): n=a or g
cgataaaggattgctggaatttttaatgcgtgcataaatcaagcttgaggttggtatgaaaaaaggacatntatgctcccactgtttgcactcgcatgtaa

SEQ ID NO: 32779 - DNA, 101 bp, rice(Oryza sativa)
  misc_feature (71): n=a or c
tggcatatttcttctttctatcaacttcagttttcactctatatatgtttcaagtagtatttcaatttgtntattacgcatgccaccagggttagcaatct

SEQ ID NO: 32780 - DNA, 101 bp, rice(Oryza sativa)
  misc_feature (71): n=t or c
gataagttggggagcttctactgcaacgaatatgctagataagttaggttttccaagcttctggtttttantacagttttttagaatttgggtgaaaaact

SEQ ID NO: 32781 - DNA, 101 bp, rice(Oryza sativa)
  misc_feature (71): n=a or g
attcagacttaccactttaggaatttctggcatatttcaggacttgagccttctacttctcacttctggtngggatccaggtataatacctcggaatgcac

SEQ ID NO: 32782 - DNA, 101 bp, rice(Oryza sativa)
  misc_feature (71): n=t or c
agagctacaggcgagtaggtctctgctgaatttgatgtggaggagaccgtcgagcaaccagctggctcgangacatctgtggtaggcttcgtaccgcggta

SEQ ID NO: 32783 - DNA, 101 bp, rice(Oryza sativa)
  misc_feature (71): n=t or c
ctaaactaggcctaactatggatgcagatggcttcctcagcattgactgcgggctggagggagacaaaaanggctacacggacaacagcaatggcatcgtt

SEQ ID NO: 32784 - DNA, 101 bp, rice(Oryza sativa)
  misc_feature (71): n=t or c
tagcgtgccaacatcagtgaagcggaacgtcaataccttatcccttacaaccttctccgtgagcccaccangctccatcttagcaagagttttctctttac

SEQ ID NO: 32785 - DNA, 101 bp, rice(Oryza sativa)
  misc_feature (71): n=a or g
cagatttgggaaagtggaataactttagtagaggacaccgaagacactatcctttggaaatggacaaacancgacaagtattcagcaaaatcggcatacat

SEQ ID NO: 32786 - DNA, 101 bp, rice(Oryza sativa)
  misc_feature (71): n=t or c
tttattggaatttgatgtgctcttcagcttctcgggatgactattgcctcgttttttcatgagcacacttnctaaactattaaactatattaagctgtata

SEQ ID NO: 32787 - DNA, 101 bp, rice(Oryza sativa)
  misc_feature (71): n=a or g
actacagttatcacacacacaattgcttttgcacctagagtcagagatcaatatgagtagcaaattcctcnccatatatctcctgcttgctttcctcagcc

SEQ ID NO: 32788 - DNA, 101 bp, rice(Oryza sativa)
  misc_feature (71): n=t or c
gtgggttgaaacattccctgcacaaatagtacattcaagaccagatagtagaatgatacagacagttcacngcgatatgatgatagaataacaactcaaaa

SEQ ID NO: 32789 - DNA, 101 bp, rice(Oryza sativa)
  misc_feature (71): n=t or c
ttatagtcgtagtatgtactcctgtaccaatatatatgggggacatataaagaatacaaaacgtactctgnagaacgtaggagctggcaagcatgcgtgca

SEQ ID NO: 32790 - DNA, 101 bp, rice(Oryza sativa)
  misc_feature (71): n=t or c
tgttcgccatgcatcattagtcaaactctttgagcttttgttatgttctagtgctccattttgaggatganaactatgtatatttccattatcaggtacct

SEQ ID NO: 32791 - DNA, 101 bp, rice(Oryza sativa)
  misc_feature (71): n=t or c
gctcgggggaggtggatccaacgccaatggtgcttgagtccaaccatgacaacctcgagtgcgacgatgcnggtggcgggtttgcttgggccaacgatggc

SEQ ID NO: 32792 - DNA, 101 bp, rice(Oryza sativa)
  misc_feature (71): n=t or c
tggacaaaacttggctgatgtataatgaggaagcacgtgtgatgtatcttgaagaagcagagcataatttngccttcgaccattgctggaaagcagtttgg

SEQ ID NO: 32793 - DNA, 101 bp, rice(Oryza sativa)
  misc_feature (71): n=t or c
aagtttagatccatctctagaaggagtagtcgacttgaaagagactgacttactagcagcacatacattantgtctcgctgaaaagaacatgaacggctag

SEQ ID NO: 32794 - DNA, 101 bp, rice(Oryza sativa)
  misc_feature (71): n=a or g
aaatactcttgcatggataaaggtacaattgaacaattatgaactgcggtggcgccccctctcaggcgcangggaggtggcgttcgccggcagcgggagtg

SEQ ID NO: 32795 - DNA, 101 bp, rice(Oryza sativa)
  misc_feature (71): n=a or g
ccatacatctgaagattgagccatcatatcttgagagttatagtagatgccttgctaatagcggtacaccnattcactgaaaaaaaataaataaccttaaa

SEQ ID NO: 32796 - DNA, 101 bp, rice(Oryza sativa)
  misc_feature (71): n=a or g
ggaagtggtgtctggttactcacttgatcctgacgcgtgtagcaaggttcagaccttatgcatcagtgctngtgctgtacccaatttttctctgagaaatg

SEQ ID NO: 32797 - DNA, 101 bp, rice(Oryza sativa)
  misc_feature (71): n=t or c
ctgctgacgtgcctgttatttttttttcctccaggagtatagatggttatatgggccgaggcccgagaccngaggcccgcggcccgatccaaggtacgcta

SEQ ID NO: 32798 - DNA, 101 bp, rice(Oryza sativa)
  misc_feature (71): n=t or c
tttagagctacatcaaatcaaatgtgccgagaatgtttcatcctacacactcaacagaacaaaacagttangttgctcgagacgaagtcgagcaaaattat

SEQ ID NO: 32799 - DNA, 101 bp, rice(Oryza sativa)
  misc_feature (71): n=a or g
gttcggtggttttagtgagcggtgctcgaagaatggtacttggttaatgggtttgccagattttggcgctnatggggaaagtagcagtcgaggtcctaaat

SEQ ID NO: 32800 - DNA, 101 bp, rice(Oryza sativa)
  misc_feature (71): n=t or c
gtaaagtagaaactgcaatggcaagcttttccttgaatctctcctctgaattggctaaaatggatagtacnttaatagaggaaatgaccagtggatcatta

SEQ ID NO: 32801 - DNA, 101 bp, rice(Oryza sativa)
  misc_feature (71): n=a or g
atggtgatcaaattaacatattgtcaccgatatcaagtgaatatttgacataaataagaacatggcgtttnaatgaatcatttatgaactatgacatttct

SEQ ID NO: 32802 - DNA, 101 bp, rice(Oryza sativa)
  misc_feature (71): n=a or c
gaactaaccgaagccccggatacaacaaaagagaagacgcaaaggaatcatcagaagcagcagcagcacgngaccatgggcgacgccgcctccaaccaacc

SEQ ID NO: 32803 - DNA, 101 bp, rice(Oryza sativa)
  misc_feature (71): n=t or c
gcgaagttaacaatattcaaagattcaggaatcttgcaataggacggtttcagaatgcattgacatacatngacaaggataatggtgctcatggatccaag

SEQ ID NO: 32804 - DNA, 101 bp, rice(Oryza sativa)
  misc_feature (71): n=a or g
tgcttattgtagaattctatttgtccaactgcattgaaggcctcagcaatacccattaaaacaagttgggntgcaagccacaagactgacataggcgatat

SEQ ID NO: 32805 - DNA, 101 bp, rice(Oryza sativa)
  misc_feature (71): n=t or c
acgtccggatatgtgcgacctggctgggcaccttcggatgcttaggaaattctgtttgagacaacctgctncactagaaaattttggttggcacctctttc

SEQ ID NO: 32806 - DNA, 101 bp, rice(Oryza sativa)
  misc_feature (71): n=a or g
gtagccaacaacttaactttttgtttgtatgacctatttgatatagggtaagaaaccagctgcgttctacnaaattaaagatgcagaagtaagatctttca

SEQ ID NO: 32807 - DNA, 101 bp, rice(Oryza sativa)
  misc_feature (71): n=a or g
atagcaaggcacccattgtaaccccatcaatctcaaaaatatactagcccaattttctgcaggtactcatngaaataggacgtgtgtgtgtttataaggtg

SEQ ID NO: 32808 - DNA, 101 bp, rice(Oryza sativa)
  misc_feature (71): n=a or g
gactggggatgtatcattccaggttaacagtgtgatttccatgagtgttcttggggaacctcttatgctantgtccccaggaccagcagattctcctggtt

SEQ ID NO: 32809 - DNA, 101 bp, rice(Oryza sativa)
  misc_feature (71): n=t or g
tgagtgcatttcctagactccaagtccttgtcttgaaatctaacaagttctttggacaagtggcaccttcngttggcgaagacagcagttgtgaatttcct

SEQ ID NO: 32810 - DNA, 101 bp, rice(Oryza sativa)
  misc_feature (71): n=a or c
tgcataactccaatataaagcaaagatatgcttgtgccttgacctcatagtttcaaacttgttattgcagnttgatggactcctttgttccttttggaggc

SEQ ID NO: 32811 - DNA, 101 bp, rice(Oryza sativa)
  misc_feature (71): n=t or c
aaatatgcctcatctgaaataaaagaacatgaggcggtatttaatggcagtggtaaccacaactgccaaantccagctaaaactatgaaatgtagacaatt

SEQ ID NO: 32812 - DNA, 101 bp, rice(Oryza sativa)
  misc_feature (71): n=t or c
gaccggtgtgtaaagcgtcagaccggctacgccaaggtcttcatctggttagagggtaatcttttagttcngtaaaaagatttttgtttcggtacctacca

SEQ ID NO: 32813 - DNA, 101 bp, rice(Oryza sativa)
  misc_feature (71): n=t or c
catgcacggctctctactaccatatcggcatcatccatttccatctcatcatcatcatcattctcgtagcngctttccatgttcatgtcatcgaccatact

SEQ ID NO: 32814 - DNA, 101 bp, rice(Oryza sativa)
  misc_feature (71): n=a or c
agaatgttacgcaagaatgttacgagtataaagttatccctggaccttgaatcaattgggttgttttgatnatttaatctcaggttctctggcagatcgaa

SEQ ID NO: 32815 - DNA, 101 bp, rice(Oryza sativa)
  misc_feature (71): n=a or g
aagcaaaagaggcaaagacatcaatcatatggacgagacagcgaacaaagaatctgatttgagaatttganatcgaggaggatacatggatgtcacggatg

SEQ ID NO: 32816 - DNA, 101 bp, rice(Oryza sativa)
  misc_feature (71): n=t or c
gagcaactcacgagtcacgtcagaaagcgagagagagatcagtgggcatcaccgtggaataataaatgaanaatcctccttcccgttgcttcagaacggag

SEQ ID NO: 32817 - DNA, 101 bp, rice(Oryza sativa)
  misc_feature (71): n=t or c
tcgactttgcgcagtcggcctgttgtcaagggaagtccaagatacttcaatggcaggtttgctctggttgntggcgtgtcatggaggatgtcgtctaaatc

SEQ ID NO: 32818 - DNA, 101 bp, rice(Oryza sativa)
  misc_feature (71): n=t or c
ctcctctgccacaatgctcacaccctccagatcctcgaggaagcattccgttacagacaacacctcgagcnctggaagcacggcgttgagccgacgcaacc

SEQ ID NO: 32819 - DNA, 101 bp, rice(Oryza sativa)
  misc_feature (71): n=t or c
ctgactgatcttttaatcgagaagatgaaagttacagctatagaaagtggcaaagaaggaagggttgtganagttgcttctgtcagctacagtctctctta

SEQ ID NO: 32820 - DNA, 101 bp, rice(Oryza sativa)
  misc_feature (71): n=a or c
cctatcctgctcaaaggacccaaggtcgtcgtcggttcaatttacccacataaccacatatttatataggnaaatacccaggaactcactccctcttagcg

SEQ ID NO: 32821 - DNA, 101 bp, rice(Oryza sativa)
  misc_feature (71): n=a or g
catatataggacttcaacttacgacttctcctgttcaacatacatggcttccataccatctcacttattantcatttctcactactacaaaacatcaaata

SEQ ID NO: 32822 - DNA, 101 bp, rice(Oryza sativa)
  misc_feature (71): n=t or c
tctatttctggtgctttggagcatcatctcggctcaatttgagcaaagccgggttttttttttaaaatcgnatacctcaaaggtgtcggtttctaaatcga

SEQ ID NO: 32823 - DNA, 101 bp, rice(Oryza sativa)
  misc_feature (71): n=t or c
gcgaagagaagccaaaagatatgtgagcatatgatttattttctttctactaacttgtggatcccactatntttatttactttttctaattgttaagccat

SEQ ID NO: 32824 - DNA, 101 bp, rice(Oryza sativa)
  misc_feature (71): n=t or c
ttatatgggccggatgggccttgtaatcgagaggcgtagaaggattcggctcggcctagaaatctaacatnggtgcatcgtgggccgcaggcccgcagttg

SEQ ID NO: 32825 - DNA, 101 bp, rice(Oryza sativa)
  misc_feature (71): n=a or g
agtaagttacaaaccgaggctctcaaggaagccatctcccaggttgttgctgattgcaaggaaaagaacangaagttcaccgagaccgttgagcttcaaat

SEQ ID NO: 32826 - DNA, 101 bp, rice(Oryza sativa)
  misc_feature (71): n=a or c
tttttttttggaacaatccttcgggcctagtaaataaaccagactgggctgatggttgaacccgaaaaaancagaaccaccatccttgtggggtcggtttg

SEQ ID NO: 32827 - DNA, 101 bp, rice(Oryza sativa)
  misc_feature (71): n=a or c
agccatcatttattccgataagatctaaagagtataccatcaataaccctgtgatcacagctcattgttgncgacatgaaggaaccaaactcgtattgacc

SEQ ID NO: 32828 - DNA, 101 bp, rice(Oryza sativa)
  misc_feature (71): n=a or c
aagaaaatgtaaggtaaatctctagccgttgcatgatgtatgccggtgtgttcacattggattgatttcantatcacatcggactcgcagatttgagaaat

SEQ ID NO: 32829 - DNA, 101 bp, rice(Oryza sativa)
  misc_feature (71): n=a or g
caacaatgctgaggtatcggcagctgttataggtgggttcatttcagctgagataccagactttcgaatcnatgaattagggtatgaattagtaaaggaat

SEQ ID NO: 32830 - DNA, 101 bp, rice(Oryza sativa)
  misc_feature (71): n=t or c
acatgaagtaagttgggatggctgacgggactgaatttatcaaagtgagacgccctccttgggggagaaanattgaacttgttgttaatcttctttccact

SEQ ID NO: 32831 - DNA, 101 bp, rice(Oryza sativa)
  misc_feature (71): n=t or g
taaaccaggggcaccatacccaacaagcttagcaactggccttggttgcttgtcatacaaacaatcctcanttctatgagatggcttggcacagttaatgc

SEQ ID NO: 32832 - DNA, 101 bp, rice(Oryza sativa)
  misc_feature (71): n=t or c
gctgcctctcttgggccggctgggccaattgggccgaagggagagagaggatttcggcccaaaagaagtanttaggaattttgaatattttgcctaaggag

SEQ ID NO: 32833 - DNA, 101 bp, rice(Oryza sativa)
  misc_feature (71): n=t or c
gccacgttgtagtagttttatttgcttttaggtgagctcaacattttgtgctatagggtgtgtttagatcnaaaaatttttggcctaaatgtggacgaaaa

SEQ ID NO: 32834 - DNA, 101 bp, rice(Oryza sativa)
  misc_feature (71): n=a or g
cggatttcaatcttcagatgattgaggggccacaatatcccttttgaggggagagaaatgacgagagagcnagagcctggggagctcgtcaacctgagcgc

SEQ ID NO: 32835 - DNA, 101 bp, rice(Oryza sativa)
  misc_feature (71): n=t or g
ctgcctctcgatctctctgaatttagttagtggagcaaaatgttgcgtgcgtctctgtccgtaattctctntatcgcacgtacttcgtccgttttaggtta

SEQ ID NO: 32836 - DNA, 101 bp, rice(Oryza sativa)
  misc_feature (71): n=a or c
tagatttagattcttcctgtttttccacaagagctttgcgccatcaacctctttccagaacgactcgtaanggccagggatgctgcaagatcgaaacatca

SEQ ID NO: 32837 - DNA, 101 bp, rice(Oryza sativa)
  misc_feature (71): n=t or c
ccacgcgaacccctcaccccttgaaattgccctttcacacgacgccctcgtcttcctcctttctcttctcnctagcgcctcctttccagaagcttccaaac

SEQ ID NO: 32838 - DNA, 101 bp, rice(Oryza sativa)
  misc_feature (71): n=t or c
aagaacttagaccctgacgggagcaaagagcctttgtggcctggtccctaatgactcgagctttttctctntttttttaaatattccgtatatgttgccta

SEQ ID NO: 32839 - DNA, 101 bp, rice(Oryza sativa)
  misc_feature (71): n=a or g
aggtatcgactccatagccgccgatcataaagatcaaaagatgactgtaataggtgaagttgacaccgtcnagatcgccaagaagttgaagaaattcggga

SEQ ID NO: 32840 - DNA, 101 bp, rice(Oryza sativa)
  misc_feature (71): n=a or g
ttcttttactccttgatttagctgcttgacttctaccattttccccttaaaaaaatcaagtgagcttagancaaatcactgtattgagcttgcaagcgaca

SEQ ID NO: 32841 - DNA, 101 bp, rice(Oryza sativa)
  misc_feature (71): n=a or c
catatcagagccatatcggctcctaccacgaattgtctcgtgtgtagatcaaagaccctattatggacccngcaaaaaaaaaagatcccattatgggcccc

SEQ ID NO: 32842 - DNA, 101 bp, rice(Oryza sativa)
  misc_feature (71): n=t or c
taagcatggggtgaatttttggatggggttgaatgtggcatttactactcggctattagatgtactggtantaattggtggtgtacatatatatatatata

SEQ ID NO: 32843 - DNA, 101 bp, rice(Oryza sativa)
  misc_feature (71): n=a or g
tacacctattattaacttaatccctatatgggggatatataactttgtgccatgcatgatgatgatgatgnttaattcgatccatgcaatgtatgtgaagt

SEQ ID NO: 32844 - DNA, 101 bp, rice(Oryza sativa)
  misc_feature (71): n=a or g
cagcaaacaacaatggcgattggcatggccacctctcaatggtggctatggtattttgagggagcgatggnaggaccatggtcaacgactaagaagactgt

SEQ ID NO: 32845 - DNA, 101 bp, rice(Oryza sativa)
  misc_feature (71): n=a or g
gtcgaatagtatttgcatctgtcttagtacgtattcgctgccgatgatatttgtgtttgtatttatacccnatactatccgtatccgtcctaattttaatt

SEQ ID NO: 32846 - DNA, 101 bp, rice(Oryza sativa)
  misc_feature (71): n=a or g
taactaatataacaagtggttttgcatattagaccacgtcgacgtaccctataaccgcgataatccagcgntaatctatggtattttaaaaacctgctatg

SEQ ID NO: 32847 - DNA, 101 bp, rice(Oryza sativa)
  misc_feature (71): n=t or c
atgagtgcaccccattgagaagcatgtggctccattggcatatccagtaacagagcttcagcttcttctanattccctgcacggccaaggagatcagctaa

SEQ ID NO: 32848 - DNA, 101 bp, rice(Oryza sativa)
  misc_feature (71): n=a or g
cggttaggatacgattgatcttaaaccattcatactgagttcatgtgtccatggcatagtagaaaaaaccngaccggtcattgacccggtggagtatttgg

SEQ ID NO: 32849 - DNA, 101 bp, rice(Oryza sativa)
  misc_feature (71): n=t or c
gtattggtgttgtccacctccacataccccgtctccaggtggaacggcagcctcccttggaaccccttcangtgtgttatcacgttcctcgcccgactcgt

SEQ ID NO: 32850 - DNA, 101 bp, rice(Oryza sativa)
  misc_feature (71): n=t or c
actcatttcggattattaatttattacgtcacgacttagatctttactcacgactgtcacaaataggtgtnaccctattagaaaaacatgtatattttttt

SEQ ID NO: 32851 - DNA, 101 bp, rice(Oryza sativa)
  misc_feature (71): n=a or g
ccaaatcagacttgtaagcatattgttcctgtgcaatgacaaatgatggagtgttggtagtatttcctccnccaaaaaaaaagataacatggaaagaaatg

SEQ ID NO: 32852 - DNA, 101 bp, rice(Oryza sativa)
  misc_feature (71): n=t or c
gtcaaacatttagaaacggagggatcattattgtcttgaagtttcacaaaactattaggaaacctatgggnttgggcctatgaagacccagcccatataca

SEQ ID NO: 32853 - DNA, 101 bp, rice(Oryza sativa)
  misc_feature (71): n=t or c
ctagataagcaatgtgggactattcccaataatcccccaccccacaattcctacaggtgaaaatggatagnggtcctacagcatatttgtttaagcgtatt

SEQ ID NO: 32854 - DNA, 101 bp, rice(Oryza sativa)
  misc_feature (71): n=t or c
tccatacaaccattttaaaaaaactcatataagagtcaagaagccaaattacaggcaatagaatgttgganggtacttctagaataatcaagtctgctttt

SEQ ID NO: 32855 - DNA, 101 bp, rice(Oryza sativa)
  misc_feature (71): n=a or g
aactatagggaaatctcaacttggacatgaatagccaaattgcagatagtttactttccattccacttganaataacttgtgaaaaaaatgttctttcaag

SEQ ID NO: 32856 - DNA, 101 bp, rice(Oryza sativa)
  misc_feature (71): n=t or c
tccatgaaaggtaaccagactggaaaagcaactggcagcagagctcttggatctacacctggccttgttangagcacagcaattttaacttgggctgtgtt

SEQ ID NO: 32857 - DNA, 101 bp, rice(Oryza sativa)
  misc_feature (71): n=t or c
aactcaattagtagagcaaatccctgtctcctgcaattgaaaatgaaataatagcctatcaataagtatangaagagaaagagaaagagagagaagaggaa

SEQ ID NO: 32858 - DNA, 101 bp, rice(Oryza sativa)
  misc_feature (71): n=t or c
taatattatattcctaaagctcttgacctaccagatggtctgttcgatggataagagtctatcctaaccgntgtgttaaattaatcattgcgaaatagaaa

SEQ ID NO: 32859 - DNA, 101 bp, rice(Oryza sativa)
  misc_feature (71): n=a or g
tacggagtattcgtcaattaaaaatgtattattctttaaaaaattgaaggtttaatccttcaaacctcacnatcatggccctccgatccacagctccaggt

SEQ ID NO: 32860 - DNA, 101 bp, rice(Oryza sativa)
  misc_feature (71): n=a or g
ttgcttaggaactggatccaagccacctttatccttggctcagctggtcttcaaggcccaaatggccagcncgattcccacacttgtgaagatgaaaagga

SEQ ID NO: 32861 - DNA, 101 bp, rice(Oryza sativa)
  misc_feature (71): n=a or g
catacaaagaaaccacattatcattcattagcagctattacatcttaaatcccataccatgctgttaacgnccaaatttggtaatccaaggatcggatgta

SEQ ID NO: 32862 - DNA, 101 bp, rice(Oryza sativa)
  misc_feature (71): n=t or c
cattagggagcaaaaaggttactctaagccatgtataacagatttagtgtagcacctaagcgtcacccccntaagcatgggcttggccatatctagaacct

SEQ ID NO: 32863 - DNA, 101 bp, rice(Oryza sativa)
  misc_feature (71): n=a or g
tgctttgtgaatgtgtacatgtaggtggcatacaagcaagcaaacaatgcttgtttgcatatgagcatganaggcccatatgggggcaccccaccaaccag

SEQ ID NO: 32864 - DNA, 101 bp, rice(Oryza sativa)
  misc_feature (71): n=t or c
aaccgaaccgtaaatcctcatttcgatttgaagcttacatcactaagggcctcatcgtacggcacatttgnaaacgaaaaataatttgtgaataaaatttt

SEQ ID NO: 32865 - DNA, 101 bp, rice(Oryza sativa)
  misc_feature (71): n=t or g
tatgcaaacacaccatcttttcttgctccttatagagaagctgcataccatattgaagaggaggagcagancaattgtcagccaagtgactacaaggagtt

SEQ ID NO: 32866 - DNA, 101 bp, rice(Oryza sativa)
  misc_feature (71): n=a or g
atggaggccggtctgcctcctggaaacacggctagttgagtcagaaaatgtctgcatgattgatcgcgtcnttgcgtccgatccattgccggaataacaac

SEQ ID NO: 32867 - DNA, 101 bp, rice(Oryza sativa)
  misc_feature (71): n=t or c
aagagctgctgttctaataatggtcatggaccctctcgcgaatggtcatggaccctcgcgaatttttaagnaacattataacgcaagagctctactgttct

SEQ ID NO: 32868 - DNA, 101 bp, rice(Oryza sativa)
  misc_feature (71): n=t or g
ctatagaatgcacaccataaagtcaaagatatttcagctagtagctgcctacagatgcactccatttcgancggctattggcatgtgatcacaaaagtggt

SEQ ID NO: 32869 - DNA, 101 bp, rice(Oryza sativa)
  misc_feature (71): n=t or c
gagaaataactttttctttacgatgattcaggtgaaagttcattcatgggggcagcaagtttcagtaatangagcatggactggactggcaccacaagtga

SEQ ID NO: 32870 - DNA, 101 bp, rice(Oryza sativa)
  misc_feature (71): n=t or c
catcgccaatggatcctctccaagattacacctacttagagctaaatatttcagatgtgtaccatggctangaaatatcgggtagtctagtgtgcccttag

SEQ ID NO: 32871 - DNA, 101 bp, rice(Oryza sativa)
  misc_feature (71): n=a or c
atacctgagaaatttagacgactcagtgcttaggtgggtatgattggccaaaacgatcggaaacggtcggnatcggcaatatctctttggaaacgatgctc

SEQ ID NO: 32872 - DNA, 101 bp, rice(Oryza sativa)
  misc_feature (71): n=t or c
acatccatacataggagaactcacaactgtcaggtttgtacatgaagcttggtaggtgcaaactctatacntgtcgcaagtgagaggttacctctggcgga

SEQ ID NO: 32873 - DNA, 101 bp, rice(Oryza sativa)
  misc_feature (71): n=a or g
ctttgagggaaaccatcaaactcccatttcttcatttggatcctcaggctccaaatgtgacagttgatgtnttcagaaacttgtcaccgcatgttcaagct

SEQ ID NO: 32874 - DNA, 101 bp, rice(Oryza sativa)
  misc_feature (71): n=t or c
gttctacctcttttgcagcattgatccatcatccatcgctggcaaatgcatcgtgtcacagtatgttcccngatgacgagttgaatccggatagatcagcc

SEQ ID NO: 32875 - DNA, 101 bp, rice(Oryza sativa)
  misc_feature (71): n=a or g
ccaatctagctgaggcctcctcaacatcatcaacatcggcttacctagcttcaaattcggctggtagcatnaaaaccatgtttaccgatgcagatgcagga

SEQ ID NO: 32876 - DNA, 101 bp, rice(Oryza sativa)
  misc_feature (71): n=a or c
atactaaaacatgcctcagcatgttgtcctgatggctgagttggacccttcaacatatatgccctcctcanttgatctataatctccttaggataatcttc

SEQ ID NO: 32877 - DNA, 101 bp, rice(Oryza sativa)
  misc_feature (71): n=a or c
tactacctataaaaattgcgcatgctcatcagtcgatacccgttaaaaagatatataagttaccacccgtnaaagatgactggttatttagtgacgctatc

SEQ ID NO: 32878 - DNA, 101 bp, rice(Oryza sativa)
  misc_feature (71): n=t or c
tgcgaggaagtttcccaacatgcacaaatgaacatagcctaattaaggctctgttcttatgtcccaactcncctaccatgttttccgcgcccacgcttttt

SEQ ID NO: 32879 - DNA, 101 bp, rice(Oryza sativa)
  misc_feature (71): n=t or c
ggttttcgactacaaacccattactttcttccttttaagccagctaaacccataagtggagctgtaggtcnagctcgcacaactaacagccgtctgaagtg

SEQ ID NO: 32880 - DNA, 101 bp, rice(Oryza sativa)
  misc_feature (71): n=t or c
tggcagcaattggaacttggatcgtgagaccagccgtggctactgttgttgttgtgagaaggattgctttngcccacaagtagtcactcaaaacattatct

SEQ ID NO: 32881 - DNA, 101 bp, rice(Oryza sativa)
  misc_feature (71): n=t or c
atgtgctccgcctcgtcttaaccatgtgctttgccattggccttcttatgttttcttagcagggttttcgncgaaaggtgtatgttcggcctccttttggg

SEQ ID NO: 32882 - DNA, 101 bp, rice(Oryza sativa)
  misc_feature (71): n=t or g
aaacaattctgtgctgccgtgagctgtgcattattcatctgggtttctgcgtgagattatatagttttttnagcttgttttgtgacgaggacgacatggcg

SEQ ID NO: 32883 - DNA, 101 bp, rice(Oryza sativa)
  misc_feature (71): n=a or g
ctaaagactctagcaaatcattgaccccggcaacatctcatcttcagtgctactatttcctgcaaatcaancagtaacattttgtcttgtaaccttttccc

SEQ ID NO: 32884 - DNA, 101 bp, rice(Oryza sativa)
  misc_feature (71): n=a or g
agtgtaactagtcctagctagcccacccaccctggattagtttttaacaacatggtttaccctgccaattntcccaatgtcccattgaccctcctctgatc

SEQ ID NO: 32885 - DNA, 101 bp, rice(Oryza sativa)
  misc_feature (71): n=t or c
aactgcacattccatgaatagagcaaataagaacactgatgtatccaatcaagtttgtaaagcttgagttnagaagtacgtacctcggtaatcagtacgtt

SEQ ID NO: 32886 - DNA, 101 bp, rice(Oryza sativa)
  misc_feature (71): n=a or g
tggtttgaatcttttgggattttcggatttaaggttaccccgagtacatgtaagaaattccactgtagccnaaaatctccacattgttcgaatttaacagg

SEQ ID NO: 32887 - DNA, 101 bp, rice(Oryza sativa)
  misc_feature (71): n=a or c
attaggaatatgagagacttttgacaaagctattgattccattcagatcgcttttcatatataaaaggtgntccctccgttcgaaaatataacaactttta

SEQ ID NO: 32888 - DNA, 101 bp, rice(Oryza sativa)
  misc_feature (71): n=t or c
caaaagggcaagagaccattaagtagcaattcaagcactttgtccagtccagtcaagaagagcaagagccnaatgattaagattgtgaaggacatagccag

SEQ ID NO: 32889 - DNA, 101 bp, rice(Oryza sativa)
  misc_feature (71): n=t or g
tttgggccttattaaactaactgggtcgaactgggccttattatcccagatcatcacgcagcttgggcttncgtccgaaagctgcggactgcagaacggtc

SEQ ID NO: 32890 - DNA, 101 bp, rice(Oryza sativa)
  misc_feature (71): n=t or c
catagtaaatataaaattattgcacataacgaacatatgtcgttcgctccaaggccttcttattttggaanaaaacaacatggattggctttttggtccaa

SEQ ID NO: 32891 - DNA, 101 bp, rice(Oryza sativa)
  misc_feature (71): n=a or g
atttttttccggtgtttcccgcaacccttttttttttcgatctcatccaatttttccgcacgcatgctgcncactatatttttttgtcactttgtatattg

SEQ ID NO: 32892 - DNA, 101 bp, rice(Oryza sativa)
  misc_feature (71): n=a or g
ttcgacaatacaaactaacaacactattgcaaattttatgaaaaagcccttgagacccagagacaaggctnaatccgcagcatcatagtttggttgtgtgg

SEQ ID NO: 32893 - DNA, 101 bp, rice(Oryza sativa)
  misc_feature (71): n=a or g
acataagaacaacaaagaagacgaagagactaacctggtaccatctctcattgtcttctatgcgatggtgncggcccaaggaatactctacaccgtggcat

SEQ ID NO: 32894 - DNA, 101 bp, rice(Oryza sativa)
  misc_feature (71): n=t or c
gttcatccctctactcataataccgtgttaactttagtccctatagtgaccggggttctggctaacataangagtgaaacccacgtgaaccccatatgtca

SEQ ID NO: 32895 - DNA, 101 bp, rice(Oryza sativa)
  misc_feature (71): n=a or g
atacagtcactgccaagtgtccagctagttggacctgaatttcttggcgatgttggagatatcccttacancaacaggaagaaagcctattttgcttttcc

SEQ ID NO: 32896 - DNA, 101 bp, rice(Oryza sativa)
  misc_feature (71): n=a or g
tatttcacacttgaggcttgataaaacccacttctatttcacacttgaggggaaggggacctcgtgtgagnagtgttacaatataaagtgaattcactatt

SEQ ID NO: 32897 - DNA, 101 bp, rice(Oryza sativa)
  misc_feature (71): n=a or g
aaagtctcatgtaatatgttgccagaagttgtttctattgaaatctggagtcactgactccaaatcaacanaacatcttatgttgaatcccatatgagtac

SEQ ID NO: 32898 - DNA, 101 bp, rice(Oryza sativa)
  misc_feature (71): n=a or g
gagttttaggggcacggttaaaaaatatccccctcaccattatatttagtgaaatacatggttgttgaccnaaaacatggacaagattcaatctccttctt

SEQ ID NO: 32899 - DNA, 101 bp, rice(Oryza sativa)
  misc_feature (71): n=t or c
gtatgggagcctccacaagcctggaatgtgtgtccaattgtgatcctcaccgtaaccttcaaacccctctncattggcagcaggttgcagacgttgcaagc

SEQ ID NO: 32900 - DNA, 101 bp, rice(Oryza sativa)
  misc_feature (71): n=a or g
cctgtgatgcatccatctacttactgcattcttcttttttcatcccctcccatctcttgcagaaggaaggngagccaactagccatgcttccttcctctct

SEQ ID NO: 32901 - DNA, 101 bp, rice(Oryza sativa)
  misc_feature (71): n=a or c
gatgcaggctgcaaacggatgatggatgattggaaaaagagaaaaaaaatgaagaagagggtgtttagatntaaggatgtaaagttttgatgtatcatatc

SEQ ID NO: 32902 - DNA, 101 bp, rice(Oryza sativa)
  misc_feature (71): n=a or g
gccaactcagcaagtgggcagcagagttatcacccttcgatttgcattttgtcgctcgcacggccatcaantcccaagtcctagccgacttcgtggccgaa

SEQ ID NO: 32903 - DNA, 101 bp, rice(Oryza sativa)
  misc_feature (71): n=t or g
tgcttctttatttcctttcaagaacagcaatgggcttggaattgttgatgtgcctggccttaagtaagatnttcatcagccatcacataattacagtagct

SEQ ID NO: 32904 - DNA, 101 bp, rice(Oryza sativa)
  misc_feature (71): n=t or g
gccggttaatttagagtggcatataagagattctctctatctcgtaacccttcttaaatcctcgctctacnatgtgcgacaatacttaattcagatcttgc

SEQ ID NO: 32905 - DNA, 101 bp, rice(Oryza sativa)
  misc_feature (71): n=t or c
cctcaccttatatatagacacaccagaatactgtagttatgtgctctgtccgtttttgttgtatgacgtgnttttgaacatgacattcaaccgtttatctt

SEQ ID NO: 32906 - DNA, 101 bp, rice(Oryza sativa)
  misc_feature (71): n=t or c
ctatatgtagatgcaattagtgcatgtgcctgagtaccttcatccacttaggcgtagttggcaaagttacnaaagtgagtggtggtgttggagctctcatt

SEQ ID NO: 32907 - DNA, 101 bp, rice(Oryza sativa)
  misc_feature (71): n=t or c
gcgagggccgtggcatccagcgttcaacgagcagggccatggggtgtggcgttcaagaagcagattgtgcnggagcccgctgccgcaagcctccacgagga

SEQ ID NO: 32908 - DNA, 101 bp, rice(Oryza sativa)
  misc_feature (71): n=t or c
gccctttcaaggagagatgctcagacagaattgttagcaatctctgttgggaggcccaaatggttggaaanagtggtagagcggtatgaacaggatgatga

SEQ ID NO: 32909 - DNA, 101 bp, rice(Oryza sativa)
  misc_feature (71): n=a or g
aggtcgttgcgttaggccactcaccactgggctgtcacatggtccatgagtgtttcccccctgaagaaaanaagaaggaaaaaaaatggaaagctattaga

SEQ ID NO: 32910 - DNA, 101 bp, rice(Oryza sativa)
  misc_feature (71): n=a or c
tattatgaacctcctagagagatatatatgtcttggtcttaacctttcatgcatcaaaggatgaccccacntgtggcaatatcatatttgggtgttgtcct

SEQ ID NO: 32911 - DNA, 101 bp, rice(Oryza sativa)
  misc_feature (71): n=a or g
ttgcaaactccggtcctctctttctattgtacaaacatcattatttattttcttgctactaaggttactgnccaatacttgctttatcagttttataatag

SEQ ID NO: 32912 - DNA, 101 bp, rice(Oryza sativa)
  misc_feature (71): n=t or c
accaaaatgaaggaaaattcaatttatggcaggttctctctcctgtgaggaacaaacggttgagatggtgncacgtggcgtgtatcggggccgaagccccc

SEQ ID NO: 32913 - DNA, 101 bp, rice(Oryza sativa)
  misc_feature (71): n=a or g
tctataaatataataaaaatatatttatgggctaattattcctcatacaactctcatacagataatttggnttatacatactgtatacaaactttttttaa

SEQ ID NO: 32914 - DNA, 101 bp, rice(Oryza sativa)
  misc_feature (71): n=t or g
tcaaatactgcaggaggatacgtcaaaggtggaagatcattcccaccaatatcaacatcttcttcaacganctcattacctacaaacatgcatataaaagt

SEQ ID NO: 32915 - DNA, 101 bp, rice(Oryza sativa)
  misc_feature (71): n=a or g
gtaggttccgcgattatgtccaaggacaacgtgagctgggaaccgacggtcaatgcttgatgcgccaaccnttatcacccatggtgcgaggttattagcag

SEQ ID NO: 32916 - DNA, 101 bp, rice(Oryza sativa)
  misc_feature (71): n=a or g
atttgctcggcatgatgtgggaagtttggaatgggaaagatttggcgatagagacgacttgtcggcaacancgagcgtcatcttcttcacgattgacgacg

SEQ ID NO: 32917 - DNA, 101 bp, rice(Oryza sativa)
  misc_feature (71): n=a or g
tttgttcaaatgcaacagtgtgagcacacaatgtcacgcagaacaaaaataaaaattcaatgggacggacnacatctttatggtggagacgtcttatagaa

SEQ ID NO: 32918 - DNA, 101 bp, rice(Oryza sativa)
  misc_feature (71): n=t or c
aactgaagcctgttgtatgttaccaaagatggaacaaataaaacacctagttaaatttgcaacttgagctncataagtatccgcacaaaaaatatctctat

SEQ ID NO: 32919 - DNA, 101 bp, rice(Oryza sativa)
  misc_feature (71): n=a or g
cgtgcctgggccgggccgcccgaatggccaactatatggccaactaagtaattacattatggtagtgcctntcgtttgcatgcatgatattacgtaaattt

SEQ ID NO: 32920 - DNA, 101 bp, rice(Oryza sativa)
  misc_feature (71): n=a or g
ggtacaacctttgcttgtgaatgaactgtacctggctccaacaaaacacctgagccatccctttccgaatncctagttgatgcaaccaaggttgtactatt

SEQ ID NO: 32921 - DNA, 101 bp, rice(Oryza sativa)
  misc_feature (71): n=t or g
gtgacgattacattatgacgataacagcttgtttcctgtcactgactgcccgcagtcatcacagaaggtgngtcactaaccagcttctgtgaccaccagag

SEQ ID NO: 32922 - DNA, 101 bp, rice(Oryza sativa)
  misc_feature (71): n=t or c
cgccttcaccttcacgttcgccctcaagtcttgctcgcgatgcgtgtctcagcggcggttgccttccgacntccacgcccaggcgatcaaacacggctgcc

SEQ ID NO: 32923 - DNA, 101 bp, rice(Oryza sativa)
  misc_feature (71): n=t or c
ttagttgcacgctgcagatcaatatatcgaaatgcagtaataccaatgctgccttgatcattttccgctcngcgagcaaacagtttcccttttctcctcca

SEQ ID NO: 32924 - DNA, 101 bp, rice(Oryza sativa)
  misc_feature (71): n=a or g
aaaaccataaaataacttaagtggcatgccagacagatgaataaatggcctgtttggtttcacgagcgggntgatgaactcatcatttgatacatgatgag

SEQ ID NO: 32925 - DNA, 101 bp, rice(Oryza sativa)
  misc_feature (71): n=t or g
gtaaattgcaatgatttcccaataccttcatccacatcaacagcaaccaccatcttcgtcggcgcagcgtnctcggggaaacccagcggcttcccacgccg

SEQ ID NO: 32926 - DNA, 101 bp, rice(Oryza sativa)
  misc_feature (71): n=t or g
caagtacggcgagcgcacctactcgctctactccggcagtgtggacggtgtcatcgccaaaatcttccggncccctgatcctggccctaactacgccaagc

SEQ ID NO: 32927 - DNA, 101 bp, rice(Oryza sativa)
  misc_feature (71): n=t or c
agataagatcctcggctagggccgcacactcattttggaacacaattttaagcaccgctcagttttctttntttctttctttctttctttctttcttgggc

SEQ ID NO: 32928 - DNA, 101 bp, rice(Oryza sativa)
  misc_feature (71): n=t or c
gagaaacaaagctggtgaaatttgaggcaaaaggtgggaataaagtactctcaagtacaagagcagttagnccacttacataaagaacagtggagtaaatg

SEQ ID NO: 32929 - DNA, 101 bp, rice(Oryza sativa)
  misc_feature (71): n=a or c
gctagtgtaatattaggttggttgcctcaggctagattgtcagattaatgtatcctgtataaacttgtagnaaattcatgccacagaacacacctggttaa

SEQ ID NO: 32930 - DNA, 101 bp, rice(Oryza sativa)
  misc_feature (71): n=a or g
gcttcaggacttttgcaacctgcactggctaaatttctcttcatggtgttttccttcgaggcttccttctnccctttatttttggtaagaatttttcttgc

SEQ ID NO: 32931 - DNA, 101 bp, rice(Oryza sativa)
  misc_feature (71): n=t or c
cgctgtcgaccgcgcgccctttcttgacccgccaccaagaacaccgaggacgagcatgccctcctcccgancaccgccttggccaggtcgatgccgagctc

SEQ ID NO: 32932 - DNA, 101 bp, rice(Oryza sativa)
  misc_feature (71): n=a or g
tgtccatgacaattgtctgcaggaagaagacatctgcctcttcgtaccaacaaaaggaggaagaaacttcncgtttactgtccatttgctccaagcagaag

SEQ ID NO: 32933 - DNA, 101 bp, rice(Oryza sativa)
  misc_feature (71): n=t or c
ggagatcacatagcatgggtactggccttgttgggaagttagatttcagaataatgttattggaccactgntgcatatctgttatcgtgcaactctagtat

SEQ ID NO: 32934 - DNA, 101 bp, rice(Oryza sativa)
  misc_feature (71): n=t or c
cctcaagaatggctgttgacagtggatcaggctttgcgcctgaaagggaaaaggtgagagagaacagtttnttcaattggctgatacttctcaagttatct

SEQ ID NO: 32935 - DNA, 101 bp, rice(Oryza sativa)
  misc_feature (71): n=a or c
agagagagagagagagagagagagccggaggcgaggagatgtggctgaattaatagtagggctggattagnggcggcgcgtggtccatgagaaactgggcc

SEQ ID NO: 32936 - DNA, 101 bp, rice(Oryza sativa)
  misc_feature (71): n=a or g
ggaagaaacccttgtgaactctgcttgagccaccatccatctgatgaataaagtcgtcgatgcagtcctcnatatcgtaggacagctctctgatttggttc

SEQ ID NO: 32937 - DNA, 101 bp, rice(Oryza sativa)
  misc_feature (71): n=t or c
tcaccataatttactccacttcccccgagacaatcttaaaaaatcacatcctccacaaaattaatactccntccgtcacataatatagcaatctaataccg

SEQ ID NO: 32938 - DNA, 101 bp, rice(Oryza sativa)
  misc_feature (71): n=a or g
ctgaccacgaaggcaacctgcattgtccttgacgaggagtttgtggccgacgttcctgttgctgccctgcngaatcctcttgtacagcggtgggcagctcc

SEQ ID NO: 32939 - DNA, 101 bp, rice(Oryza sativa)
  misc_feature (71): n=t or c
gcgacgaccttgggcacacacgtaaagacggtgtgatcgtagccagggcaatatacacagacatgggagangagcggcggtggcgcggcgcagatggtgac

SEQ ID NO: 32940 - DNA, 101 bp, rice(Oryza sativa)
  misc_feature (71): n=t or c
aaccaatctgtcgtaaccctcatcgggtgctcttccgtaacactgaatatgataagggccctttgaatcanaggattgaaaaaacgtagaaataggaaaaa

SEQ ID NO: 32941 - DNA, 101 bp, rice(Oryza sativa)
  misc_feature (71): n=a or g
gttgtccgagctgtttgacacaggactagctctagctctagttctcatcaaattagaggtcagccaaacanttttaacttaatctcaaataagagttgagt

SEQ ID NO: 32942 - DNA, 101 bp, rice(Oryza sativa)
  misc_feature (71): n=a or g
aacaaaaaggacgtgtgtgtatatagctccaagttgggattttatgagtagtacagaaaccatggatcttnctgggtagtaaccccagcttttgtcgtccc

SEQ ID NO: 32943 - DNA, 101 bp, rice(Oryza sativa)
  misc_feature (71): n=t or c
ccagattttcttgcctcaacattttccagcttgcaaccacagcagcagcttctgctgcagtccattttgtngacataggttttttttttttgttgctgcaa

SEQ ID NO: 32944 - DNA, 101 bp, rice(Oryza sativa)
  misc_feature (71): n=t or c
acttgcatcttgatggtgttactctttgtcgatacaatttccgcagagtgcgatatgtggatatgaagcangagtttgcatttgttgtaagtaaaacactt

SEQ ID NO: 32945 - DNA, 101 bp, rice(Oryza sativa)
  misc_feature (71): n=a or c
attaaaagagtactatgtgtgagagagaagggattgatagagagaaaagaagagagaaggggcaacccccnaaaaaaaaagaaagttggaaaagaaagtaa

SEQ ID NO: 32946 - DNA, 101 bp, rice(Oryza sativa)
  misc_feature (71): n=a or g
cctgaacgttccatatacacaaacagtgaaaattcgctgccacattattggttgggcccacaaaactgaancgcgcgtgaccaaagtttgctactcatgct

SEQ ID NO: 32947 - DNA, 101 bp, rice(Oryza sativa)
  misc_feature (71): n=t or c
aaaccgggggaggggggtgatgttcgtatagccgactagtctaactcggccgcctactataagtgattttnacaaacaggctagttagttaggacggtcgt

SEQ ID NO: 32948 - DNA, 101 bp, rice(Oryza sativa)
  misc_feature (71): n=t or c
attggtagtacaggtagatttttcacagttctgtgttttcttatgttatgtttcaattaattggtgcagcnatctcgagatgctaaacagaagcctggacc

SEQ ID NO: 32949 - DNA, 101 bp, rice(Oryza sativa)
  misc_feature (71): n=t or c
tagtaaccatgtaattaacaggagctaataacaggagctaatctctgaataaccatgtaattaacaggagntaataaccatgtagctctagatgttgttcc

SEQ ID NO: 32950 - DNA, 101 bp, rice(Oryza sativa)
  misc_feature (71): n=t or c
gttttgacggcagaggacaaattagatgcagtagagattgagaagctccagaaggaattagatgcattggnggaggtaaaagaggtagctgcaaaggcatt

SEQ ID NO: 32951 - DNA, 101 bp, rice(Oryza sativa)
  misc_feature (71): n=t or g
aggattgagccaagccccaagcataaagaaaaccgaaatttgcccacaattttgtccgtttggacacaccntacaaaattacagacgaaaactattaatgg

SEQ ID NO: 32952 - DNA, 101 bp, rice(Oryza sativa)
  misc_feature (71): n=a or g
gaagtgatgcaccttcttgttttctgcgatgacaccaagtaagaaggagagaaggccaaagaaagagacantgagagcaatccgttgagccgaagtgagag

SEQ ID NO: 32953 - DNA, 101 bp, rice(Oryza sativa)
  misc_feature (71): n=a or g
tcattcactccagcagtctatgtagcattacggctcgttcatctcatctctaatgtgtgtagcaaaaagancaggatggtgtcgaacataaacgcacaaca

SEQ ID NO: 32954 - DNA, 101 bp, rice(Oryza sativa)
  misc_feature (71): n=a or c
acatttatttgaactcgcttaatgtatgctgatgtttcctgtttgtgatatcgagtattccctctgatgtnatgttcagggaacaattattttcaagcacc

SEQ ID NO: 32955 - DNA, 101 bp, rice(Oryza sativa)
  misc_feature (71): n=t or c
atatgattatcatgtggtgtctccatgaatcggctcacatagctgacggcgaaggcgatgtttggccgcgngtgcacgaggtaccgtaggctgcccaccag

SEQ ID NO: 32956 - DNA, 101 bp, rice(Oryza sativa)
  misc_feature (71): n=t or c
acagtagcatctgaatcatgcttcagtttagctaatcaagcactttgtgagaagaggtgcagtctactgcntgaaacacttgaaggtgtgatttgtacaca

SEQ ID NO: 32957 - DNA, 101 bp, rice(Oryza sativa)
  misc_feature (71): n=t or c
tgcaaatcactaacatgcaggaacccccgataaatgactttctatgggacgatatgctaatgacggtgcangactccaacccatgttacgcaaatatagta

SEQ ID NO: 32958 - DNA, 101 bp, rice(Oryza sativa)
  misc_feature (71): n=a or g
tttaccacaaagctttctctgcagggcactctctgaagttccaaataaacaaacaattgctggagtgaganttggtatgatcaatgatcagtttgttgtta

SEQ ID NO: 32959 - DNA, 101 bp, rice(Oryza sativa)
  misc_feature (71): n=a or g
tgtatgtcattgtctgatggatgaacgcggtaggtaaacagataatgttcaagttaaaccttttcgccgcncagctctggttggcaccaggcttgtacagg

SEQ ID NO: 32960 - DNA, 101 bp, rice(Oryza sativa)
  misc_feature (71): n=a or g
gtgaggtcatccacgaactgttcttgttgcttgggaggctgggactagttatgctctttattccatttttnaactattattgttcaactgatgcggtacct

SEQ ID NO: 32961 - DNA, 101 bp, rice(Oryza sativa)
  misc_feature (71): n=a or g
acgattcaccactccaacagccacgcaaattatccttaccctcttttctctatatttccgtggagtgtagngaacgatgcggcaagaagcggatctagggg

SEQ ID NO: 32962 - DNA, 101 bp, rice(Oryza sativa)
  misc_feature (71): n=t or c
gcactgctagttggcgcccgcacgccgtcgtcgagtttgccaagtctcatggaagtgtcatttgtgggacnaggaggcaagccgccgtttttctacgtcgt

SEQ ID NO: 32963 - DNA, 101 bp, rice(Oryza sativa)
  misc_feature (71): n=t or c
tcccagcgcccctcttctcccttgtgttccctccctcgttcaacgagaccggaacccactcgtctaggaangagttttgatgcactcacccggctgcgatc

SEQ ID NO: 32964 - DNA, 101 bp, rice(Oryza sativa)
  misc_feature (71): n=a or g
gattaaaatgctaatgttctttcaggacacccacctgttacttactggaggtcttgagaaaattttacgtntatatgatatgaatcgcccagatgcagccc

SEQ ID NO: 32965 - DNA, 101 bp, rice(Oryza sativa)
  misc_feature (71): n=a or g
tttgcggggcctcctcttcttcttggaacgtcaccctgactcccacaggccacagactgtggaatcagccntgaactgctcatcaataatcacctctcaat

SEQ ID NO: 32966 - DNA, 101 bp, rice(Oryza sativa)
  misc_feature (71): n=t or g
gatcaactcgtacgcggtggtcagtggtggatctgagatctgcatttcggtggagggtgctggcacttacngcatggacacagtgaagcatacttggaggc

SEQ ID NO: 32967 - DNA, 101 bp, rice(Oryza sativa)
  misc_feature (71): n=t or c
attcattagtattgtacaaattgtgcctccatcatcgtcatcagaatcatcgctatgatataacatcaatnggtatcagttttttcatcatcagagttatc

SEQ ID NO: 32968 - DNA, 101 bp, rice(Oryza sativa)
  misc_feature (71): n=a or c
ctgttaaattattcaatttgttgttttacatctcccttccaaggagatatcacaaaacataagaacacttnaaaaaacctataaagcacaaggatcagtgt

SEQ ID NO: 32969 - DNA, 101 bp, rice(Oryza sativa)
  misc_feature (71): n=a or c
acatttcttctttggtggagccggatgctcgccaagtcagttcatcaaataactgttcgaagcatttgctntgtacttgactcggctactactactatgat

SEQ ID NO: 32970 - DNA, 101 bp, rice(Oryza sativa)
  misc_feature (71): n=a or c
caggggaaccgtttttgcaccagagatgcgacacaacttccattgtagaagctttgcgcaacaataccatntggacattgtggccgctacatatttcaact

SEQ ID NO: 32971 - DNA, 101 bp, rice(Oryza sativa)
  misc_feature (71): n=t or c
tcttttgtttccttagtaggaaatggcgatcatggtggatcctccaaatgggatgggtaaccaagggaagnattactactcgatgtggcaaactttgtttg

SEQ ID NO: 32972 - DNA, 101 bp, rice(Oryza sativa)
  misc_feature (71): n=a or c
gtgcaacgttgaagccattctacgtgtaagtacatattgcatatctcttctctatctctacttatctctantgttataaaaattaaagatgtttttgctgg

SEQ ID NO: 32973 - DNA, 101 bp, rice(Oryza sativa)
  misc_feature (71): n=a or g
agttgttttctctgtcttcgggttggtgtttcatgtagttttcttgtcttgcatcaagttgtggttttggnagttgtaatcttaccttcaacctccgtaaa

SEQ ID NO: 32974 - DNA, 101 bp, rice(Oryza sativa)
  misc_feature (71): n=t or c
tagatacatacaacggcagcaaaaaccaatgccagcgcgaatgaagaactatctccgccttcttgttgacngactgccacggccaaactccccaccgttgc

SEQ ID NO: 32975 - DNA, 101 bp, rice(Oryza sativa)
  misc_feature (71): n=t or c
atatagccacgtctcccctaaccaaatcactggagaagttgtgctacccactggcggtgaagatgatgcanatgcgcgcgcatcgtgacgacgggaaggca

SEQ ID NO: 32976 - DNA, 101 bp, rice(Oryza sativa)
  misc_feature (71): n=a or g
ttccgttagagcaacatggagggaaagatctttagtgacccaaccctccattccaggatccttatagaagngtgacggagctacacttcgtcttttacttc

SEQ ID NO: 32977 - DNA, 101 bp, rice(Oryza sativa)
  misc_feature (71): n=a or c
tgcgatgccacagcgatcaggcagtttgaggaggatgtggctccctgcctgctagaggggttgaaggtgancagggagttcagccacacattgtctaattt

SEQ ID NO: 32978 - DNA, 101 bp, rice(Oryza sativa)
  misc_feature (71): n=a or c
gtcagtttgctgctgccttagagcttgatccagaggatctgacgacgcctcatctctttgatttggaagcnttattgatgcacaggactagcttcatgtat

SEQ ID NO: 32979 - DNA, 101 bp, rice(Oryza sativa)
  misc_feature (71): n=a or g
ttagacattcggttggagaccacacaacagtgaaaggagaagtaggaggagcccaattagacttcatgttnggctgaacgctttcttgcgggctgaggcgg

SEQ ID NO: 32980 - DNA, 101 bp, rice(Oryza sativa)
  misc_feature (71): n=t or c
ctttttctccctttgtctgtatcaggaacaaaggggaccactacattttccttcccagggctagcagcagncgattcaattaggccatcagggttaacttc

SEQ ID NO: 32981 - DNA, 101 bp, rice(Oryza sativa)
  misc_feature (71): n=t or c
tgcttacttggattagtcttggtcttgccactcaatttctttgaagtagaggccttgtgaggcgatccaantagaactgatggtgtgctagtatcttcaga

SEQ ID NO: 32982 - DNA, 101 bp, rice(Oryza sativa)
  misc_feature (71): n=a or g
actcatcaacaagcattccttcgttgtcacgcaacgggtcatttaaagctctttctgtccttgaaggacgncgagaacttccaaaagatgcctcattgata

SEQ ID NO: 32983 - DNA, 101 bp, rice(Oryza sativa)
  misc_feature (71): n=a or g
taagacaacttgaccatgcgagacatggagatgaaagttcaacacggaaaaaaacaaagaacacaaacaanaaacattcatctctacaccatgtaagcatg

SEQ ID NO: 32984 - DNA, 101 bp, rice(Oryza sativa)
  misc_feature (71): n=a or g
acacaaccttcatcgtcctcttcatggccattctcgatctattgtcgtgtgtttgcaagccgctgtgtgcncgcgcgcacatatatatatacacatacttg

SEQ ID NO: 32985 - DNA, 101 bp, rice(Oryza sativa)
  misc_feature (71): n=t or c
agacgaagtcataagcccgtagacccatgattggtggtacaacactttgtttcctccattacggttgagtnatatgaaatttggttctaaggtggtccatt

SEQ ID NO: 32986 - DNA, 101 bp, rice(Oryza sativa)
  misc_feature (71): n=t or c
cgacaaaagtgaaaatgcatccactatggttcaaatcctagtggttaacaggccatgaatatcacgtacangtgcacacactttccataaagatttagtgg

SEQ ID NO: 32987 - DNA, 101 bp, rice(Oryza sativa)
  misc_feature (71): n=t or c
aaccgcggccaaaacttattttaaaaatgatatttttttcagcgtcaaatcgtatgacactgagtttaganacatcagcatcacatcaactggcgctaaat
